United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 203

SEQ ID NO: 8432836 - DNA, 22 bp, Homo sapiens
tcctgggactctgcctcaggct

SEQ ID NO: 8432837 - DNA, 22 bp, Homo sapiens
tcctgggactcaacttagaagg

SEQ ID NO: 8432838 - DNA, 22 bp, Homo sapiens
tcctgggaggcaggaccccttt

SEQ ID NO: 8432839 - DNA, 22 bp, Homo sapiens
tcctgggaggcaggaccccttt

SEQ ID NO: 8432840 - DNA, 22 bp, Homo sapiens
tcctgggaggcggaggttgcag

SEQ ID NO: 8432841 - DNA, 22 bp, Homo sapiens
tcctgggaggaacatttaccta

SEQ ID NO: 8432842 - DNA, 22 bp, Homo sapiens
tcctgggaggctgtgcctggct

SEQ ID NO: 8432843 - DNA, 22 bp, Homo sapiens
tcctgggaggctgtgcctggct

SEQ ID NO: 8432844 - DNA, 22 bp, Homo sapiens
tcctgggaggcggaggttgcag

SEQ ID NO: 8432845 - DNA, 22 bp, Homo sapiens
tcctgggaagcgccggcctgcg

SEQ ID NO: 8432846 - DNA, 22 bp, Homo sapiens
tcctgggaagcgccggcctgcg

SEQ ID NO: 8432847 - DNA, 22 bp, Homo sapiens
tcctgggaagagacctgagcat

SEQ ID NO: 8432848 - DNA, 22 bp, Homo sapiens
tcctgggaagtggctggctgag

SEQ ID NO: 8432849 - DNA, 21 bp, Homo sapiens
tcctgggaagcactggggtgg

SEQ ID NO: 8432850 - DNA, 22 bp, Homo sapiens
tcctgggaagttgcatcaccgt

SEQ ID NO: 8432851 - DNA, 22 bp, Homo sapiens
tcctgggaagttgcatcaccgt

SEQ ID NO: 8432852 - DNA, 22 bp, Homo sapiens
tcctgggaagtggctggctgag

SEQ ID NO: 8432853 - DNA, 22 bp, Homo sapiens
tcctgggacaagccgtggaagt

SEQ ID NO: 8432854 - DNA, 22 bp, Homo sapiens
tcctgggacaccccaatatgag

SEQ ID NO: 8432855 - DNA, 22 bp, Homo sapiens
tcctgggacaccccaatatgag

SEQ ID NO: 8432856 - DNA, 22 bp, Homo sapiens
tcctgggaccaggcacctactg

SEQ ID NO: 8432857 - DNA, 22 bp, Homo sapiens
tcctgggacaagccgtggaagt

SEQ ID NO: 8432858 - DNA, 22 bp, Homo sapiens
tcctgggaccaggcacctactg

SEQ ID NO: 8432859 - DNA, 22 bp, Homo sapiens
tcctgggaagactgtgaggaca

SEQ ID NO: 8432860 - DNA, 22 bp, Homo sapiens
tcctgggaagagacctgagcat

SEQ ID NO: 8432861 - DNA, 22 bp, Homo sapiens
tcctgggaagactgtgaggaca

SEQ ID NO: 8432862 - DNA, 18 bp, Homo sapiens
tcctgggaaaggcataca

SEQ ID NO: 8432863 - DNA, 22 bp, Homo sapiens
tcctgggaactcggaaagctct

SEQ ID NO: 8432864 - DNA, 22 bp, Homo sapiens
tcctgggaactcggaaagctct

SEQ ID NO: 8432865 - DNA, 18 bp, Homo sapiens
tcctgggaacttgctagc

SEQ ID NO: 8432866 - DNA, 18 bp, Homo sapiens
tcctgggaacttgctagc

SEQ ID NO: 8432867 - DNA, 22 bp, Homo sapiens
tcctggcttgtcacatctacgt

SEQ ID NO: 8432868 - DNA, 22 bp, Homo sapiens
tcctggcttctgtctccttatt

SEQ ID NO: 8432869 - DNA, 21 bp, Homo sapiens
tcctggctttatgctacctct

SEQ ID NO: 8432870 - DNA, 21 bp, Homo sapiens
tcctggctttatgctacctct

SEQ ID NO: 8432871 - DNA, 18 bp, Homo sapiens
tcctgggaaaggcataca

SEQ ID NO: 8432872 - DNA, 22 bp, Homo sapiens
tcctggcttttcttggctcatc

SEQ ID NO: 8432873 - DNA, 22 bp, Homo sapiens
tcctggctgccgtcgtcctgcg

SEQ ID NO: 8432874 - DNA, 22 bp, Homo sapiens
tcctggctgccgtcgtcctgcg

SEQ ID NO: 8432875 - DNA, 22 bp, Homo sapiens
tcctggctgtcactcgggttga

SEQ ID NO: 8432876 - DNA, 22 bp, Homo sapiens
tcctggctggaatttctcactc

SEQ ID NO: 8432877 - DNA, 22 bp, Homo sapiens
tcctggcttccacacctgtcat

SEQ ID NO: 8432878 - DNA, 22 bp, Homo sapiens
tcctggcttaggtttccagaac

SEQ ID NO: 8432879 - DNA, 22 bp, Homo sapiens
tcctggcttaggtttccagaac

SEQ ID NO: 8432880 - DNA, 22 bp, Homo sapiens
tcctggcttccactcctctgtt

SEQ ID NO: 8432881 - DNA, 22 bp, Homo sapiens
tcctggcttccactcctctgtt

SEQ ID NO: 8432882 - DNA, 22 bp, Homo sapiens
tcctggggaggtcgaggctgag

SEQ ID NO: 8432883 - DNA, 22 bp, Homo sapiens
tcctgggctgtgtgccactctg

SEQ ID NO: 8432884 - DNA, 22 bp, Homo sapiens
tcctgggctgtgtgccactctg

SEQ ID NO: 8432885 - DNA, 22 bp, Homo sapiens
tcctgggctgcagggaagagca

SEQ ID NO: 8432886 - DNA, 22 bp, Homo sapiens
tcctgggctgcagggaagagca

SEQ ID NO: 8432887 - DNA, 19 bp, Homo sapiens
tcctgggctgggccaggtc

SEQ ID NO: 8432888 - DNA, 19 bp, Homo sapiens
tcctgggctgcgtcttgcc

SEQ ID NO: 8432889 - DNA, 22 bp, Homo sapiens
tcctgggcgagtggtggtacac

SEQ ID NO: 8432890 - DNA, 22 bp, Homo sapiens
tcctgggcctgtactccatccg

SEQ ID NO: 8432891 - DNA, 22 bp, Homo sapiens
tcctgggcgaggtactggggct

SEQ ID NO: 8432892 - DNA, 22 bp, Homo sapiens
tcctgggcctgtactccatccg

SEQ ID NO: 8432893 - DNA, 22 bp, Homo sapiens
tcctgggcctgtactccatccg

SEQ ID NO: 8432894 - DNA, 22 bp, Homo sapiens
tcctgggccctccggatcaggt

SEQ ID NO: 8432895 - DNA, 22 bp, Homo sapiens
tcctgggccctccggatcaggt

SEQ ID NO: 8432896 - DNA, 22 bp, Homo sapiens
tcctgggccaagggctgtgagg

SEQ ID NO: 8432897 - DNA, 22 bp, Homo sapiens
tcctgggcagcgggacgctcag

SEQ ID NO: 8432898 - DNA, 22 bp, Homo sapiens
tcctgggcccaggctgccaggg

SEQ ID NO: 8432899 - DNA, 22 bp, Homo sapiens
tcctgggcccaggctgccaggg

SEQ ID NO: 8432900 - DNA, 22 bp, Homo sapiens
tcctgggcccaggctgccaggg

SEQ ID NO: 8432901 - DNA, 22 bp, Homo sapiens
tcctgggcccaggctgccaggg

SEQ ID NO: 8432902 - DNA, 22 bp, Homo sapiens
tcctgggattaaggtggtgatt

SEQ ID NO: 8432903 - DNA, 22 bp, Homo sapiens
tcctgggattaaggtggtgatt

SEQ ID NO: 8432904 - DNA, 22 bp, Homo sapiens
tcctgggcaaagaggggcagtg

SEQ ID NO: 8432905 - DNA, 22 bp, Homo sapiens
tcctgggattctgcatttctaa

SEQ ID NO: 8432906 - DNA, 22 bp, Homo sapiens
tcctgggatttgcccttttctc

SEQ ID NO: 8432907 - DNA, 22 bp, Homo sapiens
tcctgggcagcctctctggaag

SEQ ID NO: 8432908 - DNA, 22 bp, Homo sapiens
tcctgggcagcctctctggaag

SEQ ID NO: 8432909 - DNA, 22 bp, Homo sapiens
tcctgggcagcctctctggaag

SEQ ID NO: 8432910 - DNA, 22 bp, Homo sapiens
tcctgggcagcctctctggaag

SEQ ID NO: 8432911 - DNA, 22 bp, Homo sapiens
tcctgggcacaagtgagtctcc

SEQ ID NO: 8432912 - DNA, 22 bp, Homo sapiens
tcctgggcacaagtgagtctcc

SEQ ID NO: 8432913 - DNA, 22 bp, Homo sapiens
tcctgggcagaatgggatggct

SEQ ID NO: 8432914 - DNA, 22 bp, Homo sapiens
tcctgggcacaagtgagtctcc

SEQ ID NO: 8432915 - DNA, 22 bp, Homo sapiens
tcctgggatgacttttgaaatg

SEQ ID NO: 8432916 - DNA, 22 bp, Homo sapiens
tcctgggatgacttttgaaatg

SEQ ID NO: 8432917 - DNA, 22 bp, Homo sapiens
tcctgggatgcataaaatatgt

SEQ ID NO: 8432918 - DNA, 22 bp, Homo sapiens
tcctgggatgaggaaacaagga

SEQ ID NO: 8432919 - DNA, 22 bp, Homo sapiens
tcctgggatgcataaaatatgt

SEQ ID NO: 8432920 - DNA, 22 bp, Homo sapiens
tcctgggatgaggaaacaagga

SEQ ID NO: 8432921 - DNA, 22 bp, Homo sapiens
tcctgggatactaagaaatttt

SEQ ID NO: 8432922 - DNA, 22 bp, Homo sapiens
tcctgggagtggccatgtaatg

SEQ ID NO: 8432923 - DNA, 22 bp, Homo sapiens
tcctgggagtggccatgtaatg

SEQ ID NO: 8432924 - DNA, 22 bp, Homo sapiens
tcctgggatactaagaaatttt

SEQ ID NO: 8432925 - DNA, 22 bp, Homo sapiens
tcctgggatcaagtgatcctcc

SEQ ID NO: 8432926 - DNA, 22 bp, Homo sapiens
tcctgggatcaagtgatcctcc

SEQ ID NO: 8432927 - DNA, 22 bp, Homo sapiens
tcctgggagtaattgagtcatg

SEQ ID NO: 8432928 - DNA, 21 bp, Homo sapiens
tcctgggagtctgagatcctg

SEQ ID NO: 8432929 - DNA, 21 bp, Homo sapiens
tcctgggagtctgagatcctg

SEQ ID NO: 8432930 - DNA, 22 bp, Homo sapiens
tcctgggagtaaaagctgccct

SEQ ID NO: 8432931 - DNA, 22 bp, Homo sapiens
tcctgggagtaattgagtcatg

SEQ ID NO: 8432932 - DNA, 22 bp, Homo sapiens
tcctgggagtaaaagctgccct

SEQ ID NO: 8432933 - DNA, 22 bp, Homo sapiens
tcctgggaggtaaaccagcatc

SEQ ID NO: 8432934 - DNA, 22 bp, Homo sapiens
tcctgggaggtaaaccagcatc

SEQ ID NO: 8432935 - DNA, 22 bp, Homo sapiens
taagaatctgcattttaacaag

SEQ ID NO: 8432936 - DNA, 22 bp, Homo sapiens
taagaatctattaggaatatgt

SEQ ID NO: 8432937 - DNA, 22 bp, Homo sapiens
taagaatcagtagatatagatt

SEQ ID NO: 8432938 - DNA, 22 bp, Homo sapiens
taagaatcgatgtttatttaga

SEQ ID NO: 8432939 - DNA, 19 bp, Homo sapiens
tcctgctgtgtgaagggga

SEQ ID NO: 8432940 - DNA, 22 bp, Homo sapiens
taagaacattttcggaaagata

SEQ ID NO: 8432941 - DNA, 22 bp, Homo sapiens
tcctggagggctcacaggcggc

SEQ ID NO: 8432942 - DNA, 22 bp, Homo sapiens
tcctggaggggacagcatgggc

SEQ ID NO: 8432943 - DNA, 22 bp, Homo sapiens
tcctggagccaatgtgctgctg

SEQ ID NO: 8432944 - DNA, 22 bp, Homo sapiens
tcctggaggcactcgctggggc

SEQ ID NO: 8432945 - DNA, 20 bp, Homo sapiens
tcctggaggcttcatccata

SEQ ID NO: 8432946 - DNA, 22 bp, Homo sapiens
tcctggagaagaggggcttgga

SEQ ID NO: 8432947 - DNA, 22 bp, Homo sapiens
tcctggagaaactcagagatct

SEQ ID NO: 8432948 - DNA, 22 bp, Homo sapiens
tcctggacagatccccatcatc

SEQ ID NO: 8432949 - DNA, 22 bp, Homo sapiens
tcctggacaagcccttcaccct

SEQ ID NO: 8432950 - DNA, 22 bp, Homo sapiens
tcctggacaagcccttcaccct

SEQ ID NO: 8432951 - DNA, 22 bp, Homo sapiens
tcctggactggctcagcaccct

SEQ ID NO: 8432952 - DNA, 22 bp, Homo sapiens
tcctggactggctcagcaccct

SEQ ID NO: 8432953 - DNA, 22 bp, Homo sapiens
tcctggactcaggaccacagga

SEQ ID NO: 8432954 - DNA, 22 bp, Homo sapiens
tcctggacagatccccatcatc

SEQ ID NO: 8432955 - DNA, 22 bp, Homo sapiens
tcctggagagaggcctggaaga

SEQ ID NO: 8432956 - DNA, 22 bp, Homo sapiens
tcctggagaatcctgccacctg

SEQ ID NO: 8432957 - DNA, 22 bp, Homo sapiens
tcctggagataattgcagtgaa

SEQ ID NO: 8432958 - DNA, 22 bp, Homo sapiens
tcctggagagtgggcgagcaca

SEQ ID NO: 8432959 - DNA, 22 bp, Homo sapiens
tcctggagagtgggcgagcaca

SEQ ID NO: 8432960 - DNA, 22 bp, Homo sapiens
tcctggccctgtggcctgcagt

SEQ ID NO: 8432961 - DNA, 22 bp, Homo sapiens
tcctggccctgtggcctgcagt

SEQ ID NO: 8432962 - DNA, 22 bp, Homo sapiens
tcctggccctctgcaaacgcca

SEQ ID NO: 8432963 - DNA, 22 bp, Homo sapiens
tcctggccgccgcgtggggccg

SEQ ID NO: 8432964 - DNA, 22 bp, Homo sapiens
tcctggcctagagtttgtgttc

SEQ ID NO: 8432965 - DNA, 22 bp, Homo sapiens
tcctggccgctggcccctgaga

SEQ ID NO: 8432966 - DNA, 22 bp, Homo sapiens
tcctggccgctggcccctgaga

SEQ ID NO: 8432967 - DNA, 22 bp, Homo sapiens
tcctggcctagctcaccctgga

SEQ ID NO: 8432968 - DNA, 22 bp, Homo sapiens
tcctggcctagctcaccctgga

SEQ ID NO: 8432969 - DNA, 22 bp, Homo sapiens
tcctggcctagctcaccctgga

SEQ ID NO: 8432970 - DNA, 22 bp, Homo sapiens
tcctggcctcacagtcctgggt

SEQ ID NO: 8432971 - DNA, 22 bp, Homo sapiens
tcctggcccactatgccagcat

SEQ ID NO: 8432972 - DNA, 22 bp, Homo sapiens
tcctggcccactatgccagcat

SEQ ID NO: 8432973 - DNA, 22 bp, Homo sapiens
tcctggcccactcctagcttct

SEQ ID NO: 8432974 - DNA, 21 bp, Homo sapiens
tcctggcccactctatcccca

SEQ ID NO: 8432975 - DNA, 22 bp, Homo sapiens
tcctggcccactatgccagcat

SEQ ID NO: 8432976 - DNA, 22 bp, Homo sapiens
tcctggcccactcctagcttct

SEQ ID NO: 8432977 - DNA, 22 bp, Homo sapiens
tcctggcccactcctagcttct

SEQ ID NO: 8432978 - DNA, 22 bp, Homo sapiens
tcctggcccgatccctgtgaag

SEQ ID NO: 8432979 - DNA, 16 bp, Homo sapiens
tcctggcccctatgga

SEQ ID NO: 8432980 - DNA, 21 bp, Homo sapiens
tcctggcccactctatcccca

SEQ ID NO: 8432981 - DNA, 22 bp, Homo sapiens
tcctggcccgatccctgtgaag

SEQ ID NO: 8432982 - DNA, 22 bp, Homo sapiens
tcctggctcgattgctaccaat

SEQ ID NO: 8432983 - DNA, 22 bp, Homo sapiens
tcctggctcgattgctaccaat

SEQ ID NO: 8432984 - DNA, 22 bp, Homo sapiens
tcctggctctaagtcctgagtg

SEQ ID NO: 8432985 - DNA, 22 bp, Homo sapiens
tcctggctctaagtcctgagtg

SEQ ID NO: 8432986 - DNA, 22 bp, Homo sapiens
tcctggctctctacaaaccaga

SEQ ID NO: 8432987 - DNA, 22 bp, Homo sapiens
tcctggctctgctgcctcctag

SEQ ID NO: 8432988 - DNA, 22 bp, Homo sapiens
tcctggctctgctgcctcctag

SEQ ID NO: 8432989 - DNA, 17 bp, Homo sapiens
tcctggctctgccactg

SEQ ID NO: 8432990 - DNA, 22 bp, Homo sapiens
tcctggcctctgagtcaagaac

SEQ ID NO: 8432991 - DNA, 22 bp, Homo sapiens
tcctggcctcgctgtccacctt

SEQ ID NO: 8432992 - DNA, 22 bp, Homo sapiens
tcctggctcctggagacctgct

SEQ ID NO: 8432993 - DNA, 17 bp, Homo sapiens
tcctggcctggtgtgtg

SEQ ID NO: 8432994 - DNA, 22 bp, Homo sapiens
tcctggctcctgatctgtcact

SEQ ID NO: 8432995 - DNA, 20 bp, Homo sapiens
tcctggcctccctggggctc

SEQ ID NO: 8432996 - DNA, 20 bp, Homo sapiens
tcctggcctccctggggctc

SEQ ID NO: 8432997 - DNA, 20 bp, Homo sapiens
tcctggcctccctggggctc

SEQ ID NO: 8432998 - DNA, 22 bp, Homo sapiens
tcctggcctccgttctctgcat

SEQ ID NO: 8432999 - DNA, 22 bp, Homo sapiens
tcctggcctccgttctctgcat

SEQ ID NO: 8433000 - DNA, 22 bp, Homo sapiens
tcctggcctccgttctctgcat

SEQ ID NO: 8433001 - DNA, 22 bp, Homo sapiens
tcctggccaagtagatgtggcg

SEQ ID NO: 8433002 - DNA, 22 bp, Homo sapiens
tcctggcatttacaaacccacc

SEQ ID NO: 8433003 - DNA, 22 bp, Homo sapiens
tcctggccaagttactctctgc

SEQ ID NO: 8433004 - DNA, 22 bp, Homo sapiens
tcctggccaagttactctctgc

SEQ ID NO: 8433005 - DNA, 22 bp, Homo sapiens
tcctggccaagttactctctgc

SEQ ID NO: 8433006 - DNA, 17 bp, Homo sapiens
tcctggcagtcccctgg

SEQ ID NO: 8433007 - DNA, 17 bp, Homo sapiens
tcctggcagtcccctgg

SEQ ID NO: 8433008 - DNA, 22 bp, Homo sapiens
tcctggcacattgcaggggctc

SEQ ID NO: 8433009 - DNA, 22 bp, Homo sapiens
tcctggcataatggctttgctc

SEQ ID NO: 8433010 - DNA, 22 bp, Homo sapiens
tcctggcagttcagccccctaa

SEQ ID NO: 8433011 - DNA, 22 bp, Homo sapiens
tcctggcatccgtgggtctgtg

SEQ ID NO: 8433012 - DNA, 19 bp, Homo sapiens
tcctggcatcttcctccct

SEQ ID NO: 8433013 - DNA, 21 bp, Homo sapiens
tcctggccagggcactaggca

SEQ ID NO: 8433014 - DNA, 21 bp, Homo sapiens
tcctggccagggcactaggca

SEQ ID NO: 8433015 - DNA, 22 bp, Homo sapiens
tcctggcccaatctgcccatga

SEQ ID NO: 8433016 - DNA, 22 bp, Homo sapiens
tcctggccatgcaagatgagga

SEQ ID NO: 8433017 - DNA, 22 bp, Homo sapiens
tcctggccatgcaagatgagga

SEQ ID NO: 8433018 - DNA, 22 bp, Homo sapiens
tcctggccataggctatttcag

SEQ ID NO: 8433019 - DNA, 22 bp, Homo sapiens
tcctggccaggatgacctaaca

SEQ ID NO: 8433020 - DNA, 22 bp, Homo sapiens
tcctggccaggatgacctaaca

SEQ ID NO: 8433021 - DNA, 22 bp, Homo sapiens
tcctggccagaggacaaagctg

SEQ ID NO: 8433022 - DNA, 22 bp, Homo sapiens
tcctggccacccgacagaagtc

SEQ ID NO: 8433023 - DNA, 18 bp, Homo sapiens
tcctggccacactacctt

SEQ ID NO: 8433024 - DNA, 22 bp, Homo sapiens
tcctggccacacattaatagtg

SEQ ID NO: 8433025 - DNA, 22 bp, Homo sapiens
tcctggcacaaccctttaccag

SEQ ID NO: 8433026 - DNA, 22 bp, Homo sapiens
tcctggcaaagcaagttatgaa

SEQ ID NO: 8433027 - DNA, 22 bp, Homo sapiens
tcctggattaatagggagctgt

SEQ ID NO: 8433028 - DNA, 22 bp, Homo sapiens
tcctggatggagctgccctcgc

SEQ ID NO: 8433029 - DNA, 22 bp, Homo sapiens
tcctggatctactctcaattgg

SEQ ID NO: 8433030 - DNA, 22 bp, Homo sapiens
tcctggatcagcgggggcaggc

SEQ ID NO: 8433031 - DNA, 22 bp, Homo sapiens
tcctggagtgtcttccccaagg

SEQ ID NO: 8433032 - DNA, 22 bp, Homo sapiens
tcctggagtttgtggtgatatg

SEQ ID NO: 8433033 - DNA, 22 bp, Homo sapiens
tcctggagtttgtaaggtgagc

SEQ ID NO: 8433034 - DNA, 22 bp, Homo sapiens
tcctggagttgtgcagtgcaca

SEQ ID NO: 8433035 - DNA, 22 bp, Homo sapiens
tctcagagtgacaatgagaatt

SEQ ID NO: 8433036 - DNA, 22 bp, Homo sapiens
tctcagagtgacaatgagaatt

SEQ ID NO: 8433037 - DNA, 22 bp, Homo sapiens
tctcagagtaattctttaaggt

SEQ ID NO: 8433038 - DNA, 22 bp, Homo sapiens
tctcagagtaattctttaaggt

SEQ ID NO: 8433039 - DNA, 22 bp, Homo sapiens
tctcagaggtgccctggcatct

SEQ ID NO: 8433040 - DNA, 22 bp, Homo sapiens
tctcagagtaattctttaaggt

SEQ ID NO: 8433041 - DNA, 22 bp, Homo sapiens
tctcagagtaattctttaaggt

SEQ ID NO: 8433042 - DNA, 22 bp, Homo sapiens
tctcagaggtgccctggcatct

SEQ ID NO: 8433043 - DNA, 22 bp, Homo sapiens
tctcagaggtgccctggcatct

SEQ ID NO: 8433044 - DNA, 22 bp, Homo sapiens
tctcagagtgacaatgagaatt

SEQ ID NO: 8433045 - DNA, 22 bp, Homo sapiens
tctcagagtggtggtccctctg

SEQ ID NO: 8433046 - DNA, 22 bp, Homo sapiens
tctcagagtggtggtccctctg

SEQ ID NO: 8433047 - DNA, 22 bp, Homo sapiens
tctcagagttcctctggagtcc

SEQ ID NO: 8433048 - DNA, 22 bp, Homo sapiens
tctcagagttcctctggagtcc

SEQ ID NO: 8433049 - DNA, 22 bp, Homo sapiens
tctcagaggtcttcagcctctg

SEQ ID NO: 8433050 - DNA, 22 bp, Homo sapiens
tctcagagggaaaggccaattt

SEQ ID NO: 8433051 - DNA, 22 bp, Homo sapiens
tctcagagggaggattactgcc

SEQ ID NO: 8433052 - DNA, 22 bp, Homo sapiens
tctcagagggaggattactgcc

SEQ ID NO: 8433053 - DNA, 22 bp, Homo sapiens
tctcagagggaggattactgcc

SEQ ID NO: 8433054 - DNA, 22 bp, Homo sapiens
tctcagagggaaacatgagtga

SEQ ID NO: 8433055 - DNA, 22 bp, Homo sapiens
tctcagagggaaacatgagtga

SEQ ID NO: 8433056 - DNA, 22 bp, Homo sapiens
tctcagaggcccgacgttctcc

SEQ ID NO: 8433057 - DNA, 22 bp, Homo sapiens
tctcagagtttttttccaggac

SEQ ID NO: 8433058 - DNA, 22 bp, Homo sapiens
tctcagatggcatcagctagag

SEQ ID NO: 8433059 - DNA, 22 bp, Homo sapiens
tctcagcaacgatccggagtaa

SEQ ID NO: 8433060 - DNA, 22 bp, Homo sapiens
tctcagcaaggaaagaggcagg

SEQ ID NO: 8433061 - DNA, 22 bp, Homo sapiens
tctcagcaaggaaagaggcagg

SEQ ID NO: 8433062 - DNA, 20 bp, Homo sapiens
tctcagcataagaacccttc

SEQ ID NO: 8433063 - DNA, 22 bp, Homo sapiens
tctcagcagggccatcctgagc

SEQ ID NO: 8433064 - DNA, 22 bp, Homo sapiens
tctcagcacgttgttttcattg

SEQ ID NO: 8433065 - DNA, 22 bp, Homo sapiens
tctcagcagccagatccagagc

SEQ ID NO: 8433066 - DNA, 22 bp, Homo sapiens
tctcagcagccagatccagagc

SEQ ID NO: 8433067 - DNA, 22 bp, Homo sapiens
tctcagagtttagagctgagcc

SEQ ID NO: 8433068 - DNA, 22 bp, Homo sapiens
tctcagagtttagagctgagcc

SEQ ID NO: 8433069 - DNA, 22 bp, Homo sapiens
tctcagagtttagagctgagcc

SEQ ID NO: 8433070 - DNA, 22 bp, Homo sapiens
tctcagagtttagagctgagcc

SEQ ID NO: 8433071 - DNA, 22 bp, Homo sapiens
tctcagagtttagagctgagcc

SEQ ID NO: 8433072 - DNA, 22 bp, Homo sapiens
tctcagagtttagagctgagcc

SEQ ID NO: 8433073 - DNA, 22 bp, Homo sapiens
tctcagagtttacggggctgaa

SEQ ID NO: 8433074 - DNA, 22 bp, Homo sapiens
tctcagagtttacggggctgaa

SEQ ID NO: 8433075 - DNA, 22 bp, Homo sapiens
tctcagagtttttttccaggac

SEQ ID NO: 8433076 - DNA, 22 bp, Homo sapiens
tctcagagtttttttccaggac

SEQ ID NO: 8433077 - DNA, 22 bp, Homo sapiens
tctcagagtttgaatctggagt

SEQ ID NO: 8433078 - DNA, 22 bp, Homo sapiens
tctcagagtttagagctgagcc

SEQ ID NO: 8433079 - DNA, 22 bp, Homo sapiens
tctcagagtttgaatctggagt

SEQ ID NO: 8433080 - DNA, 22 bp, Homo sapiens
tctcagctgcctgccctgctcc

SEQ ID NO: 8433081 - DNA, 22 bp, Homo sapiens
tctcagctcttttttcacagaa

SEQ ID NO: 8433082 - DNA, 22 bp, Homo sapiens
tctcagctcatggcagccttga

SEQ ID NO: 8433083 - DNA, 22 bp, Homo sapiens
tctcagctcagcttccacagag

SEQ ID NO: 8433084 - DNA, 22 bp, Homo sapiens
tctcaggcccctgagtttctct

SEQ ID NO: 8433085 - DNA, 21 bp, Homo sapiens
tctcaggcgagaattctttta

SEQ ID NO: 8433086 - DNA, 20 bp, Homo sapiens
tctcaggccccctccttgct

SEQ ID NO: 8433087 - DNA, 20 bp, Homo sapiens
tctcaggccccctccttgct

SEQ ID NO: 8433088 - DNA, 22 bp, Homo sapiens
tctcaggcccctgagtttctct

SEQ ID NO: 8433089 - DNA, 21 bp, Homo sapiens
tctcaggcgagaattctttta

SEQ ID NO: 8433090 - DNA, 22 bp, Homo sapiens
tctcaggctaccttgcacaagg

SEQ ID NO: 8433091 - DNA, 22 bp, Homo sapiens
tctcaggctagtaaaagatggg

SEQ ID NO: 8433092 - DNA, 22 bp, Homo sapiens
tctcaggctcttggaacctgtt

SEQ ID NO: 8433093 - DNA, 22 bp, Homo sapiens
tctcagggagggcgagtcagcg

SEQ ID NO: 8433094 - DNA, 22 bp, Homo sapiens
tctcaggctgacattgggactc

SEQ ID NO: 8433095 - DNA, 19 bp, Homo sapiens
tctcaggctgggcggctgc

SEQ ID NO: 8433096 - DNA, 22 bp, Homo sapiens
tctcaggcttcctggtgctgtg

SEQ ID NO: 8433097 - DNA, 22 bp, Homo sapiens
tctcaggcttcctggtgctgtg

SEQ ID NO: 8433098 - DNA, 22 bp, Homo sapiens
tctcaggctgtgtgtggaggac

SEQ ID NO: 8433099 - DNA, 19 bp, Homo sapiens
tctcaggctgggcggctgc

SEQ ID NO: 8433100 - DNA, 22 bp, Homo sapiens
tctcaggctcctgacatatatg

SEQ ID NO: 8433101 - DNA, 22 bp, Homo sapiens
tctcagggcagcaaggaagcat

SEQ ID NO: 8433102 - DNA, 22 bp, Homo sapiens
tctcagggagttgaggctgcct

SEQ ID NO: 8433103 - DNA, 22 bp, Homo sapiens
tctcagggagggcgagtcagcg

SEQ ID NO: 8433104 - DNA, 23 bp, Homo sapiens
tctcagaaaggagaagtaatttg

SEQ ID NO: 8433105 - DNA, 23 bp, Homo sapiens
tctcagaaaggagaagtaatttg

SEQ ID NO: 8433106 - DNA, 22 bp, Homo sapiens
tctcagaaatactatgttgtca

SEQ ID NO: 8433107 - DNA, 22 bp, Homo sapiens
tctcagaaatgacaggaggtac

SEQ ID NO: 8433108 - DNA, 22 bp, Homo sapiens
tctcagaaatgacaggaggtac

SEQ ID NO: 8433109 - DNA, 22 bp, Homo sapiens
tctcagaacacccttctatggt

SEQ ID NO: 8433110 - DNA, 22 bp, Homo sapiens
tctcagagagatgaaacttcca

SEQ ID NO: 8433111 - DNA, 22 bp, Homo sapiens
tctcagagagatgaaacttcca

SEQ ID NO: 8433112 - DNA, 22 bp, Homo sapiens
tctcagagagatgaaacttcca

SEQ ID NO: 8433113 - DNA, 22 bp, Homo sapiens
tctcagagagatgaaacttcca

SEQ ID NO: 8433114 - DNA, 22 bp, Homo sapiens
tctcagagaggggccgggcctt

SEQ ID NO: 8433115 - DNA, 22 bp, Homo sapiens
tctcagagagctgtgttttcct

SEQ ID NO: 8433116 - DNA, 22 bp, Homo sapiens
tctcagagagctgtgttttcct

SEQ ID NO: 8433117 - DNA, 22 bp, Homo sapiens
tctcagagatgtcaagagtcta

SEQ ID NO: 8433118 - DNA, 22 bp, Homo sapiens
tctcagagatgtcaagagtcta

SEQ ID NO: 8433119 - DNA, 22 bp, Homo sapiens
tctcagagatgttagggaagag

SEQ ID NO: 8433120 - DNA, 22 bp, Homo sapiens
tctcagagatgttagggaagag

SEQ ID NO: 8433121 - DNA, 22 bp, Homo sapiens
tctcagagaggggccgggcctt

SEQ ID NO: 8433122 - DNA, 22 bp, Homo sapiens
tctcagagatctttctgcatgt

SEQ ID NO: 8433123 - DNA, 22 bp, Homo sapiens
tctcagagatctttctgcatgt

SEQ ID NO: 8433124 - DNA, 22 bp, Homo sapiens
tctcagagcttcagaaagcacc

SEQ ID NO: 8433125 - DNA, 22 bp, Homo sapiens
tctcagagcttcagttattttc

SEQ ID NO: 8433126 - DNA, 22 bp, Homo sapiens
tctcagagcttcagttattttc

SEQ ID NO: 8433127 - DNA, 22 bp, Homo sapiens
tctcagagcttcagaaagcacc

SEQ ID NO: 8433128 - DNA, 22 bp, Homo sapiens
tctcagagcttcagaaagcacc

SEQ ID NO: 8433129 - DNA, 22 bp, Homo sapiens
tctcagagcctaactaacctaa

SEQ ID NO: 8433130 - DNA, 22 bp, Homo sapiens
tctcagagcctaactaacctaa

SEQ ID NO: 8433131 - DNA, 22 bp, Homo sapiens
tctcagagctcacacctcctgg

SEQ ID NO: 8433132 - DNA, 19 bp, Homo sapiens
tctcagaggaaaaattgct

SEQ ID NO: 8433133 - DNA, 19 bp, Homo sapiens
tctcagaggaaaaattgct

SEQ ID NO: 8433134 - DNA, 18 bp, Homo sapiens
tctcagaggccatcctag

SEQ ID NO: 8433135 - DNA, 23 bp, Homo sapiens
tctcagaggattcctgggccttg

SEQ ID NO: 8433136 - DNA, 23 bp, Homo sapiens
tctcagaggattcctgggccttg

SEQ ID NO: 8433137 - DNA, 22 bp, Homo sapiens
tctcagagatgttagggaagag

SEQ ID NO: 8433138 - DNA, 22 bp, Homo sapiens
tctcagagatgttagggaagag

SEQ ID NO: 8433139 - DNA, 22 bp, Homo sapiens
tctcagagattcagggagaagt

SEQ ID NO: 8433140 - DNA, 22 bp, Homo sapiens
tctcagagatttatggaaaact

SEQ ID NO: 8433141 - DNA, 22 bp, Homo sapiens
tctcagagattcagggagaagt

SEQ ID NO: 8433142 - DNA, 22 bp, Homo sapiens
tctcagagatgttagggaagag

SEQ ID NO: 8433143 - DNA, 22 bp, Homo sapiens
tctcagagatttatggaaaact

SEQ ID NO: 8433144 - DNA, 22 bp, Homo sapiens
tctcagagatttatggaaaact

SEQ ID NO: 8433145 - DNA, 22 bp, Homo sapiens
tctcagagattttgtttccctt

SEQ ID NO: 8433146 - DNA, 19 bp, Homo sapiens
tctcagagccctagaggcc

SEQ ID NO: 8433147 - DNA, 19 bp, Homo sapiens
tctcagagccctagaggcc

SEQ ID NO: 8433148 - DNA, 19 bp, Homo sapiens
tctcagagccctagaggcc

SEQ ID NO: 8433149 - DNA, 19 bp, Homo sapiens
tctcagagccctagaggcc

SEQ ID NO: 8433150 - DNA, 19 bp, Homo sapiens
tctcagagccctagaggcc

SEQ ID NO: 8433151 - DNA, 19 bp, Homo sapiens
tctcagagccctagaggcc

SEQ ID NO: 8433152 - DNA, 22 bp, Homo sapiens
tctcagagcatcattttcttag

SEQ ID NO: 8433153 - DNA, 22 bp, Homo sapiens
tctcagagcatcattttcttag

SEQ ID NO: 8433154 - DNA, 22 bp, Homo sapiens
tctcactgggtcacagcagagg

SEQ ID NO: 8433155 - DNA, 22 bp, Homo sapiens
tctcagaaaaactttgagggta

SEQ ID NO: 8433156 - DNA, 22 bp, Homo sapiens
tctcagaaaaaggagaaactgg

SEQ ID NO: 8433157 - DNA, 22 bp, Homo sapiens
tctcagaaaagagcttcagaaa

SEQ ID NO: 8433158 - DNA, 22 bp, Homo sapiens
tctcagaaaaaggagaaactgg

SEQ ID NO: 8433159 - DNA, 22 bp, Homo sapiens
tctcactgatttgagaccaagg

SEQ ID NO: 8433160 - DNA, 22 bp, Homo sapiens
tctcacagtgagcctgaggtcg

SEQ ID NO: 8433161 - DNA, 22 bp, Homo sapiens
tctcacaggtgcacgtggctgt

SEQ ID NO: 8433162 - DNA, 22 bp, Homo sapiens
tctcacatctgccctgtgctgg

SEQ ID NO: 8433163 - DNA, 20 bp, Homo sapiens
tctcagggttcagcaaagta

SEQ ID NO: 8433164 - DNA, 23 bp, Homo sapiens
tctcagggtggctgggcccatcc

SEQ ID NO: 8433165 - DNA, 22 bp, Homo sapiens
tctcaggtggcccccatgagtg

SEQ ID NO: 8433166 - DNA, 22 bp, Homo sapiens
tctcaggtaagcttctttgatg

SEQ ID NO: 8433167 - DNA, 17 bp, Homo sapiens
tctcaggggctagccct

SEQ ID NO: 8433168 - DNA, 22 bp, Homo sapiens
tctcagggcgcagtgaggcagt

SEQ ID NO: 8433169 - DNA, 22 bp, Homo sapiens
tctcagggcgcagtgaggcagt

SEQ ID NO: 8433170 - DNA, 22 bp, Homo sapiens
tctcagggctcagagctcaggc

SEQ ID NO: 8433171 - DNA, 22 bp, Homo sapiens
tctcagggctcagagctcaggc

SEQ ID NO: 8433172 - DNA, 22 bp, Homo sapiens
tctcagtgcagagaggctatct

SEQ ID NO: 8433173 - DNA, 22 bp, Homo sapiens
tctcagtgatggcccatttgga

SEQ ID NO: 8433174 - DNA, 22 bp, Homo sapiens
tctcagtgagcttttctatgtt

SEQ ID NO: 8433175 - DNA, 23 bp, Homo sapiens
tctcagtgaatctcagaattcgc

SEQ ID NO: 8433176 - DNA, 22 bp, Homo sapiens
tctcagtgaagagtataacaaa

SEQ ID NO: 8433177 - DNA, 22 bp, Homo sapiens
tctcagtgacactcttcataca

SEQ ID NO: 8433178 - DNA, 22 bp, Homo sapiens
tctcatggagtcaggagcagaa

SEQ ID NO: 8433179 - DNA, 22 bp, Homo sapiens
tctcatcttcatatctgaaaga

SEQ ID NO: 8433180 - DNA, 22 bp, Homo sapiens
tctcatctattcacattaactg

SEQ ID NO: 8433181 - DNA, 22 bp, Homo sapiens
tctcatcattccttcaaagccc

SEQ ID NO: 8433182 - DNA, 22 bp, Homo sapiens
tctcagtggacgtgtctgtctt

SEQ ID NO: 8433183 - DNA, 22 bp, Homo sapiens
tctcagtgctatccatattcca

SEQ ID NO: 8433184 - DNA, 22 bp, Homo sapiens
tctccaaatcaatcaatatgaa

SEQ ID NO: 8433185 - DNA, 22 bp, Homo sapiens
tctccaaatcaatcaatatgaa

SEQ ID NO: 8433186 - DNA, 22 bp, Homo sapiens
tctccaaatagttatatttaga

SEQ ID NO: 8433187 - DNA, 22 bp, Homo sapiens
tctccaaactcagactaagtat

SEQ ID NO: 8433188 - DNA, 19 bp, Homo sapiens
tctccaaaaccaatcacta

SEQ ID NO: 8433189 - DNA, 22 bp, Homo sapiens
tctcatttgcctcatctataaa

SEQ ID NO: 8433190 - DNA, 22 bp, Homo sapiens
tctcattgaaatgtgactgagt

SEQ ID NO: 8433191 - DNA, 22 bp, Homo sapiens
tctcattggaaaagagtttaat

SEQ ID NO: 8433192 - DNA, 22 bp, Homo sapiens
tctcattgcacaatgcagagtg

SEQ ID NO: 8433193 - DNA, 22 bp, Homo sapiens
tctcattgccttcactcttcag

SEQ ID NO: 8433194 - DNA, 22 bp, Homo sapiens
tctcattggtatatacatgtgt

SEQ ID NO: 8433195 - DNA, 22 bp, Homo sapiens
tctcattgtccaattgaattta

SEQ ID NO: 8433196 - DNA, 22 bp, Homo sapiens
tctcattggtatgatgtgtaga

SEQ ID NO: 8433197 - DNA, 22 bp, Homo sapiens
tctcattgtagaaagactgatt

SEQ ID NO: 8433198 - DNA, 22 bp, Homo sapiens
tctcattggtatatacatgtgt

SEQ ID NO: 8433199 - DNA, 22 bp, Homo sapiens
tctcatgtttctggtactcctt

SEQ ID NO: 8433200 - DNA, 23 bp, Homo sapiens
tctcatgtctttcctacaagcat

SEQ ID NO: 8433201 - DNA, 22 bp, Homo sapiens
tctcatgtgattcccgtgcatg

SEQ ID NO: 8433202 - DNA, 23 bp, Homo sapiens
tctccaggccttactccaggcct

SEQ ID NO: 8433203 - DNA, 22 bp, Homo sapiens
tctccaggcacttggctgctac

SEQ ID NO: 8433204 - DNA, 22 bp, Homo sapiens
tctccaggcacttggctgctac

SEQ ID NO: 8433205 - DNA, 22 bp, Homo sapiens
tctccaggcacttggctgctac

SEQ ID NO: 8433206 - DNA, 19 bp, Homo sapiens
tctccaggcaggtgagcga

SEQ ID NO: 8433207 - DNA, 22 bp, Homo sapiens
tctccaggcactacctgggtaa

SEQ ID NO: 8433208 - DNA, 22 bp, Homo sapiens
tctccaggcactacctgggtaa

SEQ ID NO: 8433209 - DNA, 22 bp, Homo sapiens
tctccaggcactacctgggtaa

SEQ ID NO: 8433210 - DNA, 22 bp, Homo sapiens
tctccaggagcaagtcacccag

SEQ ID NO: 8433211 - DNA, 22 bp, Homo sapiens
tctccacaagctgatgctagga

SEQ ID NO: 8433212 - DNA, 22 bp, Homo sapiens
tctccacaagctttctcctttt

SEQ ID NO: 8433213 - DNA, 22 bp, Homo sapiens
tctccaggaagccctccctgac

SEQ ID NO: 8433214 - DNA, 22 bp, Homo sapiens
tctccaagaaaagatctcagct

SEQ ID NO: 8433215 - DNA, 22 bp, Homo sapiens
tctccaggagaaatatgaagga

SEQ ID NO: 8433216 - DNA, 22 bp, Homo sapiens
tctccaggactgagctccagcc

SEQ ID NO: 8433217 - DNA, 22 bp, Homo sapiens
tctccaggactgagctccagcc

SEQ ID NO: 8433218 - DNA, 22 bp, Homo sapiens
tctccaggactgagctccagcc

SEQ ID NO: 8433219 - DNA, 17 bp, Homo sapiens
tctccaggacgagctca

SEQ ID NO: 8433220 - DNA, 22 bp, Homo sapiens
tctccaggaagccctccctgac

SEQ ID NO: 8433221 - DNA, 17 bp, Homo sapiens
tctccaggacgagctca

SEQ ID NO: 8433222 - DNA, 20 bp, Homo sapiens
tctcgcactcggagcagccg

SEQ ID NO: 8433223 - DNA, 22 bp, Homo sapiens
tctcgacagcctggcacagtgg

SEQ ID NO: 8433224 - DNA, 22 bp, Homo sapiens
tctccttgtgctgggtccttcc

SEQ ID NO: 8433225 - DNA, 22 bp, Homo sapiens
tctcgctctgtcgcccaggctg

SEQ ID NO: 8433226 - DNA, 22 bp, Homo sapiens
tctctagttgaggactgagcag

SEQ ID NO: 8433227 - DNA, 22 bp, Homo sapiens
tctcctgtatgggactggcgag

SEQ ID NO: 8433228 - DNA, 23 bp, Homo sapiens
tctcctgtcctaattaccacccc

SEQ ID NO: 8433229 - DNA, 23 bp, Homo sapiens
tctcctgtcctaattaccacccc

SEQ ID NO: 8433230 - DNA, 22 bp, Homo sapiens
tctcctgtgcaccctccctgtg

SEQ ID NO: 8433231 - DNA, 22 bp, Homo sapiens
tctcctgtcttctcagcacccc

SEQ ID NO: 8433232 - DNA, 22 bp, Homo sapiens
tctcctgtcttctcagcacccc

SEQ ID NO: 8433233 - DNA, 22 bp, Homo sapiens
tctcctggtcacctcagaagtc

SEQ ID NO: 8433234 - DNA, 22 bp, Homo sapiens
tctcctggtcacctcagaagtc

SEQ ID NO: 8433235 - DNA, 22 bp, Homo sapiens
tctcctggtcacctcagaagtc

SEQ ID NO: 8433236 - DNA, 22 bp, Homo sapiens
tctcctggtatgtatgcacctg

SEQ ID NO: 8433237 - DNA, 20 bp, Homo sapiens
tctcctggtctggtccgtgc

SEQ ID NO: 8433238 - DNA, 20 bp, Homo sapiens
tctcctggtctggtccgtgc

SEQ ID NO: 8433239 - DNA, 20 bp, Homo sapiens
tctcctggtgacagtaccca

SEQ ID NO: 8433240 - DNA, 20 bp, Homo sapiens
tctcctggtgacagtaccca

SEQ ID NO: 8433241 - DNA, 22 bp, Homo sapiens
tctcctggtttgttaaataatt

SEQ ID NO: 8433242 - DNA, 22 bp, Homo sapiens
tctcctggtttgttaaataatt

SEQ ID NO: 8433243 - DNA, 22 bp, Homo sapiens
tctcctgggtgctttatcagaa

SEQ ID NO: 8433244 - DNA, 22 bp, Homo sapiens
tctcctgggtgctttatcagaa

SEQ ID NO: 8433245 - DNA, 22 bp, Homo sapiens
tctcctggtatgtatgcacctg

SEQ ID NO: 8433246 - DNA, 22 bp, Homo sapiens
tctcctggtatgtatgcacctg

SEQ ID NO: 8433247 - DNA, 22 bp, Homo sapiens
tctcctggtacccttcctagca

SEQ ID NO: 8433248 - DNA, 22 bp, Homo sapiens
tctcctggtacccttcctagca

SEQ ID NO: 8433249 - DNA, 22 bp, Homo sapiens
tctcctgggtaaaagggttgat

SEQ ID NO: 8433250 - DNA, 22 bp, Homo sapiens
tctcctgggtaaaagggttgat

SEQ ID NO: 8433251 - DNA, 22 bp, Homo sapiens
tctcctggccctgtcgccatct

SEQ ID NO: 8433252 - DNA, 22 bp, Homo sapiens
tctcctggccctgtcgccatct

SEQ ID NO: 8433253 - DNA, 22 bp, Homo sapiens
tctcctgggcttggttgaagtt

SEQ ID NO: 8433254 - DNA, 22 bp, Homo sapiens
tctcctgggcttggttgaagtt

SEQ ID NO: 8433255 - DNA, 18 bp, Homo sapiens
tctcctgggtaggggcct

SEQ ID NO: 8433256 - DNA, 18 bp, Homo sapiens
tctcctgggtaggggcct

SEQ ID NO: 8433257 - DNA, 21 bp, Homo sapiens
tctcctgggtccaacccatgc

SEQ ID NO: 8433258 - DNA, 21 bp, Homo sapiens
tctcctgggtccaacccatgc

SEQ ID NO: 8433259 - DNA, 22 bp, Homo sapiens
tctcctggagcaggaaggtggg

SEQ ID NO: 8433260 - DNA, 22 bp, Homo sapiens
tctcctggagcaggaaggtggg

SEQ ID NO: 8433261 - DNA, 22 bp, Homo sapiens
tctcctggagcaggaaggtggg

SEQ ID NO: 8433262 - DNA, 22 bp, Homo sapiens
tctcctggatagatactatcca

SEQ ID NO: 8433263 - DNA, 22 bp, Homo sapiens
tctcctggagcccagatgctgg

SEQ ID NO: 8433264 - DNA, 22 bp, Homo sapiens
tctcctggagcccagatgctgg

SEQ ID NO: 8433265 - DNA, 22 bp, Homo sapiens
tctcctggagcccagatgctgg

SEQ ID NO: 8433266 - DNA, 22 bp, Homo sapiens
tctcctggatggaccttctctt

SEQ ID NO: 8433267 - DNA, 22 bp, Homo sapiens
tctcctggatagatactatcca

SEQ ID NO: 8433268 - DNA, 22 bp, Homo sapiens
tctcctggatagatactatcca

SEQ ID NO: 8433269 - DNA, 22 bp, Homo sapiens
tctcctggatggaccttctctt

SEQ ID NO: 8433270 - DNA, 22 bp, Homo sapiens
tctcctggatggaccttctctt

SEQ ID NO: 8433271 - DNA, 22 bp, Homo sapiens
tctcctggcatgtgggtcatct

SEQ ID NO: 8433272 - DNA, 22 bp, Homo sapiens
tctcctggcatgtgggtcatct

SEQ ID NO: 8433273 - DNA, 22 bp, Homo sapiens
tctcctggcatttggttgagta

SEQ ID NO: 8433274 - DNA, 22 bp, Homo sapiens
tctcctggcatttggttgagta

SEQ ID NO: 8433275 - DNA, 22 bp, Homo sapiens
tctcctgcttcaactgatggac

SEQ ID NO: 8433276 - DNA, 22 bp, Homo sapiens
tctcctggaagtgattcccctg

SEQ ID NO: 8433277 - DNA, 22 bp, Homo sapiens
tctcctggaagtgattcccctg

SEQ ID NO: 8433278 - DNA, 22 bp, Homo sapiens
tctcctggaagaataccacact

SEQ ID NO: 8433279 - DNA, 22 bp, Homo sapiens
tctcctggaagaataccacact

SEQ ID NO: 8433280 - DNA, 22 bp, Homo sapiens
tctcctgcagtcagcagtctca

SEQ ID NO: 8433281 - DNA, 22 bp, Homo sapiens
tctcctgatgatggtactggca

SEQ ID NO: 8433282 - DNA, 22 bp, Homo sapiens
tctcctgacatgtctggaggaa

SEQ ID NO: 8433283 - DNA, 22 bp, Homo sapiens
tctcctccagaggctgtgggga

SEQ ID NO: 8433284 - DNA, 22 bp, Homo sapiens
tctcctcaccaccagcagcaga

SEQ ID NO: 8433285 - DNA, 22 bp, Homo sapiens
tctcctcaccaccagcagcaga

SEQ ID NO: 8433286 - DNA, 22 bp, Homo sapiens
tctcctccagaggctgtgggga

SEQ ID NO: 8433287 - DNA, 22 bp, Homo sapiens
tctcctaggctggagtgcagtg

SEQ ID NO: 8433288 - DNA, 23 bp, Homo sapiens
tctcctcctagatacagtcatgg

SEQ ID NO: 8433289 - DNA, 22 bp, Homo sapiens
tctccagggaggtagcccagtg

SEQ ID NO: 8433290 - DNA, 22 bp, Homo sapiens
tctccagggactgaggctggag

SEQ ID NO: 8433291 - DNA, 22 bp, Homo sapiens
tctccagggactgaggctggag

SEQ ID NO: 8433292 - DNA, 22 bp, Homo sapiens
tctccagggactgaggctggag

SEQ ID NO: 8433293 - DNA, 22 bp, Homo sapiens
tctccagggactgaggctggag

SEQ ID NO: 8433294 - DNA, 22 bp, Homo sapiens
tctccagggacatgtttctgga

SEQ ID NO: 8433295 - DNA, 22 bp, Homo sapiens
tctccaggcttaatctcagctt

SEQ ID NO: 8433296 - DNA, 22 bp, Homo sapiens
tctccaggcttaatctcagctt

SEQ ID NO: 8433297 - DNA, 22 bp, Homo sapiens
tctccaggcctttcccatctta

SEQ ID NO: 8433298 - DNA, 22 bp, Homo sapiens
tctccagggtgagctaggccag

SEQ ID NO: 8433299 - DNA, 22 bp, Homo sapiens
tctccaggtaaatggcatcctg

SEQ ID NO: 8433300 - DNA, 22 bp, Homo sapiens
tctccaggggctgctgtgccac

SEQ ID NO: 8433301 - DNA, 22 bp, Homo sapiens
tctccaggggctgctgtgccac

SEQ ID NO: 8433302 - DNA, 22 bp, Homo sapiens
tctccagggtgagctaggccag

SEQ ID NO: 8433303 - DNA, 22 bp, Homo sapiens
tctccagggtgagctaggccag

SEQ ID NO: 8433304 - DNA, 22 bp, Homo sapiens
tctccagggaggtagcccagtg

SEQ ID NO: 8433305 - DNA, 22 bp, Homo sapiens
tctccagggcagagaatagcaa

SEQ ID NO: 8433306 - DNA, 22 bp, Homo sapiens
tctccagggaggtagcccagtg

SEQ ID NO: 8433307 - DNA, 22 bp, Homo sapiens
tctccaggggcagggtctggag

SEQ ID NO: 8433308 - DNA, 22 bp, Homo sapiens
tctccagggcccccgagcgttg

SEQ ID NO: 8433309 - DNA, 22 bp, Homo sapiens
tctcccagaagtcctcagtaca

SEQ ID NO: 8433310 - DNA, 22 bp, Homo sapiens
tctcccagaggatcccagtgga

SEQ ID NO: 8433311 - DNA, 22 bp, Homo sapiens
tctccaggttcagtcgatggaa

SEQ ID NO: 8433312 - DNA, 22 bp, Homo sapiens
tctccaggtggggtcacctttt

SEQ ID NO: 8433313 - DNA, 21 bp, Homo sapiens
tctccagtatccttctctgag

SEQ ID NO: 8433314 - DNA, 22 bp, Homo sapiens
tctccaggtggcttgggcttct

SEQ ID NO: 8433315 - DNA, 22 bp, Homo sapiens
tctccaggtggcttgggcttct

SEQ ID NO: 8433316 - DNA, 22 bp, Homo sapiens
tctccaggtgctaagtgtgcct

SEQ ID NO: 8433317 - DNA, 22 bp, Homo sapiens
tctccaggtgctaagtgtgcct

SEQ ID NO: 8433318 - DNA, 19 bp, Homo sapiens
tctccaggtgccccaaaca

SEQ ID NO: 8433319 - DNA, 22 bp, Homo sapiens
tctccaggtgaaacttgcaggg

SEQ ID NO: 8433320 - DNA, 22 bp, Homo sapiens
tctccaggtgaaacttgcaggg

SEQ ID NO: 8433321 - DNA, 22 bp, Homo sapiens
tctccaggtgaaacttgcaggg

SEQ ID NO: 8433322 - DNA, 22 bp, Homo sapiens
tctccaggtgactctgatgtat

SEQ ID NO: 8433323 - DNA, 22 bp, Homo sapiens
tctccaggtagatatgtcagga

SEQ ID NO: 8433324 - DNA, 22 bp, Homo sapiens
tctcccagtggtgcagaaagca

SEQ ID NO: 8433325 - DNA, 22 bp, Homo sapiens
tctcccagtgtctggcagtcag

SEQ ID NO: 8433326 - DNA, 22 bp, Homo sapiens
tctcccagtgtctggcagtcag

SEQ ID NO: 8433327 - DNA, 22 bp, Homo sapiens
tctcccagtgtctggcagtcag

SEQ ID NO: 8433328 - DNA, 22 bp, Homo sapiens
tctccccagaccctggacataa

SEQ ID NO: 8433329 - DNA, 22 bp, Homo sapiens
tctccccagctgagctgccctt

SEQ ID NO: 8433330 - DNA, 22 bp, Homo sapiens
tctccccaaccatggcactcac

SEQ ID NO: 8433331 - DNA, 22 bp, Homo sapiens
tctccccaaccatggcactcac

SEQ ID NO: 8433332 - DNA, 19 bp, Homo sapiens
tctcccggcactcctgccc

SEQ ID NO: 8433333 - DNA, 22 bp, Homo sapiens
tctcccctgttggccaggtttt

SEQ ID NO: 8433334 - DNA, 22 bp, Homo sapiens
tctcccctccctggaccagtgc

SEQ ID NO: 8433335 - DNA, 22 bp, Homo sapiens
tctcccctggtctcgcgcgctg

SEQ ID NO: 8433336 - DNA, 22 bp, Homo sapiens
tctcccccagtctctacagcag

SEQ ID NO: 8433337 - DNA, 22 bp, Homo sapiens
tctcccctagtgcattaaagtg

SEQ ID NO: 8433338 - DNA, 22 bp, Homo sapiens
tctcccctactctaaatctgca

SEQ ID NO: 8433339 - DNA, 21 bp, Homo sapiens
tctccccattcttattcccat

SEQ ID NO: 8433340 - DNA, 22 bp, Homo sapiens
tctccccagtatggattctctg

SEQ ID NO: 8433341 - DNA, 22 bp, Homo sapiens
tctccccaggggtatgggtatt

SEQ ID NO: 8433342 - DNA, 22 bp, Homo sapiens
tctccccaggggtatgggtatt

SEQ ID NO: 8433343 - DNA, 22 bp, Homo sapiens
tctcccagtcctctgtgcttac

SEQ ID NO: 8433344 - DNA, 22 bp, Homo sapiens
tctcccaggctggagtgcagtg

SEQ ID NO: 8433345 - DNA, 22 bp, Homo sapiens
tctcccaggctggagtgcagtg

SEQ ID NO: 8433346 - DNA, 22 bp, Homo sapiens
tctcccaggtcatacacagaga

SEQ ID NO: 8433347 - DNA, 20 bp, Homo sapiens
tctcccaggctcagggaaga

SEQ ID NO: 8433348 - DNA, 20 bp, Homo sapiens
tctcccaggctcagggaaga

SEQ ID NO: 8433349 - DNA, 22 bp, Homo sapiens
tctcccaggctgccctgtggac

SEQ ID NO: 8433350 - DNA, 22 bp, Homo sapiens
tctcccagaggatcccagtgga

SEQ ID NO: 8433351 - DNA, 19 bp, Homo sapiens
tctcccagctgagaagggc

SEQ ID NO: 8433352 - DNA, 19 bp, Homo sapiens
tctcccagctgagaagggc

SEQ ID NO: 8433353 - DNA, 22 bp, Homo sapiens
tctcccaggcaggagtgcagtg

SEQ ID NO: 8433354 - DNA, 22 bp, Homo sapiens
tctcccaggcaggagtgcagtg

SEQ ID NO: 8433355 - DNA, 22 bp, Homo sapiens
tctctcccaaatctgcagatag

SEQ ID NO: 8433356 - DNA, 18 bp, Homo sapiens
tctctccatctatttgtt

SEQ ID NO: 8433357 - DNA, 22 bp, Homo sapiens
tctctcccaaatctgcagatag

SEQ ID NO: 8433358 - DNA, 22 bp, Homo sapiens
tctctcctgtgttctgatgttt

SEQ ID NO: 8433359 - DNA, 22 bp, Homo sapiens
tctctctactggggcactagga

SEQ ID NO: 8433360 - DNA, 22 bp, Homo sapiens
tctctctatatgtcaacagggg

SEQ ID NO: 8433361 - DNA, 22 bp, Homo sapiens
tctctctcagccattacagaac

SEQ ID NO: 8433362 - DNA, 18 bp, Homo sapiens
tctctctgataacatttt

SEQ ID NO: 8433363 - DNA, 22 bp, Homo sapiens
tctctctgagccctgctttttc

SEQ ID NO: 8433364 - DNA, 22 bp, Homo sapiens
tctctcagatggggcactagta

SEQ ID NO: 8433365 - DNA, 22 bp, Homo sapiens
tctctcagaggaagaggcagtg

SEQ ID NO: 8433366 - DNA, 18 bp, Homo sapiens
tctctcagggaaacagaa

SEQ ID NO: 8433367 - DNA, 22 bp, Homo sapiens
tctctcagtcagatgctaaaga

SEQ ID NO: 8433368 - DNA, 22 bp, Homo sapiens
tctctccaacatggtggtgctg

SEQ ID NO: 8433369 - DNA, 22 bp, Homo sapiens
tctctcaacctcggcactattg

SEQ ID NO: 8433370 - DNA, 22 bp, Homo sapiens
tctctcagaggaagaggcagtg

SEQ ID NO: 8433371 - DNA, 22 bp, Homo sapiens
tctctcagaactgcagctgcag

SEQ ID NO: 8433372 - DNA, 22 bp, Homo sapiens
tctctgaaggggagctgtttaa

SEQ ID NO: 8433373 - DNA, 22 bp, Homo sapiens
tctctgaataatgctattcttt

SEQ ID NO: 8433374 - DNA, 22 bp, Homo sapiens
tctctgaatgagattactgcct

SEQ ID NO: 8433375 - DNA, 22 bp, Homo sapiens
tctctgaattctgatgcaagtg

SEQ ID NO: 8433376 - DNA, 22 bp, Homo sapiens
tctctgagaagttcctttgtga

SEQ ID NO: 8433377 - DNA, 22 bp, Homo sapiens
tctctgaagagctcagactagt

SEQ ID NO: 8433378 - DNA, 22 bp, Homo sapiens
tctctgaagaatcgatgattct

SEQ ID NO: 8433379 - DNA, 22 bp, Homo sapiens
tctctgaagagtcagacataac

SEQ ID NO: 8433380 - DNA, 22 bp, Homo sapiens
tctctgaagagctcagactagt

SEQ ID NO: 8433381 - DNA, 22 bp, Homo sapiens
tctctgaagagtcagacataac

SEQ ID NO: 8433382 - DNA, 22 bp, Homo sapiens
tctctgaaagcagctgctcatc

SEQ ID NO: 8433383 - DNA, 23 bp, Homo sapiens
tctctctggcaaatttcacatat

SEQ ID NO: 8433384 - DNA, 22 bp, Homo sapiens
tctctctgccaactcacagcca

SEQ ID NO: 8433385 - DNA, 22 bp, Homo sapiens
tctctgagcccagtgtccccct

SEQ ID NO: 8433386 - DNA, 22 bp, Homo sapiens
tctctgagcccctgcctctttc

SEQ ID NO: 8433387 - DNA, 22 bp, Homo sapiens
tctctgagcgcattcctccggc

SEQ ID NO: 8433388 - DNA, 22 bp, Homo sapiens
tctctgagaagctgaggctggg

SEQ ID NO: 8433389 - DNA, 22 bp, Homo sapiens
tctctgagcacctaagatatat

SEQ ID NO: 8433390 - DNA, 21 bp, Homo sapiens
tctctgagaggtctgcttaga

SEQ ID NO: 8433391 - DNA, 22 bp, Homo sapiens
tctctgagctggatttgttctt

SEQ ID NO: 8433392 - DNA, 22 bp, Homo sapiens
tctctgagcttaaggtgtttca

SEQ ID NO: 8433393 - DNA, 22 bp, Homo sapiens
tctctgaggacttggggttgcc

SEQ ID NO: 8433394 - DNA, 20 bp, Homo sapiens
tctctgagcttctcttgggg

SEQ ID NO: 8433395 - DNA, 22 bp, Homo sapiens
tctctgagctcaggagctgcag

SEQ ID NO: 8433396 - DNA, 22 bp, Homo sapiens
tctctgagctcaggagctgcag

SEQ ID NO: 8433397 - DNA, 22 bp, Homo sapiens
tctctgagggagatggcctgcc

SEQ ID NO: 8433398 - DNA, 22 bp, Homo sapiens
tctctgagtaagtgacagttca

SEQ ID NO: 8433399 - DNA, 22 bp, Homo sapiens
tctctggcagggatatctggct

SEQ ID NO: 8433400 - DNA, 22 bp, Homo sapiens
tctctggcagcttgtgctgttg

SEQ ID NO: 8433401 - DNA, 22 bp, Homo sapiens
tctctggcagactggctgggct

SEQ ID NO: 8433402 - DNA, 22 bp, Homo sapiens
tctctggcagaggccctatccc

SEQ ID NO: 8433403 - DNA, 22 bp, Homo sapiens
tctctggagtataaccagggat

SEQ ID NO: 8433404 - DNA, 20 bp, Homo sapiens
tctctggcaagaagctgcag

SEQ ID NO: 8433405 - DNA, 19 bp, Homo sapiens
tctctggatgacagacact

SEQ ID NO: 8433406 - DNA, 22 bp, Homo sapiens
tctctggcagacacctccctga

SEQ ID NO: 8433407 - DNA, 22 bp, Homo sapiens
tctctggcacataataaggtct

SEQ ID NO: 8433408 - DNA, 22 bp, Homo sapiens
tctctggcactcccttatggct

SEQ ID NO: 8433409 - DNA, 22 bp, Homo sapiens
tctctggccgagagtccctggg

SEQ ID NO: 8433410 - DNA, 23 bp, Homo sapiens
tctctggcctttgatcaggttga

SEQ ID NO: 8433411 - DNA, 21 bp, Homo sapiens
tctctggcggtgtttggctcc

SEQ ID NO: 8433412 - DNA, 22 bp, Homo sapiens
tctctggctggcaccccaggga

SEQ ID NO: 8433413 - DNA, 22 bp, Homo sapiens
tctctggctcctgccgggtcca

SEQ ID NO: 8433414 - DNA, 22 bp, Homo sapiens
tctctggctgatattcctctgc

SEQ ID NO: 8433415 - DNA, 22 bp, Homo sapiens
tctctggccccatggctgagct

SEQ ID NO: 8433416 - DNA, 22 bp, Homo sapiens
tctctggccctgttttctatct

SEQ ID NO: 8433417 - DNA, 19 bp, Homo sapiens
tctctggcagttcagagca

SEQ ID NO: 8433418 - DNA, 19 bp, Homo sapiens
tctctggcatagactcaat

SEQ ID NO: 8433419 - DNA, 19 bp, Homo sapiens
tctctggcagttcagagca

SEQ ID NO: 8433420 - DNA, 20 bp, Homo sapiens
tctctggccagaaacaacag

SEQ ID NO: 8433421 - DNA, 22 bp, Homo sapiens
tctctggagtataaccagggat

SEQ ID NO: 8433422 - DNA, 21 bp, Homo sapiens
tctctggagttagcagagaga

SEQ ID NO: 8433423 - DNA, 22 bp, Homo sapiens
tctctggagggctccaggcggg

SEQ ID NO: 8433424 - DNA, 22 bp, Homo sapiens
tctctggagctgcagatccagg

SEQ ID NO: 8433425 - DNA, 22 bp, Homo sapiens
tctctggagctgcagatccagg

SEQ ID NO: 8433426 - DNA, 22 bp, Homo sapiens
tctctggaagcgcagatctgtt

SEQ ID NO: 8433427 - DNA, 22 bp, Homo sapiens
tctctggaattggctgaggcaa

SEQ ID NO: 8433428 - DNA, 22 bp, Homo sapiens
tctctggaattggctgaggcaa

SEQ ID NO: 8433429 - DNA, 21 bp, Homo sapiens
tctctggaattagaccatgtt

SEQ ID NO: 8433430 - DNA, 22 bp, Homo sapiens
tctctgctaagattgtgtctag

SEQ ID NO: 8433431 - DNA, 22 bp, Homo sapiens
tctctgctcaggcaccagccct

SEQ ID NO: 8433432 - DNA, 22 bp, Homo sapiens
tctctgagttctcctccagccc

SEQ ID NO: 8433433 - DNA, 22 bp, Homo sapiens
tctctgagttctcctccagccc

SEQ ID NO: 8433434 - DNA, 19 bp, Homo sapiens
tctctgccgatcagggccc

SEQ ID NO: 8433435 - DNA, 22 bp, Homo sapiens
tctctgggatcaggtggcccag

SEQ ID NO: 8433436 - DNA, 22 bp, Homo sapiens
tctctgggatcgttttgggctc

SEQ ID NO: 8433437 - DNA, 19 bp, Homo sapiens
tctctggcttgtctgcctg

SEQ ID NO: 8433438 - DNA, 22 bp, Homo sapiens
tctctggctggcaccccaggga

SEQ ID NO: 8433439 - DNA, 22 bp, Homo sapiens
tctctggcttaggttgagtgca

SEQ ID NO: 8433440 - DNA, 22 bp, Homo sapiens
tctctgggcccagaccttcctt

SEQ ID NO: 8433441 - DNA, 21 bp, Homo sapiens
tctctgggccctcctgtgggg

SEQ ID NO: 8433442 - DNA, 22 bp, Homo sapiens
tctctgggcctcagttttctca

SEQ ID NO: 8433443 - DNA, 22 bp, Homo sapiens
tctctgggctaaaatcaaggtg

SEQ ID NO: 8433444 - DNA, 22 bp, Homo sapiens
tctctgggctaaaatcaaggtg

SEQ ID NO: 8433445 - DNA, 22 bp, Homo sapiens
tctctgggctaaaatcaaggtg

SEQ ID NO: 8433446 - DNA, 22 bp, Homo sapiens
tctctgggctaaaatcaaggtg

SEQ ID NO: 8433447 - DNA, 22 bp, Homo sapiens
tctctgggcctccctttccaag

SEQ ID NO: 8433448 - DNA, 22 bp, Homo sapiens
tctctgggcctgttttctcatc

SEQ ID NO: 8433449 - DNA, 22 bp, Homo sapiens
tctctgggcctccctttccaag

SEQ ID NO: 8433450 - DNA, 22 bp, Homo sapiens
tctctgggctcaggagcccggc

SEQ ID NO: 8433451 - DNA, 22 bp, Homo sapiens
tctctggggaaaaggctgatac

SEQ ID NO: 8433452 - DNA, 19 bp, Homo sapiens
tctctggggacactttcac

SEQ ID NO: 8433453 - DNA, 22 bp, Homo sapiens
tctctggggatgcttattcttg

SEQ ID NO: 8433454 - DNA, 22 bp, Homo sapiens
tctctggggatgcttattcttg

SEQ ID NO: 8433455 - DNA, 22 bp, Homo sapiens
tctctgggtgatggcagggcac

SEQ ID NO: 8433456 - DNA, 23 bp, Homo sapiens
tctctgggtgggctgtgtctata

SEQ ID NO: 8433457 - DNA, 22 bp, Homo sapiens
tctctgggtgatggcagggcac

SEQ ID NO: 8433458 - DNA, 22 bp, Homo sapiens
tctctgggtcctggcaagctca

SEQ ID NO: 8433459 - DNA, 22 bp, Homo sapiens
tctctgggtctcagtttgtaca

SEQ ID NO: 8433460 - DNA, 20 bp, Homo sapiens
tctctgggttctcactcagc

SEQ ID NO: 8433461 - DNA, 20 bp, Homo sapiens
tctctgggttctcactcagc

SEQ ID NO: 8433462 - DNA, 22 bp, Homo sapiens
tctctgggttgagaactaggac

SEQ ID NO: 8433463 - DNA, 22 bp, Homo sapiens
tctctgggttgagaactaggac

SEQ ID NO: 8433464 - DNA, 16 bp, Homo sapiens
tctctgggttgcacag

SEQ ID NO: 8433465 - DNA, 22 bp, Homo sapiens
tctctgggttctcactcagcac

SEQ ID NO: 8433466 - DNA, 22 bp, Homo sapiens
tctctgggttgagaactaggac

SEQ ID NO: 8433467 - DNA, 22 bp, Homo sapiens
tctctggggtagggcccaggac

SEQ ID NO: 8433468 - DNA, 22 bp, Homo sapiens
tctctggggtagggcccaggac

SEQ ID NO: 8433469 - DNA, 22 bp, Homo sapiens
tctctgggtaaagttctctcat

SEQ ID NO: 8433470 - DNA, 22 bp, Homo sapiens
tctctgggtaaagttctctcat

SEQ ID NO: 8433471 - DNA, 22 bp, Homo sapiens
tctctgggtattcactgccttc

SEQ ID NO: 8433472 - DNA, 22 bp, Homo sapiens
tctctgggtatggtaacgttgg

SEQ ID NO: 8433473 - DNA, 22 bp, Homo sapiens
tctctgggtcctggcaagctca

SEQ ID NO: 8433474 - DNA, 22 bp, Homo sapiens
tctctggggcctttctacatca

SEQ ID NO: 8433475 - DNA, 22 bp, Homo sapiens
tctctggggatggacctgggag

SEQ ID NO: 8433476 - DNA, 22 bp, Homo sapiens
tctctggggcctttctacatca

SEQ ID NO: 8433477 - DNA, 22 bp, Homo sapiens
tctctgggggtagaactcaggc

SEQ ID NO: 8433478 - DNA, 22 bp, Homo sapiens
tctctgggggtagaactcaggc

SEQ ID NO: 8433479 - DNA, 22 bp, Homo sapiens
tctctgtgaatggcgtcacctg

SEQ ID NO: 8433480 - DNA, 22 bp, Homo sapiens
tctctgtctgcacccaatcaat

SEQ ID NO: 8433481 - DNA, 22 bp, Homo sapiens
tctctgggtttttgtcctgtac

SEQ ID NO: 8433482 - DNA, 22 bp, Homo sapiens
tctctgggtttttgtcctgtac

SEQ ID NO: 8433483 - DNA, 22 bp, Homo sapiens
tctctggtcccacctggccatt

SEQ ID NO: 8433484 - DNA, 22 bp, Homo sapiens
tctctggtggctccatcagtag

SEQ ID NO: 8433485 - DNA, 22 bp, Homo sapiens
tctctggttatgtcattaagca

SEQ ID NO: 8433486 - DNA, 22 bp, Homo sapiens
tctctgtctgagcctggcagac

SEQ ID NO: 8433487 - DNA, 22 bp, Homo sapiens
tctctgtctgagcctggcagac

SEQ ID NO: 8433488 - DNA, 22 bp, Homo sapiens
tctctgtggcatccactcaact

SEQ ID NO: 8433489 - DNA, 22 bp, Homo sapiens
tctctgtgcttgactttcccat

SEQ ID NO: 8433490 - DNA, 22 bp, Homo sapiens
tctctgtgtcttagtgaaggga

SEQ ID NO: 8433491 - DNA, 22 bp, Homo sapiens
tctctgtgggtttcaccagcgc

SEQ ID NO: 8433492 - DNA, 21 bp, Homo sapiens
tctctgtggtccaatcccagc

SEQ ID NO: 8433493 - DNA, 22 bp, Homo sapiens
tctcttccctttatggtatgtg

SEQ ID NO: 8433494 - DNA, 21 bp, Homo sapiens
tctcttcccatcaggacacta

SEQ ID NO: 8433495 - DNA, 22 bp, Homo sapiens
tctcttccagtaagagtcttta

SEQ ID NO: 8433496 - DNA, 22 bp, Homo sapiens
tctcttccatgtttcagcccca

SEQ ID NO: 8433497 - DNA, 22 bp, Homo sapiens
tctcttctaacactagaaattc

SEQ ID NO: 8433498 - DNA, 22 bp, Homo sapiens
tctcttcctcagcctggggcct

SEQ ID NO: 8433499 - DNA, 21 bp, Homo sapiens
tctcttcctccgcgccgccgc

SEQ ID NO: 8433500 - DNA, 22 bp, Homo sapiens
tctcttctatttgagactattt

SEQ ID NO: 8433501 - DNA, 22 bp, Homo sapiens
tctcttctgaaacctgtcttta

SEQ ID NO: 8433502 - DNA, 22 bp, Homo sapiens
tctgaaagatgagtggtccatt

SEQ ID NO: 8433503 - DNA, 22 bp, Homo sapiens
tctgaaagatgagtggtccatt

SEQ ID NO: 8433504 - DNA, 22 bp, Homo sapiens
tctgaaagcattacagtttatt

SEQ ID NO: 8433505 - DNA, 22 bp, Homo sapiens
tctgaaagcataatttgtccca

SEQ ID NO: 8433506 - DNA, 22 bp, Homo sapiens
tctgaaagccctagtttgtaat

SEQ ID NO: 8433507 - DNA, 18 bp, Homo sapiens
tctgaaagcccttttcca

SEQ ID NO: 8433508 - DNA, 18 bp, Homo sapiens
tctgaaagcaccggtgaa

SEQ ID NO: 8433509 - DNA, 22 bp, Homo sapiens
tctgaaagctagaaaatgctct

SEQ ID NO: 8433510 - DNA, 23 bp, Homo sapiens
tctgaaagggatgctgggcagga

SEQ ID NO: 8433511 - DNA, 22 bp, Homo sapiens
tctgaaagggctaaataatttg

SEQ ID NO: 8433512 - DNA, 22 bp, Homo sapiens
tctgaaagtatctggatctttt

SEQ ID NO: 8433513 - DNA, 22 bp, Homo sapiens
tctgaaagtctgaaacagtgtc

SEQ ID NO: 8433514 - DNA, 22 bp, Homo sapiens
tctgaaagaagggcagtctttt

SEQ ID NO: 8433515 - DNA, 22 bp, Homo sapiens
tctgaaagaagggcagtctttt

SEQ ID NO: 8433516 - DNA, 22 bp, Homo sapiens
tctgaaagagagtacatacagt

SEQ ID NO: 8433517 - DNA, 22 bp, Homo sapiens
tctgaaaatgttgactttgttt

SEQ ID NO: 8433518 - DNA, 22 bp, Homo sapiens
tctgaaagaaagattttgtttc

SEQ ID NO: 8433519 - DNA, 22 bp, Homo sapiens
tctctttgtctgctcttagttg

SEQ ID NO: 8433520 - DNA, 22 bp, Homo sapiens
tctctttgtggccaggagagga

SEQ ID NO: 8433521 - DNA, 22 bp, Homo sapiens
tctctttgtctgctcttagttg

SEQ ID NO: 8433522 - DNA, 22 bp, Homo sapiens
tctctttaaaaatagtgaaata

SEQ ID NO: 8433523 - DNA, 22 bp, Homo sapiens
tctctttaaagactcagagatt

SEQ ID NO: 8433524 - DNA, 18 bp, Homo sapiens
tctctttcctcagtggag

SEQ ID NO: 8433525 - DNA, 21 bp, Homo sapiens
tctctttgggaacattaatca

SEQ ID NO: 8433526 - DNA, 22 bp, Homo sapiens
tctctttgcctgctgccatcca

SEQ ID NO: 8433527 - DNA, 22 bp, Homo sapiens
tctctttgaccctttagctcca

SEQ ID NO: 8433528 - DNA, 22 bp, Homo sapiens
tctgaaatggggctgaagcact

SEQ ID NO: 8433529 - DNA, 22 bp, Homo sapiens
tctgaaattgttagtaaaaatg

SEQ ID NO: 8433530 - DNA, 22 bp, Homo sapiens
tctgaaataggaaagcaaatgg

SEQ ID NO: 8433531 - DNA, 22 bp, Homo sapiens
tctgaagaataggatgttgtgt

SEQ ID NO: 8433532 - DNA, 22 bp, Homo sapiens
tctgaagacatatgatatggtg

SEQ ID NO: 8433533 - DNA, 22 bp, Homo sapiens
tctgaagccacctctgcttgtc

SEQ ID NO: 8433534 - DNA, 17 bp, Homo sapiens
tctgaagccagtctgct

SEQ ID NO: 8433535 - DNA, 22 bp, Homo sapiens
tctgaaggcatcctcactgcaa

SEQ ID NO: 8433536 - DNA, 22 bp, Homo sapiens
tctgaaggcatcctcactgcaa

SEQ ID NO: 8433537 - DNA, 18 bp, Homo sapiens
tctgaaggaatgattcca

SEQ ID NO: 8433538 - DNA, 22 bp, Homo sapiens
tctgaaggttacttctgctcag

SEQ ID NO: 8433539 - DNA, 22 bp, Homo sapiens
tgcaggtgtctccagggcaggt

SEQ ID NO: 8433540 - DNA, 22 bp, Homo sapiens
tgcaggtgtctccagggcaggt

SEQ ID NO: 8433541 - DNA, 22 bp, Homo sapiens
tgcaggtgtctccagggcaggt

SEQ ID NO: 8433542 - DNA, 22 bp, Homo sapiens
tgcaggtgtctccagggcaggt

SEQ ID NO: 8433543 - DNA, 22 bp, Homo sapiens
tgcaggtgtagagttgggctcc

SEQ ID NO: 8433544 - DNA, 22 bp, Homo sapiens
tgcaggtggtttggacactgct

SEQ ID NO: 8433545 - DNA, 22 bp, Homo sapiens
tgcaggtggtccttcctctgct

SEQ ID NO: 8433546 - DNA, 20 bp, Homo sapiens
tgcaggtgggcccttctggg

SEQ ID NO: 8433547 - DNA, 22 bp, Homo sapiens
tgcaggtgtctctgtctagcgt

SEQ ID NO: 8433548 - DNA, 22 bp, Homo sapiens
tgcaggtgtctgggggcaacag

SEQ ID NO: 8433549 - DNA, 22 bp, Homo sapiens
tgcaggtgtctgggggcaacag

SEQ ID NO: 8433550 - DNA, 22 bp, Homo sapiens
tgcaggtgtctgggggcaacag

SEQ ID NO: 8433551 - DNA, 23 bp, Homo sapiens
tgcaggtgtgcagagggctcttg

SEQ ID NO: 8433552 - DNA, 22 bp, Homo sapiens
tgcaggtgtgggcaggggagca

SEQ ID NO: 8433553 - DNA, 22 bp, Homo sapiens
tgcaggtgtgggcaggggagca

SEQ ID NO: 8433554 - DNA, 22 bp, Homo sapiens
tgcaggtgtgtgcaagggaggg

SEQ ID NO: 8433555 - DNA, 22 bp, Homo sapiens
tgcaggtgtgggcaggggagca

SEQ ID NO: 8433556 - DNA, 20 bp, Homo sapiens
tgcaggtgtgtccaagcact

SEQ ID NO: 8433557 - DNA, 22 bp, Homo sapiens
tgcaggtgtggttcctcagcca

SEQ ID NO: 8433558 - DNA, 22 bp, Homo sapiens
tgcaggtgtggttcctcagcca

SEQ ID NO: 8433559 - DNA, 22 bp, Homo sapiens
tgcagtgtgaggtccacatctg

SEQ ID NO: 8433560 - DNA, 22 bp, Homo sapiens
tgcaggttctgaccagccaact

SEQ ID NO: 8433561 - DNA, 22 bp, Homo sapiens
tgcaggtgtgtgcaagggaggg

SEQ ID NO: 8433562 - DNA, 20 bp, Homo sapiens
tgcaggtgttggagaaggta

SEQ ID NO: 8433563 - DNA, 23 bp, Homo sapiens
tgcagtaggatggggctgggcct

SEQ ID NO: 8433564 - DNA, 22 bp, Homo sapiens
tgcagtctctagtttctgaatg

SEQ ID NO: 8433565 - DNA, 22 bp, Homo sapiens
tgcaggggcttgtctgggcctg

SEQ ID NO: 8433566 - DNA, 22 bp, Homo sapiens
tgcagggtagacaggtgaggtc

SEQ ID NO: 8433567 - DNA, 22 bp, Homo sapiens
tgcaggggcttgtctgggcctg

SEQ ID NO: 8433568 - DNA, 22 bp, Homo sapiens
tgcagggtcccgaagggaagac

SEQ ID NO: 8433569 - DNA, 22 bp, Homo sapiens
tgcagggtagatgcaggctgtg

SEQ ID NO: 8433570 - DNA, 22 bp, Homo sapiens
tgcagggtagatgcaggctgtg

SEQ ID NO: 8433571 - DNA, 22 bp, Homo sapiens
tgcagggtggagcggaagcgga

SEQ ID NO: 8433572 - DNA, 22 bp, Homo sapiens
tgcagggcttcctcttggagtt

SEQ ID NO: 8433573 - DNA, 23 bp, Homo sapiens
tgcaggggaggcttaaagcaggt

SEQ ID NO: 8433574 - DNA, 23 bp, Homo sapiens
tgcaggggaggcttaaagcaggt

SEQ ID NO: 8433575 - DNA, 19 bp, Homo sapiens
tgcagggctgcgcctgggg

SEQ ID NO: 8433576 - DNA, 20 bp, Homo sapiens
tgcagggctgcctcccagct

SEQ ID NO: 8433577 - DNA, 20 bp, Homo sapiens
tgcagggctctgcttctctc

SEQ ID NO: 8433578 - DNA, 22 bp, Homo sapiens
tgcagggtgtccggaggatcac

SEQ ID NO: 8433579 - DNA, 22 bp, Homo sapiens
tgcaggtcatgtggcgggactg

SEQ ID NO: 8433580 - DNA, 22 bp, Homo sapiens
tgcaggtctccattggcagact

SEQ ID NO: 8433581 - DNA, 22 bp, Homo sapiens
tgcaggtgagtgcaggggctca

SEQ ID NO: 8433582 - DNA, 22 bp, Homo sapiens
tgcaggtgagtgcaggggctca

SEQ ID NO: 8433583 - DNA, 22 bp, Homo sapiens
tgcaggtgagtgcaggggctca

SEQ ID NO: 8433584 - DNA, 22 bp, Homo sapiens
tgcaggtgaaaattatgaggat

SEQ ID NO: 8433585 - DNA, 22 bp, Homo sapiens
tgcaggtgaaaattatgaggat

SEQ ID NO: 8433586 - DNA, 22 bp, Homo sapiens
tgcaggtctctgcaaggcctat

SEQ ID NO: 8433587 - DNA, 22 bp, Homo sapiens
tgcaggtctctgcaaggcctat

SEQ ID NO: 8433588 - DNA, 22 bp, Homo sapiens
tgcaggtggattcaatgtggga

SEQ ID NO: 8433589 - DNA, 22 bp, Homo sapiens
tgcaggtggattcaatgtggga

SEQ ID NO: 8433590 - DNA, 22 bp, Homo sapiens
tgcaggtggattcaatgtggga

SEQ ID NO: 8433591 - DNA, 22 bp, Homo sapiens
tgcaggtggcagcggggcacca

SEQ ID NO: 8433592 - DNA, 22 bp, Homo sapiens
tgcaggtggcagcggggcacca

SEQ ID NO: 8433593 - DNA, 22 bp, Homo sapiens
tgcaggtggctccagggactgc

SEQ ID NO: 8433594 - DNA, 22 bp, Homo sapiens
tgcaggtggctccagggactgc

SEQ ID NO: 8433595 - DNA, 22 bp, Homo sapiens
tgcaggtgattctgatgcagtt

SEQ ID NO: 8433596 - DNA, 22 bp, Homo sapiens
tgcaggtgattctgatgcagtt

SEQ ID NO: 8433597 - DNA, 22 bp, Homo sapiens
tgcaggtggacacgggagacgg

SEQ ID NO: 8433598 - DNA, 22 bp, Homo sapiens
tgcaggtgcagcgatactgtga

SEQ ID NO: 8433599 - DNA, 22 bp, Homo sapiens
tgcaggtggacacgggagacgg

SEQ ID NO: 8433600 - DNA, 22 bp, Homo sapiens
tgcaggtggatatctcatcaga

SEQ ID NO: 8433601 - DNA, 22 bp, Homo sapiens
tgcagggattagaggccgggga

SEQ ID NO: 8433602 - DNA, 22 bp, Homo sapiens
tgcagggattatgtaggggttg

SEQ ID NO: 8433603 - DNA, 22 bp, Homo sapiens
tgcagggcacacgcacgggtgt

SEQ ID NO: 8433604 - DNA, 22 bp, Homo sapiens
tgcagggcagtggaggttgagt

SEQ ID NO: 8433605 - DNA, 22 bp, Homo sapiens
tgcagggcagctagggagcttt

SEQ ID NO: 8433606 - DNA, 22 bp, Homo sapiens
tgcagggcatctttgaagtgtg

SEQ ID NO: 8433607 - DNA, 22 bp, Homo sapiens
tgcagggccagactgggttgga

SEQ ID NO: 8433608 - DNA, 22 bp, Homo sapiens
tgcagggccatggtggcggctg

SEQ ID NO: 8433609 - DNA, 22 bp, Homo sapiens
tgcagggctacaggactacaac

SEQ ID NO: 8433610 - DNA, 22 bp, Homo sapiens
tgcagggccgctggaggtcatg

SEQ ID NO: 8433611 - DNA, 22 bp, Homo sapiens
tgcagggccgctggaggtcatg

SEQ ID NO: 8433612 - DNA, 22 bp, Homo sapiens
tgcagggctcctggctccaatc

SEQ ID NO: 8433613 - DNA, 22 bp, Homo sapiens
tgcagggcccttggggttgaac

SEQ ID NO: 8433614 - DNA, 22 bp, Homo sapiens
tgcagggcccctctgcatgagt

SEQ ID NO: 8433615 - DNA, 22 bp, Homo sapiens
tgcagggcccctctgcatgagt

SEQ ID NO: 8433616 - DNA, 22 bp, Homo sapiens
tgcagggaaagtgttggcagca

SEQ ID NO: 8433617 - DNA, 22 bp, Homo sapiens
tgcagggaaagggcactgggct

SEQ ID NO: 8433618 - DNA, 22 bp, Homo sapiens
tgcagggaagcaagggtggctc

SEQ ID NO: 8433619 - DNA, 21 bp, Homo sapiens
tgcaggctgtttaagaggcaa

SEQ ID NO: 8433620 - DNA, 17 bp, Homo sapiens
tgcaggctgttatagcc

SEQ ID NO: 8433621 - DNA, 21 bp, Homo sapiens
tgcaggctgtgcgctcctgcc

SEQ ID NO: 8433622 - DNA, 21 bp, Homo sapiens
tgcaggctgtgcgctcctgcc

SEQ ID NO: 8433623 - DNA, 21 bp, Homo sapiens
tgcaggctgtgcgctcctgcc

SEQ ID NO: 8433624 - DNA, 22 bp, Homo sapiens
tgcaggctccatgaggacaggc

SEQ ID NO: 8433625 - DNA, 22 bp, Homo sapiens
tgcaggctccatgaggacaggc

SEQ ID NO: 8433626 - DNA, 22 bp, Homo sapiens
tgcaggctgcagtctcaggtgg

SEQ ID NO: 8433627 - DNA, 22 bp, Homo sapiens
tgcaggctctgtgtgtgcctgg

SEQ ID NO: 8433628 - DNA, 22 bp, Homo sapiens
tgcaggctcttggtgacgtggg

SEQ ID NO: 8433629 - DNA, 22 bp, Homo sapiens
tgcaggctgctggcagtagctt

SEQ ID NO: 8433630 - DNA, 22 bp, Homo sapiens
tgcaggctgccttcacagagcc

SEQ ID NO: 8433631 - DNA, 22 bp, Homo sapiens
tgcaggctgctggcagtagctt

SEQ ID NO: 8433632 - DNA, 22 bp, Homo sapiens
tgcaggctggggaggcagactt

SEQ ID NO: 8433633 - DNA, 22 bp, Homo sapiens
tgcaggctgggaagagggacaa

SEQ ID NO: 8433634 - DNA, 22 bp, Homo sapiens
tgcaggctggcagtgctgaaat

SEQ ID NO: 8433635 - DNA, 22 bp, Homo sapiens
tgcaggctggggaggcagactt

SEQ ID NO: 8433636 - DNA, 22 bp, Homo sapiens
tgcattttacttacctgttagt

SEQ ID NO: 8433637 - DNA, 22 bp, Homo sapiens
tgcattttacttacctgttagt

SEQ ID NO: 8433638 - DNA, 22 bp, Homo sapiens
tgccaaaatggccaaaagctag

SEQ ID NO: 8433639 - DNA, 22 bp, Homo sapiens
tgcatttttgaggttaactcaa

SEQ ID NO: 8433640 - DNA, 22 bp, Homo sapiens
tgccaaattagagttcccaggc

SEQ ID NO: 8433641 - DNA, 22 bp, Homo sapiens
tgcatttagttttaataaagga

SEQ ID NO: 8433642 - DNA, 22 bp, Homo sapiens
tgcatttatggagcaaggcagt

SEQ ID NO: 8433643 - DNA, 22 bp, Homo sapiens
tgcatttccagatttctggagt

SEQ ID NO: 8433644 - DNA, 22 bp, Homo sapiens
tgcattggaaaactatggctca

SEQ ID NO: 8433645 - DNA, 22 bp, Homo sapiens
tgcattggtcttaatcttcagg

SEQ ID NO: 8433646 - DNA, 22 bp, Homo sapiens
tgcattggtcatttagaaaata

SEQ ID NO: 8433647 - DNA, 22 bp, Homo sapiens
tgcatttacctggaggtcattt

SEQ ID NO: 8433648 - DNA, 22 bp, Homo sapiens
tgcatttagttatgagaaaaac

SEQ ID NO: 8433649 - DNA, 22 bp, Homo sapiens
tgccacatggtgcatttcctag

SEQ ID NO: 8433650 - DNA, 22 bp, Homo sapiens
tgccaccaggagaaccagtgca

SEQ ID NO: 8433651 - DNA, 22 bp, Homo sapiens
tgccaccctggcggcagcctgc

SEQ ID NO: 8433652 - DNA, 22 bp, Homo sapiens
tgccacccctctgcaccctcag

SEQ ID NO: 8433653 - DNA, 22 bp, Homo sapiens
tgccagactttcttaccagtgt

SEQ ID NO: 8433654 - DNA, 22 bp, Homo sapiens
tgccagagaagacccagtcact

SEQ ID NO: 8433655 - DNA, 22 bp, Homo sapiens
tgccactggggctaggactgtt

SEQ ID NO: 8433656 - DNA, 22 bp, Homo sapiens
tgccagaacagctcatctggcc

SEQ ID NO: 8433657 - DNA, 22 bp, Homo sapiens
tgccagccagggaagctcaccc

SEQ ID NO: 8433658 - DNA, 22 bp, Homo sapiens
tgccagcccaccttggggcctc

SEQ ID NO: 8433659 - DNA, 22 bp, Homo sapiens
tgccagcccaccttggggcctc

SEQ ID NO: 8433660 - DNA, 22 bp, Homo sapiens
tgccagccaggttctgaggcta

SEQ ID NO: 8433661 - DNA, 22 bp, Homo sapiens
tgccagccaggttctgaggcta

SEQ ID NO: 8433662 - DNA, 22 bp, Homo sapiens
tgccagccaggttctgaggcta

SEQ ID NO: 8433663 - DNA, 22 bp, Homo sapiens
tgccagattgtggcatggcact

SEQ ID NO: 8433664 - DNA, 22 bp, Homo sapiens
tgccagagttacatgagggtca

SEQ ID NO: 8433665 - DNA, 22 bp, Homo sapiens
tgccagagttacatgagggtca

SEQ ID NO: 8433666 - DNA, 22 bp, Homo sapiens
tgccagcacttctggctgtctg

SEQ ID NO: 8433667 - DNA, 22 bp, Homo sapiens
tgcatctttctgcatatgtaaa

SEQ ID NO: 8433668 - DNA, 22 bp, Homo sapiens
tgcatgaacggagggtaagctg

SEQ ID NO: 8433669 - DNA, 22 bp, Homo sapiens
tgcatcttacgttttgaaaggg

SEQ ID NO: 8433670 - DNA, 22 bp, Homo sapiens
tgcatctgttcagagctgtcga

SEQ ID NO: 8433671 - DNA, 22 bp, Homo sapiens
tgcatgcatgctactgggaggt

SEQ ID NO: 8433672 - DNA, 22 bp, Homo sapiens
tgcattccatgtgtttcctgag

SEQ ID NO: 8433673 - DNA, 22 bp, Homo sapiens
tgcatgtgtcgggcctgtgcta

SEQ ID NO: 8433674 - DNA, 22 bp, Homo sapiens
tgcatgtggacccctggtgcct

SEQ ID NO: 8433675 - DNA, 17 bp, Homo sapiens
tgcatgtcctttgttcc

SEQ ID NO: 8433676 - DNA, 20 bp, Homo sapiens
tgcatggcgcacatctgtgg

SEQ ID NO: 8433677 - DNA, 21 bp, Homo sapiens
tgcataaagaaatacaaatac

SEQ ID NO: 8433678 - DNA, 22 bp, Homo sapiens
tgcataaagtgccatagtatta

SEQ ID NO: 8433679 - DNA, 19 bp, Homo sapiens
tgcataaattatatacttt

SEQ ID NO: 8433680 - DNA, 19 bp, Homo sapiens
tgcataaattatatacttt

SEQ ID NO: 8433681 - DNA, 22 bp, Homo sapiens
tgcagttagcctaggattgagc

SEQ ID NO: 8433682 - DNA, 22 bp, Homo sapiens
tgcagttttgccaggcaatgga

SEQ ID NO: 8433683 - DNA, 22 bp, Homo sapiens
tgcagttttggccattgaaggc

SEQ ID NO: 8433684 - DNA, 22 bp, Homo sapiens
tgcataaaacatgatttctgct

SEQ ID NO: 8433685 - DNA, 22 bp, Homo sapiens
tgcatacacatgtgcacatacg

SEQ ID NO: 8433686 - DNA, 22 bp, Homo sapiens
tgcatacacacataggtatggg

SEQ ID NO: 8433687 - DNA, 22 bp, Homo sapiens
tgcatacacttcaaatgagcat

SEQ ID NO: 8433688 - DNA, 19 bp, Homo sapiens
tgcatacatgttaacatgt

SEQ ID NO: 8433689 - DNA, 19 bp, Homo sapiens
tgcatacatgttaacatgt

SEQ ID NO: 8433690 - DNA, 22 bp, Homo sapiens
tgcatacataaagtgctatcat

SEQ ID NO: 8433691 - DNA, 22 bp, Homo sapiens
tgcatacacaagcatacatgta

SEQ ID NO: 8433692 - DNA, 22 bp, Homo sapiens
tgcataactagagtaattacag

SEQ ID NO: 8433693 - DNA, 22 bp, Homo sapiens
tgcatatacccgcatttacata

SEQ ID NO: 8433694 - DNA, 22 bp, Homo sapiens
tgcatatacccgcatttacata

SEQ ID NO: 8433695 - DNA, 22 bp, Homo sapiens
tgcatagggttcaaaggctgta

SEQ ID NO: 8433696 - DNA, 22 bp, Homo sapiens
tgcatagggaacctcatgcatt

SEQ ID NO: 8433697 - DNA, 22 bp, Homo sapiens
tgcatagaggatccagtgtggt

SEQ ID NO: 8433698 - DNA, 22 bp, Homo sapiens
tgcatcagtgactgaatatgag

SEQ ID NO: 8433699 - DNA, 22 bp, Homo sapiens
tgcatcagagtttgctgctgct

SEQ ID NO: 8433700 - DNA, 22 bp, Homo sapiens
tgcatcagagtttgctgctgct

SEQ ID NO: 8433701 - DNA, 22 bp, Homo sapiens
tgcatatacccgcatttacata

SEQ ID NO: 8433702 - DNA, 22 bp, Homo sapiens
tgcatctgattctcaggcagaa

SEQ ID NO: 8433703 - DNA, 22 bp, Homo sapiens
tgcatctgattctcaggcagaa

SEQ ID NO: 8433704 - DNA, 22 bp, Homo sapiens
tgcatctggcctttgctggcta

SEQ ID NO: 8433705 - DNA, 20 bp, Homo sapiens
tgcccagcaagagtgcagtt

SEQ ID NO: 8433706 - DNA, 20 bp, Homo sapiens
tgcccagcaagagtgcagtt

SEQ ID NO: 8433707 - DNA, 19 bp, Homo sapiens
tgcccagagtgtatgcgca

SEQ ID NO: 8433708 - DNA, 22 bp, Homo sapiens
tgcccagagcctcttacctcca

SEQ ID NO: 8433709 - DNA, 22 bp, Homo sapiens
tgcccagagcctgagaggatta

SEQ ID NO: 8433710 - DNA, 18 bp, Homo sapiens
tgcccagaaaagcaggga

SEQ ID NO: 8433711 - DNA, 22 bp, Homo sapiens
tgcccagaatagatgggctgtg

SEQ ID NO: 8433712 - DNA, 22 bp, Homo sapiens
tgcccagaatagatgggctgtg

SEQ ID NO: 8433713 - DNA, 22 bp, Homo sapiens
tgcccacattcaaaaggtgatg

SEQ ID NO: 8433714 - DNA, 18 bp, Homo sapiens
tgcccaccagaagaggga

SEQ ID NO: 8433715 - DNA, 22 bp, Homo sapiens
tgcccagcacccagcatgatgc

SEQ ID NO: 8433716 - DNA, 22 bp, Homo sapiens
tgcccagcacccagcatgatgc

SEQ ID NO: 8433717 - DNA, 22 bp, Homo sapiens
tgcccagcacccagcatgatgc

SEQ ID NO: 8433718 - DNA, 22 bp, Homo sapiens
tgcccagcacccagcatgatgc

SEQ ID NO: 8433719 - DNA, 22 bp, Homo sapiens
tgcccagcaataaaccagaaga

SEQ ID NO: 8433720 - DNA, 22 bp, Homo sapiens
tgcccagcagggagctacctgg

SEQ ID NO: 8433721 - DNA, 22 bp, Homo sapiens
tgcccaggatctggcgatgctc

SEQ ID NO: 8433722 - DNA, 22 bp, Homo sapiens
tgcccagcactgtgccagtcac

SEQ ID NO: 8433723 - DNA, 22 bp, Homo sapiens
tgcccagcactgtgccagtcac

SEQ ID NO: 8433724 - DNA, 22 bp, Homo sapiens
tgccatttgccccagcactgtc

SEQ ID NO: 8433725 - DNA, 22 bp, Homo sapiens
tgccatttaaaaatgaccaaat

SEQ ID NO: 8433726 - DNA, 22 bp, Homo sapiens
tgccatttataaccagtggcct

SEQ ID NO: 8433727 - DNA, 20 bp, Homo sapiens
tgcccacatcactcaggagt

SEQ ID NO: 8433728 - DNA, 22 bp, Homo sapiens
tgcccaggctggagtgcagtgg

SEQ ID NO: 8433729 - DNA, 22 bp, Homo sapiens
tgcccaggctggagtgcagagg

SEQ ID NO: 8433730 - DNA, 22 bp, Homo sapiens
tgcccaggctggagtgcagagg

SEQ ID NO: 8433731 - DNA, 22 bp, Homo sapiens
tgcccagggataagcctagaga

SEQ ID NO: 8433732 - DNA, 22 bp, Homo sapiens
tgcccagggataagcctagaga

SEQ ID NO: 8433733 - DNA, 22 bp, Homo sapiens
tgcccaggcttcaccctcagag

SEQ ID NO: 8433734 - DNA, 22 bp, Homo sapiens
tgcccagggtggagtgcagcgg

SEQ ID NO: 8433735 - DNA, 19 bp, Homo sapiens
tgcccaggcctcccaaaag

SEQ ID NO: 8433736 - DNA, 22 bp, Homo sapiens
tgcccaggctggaatgcagtgg

SEQ ID NO: 8433737 - DNA, 19 bp, Homo sapiens
tgcccaggcctcccaaaag

SEQ ID NO: 8433738 - DNA, 22 bp, Homo sapiens
tgcccaggattgtgaggtcagg

SEQ ID NO: 8433739 - DNA, 20 bp, Homo sapiens
tgccccaggcctgcacctgc

SEQ ID NO: 8433740 - DNA, 20 bp, Homo sapiens
tgccccaggcctgcacctgc

SEQ ID NO: 8433741 - DNA, 22 bp, Homo sapiens
tgccccagactctgctcacctc

SEQ ID NO: 8433742 - DNA, 22 bp, Homo sapiens
tgccccagacctactgaatggg

SEQ ID NO: 8433743 - DNA, 21 bp, Homo sapiens
tgcccatgagcagaagtcacc

SEQ ID NO: 8433744 - DNA, 22 bp, Homo sapiens
tgcccctcagggaacgggtatc

SEQ ID NO: 8433745 - DNA, 22 bp, Homo sapiens
tgcccaggtttgagtgcccaag

SEQ ID NO: 8433746 - DNA, 22 bp, Homo sapiens
tgcccaggtttgagtgcccaag

SEQ ID NO: 8433747 - DNA, 22 bp, Homo sapiens
tgcccagtctccgggccagccc

SEQ ID NO: 8433748 - DNA, 22 bp, Homo sapiens
tgcccaggtttgagtgcccaag

SEQ ID NO: 8433749 - DNA, 22 bp, Homo sapiens
tgcccaggtttgagtgcccaag

SEQ ID NO: 8433750 - DNA, 22 bp, Homo sapiens
tgcccatggaccaagcaagggg

SEQ ID NO: 8433751 - DNA, 23 bp, Homo sapiens
tgcccagtgcctttgcccatgca

SEQ ID NO: 8433752 - DNA, 22 bp, Homo sapiens
tgcccagggtttctaagagcag

SEQ ID NO: 8433753 - DNA, 22 bp, Homo sapiens
tgcccagggtttctaagagcag

SEQ ID NO: 8433754 - DNA, 22 bp, Homo sapiens
tgcccagggtggagtgcagtgg

SEQ ID NO: 8433755 - DNA, 22 bp, Homo sapiens
tgccatcttctctggggatgtt

SEQ ID NO: 8433756 - DNA, 23 bp, Homo sapiens
tgccagggtttgtttgtggttca

SEQ ID NO: 8433757 - DNA, 22 bp, Homo sapiens
tgccaggtacacaagtagccag

SEQ ID NO: 8433758 - DNA, 22 bp, Homo sapiens
tgccagggtgtcaggagagcta

SEQ ID NO: 8433759 - DNA, 22 bp, Homo sapiens
tgccagggtgtcaggagagcta

SEQ ID NO: 8433760 - DNA, 22 bp, Homo sapiens
tgccagggtgtcaggagagcta

SEQ ID NO: 8433761 - DNA, 22 bp, Homo sapiens
tgccagggccatagggagtcta

SEQ ID NO: 8433762 - DNA, 22 bp, Homo sapiens
tgccagggccatagggagtcta

SEQ ID NO: 8433763 - DNA, 22 bp, Homo sapiens
tgccagggtcctgagggccttg

SEQ ID NO: 8433764 - DNA, 22 bp, Homo sapiens
tgccaggggacctagggatgtc

SEQ ID NO: 8433765 - DNA, 22 bp, Homo sapiens
tgccaggggacctagggatgtc

SEQ ID NO: 8433766 - DNA, 22 bp, Homo sapiens
tgccagggtcagctgcagctct

SEQ ID NO: 8433767 - DNA, 20 bp, Homo sapiens
tgccagggccagcagaggct

SEQ ID NO: 8433768 - DNA, 20 bp, Homo sapiens
tgccagggccagcagaggct

SEQ ID NO: 8433769 - DNA, 20 bp, Homo sapiens
tgccagggccagcagaggct

SEQ ID NO: 8433770 - DNA, 21 bp, Homo sapiens
tgccagggatttacagagcct

SEQ ID NO: 8433771 - DNA, 22 bp, Homo sapiens
tgccaggctttggtcaaaggct

SEQ ID NO: 8433772 - DNA, 22 bp, Homo sapiens
tgccaggcttagagcaggggct

SEQ ID NO: 8433773 - DNA, 22 bp, Homo sapiens
tgccaggctgtcaattcaccca

SEQ ID NO: 8433774 - DNA, 22 bp, Homo sapiens
tgccaggctgtcctgggcctgg

SEQ ID NO: 8433775 - DNA, 22 bp, Homo sapiens
tgccaggctgccctccagtctg

SEQ ID NO: 8433776 - DNA, 22 bp, Homo sapiens
tgccaggctcaggatgtccctg

SEQ ID NO: 8433777 - DNA, 22 bp, Homo sapiens
tgccaggctccggaacgacagt

SEQ ID NO: 8433778 - DNA, 22 bp, Homo sapiens
tgccaggctccggaacgacagt

SEQ ID NO: 8433779 - DNA, 20 bp, Homo sapiens
tgccaggctgcacgcctgcc

SEQ ID NO: 8433780 - DNA, 22 bp, Homo sapiens
tgccaggctgaacagggtctta

SEQ ID NO: 8433781 - DNA, 22 bp, Homo sapiens
tgccaggctcagcccctatctt

SEQ ID NO: 8433782 - DNA, 22 bp, Homo sapiens
tgccaggctaagtggaggactt

SEQ ID NO: 8433783 - DNA, 22 bp, Homo sapiens
tgccaggccctgtgctggatgc

SEQ ID NO: 8433784 - DNA, 22 bp, Homo sapiens
tgccaggccctgcggggtccca

SEQ ID NO: 8433785 - DNA, 22 bp, Homo sapiens
tgccaggccctcccacagatta

SEQ ID NO: 8433786 - DNA, 22 bp, Homo sapiens
tgccaggccctcccacagatta

SEQ ID NO: 8433787 - DNA, 22 bp, Homo sapiens
tgccaggcccagctccagagct

SEQ ID NO: 8433788 - DNA, 22 bp, Homo sapiens
tgccaggcccagctccagagct

SEQ ID NO: 8433789 - DNA, 22 bp, Homo sapiens
tgccaggcccagctccagagct

SEQ ID NO: 8433790 - DNA, 22 bp, Homo sapiens
tgccaggcccagcagggcggcc

SEQ ID NO: 8433791 - DNA, 22 bp, Homo sapiens
tgccaggccacgtagcttcaag

SEQ ID NO: 8433792 - DNA, 22 bp, Homo sapiens
tgccaggcatttgacagacact

SEQ ID NO: 8433793 - DNA, 22 bp, Homo sapiens
tgccaggccaatgaaggcaggg

SEQ ID NO: 8433794 - DNA, 22 bp, Homo sapiens
tgccaggcaactgcccagccat

SEQ ID NO: 8433795 - DNA, 17 bp, Homo sapiens
tgccagcctgtcccagg

SEQ ID NO: 8433796 - DNA, 22 bp, Homo sapiens
tgccagcctggcctgagtcttt

SEQ ID NO: 8433797 - DNA, 22 bp, Homo sapiens
tgccagcctggcctgagtcttt

SEQ ID NO: 8433798 - DNA, 22 bp, Homo sapiens
tgccagcctggcctgagtcttt

SEQ ID NO: 8433799 - DNA, 18 bp, Homo sapiens
tgccagccgactggcctg

SEQ ID NO: 8433800 - DNA, 22 bp, Homo sapiens
tgccagcccaccttggggcctc

SEQ ID NO: 8433801 - DNA, 18 bp, Homo sapiens
tgccagccgactggcctg

SEQ ID NO: 8433802 - DNA, 22 bp, Homo sapiens
tgccaggcatgtagtagacttg

SEQ ID NO: 8433803 - DNA, 22 bp, Homo sapiens
tgccaggcatatggcctctttg

SEQ ID NO: 8433804 - DNA, 22 bp, Homo sapiens
tgccaggcatatggcctctttg

SEQ ID NO: 8433805 - DNA, 22 bp, Homo sapiens
tgccaggcagtgtcagattgag

SEQ ID NO: 8433806 - DNA, 22 bp, Homo sapiens
tgccaggcagtgtcagattgag

SEQ ID NO: 8433807 - DNA, 22 bp, Homo sapiens
tgccaggcacgtgagagtggcc

SEQ ID NO: 8433808 - DNA, 20 bp, Homo sapiens
tgccaggcacggagtgcatg

SEQ ID NO: 8433809 - DNA, 22 bp, Homo sapiens
tgccaggcaggaccctagaacc

SEQ ID NO: 8433810 - DNA, 22 bp, Homo sapiens
tgccaggcacgtgagagtggcc

SEQ ID NO: 8433811 - DNA, 22 bp, Homo sapiens
tgcctcagtctaaagtctctca

SEQ ID NO: 8433812 - DNA, 19 bp, Homo sapiens
tgcctcagggctttgagga

SEQ ID NO: 8433813 - DNA, 19 bp, Homo sapiens
tgcctcagggctttgagga

SEQ ID NO: 8433814 - DNA, 22 bp, Homo sapiens
tgcctcagagtgggcttgctat

SEQ ID NO: 8433815 - DNA, 22 bp, Homo sapiens
tgcctcagctgaggccgctcca

SEQ ID NO: 8433816 - DNA, 22 bp, Homo sapiens
tgcctccctctctgccactgga

SEQ ID NO: 8433817 - DNA, 22 bp, Homo sapiens
tgcctctgcctccattgttagt

SEQ ID NO: 8433818 - DNA, 22 bp, Homo sapiens
tgcctctctaacccatgcccaa

SEQ ID NO: 8433819 - DNA, 22 bp, Homo sapiens
tgcctctgctgctgtggcatca

SEQ ID NO: 8433820 - DNA, 23 bp, Homo sapiens
tgcctctgcctccctagtctgca

SEQ ID NO: 8433821 - DNA, 22 bp, Homo sapiens
tgcctcttggagcctttcctct

SEQ ID NO: 8433822 - DNA, 22 bp, Homo sapiens
tgcctctgtgtgcaggtgagca

SEQ ID NO: 8433823 - DNA, 22 bp, Homo sapiens
tgcctctgtgtgcaggtgagca

SEQ ID NO: 8433824 - DNA, 22 bp, Homo sapiens
tgcctgaagctgcattcctagt

SEQ ID NO: 8433825 - DNA, 22 bp, Homo sapiens
tgcctgaacatgaatagtttat

SEQ ID NO: 8433826 - DNA, 22 bp, Homo sapiens
tgcctgaggagtcagggcaggt

SEQ ID NO: 8433827 - DNA, 22 bp, Homo sapiens
tgcctgagtgatgtggcagcca

SEQ ID NO: 8433828 - DNA, 22 bp, Homo sapiens
tgcctgagggagtaagagtcct

SEQ ID NO: 8433829 - DNA, 22 bp, Homo sapiens
tgcctctggcctttggtgccca

SEQ ID NO: 8433830 - DNA, 22 bp, Homo sapiens
tgcctctggttatctggtacct

SEQ ID NO: 8433831 - DNA, 22 bp, Homo sapiens
tgcctctgtggaaatggtggtc

SEQ ID NO: 8433832 - DNA, 22 bp, Homo sapiens
tgcctctgtgggccttcctggc

SEQ ID NO: 8433833 - DNA, 22 bp, Homo sapiens
tgcctctgtggaaatggtggtc

SEQ ID NO: 8433834 - DNA, 22 bp, Homo sapiens
tgcctctgtgggcagagctgcc

SEQ ID NO: 8433835 - DNA, 22 bp, Homo sapiens
tgcctgatgcaggagtatcaga

SEQ ID NO: 8433836 - DNA, 22 bp, Homo sapiens
tgcctgcaagagttggggctac

SEQ ID NO: 8433837 - DNA, 22 bp, Homo sapiens
tgcctgcattttgtggctggct

SEQ ID NO: 8433838 - DNA, 22 bp, Homo sapiens
tgcctgcattttgtggctggct

SEQ ID NO: 8433839 - DNA, 22 bp, Homo sapiens
tgcctgccacgcttgctaccac

SEQ ID NO: 8433840 - DNA, 22 bp, Homo sapiens
tgcctgccaatgatgcttgtgt

SEQ ID NO: 8433841 - DNA, 17 bp, Homo sapiens
tgcctgccagcattgga

SEQ ID NO: 8433842 - DNA, 17 bp, Homo sapiens
tgcctgccagcattgga

SEQ ID NO: 8433843 - DNA, 22 bp, Homo sapiens
tgcctgccaggcaacctgggag

SEQ ID NO: 8433844 - DNA, 22 bp, Homo sapiens
tgcctgcccacgactacagcag

SEQ ID NO: 8433845 - DNA, 22 bp, Homo sapiens
tgcctgcccacgactacagcag

SEQ ID NO: 8433846 - DNA, 22 bp, Homo sapiens
tgcctgccccacaaggggttgc

SEQ ID NO: 8433847 - DNA, 22 bp, Homo sapiens
tgcctggcaagaggggctggct

SEQ ID NO: 8433848 - DNA, 22 bp, Homo sapiens
tgcctggcaagaggggctggct

SEQ ID NO: 8433849 - DNA, 22 bp, Homo sapiens
tgcctggcaatgccagaagcca

SEQ ID NO: 8433850 - DNA, 22 bp, Homo sapiens
tgcctggcacagagcaggtggc

SEQ ID NO: 8433851 - DNA, 19 bp, Homo sapiens
tgcctggcaccagctccac

SEQ ID NO: 8433852 - DNA, 19 bp, Homo sapiens
tgcctggcaccagctccac

SEQ ID NO: 8433853 - DNA, 22 bp, Homo sapiens
tgcctggcatctagccctggga

SEQ ID NO: 8433854 - DNA, 22 bp, Homo sapiens
tgcctggcaccccagtctgcac

SEQ ID NO: 8433855 - DNA, 22 bp, Homo sapiens
tgcctggcaccccagtctgcac

SEQ ID NO: 8433856 - DNA, 22 bp, Homo sapiens
tgcctggcagcttgaaagaaat

SEQ ID NO: 8433857 - DNA, 22 bp, Homo sapiens
tgcctggcactcctggagctca

SEQ ID NO: 8433858 - DNA, 22 bp, Homo sapiens
tgcctagccttcttcatgccat

SEQ ID NO: 8433859 - DNA, 22 bp, Homo sapiens
tgcctattcaatatatgcattt

SEQ ID NO: 8433860 - DNA, 22 bp, Homo sapiens
tgcctcaagccctccactgcac

SEQ ID NO: 8433861 - DNA, 22 bp, Homo sapiens
tgcctcagagacctgacagtac

SEQ ID NO: 8433862 - DNA, 22 bp, Homo sapiens
tgcctcaagccctccactgcac

SEQ ID NO: 8433863 - DNA, 22 bp, Homo sapiens
tgccgtgtcccattgtgctctg

SEQ ID NO: 8433864 - DNA, 23 bp, Homo sapiens
tgccgtgttagaaatgttttaca

SEQ ID NO: 8433865 - DNA, 22 bp, Homo sapiens
tgcctactagtactattttgtg

SEQ ID NO: 8433866 - DNA, 22 bp, Homo sapiens
tgccgtggggctgaggctggag

SEQ ID NO: 8433867 - DNA, 22 bp, Homo sapiens
tgccgtggggctgaggctggag

SEQ ID NO: 8433868 - DNA, 22 bp, Homo sapiens
tgccgcagtgcggggagggccc

SEQ ID NO: 8433869 - DNA, 22 bp, Homo sapiens
tgccctgggaacacagatgcca

SEQ ID NO: 8433870 - DNA, 22 bp, Homo sapiens
tgccctgggaggctttcctgtt

SEQ ID NO: 8433871 - DNA, 22 bp, Homo sapiens
tgccctgggaacacagatgcca

SEQ ID NO: 8433872 - DNA, 22 bp, Homo sapiens
tgccctgggaacacagatgcca

SEQ ID NO: 8433873 - DNA, 22 bp, Homo sapiens
tgccctgttcctgcctccagct

SEQ ID NO: 8433874 - DNA, 22 bp, Homo sapiens
tgccctgtgtgtgcaagcactg

SEQ ID NO: 8433875 - DNA, 22 bp, Homo sapiens
tgccctgtgtgtgcaagcactg

SEQ ID NO: 8433876 - DNA, 22 bp, Homo sapiens
tgccctgtgggtatctgatggc

SEQ ID NO: 8433877 - DNA, 22 bp, Homo sapiens
tgccctgtggggatttccagcc

SEQ ID NO: 8433878 - DNA, 22 bp, Homo sapiens
tgccctgtgccagacttcctgg

SEQ ID NO: 8433879 - DNA, 22 bp, Homo sapiens
tgccctggctctccactagttt

SEQ ID NO: 8433880 - DNA, 22 bp, Homo sapiens
tgccctggctcttcttgttcca

SEQ ID NO: 8433881 - DNA, 22 bp, Homo sapiens
tgccctggctctccactagttt

SEQ ID NO: 8433882 - DNA, 22 bp, Homo sapiens
tgccctggctcctcccacgctg

SEQ ID NO: 8433883 - DNA, 22 bp, Homo sapiens
tgccctggctcctcccacgctg

SEQ ID NO: 8433884 - DNA, 22 bp, Homo sapiens
tgccctggcacacacacagctg

SEQ ID NO: 8433885 - DNA, 22 bp, Homo sapiens
tgccctggcacacacacagctg

SEQ ID NO: 8433886 - DNA, 22 bp, Homo sapiens
tgccctggcattgggttggata

SEQ ID NO: 8433887 - DNA, 22 bp, Homo sapiens
tgccctggagtcagtggctatt

SEQ ID NO: 8433888 - DNA, 22 bp, Homo sapiens
tgccctggaggggcttacagtc

SEQ ID NO: 8433889 - DNA, 22 bp, Homo sapiens
tgccctggaggggcttacagtc

SEQ ID NO: 8433890 - DNA, 22 bp, Homo sapiens
tgccctggaaccatctacagtc

SEQ ID NO: 8433891 - DNA, 22 bp, Homo sapiens
tgccctggaaccatctacagtc

SEQ ID NO: 8433892 - DNA, 22 bp, Homo sapiens
tgccctggaaccatctacagtc

SEQ ID NO: 8433893 - DNA, 22 bp, Homo sapiens
tgccctggaaccatctacagtc

SEQ ID NO: 8433894 - DNA, 22 bp, Homo sapiens
tgccctggaaccatctacagtc

SEQ ID NO: 8433895 - DNA, 22 bp, Homo sapiens
tgccctgcttggtttattttca

SEQ ID NO: 8433896 - DNA, 22 bp, Homo sapiens
tgccctggaaatgagaggtgtg

SEQ ID NO: 8433897 - DNA, 22 bp, Homo sapiens
tgccctgcttctcttgggacag

SEQ ID NO: 8433898 - DNA, 22 bp, Homo sapiens
tgccctgctgtgcctggagcca

SEQ ID NO: 8433899 - DNA, 22 bp, Homo sapiens
tgccctgctgtggctctgccca

SEQ ID NO: 8433900 - DNA, 22 bp, Homo sapiens
tgccctgctgtggctctgccca

SEQ ID NO: 8433901 - DNA, 19 bp, Homo sapiens
tgccctgcacgctgtcctg

SEQ ID NO: 8433902 - DNA, 22 bp, Homo sapiens
tgccctgcagtgagtgcgtctg

SEQ ID NO: 8433903 - DNA, 22 bp, Homo sapiens
tgccctgcagtgagtgcgtctg

SEQ ID NO: 8433904 - DNA, 22 bp, Homo sapiens
tgccctgcagaccctgcagtgt

SEQ ID NO: 8433905 - DNA, 22 bp, Homo sapiens
tgccctgccaagactcagtggt

SEQ ID NO: 8433906 - DNA, 22 bp, Homo sapiens
tgccctgcatgcagggagctgt

SEQ ID NO: 8433907 - DNA, 22 bp, Homo sapiens
tgccctgccaagaccaagtggt

SEQ ID NO: 8433908 - DNA, 22 bp, Homo sapiens
tgccctgcccatctaccctgtc

SEQ ID NO: 8433909 - DNA, 22 bp, Homo sapiens
tgccctgcccatctaccctgtc

SEQ ID NO: 8433910 - DNA, 22 bp, Homo sapiens
tgccctgcccatctaccctgtc

SEQ ID NO: 8433911 - DNA, 19 bp, Homo sapiens
tgccctgcccgcagccttg

SEQ ID NO: 8433912 - DNA, 22 bp, Homo sapiens
tgccctgccaagactgagtggt

SEQ ID NO: 8433913 - DNA, 22 bp, Homo sapiens
tgccctgctaaatataggtagc

SEQ ID NO: 8433914 - DNA, 22 bp, Homo sapiens
tgccctgctaaccttggttcca

SEQ ID NO: 8433915 - DNA, 22 bp, Homo sapiens
tgccctgctgtgcctggagcca

SEQ ID NO: 8433916 - DNA, 22 bp, Homo sapiens
tgccctgcctgagagacagtaa

SEQ ID NO: 8433917 - DNA, 22 bp, Homo sapiens
tgccctgcggctatctagatga

SEQ ID NO: 8433918 - DNA, 19 bp, Homo sapiens
tgccctgcccgcagccttg

SEQ ID NO: 8433919 - DNA, 22 bp, Homo sapiens
tgccctgcccttgctatttcta

SEQ ID NO: 8433920 - DNA, 22 bp, Homo sapiens
tgcaggctcacctgccagggcc

SEQ ID NO: 8433921 - DNA, 22 bp, Homo sapiens
tgcaggctcaccctggagctga

SEQ ID NO: 8433922 - DNA, 22 bp, Homo sapiens
tgcaggctcatctcaagagtag

SEQ ID NO: 8433923 - DNA, 22 bp, Homo sapiens
tgcaggctcatctcaagagtag

SEQ ID NO: 8433924 - DNA, 21 bp, Homo sapiens
tgcaggctacttctgactcta

SEQ ID NO: 8433925 - DNA, 22 bp, Homo sapiens
tgcaggcctcagacttagccat

SEQ ID NO: 8433926 - DNA, 21 bp, Homo sapiens
tgcaggagtgtaatgtgaccc

SEQ ID NO: 8433927 - DNA, 22 bp, Homo sapiens
tgcaggagttaagtgctctcct

SEQ ID NO: 8433928 - DNA, 21 bp, Homo sapiens
tgcaggagtctgtgagtcagg

SEQ ID NO: 8433929 - DNA, 22 bp, Homo sapiens
tgcaggcaccattctgcctctc

SEQ ID NO: 8433930 - DNA, 22 bp, Homo sapiens
tgcaggcaccattctgcctctc

SEQ ID NO: 8433931 - DNA, 22 bp, Homo sapiens
tgcaggagttcccctctgcctg

SEQ ID NO: 8433932 - DNA, 22 bp, Homo sapiens
tgcaggaggattttgtggagct

SEQ ID NO: 8433933 - DNA, 22 bp, Homo sapiens
tgcaggaggattttgtggagct

SEQ ID NO: 8433934 - DNA, 22 bp, Homo sapiens
tgcaggagggagggttacagtt

SEQ ID NO: 8433935 - DNA, 22 bp, Homo sapiens
tgcaggagtccaatcaggagac

SEQ ID NO: 8433936 - DNA, 21 bp, Homo sapiens
tgcaggagtctgtgagtcagg

SEQ ID NO: 8433937 - DNA, 22 bp, Homo sapiens
tgcaggagcccttgggctctgg

SEQ ID NO: 8433938 - DNA, 22 bp, Homo sapiens
tgcaggagcccttgggctctgg

SEQ ID NO: 8433939 - DNA, 22 bp, Homo sapiens
tgcaggagctgctgtcctgctc

SEQ ID NO: 8433940 - DNA, 22 bp, Homo sapiens
tgcaggagctgtgcggtgaggg

SEQ ID NO: 8433941 - DNA, 19 bp, Homo sapiens
tgcaggaggactgagcaga

SEQ ID NO: 8433942 - DNA, 22 bp, Homo sapiens
tgcaggaaattccagggtggcc

SEQ ID NO: 8433943 - DNA, 22 bp, Homo sapiens
tgcaggaaattccagggtggcc

SEQ ID NO: 8433944 - DNA, 21 bp, Homo sapiens
tgcaggaagtatggtgcctat

SEQ ID NO: 8433945 - DNA, 21 bp, Homo sapiens
tgcaggaagtatggtgcctat

SEQ ID NO: 8433946 - DNA, 22 bp, Homo sapiens
tgcaggagacataatagggact

SEQ ID NO: 8433947 - DNA, 22 bp, Homo sapiens
tgcaggagaaagtacggagcgt

SEQ ID NO: 8433948 - DNA, 22 bp, Homo sapiens
tgcaggagagctggtctggccc

SEQ ID NO: 8433949 - DNA, 22 bp, Homo sapiens
tgcaggagagctggtctggccc

SEQ ID NO: 8433950 - DNA, 22 bp, Homo sapiens
tgcaggagataatggtgcttag

SEQ ID NO: 8433951 - DNA, 22 bp, Homo sapiens
tgcaggagcagagatggctgga

SEQ ID NO: 8433952 - DNA, 22 bp, Homo sapiens
tgcaggagcagagatggctgga

SEQ ID NO: 8433953 - DNA, 22 bp, Homo sapiens
tgcaggagcaccagctcaccct

SEQ ID NO: 8433954 - DNA, 22 bp, Homo sapiens
tgcagctgtgaaagggaaccaa

SEQ ID NO: 8433955 - DNA, 22 bp, Homo sapiens
tgcagctgttacggaccctgtc

SEQ ID NO: 8433956 - DNA, 22 bp, Homo sapiens
tgcagctgtaacagaggcctca

SEQ ID NO: 8433957 - DNA, 20 bp, Homo sapiens
tgcagctggtttcacaggga

SEQ ID NO: 8433958 - DNA, 22 bp, Homo sapiens
tgcagcttcttgtcctgtgatt

SEQ ID NO: 8433959 - DNA, 22 bp, Homo sapiens
tgcaggaaacagaggctcaaat

SEQ ID NO: 8433960 - DNA, 22 bp, Homo sapiens
tgcagctgaccagcaagtcctg

SEQ ID NO: 8433961 - DNA, 22 bp, Homo sapiens
tgcagctgaacctagagtctgt

SEQ ID NO: 8433962 - DNA, 21 bp, Homo sapiens
tgcagctgacaccctttggga

SEQ ID NO: 8433963 - DNA, 22 bp, Homo sapiens
tgcagcctttagaagttcagat

SEQ ID NO: 8433964 - DNA, 22 bp, Homo sapiens
tgcagcctttagaagttcagat

SEQ ID NO: 8433965 - DNA, 23 bp, Homo sapiens
tgcagctcaaagatgggtaaatg

SEQ ID NO: 8433966 - DNA, 22 bp, Homo sapiens
tgcagctctgaacagtcatgaa

SEQ ID NO: 8433967 - DNA, 22 bp, Homo sapiens
tgcagctcctgtgctgagtgtg

SEQ ID NO: 8433968 - DNA, 22 bp, Homo sapiens
tgcagctcattggtgtcctggt

SEQ ID NO: 8433969 - DNA, 22 bp, Homo sapiens
tgcagctgctggtggctgaaag

SEQ ID NO: 8433970 - DNA, 22 bp, Homo sapiens
tgcagctgggtctgccctggct

SEQ ID NO: 8433971 - DNA, 22 bp, Homo sapiens
tgcagctggtatcccatggatt

SEQ ID NO: 8433972 - DNA, 22 bp, Homo sapiens
tgcagcaggcacaggacggaag

SEQ ID NO: 8433973 - DNA, 22 bp, Homo sapiens
tgcagcaggcacaggacggaag

SEQ ID NO: 8433974 - DNA, 22 bp, Homo sapiens
tgcagcagggcccaggcacaga

SEQ ID NO: 8433975 - DNA, 22 bp, Homo sapiens
tgcagcagggcccaggcacaga

SEQ ID NO: 8433976 - DNA, 22 bp, Homo sapiens
tgcagcagcagggaggaggctc

SEQ ID NO: 8433977 - DNA, 22 bp, Homo sapiens
tgcagcagcagggaggaggctc

SEQ ID NO: 8433978 - DNA, 21 bp, Homo sapiens
tgcagcagagtaagcagggga

SEQ ID NO: 8433979 - DNA, 21 bp, Homo sapiens
tgcagcagatttgggggaaga

SEQ ID NO: 8433980 - DNA, 22 bp, Homo sapiens
tgcagcagagtgggcctgggtg

SEQ ID NO: 8433981 - DNA, 22 bp, Homo sapiens
tgcagcagagtgggcctgggtg

SEQ ID NO: 8433982 - DNA, 22 bp, Homo sapiens
tgcagcctagacattctggtca

SEQ ID NO: 8433983 - DNA, 22 bp, Homo sapiens
tgcagccctgtgcacatcccct

SEQ ID NO: 8433984 - DNA, 22 bp, Homo sapiens
tgcagccccccagatggccgta

SEQ ID NO: 8433985 - DNA, 22 bp, Homo sapiens
tgcagcccctatcgcggacagg

SEQ ID NO: 8433986 - DNA, 22 bp, Homo sapiens
tgcagcccaggcgtcaggtggt

SEQ ID NO: 8433987 - DNA, 22 bp, Homo sapiens
tgcagcctggtggtcactggag

SEQ ID NO: 8433988 - DNA, 18 bp, Homo sapiens
tgcagcctgtagtcttgt

SEQ ID NO: 8433989 - DNA, 22 bp, Homo sapiens
tgcagcctctctgcttcaggaa

SEQ ID NO: 8433990 - DNA, 23 bp, Homo sapiens
tgcagcagggtggtctacttctc

SEQ ID NO: 8433991 - DNA, 22 bp, Homo sapiens
tgcagcaggtatggcaagctcc

SEQ ID NO: 8433992 - DNA, 22 bp, Homo sapiens
tgcagagtcctctggagggact

SEQ ID NO: 8433993 - DNA, 22 bp, Homo sapiens
tgcagagtgggagaggtgcggg

SEQ ID NO: 8433994 - DNA, 22 bp, Homo sapiens
tgcagagtgggagaggtgcggg

SEQ ID NO: 8433995 - DNA, 19 bp, Homo sapiens
tgcagagggtaggaaggcc

SEQ ID NO: 8433996 - DNA, 19 bp, Homo sapiens
tgcagagggtaggaaggcc

SEQ ID NO: 8433997 - DNA, 22 bp, Homo sapiens
tgcagagtcacccagataatta

SEQ ID NO: 8433998 - DNA, 22 bp, Homo sapiens
tgcagagtcctctggagggact

SEQ ID NO: 8433999 - DNA, 22 bp, Homo sapiens
tgcagagtagtgaggggacaga

SEQ ID NO: 8434000 - DNA, 23 bp, Homo sapiens
tgcagagggactgaagccagctt

SEQ ID NO: 8434001 - DNA, 23 bp, Homo sapiens
tgcagagggactgaagccagctt

SEQ ID NO: 8434002 - DNA, 19 bp, Homo sapiens
tgcagagggtaggaaggcc

SEQ ID NO: 8434003 - DNA, 22 bp, Homo sapiens
tgcagagggaaaaggtgctcct

SEQ ID NO: 8434004 - DNA, 22 bp, Homo sapiens
tgcagagggaaaaggtgctcct

SEQ ID NO: 8434005 - DNA, 20 bp, Homo sapiens
tgcagcagaagcccatgctc

SEQ ID NO: 8434006 - DNA, 22 bp, Homo sapiens
tgcagattcaaatgaaatgcaa

SEQ ID NO: 8434007 - DNA, 22 bp, Homo sapiens
tgcagattcaaatgaaatgcaa

SEQ ID NO: 8434008 - DNA, 22 bp, Homo sapiens
tgcagagaaaactcctgggtac

SEQ ID NO: 8434009 - DNA, 22 bp, Homo sapiens
tgcagagaaaactcctgggtac

SEQ ID NO: 8434010 - DNA, 22 bp, Homo sapiens
tgcagagaaaccagtggaggac

SEQ ID NO: 8434011 - DNA, 22 bp, Homo sapiens
tgcagagatcctggactgagcg

SEQ ID NO: 8434012 - DNA, 22 bp, Homo sapiens
tgcagacaagtgcatctaaccc

SEQ ID NO: 8434013 - DNA, 22 bp, Homo sapiens
tgcagacaagtgcatctaaccc

SEQ ID NO: 8434014 - DNA, 22 bp, Homo sapiens
tgcagaattatggtgctggctt

SEQ ID NO: 8434015 - DNA, 22 bp, Homo sapiens
tgcagaatgtggacagtgggtt

SEQ ID NO: 8434016 - DNA, 22 bp, Homo sapiens
tgcagagatctgggcgtcggct

SEQ ID NO: 8434017 - DNA, 22 bp, Homo sapiens
tgcagagatctgggcgtcggct

SEQ ID NO: 8434018 - DNA, 22 bp, Homo sapiens
tgcagagatttggctcttaaag

SEQ ID NO: 8434019 - DNA, 22 bp, Homo sapiens
tgcagaggaccattgtcctgga

SEQ ID NO: 8434020 - DNA, 22 bp, Homo sapiens
tgcagaggagctggaaggctgg

SEQ ID NO: 8434021 - DNA, 22 bp, Homo sapiens
tgcagaggagctggaaggctgg

SEQ ID NO: 8434022 - DNA, 22 bp, Homo sapiens
tgcagaggagctggaaggctgg

SEQ ID NO: 8434023 - DNA, 22 bp, Homo sapiens
tgcagaggagctggaaggctgg

SEQ ID NO: 8434024 - DNA, 22 bp, Homo sapiens
tgcagaggagtcagcctgggca

SEQ ID NO: 8434025 - DNA, 22 bp, Homo sapiens
tgcagaggagtcagcctgggca

SEQ ID NO: 8434026 - DNA, 21 bp, Homo sapiens
tgcagaggcacaaacaagccc

SEQ ID NO: 8434027 - DNA, 22 bp, Homo sapiens
tgcagaggctggctcgccgggt

SEQ ID NO: 8434028 - DNA, 22 bp, Homo sapiens
tgcagaggcgccgtgggtgggg

SEQ ID NO: 8434029 - DNA, 22 bp, Homo sapiens
tgcagaaataactcatattgca

SEQ ID NO: 8434030 - DNA, 22 bp, Homo sapiens
tgcagaaataactcatattgca

SEQ ID NO: 8434031 - DNA, 21 bp, Homo sapiens
tgcagaaatggtttttctaag

SEQ ID NO: 8434032 - DNA, 22 bp, Homo sapiens
tgcagaaattcagaaagcataa

SEQ ID NO: 8434033 - DNA, 21 bp, Homo sapiens
tgcactttgggggacaggctg

SEQ ID NO: 8434034 - DNA, 22 bp, Homo sapiens
tgcactttgcaggcatggaaac

SEQ ID NO: 8434035 - DNA, 22 bp, Homo sapiens
tgcagaaacaagccatcattca

SEQ ID NO: 8434036 - DNA, 22 bp, Homo sapiens
tgcactactgtgatacacagcc

SEQ ID NO: 8434037 - DNA, 22 bp, Homo sapiens
tgcacgtgtgagcattcacatg

SEQ ID NO: 8434038 - DNA, 22 bp, Homo sapiens
tgcacgtgtgagcattcacatg

SEQ ID NO: 8434039 - DNA, 22 bp, Homo sapiens
tgcagaagaaaacagctgtgtg

SEQ ID NO: 8434040 - DNA, 20 bp, Homo sapiens
tgcagaagaacgttctggtt

SEQ ID NO: 8434041 - DNA, 20 bp, Homo sapiens
tgcagaagaacgttctggtt

SEQ ID NO: 8434042 - DNA, 22 bp, Homo sapiens
tgcagaagaatgagcttggagt

SEQ ID NO: 8434043 - DNA, 22 bp, Homo sapiens
tgcagaagacacaaggtaacgt

SEQ ID NO: 8434044 - DNA, 22 bp, Homo sapiens
tgcagaagcagagccggtggcc

SEQ ID NO: 8434045 - DNA, 22 bp, Homo sapiens
tgcagaagcagagagttgccaa

SEQ ID NO: 8434046 - DNA, 22 bp, Homo sapiens
tgcagaagaccttccagggctg

SEQ ID NO: 8434047 - DNA, 22 bp, Homo sapiens
tgcagaagatggtctgagcacc

SEQ ID NO: 8434048 - DNA, 22 bp, Homo sapiens
tgcagaagaccttccagggctg

SEQ ID NO: 8434049 - DNA, 22 bp, Homo sapiens
tgcagaagtgagtcatgaggaa

SEQ ID NO: 8434050 - DNA, 22 bp, Homo sapiens
tgcagaagtgagtcatgaggaa

SEQ ID NO: 8434051 - DNA, 22 bp, Homo sapiens
tgcagaagtattccaggcccca

SEQ ID NO: 8434052 - DNA, 22 bp, Homo sapiens
tgcagaagctgcaggtcagtgg

SEQ ID NO: 8434053 - DNA, 22 bp, Homo sapiens
tgcacccacttagctgaagttc

SEQ ID NO: 8434054 - DNA, 22 bp, Homo sapiens
tgcacccatgtctccacgtaca

SEQ ID NO: 8434055 - DNA, 22 bp, Homo sapiens
tgcaccccattttacatttaca

SEQ ID NO: 8434056 - DNA, 22 bp, Homo sapiens
tgcaccagtttctcagagaatc

SEQ ID NO: 8434057 - DNA, 22 bp, Homo sapiens
tgcaccagtttctcagagaatc

SEQ ID NO: 8434058 - DNA, 22 bp, Homo sapiens
tgcaccagagcagggtgcccaa

SEQ ID NO: 8434059 - DNA, 22 bp, Homo sapiens
tgcacatttgttattttgaggt

SEQ ID NO: 8434060 - DNA, 22 bp, Homo sapiens
tgcacagttggctacatcgtgg

SEQ ID NO: 8434061 - DNA, 22 bp, Homo sapiens
tgcacagtgaccactgagcaag

SEQ ID NO: 8434062 - DNA, 22 bp, Homo sapiens
tgcacagtaaacatgactggag

SEQ ID NO: 8434063 - DNA, 21 bp, Homo sapiens
tgcacagggcccaggagagcc

SEQ ID NO: 8434064 - DNA, 22 bp, Homo sapiens
tgcacaggtatgcaaagcatgt

SEQ ID NO: 8434065 - DNA, 20 bp, Homo sapiens
tgcacagggtgggaagcaac

SEQ ID NO: 8434066 - DNA, 22 bp, Homo sapiens
tgcacagcgggtgtctgtcagg

SEQ ID NO: 8434067 - DNA, 22 bp, Homo sapiens
tgcacagcgggtgtctgtcagg

SEQ ID NO: 8434068 - DNA, 21 bp, Homo sapiens
tgcacagccataccctccttg

SEQ ID NO: 8434069 - DNA, 22 bp, Homo sapiens
tgcacagctgcctcctctctgc

SEQ ID NO: 8434070 - DNA, 20 bp, Homo sapiens
tgcacagctgtgaataggat

SEQ ID NO: 8434071 - DNA, 22 bp, Homo sapiens
tgcacaggaggctgtggagaag

SEQ ID NO: 8434072 - DNA, 21 bp, Homo sapiens
tgcacaaactttctgtggctt

SEQ ID NO: 8434073 - DNA, 22 bp, Homo sapiens
tgcacaaagcattctagacgca

SEQ ID NO: 8434074 - DNA, 22 bp, Homo sapiens
tgcacaagtcagagtaacattt

SEQ ID NO: 8434075 - DNA, 22 bp, Homo sapiens
tgcaattagcattgtattctta

SEQ ID NO: 8434076 - DNA, 22 bp, Homo sapiens
tgcaattagcgtattagtttat

SEQ ID NO: 8434077 - DNA, 22 bp, Homo sapiens
tgcaattatgggcaatttttaa

SEQ ID NO: 8434078 - DNA, 22 bp, Homo sapiens
tgcaatctcggcactttgggag

SEQ ID NO: 8434079 - DNA, 22 bp, Homo sapiens
tgcaattagcgtattagtttat

SEQ ID NO: 8434080 - DNA, 22 bp, Homo sapiens
tgcaattaatttacatgcttaa

SEQ ID NO: 8434081 - DNA, 22 bp, Homo sapiens
tgcaattactgggaggttttat

SEQ ID NO: 8434082 - DNA, 22 bp, Homo sapiens
tgcaattagcattgtattctta

SEQ ID NO: 8434083 - DNA, 22 bp, Homo sapiens
tgcacacacgcggcacatctgt

SEQ ID NO: 8434084 - DNA, 22 bp, Homo sapiens
tgcacacacaggagtctcctcc

SEQ ID NO: 8434085 - DNA, 22 bp, Homo sapiens
tgcacacacatgaagtagcatg

SEQ ID NO: 8434086 - DNA, 19 bp, Homo sapiens
tgcacacagataagtatct

SEQ ID NO: 8434087 - DNA, 22 bp, Homo sapiens
tgcacacactctgcatatactt

SEQ ID NO: 8434088 - DNA, 22 bp, Homo sapiens
tgcacacaggtctaggacatgg

SEQ ID NO: 8434089 - DNA, 22 bp, Homo sapiens
tgcacacagatggtacatgcat

SEQ ID NO: 8434090 - DNA, 22 bp, Homo sapiens
tgcacacagatggtacatgcat

SEQ ID NO: 8434091 - DNA, 21 bp, Homo sapiens
tgcaatccagcctgggcgaca

SEQ ID NO: 8434092 - DNA, 21 bp, Homo sapiens
tgcaatccagcctgggcgaca

SEQ ID NO: 8434093 - DNA, 21 bp, Homo sapiens
tgcaatccagcctgggcgaca

SEQ ID NO: 8434094 - DNA, 21 bp, Homo sapiens
tgcaatccagcctgggcgaca

SEQ ID NO: 8434095 - DNA, 22 bp, Homo sapiens
tgcaagggtagaagtgatggca

SEQ ID NO: 8434096 - DNA, 22 bp, Homo sapiens
tgcaaggctgcctctgaggacc

SEQ ID NO: 8434097 - DNA, 22 bp, Homo sapiens
tgcaaggcccagacaagagctc

SEQ ID NO: 8434098 - DNA, 22 bp, Homo sapiens
tgcaagcaagtttttgaagtgg

SEQ ID NO: 8434099 - DNA, 20 bp, Homo sapiens
tgcaaggaagcaggcaagtg

SEQ ID NO: 8434100 - DNA, 22 bp, Homo sapiens
tgcaaggatatttagtctagtg

SEQ ID NO: 8434101 - DNA, 22 bp, Homo sapiens
tgcaaggcacccactctgcttt

SEQ ID NO: 8434102 - DNA, 22 bp, Homo sapiens
tgcaacagtggggcatgctgaa

SEQ ID NO: 8434103 - DNA, 22 bp, Homo sapiens
tgcaactaggaggttcttagct

SEQ ID NO: 8434104 - DNA, 22 bp, Homo sapiens
tgcaacctgcactctgtcttta

SEQ ID NO: 8434105 - DNA, 22 bp, Homo sapiens
tgcaacttgtttggagagaaag

SEQ ID NO: 8434106 - DNA, 22 bp, Homo sapiens
tgcaacaggagagttcagggca

SEQ ID NO: 8434107 - DNA, 22 bp, Homo sapiens
tgcaacagactttattaactct

SEQ ID NO: 8434108 - DNA, 22 bp, Homo sapiens
tgcaacaggctgtgacatggaa

SEQ ID NO: 8434109 - DNA, 23 bp, Homo sapiens
tgcaacaatgaggaaagctactg

SEQ ID NO: 8434110 - DNA, 22 bp, Homo sapiens
tgcaacaaggcctcatttcttg

SEQ ID NO: 8434111 - DNA, 22 bp, Homo sapiens
tgcaacaaggcctcatttcttg

SEQ ID NO: 8434112 - DNA, 23 bp, Homo sapiens
tgcaacaatgaggaaagctactg

SEQ ID NO: 8434113 - DNA, 22 bp, Homo sapiens
tgcaaatttgagcagactgttc

SEQ ID NO: 8434114 - DNA, 22 bp, Homo sapiens
tgcaaatttgacttcacacatc

SEQ ID NO: 8434115 - DNA, 22 bp, Homo sapiens
tgcaaatttctttagtacataa

SEQ ID NO: 8434116 - DNA, 22 bp, Homo sapiens
tgcaagagcccaaactatatac

SEQ ID NO: 8434117 - DNA, 22 bp, Homo sapiens
tgcaagagcccaccacacactt

SEQ ID NO: 8434118 - DNA, 22 bp, Homo sapiens
tgcaagagattcaaaccataaa

SEQ ID NO: 8434119 - DNA, 22 bp, Homo sapiens
tgcaagagcagaaagaactgag

SEQ ID NO: 8434120 - DNA, 22 bp, Homo sapiens
tgcaagagacagacatgactca

SEQ ID NO: 8434121 - DNA, 22 bp, Homo sapiens
tgcaagaggattgtatcaataa

SEQ ID NO: 8434122 - DNA, 22 bp, Homo sapiens
tgcaagataacctgcttcttcc

SEQ ID NO: 8434123 - DNA, 22 bp, Homo sapiens
tgcaagaggttggattttaaga

SEQ ID NO: 8434124 - DNA, 22 bp, Homo sapiens
tgcaaaagaatatagatattgt

SEQ ID NO: 8434125 - DNA, 22 bp, Homo sapiens
tgcaaaaattgctggaatcttt

SEQ ID NO: 8434126 - DNA, 22 bp, Homo sapiens
tgcaaaagaatatagatattgt

SEQ ID NO: 8434127 - DNA, 22 bp, Homo sapiens
tgcaaaacttctcagagccttt

SEQ ID NO: 8434128 - DNA, 22 bp, Homo sapiens
tgcaaaaagagcgaggagccct

SEQ ID NO: 8434129 - DNA, 22 bp, Homo sapiens
tgcaaaaactgcaattgctttt

SEQ ID NO: 8434130 - DNA, 22 bp, Homo sapiens
tgcaaaaaggcagactggtgat

SEQ ID NO: 8434131 - DNA, 22 bp, Homo sapiens
tgcaaaaaggcagactggtgat

SEQ ID NO: 8434132 - DNA, 22 bp, Homo sapiens
tgcaaaaactgcaattgctttt

SEQ ID NO: 8434133 - DNA, 22 bp, Homo sapiens
tgcaaaaactgcaattgctttt

SEQ ID NO: 8434134 - DNA, 22 bp, Homo sapiens
tgcaaaaagagcgaggagccct

SEQ ID NO: 8434135 - DNA, 22 bp, Homo sapiens
tgattttctccattgtaaattc

SEQ ID NO: 8434136 - DNA, 22 bp, Homo sapiens
tgattttgtcatgtttctgata

SEQ ID NO: 8434137 - DNA, 22 bp, Homo sapiens
tgattttgtcatgtttctgata

SEQ ID NO: 8434138 - DNA, 22 bp, Homo sapiens
tgattttcatgggtgatctttg

SEQ ID NO: 8434139 - DNA, 22 bp, Homo sapiens
tgcaaaaacagccttgaggcct

SEQ ID NO: 8434140 - DNA, 22 bp, Homo sapiens
tgcaaaaacagccttgaggcct

SEQ ID NO: 8434141 - DNA, 22 bp, Homo sapiens
tgatttttggatctgagctgca

SEQ ID NO: 8434142 - DNA, 22 bp, Homo sapiens
tgatttttagctattctgaaga

SEQ ID NO: 8434143 - DNA, 22 bp, Homo sapiens
tgatttacagtagtgtctaaac

SEQ ID NO: 8434144 - DNA, 22 bp, Homo sapiens
tgatttacacacctatgattta

SEQ ID NO: 8434145 - DNA, 22 bp, Homo sapiens
tgatttacacatcaaagcagca

SEQ ID NO: 8434146 - DNA, 22 bp, Homo sapiens
tgatttaccagttactatcttg

SEQ ID NO: 8434147 - DNA, 22 bp, Homo sapiens
tgatttacagtagtgtctaaac

SEQ ID NO: 8434148 - DNA, 22 bp, Homo sapiens
tgatttacacacctatgattta

SEQ ID NO: 8434149 - DNA, 22 bp, Homo sapiens
tgatttacaattgtaaaagttt

SEQ ID NO: 8434150 - DNA, 22 bp, Homo sapiens
tgatttacaattgtaaaagttt

SEQ ID NO: 8434151 - DNA, 22 bp, Homo sapiens
tgatttacttctggataaatcc

SEQ ID NO: 8434152 - DNA, 22 bp, Homo sapiens
tgatttacttctggataaatcc

SEQ ID NO: 8434153 - DNA, 22 bp, Homo sapiens
tgatttaggaaacagctacagg

SEQ ID NO: 8434154 - DNA, 22 bp, Homo sapiens
tgatttacttcccagctgggtt

SEQ ID NO: 8434155 - DNA, 22 bp, Homo sapiens
tgatttactcccacttagagcc

SEQ ID NO: 8434156 - DNA, 22 bp, Homo sapiens
tgatttacccgtaactatttct

SEQ ID NO: 8434157 - DNA, 22 bp, Homo sapiens
tgatttacccgtaactatttct

SEQ ID NO: 8434158 - DNA, 22 bp, Homo sapiens
tgatttacccgtccaggcccta

SEQ ID NO: 8434159 - DNA, 22 bp, Homo sapiens
tgatttcatagtatatacatga

SEQ ID NO: 8434160 - DNA, 22 bp, Homo sapiens
tgatttcatagtatatacatga

SEQ ID NO: 8434161 - DNA, 22 bp, Homo sapiens
tgatttatgcattatactgttg

SEQ ID NO: 8434162 - DNA, 22 bp, Homo sapiens
tgatttccctcatcataacaga

SEQ ID NO: 8434163 - DNA, 22 bp, Homo sapiens
tgatttccctcatcataacaga

SEQ ID NO: 8434164 - DNA, 22 bp, Homo sapiens
tgatttccctcatcataacaga

SEQ ID NO: 8434165 - DNA, 22 bp, Homo sapiens
tgcaaatgtgtggtgaggcatt

SEQ ID NO: 8434166 - DNA, 19 bp, Homo sapiens
tgcaaatgtaggaagaata

SEQ ID NO: 8434167 - DNA, 19 bp, Homo sapiens
tgcaaatgtaggaagaata

SEQ ID NO: 8434168 - DNA, 22 bp, Homo sapiens
tgcaaatgtgttttaaaccaaa

SEQ ID NO: 8434169 - DNA, 18 bp, Homo sapiens
tgcaaatggctgtttgat

SEQ ID NO: 8434170 - DNA, 22 bp, Homo sapiens
tgcaaatttaatgaaactatgt

SEQ ID NO: 8434171 - DNA, 22 bp, Homo sapiens
tgcaaattgcgatttttattag

SEQ ID NO: 8434172 - DNA, 19 bp, Homo sapiens
tgcaaattctaaaaactga

SEQ ID NO: 8434173 - DNA, 22 bp, Homo sapiens
tgcaaattccatttaaacacta

SEQ ID NO: 8434174 - DNA, 22 bp, Homo sapiens
tgcaaattcagaagaactgccc

SEQ ID NO: 8434175 - DNA, 22 bp, Homo sapiens
tgcaaatattgggacagtctag

SEQ ID NO: 8434176 - DNA, 22 bp, Homo sapiens
tgcaaagaagcctttgccttct

SEQ ID NO: 8434177 - DNA, 22 bp, Homo sapiens
tgcaaacaatttcctataaagt

SEQ ID NO: 8434178 - DNA, 17 bp, Homo sapiens
tgcaaacaatcacatat

SEQ ID NO: 8434179 - DNA, 17 bp, Homo sapiens
tgcaaacaatcacatat

SEQ ID NO: 8434180 - DNA, 20 bp, Homo sapiens
tgcaaacacagagtgtatga

SEQ ID NO: 8434181 - DNA, 22 bp, Homo sapiens
tgcaaacagaaaagctactttg

SEQ ID NO: 8434182 - DNA, 22 bp, Homo sapiens
tgcaaacaggcatttcacaaac

SEQ ID NO: 8434183 - DNA, 22 bp, Homo sapiens
tgcaaacaggagagtaagtata

SEQ ID NO: 8434184 - DNA, 22 bp, Homo sapiens
tgatcttttctatttatggtag

SEQ ID NO: 8434185 - DNA, 22 bp, Homo sapiens
tgatcttttcaaagacaagctt

SEQ ID NO: 8434186 - DNA, 22 bp, Homo sapiens
tgatctttggtagtacgataat

SEQ ID NO: 8434187 - DNA, 22 bp, Homo sapiens
tgatgaaaatatgattctgagg

SEQ ID NO: 8434188 - DNA, 22 bp, Homo sapiens
tgatgaaaaccagaactctcat

SEQ ID NO: 8434189 - DNA, 18 bp, Homo sapiens
tgatctttgagtataatg

SEQ ID NO: 8434190 - DNA, 22 bp, Homo sapiens
tgatctttgggccattaataaa

SEQ ID NO: 8434191 - DNA, 22 bp, Homo sapiens
tgatgagtaaataaggttgagt

SEQ ID NO: 8434192 - DNA, 22 bp, Homo sapiens
tgatgagtttactcttttctaa

SEQ ID NO: 8434193 - DNA, 22 bp, Homo sapiens
tgatgaggtggattcaaagcag

SEQ ID NO: 8434194 - DNA, 22 bp, Homo sapiens
tgatgaaaatgttcagcaatta

SEQ ID NO: 8434195 - DNA, 22 bp, Homo sapiens
tgatgaaagtgtttactcacct

SEQ ID NO: 8434196 - DNA, 22 bp, Homo sapiens
tgatgaaagttcagtagtgaat

SEQ ID NO: 8434197 - DNA, 22 bp, Homo sapiens
tgatgcaatgtttacatcttga

SEQ ID NO: 8434198 - DNA, 22 bp, Homo sapiens
tgatggaagagctaacaatatc

SEQ ID NO: 8434199 - DNA, 22 bp, Homo sapiens
tgatggaatggaggacatgtgg

SEQ ID NO: 8434200 - DNA, 18 bp, Homo sapiens
tgattcaagttgccctcc

SEQ ID NO: 8434201 - DNA, 22 bp, Homo sapiens
tgattcaataggaattgagtag

SEQ ID NO: 8434202 - DNA, 22 bp, Homo sapiens
tgattcaattatctgatgcttt

SEQ ID NO: 8434203 - DNA, 23 bp, Homo sapiens
tgattcagcaagtccacttctgg

SEQ ID NO: 8434204 - DNA, 22 bp, Homo sapiens
tgattacaaaagattgtttgaa

SEQ ID NO: 8434205 - DNA, 23 bp, Homo sapiens
tgattacaagggccaaagaaagg

SEQ ID NO: 8434206 - DNA, 23 bp, Homo sapiens
tgattacaagggccaaagaaagg

SEQ ID NO: 8434207 - DNA, 22 bp, Homo sapiens
tgatgtctagtacatacaagag

SEQ ID NO: 8434208 - DNA, 22 bp, Homo sapiens
tgatgtgtgattcattctcaaa

SEQ ID NO: 8434209 - DNA, 22 bp, Homo sapiens
tgatgtggccccacttagctgt

SEQ ID NO: 8434210 - DNA, 22 bp, Homo sapiens
tgatgtttaatactatgctttt

SEQ ID NO: 8434211 - DNA, 22 bp, Homo sapiens
tgattaaaatttaacttagtta

SEQ ID NO: 8434212 - DNA, 22 bp, Homo sapiens
tgatgtgtggcagttaaactgt

SEQ ID NO: 8434213 - DNA, 21 bp, Homo sapiens
tgattgatatttgcaaacaga

SEQ ID NO: 8434214 - DNA, 22 bp, Homo sapiens
tgattgatacaactcaatccaa

SEQ ID NO: 8434215 - DNA, 22 bp, Homo sapiens
tgattgaattcaaatgcaatct

SEQ ID NO: 8434216 - DNA, 22 bp, Homo sapiens
tgattgttttagttccctgatg

SEQ ID NO: 8434217 - DNA, 22 bp, Homo sapiens
tgattctttgaccaaaaaattg

SEQ ID NO: 8434218 - DNA, 22 bp, Homo sapiens
tgattctgtaagtcatattgtt

SEQ ID NO: 8434219 - DNA, 22 bp, Homo sapiens
tgattctgagggagcattctgc

SEQ ID NO: 8434220 - DNA, 22 bp, Homo sapiens
tgagtgaggctgggcagtccct

SEQ ID NO: 8434221 - DNA, 22 bp, Homo sapiens
tgagtgctaagaataatctgca

SEQ ID NO: 8434222 - DNA, 22 bp, Homo sapiens
tgagtgactccactggggcaga

SEQ ID NO: 8434223 - DNA, 22 bp, Homo sapiens
tgagtcttttcattgtgtggat

SEQ ID NO: 8434224 - DNA, 22 bp, Homo sapiens
tgagtcttttatcctgggaatg

SEQ ID NO: 8434225 - DNA, 21 bp, Homo sapiens
tgagtcttttgcacaaggaat

SEQ ID NO: 8434226 - DNA, 21 bp, Homo sapiens
tgagtcttttgcacaaggaat

SEQ ID NO: 8434227 - DNA, 22 bp, Homo sapiens
tgagtgaaaaatttgcctggag

SEQ ID NO: 8434228 - DNA, 22 bp, Homo sapiens
tgagtgggatgagttagaggtg

SEQ ID NO: 8434229 - DNA, 16 bp, Homo sapiens
tgagtgggagaagggg

SEQ ID NO: 8434230 - DNA, 17 bp, Homo sapiens
tgagtggccgggggaca

SEQ ID NO: 8434231 - DNA, 22 bp, Homo sapiens
tgagtggagactgtgtgtagag

SEQ ID NO: 8434232 - DNA, 20 bp, Homo sapiens
tgagtggccactgggtcgca

SEQ ID NO: 8434233 - DNA, 22 bp, Homo sapiens
tgagtgctttaaatgttatttt

SEQ ID NO: 8434234 - DNA, 22 bp, Homo sapiens
tgagtggacacctgcttcttta

SEQ ID NO: 8434235 - DNA, 22 bp, Homo sapiens
tgagtgctggctaaatagaaaa

SEQ ID NO: 8434236 - DNA, 22 bp, Homo sapiens
tgagtggagaacagaggctctc

SEQ ID NO: 8434237 - DNA, 22 bp, Homo sapiens
tgagtggacgtgaggctgagta

SEQ ID NO: 8434238 - DNA, 22 bp, Homo sapiens
tgagtggacacctgcttcttta

SEQ ID NO: 8434239 - DNA, 22 bp, Homo sapiens
tgagtgggattaaatgaggtga

SEQ ID NO: 8434240 - DNA, 22 bp, Homo sapiens
tgagtgggttatcaggaaaggt

SEQ ID NO: 8434241 - DNA, 22 bp, Homo sapiens
tgagttctaggcttaaaactaa

SEQ ID NO: 8434242 - DNA, 22 bp, Homo sapiens
tgagttcaagtccaagttgctg

SEQ ID NO: 8434243 - DNA, 22 bp, Homo sapiens
tgagtgttgtaaccatatgatt

SEQ ID NO: 8434244 - DNA, 22 bp, Homo sapiens
tgagttaaatgagaacatgaaa

SEQ ID NO: 8434245 - DNA, 22 bp, Homo sapiens
tgagttatatatactggctctg

SEQ ID NO: 8434246 - DNA, 22 bp, Homo sapiens
tgatagaaaggaaattaattgg

SEQ ID NO: 8434247 - DNA, 22 bp, Homo sapiens
tgatagaagcagaagcatacca

SEQ ID NO: 8434248 - DNA, 22 bp, Homo sapiens
tgatagaagcagaagcatacca

SEQ ID NO: 8434249 - DNA, 22 bp, Homo sapiens
tgataggcttaattttcctgtc

SEQ ID NO: 8434250 - DNA, 21 bp, Homo sapiens
tgatagggtttgggcaattat

SEQ ID NO: 8434251 - DNA, 22 bp, Homo sapiens
tgatagagcactaagtagtgta

SEQ ID NO: 8434252 - DNA, 23 bp, Homo sapiens
tgagttctaggcttaaaactagc

SEQ ID NO: 8434253 - DNA, 22 bp, Homo sapiens
tgagttctcatgaaatctagtt

SEQ ID NO: 8434254 - DNA, 22 bp, Homo sapiens
tgagttctccaggaagcagact

SEQ ID NO: 8434255 - DNA, 22 bp, Homo sapiens
tgatatgtaactactccttata

SEQ ID NO: 8434256 - DNA, 22 bp, Homo sapiens
tgatatctaccataaccattcg

SEQ ID NO: 8434257 - DNA, 22 bp, Homo sapiens
tgatatctgaagtgtataaaca

SEQ ID NO: 8434258 - DNA, 22 bp, Homo sapiens
tgatatttaagcaaaaatatgg

SEQ ID NO: 8434259 - DNA, 22 bp, Homo sapiens
tgatatttaagcaaaaatatgg

SEQ ID NO: 8434260 - DNA, 22 bp, Homo sapiens
tgatatttgctgactgcattgt

SEQ ID NO: 8434261 - DNA, 22 bp, Homo sapiens
tgatctttactgctgtttataa

SEQ ID NO: 8434262 - DNA, 22 bp, Homo sapiens
tgatctttactgctgtttataa

SEQ ID NO: 8434263 - DNA, 19 bp, Homo sapiens
tgatctggaaggaaccagg

SEQ ID NO: 8434264 - DNA, 22 bp, Homo sapiens
tgatctggaattccctgtggta

SEQ ID NO: 8434265 - DNA, 22 bp, Homo sapiens
tgatctggtcctactgtgggca

SEQ ID NO: 8434266 - DNA, 22 bp, Homo sapiens
tgatcccaatctttcctgctcc

SEQ ID NO: 8434267 - DNA, 22 bp, Homo sapiens
tgatctaggttggcttcaactg

SEQ ID NO: 8434268 - DNA, 22 bp, Homo sapiens
tgatcaaattcaggagtctgga

SEQ ID NO: 8434269 - DNA, 22 bp, Homo sapiens
tgatcacaagtctgaagaatga

SEQ ID NO: 8434270 - DNA, 22 bp, Homo sapiens
tgatcaaagccaaagttgagat

SEQ ID NO: 8434271 - DNA, 22 bp, Homo sapiens
tgatccatatgtgttacttctc

SEQ ID NO: 8434272 - DNA, 22 bp, Homo sapiens
tgaattagcagtagacagactg

SEQ ID NO: 8434273 - DNA, 19 bp, Homo sapiens
tgaattagaattatcctct

SEQ ID NO: 8434274 - DNA, 18 bp, Homo sapiens
tgaattagtttgtggttt

SEQ ID NO: 8434275 - DNA, 23 bp, Homo sapiens
tgaatgtttattctcggtgcaga

SEQ ID NO: 8434276 - DNA, 22 bp, Homo sapiens
tgaatgtgatgctaaacatatg

SEQ ID NO: 8434277 - DNA, 22 bp, Homo sapiens
tgaatgaatcctaacaaagaca

SEQ ID NO: 8434278 - DNA, 22 bp, Homo sapiens
tgaatctttttggaaataaaga

SEQ ID NO: 8434279 - DNA, 22 bp, Homo sapiens
tgaatgcttggagtcataaaat

SEQ ID NO: 8434280 - DNA, 22 bp, Homo sapiens
tgaatagactggggctgtgaag

SEQ ID NO: 8434281 - DNA, 22 bp, Homo sapiens
tgaatagagcttggcactagaa

SEQ ID NO: 8434282 - DNA, 22 bp, Homo sapiens
tgaatacaggaaaatatactga

SEQ ID NO: 8434283 - DNA, 22 bp, Homo sapiens
tgaatagatttttaacatataa

SEQ ID NO: 8434284 - DNA, 22 bp, Homo sapiens
tgaataatcttgggtattaata

SEQ ID NO: 8434285 - DNA, 22 bp, Homo sapiens
tgaatacactaaaaatcacttt

SEQ ID NO: 8434286 - DNA, 22 bp, Homo sapiens
tgaatcaaagctgaagttttca

SEQ ID NO: 8434287 - DNA, 22 bp, Homo sapiens
tgaatcaatgaattgcacttca

SEQ ID NO: 8434288 - DNA, 22 bp, Homo sapiens
tgaatcaatagttgcaagtatt

SEQ ID NO: 8434289 - DNA, 22 bp, Homo sapiens
tgaatcaattgtcttaagacat

SEQ ID NO: 8434290 - DNA, 23 bp, Homo sapiens
tgaatcaattatgggattcaatg

SEQ ID NO: 8434291 - DNA, 23 bp, Homo sapiens
tgaatcaattatgggattcaatg

SEQ ID NO: 8434292 - DNA, 22 bp, Homo sapiens
tgacacaaaggaaagcataatc

SEQ ID NO: 8434293 - DNA, 22 bp, Homo sapiens
tgacaaattcatatttcagagg

SEQ ID NO: 8434294 - DNA, 22 bp, Homo sapiens
tgacaaagtgaggtcttcagta

SEQ ID NO: 8434295 - DNA, 22 bp, Homo sapiens
tgacaaatatttgaagaggctg

SEQ ID NO: 8434296 - DNA, 22 bp, Homo sapiens
tgacaaagacaaagatatgtcc

SEQ ID NO: 8434297 - DNA, 22 bp, Homo sapiens
tgacaaaccagtagcaataaag

SEQ ID NO: 8434298 - DNA, 22 bp, Homo sapiens
tgacaaaactgcaattactttt

SEQ ID NO: 8434299 - DNA, 22 bp, Homo sapiens
tgaattccctgcaggcatcctc

SEQ ID NO: 8434300 - DNA, 22 bp, Homo sapiens
tgaattcttaatgaaatctact

SEQ ID NO: 8434301 - DNA, 21 bp, Homo sapiens
tgaatttcggtatggctataa

SEQ ID NO: 8434302 - DNA, 22 bp, Homo sapiens
tgaattcttttagaattcagtg

SEQ ID NO: 8434303 - DNA, 22 bp, Homo sapiens
tgaattcttttagaattcagtg

SEQ ID NO: 8434304 - DNA, 22 bp, Homo sapiens
tgaattgtggctttttccaatt

SEQ ID NO: 8434305 - DNA, 22 bp, Homo sapiens
tgaagccaatctgccaggcaga

SEQ ID NO: 8434306 - DNA, 22 bp, Homo sapiens
tgaagccactttccagaatcac

SEQ ID NO: 8434307 - DNA, 22 bp, Homo sapiens
tgaagccatcaggaagccagca

SEQ ID NO: 8434308 - DNA, 22 bp, Homo sapiens
tgaaggaggaatgtggcctcca

SEQ ID NO: 8434309 - DNA, 22 bp, Homo sapiens
tgaaggcacgtgggtggatact

SEQ ID NO: 8434310 - DNA, 22 bp, Homo sapiens
tgaaggcacgtgggtggatact

SEQ ID NO: 8434311 - DNA, 22 bp, Homo sapiens
tgaaggcaactgagaaaaagca

SEQ ID NO: 8434312 - DNA, 22 bp, Homo sapiens
tgaaggagctcaggagatagtc

SEQ ID NO: 8434313 - DNA, 22 bp, Homo sapiens
tgaaggagatttttagggaggc

SEQ ID NO: 8434314 - DNA, 22 bp, Homo sapiens
tgaataatcttgggtattaata

SEQ ID NO: 8434315 - DNA, 22 bp, Homo sapiens
tgaataaattgagagcgaatgt

SEQ ID NO: 8434316 - DNA, 20 bp, Homo sapiens
tgaaggtgactcctttcttg

SEQ ID NO: 8434317 - DNA, 22 bp, Homo sapiens
tgaaggggttcagcatgggggt

SEQ ID NO: 8434318 - DNA, 21 bp, Homo sapiens
tgaaggggtggcagtgtgctt

SEQ ID NO: 8434319 - DNA, 22 bp, Homo sapiens
tgaaggtaatggaatctcctga

SEQ ID NO: 8434320 - DNA, 22 bp, Homo sapiens
tgaaggcttttagctctgaaaa

SEQ ID NO: 8434321 - DNA, 22 bp, Homo sapiens
tgaaggctttctcccctctggt

SEQ ID NO: 8434322 - DNA, 22 bp, Homo sapiens
tgaaggctttttaaagcatttg

SEQ ID NO: 8434323 - DNA, 22 bp, Homo sapiens
tgaaggcttggtggcagcctct

SEQ ID NO: 8434324 - DNA, 22 bp, Homo sapiens
tgaaggcttggtggcagcctct

SEQ ID NO: 8434325 - DNA, 22 bp, Homo sapiens
tgaaggcttggattggtcattt

SEQ ID NO: 8434326 - DNA, 22 bp, Homo sapiens
tgaaggcttgactgaggcagga

SEQ ID NO: 8434327 - DNA, 22 bp, Homo sapiens
tgaaggctgggctcagccagct

SEQ ID NO: 8434328 - DNA, 22 bp, Homo sapiens
tgaaggctgttggatggggaag

SEQ ID NO: 8434329 - DNA, 22 bp, Homo sapiens
tgaaggctggtagtttgggctg

SEQ ID NO: 8434330 - DNA, 22 bp, Homo sapiens
tgaaggctgtcacctgcacctt

SEQ ID NO: 8434331 - DNA, 22 bp, Homo sapiens
tgaaggctgtcacctgcacctt

SEQ ID NO: 8434332 - DNA, 22 bp, Homo sapiens
tgaaggccacttcctgtgagct

SEQ ID NO: 8434333 - DNA, 22 bp, Homo sapiens
tgaaggcacttgcctaggggca

SEQ ID NO: 8434334 - DNA, 20 bp, Homo sapiens
tgaaggcaggtaagaaagat

SEQ ID NO: 8434335 - DNA, 22 bp, Homo sapiens
tgaaggcagtgagtttgtgttt

SEQ ID NO: 8434336 - DNA, 22 bp, Homo sapiens
tgaaggcagtgagtttgtgttt

SEQ ID NO: 8434337 - DNA, 22 bp, Homo sapiens
tgaaggcataaatcttgggaac

SEQ ID NO: 8434338 - DNA, 22 bp, Homo sapiens
tgaaggcatttgagttggtgag

SEQ ID NO: 8434339 - DNA, 22 bp, Homo sapiens
tgaaggcatttgagttggtgag

SEQ ID NO: 8434340 - DNA, 22 bp, Homo sapiens
tgacattattatcatgtcacca

SEQ ID NO: 8434341 - DNA, 22 bp, Homo sapiens
tgacatttaatccctaaatatt

SEQ ID NO: 8434342 - DNA, 21 bp, Homo sapiens
tgacatttccaatataaagcc

SEQ ID NO: 8434343 - DNA, 22 bp, Homo sapiens
tgacatttcagatatggtattt

SEQ ID NO: 8434344 - DNA, 22 bp, Homo sapiens
tgacatttatcaaagaaatggt

SEQ ID NO: 8434345 - DNA, 22 bp, Homo sapiens
tgacatttatcaaagaaatggt

SEQ ID NO: 8434346 - DNA, 22 bp, Homo sapiens
tgacatttgagcatacatgtaa

SEQ ID NO: 8434347 - DNA, 22 bp, Homo sapiens
tgacatttcggtgtatgtgatg

SEQ ID NO: 8434348 - DNA, 18 bp, Homo sapiens
tgacatttccagagtgta

SEQ ID NO: 8434349 - DNA, 21 bp, Homo sapiens
tgacatttggattcatagtaa

SEQ ID NO: 8434350 - DNA, 22 bp, Homo sapiens
tgacctattagatttccttgcc

SEQ ID NO: 8434351 - DNA, 22 bp, Homo sapiens
tgaccctttcattattctcatt

SEQ ID NO: 8434352 - DNA, 20 bp, Homo sapiens
tgacttcttcatgctgtact

SEQ ID NO: 8434353 - DNA, 20 bp, Homo sapiens
tgacttcttcatgctgtact

SEQ ID NO: 8434354 - DNA, 22 bp, Homo sapiens
tgacttctgggtgagccagcat

SEQ ID NO: 8434355 - DNA, 20 bp, Homo sapiens
tgacttcttcatgctgtact

SEQ ID NO: 8434356 - DNA, 20 bp, Homo sapiens
tgacttctgggatttgtggt

SEQ ID NO: 8434357 - DNA, 22 bp, Homo sapiens
tgacttctctggcctggtgcag

SEQ ID NO: 8434358 - DNA, 22 bp, Homo sapiens
tgactttaaaataacaagttta

SEQ ID NO: 8434359 - DNA, 22 bp, Homo sapiens
tgacttgtctctttgggagaca

SEQ ID NO: 8434360 - DNA, 22 bp, Homo sapiens
tgacttgtctctttgggagaca

SEQ ID NO: 8434361 - DNA, 22 bp, Homo sapiens
tgacttcctgcactcaggtgat

SEQ ID NO: 8434362 - DNA, 22 bp, Homo sapiens
tgactgaggcagcctgagttat

SEQ ID NO: 8434363 - DNA, 22 bp, Homo sapiens
tgactgtgcctgttgaatgaat

SEQ ID NO: 8434364 - DNA, 22 bp, Homo sapiens
tgactgccgattgtccttctct

SEQ ID NO: 8434365 - DNA, 22 bp, Homo sapiens
tgactaaaataggacattaact

SEQ ID NO: 8434366 - DNA, 22 bp, Homo sapiens
tgacggctgggggcagtggtca

SEQ ID NO: 8434367 - DNA, 22 bp, Homo sapiens
tgacgttttaggtgttaaatcg

SEQ ID NO: 8434368 - DNA, 22 bp, Homo sapiens
tgactaaaataggacattaact

SEQ ID NO: 8434369 - DNA, 21 bp, Homo sapiens
tgactaattgtgataaagtgc

SEQ ID NO: 8434370 - DNA, 22 bp, Homo sapiens
tgactcttggtgattactgggt

SEQ ID NO: 8434371 - DNA, 22 bp, Homo sapiens
tgactccaaacagaaaacgaat

SEQ ID NO: 8434372 - DNA, 22 bp, Homo sapiens
tgactcacttaatttacaagtc

SEQ ID NO: 8434373 - DNA, 18 bp, Homo sapiens
tgactcaccctgtcagtg

SEQ ID NO: 8434374 - DNA, 22 bp, Homo sapiens
tgactcaccatcggagtttgaa

SEQ ID NO: 8434375 - DNA, 22 bp, Homo sapiens
tgactcaagagcctgactcatc

SEQ ID NO: 8434376 - DNA, 22 bp, Homo sapiens
tgacagtattgatggcaggatt

SEQ ID NO: 8434377 - DNA, 22 bp, Homo sapiens
tgacaggtgctgggggcagtgt

SEQ ID NO: 8434378 - DNA, 22 bp, Homo sapiens
tgacaggttcgttagtcatgtt

SEQ ID NO: 8434379 - DNA, 22 bp, Homo sapiens
tgacaggggctggtggataaat

SEQ ID NO: 8434380 - DNA, 22 bp, Homo sapiens
tgacagggggcagaggtggctg

SEQ ID NO: 8434381 - DNA, 22 bp, Homo sapiens
tgacagggctagaggcaatgca

SEQ ID NO: 8434382 - DNA, 22 bp, Homo sapiens
tgacagggaggtggaataagta

SEQ ID NO: 8434383 - DNA, 22 bp, Homo sapiens
tgacagggtgattatgagagct

SEQ ID NO: 8434384 - DNA, 22 bp, Homo sapiens
tgacaggggctggtggataaat

SEQ ID NO: 8434385 - DNA, 22 bp, Homo sapiens
tgacagggtcagagctgagctg

SEQ ID NO: 8434386 - DNA, 22 bp, Homo sapiens
tgacagcatgaccacagggtct

SEQ ID NO: 8434387 - DNA, 21 bp, Homo sapiens
tgacaggcaccctggctgtga

SEQ ID NO: 8434388 - DNA, 22 bp, Homo sapiens
tgacagggacagtggagatgga

SEQ ID NO: 8434389 - DNA, 22 bp, Homo sapiens
tgacagggaaaggtcctctttt

SEQ ID NO: 8434390 - DNA, 22 bp, Homo sapiens
tgacagggacagtggagatgga

SEQ ID NO: 8434391 - DNA, 19 bp, Homo sapiens
tgacaggctgttgccttga

SEQ ID NO: 8434392 - DNA, 23 bp, Homo sapiens
tgacaggctttgctccttctgcc

SEQ ID NO: 8434393 - DNA, 23 bp, Homo sapiens
tgacaggctttgctccttctgcc

SEQ ID NO: 8434394 - DNA, 22 bp, Homo sapiens
tgacaggctaggaggctgaagg

SEQ ID NO: 8434395 - DNA, 23 bp, Homo sapiens
tgacaggctgcttctggctgagg

SEQ ID NO: 8434396 - DNA, 22 bp, Homo sapiens
tgacaggcagtgctgggcatgt

SEQ ID NO: 8434397 - DNA, 22 bp, Homo sapiens
tgacaggcgtttttctctagta

SEQ ID NO: 8434398 - DNA, 22 bp, Homo sapiens
tgacaggcagtgctgggcatgt

SEQ ID NO: 8434399 - DNA, 23 bp, Homo sapiens
tgacaggccagaagagcagctgg

SEQ ID NO: 8434400 - DNA, 23 bp, Homo sapiens
tgacaggccagaagagcagctgg

SEQ ID NO: 8434401 - DNA, 22 bp, Homo sapiens
tgacagaaagaatatgtcaatc

SEQ ID NO: 8434402 - DNA, 22 bp, Homo sapiens
tgacagaaatagttcttaattt

SEQ ID NO: 8434403 - DNA, 22 bp, Homo sapiens
tgacagaacaggttgggagcaa

SEQ ID NO: 8434404 - DNA, 22 bp, Homo sapiens
tgacagaaatagttcttaattt

SEQ ID NO: 8434405 - DNA, 22 bp, Homo sapiens
tgacacataccgaaaatatttg

SEQ ID NO: 8434406 - DNA, 22 bp, Homo sapiens
tgacacatgcaccagtctttaa

SEQ ID NO: 8434407 - DNA, 22 bp, Homo sapiens
tgacacagttgtcgactctaca

SEQ ID NO: 8434408 - DNA, 22 bp, Homo sapiens
tgacacagtatcaaacatgatt

SEQ ID NO: 8434409 - DNA, 22 bp, Homo sapiens
tgacacagtagaaagatgatga

SEQ ID NO: 8434410 - DNA, 22 bp, Homo sapiens
tgacaccaaggaagtatcattt

SEQ ID NO: 8434411 - DNA, 23 bp, Homo sapiens
tgacacaggtcaaaaataagatg

SEQ ID NO: 8434412 - DNA, 23 bp, Homo sapiens
tgacacaggtcaaaaataagatg

SEQ ID NO: 8434413 - DNA, 22 bp, Homo sapiens
tgacacaggggaaggagtctgg

SEQ ID NO: 8434414 - DNA, 22 bp, Homo sapiens
tgacacagggcatgcagcagaa

SEQ ID NO: 8434415 - DNA, 22 bp, Homo sapiens
tgacacagattagagacatacc

SEQ ID NO: 8434416 - DNA, 22 bp, Homo sapiens
tgacacactaggaaaagcattt

SEQ ID NO: 8434417 - DNA, 22 bp, Homo sapiens
tgaaaaaacaagttggcccatt

SEQ ID NO: 8434418 - DNA, 22 bp, Homo sapiens
tgaaaaaacaagttggcccatt

SEQ ID NO: 8434419 - DNA, 22 bp, Homo sapiens
tctttttttcctgtgcagagct

SEQ ID NO: 8434420 - DNA, 22 bp, Homo sapiens
tgaaaaaacaagttggcccatt

SEQ ID NO: 8434421 - DNA, 22 bp, Homo sapiens
tgaaaaaacaagttggcccatt

SEQ ID NO: 8434422 - DNA, 22 bp, Homo sapiens
tgaaaaacctcagtccgcttta

SEQ ID NO: 8434423 - DNA, 22 bp, Homo sapiens
tgaaaaactgaatagttgagta

SEQ ID NO: 8434424 - DNA, 22 bp, Homo sapiens
tgaaaaacactaattggaaagc

SEQ ID NO: 8434425 - DNA, 22 bp, Homo sapiens
tgaaaaacactaattggaaagc

SEQ ID NO: 8434426 - DNA, 22 bp, Homo sapiens
tgaaaaacactaattggaaagc

SEQ ID NO: 8434427 - DNA, 22 bp, Homo sapiens
tgaaaaacctcagtccgcttta

SEQ ID NO: 8434428 - DNA, 22 bp, Homo sapiens
tgaaaaactttaatccataaag

SEQ ID NO: 8434429 - DNA, 22 bp, Homo sapiens
tgaaaaactttaatccataaag

SEQ ID NO: 8434430 - DNA, 22 bp, Homo sapiens
tgaaaaactgaatagttgagta

SEQ ID NO: 8434431 - DNA, 22 bp, Homo sapiens
tgaaaaactttaatccataaag

SEQ ID NO: 8434432 - DNA, 22 bp, Homo sapiens
tctttttttcctgtgcagagct

SEQ ID NO: 8434433 - DNA, 22 bp, Homo sapiens
tctttttttcctgtgcagagct

SEQ ID NO: 8434434 - DNA, 22 bp, Homo sapiens
tgaaaaaacaagttggcccatt

SEQ ID NO: 8434435 - DNA, 22 bp, Homo sapiens
tctttttctgcacacgtgtccc

SEQ ID NO: 8434436 - DNA, 22 bp, Homo sapiens
tctttttatattgacaaaaggt

SEQ ID NO: 8434437 - DNA, 22 bp, Homo sapiens
tctttttctgcacacgtgtccc

SEQ ID NO: 8434438 - DNA, 22 bp, Homo sapiens
tctttttatattgacaaaaggt

SEQ ID NO: 8434439 - DNA, 22 bp, Homo sapiens
tctttttatattgacaaaaggt

SEQ ID NO: 8434440 - DNA, 23 bp, Homo sapiens
tctttttaagagatctagtgacg

SEQ ID NO: 8434441 - DNA, 22 bp, Homo sapiens
tcttttgttgcctacttattaa

SEQ ID NO: 8434442 - DNA, 22 bp, Homo sapiens
tgaaaattcatctcatagcaga

SEQ ID NO: 8434443 - DNA, 22 bp, Homo sapiens
tgaaaatatagttttccagact

SEQ ID NO: 8434444 - DNA, 22 bp, Homo sapiens
tgaaaagactgcaagagagcat

SEQ ID NO: 8434445 - DNA, 22 bp, Homo sapiens
tgaaaacttgacaagtgaggta

SEQ ID NO: 8434446 - DNA, 22 bp, Homo sapiens
tgaaaactccaagtttcatcag

SEQ ID NO: 8434447 - DNA, 22 bp, Homo sapiens
tgaaagaagtgtcacattgcca

SEQ ID NO: 8434448 - DNA, 22 bp, Homo sapiens
tgaaagaagcctccctttggag

SEQ ID NO: 8434449 - DNA, 22 bp, Homo sapiens
tgaaagaagccttcgaggctcg

SEQ ID NO: 8434450 - DNA, 22 bp, Homo sapiens
tgaaagaagggtggaaaatgta

SEQ ID NO: 8434451 - DNA, 22 bp, Homo sapiens
tgaaagaagggtggaaaatgta

SEQ ID NO: 8434452 - DNA, 22 bp, Homo sapiens
tgaaagaagggtggaaaatgta

SEQ ID NO: 8434453 - DNA, 21 bp, Homo sapiens
tgaaagaaggtgcagtctgaa

SEQ ID NO: 8434454 - DNA, 22 bp, Homo sapiens
tgaaacttctaatatgaatagt

SEQ ID NO: 8434455 - DNA, 22 bp, Homo sapiens
tgaaactgaaaggtatttatag

SEQ ID NO: 8434456 - DNA, 22 bp, Homo sapiens
tgaaaccccagattaccacaaa

SEQ ID NO: 8434457 - DNA, 22 bp, Homo sapiens
tgaaacattaggaaatcattat

SEQ ID NO: 8434458 - DNA, 22 bp, Homo sapiens
tgaaacattgcactgtatgaat

SEQ ID NO: 8434459 - DNA, 23 bp, Homo sapiens
tgaaacatttagggtagaatttc

SEQ ID NO: 8434460 - DNA, 23 bp, Homo sapiens
tgaaacatttagggtagaatttc

SEQ ID NO: 8434461 - DNA, 21 bp, Homo sapiens
tgaaacatttgatcaaagcac

SEQ ID NO: 8434462 - DNA, 22 bp, Homo sapiens
tgaaacagtgcttcactcagcc

SEQ ID NO: 8434463 - DNA, 22 bp, Homo sapiens
tgaaacaggcaaaactgcagat

SEQ ID NO: 8434464 - DNA, 22 bp, Homo sapiens
tgaaacagtagtctgtgggttt

SEQ ID NO: 8434465 - DNA, 22 bp, Homo sapiens
tgaaacaggaagtaaacagaca

SEQ ID NO: 8434466 - DNA, 21 bp, Homo sapiens
tcttttcctttctgtgtgcaa

SEQ ID NO: 8434467 - DNA, 21 bp, Homo sapiens
tcttttctcagctttgtggtt

SEQ ID NO: 8434468 - DNA, 22 bp, Homo sapiens
tcttttccttccctacagatct

SEQ ID NO: 8434469 - DNA, 22 bp, Homo sapiens
tcttttcattgagaacacactg

SEQ ID NO: 8434470 - DNA, 22 bp, Homo sapiens
tcttttattaggctgaaatggg

SEQ ID NO: 8434471 - DNA, 22 bp, Homo sapiens
tcttttatcctacatttagctc

SEQ ID NO: 8434472 - DNA, 23 bp, Homo sapiens
tcttttcaatggttctttatgtg

SEQ ID NO: 8434473 - DNA, 21 bp, Homo sapiens
tcttttaacaccaggaattcc

SEQ ID NO: 8434474 - DNA, 22 bp, Homo sapiens
tcttttaacctaactagcttgg

SEQ ID NO: 8434475 - DNA, 22 bp, Homo sapiens
tcttttaacctaactagcttgg

SEQ ID NO: 8434476 - DNA, 22 bp, Homo sapiens
tcttttaacctaactagcttgg

SEQ ID NO: 8434477 - DNA, 22 bp, Homo sapiens
tcttttaagcctctggcatagg

SEQ ID NO: 8434478 - DNA, 22 bp, Homo sapiens
tcttttagaaaagttgaatgta

SEQ ID NO: 8434479 - DNA, 22 bp, Homo sapiens
tcttttaagcctctggcatagg

SEQ ID NO: 8434480 - DNA, 22 bp, Homo sapiens
tcttttagaaaagttgaatgta

SEQ ID NO: 8434481 - DNA, 22 bp, Homo sapiens
tcttttatagtgaattttcttg

SEQ ID NO: 8434482 - DNA, 22 bp, Homo sapiens
tcttttatagtgaattttcttg

SEQ ID NO: 8434483 - DNA, 20 bp, Homo sapiens
tctttgtgtcagatggacag

SEQ ID NO: 8434484 - DNA, 22 bp, Homo sapiens
tctttgtgttcaggagccacgt

SEQ ID NO: 8434485 - DNA, 20 bp, Homo sapiens
tctttgttaattttatctcc

SEQ ID NO: 8434486 - DNA, 22 bp, Homo sapiens
tctttgttattgctttatctat

SEQ ID NO: 8434487 - DNA, 20 bp, Homo sapiens
tctttgttaattttatctcc

SEQ ID NO: 8434488 - DNA, 22 bp, Homo sapiens
tctttgttattgctttatctat

SEQ ID NO: 8434489 - DNA, 22 bp, Homo sapiens
tctttgtttgcctttatcaaga

SEQ ID NO: 8434490 - DNA, 18 bp, Homo sapiens
tctttgtttccttcttgc

SEQ ID NO: 8434491 - DNA, 22 bp, Homo sapiens
tctttgtttgcctttatcaaga

SEQ ID NO: 8434492 - DNA, 22 bp, Homo sapiens
tcttttaaaagccctgctgtct

SEQ ID NO: 8434493 - DNA, 22 bp, Homo sapiens
tctttgtttgtactgttagaat

SEQ ID NO: 8434494 - DNA, 22 bp, Homo sapiens
tctttgtttgtactgttagaat

SEQ ID NO: 8434495 - DNA, 22 bp, Homo sapiens
tctttgtagttataaacgactt

SEQ ID NO: 8434496 - DNA, 22 bp, Homo sapiens
tctttgtggcgggcttaaatac

SEQ ID NO: 8434497 - DNA, 22 bp, Homo sapiens
tctttgtctgaacagggacatt

SEQ ID NO: 8434498 - DNA, 19 bp, Homo sapiens
tctttgtacaagtctctgc

SEQ ID NO: 8434499 - DNA, 16 bp, Homo sapiens
tctttgtaatcagcag

SEQ ID NO: 8434500 - DNA, 22 bp, Homo sapiens
tctttggcatttaggagcagga

SEQ ID NO: 8434501 - DNA, 22 bp, Homo sapiens
tctttggcatcagggccagcta

SEQ ID NO: 8434502 - DNA, 22 bp, Homo sapiens
tctttggattaaaatatttgta

SEQ ID NO: 8434503 - DNA, 22 bp, Homo sapiens
tctttggactttccaatttgtt

SEQ ID NO: 8434504 - DNA, 18 bp, Homo sapiens
tctttggacaactactgg

SEQ ID NO: 8434505 - DNA, 22 bp, Homo sapiens
tctttggaatgctagcattcta

SEQ ID NO: 8434506 - DNA, 22 bp, Homo sapiens
tctttggagtgttatcagtaat

SEQ ID NO: 8434507 - DNA, 22 bp, Homo sapiens
tctttggatcccaactggctgg

SEQ ID NO: 8434508 - DNA, 22 bp, Homo sapiens
tctttggatctcaaggtggcag

SEQ ID NO: 8434509 - DNA, 22 bp, Homo sapiens
tctttggatggaaaatgtattc

SEQ ID NO: 8434510 - DNA, 22 bp, Homo sapiens
tctttggatgcgttacttttac

SEQ ID NO: 8434511 - DNA, 22 bp, Homo sapiens
tctttgattttgttactaagac

SEQ ID NO: 8434512 - DNA, 22 bp, Homo sapiens
tctttggaaatgctttgagaat

SEQ ID NO: 8434513 - DNA, 22 bp, Homo sapiens
tctttggaagctttcagagaag

SEQ ID NO: 8434514 - DNA, 22 bp, Homo sapiens
tctttggaaatgctttgagaat

SEQ ID NO: 8434515 - DNA, 22 bp, Homo sapiens
tctttgcattcctgtgtgcttt

SEQ ID NO: 8434516 - DNA, 18 bp, Homo sapiens
tgaactggcatcagaatc

SEQ ID NO: 8434517 - DNA, 22 bp, Homo sapiens
tgaacttacaaattaaaagact

SEQ ID NO: 8434518 - DNA, 17 bp, Homo sapiens
tgaactttaggtggagc

SEQ ID NO: 8434519 - DNA, 22 bp, Homo sapiens
tgaactttcacaagaatatgct

SEQ ID NO: 8434520 - DNA, 22 bp, Homo sapiens
tgaactttcacaagaatatgct

SEQ ID NO: 8434521 - DNA, 18 bp, Homo sapiens
tgaactttggtgtctctc

SEQ ID NO: 8434522 - DNA, 22 bp, Homo sapiens
tgaactttgtagtaatggagat

SEQ ID NO: 8434523 - DNA, 22 bp, Homo sapiens
tgaaccatctggctccagaaga

SEQ ID NO: 8434524 - DNA, 22 bp, Homo sapiens
tgaaccttcataaaattaagtg

SEQ ID NO: 8434525 - DNA, 22 bp, Homo sapiens
tgaacctttgtgttggacctgg

SEQ ID NO: 8434526 - DNA, 22 bp, Homo sapiens
tgaaccttttgaataaggacca

SEQ ID NO: 8434527 - DNA, 22 bp, Homo sapiens
tgaaccttttgctaagaagtta

SEQ ID NO: 8434528 - DNA, 22 bp, Homo sapiens
tgaaattatgcattgttgtacc

SEQ ID NO: 8434529 - DNA, 22 bp, Homo sapiens
tgaaattagtgaagttacagtt

SEQ ID NO: 8434530 - DNA, 22 bp, Homo sapiens
tgaaattattcttaccaaggtg

SEQ ID NO: 8434531 - DNA, 22 bp, Homo sapiens
tgaaattatgcattgttgtacc

SEQ ID NO: 8434532 - DNA, 22 bp, Homo sapiens
tgaacagtgatctacatgtggc

SEQ ID NO: 8434533 - DNA, 22 bp, Homo sapiens
tgaagaaacagaccaagaggat

SEQ ID NO: 8434534 - DNA, 22 bp, Homo sapiens
tgaagaaaatatgattacccca

SEQ ID NO: 8434535 - DNA, 22 bp, Homo sapiens
tgaacttttgcacagaggattt

SEQ ID NO: 8434536 - DNA, 22 bp, Homo sapiens
tgaacttttatttgatgacagg

SEQ ID NO: 8434537 - DNA, 22 bp, Homo sapiens
tgaacttttatttgatgacagg

SEQ ID NO: 8434538 - DNA, 18 bp, Homo sapiens
tgaacttttcctgctgct

SEQ ID NO: 8434539 - DNA, 22 bp, Homo sapiens
tgaagaaacgcagagaggtagg

SEQ ID NO: 8434540 - DNA, 22 bp, Homo sapiens
tgaagactcagaagctaagata

SEQ ID NO: 8434541 - DNA, 18 bp, Homo sapiens
tgaagacatgaggttagt

SEQ ID NO: 8434542 - DNA, 22 bp, Homo sapiens
tgaagacaagaaaacactgggg

SEQ ID NO: 8434543 - DNA, 22 bp, Homo sapiens
tgaagcaaacgcttctgttcct

SEQ ID NO: 8434544 - DNA, 22 bp, Homo sapiens
tgaagcaaatttttctcagagt

SEQ ID NO: 8434545 - DNA, 19 bp, Homo sapiens
tgaagcaggcagagaagat

SEQ ID NO: 8434546 - DNA, 22 bp, Homo sapiens
tgaaatgttaatcacacaaagg

SEQ ID NO: 8434547 - DNA, 22 bp, Homo sapiens
tgaaatgttaaacaagtggctc

SEQ ID NO: 8434548 - DNA, 22 bp, Homo sapiens
tgaaatgtttgggtccagaagt

SEQ ID NO: 8434549 - DNA, 22 bp, Homo sapiens
tgaaatcattgccaagtattga

SEQ ID NO: 8434550 - DNA, 22 bp, Homo sapiens
tgaaatcatgaacaaggtaggt

SEQ ID NO: 8434551 - DNA, 22 bp, Homo sapiens
tgaaatcatctgccaataagtt

SEQ ID NO: 8434552 - DNA, 22 bp, Homo sapiens
tgaaatcattggggttgaataa

SEQ ID NO: 8434553 - DNA, 22 bp, Homo sapiens
tgaaatctaccctattcagggt

SEQ ID NO: 8434554 - DNA, 22 bp, Homo sapiens
tgaaatcttagccattctgcct

SEQ ID NO: 8434555 - DNA, 22 bp, Homo sapiens
tgaaatctgtcccactttagct

SEQ ID NO: 8434556 - DNA, 21 bp, Homo sapiens
tgaaatctgatgggacaaatg

SEQ ID NO: 8434557 - DNA, 22 bp, Homo sapiens
tgaaatgcaacagttatttttg

SEQ ID NO: 8434558 - DNA, 22 bp, Homo sapiens
tgaaatgaaacagaacatatca

SEQ ID NO: 8434559 - DNA, 22 bp, Homo sapiens
tgaaatcttatactttggtagt

SEQ ID NO: 8434560 - DNA, 22 bp, Homo sapiens
tgaaatcttcactaagtctctt

SEQ ID NO: 8434561 - DNA, 22 bp, Homo sapiens
tgaaatgcttaggaccagaagg

SEQ ID NO: 8434562 - DNA, 22 bp, Homo sapiens
tgaaatgtacaagtgctttttt

SEQ ID NO: 8434563 - DNA, 22 bp, Homo sapiens
tgaaatgcttgggaccagaagt

SEQ ID NO: 8434564 - DNA, 22 bp, Homo sapiens
tgaaagataagttattatgtac

SEQ ID NO: 8434565 - DNA, 22 bp, Homo sapiens
tgaaagagtttgacatgattct

SEQ ID NO: 8434566 - DNA, 22 bp, Homo sapiens
tgaaagattgtgattcaatatg

SEQ ID NO: 8434567 - DNA, 22 bp, Homo sapiens
tgaaagcaacctgtaacagtga

SEQ ID NO: 8434568 - DNA, 22 bp, Homo sapiens
tgaaagcacaagttctaacagg

SEQ ID NO: 8434569 - DNA, 22 bp, Homo sapiens
tgaaagcactcacttctgctct

SEQ ID NO: 8434570 - DNA, 23 bp, Homo sapiens
tgaaagcaatgggtctatagtat

SEQ ID NO: 8434571 - DNA, 23 bp, Homo sapiens
tgaaagcaatgggtctatagtat

SEQ ID NO: 8434572 - DNA, 23 bp, Homo sapiens
tgaaagcaatgggtctatagtat

SEQ ID NO: 8434573 - DNA, 22 bp, Homo sapiens
tgaaagtctctgttatagagaa

SEQ ID NO: 8434574 - DNA, 23 bp, Homo sapiens
tgaaatattcttttgcatgagct

SEQ ID NO: 8434575 - DNA, 22 bp, Homo sapiens
tgaaatcaattgcaatgtttat

SEQ ID NO: 8434576 - DNA, 22 bp, Homo sapiens
tgaaatagaaaaacaggcttct

SEQ ID NO: 8434577 - DNA, 22 bp, Homo sapiens
tgaaatactgagtgaaagaatt

SEQ ID NO: 8434578 - DNA, 22 bp, Homo sapiens
tgaaataacttttgggtgagtt

SEQ ID NO: 8434579 - DNA, 20 bp, Homo sapiens
tgaaatagatactcagagat

SEQ ID NO: 8434580 - DNA, 22 bp, Homo sapiens
tgaaatagacacagtgctatac

SEQ ID NO: 8434581 - DNA, 22 bp, Homo sapiens
tgagacactctcgggcacattt

SEQ ID NO: 8434582 - DNA, 19 bp, Homo sapiens
tgagacagaagatgagcct

SEQ ID NO: 8434583 - DNA, 22 bp, Homo sapiens
tgagacactctcgggcacattt

SEQ ID NO: 8434584 - DNA, 19 bp, Homo sapiens
tgagacagaagatgagcct

SEQ ID NO: 8434585 - DNA, 22 bp, Homo sapiens
tgagacagcagtcagggaaata

SEQ ID NO: 8434586 - DNA, 22 bp, Homo sapiens
tgagacagcagattagcaatga

SEQ ID NO: 8434587 - DNA, 19 bp, Homo sapiens
tgagacagagaccagttct

SEQ ID NO: 8434588 - DNA, 22 bp, Homo sapiens
tgagacaatattaacctatctt

SEQ ID NO: 8434589 - DNA, 22 bp, Homo sapiens
tgagaattctacaatagatcaa

SEQ ID NO: 8434590 - DNA, 22 bp, Homo sapiens
tgagaattttttgtcatgcatt

SEQ ID NO: 8434591 - DNA, 22 bp, Homo sapiens
tgagacagcagtcagggaaata

SEQ ID NO: 8434592 - DNA, 22 bp, Homo sapiens
tgagacagcccttctgcacagg

SEQ ID NO: 8434593 - DNA, 22 bp, Homo sapiens
tgagacagcccttctgcacagg

SEQ ID NO: 8434594 - DNA, 22 bp, Homo sapiens
tgagacagcctctgcactcatg

SEQ ID NO: 8434595 - DNA, 22 bp, Homo sapiens
tgagacagcccttctgcacagg

SEQ ID NO: 8434596 - DNA, 22 bp, Homo sapiens
tgagacaggagaggcccctcct

SEQ ID NO: 8434597 - DNA, 18 bp, Homo sapiens
tgagacagctaccacttg

SEQ ID NO: 8434598 - DNA, 19 bp, Homo sapiens
tgagacagggattcaggtg

SEQ ID NO: 8434599 - DNA, 22 bp, Homo sapiens
tgagacaggcttccttcttggg

SEQ ID NO: 8434600 - DNA, 22 bp, Homo sapiens
tgagacagtcaccaggcaggcc

SEQ ID NO: 8434601 - DNA, 22 bp, Homo sapiens
tgagacagtatcgccccaaggc

SEQ ID NO: 8434602 - DNA, 22 bp, Homo sapiens
tgagacagtaattgtatagttt

SEQ ID NO: 8434603 - DNA, 22 bp, Homo sapiens
tgagacagtcaccaggcaggcc

SEQ ID NO: 8434604 - DNA, 22 bp, Homo sapiens
tgagacagtcccatgatctgca

SEQ ID NO: 8434605 - DNA, 22 bp, Homo sapiens
tgagacagtcccatgatctgca

SEQ ID NO: 8434606 - DNA, 22 bp, Homo sapiens
tgagacagttctgcagctgggt

SEQ ID NO: 8434607 - DNA, 22 bp, Homo sapiens
tgagacagggtcttgctctgtt

SEQ ID NO: 8434608 - DNA, 17 bp, Homo sapiens
tgagacagggcaggccc

SEQ ID NO: 8434609 - DNA, 22 bp, Homo sapiens
tgagacagggtcttgctctgtt

SEQ ID NO: 8434610 - DNA, 22 bp, Homo sapiens
tgagacagggtcttgctctgtt

SEQ ID NO: 8434611 - DNA, 22 bp, Homo sapiens
tgagaacattgggaaagctatg

SEQ ID NO: 8434612 - DNA, 22 bp, Homo sapiens
tgagaacagttggaagcagtca

SEQ ID NO: 8434613 - DNA, 22 bp, Homo sapiens
tgagaactgaggatttgaattc

SEQ ID NO: 8434614 - DNA, 22 bp, Homo sapiens
tgagaaccacctggaggtgact

SEQ ID NO: 8434615 - DNA, 22 bp, Homo sapiens
tgagaaccatgaaaagctgtca

SEQ ID NO: 8434616 - DNA, 18 bp, Homo sapiens
tgagaaccatgttcattc

SEQ ID NO: 8434617 - DNA, 22 bp, Homo sapiens
tgagaacctcgaagattttgcc

SEQ ID NO: 8434618 - DNA, 23 bp, Homo sapiens
tgagaagccgccgggcagcctgg

SEQ ID NO: 8434619 - DNA, 22 bp, Homo sapiens
tgagaaaatccagaggctagtt

SEQ ID NO: 8434620 - DNA, 22 bp, Homo sapiens
tgagaaagcctttagtcccagg

SEQ ID NO: 8434621 - DNA, 22 bp, Homo sapiens
tgagaaattcgacatatattta

SEQ ID NO: 8434622 - DNA, 22 bp, Homo sapiens
tgagaaattacttcagtgatgg

SEQ ID NO: 8434623 - DNA, 22 bp, Homo sapiens
tgagaggctagatcagctctgt

SEQ ID NO: 8434624 - DNA, 22 bp, Homo sapiens
tgagaggctagatcagctctgt

SEQ ID NO: 8434625 - DNA, 22 bp, Homo sapiens
tgagaggcgctcactctcaggt

SEQ ID NO: 8434626 - DNA, 22 bp, Homo sapiens
tgagaggcgctcactctcaggt

SEQ ID NO: 8434627 - DNA, 22 bp, Homo sapiens
tgagagggcccagagcacacca

SEQ ID NO: 8434628 - DNA, 22 bp, Homo sapiens
tgagaggcagaatggtgcctgc

SEQ ID NO: 8434629 - DNA, 22 bp, Homo sapiens
tgagaggatattttgggaggat

SEQ ID NO: 8434630 - DNA, 22 bp, Homo sapiens
tgagaggagtgattgtaaaatt

SEQ ID NO: 8434631 - DNA, 20 bp, Homo sapiens
tgagagctgggcagggatac

SEQ ID NO: 8434632 - DNA, 22 bp, Homo sapiens
tgagagccagaagggcctgagg

SEQ ID NO: 8434633 - DNA, 22 bp, Homo sapiens
tgagagcctagtaggtggaaaa

SEQ ID NO: 8434634 - DNA, 21 bp, Homo sapiens
tgagagcctccaaccggctac

SEQ ID NO: 8434635 - DNA, 22 bp, Homo sapiens
tgagagccaggatctgctctat

SEQ ID NO: 8434636 - DNA, 18 bp, Homo sapiens
tgagagcctgcttgtccc

SEQ ID NO: 8434637 - DNA, 23 bp, Homo sapiens
tgagagcctggcagcctgggttc

SEQ ID NO: 8434638 - DNA, 22 bp, Homo sapiens
tgagagcaacacgcagtagtat

SEQ ID NO: 8434639 - DNA, 22 bp, Homo sapiens
tgagacagttctgcagctgggt

SEQ ID NO: 8434640 - DNA, 22 bp, Homo sapiens
tgagagagcgcctgggatcatt

SEQ ID NO: 8434641 - DNA, 22 bp, Homo sapiens
tgagaggtcaaagggcatggag

SEQ ID NO: 8434642 - DNA, 22 bp, Homo sapiens
tgagaggtcaaagggcatggag

SEQ ID NO: 8434643 - DNA, 22 bp, Homo sapiens
tgagatctgtgcatgttagtta

SEQ ID NO: 8434644 - DNA, 23 bp, Homo sapiens
tgagatctttgtagtatcaatga

SEQ ID NO: 8434645 - DNA, 22 bp, Homo sapiens
tgagatctctgcctatatggat

SEQ ID NO: 8434646 - DNA, 22 bp, Homo sapiens
tgagatccccaggaaggacaac

SEQ ID NO: 8434647 - DNA, 19 bp, Homo sapiens
tgagatgccttccagccct

SEQ ID NO: 8434648 - DNA, 22 bp, Homo sapiens
tgagatgcaggagatgggactg

SEQ ID NO: 8434649 - DNA, 22 bp, Homo sapiens
tgagatgctaaagggctgctca

SEQ ID NO: 8434650 - DNA, 17 bp, Homo sapiens
tgagatggaagaagact

SEQ ID NO: 8434651 - DNA, 21 bp, Homo sapiens
tgagatgctagaaggcaggga

SEQ ID NO: 8434652 - DNA, 22 bp, Homo sapiens
tgagatgctgggaacaaggaag

SEQ ID NO: 8434653 - DNA, 22 bp, Homo sapiens
tgagatgtaaggtatgcttact

SEQ ID NO: 8434654 - DNA, 22 bp, Homo sapiens
tgagatggttcacagagaaggc

SEQ ID NO: 8434655 - DNA, 22 bp, Homo sapiens
tgagatggggagggctgcagaa

SEQ ID NO: 8434656 - DNA, 19 bp, Homo sapiens
tgagatttcttaggtgatt

SEQ ID NO: 8434657 - DNA, 19 bp, Homo sapiens
tgagatttcttaggtgatt

SEQ ID NO: 8434658 - DNA, 22 bp, Homo sapiens
tgagatttcaggccaaggagtg

SEQ ID NO: 8434659 - DNA, 22 bp, Homo sapiens
tgagattccctgaatgatatat

SEQ ID NO: 8434660 - DNA, 22 bp, Homo sapiens
tgagattttcctaaatataatg

SEQ ID NO: 8434661 - DNA, 22 bp, Homo sapiens
tgagatttgttttataaaatag

SEQ ID NO: 8434662 - DNA, 22 bp, Homo sapiens
tgagattttaatattgagaaaa

SEQ ID NO: 8434663 - DNA, 22 bp, Homo sapiens
tgagattttaatattgagaaaa

SEQ ID NO: 8434664 - DNA, 20 bp, Homo sapiens
tgagatttgtattataagtc

SEQ ID NO: 8434665 - DNA, 22 bp, Homo sapiens
tgagctggtcttgagtgtagct

SEQ ID NO: 8434666 - DNA, 22 bp, Homo sapiens
tgagctggtcactccttctgaa

SEQ ID NO: 8434667 - DNA, 22 bp, Homo sapiens
tgagctggtcactccttctgaa

SEQ ID NO: 8434668 - DNA, 22 bp, Homo sapiens
tgagctggttcttgaggcatga

SEQ ID NO: 8434669 - DNA, 22 bp, Homo sapiens
tgagctggttcttgaggcatga

SEQ ID NO: 8434670 - DNA, 22 bp, Homo sapiens
tgagctggttcttgaggcatga

SEQ ID NO: 8434671 - DNA, 22 bp, Homo sapiens
tgagctggagtctgtggctcct

SEQ ID NO: 8434672 - DNA, 22 bp, Homo sapiens
tgagctggaggacaggagggta

SEQ ID NO: 8434673 - DNA, 22 bp, Homo sapiens
tgagctctgttagggctggaac

SEQ ID NO: 8434674 - DNA, 22 bp, Homo sapiens
tgagctcttctaactaattgtg

SEQ ID NO: 8434675 - DNA, 22 bp, Homo sapiens
tgagctgagtggcaggtctcag

SEQ ID NO: 8434676 - DNA, 22 bp, Homo sapiens
tgagctctcagggacagactat

SEQ ID NO: 8434677 - DNA, 22 bp, Homo sapiens
tgagctgatggcatccctgttt

SEQ ID NO: 8434678 - DNA, 22 bp, Homo sapiens
tgagctgcattacagcctctgt

SEQ ID NO: 8434679 - DNA, 22 bp, Homo sapiens
tgagctgccccctggcctgctc

SEQ ID NO: 8434680 - DNA, 22 bp, Homo sapiens
tgaggaaactgaggcacagatg

SEQ ID NO: 8434681 - DNA, 22 bp, Homo sapiens
tgagctttcatgtatgaaaaga

SEQ ID NO: 8434682 - DNA, 22 bp, Homo sapiens
tgagctttgtgggtaaagagag

SEQ ID NO: 8434683 - DNA, 22 bp, Homo sapiens
tgagctttgttgttagtatatt

SEQ ID NO: 8434684 - DNA, 22 bp, Homo sapiens
tgagcttcctccctgcatccat

SEQ ID NO: 8434685 - DNA, 22 bp, Homo sapiens
tgagcttcctccctgcatccat

SEQ ID NO: 8434686 - DNA, 22 bp, Homo sapiens
tgagcttctttatttggccaga

SEQ ID NO: 8434687 - DNA, 22 bp, Homo sapiens
tgagcttctttatttggccaga

SEQ ID NO: 8434688 - DNA, 22 bp, Homo sapiens
tgagcttccctcctgcactaca

SEQ ID NO: 8434689 - DNA, 22 bp, Homo sapiens
tgagcttccctcctgcactaca

SEQ ID NO: 8434690 - DNA, 22 bp, Homo sapiens
tgagctgtgtcctgggggcagt

SEQ ID NO: 8434691 - DNA, 22 bp, Homo sapiens
tgagcttatacatgtgaagtca

SEQ ID NO: 8434692 - DNA, 22 bp, Homo sapiens
tgagcttattcataaaagtgca

SEQ ID NO: 8434693 - DNA, 22 bp, Homo sapiens
tgagcttcaaaatatgtgaatc

SEQ ID NO: 8434694 - DNA, 22 bp, Homo sapiens
tgagcttcaaagttggatctga

SEQ ID NO: 8434695 - DNA, 20 bp, Homo sapiens
tgagcttcagatatcgtgca

SEQ ID NO: 8434696 - DNA, 17 bp, Homo sapiens
tgagcttcaatcaggtg

SEQ ID NO: 8434697 - DNA, 22 bp, Homo sapiens
tgagcttcaaagttggatctga

SEQ ID NO: 8434698 - DNA, 17 bp, Homo sapiens
tgagcttcaatcaggtg

SEQ ID NO: 8434699 - DNA, 22 bp, Homo sapiens
tgagctgtctatggtcctgtct

SEQ ID NO: 8434700 - DNA, 22 bp, Homo sapiens
tgagccgtggtctctgagggtg

SEQ ID NO: 8434701 - DNA, 22 bp, Homo sapiens
tgagccgtggtctctgagggtg

SEQ ID NO: 8434702 - DNA, 22 bp, Homo sapiens
tgagcccttgacatcgcccact

SEQ ID NO: 8434703 - DNA, 22 bp, Homo sapiens
tgagcccttgacatcgcccact

SEQ ID NO: 8434704 - DNA, 21 bp, Homo sapiens
tgagcccttgcctcagagccc

SEQ ID NO: 8434705 - DNA, 21 bp, Homo sapiens
tgagcccttgcctcagagccc

SEQ ID NO: 8434706 - DNA, 22 bp, Homo sapiens
tgagccctgacctagcctggcc

SEQ ID NO: 8434707 - DNA, 22 bp, Homo sapiens
tgagccctgaggatctgttcgg

SEQ ID NO: 8434708 - DNA, 22 bp, Homo sapiens
tgagccctggctctttcactta

SEQ ID NO: 8434709 - DNA, 22 bp, Homo sapiens
tgagccctggagccctctgtta

SEQ ID NO: 8434710 - DNA, 22 bp, Homo sapiens
tgagcccatgtagcacttccat

SEQ ID NO: 8434711 - DNA, 22 bp, Homo sapiens
tgagccctccaaacccaggatt

SEQ ID NO: 8434712 - DNA, 22 bp, Homo sapiens
tgagccctacctgctcatctcc

SEQ ID NO: 8434713 - DNA, 22 bp, Homo sapiens
tgagccctaagggtcaagcagg

SEQ ID NO: 8434714 - DNA, 22 bp, Homo sapiens
tgagccctaatttacaacatct

SEQ ID NO: 8434715 - DNA, 22 bp, Homo sapiens
tgagccctaagggtcaagcagg

SEQ ID NO: 8434716 - DNA, 22 bp, Homo sapiens
tgagccctaagggtcaagcagg

SEQ ID NO: 8434717 - DNA, 22 bp, Homo sapiens
tgagccaggttaagacaggagc

SEQ ID NO: 8434718 - DNA, 22 bp, Homo sapiens
tgagccagtctctcagaaccct

SEQ ID NO: 8434719 - DNA, 22 bp, Homo sapiens
tgagccagtctctcagaaccct

SEQ ID NO: 8434720 - DNA, 22 bp, Homo sapiens
tgagctacacactaggcatggg

SEQ ID NO: 8434721 - DNA, 20 bp, Homo sapiens
tgagccttgaggagtgactg

SEQ ID NO: 8434722 - DNA, 22 bp, Homo sapiens
tgagcctgggagatggaggctg

SEQ ID NO: 8434723 - DNA, 22 bp, Homo sapiens
tgagcctggcctgcagagacca

SEQ ID NO: 8434724 - DNA, 22 bp, Homo sapiens
tgagcagtgatgcgttttgttt

SEQ ID NO: 8434725 - DNA, 22 bp, Homo sapiens
tgagcagtggcaccaggtcacc

SEQ ID NO: 8434726 - DNA, 22 bp, Homo sapiens
tgagcagtggcaccaggtcacc

SEQ ID NO: 8434727 - DNA, 22 bp, Homo sapiens
tgagcagtggtgtttttctatc

SEQ ID NO: 8434728 - DNA, 22 bp, Homo sapiens
tgagcagttcgacttcttcccc

SEQ ID NO: 8434729 - DNA, 22 bp, Homo sapiens
tgagcagtggtgtttttctatc

SEQ ID NO: 8434730 - DNA, 22 bp, Homo sapiens
tgagcagtggctcctgctggac

SEQ ID NO: 8434731 - DNA, 22 bp, Homo sapiens
tgagcagtggggcctgcattct

SEQ ID NO: 8434732 - DNA, 22 bp, Homo sapiens
tgagcagggactttgagtgtag

SEQ ID NO: 8434733 - DNA, 22 bp, Homo sapiens
tgagcagggactttggagtctg

SEQ ID NO: 8434734 - DNA, 22 bp, Homo sapiens
tgagccagagtggagtgtgcct

SEQ ID NO: 8434735 - DNA, 22 bp, Homo sapiens
tgagccagagtggagtgtgcct

SEQ ID NO: 8434736 - DNA, 22 bp, Homo sapiens
tgagccaaggcctcaagaattt

SEQ ID NO: 8434737 - DNA, 22 bp, Homo sapiens
tgagccaggcactgctcctgga

SEQ ID NO: 8434738 - DNA, 22 bp, Homo sapiens
tgagccaggcccagtggggtca

SEQ ID NO: 8434739 - DNA, 22 bp, Homo sapiens
tgagccagccttgcagctgtgc

SEQ ID NO: 8434740 - DNA, 22 bp, Homo sapiens
tgagccaggagtttgaggctgt

SEQ ID NO: 8434741 - DNA, 22 bp, Homo sapiens
tgagccaggcactgctcctgga

SEQ ID NO: 8434742 - DNA, 22 bp, Homo sapiens
tgagccagcctcagaagtcacg

SEQ ID NO: 8434743 - DNA, 22 bp, Homo sapiens
tgagcagatggaggcttctgca

SEQ ID NO: 8434744 - DNA, 22 bp, Homo sapiens
tgagcagagcagtaacaggagc

SEQ ID NO: 8434745 - DNA, 22 bp, Homo sapiens
tgagcacagctttcactagaaa

SEQ ID NO: 8434746 - DNA, 22 bp, Homo sapiens
tgagcagagatgactgggcatt

SEQ ID NO: 8434747 - DNA, 22 bp, Homo sapiens
tgagcaggcgcagcaggaggtc

SEQ ID NO: 8434748 - DNA, 22 bp, Homo sapiens
tgagcaggcgcagcaggaggtc

SEQ ID NO: 8434749 - DNA, 22 bp, Homo sapiens
tgagcaggcgcagcaggaggtc

SEQ ID NO: 8434750 - DNA, 22 bp, Homo sapiens
tgagcaggctcccacttcagtg

SEQ ID NO: 8434751 - DNA, 22 bp, Homo sapiens
tgagcagggactttgagtgtag

SEQ ID NO: 8434752 - DNA, 21 bp, Homo sapiens
tgagcaggagtcatgggaatg

SEQ ID NO: 8434753 - DNA, 22 bp, Homo sapiens
tgagcaggagataaacaggtag

SEQ ID NO: 8434754 - DNA, 22 bp, Homo sapiens
tgagcaggcaaacaatggttat

SEQ ID NO: 8434755 - DNA, 22 bp, Homo sapiens
tgagcaggattcgcctcttgca

SEQ ID NO: 8434756 - DNA, 22 bp, Homo sapiens
tgagcaggactcactgcagcct

SEQ ID NO: 8434757 - DNA, 22 bp, Homo sapiens
tgagcaggactgaccggcctta

SEQ ID NO: 8434758 - DNA, 22 bp, Homo sapiens
tgagcaggactcactgcagcct

SEQ ID NO: 8434759 - DNA, 22 bp, Homo sapiens
tgagcaggactcactgcagcct

SEQ ID NO: 8434760 - DNA, 22 bp, Homo sapiens
tgagcagatttgttctaggggt

SEQ ID NO: 8434761 - DNA, 22 bp, Homo sapiens
tgagggagtgtggatacagtag

SEQ ID NO: 8434762 - DNA, 22 bp, Homo sapiens
tgaggggagaagcagcagcctg

SEQ ID NO: 8434763 - DNA, 22 bp, Homo sapiens
tgaggggagctagcatgccttg

SEQ ID NO: 8434764 - DNA, 22 bp, Homo sapiens
tgaggggaggttggggcacatc

SEQ ID NO: 8434765 - DNA, 22 bp, Homo sapiens
tgaggggcagagaggtgtccag

SEQ ID NO: 8434766 - DNA, 22 bp, Homo sapiens
tgaggggatacggtacacattg

SEQ ID NO: 8434767 - DNA, 22 bp, Homo sapiens
tgagggacaccagggctggagc

SEQ ID NO: 8434768 - DNA, 22 bp, Homo sapiens
tgaggcttggaggctccagtgg

SEQ ID NO: 8434769 - DNA, 19 bp, Homo sapiens
tgagggacattgggagcag

SEQ ID NO: 8434770 - DNA, 22 bp, Homo sapiens
tgagggagcacacactgaagtg

SEQ ID NO: 8434771 - DNA, 22 bp, Homo sapiens
tgaggctcaagaatagacagta

SEQ ID NO: 8434772 - DNA, 22 bp, Homo sapiens
tgaggccttagtaaccctgcac

SEQ ID NO: 8434773 - DNA, 22 bp, Homo sapiens
tgaggccttagtaaccctgcac

SEQ ID NO: 8434774 - DNA, 22 bp, Homo sapiens
tgaggcctgggcacataacctc

SEQ ID NO: 8434775 - DNA, 22 bp, Homo sapiens
tgaggcctgtcattgtcttgtt

SEQ ID NO: 8434776 - DNA, 22 bp, Homo sapiens
tgaggccttttctgtctggcta

SEQ ID NO: 8434777 - DNA, 22 bp, Homo sapiens
tgaggccttttctgtctggcta

SEQ ID NO: 8434778 - DNA, 22 bp, Homo sapiens
tgaggcctggagggaggagttt

SEQ ID NO: 8434779 - DNA, 22 bp, Homo sapiens
tgaggcctggactctgcatgga

SEQ ID NO: 8434780 - DNA, 22 bp, Homo sapiens
tgaggcctggactctgcatgga

SEQ ID NO: 8434781 - DNA, 22 bp, Homo sapiens
tgaggcctggagggaggagttt

SEQ ID NO: 8434782 - DNA, 22 bp, Homo sapiens
tgaggcctgggcacataacctc

SEQ ID NO: 8434783 - DNA, 22 bp, Homo sapiens
tgaggcctgccctggggaagtt

SEQ ID NO: 8434784 - DNA, 22 bp, Homo sapiens
tgaggcctgccctggggaagtt

SEQ ID NO: 8434785 - DNA, 21 bp, Homo sapiens
tgaggcctgccagtctcagaa

SEQ ID NO: 8434786 - DNA, 22 bp, Homo sapiens
tgaggcctgcttggaattgaat

SEQ ID NO: 8434787 - DNA, 22 bp, Homo sapiens
tgaggctcagaagtgccaagtg

SEQ ID NO: 8434788 - DNA, 22 bp, Homo sapiens
tgaggctcacgaacagaagact

SEQ ID NO: 8434789 - DNA, 22 bp, Homo sapiens
tgaggctcagagaagtgctgtt

SEQ ID NO: 8434790 - DNA, 22 bp, Homo sapiens
tgaggctcattctgcatgccaa

SEQ ID NO: 8434791 - DNA, 18 bp, Homo sapiens
tgaggctcagctcctggt

SEQ ID NO: 8434792 - DNA, 22 bp, Homo sapiens
tgaggctcagtgagccctgcag

SEQ ID NO: 8434793 - DNA, 22 bp, Homo sapiens
tgaggctcagtgagccctgcag

SEQ ID NO: 8434794 - DNA, 22 bp, Homo sapiens
tgaggcttgatttgcccgagag

SEQ ID NO: 8434795 - DNA, 22 bp, Homo sapiens
tgaggcttagatttggtaactc

SEQ ID NO: 8434796 - DNA, 22 bp, Homo sapiens
tgaggcttagagaattaagtga

SEQ ID NO: 8434797 - DNA, 22 bp, Homo sapiens
tgaggctctgcttctgtggctc

SEQ ID NO: 8434798 - DNA, 22 bp, Homo sapiens
tgaggctcttcctcccctgctc

SEQ ID NO: 8434799 - DNA, 22 bp, Homo sapiens
tgagtactgatttaagatacac

SEQ ID NO: 8434800 - DNA, 22 bp, Homo sapiens
tgagtactttatgttagttatt

SEQ ID NO: 8434801 - DNA, 22 bp, Homo sapiens
tgagtaaaagtgaatcttatgt

SEQ ID NO: 8434802 - DNA, 22 bp, Homo sapiens
tgaggttcagttcttggccaca

SEQ ID NO: 8434803 - DNA, 22 bp, Homo sapiens
tgagtattttccctatcaatgt

SEQ ID NO: 8434804 - DNA, 22 bp, Homo sapiens
tgagtcacagccttgccttggt

SEQ ID NO: 8434805 - DNA, 22 bp, Homo sapiens
tgagtattgaccagaaaattta

SEQ ID NO: 8434806 - DNA, 22 bp, Homo sapiens
tgagtattccttatctgaaatg

SEQ ID NO: 8434807 - DNA, 22 bp, Homo sapiens
tgagtctttagaattctaactt

SEQ ID NO: 8434808 - DNA, 21 bp, Homo sapiens
tgagtcttttaataggtgcac

SEQ ID NO: 8434809 - DNA, 22 bp, Homo sapiens
tgagtctttccaaagccgtcat

SEQ ID NO: 8434810 - DNA, 23 bp, Homo sapiens
tgagtcttgagctttggattctg

SEQ ID NO: 8434811 - DNA, 22 bp, Homo sapiens
tgagtcttctgcctaaagaagt

SEQ ID NO: 8434812 - DNA, 22 bp, Homo sapiens
tgagtcttcttccgggattgct

SEQ ID NO: 8434813 - DNA, 22 bp, Homo sapiens
tgagtcttctgcctaaagaagt

SEQ ID NO: 8434814 - DNA, 22 bp, Homo sapiens
tgagtctgggcatgttcacttt

SEQ ID NO: 8434815 - DNA, 22 bp, Homo sapiens
tgagtctgggcatgttcacttt

SEQ ID NO: 8434816 - DNA, 22 bp, Homo sapiens
tgagtctgtatgtccagattta

SEQ ID NO: 8434817 - DNA, 19 bp, Homo sapiens
tgagtcactcttacagtca

SEQ ID NO: 8434818 - DNA, 22 bp, Homo sapiens
tgagtcactatcactttctctg

SEQ ID NO: 8434819 - DNA, 22 bp, Homo sapiens
tgaggtggtttgtatcactggg

SEQ ID NO: 8434820 - DNA, 22 bp, Homo sapiens
tgaggttatttattatgcatga

SEQ ID NO: 8434821 - DNA, 22 bp, Homo sapiens
tgaggtggttcaagagccttgt

SEQ ID NO: 8434822 - DNA, 22 bp, Homo sapiens
tgaggtggttactgtggtgctc

SEQ ID NO: 8434823 - DNA, 22 bp, Homo sapiens
tgaggtggtgctaatctctgct

SEQ ID NO: 8434824 - DNA, 22 bp, Homo sapiens
tgaggtggtgctaatctctgct

SEQ ID NO: 8434825 - DNA, 22 bp, Homo sapiens
tgaggtgggcttgtggatttgc

SEQ ID NO: 8434826 - DNA, 22 bp, Homo sapiens
tgaggtgggtggcttctgttat

SEQ ID NO: 8434827 - DNA, 22 bp, Homo sapiens
tgaggtggctagggaggcactc

SEQ ID NO: 8434828 - DNA, 22 bp, Homo sapiens
tgaggtggctagggaggcactc

SEQ ID NO: 8434829 - DNA, 22 bp, Homo sapiens
tgaggtggcacacacttcctgc

SEQ ID NO: 8434830 - DNA, 22 bp, Homo sapiens
tgaggtggaaggatcctttgaa

SEQ ID NO: 8434831 - DNA, 22 bp, Homo sapiens
tgaggtggccgaggagcaggac

SEQ ID NO: 8434832 - DNA, 22 bp, Homo sapiens
tgaggtggccgaggagcaggac

SEQ ID NO: 8434833 - DNA, 22 bp, Homo sapiens
tgaggggcgctggcaggttcct

SEQ ID NO: 8434834 - DNA, 22 bp, Homo sapiens
tgaggggcgctggcaggttcct

SEQ ID NO: 8434835 - DNA, 22 bp, Homo sapiens
tgaggggccagaccccacctag

SEQ ID NO: 8434836 - DNA, 22 bp, Homo sapiens
tgaggggcagagaggtgtccag

SEQ ID NO: 8434837 - DNA, 22 bp, Homo sapiens
tgaggggcatgtgtttacacat

SEQ ID NO: 8434838 - DNA, 19 bp, Homo sapiens
tgaggggctcacagtctca

SEQ ID NO: 8434839 - DNA, 22 bp, Homo sapiens
tgaggggcggcctgcagaggcc

SEQ ID NO: 8434840 - DNA, 22 bp, Homo sapiens
tgagggtctggaatctgggctt

SEQ ID NO: 8434841 - DNA, 22 bp, Homo sapiens
tgagggtagaggcaggagtgca

SEQ ID NO: 8434842 - DNA, 22 bp, Homo sapiens
tgaggggggtaatcactgggtt

SEQ ID NO: 8434843 - DNA, 22 bp, Homo sapiens
tgagggggttaattaggagagt

SEQ ID NO: 8434844 - DNA, 22 bp, Homo sapiens
tgagggggttaattaggagagt

SEQ ID NO: 8434845 - DNA, 16 bp, Homo sapiens
tgaggtcttattagca

SEQ ID NO: 8434846 - DNA, 22 bp, Homo sapiens
tgaggtctgcagggctgtgcat

SEQ ID NO: 8434847 - DNA, 22 bp, Homo sapiens
tgaggtgacaattcattctcca

SEQ ID NO: 8434848 - DNA, 22 bp, Homo sapiens
tgaggtaaattctggcccaaac

SEQ ID NO: 8434849 - DNA, 21 bp, Homo sapiens
tgaggcaggggtgcttttgtc

SEQ ID NO: 8434850 - DNA, 22 bp, Homo sapiens
tgaggcagttgagcttcctgag

SEQ ID NO: 8434851 - DNA, 22 bp, Homo sapiens
tgaggccaactagggagatgga

SEQ ID NO: 8434852 - DNA, 22 bp, Homo sapiens
tgaggcaggagttcaggctgcg

SEQ ID NO: 8434853 - DNA, 22 bp, Homo sapiens
tgaggcaggagttaatgtgctc

SEQ ID NO: 8434854 - DNA, 22 bp, Homo sapiens
tgaggcaggatgcttgcacagg

SEQ ID NO: 8434855 - DNA, 22 bp, Homo sapiens
tgaggcaggaggattgcaggat

SEQ ID NO: 8434856 - DNA, 22 bp, Homo sapiens
tgaggcaggaggttgagaactg

SEQ ID NO: 8434857 - DNA, 22 bp, Homo sapiens
tgaggcaggaggttgagaactg

SEQ ID NO: 8434858 - DNA, 22 bp, Homo sapiens
tgaggcaggagttaatgtgctc

SEQ ID NO: 8434859 - DNA, 22 bp, Homo sapiens
tgaggcaggagaatggcgggaa

SEQ ID NO: 8434860 - DNA, 20 bp, Homo sapiens
tgaggcaggagaatggcatg

SEQ ID NO: 8434861 - DNA, 22 bp, Homo sapiens
tgaggccaatgaccctgggcag

SEQ ID NO: 8434862 - DNA, 19 bp, Homo sapiens
tgaggccaaggtcacagat

SEQ ID NO: 8434863 - DNA, 22 bp, Homo sapiens
tgaggccacaggaaagggcccg

SEQ ID NO: 8434864 - DNA, 22 bp, Homo sapiens
tgaggccacttccccacagccc

SEQ ID NO: 8434865 - DNA, 22 bp, Homo sapiens
tgaggccagcttcagcagtgga

SEQ ID NO: 8434866 - DNA, 22 bp, Homo sapiens
tgaggccaggacccccagcagg

SEQ ID NO: 8434867 - DNA, 22 bp, Homo sapiens
tgaggccagcttcagcagtgga

SEQ ID NO: 8434868 - DNA, 22 bp, Homo sapiens
tgaggccagcttcagcagtgga

SEQ ID NO: 8434869 - DNA, 19 bp, Homo sapiens
tgaggccagctggcatttt

SEQ ID NO: 8434870 - DNA, 18 bp, Homo sapiens
tgaggccagagtgggcat

SEQ ID NO: 8434871 - DNA, 18 bp, Homo sapiens
tgaggccagagtgggcat

SEQ ID NO: 8434872 - DNA, 22 bp, Homo sapiens
tgaggccagccacagccaccct

SEQ ID NO: 8434873 - DNA, 22 bp, Homo sapiens
tgaggcctgacagaccaagcct

SEQ ID NO: 8434874 - DNA, 22 bp, Homo sapiens
tgaggcctgaagcctggagcct

SEQ ID NO: 8434875 - DNA, 22 bp, Homo sapiens
tgaggcctgaagcctggagcct

SEQ ID NO: 8434876 - DNA, 22 bp, Homo sapiens
tgaggcctgacagaccaagcct

SEQ ID NO: 8434877 - DNA, 22 bp, Homo sapiens
tgaggcctgcattgaactagaa

SEQ ID NO: 8434878 - DNA, 21 bp, Homo sapiens
tgaggcctgccagtctcagaa

SEQ ID NO: 8434879 - DNA, 17 bp, Homo sapiens
tgaggcctgcatcagtg

SEQ ID NO: 8434880 - DNA, 18 bp, Homo sapiens
tgaggcctctgctgggcc

SEQ ID NO: 8434881 - DNA, 18 bp, Homo sapiens
tgaggcctctgctgggcc

SEQ ID NO: 8434882 - DNA, 22 bp, Homo sapiens
tgaggcctcttggtatggtgtg

SEQ ID NO: 8434883 - DNA, 22 bp, Homo sapiens
tgaggcctgaagcctgaagtga

SEQ ID NO: 8434884 - DNA, 22 bp, Homo sapiens
tgaggcctctgtgccatccagg

SEQ ID NO: 8434885 - DNA, 18 bp, Homo sapiens
tgaggcccgcagaggtgg

SEQ ID NO: 8434886 - DNA, 22 bp, Homo sapiens
tgaggccaggatcccaggctct

SEQ ID NO: 8434887 - DNA, 22 bp, Homo sapiens
tgaggcctcataatgagatttc

SEQ ID NO: 8434888 - DNA, 22 bp, Homo sapiens
tgaggcctcataatgagatttc

SEQ ID NO: 8434889 - DNA, 22 bp, Homo sapiens
tgaggcctcatttagggagagg

SEQ ID NO: 8434890 - DNA, 21 bp, Homo sapiens
tgaggcctctcctgggctggc

SEQ ID NO: 8434891 - DNA, 22 bp, Homo sapiens
tgaggccctagggcatgggaga

SEQ ID NO: 8434892 - DNA, 22 bp, Homo sapiens
tgaggcctacccccctgtgttt

SEQ ID NO: 8434893 - DNA, 22 bp, Homo sapiens
tgaggcaaggctgaatgaaggc

SEQ ID NO: 8434894 - DNA, 22 bp, Homo sapiens
tgaggcaaggctgaatgaaggc

SEQ ID NO: 8434895 - DNA, 22 bp, Homo sapiens
tgaggcaagggatggccccgtg

SEQ ID NO: 8434896 - DNA, 19 bp, Homo sapiens
tgaggcaagatggctctgg

SEQ ID NO: 8434897 - DNA, 22 bp, Homo sapiens
tgaggcaagctgggcccatgga

SEQ ID NO: 8434898 - DNA, 19 bp, Homo sapiens
tgaggcaagctttttcttg

SEQ ID NO: 8434899 - DNA, 22 bp, Homo sapiens
tgaggcaatccctagggtaagg

SEQ ID NO: 8434900 - DNA, 22 bp, Homo sapiens
tgaggcaatccctagggtaagg

SEQ ID NO: 8434901 - DNA, 22 bp, Homo sapiens
tgaggcaagtctcaatctttga

SEQ ID NO: 8434902 - DNA, 22 bp, Homo sapiens
tgaggcaagtactttccctttt

SEQ ID NO: 8434903 - DNA, 21 bp, Homo sapiens
tgaggcaagtccttttatagc

SEQ ID NO: 8434904 - DNA, 19 bp, Homo sapiens
tgaggcacatgataagaac

SEQ ID NO: 8434905 - DNA, 22 bp, Homo sapiens
tgaggcaattggaaattttaac

SEQ ID NO: 8434906 - DNA, 22 bp, Homo sapiens
tgaggcaatgtccttcatcctt

SEQ ID NO: 8434907 - DNA, 22 bp, Homo sapiens
tgaggcacatccaggccagctc

SEQ ID NO: 8434908 - DNA, 22 bp, Homo sapiens
tgaggcaaagttcaagctgaaa

SEQ ID NO: 8434909 - DNA, 22 bp, Homo sapiens
tgaggcaacagaaagggccaat

SEQ ID NO: 8434910 - DNA, 17 bp, Homo sapiens
tgaggcaaccatcacta

SEQ ID NO: 8434911 - DNA, 19 bp, Homo sapiens
tgaggcaagatggctctgg

SEQ ID NO: 8434912 - DNA, 22 bp, Homo sapiens
tgaggcaagagtttgattagag

SEQ ID NO: 8434913 - DNA, 22 bp, Homo sapiens
tgaggcaaagacaaagcagcat

SEQ ID NO: 8434914 - DNA, 22 bp, Homo sapiens
tgaggcaaaagttatgtggtag

SEQ ID NO: 8434915 - DNA, 22 bp, Homo sapiens
tgaggcaaagacaaagcagcat

SEQ ID NO: 8434916 - DNA, 22 bp, Homo sapiens
tgaggcaaagttcaagctgaaa

SEQ ID NO: 8434917 - DNA, 22 bp, Homo sapiens
tgaggcaaaaacactgattagg

SEQ ID NO: 8434918 - DNA, 21 bp, Homo sapiens
tgaggatgtgcagcagcagga

SEQ ID NO: 8434919 - DNA, 22 bp, Homo sapiens
tgaggatggttaaagaacattg

SEQ ID NO: 8434920 - DNA, 22 bp, Homo sapiens
tgaggcagaaaatagcagttca

SEQ ID NO: 8434921 - DNA, 22 bp, Homo sapiens
tgaggcagaaaatagcagttca

SEQ ID NO: 8434922 - DNA, 22 bp, Homo sapiens
tgaggcactgggagagcacact

SEQ ID NO: 8434923 - DNA, 20 bp, Homo sapiens
tgaggcaggagaatggcatg

SEQ ID NO: 8434924 - DNA, 22 bp, Homo sapiens
tgaggcaggagaatcacatgaa

SEQ ID NO: 8434925 - DNA, 22 bp, Homo sapiens
tgaggcaggagaatcacatgaa

SEQ ID NO: 8434926 - DNA, 22 bp, Homo sapiens
tgaggaagccaaacagctacac

SEQ ID NO: 8434927 - DNA, 22 bp, Homo sapiens
tgaggaaggaattgaggtttta

SEQ ID NO: 8434928 - DNA, 22 bp, Homo sapiens
tgaggaagtggttgtatggttt

SEQ ID NO: 8434929 - DNA, 22 bp, Homo sapiens
tgaggaagggtgtgacggcacc

SEQ ID NO: 8434930 - DNA, 22 bp, Homo sapiens
tgaggaagggtgtgacggcacc

SEQ ID NO: 8434931 - DNA, 22 bp, Homo sapiens
tgaggaagggtgtgacggcacc

SEQ ID NO: 8434932 - DNA, 22 bp, Homo sapiens
tgaggagaaatgctcagagcca

SEQ ID NO: 8434933 - DNA, 19 bp, Homo sapiens
tgaggagcagctggttgat

SEQ ID NO: 8434934 - DNA, 22 bp, Homo sapiens
tgaggagcgggcagggatgcag

SEQ ID NO: 8434935 - DNA, 22 bp, Homo sapiens
tgaggagcttctggaaagtgca

SEQ ID NO: 8434936 - DNA, 22 bp, Homo sapiens
tgaggatgagatgagataacac

SEQ ID NO: 8434937 - DNA, 22 bp, Homo sapiens
tgaggatgacgatggcaatggc

SEQ ID NO: 8434938 - DNA, 22 bp, Homo sapiens
tgaggagtcgagaaggggtaat

SEQ ID NO: 8434939 - DNA, 22 bp, Homo sapiens
tgaggagtatggtggggtcatt

SEQ ID NO: 8434940 - DNA, 22 bp, Homo sapiens
tgaggagtgtggatggagcttg

SEQ ID NO: 8434941 - DNA, 22 bp, Homo sapiens
tgaggatggtcccgaggacact

SEQ ID NO: 8434942 - DNA, 22 bp, Homo sapiens
tgaggatggggagatggtgtct

SEQ ID NO: 8434943 - DNA, 22 bp, Homo sapiens
tgaggatggaatgctgtgcaag

SEQ ID NO: 8434944 - DNA, 22 bp, Homo sapiens
tgaggatggcagtgtgctcagc

SEQ ID NO: 8434945 - DNA, 22 bp, Homo sapiens
tggcttcttgtctaatttgtta

SEQ ID NO: 8434946 - DNA, 22 bp, Homo sapiens
tggcttcttgtctaatttgtta

SEQ ID NO: 8434947 - DNA, 22 bp, Homo sapiens
tggcttcttgtctaatttgtta

SEQ ID NO: 8434948 - DNA, 17 bp, Homo sapiens
tggctttcctgacacag

SEQ ID NO: 8434949 - DNA, 22 bp, Homo sapiens
tggcttcttcatatgtgatctt

SEQ ID NO: 8434950 - DNA, 22 bp, Homo sapiens
tggcttcttagaccagtggcct

SEQ ID NO: 8434951 - DNA, 22 bp, Homo sapiens
tggcttcttcatatgtgatctt

SEQ ID NO: 8434952 - DNA, 19 bp, Homo sapiens
tggcttcttcggtgttccc

SEQ ID NO: 8434953 - DNA, 22 bp, Homo sapiens
tggcttcttgacttcttggctg

SEQ ID NO: 8434954 - DNA, 16 bp, Homo sapiens
tggcttcttatttcta

SEQ ID NO: 8434955 - DNA, 22 bp, Homo sapiens
tggcttcttcatatgtgatctt

SEQ ID NO: 8434956 - DNA, 22 bp, Homo sapiens
tggcttcttactagggctcagt

SEQ ID NO: 8434957 - DNA, 22 bp, Homo sapiens
tggcttcttgacttcttggctg

SEQ ID NO: 8434958 - DNA, 22 bp, Homo sapiens
tggcttcttgacttcttggctg

SEQ ID NO: 8434959 - DNA, 18 bp, Homo sapiens
tggcttcttgagctaaca

SEQ ID NO: 8434960 - DNA, 22 bp, Homo sapiens
tggcttcttgatcttggacttg

SEQ ID NO: 8434961 - DNA, 22 bp, Homo sapiens
tggcttcttgggatgggtcatt

SEQ ID NO: 8434962 - DNA, 22 bp, Homo sapiens
tggcttcttgatcttggacttg

SEQ ID NO: 8434963 - DNA, 22 bp, Homo sapiens
tgggaaagtaattgtcatcctt

SEQ ID NO: 8434964 - DNA, 22 bp, Homo sapiens
tgggaaagccagcagtgtcacc

SEQ ID NO: 8434965 - DNA, 22 bp, Homo sapiens
tggcttttgttggtaccacctt

SEQ ID NO: 8434966 - DNA, 21 bp, Homo sapiens
tggctttgccctgcttgcccc

SEQ ID NO: 8434967 - DNA, 22 bp, Homo sapiens
tgggaagaggcgggaggctgtt

SEQ ID NO: 8434968 - DNA, 22 bp, Homo sapiens
tgggaagactcctcaggaggcg

SEQ ID NO: 8434969 - DNA, 22 bp, Homo sapiens
tgggaagactcctcaggaggcg

SEQ ID NO: 8434970 - DNA, 22 bp, Homo sapiens
tgggaaccatgtagctgagatg

SEQ ID NO: 8434971 - DNA, 22 bp, Homo sapiens
tgggaagaagcagagaactgga

SEQ ID NO: 8434972 - DNA, 22 bp, Homo sapiens
tgggaagaagcagagaactgga

SEQ ID NO: 8434973 - DNA, 22 bp, Homo sapiens
tgggaagaagcagagaactgga

SEQ ID NO: 8434974 - DNA, 22 bp, Homo sapiens
tgggaaccacaggactcggcac

SEQ ID NO: 8434975 - DNA, 22 bp, Homo sapiens
tgggaaccaggactggctgagg

SEQ ID NO: 8434976 - DNA, 22 bp, Homo sapiens
tgggaacattttgagctgagag

SEQ ID NO: 8434977 - DNA, 22 bp, Homo sapiens
tgggaacattttgagctgagag

SEQ ID NO: 8434978 - DNA, 22 bp, Homo sapiens
tgggaaagtgtagcctgcaggc

SEQ ID NO: 8434979 - DNA, 22 bp, Homo sapiens
tgggaaagtgtagcctgcaggc

SEQ ID NO: 8434980 - DNA, 22 bp, Homo sapiens
tgggaaagtgtagcctgcaggc

SEQ ID NO: 8434981 - DNA, 22 bp, Homo sapiens
tgggaaagtgttgaggtgtctt

SEQ ID NO: 8434982 - DNA, 22 bp, Homo sapiens
tgggaaagtgttgaggtgtctt

SEQ ID NO: 8434983 - DNA, 22 bp, Homo sapiens
tgggaacacctgctgcccagtg

SEQ ID NO: 8434984 - DNA, 22 bp, Homo sapiens
tgggaacacctgctgcccagtg

SEQ ID NO: 8434985 - DNA, 22 bp, Homo sapiens
tgggaacaacatgcactgccac

SEQ ID NO: 8434986 - DNA, 22 bp, Homo sapiens
tgggaacaacatgcactgccac

SEQ ID NO: 8434987 - DNA, 22 bp, Homo sapiens
tggcttctccagaaatcttggt

SEQ ID NO: 8434988 - DNA, 22 bp, Homo sapiens
tggcttctccagaaatcttggt

SEQ ID NO: 8434989 - DNA, 22 bp, Homo sapiens
tggcttctcagtttcataatga

SEQ ID NO: 8434990 - DNA, 22 bp, Homo sapiens
tggcttctcatttgcattaaac

SEQ ID NO: 8434991 - DNA, 22 bp, Homo sapiens
tggcttctcagtttcataatga

SEQ ID NO: 8434992 - DNA, 22 bp, Homo sapiens
tggcttctcagaatactctgga

SEQ ID NO: 8434993 - DNA, 22 bp, Homo sapiens
tggcttctcagaatactctgga

SEQ ID NO: 8434994 - DNA, 18 bp, Homo sapiens
tggcttctcaaagcccag

SEQ ID NO: 8434995 - DNA, 22 bp, Homo sapiens
tggcttctcagaatactctgga

SEQ ID NO: 8434996 - DNA, 22 bp, Homo sapiens
tggcttctcaaaataactggtt

SEQ ID NO: 8434997 - DNA, 22 bp, Homo sapiens
tggcttctcaaaataactggtt

SEQ ID NO: 8434998 - DNA, 18 bp, Homo sapiens
tggcttctattttactca

SEQ ID NO: 8434999 - DNA, 18 bp, Homo sapiens
tggcttctattttactca

SEQ ID NO: 8435000 - DNA, 22 bp, Homo sapiens
tggcttctagcagtgttgattt

SEQ ID NO: 8435001 - DNA, 22 bp, Homo sapiens
tggcttctagagcccatccttc

SEQ ID NO: 8435002 - DNA, 22 bp, Homo sapiens
tggcttctagtttgaggaaaaa

SEQ ID NO: 8435003 - DNA, 22 bp, Homo sapiens
tggcttctagcagtgttgattt

SEQ ID NO: 8435004 - DNA, 22 bp, Homo sapiens
tggcttctagtttgaggaaaaa

SEQ ID NO: 8435005 - DNA, 22 bp, Homo sapiens
tggcttctattgctgtggcatt

SEQ ID NO: 8435006 - DNA, 22 bp, Homo sapiens
tggcttctaaagtttcttttag

SEQ ID NO: 8435007 - DNA, 22 bp, Homo sapiens
tggcttcctgtttcccagaaag

SEQ ID NO: 8435008 - DNA, 22 bp, Homo sapiens
tggcttcctgtttcccagaaag

SEQ ID NO: 8435009 - DNA, 22 bp, Homo sapiens
tggcttcagacttctgctacgt

SEQ ID NO: 8435010 - DNA, 22 bp, Homo sapiens
tggcttcagagacagaatctat

SEQ ID NO: 8435011 - DNA, 17 bp, Homo sapiens
tggcttcagatgtacat

SEQ ID NO: 8435012 - DNA, 22 bp, Homo sapiens
tggcttccgccgcgggcctcgg

SEQ ID NO: 8435013 - DNA, 17 bp, Homo sapiens
tggcttccctgggccac

SEQ ID NO: 8435014 - DNA, 22 bp, Homo sapiens
tggcttcctaaactgatttcca

SEQ ID NO: 8435015 - DNA, 22 bp, Homo sapiens
tggcttcctccagagcaggagg

SEQ ID NO: 8435016 - DNA, 22 bp, Homo sapiens
tggcttcctaggagcccgtgct

SEQ ID NO: 8435017 - DNA, 22 bp, Homo sapiens
tggcttcctgcacagtgtctgc

SEQ ID NO: 8435018 - DNA, 19 bp, Homo sapiens
tggcttcctgactctcatc

SEQ ID NO: 8435019 - DNA, 19 bp, Homo sapiens
tggcttcctgactctcatc

SEQ ID NO: 8435020 - DNA, 22 bp, Homo sapiens
tggcttcctgcatggatcctct

SEQ ID NO: 8435021 - DNA, 22 bp, Homo sapiens
tggcttctcgcctgtcatcccg

SEQ ID NO: 8435022 - DNA, 22 bp, Homo sapiens
tggcttctcgcctgtcatcccg

SEQ ID NO: 8435023 - DNA, 22 bp, Homo sapiens
tggcttctctggcatccccatc

SEQ ID NO: 8435024 - DNA, 22 bp, Homo sapiens
tggcttctctgtggtggctccc

SEQ ID NO: 8435025 - DNA, 22 bp, Homo sapiens
tggcttctctgtgtgagggaga

SEQ ID NO: 8435026 - DNA, 22 bp, Homo sapiens
tggcttctccctctgcctgatt

SEQ ID NO: 8435027 - DNA, 22 bp, Homo sapiens
tggcttctcccgacaccctggc

SEQ ID NO: 8435028 - DNA, 22 bp, Homo sapiens
tggcttctccctccccatctag

SEQ ID NO: 8435029 - DNA, 22 bp, Homo sapiens
tggcttctccctacaacatgcc

SEQ ID NO: 8435030 - DNA, 22 bp, Homo sapiens
tggcttctgagcattgaaacgt

SEQ ID NO: 8435031 - DNA, 22 bp, Homo sapiens
tggcttctgagcattgaaacgt

SEQ ID NO: 8435032 - DNA, 22 bp, Homo sapiens
tggcttctgagtctcctgacat

SEQ ID NO: 8435033 - DNA, 22 bp, Homo sapiens
tggcttctgagtctcctgacat

SEQ ID NO: 8435034 - DNA, 22 bp, Homo sapiens
tggcttctgcatatttttagag

SEQ ID NO: 8435035 - DNA, 22 bp, Homo sapiens
tggcttctctgttttagtattt

SEQ ID NO: 8435036 - DNA, 22 bp, Homo sapiens
tggcttctctgtgtgagggaga

SEQ ID NO: 8435037 - DNA, 22 bp, Homo sapiens
tggcttctctgttttagtattt

SEQ ID NO: 8435038 - DNA, 18 bp, Homo sapiens
tggcttctgaacaactgc

SEQ ID NO: 8435039 - DNA, 20 bp, Homo sapiens
tggcttctcttcactcctgt

SEQ ID NO: 8435040 - DNA, 21 bp, Homo sapiens
tggcttctgccaatgttaaga

SEQ ID NO: 8435041 - DNA, 22 bp, Homo sapiens
tggcttctgcatatttttagag

SEQ ID NO: 8435042 - DNA, 21 bp, Homo sapiens
tggcttctgccaatgttaaga

SEQ ID NO: 8435043 - DNA, 18 bp, Homo sapiens
tggcttctgctagctgga

SEQ ID NO: 8435044 - DNA, 23 bp, Homo sapiens
tggcttctgccccattctctcca

SEQ ID NO: 8435045 - DNA, 22 bp, Homo sapiens
tggcttctggccaggcacagga

SEQ ID NO: 8435046 - DNA, 19 bp, Homo sapiens
tggcttctggcaacagatg

SEQ ID NO: 8435047 - DNA, 22 bp, Homo sapiens
tggcttctgctttcagtggagg

SEQ ID NO: 8435048 - DNA, 22 bp, Homo sapiens
tggcttctgctcccagaatgat

SEQ ID NO: 8435049 - DNA, 22 bp, Homo sapiens
tggcttctggtttatccttata

SEQ ID NO: 8435050 - DNA, 22 bp, Homo sapiens
tggcttctggggtggcctgcat

SEQ ID NO: 8435051 - DNA, 22 bp, Homo sapiens
tggcttctggtttatccttata

SEQ ID NO: 8435052 - DNA, 22 bp, Homo sapiens
tggcttctgtccctgctacatt

SEQ ID NO: 8435053 - DNA, 22 bp, Homo sapiens
tggcttctgtccctgctacatt

SEQ ID NO: 8435054 - DNA, 19 bp, Homo sapiens
tggcttctgttttcatgtt

SEQ ID NO: 8435055 - DNA, 19 bp, Homo sapiens
tggcttctgttttcatgtt

SEQ ID NO: 8435056 - DNA, 22 bp, Homo sapiens
tggcttctgggacttgtgagca

SEQ ID NO: 8435057 - DNA, 22 bp, Homo sapiens
tggcttctgggacttgtgagca

SEQ ID NO: 8435058 - DNA, 22 bp, Homo sapiens
tggcttctggctggtgagaaat

SEQ ID NO: 8435059 - DNA, 22 bp, Homo sapiens
tggcttctgggacttgtgagca

SEQ ID NO: 8435060 - DNA, 22 bp, Homo sapiens
tggcttctgggatgtgttgaca

SEQ ID NO: 8435061 - DNA, 22 bp, Homo sapiens
tggctgtgtccctgtccagagt

SEQ ID NO: 8435062 - DNA, 22 bp, Homo sapiens
tggctgtgttaccacttcatgt

SEQ ID NO: 8435063 - DNA, 22 bp, Homo sapiens
tggcttcaaaggtagcatacaa

SEQ ID NO: 8435064 - DNA, 22 bp, Homo sapiens
tggctgtgtccctgtccagagt

SEQ ID NO: 8435065 - DNA, 22 bp, Homo sapiens
tggcttcaaaatctagtggtct

SEQ ID NO: 8435066 - DNA, 22 bp, Homo sapiens
tggctgtgcggcctcgggcaga

SEQ ID NO: 8435067 - DNA, 22 bp, Homo sapiens
tggctgtgcggcctcgggcaga

SEQ ID NO: 8435068 - DNA, 22 bp, Homo sapiens
tggctgtgggatgagagcctca

SEQ ID NO: 8435069 - DNA, 22 bp, Homo sapiens
tggctgtggactcagatggctc

SEQ ID NO: 8435070 - DNA, 22 bp, Homo sapiens
tggctgtgggatatgtgactga

SEQ ID NO: 8435071 - DNA, 22 bp, Homo sapiens
tggctgtgggtggaaggaaacc

SEQ ID NO: 8435072 - DNA, 22 bp, Homo sapiens
tggctgtcagctgcctggtgcg

SEQ ID NO: 8435073 - DNA, 19 bp, Homo sapiens
tggctgggtgccaatggcc

SEQ ID NO: 8435074 - DNA, 22 bp, Homo sapiens
tggctggggagccccgactccc

SEQ ID NO: 8435075 - DNA, 22 bp, Homo sapiens
tggctggggcctgaatcctgca

SEQ ID NO: 8435076 - DNA, 22 bp, Homo sapiens
tggctggggccacagttttcct

SEQ ID NO: 8435077 - DNA, 22 bp, Homo sapiens
tggctgggccgggccttgtgcc

SEQ ID NO: 8435078 - DNA, 19 bp, Homo sapiens
tggctgggcgtgcctccgt

SEQ ID NO: 8435079 - DNA, 19 bp, Homo sapiens
tggctgggcgtgcctccgt

SEQ ID NO: 8435080 - DNA, 22 bp, Homo sapiens
tggctggagtctggtgctagcc

SEQ ID NO: 8435081 - DNA, 22 bp, Homo sapiens
tggctggatgtgagatcaagag

SEQ ID NO: 8435082 - DNA, 22 bp, Homo sapiens
tggctggcaaggctggagtcag

SEQ ID NO: 8435083 - DNA, 22 bp, Homo sapiens
tggctggagagggtcccatgag

SEQ ID NO: 8435084 - DNA, 23 bp, Homo sapiens
tggctggcagaaactgaagcatg

SEQ ID NO: 8435085 - DNA, 18 bp, Homo sapiens
tggctggcagtgggcagc

SEQ ID NO: 8435086 - DNA, 22 bp, Homo sapiens
tggctggcagtaggctagtggc

SEQ ID NO: 8435087 - DNA, 22 bp, Homo sapiens
tggctggcgccgggctagccac

SEQ ID NO: 8435088 - DNA, 23 bp, Homo sapiens
tggctggcgcctgcctcaccctg

SEQ ID NO: 8435089 - DNA, 22 bp, Homo sapiens
tggctggcgttggggccagtga

SEQ ID NO: 8435090 - DNA, 22 bp, Homo sapiens
tggctgggagctggaactgggc

SEQ ID NO: 8435091 - DNA, 22 bp, Homo sapiens
tggctggcgttggggccagtga

SEQ ID NO: 8435092 - DNA, 22 bp, Homo sapiens
tggctgggagctggaactgggc

SEQ ID NO: 8435093 - DNA, 22 bp, Homo sapiens
tggctgggagctggaactgggc

SEQ ID NO: 8435094 - DNA, 22 bp, Homo sapiens
tggctgggcccccacctgcctc

SEQ ID NO: 8435095 - DNA, 21 bp, Homo sapiens
tgggacctagctttgcacagg

SEQ ID NO: 8435096 - DNA, 22 bp, Homo sapiens
tgggactcactcttttggccag

SEQ ID NO: 8435097 - DNA, 22 bp, Homo sapiens
tgggactcactcttttggccag

SEQ ID NO: 8435098 - DNA, 21 bp, Homo sapiens
tgggacagtgatggctcctcc

SEQ ID NO: 8435099 - DNA, 21 bp, Homo sapiens
tgggacagtgatggctcctcc

SEQ ID NO: 8435100 - DNA, 21 bp, Homo sapiens
tgggacagtgatggctcctcc

SEQ ID NO: 8435101 - DNA, 22 bp, Homo sapiens
tgggacagtgaccccagaggtc

SEQ ID NO: 8435102 - DNA, 22 bp, Homo sapiens
tgggacagttgtcctccactct

SEQ ID NO: 8435103 - DNA, 22 bp, Homo sapiens
tgggacagtgtgccttgctcct

SEQ ID NO: 8435104 - DNA, 22 bp, Homo sapiens
tgggacacacaaggtcagctct

SEQ ID NO: 8435105 - DNA, 22 bp, Homo sapiens
tgggacaggttggagagaagca

SEQ ID NO: 8435106 - DNA, 22 bp, Homo sapiens
tgggacaggttggagagaagca

SEQ ID NO: 8435107 - DNA, 22 bp, Homo sapiens
tgggaatgtagaatgtaaacca

SEQ ID NO: 8435108 - DNA, 22 bp, Homo sapiens
tgggaaggtgattttccaaaag

SEQ ID NO: 8435109 - DNA, 22 bp, Homo sapiens
tgggaaggttagcagtttgtca

SEQ ID NO: 8435110 - DNA, 22 bp, Homo sapiens
tgggaagcctagcagacagctg

SEQ ID NO: 8435111 - DNA, 22 bp, Homo sapiens
tgggaaggcgtggaagtagaag

SEQ ID NO: 8435112 - DNA, 22 bp, Homo sapiens
tgggaagcacgctcagcagaaa

SEQ ID NO: 8435113 - DNA, 22 bp, Homo sapiens
tgggaagcattaatgatagggg

SEQ ID NO: 8435114 - DNA, 22 bp, Homo sapiens
tgggaagatggagtgacaggca

SEQ ID NO: 8435115 - DNA, 22 bp, Homo sapiens
tgggaagatggagtgacaggca

SEQ ID NO: 8435116 - DNA, 22 bp, Homo sapiens
tgggaagatgaggtgccatggg

SEQ ID NO: 8435117 - DNA, 22 bp, Homo sapiens
tgggaagggtcaacagctggaa

SEQ ID NO: 8435118 - DNA, 22 bp, Homo sapiens
tgggaagggtcaacagctggaa

SEQ ID NO: 8435119 - DNA, 22 bp, Homo sapiens
tgggaaggggagctggaaagga

SEQ ID NO: 8435120 - DNA, 22 bp, Homo sapiens
tgggaaggtacacgggaaagag

SEQ ID NO: 8435121 - DNA, 22 bp, Homo sapiens
tgggaagggtctgaatctgaga

SEQ ID NO: 8435122 - DNA, 22 bp, Homo sapiens
tgggaggatctcttgaggccag

SEQ ID NO: 8435123 - DNA, 22 bp, Homo sapiens
tgggaggcaggtaggtgatgat

SEQ ID NO: 8435124 - DNA, 22 bp, Homo sapiens
tgggaggcagaagttgactgga

SEQ ID NO: 8435125 - DNA, 22 bp, Homo sapiens
tgggaggatcgcttgagcccag

SEQ ID NO: 8435126 - DNA, 22 bp, Homo sapiens
tgggaggagccctctgggaagg

SEQ ID NO: 8435127 - DNA, 22 bp, Homo sapiens
tgggaggacttgtgggcttcat

SEQ ID NO: 8435128 - DNA, 22 bp, Homo sapiens
tgggaggaatgtcactgagcca

SEQ ID NO: 8435129 - DNA, 20 bp, Homo sapiens
tgggagctggtgaggtctca

SEQ ID NO: 8435130 - DNA, 22 bp, Homo sapiens
tgggaggaagtgctaatgggag

SEQ ID NO: 8435131 - DNA, 22 bp, Homo sapiens
tgggagctggggttggacgtct

SEQ ID NO: 8435132 - DNA, 22 bp, Homo sapiens
tgggagctcctggagggcagga

SEQ ID NO: 8435133 - DNA, 22 bp, Homo sapiens
tgggagcagcagggagatgcgg

SEQ ID NO: 8435134 - DNA, 22 bp, Homo sapiens
tgggagcagccaacatggcctt

SEQ ID NO: 8435135 - DNA, 22 bp, Homo sapiens
tgggagcagcattgccatgtgc

SEQ ID NO: 8435136 - DNA, 22 bp, Homo sapiens
tgggagcagccaacatggcctt

SEQ ID NO: 8435137 - DNA, 22 bp, Homo sapiens
tgggagcagctttgcgagggag

SEQ ID NO: 8435138 - DNA, 22 bp, Homo sapiens
tgggagcagctgggaacacagc

SEQ ID NO: 8435139 - DNA, 22 bp, Homo sapiens
tgggagcaggaagcaggaagta

SEQ ID NO: 8435140 - DNA, 22 bp, Homo sapiens
tgggagcaccttgagggcagaa

SEQ ID NO: 8435141 - DNA, 22 bp, Homo sapiens
tgggagcactctttgggaagca

SEQ ID NO: 8435142 - DNA, 22 bp, Homo sapiens
tgggagcaccctgaggagcttc

SEQ ID NO: 8435143 - DNA, 22 bp, Homo sapiens
tgggagcaagctggtgctggag

SEQ ID NO: 8435144 - DNA, 19 bp, Homo sapiens
tgggagaggcaacagagta

SEQ ID NO: 8435145 - DNA, 19 bp, Homo sapiens
tgggagaggcaacagagta

SEQ ID NO: 8435146 - DNA, 22 bp, Homo sapiens
tgggagaggctgccatcttgca

SEQ ID NO: 8435147 - DNA, 21 bp, Homo sapiens
tgggagagggctcagctaccc

SEQ ID NO: 8435148 - DNA, 22 bp, Homo sapiens
tgggagataaagcatctgttct

SEQ ID NO: 8435149 - DNA, 22 bp, Homo sapiens
tgggagagtgctcaatgtgcaa

SEQ ID NO: 8435150 - DNA, 22 bp, Homo sapiens
tgggagagtgctcaatgtgcaa

SEQ ID NO: 8435151 - DNA, 22 bp, Homo sapiens
tgggagatattgctgtggctgt

SEQ ID NO: 8435152 - DNA, 22 bp, Homo sapiens
tgggagataattcattgtgttc

SEQ ID NO: 8435153 - DNA, 22 bp, Homo sapiens
tgggagcaagctacttagggaa

SEQ ID NO: 8435154 - DNA, 22 bp, Homo sapiens
tgggagcaaatgactgggagat

SEQ ID NO: 8435155 - DNA, 22 bp, Homo sapiens
tgggagaagcagcagccaagtg

SEQ ID NO: 8435156 - DNA, 22 bp, Homo sapiens
tgggagaagcagcagccaagtg

SEQ ID NO: 8435157 - DNA, 22 bp, Homo sapiens
tgggagaacccagggtcaggct

SEQ ID NO: 8435158 - DNA, 22 bp, Homo sapiens
tgggagaacccagggtcaggct

SEQ ID NO: 8435159 - DNA, 22 bp, Homo sapiens
tgggagaagacgtactttagac

SEQ ID NO: 8435160 - DNA, 20 bp, Homo sapiens
tgggagaagaacactggaac

SEQ ID NO: 8435161 - DNA, 22 bp, Homo sapiens
tgggagaaagaaccctgagtga

SEQ ID NO: 8435162 - DNA, 22 bp, Homo sapiens
tgggagaaagaaccctgagtga

SEQ ID NO: 8435163 - DNA, 22 bp, Homo sapiens
tgggagaaagaaccctgagtga

SEQ ID NO: 8435164 - DNA, 22 bp, Homo sapiens
tgggagaagcagtgggacagta

SEQ ID NO: 8435165 - DNA, 22 bp, Homo sapiens
tgggagaagcagtgggacagta

SEQ ID NO: 8435166 - DNA, 22 bp, Homo sapiens
tgggagaatatatttaaaactt

SEQ ID NO: 8435167 - DNA, 22 bp, Homo sapiens
tgggagaagcatggggtgcaga

SEQ ID NO: 8435168 - DNA, 22 bp, Homo sapiens
tgggagaagcatggggtgcaga

SEQ ID NO: 8435169 - DNA, 22 bp, Homo sapiens
tgggagagaataatcaataggt

SEQ ID NO: 8435170 - DNA, 22 bp, Homo sapiens
tggctctcaatggctgtactat

SEQ ID NO: 8435171 - DNA, 22 bp, Homo sapiens
tggctcctttccgggtctccag

SEQ ID NO: 8435172 - DNA, 22 bp, Homo sapiens
tggctctgagacacaggctctc

SEQ ID NO: 8435173 - DNA, 22 bp, Homo sapiens
tggctccttcattctcctgcca

SEQ ID NO: 8435174 - DNA, 20 bp, Homo sapiens
tggctcctggctcctccctc

SEQ ID NO: 8435175 - DNA, 22 bp, Homo sapiens
tggctccttccgcagcatgcct

SEQ ID NO: 8435176 - DNA, 22 bp, Homo sapiens
tggctccttccgcagcatgcct

SEQ ID NO: 8435177 - DNA, 22 bp, Homo sapiens
tggctctgagctgcaaagctgc

SEQ ID NO: 8435178 - DNA, 23 bp, Homo sapiens
tggctctgagcttcctggtggcc

SEQ ID NO: 8435179 - DNA, 17 bp, Homo sapiens
tggctctgaggctgaat

SEQ ID NO: 8435180 - DNA, 23 bp, Homo sapiens
tggctctgagaggttcagatgct

SEQ ID NO: 8435181 - DNA, 21 bp, Homo sapiens
tggctctgagcctcatggctg

SEQ ID NO: 8435182 - DNA, 21 bp, Homo sapiens
tggctctgagcctcatggctg

SEQ ID NO: 8435183 - DNA, 22 bp, Homo sapiens
tggctctgcgtctgttcgtggg

SEQ ID NO: 8435184 - DNA, 21 bp, Homo sapiens
tggctctgctcagagcagtcc

SEQ ID NO: 8435185 - DNA, 22 bp, Homo sapiens
tggctctggagctcctgggccc

SEQ ID NO: 8435186 - DNA, 22 bp, Homo sapiens
tggctctggagctcctgggccc

SEQ ID NO: 8435187 - DNA, 22 bp, Homo sapiens
tggctctgctgaacctagtgca

SEQ ID NO: 8435188 - DNA, 18 bp, Homo sapiens
tggctctgccactcaccg

SEQ ID NO: 8435189 - DNA, 18 bp, Homo sapiens
tggctctgccactcaccg

SEQ ID NO: 8435190 - DNA, 18 bp, Homo sapiens
tggctctgcagccagatg

SEQ ID NO: 8435191 - DNA, 18 bp, Homo sapiens
tggctctgcagccagatg

SEQ ID NO: 8435192 - DNA, 22 bp, Homo sapiens
tggctctgtggatgttctgacc

SEQ ID NO: 8435193 - DNA, 22 bp, Homo sapiens
tggctctgtggtcttagcatgc

SEQ ID NO: 8435194 - DNA, 23 bp, Homo sapiens
tggctctgtggatccctcaggag

SEQ ID NO: 8435195 - DNA, 23 bp, Homo sapiens
tggctctgtggatccctcaggag

SEQ ID NO: 8435196 - DNA, 22 bp, Homo sapiens
tggctctggggacagtaagtcc

SEQ ID NO: 8435197 - DNA, 22 bp, Homo sapiens
tggctctgtcgccgtttggaat

SEQ ID NO: 8435198 - DNA, 22 bp, Homo sapiens
tggctctgtgaacagacgactg

SEQ ID NO: 8435199 - DNA, 22 bp, Homo sapiens
tggctctgtgcttctagtatct

SEQ ID NO: 8435200 - DNA, 22 bp, Homo sapiens
tggctctggattaatctaggaa

SEQ ID NO: 8435201 - DNA, 22 bp, Homo sapiens
tggctctggagctggcggctga

SEQ ID NO: 8435202 - DNA, 22 bp, Homo sapiens
tggctctgggaatgggaagatg

SEQ ID NO: 8435203 - DNA, 22 bp, Homo sapiens
tggctctgggaatctgttgctt

SEQ ID NO: 8435204 - DNA, 22 bp, Homo sapiens
tggctctgttcgccatcaggag

SEQ ID NO: 8435205 - DNA, 22 bp, Homo sapiens
tggctctgttcgccatcaggag

SEQ ID NO: 8435206 - DNA, 22 bp, Homo sapiens
tggctctgttgtgctgagccag

SEQ ID NO: 8435207 - DNA, 22 bp, Homo sapiens
tggctctgttgtgctgagccag

SEQ ID NO: 8435208 - DNA, 22 bp, Homo sapiens
tggctctgttgtgctgagccag

SEQ ID NO: 8435209 - DNA, 19 bp, Homo sapiens
tggctctgtttctctggag

SEQ ID NO: 8435210 - DNA, 19 bp, Homo sapiens
tggctctgtttctctggag

SEQ ID NO: 8435211 - DNA, 22 bp, Homo sapiens
tggctgacaaataggtgcagtt

SEQ ID NO: 8435212 - DNA, 22 bp, Homo sapiens
tggctgagaagttctggtggga

SEQ ID NO: 8435213 - DNA, 22 bp, Homo sapiens
tggctgagaaaatggttttagg

SEQ ID NO: 8435214 - DNA, 22 bp, Homo sapiens
tggctgagaagttctggtggga

SEQ ID NO: 8435215 - DNA, 21 bp, Homo sapiens
tggctgagccaggtgtgtgga

SEQ ID NO: 8435216 - DNA, 23 bp, Homo sapiens
tggctgagcccactatcttggcc

SEQ ID NO: 8435217 - DNA, 23 bp, Homo sapiens
tggctgagcccactatcttggcc

SEQ ID NO: 8435218 - DNA, 22 bp, Homo sapiens
tggctgagagtcatcctgtgtg

SEQ ID NO: 8435219 - DNA, 22 bp, Homo sapiens
tggctgagagtcatcctgtgtg

SEQ ID NO: 8435220 - DNA, 22 bp, Homo sapiens
tggctgagagtcatcctgtgtg

SEQ ID NO: 8435221 - DNA, 22 bp, Homo sapiens
tggctgagaaaaaagagctata

SEQ ID NO: 8435222 - DNA, 23 bp, Homo sapiens
tggctgagatcctactgtttgct

SEQ ID NO: 8435223 - DNA, 22 bp, Homo sapiens
tggctgagccacttgttcagat

SEQ ID NO: 8435224 - DNA, 22 bp, Homo sapiens
tggctgagccacttgttcagat

SEQ ID NO: 8435225 - DNA, 22 bp, Homo sapiens
tggctgaggctggagtgcagtg

SEQ ID NO: 8435226 - DNA, 22 bp, Homo sapiens
tggctgaggagggtcttctggt

SEQ ID NO: 8435227 - DNA, 22 bp, Homo sapiens
tggctgaggctggagtgcagtg

SEQ ID NO: 8435228 - DNA, 22 bp, Homo sapiens
tggctgagggcactatgaagcc

SEQ ID NO: 8435229 - DNA, 22 bp, Homo sapiens
tggctgaggcacagctgccgcc

SEQ ID NO: 8435230 - DNA, 22 bp, Homo sapiens
tggctgaggctggagtgcagtg

SEQ ID NO: 8435231 - DNA, 22 bp, Homo sapiens
tggctgaggctggagtgcagtg

SEQ ID NO: 8435232 - DNA, 22 bp, Homo sapiens
tggctgaggttatgctggttgt

SEQ ID NO: 8435233 - DNA, 22 bp, Homo sapiens
tggctgaggtctggggcttctg

SEQ ID NO: 8435234 - DNA, 22 bp, Homo sapiens
tggctgaggtctggggcttctg

SEQ ID NO: 8435235 - DNA, 22 bp, Homo sapiens
tggctgaggcttttcttaaaga

SEQ ID NO: 8435236 - DNA, 22 bp, Homo sapiens
tggctgagggcactatgaagcc

SEQ ID NO: 8435237 - DNA, 22 bp, Homo sapiens
tggctgaggttatgctggttgt

SEQ ID NO: 8435238 - DNA, 22 bp, Homo sapiens
tggctgaggagggtcttctggt

SEQ ID NO: 8435239 - DNA, 22 bp, Homo sapiens
tggctgaggagggtcttctggt

SEQ ID NO: 8435240 - DNA, 22 bp, Homo sapiens
tggctgaggcacagctgccgcc

SEQ ID NO: 8435241 - DNA, 22 bp, Homo sapiens
tggctgagctgcagcgtggctt

SEQ ID NO: 8435242 - DNA, 22 bp, Homo sapiens
tggctgaggagagggcggaagt

SEQ ID NO: 8435243 - DNA, 22 bp, Homo sapiens
tggctgaggagagggcggaagt

SEQ ID NO: 8435244 - DNA, 19 bp, Homo sapiens
tggctgagctggactgagg

SEQ ID NO: 8435245 - DNA, 22 bp, Homo sapiens
tggctgagctgcagcgtggctt

SEQ ID NO: 8435246 - DNA, 22 bp, Homo sapiens
tggctgagctgcagcgtggctt

SEQ ID NO: 8435247 - DNA, 22 bp, Homo sapiens
tggctgagctccctgtgtgttg

SEQ ID NO: 8435248 - DNA, 22 bp, Homo sapiens
tggctgagctgcagcgtggctt

SEQ ID NO: 8435249 - DNA, 22 bp, Homo sapiens
tggctgagcctttggggctttc

SEQ ID NO: 8435250 - DNA, 22 bp, Homo sapiens
tggctgagcctttggggctttc

SEQ ID NO: 8435251 - DNA, 22 bp, Homo sapiens
tggctgccagctcctcgccttg

SEQ ID NO: 8435252 - DNA, 22 bp, Homo sapiens
tggctgccatgacgcctgggga

SEQ ID NO: 8435253 - DNA, 22 bp, Homo sapiens
tggctgcagtgcttgagatgtc

SEQ ID NO: 8435254 - DNA, 22 bp, Homo sapiens
tggctgcaggggtgtctgacat

SEQ ID NO: 8435255 - DNA, 22 bp, Homo sapiens
tggctgcagatctgtgggacac

SEQ ID NO: 8435256 - DNA, 22 bp, Homo sapiens
tggctgccaatggcttggaaag

SEQ ID NO: 8435257 - DNA, 22 bp, Homo sapiens
tggctgcagttgggccctcaga

SEQ ID NO: 8435258 - DNA, 22 bp, Homo sapiens
tggctgcagttcacaggagcaa

SEQ ID NO: 8435259 - DNA, 22 bp, Homo sapiens
tggctgctgagaaggcagctgt

SEQ ID NO: 8435260 - DNA, 22 bp, Homo sapiens
tggctgctgctcactcagcctc

SEQ ID NO: 8435261 - DNA, 18 bp, Homo sapiens
tggctgctggagtagggt

SEQ ID NO: 8435262 - DNA, 18 bp, Homo sapiens
tggctgctggagtagggt

SEQ ID NO: 8435263 - DNA, 22 bp, Homo sapiens
tggctgcacttcaacacatcct

SEQ ID NO: 8435264 - DNA, 22 bp, Homo sapiens
tggctgcagatcaagggcaggc

SEQ ID NO: 8435265 - DNA, 22 bp, Homo sapiens
tggctgcagatcaagggcaggc

SEQ ID NO: 8435266 - DNA, 22 bp, Homo sapiens
tggctgattggtaccatcttca

SEQ ID NO: 8435267 - DNA, 22 bp, Homo sapiens
tggctgagtttcatgcatcatg

SEQ ID NO: 8435268 - DNA, 21 bp, Homo sapiens
tggctgcaagcagctgcctcc

SEQ ID NO: 8435269 - DNA, 22 bp, Homo sapiens
tggctgagttctccaggagtag

SEQ ID NO: 8435270 - DNA, 22 bp, Homo sapiens
tggctgagttctccaggagtag

SEQ ID NO: 8435271 - DNA, 22 bp, Homo sapiens
tggctgagtgttccaaggagca

SEQ ID NO: 8435272 - DNA, 22 bp, Homo sapiens
tggctgagttacgaacagagca

SEQ ID NO: 8435273 - DNA, 22 bp, Homo sapiens
tggctgagttacgaacagagca

SEQ ID NO: 8435274 - DNA, 22 bp, Homo sapiens
tggctgagttcctggcacacgg

SEQ ID NO: 8435275 - DNA, 22 bp, Homo sapiens
tggctgagttcctggcacacgg

SEQ ID NO: 8435276 - DNA, 22 bp, Homo sapiens
tggctgagtgttccaaggagca

SEQ ID NO: 8435277 - DNA, 21 bp, Homo sapiens
tggctgagtggatgcatgaat

SEQ ID NO: 8435278 - DNA, 22 bp, Homo sapiens
tggctgagtaagttgtgatatg

SEQ ID NO: 8435279 - DNA, 22 bp, Homo sapiens
tggctgagtgatatttgcaaag

SEQ ID NO: 8435280 - DNA, 22 bp, Homo sapiens
tggctgagtgaacatgtccatt

SEQ ID NO: 8435281 - DNA, 22 bp, Homo sapiens
tggctgagtgaacatgtccatt

SEQ ID NO: 8435282 - DNA, 22 bp, Homo sapiens
tggcgtgccctccagacttggc

SEQ ID NO: 8435283 - DNA, 20 bp, Homo sapiens
tggcggggatgagggagtta

SEQ ID NO: 8435284 - DNA, 21 bp, Homo sapiens
tggcggggacttgtggctgcc

SEQ ID NO: 8435285 - DNA, 21 bp, Homo sapiens
tggcggggacttgtggctgcc

SEQ ID NO: 8435286 - DNA, 22 bp, Homo sapiens
tggctcagaactacttctagtt

SEQ ID NO: 8435287 - DNA, 22 bp, Homo sapiens
tggctcaagtaacaaaaatata

SEQ ID NO: 8435288 - DNA, 22 bp, Homo sapiens
tggctatggtattgatgggttt

SEQ ID NO: 8435289 - DNA, 22 bp, Homo sapiens
tggctatgcaaacctgaggctg

SEQ ID NO: 8435290 - DNA, 22 bp, Homo sapiens
tggctcagagttcatcttttag

SEQ ID NO: 8435291 - DNA, 18 bp, Homo sapiens
tggctcagatggctttaa

SEQ ID NO: 8435292 - DNA, 18 bp, Homo sapiens
tggctcagatggctttaa

SEQ ID NO: 8435293 - DNA, 22 bp, Homo sapiens
tggctcagatttttgtaggctt

SEQ ID NO: 8435294 - DNA, 22 bp, Homo sapiens
tggctcagatgctcttccagtg

SEQ ID NO: 8435295 - DNA, 22 bp, Homo sapiens
tggctcagatgctcttccagtg

SEQ ID NO: 8435296 - DNA, 22 bp, Homo sapiens
tggctcagatgctcttccagtg

SEQ ID NO: 8435297 - DNA, 22 bp, Homo sapiens
tggctcagagcagggactctgg

SEQ ID NO: 8435298 - DNA, 22 bp, Homo sapiens
tggctcagagccttgagagctg

SEQ ID NO: 8435299 - DNA, 22 bp, Homo sapiens
tggctcagagccttgagagctg

SEQ ID NO: 8435300 - DNA, 22 bp, Homo sapiens
tggctcagagccttgagagctg

SEQ ID NO: 8435301 - DNA, 22 bp, Homo sapiens
tggctcagaaggctgccttcac

SEQ ID NO: 8435302 - DNA, 22 bp, Homo sapiens
tggctcagaaggctgccttcac

SEQ ID NO: 8435303 - DNA, 22 bp, Homo sapiens
tggcctggccctgaggccctgt

SEQ ID NO: 8435304 - DNA, 22 bp, Homo sapiens
tggcctggccctgaggccctgt

SEQ ID NO: 8435305 - DNA, 22 bp, Homo sapiens
tggcctgggtgctgctgacatc

SEQ ID NO: 8435306 - DNA, 22 bp, Homo sapiens
tggcctgggtgctgctgacatc

SEQ ID NO: 8435307 - DNA, 22 bp, Homo sapiens
tggcctggtaccacatagattt

SEQ ID NO: 8435308 - DNA, 22 bp, Homo sapiens
tggcctggtaccacatagattt

SEQ ID NO: 8435309 - DNA, 22 bp, Homo sapiens
tggcctggttgttgctgccgtt

SEQ ID NO: 8435310 - DNA, 22 bp, Homo sapiens
tggcgaggccaggccagggcct

SEQ ID NO: 8435311 - DNA, 20 bp, Homo sapiens
tggccttttggcttggagct

SEQ ID NO: 8435312 - DNA, 22 bp, Homo sapiens
tggccttttctttcacaggcaa

SEQ ID NO: 8435313 - DNA, 22 bp, Homo sapiens
tggcgcagtttctctgctgcct

SEQ ID NO: 8435314 - DNA, 22 bp, Homo sapiens
tggcgaggccaggccagggcct

SEQ ID NO: 8435315 - DNA, 22 bp, Homo sapiens
tggccttggccgtgctggggtc

SEQ ID NO: 8435316 - DNA, 22 bp, Homo sapiens
tggcctgtcttgttgtgctaga

SEQ ID NO: 8435317 - DNA, 22 bp, Homo sapiens
tggcctgttgctcctaggggtc

SEQ ID NO: 8435318 - DNA, 22 bp, Homo sapiens
tggcctgtgtggcttcctggga

SEQ ID NO: 8435319 - DNA, 22 bp, Homo sapiens
tggcctgtgtggcttcctggga

SEQ ID NO: 8435320 - DNA, 22 bp, Homo sapiens
tggccttgaaccaggtctccac

SEQ ID NO: 8435321 - DNA, 22 bp, Homo sapiens
tggccttcctggtgactcatga

SEQ ID NO: 8435322 - DNA, 22 bp, Homo sapiens
tggccttgataactggggagag

SEQ ID NO: 8435323 - DNA, 22 bp, Homo sapiens
tggccttggagaggcacggccc

SEQ ID NO: 8435324 - DNA, 22 bp, Homo sapiens
tggctcaggggtctggctctgt

SEQ ID NO: 8435325 - DNA, 22 bp, Homo sapiens
tggctcaggggtctggctctgt

SEQ ID NO: 8435326 - DNA, 22 bp, Homo sapiens
tggctcagtaatcgagtctcct

SEQ ID NO: 8435327 - DNA, 22 bp, Homo sapiens
tggctcagtcatggatgagtaa

SEQ ID NO: 8435328 - DNA, 22 bp, Homo sapiens
tggctcagtcatggatgagtaa

SEQ ID NO: 8435329 - DNA, 22 bp, Homo sapiens
tggctcagtgaagagataactt

SEQ ID NO: 8435330 - DNA, 22 bp, Homo sapiens
tggctcagtctgggttgactga

SEQ ID NO: 8435331 - DNA, 22 bp, Homo sapiens
tggctcagtgacattcctccca

SEQ ID NO: 8435332 - DNA, 22 bp, Homo sapiens
tggctcagtgacattcctccca

SEQ ID NO: 8435333 - DNA, 22 bp, Homo sapiens
tggctcagtggcagccgcagct

SEQ ID NO: 8435334 - DNA, 22 bp, Homo sapiens
tggctcagtgcattcacagtaa

SEQ ID NO: 8435335 - DNA, 22 bp, Homo sapiens
tggctcagcattcactggtctt

SEQ ID NO: 8435336 - DNA, 22 bp, Homo sapiens
tggctcagcattcactggtctt

SEQ ID NO: 8435337 - DNA, 22 bp, Homo sapiens
tggctcagccagccctaggaac

SEQ ID NO: 8435338 - DNA, 22 bp, Homo sapiens
tggctcagccagccctaggaac

SEQ ID NO: 8435339 - DNA, 22 bp, Homo sapiens
tggctcaggataattttcccaa

SEQ ID NO: 8435340 - DNA, 22 bp, Homo sapiens
tggctcagctttccccatctgg

SEQ ID NO: 8435341 - DNA, 22 bp, Homo sapiens
tggctcaggagggatctttgct

SEQ ID NO: 8435342 - DNA, 22 bp, Homo sapiens
tggctcaggatctaagcagaat

SEQ ID NO: 8435343 - DNA, 22 bp, Homo sapiens
tggctcaggatctaagcagaat

SEQ ID NO: 8435344 - DNA, 22 bp, Homo sapiens
tggctcaggcttgaaaatagat

SEQ ID NO: 8435345 - DNA, 22 bp, Homo sapiens
tggctccacaggccagggtgtg

SEQ ID NO: 8435346 - DNA, 22 bp, Homo sapiens
tggctcagttccatcatctgga

SEQ ID NO: 8435347 - DNA, 22 bp, Homo sapiens
tggctcagttaggtcagaaaca

SEQ ID NO: 8435348 - DNA, 23 bp, Homo sapiens
tggctccaggagaagccagaagc

SEQ ID NO: 8435349 - DNA, 22 bp, Homo sapiens
tggctccagcgtccacgtcctg

SEQ ID NO: 8435350 - DNA, 20 bp, Homo sapiens
tggctccagcctcccctacc

SEQ ID NO: 8435351 - DNA, 20 bp, Homo sapiens
tggctccagcctcccctacc

SEQ ID NO: 8435352 - DNA, 22 bp, Homo sapiens
tggctccagatttcctgctgca

SEQ ID NO: 8435353 - DNA, 22 bp, Homo sapiens
tggctccagatctgtctcctgt

SEQ ID NO: 8435354 - DNA, 22 bp, Homo sapiens
tggctcctgcatttgtgctaac

SEQ ID NO: 8435355 - DNA, 18 bp, Homo sapiens
tggctcctgcctcctgca

SEQ ID NO: 8435356 - DNA, 22 bp, Homo sapiens
tggctcctcacgtcctcagagc

SEQ ID NO: 8435357 - DNA, 22 bp, Homo sapiens
tggctcctcatcacagttggtg

SEQ ID NO: 8435358 - DNA, 22 bp, Homo sapiens
tggctcctgcagaccatctgga

SEQ ID NO: 8435359 - DNA, 20 bp, Homo sapiens
tggctcctcttggctgtggc

SEQ ID NO: 8435360 - DNA, 22 bp, Homo sapiens
tggctcctcttctgggtgtccc

SEQ ID NO: 8435361 - DNA, 22 bp, Homo sapiens
tggctcctaatgctgcccagac

SEQ ID NO: 8435362 - DNA, 22 bp, Homo sapiens
tggctcccgcagaccctgtgct

SEQ ID NO: 8435363 - DNA, 22 bp, Homo sapiens
tggctcccacaaactcactact

SEQ ID NO: 8435364 - DNA, 22 bp, Homo sapiens
tggctcccgcttgcacctaaga

SEQ ID NO: 8435365 - DNA, 21 bp, Homo sapiens
tggctcccttgaattgtctgt

SEQ ID NO: 8435366 - DNA, 22 bp, Homo sapiens
tggctcctaatgctgcccagac

SEQ ID NO: 8435367 - DNA, 22 bp, Homo sapiens
tggctccaggggacacgcagta

SEQ ID NO: 8435368 - DNA, 22 bp, Homo sapiens
tggctccaggttgaactttggg

SEQ ID NO: 8435369 - DNA, 22 bp, Homo sapiens
tggctccatcatccatgcaaga

SEQ ID NO: 8435370 - DNA, 22 bp, Homo sapiens
tggctcccaaggagctcctgcc

SEQ ID NO: 8435371 - DNA, 22 bp, Homo sapiens
tggccagtagagctcagatagt

SEQ ID NO: 8435372 - DNA, 22 bp, Homo sapiens
tggccagtagataggcaggcaa

SEQ ID NO: 8435373 - DNA, 22 bp, Homo sapiens
tggccaggtgtgggttctcaga

SEQ ID NO: 8435374 - DNA, 22 bp, Homo sapiens
tggccaggtgtgggttctcaga

SEQ ID NO: 8435375 - DNA, 22 bp, Homo sapiens
tggccaggtgtgggttctcaga

SEQ ID NO: 8435376 - DNA, 22 bp, Homo sapiens
tggccaggttgggctttgcagc

SEQ ID NO: 8435377 - DNA, 22 bp, Homo sapiens
tggccaggttgggctttgcagc

SEQ ID NO: 8435378 - DNA, 23 bp, Homo sapiens
tggccaggtagaggaggtagtga

SEQ ID NO: 8435379 - DNA, 23 bp, Homo sapiens
tggccaggtagaggaggtagtga

SEQ ID NO: 8435380 - DNA, 23 bp, Homo sapiens
tggccaggtagaggaggtagtga

SEQ ID NO: 8435381 - DNA, 23 bp, Homo sapiens
tggccaggtagaggaggtagtga

SEQ ID NO: 8435382 - DNA, 19 bp, Homo sapiens
tggccaggtactgtctgct

SEQ ID NO: 8435383 - DNA, 19 bp, Homo sapiens
tggccaggtactgtctgct

SEQ ID NO: 8435384 - DNA, 19 bp, Homo sapiens
tggccaggtactgtctgct

SEQ ID NO: 8435385 - DNA, 22 bp, Homo sapiens
tggccaggcctcttggtgccca

SEQ ID NO: 8435386 - DNA, 22 bp, Homo sapiens
tggccaggcctcttggtgccca

SEQ ID NO: 8435387 - DNA, 22 bp, Homo sapiens
tggccaggctggtctggaacgc

SEQ ID NO: 8435388 - DNA, 22 bp, Homo sapiens
tggccaggctggtctggaacgc

SEQ ID NO: 8435389 - DNA, 22 bp, Homo sapiens
tggccaggctggtctggaacgc

SEQ ID NO: 8435390 - DNA, 22 bp, Homo sapiens
tggccaggctggtctggaacgc

SEQ ID NO: 8435391 - DNA, 22 bp, Homo sapiens
tggccaggctggtctggaacgc

SEQ ID NO: 8435392 - DNA, 22 bp, Homo sapiens
tggccaggggagttcccctcca

SEQ ID NO: 8435393 - DNA, 22 bp, Homo sapiens
tggccaggggagttcccctcca

SEQ ID NO: 8435394 - DNA, 23 bp, Homo sapiens
tggccagggtactacacccaccc

SEQ ID NO: 8435395 - DNA, 19 bp, Homo sapiens
tggccaggtactgtctgct

SEQ ID NO: 8435396 - DNA, 23 bp, Homo sapiens
tggccagggtactacacccaccc

SEQ ID NO: 8435397 - DNA, 22 bp, Homo sapiens
tggccagcacttagcccttacc

SEQ ID NO: 8435398 - DNA, 22 bp, Homo sapiens
tggccagcccttcagccatgcc

SEQ ID NO: 8435399 - DNA, 22 bp, Homo sapiens
tggccagccctcttcccacact

SEQ ID NO: 8435400 - DNA, 22 bp, Homo sapiens
tggccaggcattcagataagac

SEQ ID NO: 8435401 - DNA, 21 bp, Homo sapiens
tggccagctggagtctccaca

SEQ ID NO: 8435402 - DNA, 22 bp, Homo sapiens
tggccaggccggggacagaact

SEQ ID NO: 8435403 - DNA, 22 bp, Homo sapiens
tggccaggccggggacagaact

SEQ ID NO: 8435404 - DNA, 22 bp, Homo sapiens
tggccaggccggggacagaact

SEQ ID NO: 8435405 - DNA, 22 bp, Homo sapiens
tggccaggccggggacagaact

SEQ ID NO: 8435406 - DNA, 22 bp, Homo sapiens
tggccaggccggggacagaact

SEQ ID NO: 8435407 - DNA, 17 bp, Homo sapiens
tggccaggccccgccag

SEQ ID NO: 8435408 - DNA, 22 bp, Homo sapiens
tggccaccttcccacttctgcc

SEQ ID NO: 8435409 - DNA, 23 bp, Homo sapiens
tggccacagtccatgcatgccca

SEQ ID NO: 8435410 - DNA, 23 bp, Homo sapiens
tggccacagtccatgcatgccca

SEQ ID NO: 8435411 - DNA, 22 bp, Homo sapiens
tggccacagtgtccagcagcag

SEQ ID NO: 8435412 - DNA, 22 bp, Homo sapiens
tggccacccctttctctgcact

SEQ ID NO: 8435413 - DNA, 22 bp, Homo sapiens
tggccacccagctgacgccttc

SEQ ID NO: 8435414 - DNA, 22 bp, Homo sapiens
tggccacatgcgtctgtgaggc

SEQ ID NO: 8435415 - DNA, 19 bp, Homo sapiens
tggcattggtccagataaa

SEQ ID NO: 8435416 - DNA, 22 bp, Homo sapiens
tggcattgacgctgacctgcac

SEQ ID NO: 8435417 - DNA, 22 bp, Homo sapiens
tggcattgctagtgacccagca

SEQ ID NO: 8435418 - DNA, 22 bp, Homo sapiens
tggcatgtttaatgtactgtat

SEQ ID NO: 8435419 - DNA, 22 bp, Homo sapiens
tggcatgtatacttgagtagga

SEQ ID NO: 8435420 - DNA, 22 bp, Homo sapiens
tggccacactgcccccactggg

SEQ ID NO: 8435421 - DNA, 22 bp, Homo sapiens
tggcatttctggccatttgtgt

SEQ ID NO: 8435422 - DNA, 23 bp, Homo sapiens
tggcatttctatactggcaagtg

SEQ ID NO: 8435423 - DNA, 22 bp, Homo sapiens
tggcatttcctcagtgctcaga

SEQ ID NO: 8435424 - DNA, 22 bp, Homo sapiens
tggcatttcagtattttcataa

SEQ ID NO: 8435425 - DNA, 22 bp, Homo sapiens
tggcatttcacctttcatttcc

SEQ ID NO: 8435426 - DNA, 22 bp, Homo sapiens
tggcatttcacctttcatttcc

SEQ ID NO: 8435427 - DNA, 22 bp, Homo sapiens
tggcatggcatttagagaatta

SEQ ID NO: 8435428 - DNA, 17 bp, Homo sapiens
tggcatcttttgctcat

SEQ ID NO: 8435429 - DNA, 22 bp, Homo sapiens
tggcatgaatttagctttccat

SEQ ID NO: 8435430 - DNA, 22 bp, Homo sapiens
tggcatgaagtcagcagctggg

SEQ ID NO: 8435431 - DNA, 22 bp, Homo sapiens
tggcatgagtataggcttctca

SEQ ID NO: 8435432 - DNA, 19 bp, Homo sapiens
tggcatgatgatggatggg

SEQ ID NO: 8435433 - DNA, 22 bp, Homo sapiens
tggcagtggctcagagtgcaga

SEQ ID NO: 8435434 - DNA, 22 bp, Homo sapiens
tggcagtggctcagagtgcaga

SEQ ID NO: 8435435 - DNA, 22 bp, Homo sapiens
tggcagtggctcagagtgcaga

SEQ ID NO: 8435436 - DNA, 22 bp, Homo sapiens
tggcagtgtttctaaggggctc

SEQ ID NO: 8435437 - DNA, 19 bp, Homo sapiens
tggcagtgtggggtatgaa

SEQ ID NO: 8435438 - DNA, 22 bp, Homo sapiens
tggcagtgccccttgaccagtg

SEQ ID NO: 8435439 - DNA, 22 bp, Homo sapiens
tggcagtgccccttgaccagtg

SEQ ID NO: 8435440 - DNA, 22 bp, Homo sapiens
tggcagtggcgggactcagggc

SEQ ID NO: 8435441 - DNA, 22 bp, Homo sapiens
tggcagtggcgggactcagggc

SEQ ID NO: 8435442 - DNA, 23 bp, Homo sapiens
tggcatagtgaggggcacagaga

SEQ ID NO: 8435443 - DNA, 23 bp, Homo sapiens
tggcatagtgaggggcacagaga

SEQ ID NO: 8435444 - DNA, 22 bp, Homo sapiens
tggcagtttacagagttctgaa

SEQ ID NO: 8435445 - DNA, 22 bp, Homo sapiens
tggcagtttcatgtgattcaac

SEQ ID NO: 8435446 - DNA, 22 bp, Homo sapiens
tggcagttattaatcaagtctt

SEQ ID NO: 8435447 - DNA, 22 bp, Homo sapiens
tggcagttatattgccttaggg

SEQ ID NO: 8435448 - DNA, 22 bp, Homo sapiens
tggcagttctaattgaccattt

SEQ ID NO: 8435449 - DNA, 22 bp, Homo sapiens
tggcagttgtgaggttcatatt

SEQ ID NO: 8435450 - DNA, 22 bp, Homo sapiens
tggcagttggggatgaagtgag

SEQ ID NO: 8435451 - DNA, 22 bp, Homo sapiens
tggcaggtgccatgggctcaga

SEQ ID NO: 8435452 - DNA, 22 bp, Homo sapiens
tggcaggtgaagttgttaggga

SEQ ID NO: 8435453 - DNA, 18 bp, Homo sapiens
tggcaggtccagctgtgg

SEQ ID NO: 8435454 - DNA, 22 bp, Homo sapiens
tggcagggtgccagttgcgagt

SEQ ID NO: 8435455 - DNA, 22 bp, Homo sapiens
tggcagggtgccagttgcgagt

SEQ ID NO: 8435456 - DNA, 22 bp, Homo sapiens
tggcagggtcttgctgtgttgc

SEQ ID NO: 8435457 - DNA, 22 bp, Homo sapiens
tggcagggtacaccttaacacc

SEQ ID NO: 8435458 - DNA, 21 bp, Homo sapiens
tggcaggttcaaaggcctatc

SEQ ID NO: 8435459 - DNA, 22 bp, Homo sapiens
tggcagtagatccagtctctct

SEQ ID NO: 8435460 - DNA, 22 bp, Homo sapiens
tggcagtctgcctcttcaccat

SEQ ID NO: 8435461 - DNA, 18 bp, Homo sapiens
tggcagtgaggtaggcat

SEQ ID NO: 8435462 - DNA, 22 bp, Homo sapiens
tggcagtgatgcggcaggacat

SEQ ID NO: 8435463 - DNA, 22 bp, Homo sapiens
tggcagtgatgcggcaggacat

SEQ ID NO: 8435464 - DNA, 22 bp, Homo sapiens
tggcagtgatgcttatggtttg

SEQ ID NO: 8435465 - DNA, 22 bp, Homo sapiens
tggcctctgggaaagcagattc

SEQ ID NO: 8435466 - DNA, 22 bp, Homo sapiens
tggcctgaggctcggcatgggt

SEQ ID NO: 8435467 - DNA, 22 bp, Homo sapiens
tggcctgactgtccagccaggg

SEQ ID NO: 8435468 - DNA, 22 bp, Homo sapiens
tggcctgagttgtctgcaggcc

SEQ ID NO: 8435469 - DNA, 22 bp, Homo sapiens
tggcctgatacttccagagttc

SEQ ID NO: 8435470 - DNA, 23 bp, Homo sapiens
tggcctgcagagtttctgctggg

SEQ ID NO: 8435471 - DNA, 22 bp, Homo sapiens
tggcctgccccgagatcctggc

SEQ ID NO: 8435472 - DNA, 22 bp, Homo sapiens
tggcctgcccagagcagctctg

SEQ ID NO: 8435473 - DNA, 23 bp, Homo sapiens
tggcctggagagaaaagatgagt

SEQ ID NO: 8435474 - DNA, 22 bp, Homo sapiens
tggcctggaagagaggtcgagg

SEQ ID NO: 8435475 - DNA, 22 bp, Homo sapiens
tggcctggccacatccagcagg

SEQ ID NO: 8435476 - DNA, 22 bp, Homo sapiens
tggcctggccacatccagcagg

SEQ ID NO: 8435477 - DNA, 23 bp, Homo sapiens
tggcctggagagaaaagatgagt

SEQ ID NO: 8435478 - DNA, 22 bp, Homo sapiens
tggcctggccacatccagcagg

SEQ ID NO: 8435479 - DNA, 22 bp, Homo sapiens
tggcctgccttcgctgagctga

SEQ ID NO: 8435480 - DNA, 22 bp, Homo sapiens
tggcctggaaaaatgcagatgg

SEQ ID NO: 8435481 - DNA, 22 bp, Homo sapiens
tggcctggaaaaatgcagatgg

SEQ ID NO: 8435482 - DNA, 22 bp, Homo sapiens
tggccctgtgtcctgctgccag

SEQ ID NO: 8435483 - DNA, 22 bp, Homo sapiens
tggccctgtgtcctgctgccag

SEQ ID NO: 8435484 - DNA, 22 bp, Homo sapiens
tggccctgtgtcctgctgccag

SEQ ID NO: 8435485 - DNA, 22 bp, Homo sapiens
tggccctgtggcttcagaacag

SEQ ID NO: 8435486 - DNA, 23 bp, Homo sapiens
tggccctgtgcatgctgcttccc

SEQ ID NO: 8435487 - DNA, 22 bp, Homo sapiens
tggcctcaaccgtcctaagcac

SEQ ID NO: 8435488 - DNA, 22 bp, Homo sapiens
tggcctagagaagccaaaagat

SEQ ID NO: 8435489 - DNA, 22 bp, Homo sapiens
tggcccttgttcaaatatgtca

SEQ ID NO: 8435490 - DNA, 22 bp, Homo sapiens
tggccctttggtttatgactga

SEQ ID NO: 8435491 - DNA, 20 bp, Homo sapiens
tggccctgttttctccaggc

SEQ ID NO: 8435492 - DNA, 22 bp, Homo sapiens
tggccctgttctgtacctcata

SEQ ID NO: 8435493 - DNA, 20 bp, Homo sapiens
tggccctgttttctccaggc

SEQ ID NO: 8435494 - DNA, 20 bp, Homo sapiens
tggccctgttttctccaggc

SEQ ID NO: 8435495 - DNA, 22 bp, Homo sapiens
tggccctgggcagaggcaacat

SEQ ID NO: 8435496 - DNA, 22 bp, Homo sapiens
tggccctgggcagaggcaacat

SEQ ID NO: 8435497 - DNA, 22 bp, Homo sapiens
tggccctgggcagaggcaacat

SEQ ID NO: 8435498 - DNA, 22 bp, Homo sapiens
tggccctgggcatctttcgtga

SEQ ID NO: 8435499 - DNA, 21 bp, Homo sapiens
tggccctggccacggctgcca

SEQ ID NO: 8435500 - DNA, 22 bp, Homo sapiens
tggccctgccgccacgacgtct

SEQ ID NO: 8435501 - DNA, 21 bp, Homo sapiens
tggccctggccacggctgcca

SEQ ID NO: 8435502 - DNA, 22 bp, Homo sapiens
tggccctgccactcactgctga

SEQ ID NO: 8435503 - DNA, 22 bp, Homo sapiens
tggccctgccactcactgctga

SEQ ID NO: 8435504 - DNA, 22 bp, Homo sapiens
tggccctgccactcactgctga

SEQ ID NO: 8435505 - DNA, 22 bp, Homo sapiens
tggccctgccgcactatcctca

SEQ ID NO: 8435506 - DNA, 22 bp, Homo sapiens
tggccctgccctcttcatcttt

SEQ ID NO: 8435507 - DNA, 22 bp, Homo sapiens
tggccctgtctgcacacaggat

SEQ ID NO: 8435508 - DNA, 22 bp, Homo sapiens
tggccctgtcctcatttcatct

SEQ ID NO: 8435509 - DNA, 22 bp, Homo sapiens
tggccctgtctgcacacaggat

SEQ ID NO: 8435510 - DNA, 23 bp, Homo sapiens
tggccctgtgcatgctgcttccc

SEQ ID NO: 8435511 - DNA, 22 bp, Homo sapiens
tggccctggtggcacagcctgc

SEQ ID NO: 8435512 - DNA, 22 bp, Homo sapiens
tggccctggtggcacagcctgc

SEQ ID NO: 8435513 - DNA, 22 bp, Homo sapiens
tggcccagggagttcatggtgt

SEQ ID NO: 8435514 - DNA, 22 bp, Homo sapiens
tggcccagggagttcatggtgt

SEQ ID NO: 8435515 - DNA, 22 bp, Homo sapiens
tggcccaggcgaggtgggcaga

SEQ ID NO: 8435516 - DNA, 22 bp, Homo sapiens
tggcccaggccaaagccctgga

SEQ ID NO: 8435517 - DNA, 22 bp, Homo sapiens
tggcccaggcgaggtgggcaga

SEQ ID NO: 8435518 - DNA, 22 bp, Homo sapiens
tggcccaggaggccagagggca

SEQ ID NO: 8435519 - DNA, 22 bp, Homo sapiens
tggcccaggaggccagagggca

SEQ ID NO: 8435520 - DNA, 22 bp, Homo sapiens
tggcccagctgcagatggtgga

SEQ ID NO: 8435521 - DNA, 22 bp, Homo sapiens
tggcccaggaggccagagggca

SEQ ID NO: 8435522 - DNA, 22 bp, Homo sapiens
tggcccaggtctctctgagccc

SEQ ID NO: 8435523 - DNA, 22 bp, Homo sapiens
tggcccaggtctctctgagccc

SEQ ID NO: 8435524 - DNA, 22 bp, Homo sapiens
tggcccaggtctctctgagccc

SEQ ID NO: 8435525 - DNA, 22 bp, Homo sapiens
tggcccagggtctacagcctca

SEQ ID NO: 8435526 - DNA, 22 bp, Homo sapiens
tggcccaggggctcttggtgtt

SEQ ID NO: 8435527 - DNA, 22 bp, Homo sapiens
tggcccaggggctcttggtgtt

SEQ ID NO: 8435528 - DNA, 22 bp, Homo sapiens
tggcccaggggctcttggtgtt

SEQ ID NO: 8435529 - DNA, 22 bp, Homo sapiens
tggcccaggggctcttggtgtt

SEQ ID NO: 8435530 - DNA, 22 bp, Homo sapiens
tggcccagggcacagcagggag

SEQ ID NO: 8435531 - DNA, 22 bp, Homo sapiens
tggccagtggggttgagcagga

SEQ ID NO: 8435532 - DNA, 22 bp, Homo sapiens
tggccagtgcctgccagtgcag

SEQ ID NO: 8435533 - DNA, 22 bp, Homo sapiens
tggccagtgattaatgacgctt

SEQ ID NO: 8435534 - DNA, 22 bp, Homo sapiens
tggccagtttgctcaggcagtc

SEQ ID NO: 8435535 - DNA, 22 bp, Homo sapiens
tggccatgggatagtgcagggg

SEQ ID NO: 8435536 - DNA, 22 bp, Homo sapiens
tggcccaaagcagcccagcagg

SEQ ID NO: 8435537 - DNA, 22 bp, Homo sapiens
tggccatgacatggaggctttg

SEQ ID NO: 8435538 - DNA, 22 bp, Homo sapiens
tggcccagactctgctcttatc

SEQ ID NO: 8435539 - DNA, 22 bp, Homo sapiens
tggcccagccctgctctagggc

SEQ ID NO: 8435540 - DNA, 22 bp, Homo sapiens
tggcccagccctgctctagggc

SEQ ID NO: 8435541 - DNA, 22 bp, Homo sapiens
tggcccaagtctgctagaagag

SEQ ID NO: 8435542 - DNA, 22 bp, Homo sapiens
tggcccagctgcagatggtgga

SEQ ID NO: 8435543 - DNA, 22 bp, Homo sapiens
tggcccagctcagggtgggcgg

SEQ ID NO: 8435544 - DNA, 22 bp, Homo sapiens
tggcccagctcagggtgggcgg

SEQ ID NO: 8435545 - DNA, 22 bp, Homo sapiens
tggcccagccctgctctagggc

SEQ ID NO: 8435546 - DNA, 22 bp, Homo sapiens
tggcccagccctgctctagggc

SEQ ID NO: 8435547 - DNA, 23 bp, Homo sapiens
tggccctgaatctgtcctggagg

SEQ ID NO: 8435548 - DNA, 22 bp, Homo sapiens
tggccctatttggaaatagagc

SEQ ID NO: 8435549 - DNA, 17 bp, Homo sapiens
tggccctagactccagc

SEQ ID NO: 8435550 - DNA, 22 bp, Homo sapiens
tggcccaggtgcaagagacaga

SEQ ID NO: 8435551 - DNA, 22 bp, Homo sapiens
tggcccaggtgcaagagacaga

SEQ ID NO: 8435552 - DNA, 22 bp, Homo sapiens
tggcccaggtgcacccagaggc

SEQ ID NO: 8435553 - DNA, 22 bp, Homo sapiens
tggcccaggtgcacccagaggc

SEQ ID NO: 8435554 - DNA, 22 bp, Homo sapiens
tggcccagtagaaaagggatcg

SEQ ID NO: 8435555 - DNA, 22 bp, Homo sapiens
tggcccaggtgcacccagaggc

SEQ ID NO: 8435556 - DNA, 22 bp, Homo sapiens
tggcccagtatgtataatctta

SEQ ID NO: 8435557 - DNA, 22 bp, Homo sapiens
tggcccagtcagcaggagaggg

SEQ ID NO: 8435558 - DNA, 22 bp, Homo sapiens
tggcccgccggaagaagatgtc

SEQ ID NO: 8435559 - DNA, 22 bp, Homo sapiens
tggcccagtcagcaggagaggg

SEQ ID NO: 8435560 - DNA, 22 bp, Homo sapiens
tggccctgcacccagagcagtt

SEQ ID NO: 8435561 - DNA, 22 bp, Homo sapiens
tggccctgcagaactagcctgg

SEQ ID NO: 8435562 - DNA, 22 bp, Homo sapiens
tggccctgcagaactagcctgg

SEQ ID NO: 8435563 - DNA, 22 bp, Homo sapiens
tggccctgaggggctgtgcccc

SEQ ID NO: 8435564 - DNA, 22 bp, Homo sapiens
tggccctgaggacccagtgtgg

SEQ ID NO: 8435565 - DNA, 22 bp, Homo sapiens
tggccctgacacgtggtactgg

SEQ ID NO: 8435566 - DNA, 22 bp, Homo sapiens
tggccctgacaggtcctgggca

SEQ ID NO: 8435567 - DNA, 22 bp, Homo sapiens
tggcacatggttaatcataatt

SEQ ID NO: 8435568 - DNA, 22 bp, Homo sapiens
tggcaccaccagacaccaggag

SEQ ID NO: 8435569 - DNA, 22 bp, Homo sapiens
tggcactgaaaaaggagaggtt

SEQ ID NO: 8435570 - DNA, 22 bp, Homo sapiens
tggcactgaagctggaaagcct

SEQ ID NO: 8435571 - DNA, 22 bp, Homo sapiens
tggcactgacagggtgctcaag

SEQ ID NO: 8435572 - DNA, 22 bp, Homo sapiens
tggcactgccaacctgctaggt

SEQ ID NO: 8435573 - DNA, 22 bp, Homo sapiens
tggcactgaccccaggcctgtg

SEQ ID NO: 8435574 - DNA, 22 bp, Homo sapiens
tggcactggaatcgtagccttg

SEQ ID NO: 8435575 - DNA, 22 bp, Homo sapiens
tggcactgccaacctgctaggt

SEQ ID NO: 8435576 - DNA, 22 bp, Homo sapiens
tggcagagccttgccaaactcc

SEQ ID NO: 8435577 - DNA, 22 bp, Homo sapiens
tggcagagccttgccaaactcc

SEQ ID NO: 8435578 - DNA, 22 bp, Homo sapiens
tggcagaggaaaaagtcactgg

SEQ ID NO: 8435579 - DNA, 22 bp, Homo sapiens
tggcagaggaaaaagtcactgg

SEQ ID NO: 8435580 - DNA, 22 bp, Homo sapiens
tggcagaggaaaaagtcactgg

SEQ ID NO: 8435581 - DNA, 22 bp, Homo sapiens
tggcagagcccagaactgagca

SEQ ID NO: 8435582 - DNA, 22 bp, Homo sapiens
tggcagagcaaaaagatagaat

SEQ ID NO: 8435583 - DNA, 22 bp, Homo sapiens
tggcagagactcctcctgggag

SEQ ID NO: 8435584 - DNA, 22 bp, Homo sapiens
tggcagagagactctccttgat

SEQ ID NO: 8435585 - DNA, 23 bp, Homo sapiens
tggcagagacccagaatctacat

SEQ ID NO: 8435586 - DNA, 22 bp, Homo sapiens
tggcagagacaaggccgggcct

SEQ ID NO: 8435587 - DNA, 22 bp, Homo sapiens
tggcaaagtatctgtcccagct

SEQ ID NO: 8435588 - DNA, 22 bp, Homo sapiens
tggcaacacctggaagacatgg

SEQ ID NO: 8435589 - DNA, 22 bp, Homo sapiens
tggcaacacctggaagacatgg

SEQ ID NO: 8435590 - DNA, 22 bp, Homo sapiens
tggcaatatgctttcagtggcc

SEQ ID NO: 8435591 - DNA, 22 bp, Homo sapiens
tggcaaaggaaatgatttaaga

SEQ ID NO: 8435592 - DNA, 22 bp, Homo sapiens
tggcaaaggcgctcacatgcct

SEQ ID NO: 8435593 - DNA, 22 bp, Homo sapiens
tggcaaaagttttaggttattt

SEQ ID NO: 8435594 - DNA, 22 bp, Homo sapiens
tggcaaaatgagcaattacttt

SEQ ID NO: 8435595 - DNA, 22 bp, Homo sapiens
tggattttagcatgtaactgtg

SEQ ID NO: 8435596 - DNA, 22 bp, Homo sapiens
tggatttccagacagcttaatt

SEQ ID NO: 8435597 - DNA, 22 bp, Homo sapiens
tggcaaaacccacaattatatc

SEQ ID NO: 8435598 - DNA, 22 bp, Homo sapiens
tggatttattaggttggtgaaa

SEQ ID NO: 8435599 - DNA, 22 bp, Homo sapiens
tggatttctccagctctccatt

SEQ ID NO: 8435600 - DNA, 22 bp, Homo sapiens
tggatttctccagctctccatt

SEQ ID NO: 8435601 - DNA, 22 bp, Homo sapiens
tggatttgctaccttctgatat

SEQ ID NO: 8435602 - DNA, 22 bp, Homo sapiens
tggattgataaaatgggatgtt

SEQ ID NO: 8435603 - DNA, 22 bp, Homo sapiens
tggattgataagagacaagtga

SEQ ID NO: 8435604 - DNA, 22 bp, Homo sapiens
tggattctgggagagttctata

SEQ ID NO: 8435605 - DNA, 22 bp, Homo sapiens
tggattctcatgggaccagtag

SEQ ID NO: 8435606 - DNA, 22 bp, Homo sapiens
tggattctgggctgtttgcatt

SEQ ID NO: 8435607 - DNA, 22 bp, Homo sapiens
tggattctcatgggaccagtag

SEQ ID NO: 8435608 - DNA, 22 bp, Homo sapiens
tggattctaatgcacttcaaat

SEQ ID NO: 8435609 - DNA, 22 bp, Homo sapiens
tggatggttctgggcggcagca

SEQ ID NO: 8435610 - DNA, 22 bp, Homo sapiens
tggatgtgagaaggatcaggct

SEQ ID NO: 8435611 - DNA, 17 bp, Homo sapiens
tggcacagaggtgctat

SEQ ID NO: 8435612 - DNA, 22 bp, Homo sapiens
tggcacagagggacccagcagc

SEQ ID NO: 8435613 - DNA, 22 bp, Homo sapiens
tggcacagactgggccaaggaa

SEQ ID NO: 8435614 - DNA, 22 bp, Homo sapiens
tggcacagagggacccagcagc

SEQ ID NO: 8435615 - DNA, 22 bp, Homo sapiens
tggcacagagggacccagcagc

SEQ ID NO: 8435616 - DNA, 23 bp, Homo sapiens
tggcacagaggaccatgctttgc

SEQ ID NO: 8435617 - DNA, 22 bp, Homo sapiens
tggcacagccatcttctcctgc

SEQ ID NO: 8435618 - DNA, 22 bp, Homo sapiens
tggcacagccactgaatcggga

SEQ ID NO: 8435619 - DNA, 21 bp, Homo sapiens
tggcacagcaagtgggctcat

SEQ ID NO: 8435620 - DNA, 23 bp, Homo sapiens
tggcacagcaggtgtgctttgtt

SEQ ID NO: 8435621 - DNA, 22 bp, Homo sapiens
tggcacagttaaagttgtagaa

SEQ ID NO: 8435622 - DNA, 22 bp, Homo sapiens
tggcacagtgctggatggtgct

SEQ ID NO: 8435623 - DNA, 22 bp, Homo sapiens
tggcacagcccagagctcttga

SEQ ID NO: 8435624 - DNA, 22 bp, Homo sapiens
tggcacagcccagagctcttga

SEQ ID NO: 8435625 - DNA, 22 bp, Homo sapiens
tggcacagcccggattctatga

SEQ ID NO: 8435626 - DNA, 22 bp, Homo sapiens
tggcacagcccattcagagaag

SEQ ID NO: 8435627 - DNA, 22 bp, Homo sapiens
tggcacagacagatcaggagtc

SEQ ID NO: 8435628 - DNA, 20 bp, Homo sapiens
tggcacagaacccttgccta

SEQ ID NO: 8435629 - DNA, 22 bp, Homo sapiens
tggcacagaaaaatgctccatt

SEQ ID NO: 8435630 - DNA, 22 bp, Homo sapiens
tggcacagaaaaatgctccatt

SEQ ID NO: 8435631 - DNA, 22 bp, Homo sapiens
tggcacagacagcacagcaatg

SEQ ID NO: 8435632 - DNA, 22 bp, Homo sapiens
tggcacagaccttatcttctct

SEQ ID NO: 8435633 - DNA, 22 bp, Homo sapiens
tggcacagacatttaatagcct

SEQ ID NO: 8435634 - DNA, 22 bp, Homo sapiens
tggcacagacagcacagcaatg

SEQ ID NO: 8435635 - DNA, 22 bp, Homo sapiens
tggcacagacagcacagcaatg

SEQ ID NO: 8435636 - DNA, 22 bp, Homo sapiens
tggcaattggcaatttcgtatg

SEQ ID NO: 8435637 - DNA, 22 bp, Homo sapiens
tggcaatgttagcaaagcattt

SEQ ID NO: 8435638 - DNA, 22 bp, Homo sapiens
tggcaatgtaggcaagaacatt

SEQ ID NO: 8435639 - DNA, 22 bp, Homo sapiens
tggcacagaaaaatgctccatt

SEQ ID NO: 8435640 - DNA, 22 bp, Homo sapiens
tggcacagaaaaatgctccatt

SEQ ID NO: 8435641 - DNA, 22 bp, Homo sapiens
tggcacacagagaagacacttg

SEQ ID NO: 8435642 - DNA, 22 bp, Homo sapiens
tggcacacagagaagacacttg

SEQ ID NO: 8435643 - DNA, 18 bp, Homo sapiens
tggcaggaaatgcacttt

SEQ ID NO: 8435644 - DNA, 18 bp, Homo sapiens
tggcaggaaatgcacttt

SEQ ID NO: 8435645 - DNA, 22 bp, Homo sapiens
tggcaggaaccaggaggctctc

SEQ ID NO: 8435646 - DNA, 22 bp, Homo sapiens
tggcaggaaccaggaggctctc

SEQ ID NO: 8435647 - DNA, 22 bp, Homo sapiens
tggcaggaaataccctgcctag

SEQ ID NO: 8435648 - DNA, 22 bp, Homo sapiens
tggcaggaaaaagggccagagg

SEQ ID NO: 8435649 - DNA, 22 bp, Homo sapiens
tggcaggaaagtaacagagcac

SEQ ID NO: 8435650 - DNA, 22 bp, Homo sapiens
tggcaggaaagtaacagagcac

SEQ ID NO: 8435651 - DNA, 17 bp, Homo sapiens
tggcagctgaaagctct

SEQ ID NO: 8435652 - DNA, 22 bp, Homo sapiens
tggcagctgaggggaggctttg

SEQ ID NO: 8435653 - DNA, 22 bp, Homo sapiens
tggcagctgaatggctggatgg

SEQ ID NO: 8435654 - DNA, 22 bp, Homo sapiens
tggcagctgcaggcctcctgag

SEQ ID NO: 8435655 - DNA, 22 bp, Homo sapiens
tggcagctgccatgtccacgtg

SEQ ID NO: 8435656 - DNA, 22 bp, Homo sapiens
tggcaggaaaaagggccagagg

SEQ ID NO: 8435657 - DNA, 22 bp, Homo sapiens
tggcaggaagacgtggggcacc

SEQ ID NO: 8435658 - DNA, 20 bp, Homo sapiens
tggcaggaatagggccagag

SEQ ID NO: 8435659 - DNA, 22 bp, Homo sapiens
tggcaggaaggagactcagccc

SEQ ID NO: 8435660 - DNA, 20 bp, Homo sapiens
tggcaggaatagggccagag

SEQ ID NO: 8435661 - DNA, 22 bp, Homo sapiens
tggcaggaaggagactcagccc

SEQ ID NO: 8435662 - DNA, 22 bp, Homo sapiens
tggcaggagacacatggcatag

SEQ ID NO: 8435663 - DNA, 22 bp, Homo sapiens
tggcaggagagcgtcagatcag

SEQ ID NO: 8435664 - DNA, 20 bp, Homo sapiens
tggcaggactggctccaccc

SEQ ID NO: 8435665 - DNA, 20 bp, Homo sapiens
tggcaggactggctccaccc

SEQ ID NO: 8435666 - DNA, 20 bp, Homo sapiens
tggcaggaatagggccagag

SEQ ID NO: 8435667 - DNA, 22 bp, Homo sapiens
tggcaggatctttgagagtgaa

SEQ ID NO: 8435668 - DNA, 22 bp, Homo sapiens
tggcaggaggttttctccagga

SEQ ID NO: 8435669 - DNA, 20 bp, Homo sapiens
tggcaggaggcagcagtgga

SEQ ID NO: 8435670 - DNA, 20 bp, Homo sapiens
tggcaggaggcagcagtgga

SEQ ID NO: 8435671 - DNA, 20 bp, Homo sapiens
tggcaggaggcagcagtgga

SEQ ID NO: 8435672 - DNA, 20 bp, Homo sapiens
tggcaggaggcagcagtgga

SEQ ID NO: 8435673 - DNA, 22 bp, Homo sapiens
tggcaggaggatgaggcggcta

SEQ ID NO: 8435674 - DNA, 22 bp, Homo sapiens
tggcaggaggatgaggcggcta

SEQ ID NO: 8435675 - DNA, 22 bp, Homo sapiens
tggcaggaggatgaggcggcta

SEQ ID NO: 8435676 - DNA, 22 bp, Homo sapiens
tggcaggagcctgcggggaggt

SEQ ID NO: 8435677 - DNA, 22 bp, Homo sapiens
tggcaggagcctgcggggaggt

SEQ ID NO: 8435678 - DNA, 20 bp, Homo sapiens
tggcaggagccactggaagc

SEQ ID NO: 8435679 - DNA, 22 bp, Homo sapiens
tggcagggcctaccccaatatc

SEQ ID NO: 8435680 - DNA, 22 bp, Homo sapiens
tggcagggagttgcaggatttc

SEQ ID NO: 8435681 - DNA, 22 bp, Homo sapiens
tggcagggcctgctcatcatcc

SEQ ID NO: 8435682 - DNA, 22 bp, Homo sapiens
tggcagggcctgaatcttatac

SEQ ID NO: 8435683 - DNA, 18 bp, Homo sapiens
tggcaggggcagtacgcc

SEQ ID NO: 8435684 - DNA, 22 bp, Homo sapiens
tggcagggagttcgttcacaac

SEQ ID NO: 8435685 - DNA, 22 bp, Homo sapiens
tggcagggagttcgttcacaac

SEQ ID NO: 8435686 - DNA, 18 bp, Homo sapiens
tggcagggaggaaatata

SEQ ID NO: 8435687 - DNA, 22 bp, Homo sapiens
tggcagggagccaccggtcatg

SEQ ID NO: 8435688 - DNA, 22 bp, Homo sapiens
tggcaggcagtgtgggagctgg

SEQ ID NO: 8435689 - DNA, 21 bp, Homo sapiens
tggcaggcagctggaagcttg

SEQ ID NO: 8435690 - DNA, 21 bp, Homo sapiens
tggcaggcagctggaagcttg

SEQ ID NO: 8435691 - DNA, 22 bp, Homo sapiens
tggcaggatttgcccggaagga

SEQ ID NO: 8435692 - DNA, 22 bp, Homo sapiens
tggcaggcaagttcagctccac

SEQ ID NO: 8435693 - DNA, 22 bp, Homo sapiens
tggcagcacttgaacttgagcc

SEQ ID NO: 8435694 - DNA, 20 bp, Homo sapiens
tggcagagttgtcccaccca

SEQ ID NO: 8435695 - DNA, 22 bp, Homo sapiens
tggcagagttcgctgtgccttt

SEQ ID NO: 8435696 - DNA, 22 bp, Homo sapiens
tggcagagttcgctgtgccttt

SEQ ID NO: 8435697 - DNA, 22 bp, Homo sapiens
tggcagagtctgggcttgggca

SEQ ID NO: 8435698 - DNA, 22 bp, Homo sapiens
tggcagagtcatcacatctgga

SEQ ID NO: 8435699 - DNA, 22 bp, Homo sapiens
tggcagagtaggatggccctgt

SEQ ID NO: 8435700 - DNA, 22 bp, Homo sapiens
tggcagagtaggatggccctgt

SEQ ID NO: 8435701 - DNA, 22 bp, Homo sapiens
tggcagagtggaccatactcaa

SEQ ID NO: 8435702 - DNA, 21 bp, Homo sapiens
tggcagagtgcagtctataca

SEQ ID NO: 8435703 - DNA, 22 bp, Homo sapiens
tggcagagtgcggcatcccctg

SEQ ID NO: 8435704 - DNA, 22 bp, Homo sapiens
tggcagagtgcagaagaggcat

SEQ ID NO: 8435705 - DNA, 21 bp, Homo sapiens
tggcagagtgcagtctataca

SEQ ID NO: 8435706 - DNA, 22 bp, Homo sapiens
tggcagagtgcagaagaggcat

SEQ ID NO: 8435707 - DNA, 22 bp, Homo sapiens
tggcagcagccatggaaggccc

SEQ ID NO: 8435708 - DNA, 18 bp, Homo sapiens
tggcagcaggaagccatt

SEQ ID NO: 8435709 - DNA, 22 bp, Homo sapiens
tggcagcagctaacttaggcag

SEQ ID NO: 8435710 - DNA, 22 bp, Homo sapiens
tggcagcagacatctgaggtct

SEQ ID NO: 8435711 - DNA, 22 bp, Homo sapiens
tggcagcagacatctgaggtct

SEQ ID NO: 8435712 - DNA, 22 bp, Homo sapiens
tggcagcagtggaggtagaaag

SEQ ID NO: 8435713 - DNA, 22 bp, Homo sapiens
tggcagcatgttatgtaaggaa

SEQ ID NO: 8435714 - DNA, 22 bp, Homo sapiens
tggcagcagggaggccagtgtt

SEQ ID NO: 8435715 - DNA, 19 bp, Homo sapiens
tggcagcctccacttttgc

SEQ ID NO: 8435716 - DNA, 22 bp, Homo sapiens
tggcagccttctctgagaaggt

SEQ ID NO: 8435717 - DNA, 22 bp, Homo sapiens
tggcagctacagacagaggtga

SEQ ID NO: 8435718 - DNA, 22 bp, Homo sapiens
tggcagctcccagagcttccaa

SEQ ID NO: 8435719 - DNA, 22 bp, Homo sapiens
tggcagctcccagagcttccaa

SEQ ID NO: 8435720 - DNA, 22 bp, Homo sapiens
tggcagcattttttccagaaca

SEQ ID NO: 8435721 - DNA, 22 bp, Homo sapiens
tggcagcctgcgtgaaggagct

SEQ ID NO: 8435722 - DNA, 22 bp, Homo sapiens
tggcagcctcccagctgcattc

SEQ ID NO: 8435723 - DNA, 22 bp, Homo sapiens
tggcagccatcagagcaggggt

SEQ ID NO: 8435724 - DNA, 22 bp, Homo sapiens
tggcagcctcagacaaggacct

SEQ ID NO: 8435725 - DNA, 22 bp, Homo sapiens
tggcagcctcagacaaggacct

SEQ ID NO: 8435726 - DNA, 22 bp, Homo sapiens
tgctcagtatagaaaatgatat

SEQ ID NO: 8435727 - DNA, 22 bp, Homo sapiens
tgctcagctggtgccagggtcc

SEQ ID NO: 8435728 - DNA, 22 bp, Homo sapiens
tgctcagcttcagaggatcccc

SEQ ID NO: 8435729 - DNA, 22 bp, Homo sapiens
tgctcagcttcagaggatcccc

SEQ ID NO: 8435730 - DNA, 21 bp, Homo sapiens
tgctcagtctgtctccagctt

SEQ ID NO: 8435731 - DNA, 22 bp, Homo sapiens
tgctcagttaagcagaggaaat

SEQ ID NO: 8435732 - DNA, 22 bp, Homo sapiens
tgctcatcaacatgatgatcat

SEQ ID NO: 8435733 - DNA, 21 bp, Homo sapiens
tgctcatgagcccacagctgc

SEQ ID NO: 8435734 - DNA, 22 bp, Homo sapiens
tgctcatttgcccattagcatc

SEQ ID NO: 8435735 - DNA, 22 bp, Homo sapiens
tgctcattaggactgcaaattc

SEQ ID NO: 8435736 - DNA, 22 bp, Homo sapiens
tgctccagaaaaacttgagact

SEQ ID NO: 8435737 - DNA, 22 bp, Homo sapiens
tgctccagcaacaggcttagct

SEQ ID NO: 8435738 - DNA, 22 bp, Homo sapiens
tgctccagcaccaagagctcca

SEQ ID NO: 8435739 - DNA, 22 bp, Homo sapiens
tgctccagcaccaagagctcca

SEQ ID NO: 8435740 - DNA, 22 bp, Homo sapiens
tgctcagagctctggtgcaggt

SEQ ID NO: 8435741 - DNA, 22 bp, Homo sapiens
tgctcagacttaagaagatcag

SEQ ID NO: 8435742 - DNA, 22 bp, Homo sapiens
tgctcagaattgcgctggtgga

SEQ ID NO: 8435743 - DNA, 22 bp, Homo sapiens
tgctcagcgccaaagctgatgg

SEQ ID NO: 8435744 - DNA, 22 bp, Homo sapiens
tgctcagccgtgagcagagccg

SEQ ID NO: 8435745 - DNA, 22 bp, Homo sapiens
tgctcagctgctctgtattctt

SEQ ID NO: 8435746 - DNA, 22 bp, Homo sapiens
tgctcagctggtgccagggtcc

SEQ ID NO: 8435747 - DNA, 22 bp, Homo sapiens
tgctcagcacagaccaggccag

SEQ ID NO: 8435748 - DNA, 22 bp, Homo sapiens
tgctcagcagatctcaggagat

SEQ ID NO: 8435749 - DNA, 22 bp, Homo sapiens
tgctcagcagtcaaggtcatag

SEQ ID NO: 8435750 - DNA, 22 bp, Homo sapiens
tgctcagcagtcaaggtcatag

SEQ ID NO: 8435751 - DNA, 22 bp, Homo sapiens
tgctcagcaaaaagcttgtgag

SEQ ID NO: 8435752 - DNA, 22 bp, Homo sapiens
tgctcagcacagaccaggccag

SEQ ID NO: 8435753 - DNA, 22 bp, Homo sapiens
tgctcaatgtcttatgagactg

SEQ ID NO: 8435754 - DNA, 17 bp, Homo sapiens
tgctcaaatacttttga

SEQ ID NO: 8435755 - DNA, 22 bp, Homo sapiens
tgctcagaaacgaggtgcagcc

SEQ ID NO: 8435756 - DNA, 22 bp, Homo sapiens
tgctatctaggcaaggtggtcc

SEQ ID NO: 8435757 - DNA, 22 bp, Homo sapiens
tgctatataatggaatttctaa

SEQ ID NO: 8435758 - DNA, 22 bp, Homo sapiens
tgctagtgtgtgagatgttcaa

SEQ ID NO: 8435759 - DNA, 22 bp, Homo sapiens
tgctatttaacttttatgtgta

SEQ ID NO: 8435760 - DNA, 19 bp, Homo sapiens
tgctatttagaacgcctgg

SEQ ID NO: 8435761 - DNA, 19 bp, Homo sapiens
tgctatttagaacgcctgg

SEQ ID NO: 8435762 - DNA, 21 bp, Homo sapiens
tgctatttaatttttctgttc

SEQ ID NO: 8435763 - DNA, 22 bp, Homo sapiens
tgctattttagacatactttgt

SEQ ID NO: 8435764 - DNA, 22 bp, Homo sapiens
tgctatttgtgagtgtcttcgt

SEQ ID NO: 8435765 - DNA, 22 bp, Homo sapiens
tgctatttgtgagtgtcttcgt

SEQ ID NO: 8435766 - DNA, 22 bp, Homo sapiens
tgctattttggtctacagcact

SEQ ID NO: 8435767 - DNA, 22 bp, Homo sapiens
tgctattttggtctacagcact

SEQ ID NO: 8435768 - DNA, 22 bp, Homo sapiens
tgctattttggtctacagcact

SEQ ID NO: 8435769 - DNA, 19 bp, Homo sapiens
tgctatttgaagaagtgta

SEQ ID NO: 8435770 - DNA, 22 bp, Homo sapiens
tgctatttggcacttttgacct

SEQ ID NO: 8435771 - DNA, 22 bp, Homo sapiens
tgctatttggaaaagcatttgg

SEQ ID NO: 8435772 - DNA, 22 bp, Homo sapiens
tgcgcccagccaagtctggcac

SEQ ID NO: 8435773 - DNA, 22 bp, Homo sapiens
tgcgcctctaatctcgggcgtc

SEQ ID NO: 8435774 - DNA, 22 bp, Homo sapiens
tgcggaaggcagcgcagggtgg

SEQ ID NO: 8435775 - DNA, 22 bp, Homo sapiens
tgctaacaaagtctaaatcata

SEQ ID NO: 8435776 - DNA, 22 bp, Homo sapiens
tgccttttccagtttctagggg

SEQ ID NO: 8435777 - DNA, 22 bp, Homo sapiens
tgccttttccagttcctagaag

SEQ ID NO: 8435778 - DNA, 22 bp, Homo sapiens
tgccttttccagcttccagagg

SEQ ID NO: 8435779 - DNA, 22 bp, Homo sapiens
tgcctttaacttaaagcatgac

SEQ ID NO: 8435780 - DNA, 22 bp, Homo sapiens
tgccttgggagccagcatgcca

SEQ ID NO: 8435781 - DNA, 22 bp, Homo sapiens
tgccttgctggatgtcagtttt

SEQ ID NO: 8435782 - DNA, 22 bp, Homo sapiens
tgccttggattgcagggaacct

SEQ ID NO: 8435783 - DNA, 19 bp, Homo sapiens
tgccttggctgccaggaaa

SEQ ID NO: 8435784 - DNA, 16 bp, Homo sapiens
tgccttgctgtcagtc

SEQ ID NO: 8435785 - DNA, 22 bp, Homo sapiens
tgccttgctgctttggagtcct

SEQ ID NO: 8435786 - DNA, 22 bp, Homo sapiens
tgccttgcttaacaagatggca

SEQ ID NO: 8435787 - DNA, 22 bp, Homo sapiens
tgccttgctttggcggaggctg

SEQ ID NO: 8435788 - DNA, 22 bp, Homo sapiens
tgccttcttgaatatggttctt

SEQ ID NO: 8435789 - DNA, 22 bp, Homo sapiens
tgccttgacagttgtaagacct

SEQ ID NO: 8435790 - DNA, 22 bp, Homo sapiens
tgccttgaacatagtggacagt

SEQ ID NO: 8435791 - DNA, 22 bp, Homo sapiens
tgccttgcaggttttaaataca

SEQ ID NO: 8435792 - DNA, 22 bp, Homo sapiens
tgcctgtgtccccttcttggca

SEQ ID NO: 8435793 - DNA, 22 bp, Homo sapiens
tgcctgtgtatttccggcctgc

SEQ ID NO: 8435794 - DNA, 22 bp, Homo sapiens
tgcctgtgccctttgctgggag

SEQ ID NO: 8435795 - DNA, 22 bp, Homo sapiens
tgcctgtgcccttcttggcatt

SEQ ID NO: 8435796 - DNA, 22 bp, Homo sapiens
tgcctgtgggtgccaccaccct

SEQ ID NO: 8435797 - DNA, 19 bp, Homo sapiens
tgcctgtggcgagcatctt

SEQ ID NO: 8435798 - DNA, 21 bp, Homo sapiens
tgcctggcctttgcttttcct

SEQ ID NO: 8435799 - DNA, 22 bp, Homo sapiens
tgcctggctaatttttgtatcc

SEQ ID NO: 8435800 - DNA, 22 bp, Homo sapiens
tgcctggctctatcagtggtgg

SEQ ID NO: 8435801 - DNA, 22 bp, Homo sapiens
tgcctggccctgacagccctgg

SEQ ID NO: 8435802 - DNA, 20 bp, Homo sapiens
tgcctggcctttctctgccc

SEQ ID NO: 8435803 - DNA, 20 bp, Homo sapiens
tgcctggcctttctctgccc

SEQ ID NO: 8435804 - DNA, 21 bp, Homo sapiens
tgcctggcctttgcttttcct

SEQ ID NO: 8435805 - DNA, 22 bp, Homo sapiens
tgcctggccctgacagccctgg

SEQ ID NO: 8435806 - DNA, 22 bp, Homo sapiens
tgcctggccctgacagccctgg

SEQ ID NO: 8435807 - DNA, 22 bp, Homo sapiens
tgcctggccagaccctatagag

SEQ ID NO: 8435808 - DNA, 22 bp, Homo sapiens
tgcctggctgggctgctcatgg

SEQ ID NO: 8435809 - DNA, 22 bp, Homo sapiens
tgcctgggaaccaatcctggct

SEQ ID NO: 8435810 - DNA, 22 bp, Homo sapiens
tgcctggggattgctctgggcc

SEQ ID NO: 8435811 - DNA, 22 bp, Homo sapiens
tgcctgggtccaggccaagcct

SEQ ID NO: 8435812 - DNA, 22 bp, Homo sapiens
tgcctggggattgctctgggcc

SEQ ID NO: 8435813 - DNA, 22 bp, Homo sapiens
tgcctgggggactaaggccaaa

SEQ ID NO: 8435814 - DNA, 22 bp, Homo sapiens
tgcctgggtgtaaagggccaac

SEQ ID NO: 8435815 - DNA, 22 bp, Homo sapiens
tgcctgggttcccaccccaaag

SEQ ID NO: 8435816 - DNA, 22 bp, Homo sapiens
tgcctgggttgactcttagctg

SEQ ID NO: 8435817 - DNA, 22 bp, Homo sapiens
tgcctggtatttgaataaagag

SEQ ID NO: 8435818 - DNA, 22 bp, Homo sapiens
tgcctgggtgccctctgctcct

SEQ ID NO: 8435819 - DNA, 22 bp, Homo sapiens
tgcctgggtgccctctgctcct

SEQ ID NO: 8435820 - DNA, 22 bp, Homo sapiens
tgcctgggtgccctctgctcct

SEQ ID NO: 8435821 - DNA, 22 bp, Homo sapiens
tgcctgggtgctggctggtcac

SEQ ID NO: 8435822 - DNA, 22 bp, Homo sapiens
tgcctgtcttggagtcctggcc

SEQ ID NO: 8435823 - DNA, 22 bp, Homo sapiens
tgcctgtgaaaaccctggggtt

SEQ ID NO: 8435824 - DNA, 22 bp, Homo sapiens
tgcctgtgatcagctgagttca

SEQ ID NO: 8435825 - DNA, 22 bp, Homo sapiens
tgcctgtcttcaggagtgtcac

SEQ ID NO: 8435826 - DNA, 22 bp, Homo sapiens
tgcctgtcttcaggagtgtcac

SEQ ID NO: 8435827 - DNA, 22 bp, Homo sapiens
tgcctgtcttaatatctggaaa

SEQ ID NO: 8435828 - DNA, 22 bp, Homo sapiens
tgcctgtctctgactgccatta

SEQ ID NO: 8435829 - DNA, 22 bp, Homo sapiens
tgcctgtcagggggagtgggaa

SEQ ID NO: 8435830 - DNA, 19 bp, Homo sapiens
tgcctgtcagtagatctca

SEQ ID NO: 8435831 - DNA, 22 bp, Homo sapiens
tgcctgtcctgaggatgagggt

SEQ ID NO: 8435832 - DNA, 22 bp, Homo sapiens
tgcctgtcctgaggatgagggt

SEQ ID NO: 8435833 - DNA, 22 bp, Homo sapiens
tgcctgtctcctctgcagggtg

SEQ ID NO: 8435834 - DNA, 22 bp, Homo sapiens
tgcctgtctcctctgcagggtg

SEQ ID NO: 8435835 - DNA, 22 bp, Homo sapiens
tgctcccatgtgtgggtacaga

SEQ ID NO: 8435836 - DNA, 22 bp, Homo sapiens
tgctccctgacccaggtcttct

SEQ ID NO: 8435837 - DNA, 22 bp, Homo sapiens
tgctcccttgccagaggggaag

SEQ ID NO: 8435838 - DNA, 20 bp, Homo sapiens
tgctcccttgcgagtcgctg

SEQ ID NO: 8435839 - DNA, 22 bp, Homo sapiens
tgctccagggcctccagtgggg

SEQ ID NO: 8435840 - DNA, 22 bp, Homo sapiens
tgctcccagggactctggctgg

SEQ ID NO: 8435841 - DNA, 22 bp, Homo sapiens
tgctccagggcctccagtgggg

SEQ ID NO: 8435842 - DNA, 22 bp, Homo sapiens
tgctcctgaattacactactac

SEQ ID NO: 8435843 - DNA, 22 bp, Homo sapiens
tgctcctgaattacactactac

SEQ ID NO: 8435844 - DNA, 22 bp, Homo sapiens
tgctcctgctggccctcgtgcc

SEQ ID NO: 8435845 - DNA, 22 bp, Homo sapiens
tgctcctgcttagccgtgtttt

SEQ ID NO: 8435846 - DNA, 22 bp, Homo sapiens
tgctcctgctgcatgcatctcc

SEQ ID NO: 8435847 - DNA, 22 bp, Homo sapiens
tgctcctgctgcatgcatctcc

SEQ ID NO: 8435848 - DNA, 22 bp, Homo sapiens
tgctcctgctgcatgcatctcc

SEQ ID NO: 8435849 - DNA, 22 bp, Homo sapiens
tgctcctgctcctcccggttga

SEQ ID NO: 8435850 - DNA, 22 bp, Homo sapiens
tgctccagcctatgctctccgg

SEQ ID NO: 8435851 - DNA, 22 bp, Homo sapiens
tgctccaggagcaacctttgag

SEQ ID NO: 8435852 - DNA, 20 bp, Homo sapiens
tgctccaggaacactggccg

SEQ ID NO: 8435853 - DNA, 20 bp, Homo sapiens
tgctccaggaacactggccg

SEQ ID NO: 8435854 - DNA, 22 bp, Homo sapiens
tgctccagctggagatgggggc

SEQ ID NO: 8435855 - DNA, 22 bp, Homo sapiens
tgctccagcctatgctctccgg

SEQ ID NO: 8435856 - DNA, 22 bp, Homo sapiens
tgctccagcgctgccaccagtt

SEQ ID NO: 8435857 - DNA, 22 bp, Homo sapiens
tgctccaggcaagctgagagtt

SEQ ID NO: 8435858 - DNA, 21 bp, Homo sapiens
tgctccaggagggggcagtcc

SEQ ID NO: 8435859 - DNA, 21 bp, Homo sapiens
tgctccagggcagcttccagc

SEQ ID NO: 8435860 - DNA, 22 bp, Homo sapiens
tgctccaggctgctgaagatct

SEQ ID NO: 8435861 - DNA, 18 bp, Homo sapiens
tgctccaggcccatgggc

SEQ ID NO: 8435862 - DNA, 22 bp, Homo sapiens
tgctccaggccgcctggggctg

SEQ ID NO: 8435863 - DNA, 22 bp, Homo sapiens
tgctcgaggtccccaccggctc

SEQ ID NO: 8435864 - DNA, 22 bp, Homo sapiens
tgctcgaggtccccaccggctc

SEQ ID NO: 8435865 - DNA, 21 bp, Homo sapiens
tgctcctttaccccacaagac

SEQ ID NO: 8435866 - DNA, 22 bp, Homo sapiens
tgctcctgtttcatcagctata

SEQ ID NO: 8435867 - DNA, 22 bp, Homo sapiens
tgctctagctcataggactcat

SEQ ID NO: 8435868 - DNA, 22 bp, Homo sapiens
tgctctattaattttaacgatg

SEQ ID NO: 8435869 - DNA, 22 bp, Homo sapiens
tgctctagctcataggactcat

SEQ ID NO: 8435870 - DNA, 22 bp, Homo sapiens
tgctcctggcatctctgcgtcc

SEQ ID NO: 8435871 - DNA, 22 bp, Homo sapiens
tgctcctggctccttccctaac

SEQ ID NO: 8435872 - DNA, 22 bp, Homo sapiens
tgctcctgtttcatcagctata

SEQ ID NO: 8435873 - DNA, 22 bp, Homo sapiens
tgctcctgggctgaagcacact

SEQ ID NO: 8435874 - DNA, 17 bp, Homo sapiens
tgctcctgtggcagcct

SEQ ID NO: 8435875 - DNA, 22 bp, Homo sapiens
tgctctggctgggatgagtgca

SEQ ID NO: 8435876 - DNA, 22 bp, Homo sapiens
tgctctgggattcagcagcctg

SEQ ID NO: 8435877 - DNA, 22 bp, Homo sapiens
tgctctggctggagcaatgact

SEQ ID NO: 8435878 - DNA, 22 bp, Homo sapiens
tgctctcctgctcctcagccca

SEQ ID NO: 8435879 - DNA, 22 bp, Homo sapiens
tgctctggggagctcctctgcg

SEQ ID NO: 8435880 - DNA, 22 bp, Homo sapiens
tgctctgggctcaatggcagct

SEQ ID NO: 8435881 - DNA, 22 bp, Homo sapiens
tgctgaggtttctgactatgga

SEQ ID NO: 8435882 - DNA, 22 bp, Homo sapiens
tgctgaggtttcgtctgcttgc

SEQ ID NO: 8435883 - DNA, 22 bp, Homo sapiens
tgctgaggttgtggagtgcatt

SEQ ID NO: 8435884 - DNA, 22 bp, Homo sapiens
tgctgcagttcaccctgccgtc

SEQ ID NO: 8435885 - DNA, 19 bp, Homo sapiens
tgctgcagtcaggcgaggg

SEQ ID NO: 8435886 - DNA, 22 bp, Homo sapiens
tgctgcagggaagtcggggggt

SEQ ID NO: 8435887 - DNA, 22 bp, Homo sapiens
tgctgcaggccttggctgggaa

SEQ ID NO: 8435888 - DNA, 22 bp, Homo sapiens
tgctgcagggatttcagagaca

SEQ ID NO: 8435889 - DNA, 22 bp, Homo sapiens
tgctgcagggccttccctgcat

SEQ ID NO: 8435890 - DNA, 22 bp, Homo sapiens
tgctgaggtcatttccaagtga

SEQ ID NO: 8435891 - DNA, 20 bp, Homo sapiens
tgctgaggttgacatgccca

SEQ ID NO: 8435892 - DNA, 22 bp, Homo sapiens
tgctgaggtcaccttgctgcta

SEQ ID NO: 8435893 - DNA, 22 bp, Homo sapiens
tgctgaggtcacggcggccaga

SEQ ID NO: 8435894 - DNA, 22 bp, Homo sapiens
tgctgagggagcatcaaagaaa

SEQ ID NO: 8435895 - DNA, 22 bp, Homo sapiens
tgctgagggaggggttttccag

SEQ ID NO: 8435896 - DNA, 22 bp, Homo sapiens
tgctgaggtaaccatatcctgc

SEQ ID NO: 8435897 - DNA, 22 bp, Homo sapiens
tgctgagggcagatgaattaga

SEQ ID NO: 8435898 - DNA, 22 bp, Homo sapiens
tgctgagggctgttaaggaagc

SEQ ID NO: 8435899 - DNA, 22 bp, Homo sapiens
tgctgaggcccaggagcacttt

SEQ ID NO: 8435900 - DNA, 22 bp, Homo sapiens
tgctgaggcccaggagcacttt

SEQ ID NO: 8435901 - DNA, 20 bp, Homo sapiens
tgctgaggcctgaggcctgg

SEQ ID NO: 8435902 - DNA, 22 bp, Homo sapiens
tgctgaggctagacctggaagt

SEQ ID NO: 8435903 - DNA, 20 bp, Homo sapiens
tgctgaggcctgaggcctgg

SEQ ID NO: 8435904 - DNA, 22 bp, Homo sapiens
tgctgaggcagtcctaacagga

SEQ ID NO: 8435905 - DNA, 22 bp, Homo sapiens
tgctgaggcatttggacagagt

SEQ ID NO: 8435906 - DNA, 22 bp, Homo sapiens
tgctgaggcagatgtctgtgac

SEQ ID NO: 8435907 - DNA, 19 bp, Homo sapiens
tgctgaggatgcaagatcc

SEQ ID NO: 8435908 - DNA, 22 bp, Homo sapiens
tgctctgtgtgtggttatttcc

SEQ ID NO: 8435909 - DNA, 22 bp, Homo sapiens
tgctctgtccagtgcaccatca

SEQ ID NO: 8435910 - DNA, 20 bp, Homo sapiens
tgctctgggggtggagagac

SEQ ID NO: 8435911 - DNA, 20 bp, Homo sapiens
tgctctgggggtggagagac

SEQ ID NO: 8435912 - DNA, 22 bp, Homo sapiens
tgctctgggttcttgctgttac

SEQ ID NO: 8435913 - DNA, 22 bp, Homo sapiens
tgctgaaagtcccaaatctcat

SEQ ID NO: 8435914 - DNA, 22 bp, Homo sapiens
tgctgaaatatttatgggtcaa

SEQ ID NO: 8435915 - DNA, 22 bp, Homo sapiens
tgctgaaattagaacattgagg

SEQ ID NO: 8435916 - DNA, 22 bp, Homo sapiens
tgctgaaagaccgtatttatct

SEQ ID NO: 8435917 - DNA, 22 bp, Homo sapiens
tgctgaaggcaggggaggtggc

SEQ ID NO: 8435918 - DNA, 22 bp, Homo sapiens
tgctgaaacaataacatactgg

SEQ ID NO: 8435919 - DNA, 22 bp, Homo sapiens
tgctgaaaactcaaccattgtg

SEQ ID NO: 8435920 - DNA, 22 bp, Homo sapiens
tgctgaaaatgcgtatcttcca

SEQ ID NO: 8435921 - DNA, 22 bp, Homo sapiens
tgctgaaaagtaaataggccta

SEQ ID NO: 8435922 - DNA, 22 bp, Homo sapiens
tgctgagcgcatccggcggccg

SEQ ID NO: 8435923 - DNA, 22 bp, Homo sapiens
tgctgagcgcatccggcggccg

SEQ ID NO: 8435924 - DNA, 22 bp, Homo sapiens
tgctgaggaaagaggataaaag

SEQ ID NO: 8435925 - DNA, 22 bp, Homo sapiens
tgctgaggaaaaatgtgactct

SEQ ID NO: 8435926 - DNA, 22 bp, Homo sapiens
tgctgaggaataattgttcctg

SEQ ID NO: 8435927 - DNA, 22 bp, Homo sapiens
tgctgaggactaaaggagatga

SEQ ID NO: 8435928 - DNA, 22 bp, Homo sapiens
tgctgaggacacctagccttct

SEQ ID NO: 8435929 - DNA, 22 bp, Homo sapiens
tgctgaggaatttggtttatgt

SEQ ID NO: 8435930 - DNA, 22 bp, Homo sapiens
tgctgaggaggtggctgtgctt

SEQ ID NO: 8435931 - DNA, 22 bp, Homo sapiens
tgctgaggagggcacccggggg

SEQ ID NO: 8435932 - DNA, 22 bp, Homo sapiens
tgctggaactcagtgaatcatt

SEQ ID NO: 8435933 - DNA, 22 bp, Homo sapiens
tgctggagaaagtttttctgaa

SEQ ID NO: 8435934 - DNA, 22 bp, Homo sapiens
tgctggaagaattccatgctgg

SEQ ID NO: 8435935 - DNA, 22 bp, Homo sapiens
tgctggaataatttcatgttaa

SEQ ID NO: 8435936 - DNA, 22 bp, Homo sapiens
tgctggagaagctcctgggact

SEQ ID NO: 8435937 - DNA, 22 bp, Homo sapiens
tgctggagaactgctctgtgtt

SEQ ID NO: 8435938 - DNA, 22 bp, Homo sapiens
tgctggagaactgctctgtgtt

SEQ ID NO: 8435939 - DNA, 20 bp, Homo sapiens
tgctgctgtgagcgtccctg

SEQ ID NO: 8435940 - DNA, 22 bp, Homo sapiens
tgctgctgtatcatgccttcat

SEQ ID NO: 8435941 - DNA, 23 bp, Homo sapiens
tgctgcccactcttccagccctc

SEQ ID NO: 8435942 - DNA, 23 bp, Homo sapiens
tgctgcccactcttccagccctc

SEQ ID NO: 8435943 - DNA, 23 bp, Homo sapiens
tgctgcccgcttggcacgctccc

SEQ ID NO: 8435944 - DNA, 23 bp, Homo sapiens
tgctgcccgcttggcacgctccc

SEQ ID NO: 8435945 - DNA, 22 bp, Homo sapiens
tgctgccatggtcgctggtgtc

SEQ ID NO: 8435946 - DNA, 22 bp, Homo sapiens
tgctgccacctggtggctgaag

SEQ ID NO: 8435947 - DNA, 22 bp, Homo sapiens
tgctgccagccaggccatggag

SEQ ID NO: 8435948 - DNA, 22 bp, Homo sapiens
tgctgccaggtcttgctgtcca

SEQ ID NO: 8435949 - DNA, 22 bp, Homo sapiens
tgctgccagggctctgcccaca

SEQ ID NO: 8435950 - DNA, 22 bp, Homo sapiens
tgctgccaaatgcgagctctgt

SEQ ID NO: 8435951 - DNA, 20 bp, Homo sapiens
tgctgcagtttcatgggact

SEQ ID NO: 8435952 - DNA, 20 bp, Homo sapiens
tgctgcagtttcatgggact

SEQ ID NO: 8435953 - DNA, 22 bp, Homo sapiens
tgctgccacatttaaagagggg

SEQ ID NO: 8435954 - DNA, 22 bp, Homo sapiens
tgctggaggggcctgaccagga

SEQ ID NO: 8435955 - DNA, 22 bp, Homo sapiens
tgctggagtaacaagacactca

SEQ ID NO: 8435956 - DNA, 20 bp, Homo sapiens
tgctggaggcgccggcgctc

SEQ ID NO: 8435957 - DNA, 22 bp, Homo sapiens
tgctggaggcctgactgtgttt

SEQ ID NO: 8435958 - DNA, 22 bp, Homo sapiens
tgctggaggagtttactgtggc

SEQ ID NO: 8435959 - DNA, 22 bp, Homo sapiens
tgctggaggagaaggttgctca

SEQ ID NO: 8435960 - DNA, 22 bp, Homo sapiens
tgctggaggagaaggttgctca

SEQ ID NO: 8435961 - DNA, 22 bp, Homo sapiens
tgctggagtgagtggtttctta

SEQ ID NO: 8435962 - DNA, 22 bp, Homo sapiens
tgctggagtggcactgtgtggc

SEQ ID NO: 8435963 - DNA, 18 bp, Homo sapiens
tgctggcaactactattg

SEQ ID NO: 8435964 - DNA, 22 bp, Homo sapiens
tgctggcatcttaatgttctgt

SEQ ID NO: 8435965 - DNA, 22 bp, Homo sapiens
tgctggctactgatggcaggcc

SEQ ID NO: 8435966 - DNA, 22 bp, Homo sapiens
tgctggctatttaaagaagaaa

SEQ ID NO: 8435967 - DNA, 22 bp, Homo sapiens
tgctggctcagtttgcagactc

SEQ ID NO: 8435968 - DNA, 22 bp, Homo sapiens
tgctggctcagtttgcagactc

SEQ ID NO: 8435969 - DNA, 22 bp, Homo sapiens
tgctggctccaacctggcatct

SEQ ID NO: 8435970 - DNA, 22 bp, Homo sapiens
tgctggccaagcagaggtcaat

SEQ ID NO: 8435971 - DNA, 22 bp, Homo sapiens
tgctggctactgatggcaggcc

SEQ ID NO: 8435972 - DNA, 22 bp, Homo sapiens
tgctggcatttcaggactcacc

SEQ ID NO: 8435973 - DNA, 23 bp, Homo sapiens
tgctggctgaaacagccaaagga

SEQ ID NO: 8435974 - DNA, 21 bp, Homo sapiens
tgctggctgaaaggcacagag

SEQ ID NO: 8435975 - DNA, 22 bp, Homo sapiens
tgctggctcccaggagccgctg

SEQ ID NO: 8435976 - DNA, 22 bp, Homo sapiens
tgctggctcctcgaggcttcgt

SEQ ID NO: 8435977 - DNA, 22 bp, Homo sapiens
tgctggctcctcgaggcttcgt

SEQ ID NO: 8435978 - DNA, 22 bp, Homo sapiens
tgctggctctgggccaagcagg

SEQ ID NO: 8435979 - DNA, 22 bp, Homo sapiens
tgctggctctgggccaagcagg

SEQ ID NO: 8435980 - DNA, 22 bp, Homo sapiens
tgctggctctaggctgagacag

SEQ ID NO: 8435981 - DNA, 22 bp, Homo sapiens
tgctggctgggctgctggagac

SEQ ID NO: 8435982 - DNA, 22 bp, Homo sapiens
tgctggctggcctggcctggac

SEQ ID NO: 8435983 - DNA, 22 bp, Homo sapiens
tgctggctgtatatgtgagagt

SEQ ID NO: 8435984 - DNA, 22 bp, Homo sapiens
tgctggctgggctgctggagac

SEQ ID NO: 8435985 - DNA, 22 bp, Homo sapiens
tgctggctgggctgctggagac

SEQ ID NO: 8435986 - DNA, 22 bp, Homo sapiens
tgctggctgccaggttccctgt

SEQ ID NO: 8435987 - DNA, 22 bp, Homo sapiens
tgctggctggagtgcctctgga

SEQ ID NO: 8435988 - DNA, 22 bp, Homo sapiens
tgctggctggatcagagattgg

SEQ ID NO: 8435989 - DNA, 22 bp, Homo sapiens
tgctggctggatcagagattgg

SEQ ID NO: 8435990 - DNA, 22 bp, Homo sapiens
tgctggctgtgtaccatctcaa

SEQ ID NO: 8435991 - DNA, 22 bp, Homo sapiens
tgctggctgtccctacctggct

SEQ ID NO: 8435992 - DNA, 22 bp, Homo sapiens
tgctggctgtccctacctggct

SEQ ID NO: 8435993 - DNA, 22 bp, Homo sapiens
tgctggctgtatatgtgagagt

SEQ ID NO: 8435994 - DNA, 23 bp, Homo sapiens
tgctggctgtgttattgccaaca

SEQ ID NO: 8435995 - DNA, 22 bp, Homo sapiens
tgctggcttatttagtaaatgt

SEQ ID NO: 8435996 - DNA, 23 bp, Homo sapiens
tgctggcttccagctgctccctc

SEQ ID NO: 8435997 - DNA, 23 bp, Homo sapiens
tgctggcttccagctgctccctc

SEQ ID NO: 8435998 - DNA, 22 bp, Homo sapiens
tgctggctgttctagggaggcc

SEQ ID NO: 8435999 - DNA, 22 bp, Homo sapiens
tgctggctgttctagggaggcc

SEQ ID NO: 8436000 - DNA, 22 bp, Homo sapiens
tgcttaaacatccagacagtat

SEQ ID NO: 8436001 - DNA, 22 bp, Homo sapiens
tgcttaaaggatagtttaaact

SEQ ID NO: 8436002 - DNA, 22 bp, Homo sapiens
tgcttattaaacatgcatattc

SEQ ID NO: 8436003 - DNA, 22 bp, Homo sapiens
tgcttaggatgctagcaggcat

SEQ ID NO: 8436004 - DNA, 22 bp, Homo sapiens
tgcttagaatctggacttgttg

SEQ ID NO: 8436005 - DNA, 22 bp, Homo sapiens
tgcttagatgaggcagcaggag

SEQ ID NO: 8436006 - DNA, 22 bp, Homo sapiens
tgcttagacgtcaagtacagcc

SEQ ID NO: 8436007 - DNA, 22 bp, Homo sapiens
tgctgtcttccaggatggtgaa

SEQ ID NO: 8436008 - DNA, 22 bp, Homo sapiens
tgctgtctgtttactggctata

SEQ ID NO: 8436009 - DNA, 22 bp, Homo sapiens
tgctgtctgtttactggctata

SEQ ID NO: 8436010 - DNA, 17 bp, Homo sapiens
tgctgtctgcttcccta

SEQ ID NO: 8436011 - DNA, 22 bp, Homo sapiens
tgctgtctgattcagggtgatt

SEQ ID NO: 8436012 - DNA, 22 bp, Homo sapiens
tgctgtcctgttttggagtaat

SEQ ID NO: 8436013 - DNA, 22 bp, Homo sapiens
tgctgtgaggttgagaaggaag

SEQ ID NO: 8436014 - DNA, 22 bp, Homo sapiens
tgcttctctgttctaacccttg

SEQ ID NO: 8436015 - DNA, 23 bp, Homo sapiens
tgcttctctgcttgacagttctg

SEQ ID NO: 8436016 - DNA, 21 bp, Homo sapiens
tgcttctctagatcaactact

SEQ ID NO: 8436017 - DNA, 22 bp, Homo sapiens
tgcttctctctaggaagacgct

SEQ ID NO: 8436018 - DNA, 22 bp, Homo sapiens
tgcttctcccaaccagggcctg

SEQ ID NO: 8436019 - DNA, 22 bp, Homo sapiens
tgcttctccattgatgctaagt

SEQ ID NO: 8436020 - DNA, 22 bp, Homo sapiens
tgcttctcaaagaagcataatg

SEQ ID NO: 8436021 - DNA, 22 bp, Homo sapiens
tgcttctcagcctgtctggaaa

SEQ ID NO: 8436022 - DNA, 22 bp, Homo sapiens
tgcttctcaaaaggaggtaggt

SEQ ID NO: 8436023 - DNA, 22 bp, Homo sapiens
tgcttctctttatttgtaggtt

SEQ ID NO: 8436024 - DNA, 22 bp, Homo sapiens
tgcttctgactgggtcagttga

SEQ ID NO: 8436025 - DNA, 20 bp, Homo sapiens
tgcttcattatgtgagatag

SEQ ID NO: 8436026 - DNA, 22 bp, Homo sapiens
tgcttcaggagatgtcaccatg

SEQ ID NO: 8436027 - DNA, 19 bp, Homo sapiens
tgcttcagaaatagaaagc

SEQ ID NO: 8436028 - DNA, 22 bp, Homo sapiens
tgcttattaaacatgcatattc

SEQ ID NO: 8436029 - DNA, 23 bp, Homo sapiens
tgcttattcaaaaggtgctttca

SEQ ID NO: 8436030 - DNA, 22 bp, Homo sapiens
tgcttattaacatgtatatctc

SEQ ID NO: 8436031 - DNA, 22 bp, Homo sapiens
tgcttatcgtttagtacattgc

SEQ ID NO: 8436032 - DNA, 22 bp, Homo sapiens
tgcttattaaacatgcatattc

SEQ ID NO: 8436033 - DNA, 22 bp, Homo sapiens
tgcttatttaggtagatattaa

SEQ ID NO: 8436034 - DNA, 22 bp, Homo sapiens
tgcttatttaggtagatattaa

SEQ ID NO: 8436035 - DNA, 22 bp, Homo sapiens
tgcttatttgaatttattctca

SEQ ID NO: 8436036 - DNA, 22 bp, Homo sapiens
tgctgggcctttacctccaggg

SEQ ID NO: 8436037 - DNA, 22 bp, Homo sapiens
tgctgggcctttacctccaggg

SEQ ID NO: 8436038 - DNA, 22 bp, Homo sapiens
tgctgggcggtgggctcatccc

SEQ ID NO: 8436039 - DNA, 22 bp, Homo sapiens
tgctgggctagggtggagctct

SEQ ID NO: 8436040 - DNA, 22 bp, Homo sapiens
tgctgggctcaacctccagagc

SEQ ID NO: 8436041 - DNA, 22 bp, Homo sapiens
tgctgggctgcacccccagagt

SEQ ID NO: 8436042 - DNA, 22 bp, Homo sapiens
tgctgggctggagctgccaggg

SEQ ID NO: 8436043 - DNA, 22 bp, Homo sapiens
tgctgggctggggcctcagacc

SEQ ID NO: 8436044 - DNA, 22 bp, Homo sapiens
tgctgggcttgaaagctgctaa

SEQ ID NO: 8436045 - DNA, 22 bp, Homo sapiens
tgctgggctgttcctgtccatg

SEQ ID NO: 8436046 - DNA, 22 bp, Homo sapiens
tgctgggctgttcctgtccatg

SEQ ID NO: 8436047 - DNA, 22 bp, Homo sapiens
tgctgggccaaagcagggtttt

SEQ ID NO: 8436048 - DNA, 18 bp, Homo sapiens
tgctgggcattaggctta

SEQ ID NO: 8436049 - DNA, 22 bp, Homo sapiens
tgctgggcccagggagcctctg

SEQ ID NO: 8436050 - DNA, 22 bp, Homo sapiens
tgctggcttcctgtgcacagca

SEQ ID NO: 8436051 - DNA, 22 bp, Homo sapiens
tgctggcttcctgtgcacagca

SEQ ID NO: 8436052 - DNA, 22 bp, Homo sapiens
tgctggcttggaaggaaagcgc

SEQ ID NO: 8436053 - DNA, 22 bp, Homo sapiens
tgctgggcactgtctaggtact

SEQ ID NO: 8436054 - DNA, 22 bp, Homo sapiens
tgctgggcactgtctctgggga

SEQ ID NO: 8436055 - DNA, 23 bp, Homo sapiens
tgctgtagtctctacagctggtc

SEQ ID NO: 8436056 - DNA, 22 bp, Homo sapiens
tgctgtattacttttacaaact

SEQ ID NO: 8436057 - DNA, 22 bp, Homo sapiens
tgctgggtggttgctcctcccg

SEQ ID NO: 8436058 - DNA, 22 bp, Homo sapiens
tgctgggtgttccgcacttgac

SEQ ID NO: 8436059 - DNA, 22 bp, Homo sapiens
tgctgggtggacttggctctca

SEQ ID NO: 8436060 - DNA, 22 bp, Homo sapiens
tgctggggcagaagagccaaga

SEQ ID NO: 8436061 - DNA, 22 bp, Homo sapiens
tgctggggcagaagagccaaga

SEQ ID NO: 8436062 - DNA, 20 bp, Homo sapiens
tgctggggacatacagggtg

SEQ ID NO: 8436063 - DNA, 20 bp, Homo sapiens
tgctggggacatacagggtg

SEQ ID NO: 8436064 - DNA, 20 bp, Homo sapiens
tgctggggacatacagggtg

SEQ ID NO: 8436065 - DNA, 22 bp, Homo sapiens
tgctggggtcatggggcgcccg

SEQ ID NO: 8436066 - DNA, 22 bp, Homo sapiens
tgctggggtcatggggcgcccg

SEQ ID NO: 8436067 - DNA, 23 bp, Homo sapiens
tgctggggtagtttgtggcacag

SEQ ID NO: 8436068 - DNA, 23 bp, Homo sapiens
tgctggggtagtttgtggcacag

SEQ ID NO: 8436069 - DNA, 23 bp, Homo sapiens
tgctggggtagtttgtggcacag

SEQ ID NO: 8436070 - DNA, 22 bp, Homo sapiens
tgctggggtctctccggtgccc

SEQ ID NO: 8436071 - DNA, 22 bp, Homo sapiens
tgctggggtctctccggtgccc

SEQ ID NO: 8436072 - DNA, 22 bp, Homo sapiens
tgctggggtctctccggtgccc

SEQ ID NO: 8436073 - DNA, 22 bp, Homo sapiens
tgctgggtcagtgagagcaggg

SEQ ID NO: 8436074 - DNA, 20 bp, Homo sapiens
tgcttttatacctataatga

SEQ ID NO: 8436075 - DNA, 22 bp, Homo sapiens
tgcttttaggagattaaaatta

SEQ ID NO: 8436076 - DNA, 22 bp, Homo sapiens
tggaaaaaaattggctagcttc

SEQ ID NO: 8436077 - DNA, 22 bp, Homo sapiens
tggaaaaaacccagactctaga

SEQ ID NO: 8436078 - DNA, 22 bp, Homo sapiens
tggaaaaaaattggctagcttc

SEQ ID NO: 8436079 - DNA, 22 bp, Homo sapiens
tggaaaaactgagacttagaca

SEQ ID NO: 8436080 - DNA, 22 bp, Homo sapiens
tggaaaaactgagacttagaca

SEQ ID NO: 8436081 - DNA, 21 bp, Homo sapiens
tggaaaaatgtggcctagtga

SEQ ID NO: 8436082 - DNA, 21 bp, Homo sapiens
tggaaaaatgtggcctagtga

SEQ ID NO: 8436083 - DNA, 22 bp, Homo sapiens
tgctttgctggcactcctggct

SEQ ID NO: 8436084 - DNA, 19 bp, Homo sapiens
tgctttgctcttggactca

SEQ ID NO: 8436085 - DNA, 22 bp, Homo sapiens
tgctttgtgatatgctgtgtct

SEQ ID NO: 8436086 - DNA, 22 bp, Homo sapiens
tgctttgtgatatgctgtgtct

SEQ ID NO: 8436087 - DNA, 22 bp, Homo sapiens
tgctttgtgacagattagtttt

SEQ ID NO: 8436088 - DNA, 22 bp, Homo sapiens
tgctttgtgtttgaatagataa

SEQ ID NO: 8436089 - DNA, 22 bp, Homo sapiens
tggaaaattagtagtgaaaggc

SEQ ID NO: 8436090 - DNA, 22 bp, Homo sapiens
tggaaaatcaggggacattgat

SEQ ID NO: 8436091 - DNA, 22 bp, Homo sapiens
tggaaaatcaggggacattgat

SEQ ID NO: 8436092 - DNA, 22 bp, Homo sapiens
tggaaaacaaagctctcattat

SEQ ID NO: 8436093 - DNA, 22 bp, Homo sapiens
tggaaaacattgagataccaag

SEQ ID NO: 8436094 - DNA, 22 bp, Homo sapiens
tggaaaactttggtggtgaggg

SEQ ID NO: 8436095 - DNA, 22 bp, Homo sapiens
tggaaacacccacgcatgcata

SEQ ID NO: 8436096 - DNA, 22 bp, Homo sapiens
tggaaagaggtagaggatctgg

SEQ ID NO: 8436097 - DNA, 22 bp, Homo sapiens
tggaaagagaaactcttgctaa

SEQ ID NO: 8436098 - DNA, 22 bp, Homo sapiens
tggaaaggacagttgctgatag

SEQ ID NO: 8436099 - DNA, 22 bp, Homo sapiens
tggaaagtgctctagactttct

SEQ ID NO: 8436100 - DNA, 22 bp, Homo sapiens
tggaaatacaagaagtatgtca

SEQ ID NO: 8436101 - DNA, 22 bp, Homo sapiens
tggaaaggtaggatttcaagac

SEQ ID NO: 8436102 - DNA, 22 bp, Homo sapiens
tggaaaggtgtaaagcagaacc

SEQ ID NO: 8436103 - DNA, 22 bp, Homo sapiens
tggaaatacttgccataaaact

SEQ ID NO: 8436104 - DNA, 22 bp, Homo sapiens
tggaaatggatctgatgagtct

SEQ ID NO: 8436105 - DNA, 21 bp, Homo sapiens
tggaactggtgaaaacctcct

SEQ ID NO: 8436106 - DNA, 22 bp, Homo sapiens
tggaactgctccaaaacctcca

SEQ ID NO: 8436107 - DNA, 22 bp, Homo sapiens
tggaactaaggtagaaactatt

SEQ ID NO: 8436108 - DNA, 22 bp, Homo sapiens
tggaagaaaattcaatcgagtt

SEQ ID NO: 8436109 - DNA, 23 bp, Homo sapiens
tggaagaaaatggtttggctgtg

SEQ ID NO: 8436110 - DNA, 20 bp, Homo sapiens
tggaacctaggcagagctgg

SEQ ID NO: 8436111 - DNA, 22 bp, Homo sapiens
tggaacctggcattagggacac

SEQ ID NO: 8436112 - DNA, 22 bp, Homo sapiens
tggaacctggcctgagctacca

SEQ ID NO: 8436113 - DNA, 22 bp, Homo sapiens
tggaacctggcctgagctacca

SEQ ID NO: 8436114 - DNA, 22 bp, Homo sapiens
tggaacctggtgatgtacaagt

SEQ ID NO: 8436115 - DNA, 22 bp, Homo sapiens
tggaaccatcaaagagatcctg

SEQ ID NO: 8436116 - DNA, 22 bp, Homo sapiens
tggaacacacttcaaggagaaa

SEQ ID NO: 8436117 - DNA, 22 bp, Homo sapiens
tgcttctttatgatgtatgatt

SEQ ID NO: 8436118 - DNA, 22 bp, Homo sapiens
tgcttgaacaaggataaatttg

SEQ ID NO: 8436119 - DNA, 22 bp, Homo sapiens
tgcttgaagcctacattcgtca

SEQ ID NO: 8436120 - DNA, 22 bp, Homo sapiens
tgctttagttcaacatgccaaa

SEQ ID NO: 8436121 - DNA, 22 bp, Homo sapiens
tgctttaagagattgttagtac

SEQ ID NO: 8436122 - DNA, 22 bp, Homo sapiens
tgctttaagacactaagtttga

SEQ ID NO: 8436123 - DNA, 22 bp, Homo sapiens
tgctttaacataagatatcttt

SEQ ID NO: 8436124 - DNA, 22 bp, Homo sapiens
tgctttaaccatcttgtttgga

SEQ ID NO: 8436125 - DNA, 22 bp, Homo sapiens
tgctttaaaatggactgttttg

SEQ ID NO: 8436126 - DNA, 22 bp, Homo sapiens
tgctttaaaccatggatgtgag

SEQ ID NO: 8436127 - DNA, 22 bp, Homo sapiens
tgcttctggagtaacagggtga

SEQ ID NO: 8436128 - DNA, 22 bp, Homo sapiens
tgctttgcaggaaccctaagca

SEQ ID NO: 8436129 - DNA, 19 bp, Homo sapiens
tgctttgcatctgattgtt

SEQ ID NO: 8436130 - DNA, 22 bp, Homo sapiens
tgctttgccagacagttccctt

SEQ ID NO: 8436131 - DNA, 19 bp, Homo sapiens
tgctttgccttgattagct

SEQ ID NO: 8436132 - DNA, 22 bp, Homo sapiens
tgctttgcctgctttgactcat

SEQ ID NO: 8436133 - DNA, 22 bp, Homo sapiens
tgctttgctctcactgtaaggt

SEQ ID NO: 8436134 - DNA, 22 bp, Homo sapiens
tgctttgacagggatgacatga

SEQ ID NO: 8436135 - DNA, 22 bp, Homo sapiens
tgctttctttagctcctgagtc

SEQ ID NO: 8436136 - DNA, 22 bp, Homo sapiens
tgctttctgctctggaaacagg

SEQ ID NO: 8436137 - DNA, 19 bp, Homo sapiens
tgctttctaaacacatgca

SEQ ID NO: 8436138 - DNA, 22 bp, Homo sapiens
tgctttctcctgtctgaaagat

SEQ ID NO: 8436139 - DNA, 22 bp, Homo sapiens
tgctttattcagggtttacccc

SEQ ID NO: 8436140 - DNA, 18 bp, Homo sapiens
tgctttatgcttatataa

SEQ ID NO: 8436141 - DNA, 21 bp, Homo sapiens
tgctttatgggaaaaatgtca

SEQ ID NO: 8436142 - DNA, 22 bp, Homo sapiens
tgctttatgtggctgatactca

SEQ ID NO: 8436143 - DNA, 22 bp, Homo sapiens
tgctttatcaaagctatagtga

SEQ ID NO: 8436144 - DNA, 22 bp, Homo sapiens
tgctttatatctctcttcttag

SEQ ID NO: 8436145 - DNA, 22 bp, Homo sapiens
tgctttataaccatttctgtgg

SEQ ID NO: 8436146 - DNA, 22 bp, Homo sapiens
tgctttataacttagtttatgg

SEQ ID NO: 8436147 - DNA, 22 bp, Homo sapiens
tgctttataacttagtttatgg

SEQ ID NO: 8436148 - DNA, 22 bp, Homo sapiens
tgctttatagacaaggaagtag

SEQ ID NO: 8436149 - DNA, 20 bp, Homo sapiens
tggacctgtctctttaggga

SEQ ID NO: 8436150 - DNA, 19 bp, Homo sapiens
tggacctgtgcccatggct

SEQ ID NO: 8436151 - DNA, 21 bp, Homo sapiens
tggactggtgagtttaggctg

SEQ ID NO: 8436152 - DNA, 22 bp, Homo sapiens
tggacctgaagaataggaagta

SEQ ID NO: 8436153 - DNA, 22 bp, Homo sapiens
tggacctgagcctggccctgcc

SEQ ID NO: 8436154 - DNA, 22 bp, Homo sapiens
tggacctcactgtctgctggta

SEQ ID NO: 8436155 - DNA, 22 bp, Homo sapiens
tggacctgctggatgggcaggt

SEQ ID NO: 8436156 - DNA, 22 bp, Homo sapiens
tggacctggggtggcctcctct

SEQ ID NO: 8436157 - DNA, 22 bp, Homo sapiens
tggacccaggcaggtctgtcct

SEQ ID NO: 8436158 - DNA, 23 bp, Homo sapiens
tggaccctgcacaccagctctac

SEQ ID NO: 8436159 - DNA, 22 bp, Homo sapiens
tggacaggggctgctgttgtca

SEQ ID NO: 8436160 - DNA, 18 bp, Homo sapiens
tggacagggtggagaaaa

SEQ ID NO: 8436161 - DNA, 22 bp, Homo sapiens
tggaccactctggtgcccatgt

SEQ ID NO: 8436162 - DNA, 22 bp, Homo sapiens
tggacaggtgagtgactcaggg

SEQ ID NO: 8436163 - DNA, 22 bp, Homo sapiens
tggaccagggtcccagagtatg

SEQ ID NO: 8436164 - DNA, 22 bp, Homo sapiens
tggacccaccccagggcctgct

SEQ ID NO: 8436165 - DNA, 22 bp, Homo sapiens
tggaccagcagccccagtgcct

SEQ ID NO: 8436166 - DNA, 22 bp, Homo sapiens
tggaccagcagccccagtgcct

SEQ ID NO: 8436167 - DNA, 21 bp, Homo sapiens
tggaccaggaaggtggtggtg

SEQ ID NO: 8436168 - DNA, 23 bp, Homo sapiens
tggaatgagctgggaagctgagc

SEQ ID NO: 8436169 - DNA, 22 bp, Homo sapiens
tggaatgacagagagtctgaat

SEQ ID NO: 8436170 - DNA, 22 bp, Homo sapiens
tggacaacatagtgagacctca

SEQ ID NO: 8436171 - DNA, 22 bp, Homo sapiens
tggacaaatgatttctaccttt

SEQ ID NO: 8436172 - DNA, 22 bp, Homo sapiens
tggaattttgtattagctttga

SEQ ID NO: 8436173 - DNA, 22 bp, Homo sapiens
tggaattaataggggatataca

SEQ ID NO: 8436174 - DNA, 22 bp, Homo sapiens
tggacacacatgtatgtcagag

SEQ ID NO: 8436175 - DNA, 22 bp, Homo sapiens
tggacacacatgtatgtcagag

SEQ ID NO: 8436176 - DNA, 18 bp, Homo sapiens
tggacacatggcctgggt

SEQ ID NO: 8436177 - DNA, 20 bp, Homo sapiens
tggacacagccctgttgagt

SEQ ID NO: 8436178 - DNA, 22 bp, Homo sapiens
tggacacatcactgcagccact

SEQ ID NO: 8436179 - DNA, 22 bp, Homo sapiens
tggacacagtggtgaaggtaca

SEQ ID NO: 8436180 - DNA, 22 bp, Homo sapiens
tggacagcttgcagagccaccc

SEQ ID NO: 8436181 - DNA, 22 bp, Homo sapiens
tggacagcttgcagagccaccc

SEQ ID NO: 8436182 - DNA, 22 bp, Homo sapiens
tggacagcttgcagagccaccc

SEQ ID NO: 8436183 - DNA, 23 bp, Homo sapiens
tggacagcagcagcagtgtcacc

SEQ ID NO: 8436184 - DNA, 22 bp, Homo sapiens
tggacaggatagtgcagtacgc

SEQ ID NO: 8436185 - DNA, 22 bp, Homo sapiens
tggacaggatagtgcagtacgc

SEQ ID NO: 8436186 - DNA, 22 bp, Homo sapiens
tggacaggatctgagactgaga

SEQ ID NO: 8436187 - DNA, 22 bp, Homo sapiens
tggaatatactcagaacaggct

SEQ ID NO: 8436188 - DNA, 22 bp, Homo sapiens
tggaatctctttggggactgaa

SEQ ID NO: 8436189 - DNA, 22 bp, Homo sapiens
tggaatctgtgctgttttagtg

SEQ ID NO: 8436190 - DNA, 22 bp, Homo sapiens
tggaatctgtatgtatgtataa

SEQ ID NO: 8436191 - DNA, 22 bp, Homo sapiens
tggaatcttgcgggcacatggc

SEQ ID NO: 8436192 - DNA, 23 bp, Homo sapiens
tggaatcttcgatattgattcag

SEQ ID NO: 8436193 - DNA, 22 bp, Homo sapiens
tggaatctttaggaagcacata

SEQ ID NO: 8436194 - DNA, 22 bp, Homo sapiens
tggaatctctggtatctgggga

SEQ ID NO: 8436195 - DNA, 22 bp, Homo sapiens
tggaatcagttacatgtggttg

SEQ ID NO: 8436196 - DNA, 20 bp, Homo sapiens
tggaagttctgttgcattgg

SEQ ID NO: 8436197 - DNA, 22 bp, Homo sapiens
tggaaggggttacgcagcagga

SEQ ID NO: 8436198 - DNA, 22 bp, Homo sapiens
tggaaggggttacgcagcagga

SEQ ID NO: 8436199 - DNA, 22 bp, Homo sapiens
tggaaggggagctggaaagggg

SEQ ID NO: 8436200 - DNA, 22 bp, Homo sapiens
tggaaggcaacggagtgagctg

SEQ ID NO: 8436201 - DNA, 22 bp, Homo sapiens
tggaaggaagccaaggaaggtt

SEQ ID NO: 8436202 - DNA, 22 bp, Homo sapiens
tggaaggaagccaaggaaggtt

SEQ ID NO: 8436203 - DNA, 22 bp, Homo sapiens
tggaaggagactgggaagtgtg

SEQ ID NO: 8436204 - DNA, 22 bp, Homo sapiens
tggaagcagagagctatcacca

SEQ ID NO: 8436205 - DNA, 22 bp, Homo sapiens
tggaagccaaggtcagaaggag

SEQ ID NO: 8436206 - DNA, 22 bp, Homo sapiens
tggaagcatcacttcttgcctg

SEQ ID NO: 8436207 - DNA, 22 bp, Homo sapiens
tggaagccaggcccgctcctaa

SEQ ID NO: 8436208 - DNA, 22 bp, Homo sapiens
tggaagcctcagtttgccttct

SEQ ID NO: 8436209 - DNA, 22 bp, Homo sapiens
tggaagccgtagggtttgggaa

SEQ ID NO: 8436210 - DNA, 22 bp, Homo sapiens
tggaaggaaaggtagcagagaa

SEQ ID NO: 8436211 - DNA, 22 bp, Homo sapiens
tggaaggaagccaaggaaggtt

SEQ ID NO: 8436212 - DNA, 22 bp, Homo sapiens
tggaaggaaaggtagcagagaa

SEQ ID NO: 8436213 - DNA, 19 bp, Homo sapiens
tggaagaggaagggaaata

SEQ ID NO: 8436214 - DNA, 22 bp, Homo sapiens
tggaagagcaggcagacaatgc

SEQ ID NO: 8436215 - DNA, 22 bp, Homo sapiens
tggaagcaaaatatcctttaat

SEQ ID NO: 8436216 - DNA, 22 bp, Homo sapiens
tggataaatggtgctatcaccc

SEQ ID NO: 8436217 - DNA, 20 bp, Homo sapiens
tggagttgttctgctaggtc

SEQ ID NO: 8436218 - DNA, 22 bp, Homo sapiens
tggagttgcagctaccagacat

SEQ ID NO: 8436219 - DNA, 22 bp, Homo sapiens
tggagtctgtgatgctctgggt

SEQ ID NO: 8436220 - DNA, 22 bp, Homo sapiens
tggaggtgtggagtcaaaggga

SEQ ID NO: 8436221 - DNA, 22 bp, Homo sapiens
tggagggaacaaaggagtccca

SEQ ID NO: 8436222 - DNA, 22 bp, Homo sapiens
tggagggatacaaagatgaaaa

SEQ ID NO: 8436223 - DNA, 22 bp, Homo sapiens
tggaggctggtttctgctgagg

SEQ ID NO: 8436224 - DNA, 22 bp, Homo sapiens
tggaggctgtgtgcatgagacc

SEQ ID NO: 8436225 - DNA, 22 bp, Homo sapiens
tggaggctggtttctgctgagg

SEQ ID NO: 8436226 - DNA, 22 bp, Homo sapiens
tggagggcatctgtggtcaggc

SEQ ID NO: 8436227 - DNA, 22 bp, Homo sapiens
tggagggcatagctgttctttc

SEQ ID NO: 8436228 - DNA, 22 bp, Homo sapiens
tggagggcatgctgtccatggg

SEQ ID NO: 8436229 - DNA, 22 bp, Homo sapiens
tggagggcgcttagatggaggg

SEQ ID NO: 8436230 - DNA, 22 bp, Homo sapiens
tggagggctaagctgagggata

SEQ ID NO: 8436231 - DNA, 18 bp, Homo sapiens
tggagggcttgctgcagc

SEQ ID NO: 8436232 - DNA, 22 bp, Homo sapiens
tggagggctctttcacctggta

SEQ ID NO: 8436233 - DNA, 20 bp, Homo sapiens
tggaggtggtctgctgtcct

SEQ ID NO: 8436234 - DNA, 22 bp, Homo sapiens
tggaggtggcacaagggaggtc

SEQ ID NO: 8436235 - DNA, 22 bp, Homo sapiens
tggaggtgggagggactgtcct

SEQ ID NO: 8436236 - DNA, 22 bp, Homo sapiens
tggaggcaggtggaggagtgaa

SEQ ID NO: 8436237 - DNA, 23 bp, Homo sapiens
tggaggcaggatgctaaggagtc

SEQ ID NO: 8436238 - DNA, 22 bp, Homo sapiens
tggaggcaggagacagggcaaa

SEQ ID NO: 8436239 - DNA, 18 bp, Homo sapiens
tggaggcagagttctggc

SEQ ID NO: 8436240 - DNA, 22 bp, Homo sapiens
tggaggcaccactggctgcccg

SEQ ID NO: 8436241 - DNA, 22 bp, Homo sapiens
tggaggcaccactggctgcccg

SEQ ID NO: 8436242 - DNA, 20 bp, Homo sapiens
tggaggcagagccagaggga

SEQ ID NO: 8436243 - DNA, 20 bp, Homo sapiens
tggaggcagagccagaggga

SEQ ID NO: 8436244 - DNA, 20 bp, Homo sapiens
tggaggcacctgtggagatc

SEQ ID NO: 8436245 - DNA, 22 bp, Homo sapiens
tggaggcactaaatggccacaa

SEQ ID NO: 8436246 - DNA, 22 bp, Homo sapiens
tggaggcagtcaaatgactgac

SEQ ID NO: 8436247 - DNA, 22 bp, Homo sapiens
tggaggcagtaactgagcaaca

SEQ ID NO: 8436248 - DNA, 22 bp, Homo sapiens
tggaggcaggttagccagacga

SEQ ID NO: 8436249 - DNA, 22 bp, Homo sapiens
tggagctggtaaacagtgacat

SEQ ID NO: 8436250 - DNA, 23 bp, Homo sapiens
tggagctgggctcagaccctggg

SEQ ID NO: 8436251 - DNA, 23 bp, Homo sapiens
tggagctgggcagctgggaaagt

SEQ ID NO: 8436252 - DNA, 22 bp, Homo sapiens
tggagctgggagtcctgggctg

SEQ ID NO: 8436253 - DNA, 22 bp, Homo sapiens
tggagctgggagtcctgggctg

SEQ ID NO: 8436254 - DNA, 22 bp, Homo sapiens
tggaggaaaaaaccaggcagag

SEQ ID NO: 8436255 - DNA, 22 bp, Homo sapiens
tggagctgtcactcagaaccaa

SEQ ID NO: 8436256 - DNA, 22 bp, Homo sapiens
tggagctgtcactcagaaccaa

SEQ ID NO: 8436257 - DNA, 20 bp, Homo sapiens
tggagctgtaatcttgtctg

SEQ ID NO: 8436258 - DNA, 22 bp, Homo sapiens
tggagctgtagccaccaccctg

SEQ ID NO: 8436259 - DNA, 22 bp, Homo sapiens
tggagctggtaaacagtgacat

SEQ ID NO: 8436260 - DNA, 22 bp, Homo sapiens
tggagctggttctggggaagct

SEQ ID NO: 8436261 - DNA, 22 bp, Homo sapiens
tggaggagaactccctggctac

SEQ ID NO: 8436262 - DNA, 22 bp, Homo sapiens
tggaggagaccattccactcag

SEQ ID NO: 8436263 - DNA, 19 bp, Homo sapiens
tggaggagaggaaaagtca

SEQ ID NO: 8436264 - DNA, 22 bp, Homo sapiens
tggaggagaccgcattttattt

SEQ ID NO: 8436265 - DNA, 22 bp, Homo sapiens
tggaggaggatgcatttgttgt

SEQ ID NO: 8436266 - DNA, 22 bp, Homo sapiens
tggaggcaactgaagatgtagt

SEQ ID NO: 8436267 - DNA, 22 bp, Homo sapiens
tggaggcaactgaagatgtagt

SEQ ID NO: 8436268 - DNA, 22 bp, Homo sapiens
tggaggcaactgaagatgtagt

SEQ ID NO: 8436269 - DNA, 22 bp, Homo sapiens
tggaggagtagattttcagagg

SEQ ID NO: 8436270 - DNA, 22 bp, Homo sapiens
tggaggagggctggtgtctgta

SEQ ID NO: 8436271 - DNA, 22 bp, Homo sapiens
tggaggagggctggtgtctgta

SEQ ID NO: 8436272 - DNA, 22 bp, Homo sapiens
tggagaaggccggccaggagtg

SEQ ID NO: 8436273 - DNA, 22 bp, Homo sapiens
tggagaaaaggttgaatccatc

SEQ ID NO: 8436274 - DNA, 22 bp, Homo sapiens
tggagaagattggtcaccattc

SEQ ID NO: 8436275 - DNA, 22 bp, Homo sapiens
tggagagaagaggcagtgtgct

SEQ ID NO: 8436276 - DNA, 22 bp, Homo sapiens
tggagagaacagtgtctgaaag

SEQ ID NO: 8436277 - DNA, 22 bp, Homo sapiens
tggagagaagaggcagtgtgct

SEQ ID NO: 8436278 - DNA, 22 bp, Homo sapiens
tggagagaaagttgaatggagg

SEQ ID NO: 8436279 - DNA, 22 bp, Homo sapiens
tggagagaaagttgaatggagg

SEQ ID NO: 8436280 - DNA, 22 bp, Homo sapiens
tggagagcaatgaggggcaggc

SEQ ID NO: 8436281 - DNA, 21 bp, Homo sapiens
tggagagcccttgcctgagtc

SEQ ID NO: 8436282 - DNA, 22 bp, Homo sapiens
tggagagcagggctggagttca

SEQ ID NO: 8436283 - DNA, 19 bp, Homo sapiens
tggagaggaaatgctgctc

SEQ ID NO: 8436284 - DNA, 22 bp, Homo sapiens
tggagaggagcaccatggccat

SEQ ID NO: 8436285 - DNA, 22 bp, Homo sapiens
tggagaggtttaaacaaaagtt

SEQ ID NO: 8436286 - DNA, 22 bp, Homo sapiens
tggagcagaaatttgaagccat

SEQ ID NO: 8436287 - DNA, 22 bp, Homo sapiens
tggagcagaaatttgaagccat

SEQ ID NO: 8436288 - DNA, 22 bp, Homo sapiens
tggagagtctctgagccagggc

SEQ ID NO: 8436289 - DNA, 22 bp, Homo sapiens
tggagagtggtttgggggacat

SEQ ID NO: 8436290 - DNA, 22 bp, Homo sapiens
tggagagtggatatgggagcaa

SEQ ID NO: 8436291 - DNA, 22 bp, Homo sapiens
tggagcagaggctgaggttggg

SEQ ID NO: 8436292 - DNA, 22 bp, Homo sapiens
tggagcagaggaagaaggcttt

SEQ ID NO: 8436293 - DNA, 22 bp, Homo sapiens
tggagcagagatggtggccttc

SEQ ID NO: 8436294 - DNA, 22 bp, Homo sapiens
tggagcagcattcatccagcag

SEQ ID NO: 8436295 - DNA, 22 bp, Homo sapiens
tggagctgcctggcacctacag

SEQ ID NO: 8436296 - DNA, 21 bp, Homo sapiens
tggagctgccacttgagctgc

SEQ ID NO: 8436297 - DNA, 21 bp, Homo sapiens
tggagctgccacttgtcctcc

SEQ ID NO: 8436298 - DNA, 18 bp, Homo sapiens
tggagctgagtgctgtgc

SEQ ID NO: 8436299 - DNA, 18 bp, Homo sapiens
tggagctgagtgctgtgc

SEQ ID NO: 8436300 - DNA, 22 bp, Homo sapiens
tggagctgatacagctggcttt

SEQ ID NO: 8436301 - DNA, 22 bp, Homo sapiens
tggagctggaatttctgggcct

SEQ ID NO: 8436302 - DNA, 22 bp, Homo sapiens
tggagctggaagacagtgatat

SEQ ID NO: 8436303 - DNA, 22 bp, Homo sapiens
tggagctggaatttctgggcct

SEQ ID NO: 8436304 - DNA, 22 bp, Homo sapiens
tggagctggaatttgagctgga

SEQ ID NO: 8436305 - DNA, 22 bp, Homo sapiens
tggagctggcagcggaaaaggg

SEQ ID NO: 8436306 - DNA, 22 bp, Homo sapiens
tggagctggcttgtggaagttg

SEQ ID NO: 8436307 - DNA, 23 bp, Homo sapiens
tggagctgacagtcagagggagg

SEQ ID NO: 8436308 - DNA, 18 bp, Homo sapiens
tggagctgagtgctgtgc

SEQ ID NO: 8436309 - DNA, 21 bp, Homo sapiens
tggagctgaatttttggcatc

SEQ ID NO: 8436310 - DNA, 22 bp, Homo sapiens
tggagctctggaagttctaagc

SEQ ID NO: 8436311 - DNA, 22 bp, Homo sapiens
tggagctgaactttgaggccag

SEQ ID NO: 8436312 - DNA, 22 bp, Homo sapiens
tggagctgaactttgaggccag

SEQ ID NO: 8436313 - DNA, 22 bp, Homo sapiens
tggagctcagcgggtggtttct

SEQ ID NO: 8436314 - DNA, 20 bp, Homo sapiens
tggagctccagcgtccatgt

SEQ ID NO: 8436315 - DNA, 20 bp, Homo sapiens
tggagctccagcgtccatgt

SEQ ID NO: 8436316 - DNA, 23 bp, Homo sapiens
tggagctcctgcccatcctggct

SEQ ID NO: 8436317 - DNA, 22 bp, Homo sapiens
tggagctccactggaaaaatgt

SEQ ID NO: 8436318 - DNA, 22 bp, Homo sapiens
tggagctctgattaaattggaa

SEQ ID NO: 8436319 - DNA, 21 bp, Homo sapiens
tggagctccctgcatcccact

SEQ ID NO: 8436320 - DNA, 21 bp, Homo sapiens
tggagctccctgcatcccact

SEQ ID NO: 8436321 - DNA, 22 bp, Homo sapiens
tggagctgaactttgaggccag

SEQ ID NO: 8436322 - DNA, 22 bp, Homo sapiens
tggagctcaaaggcctgtggga

SEQ ID NO: 8436323 - DNA, 22 bp, Homo sapiens
tggagccttttacccacaggag

SEQ ID NO: 8436324 - DNA, 22 bp, Homo sapiens
tggagcctgttctgagaagccg

SEQ ID NO: 8436325 - DNA, 22 bp, Homo sapiens
tggagcccaggagaggataaac

SEQ ID NO: 8436326 - DNA, 22 bp, Homo sapiens
tggagcccagggtgagaaggag

SEQ ID NO: 8436327 - DNA, 22 bp, Homo sapiens
tggagccagggtagaagcagag

SEQ ID NO: 8436328 - DNA, 22 bp, Homo sapiens
tggagccagagcgcagcctggg

SEQ ID NO: 8436329 - DNA, 22 bp, Homo sapiens
tggagccagaagagccagttca

SEQ ID NO: 8436330 - DNA, 22 bp, Homo sapiens
tggagccagcaggactcagagg

SEQ ID NO: 8436331 - DNA, 22 bp, Homo sapiens
tggagccagcgagccgaggcgg

SEQ ID NO: 8436332 - DNA, 22 bp, Homo sapiens
tggagccagcggcctgctgagg

SEQ ID NO: 8436333 - DNA, 22 bp, Homo sapiens
tggagcattcaggtttcccttt

SEQ ID NO: 8436334 - DNA, 22 bp, Homo sapiens
tggagcaggtgctcagggtaat

SEQ ID NO: 8436335 - DNA, 22 bp, Homo sapiens
tggagcaggtgccaggtgtgtg

SEQ ID NO: 8436336 - DNA, 22 bp, Homo sapiens
tggagcaggacggggagtggta

SEQ ID NO: 8436337 - DNA, 22 bp, Homo sapiens
tggagcagctgaacagagttga

SEQ ID NO: 8436338 - DNA, 22 bp, Homo sapiens
tggagcagctaagcctctgaga

SEQ ID NO: 8436339 - DNA, 22 bp, Homo sapiens
tggagcaggaaacatctagagg

SEQ ID NO: 8436340 - DNA, 22 bp, Homo sapiens
tggtggcatcaattgacttctc

SEQ ID NO: 8436341 - DNA, 22 bp, Homo sapiens
tggtggcatcactcagcctccc

SEQ ID NO: 8436342 - DNA, 22 bp, Homo sapiens
tggtggcagctgagtgtcaggt

SEQ ID NO: 8436343 - DNA, 22 bp, Homo sapiens
tggtggcagctgggacagaggt

SEQ ID NO: 8436344 - DNA, 19 bp, Homo sapiens
tggtggcaatgtcagctaa

SEQ ID NO: 8436345 - DNA, 22 bp, Homo sapiens
tggtggcacaagggagagaatc

SEQ ID NO: 8436346 - DNA, 16 bp, Homo sapiens
tggtggggaggacagc

SEQ ID NO: 8436347 - DNA, 22 bp, Homo sapiens
tggtgggcacagtgcccaggct

SEQ ID NO: 8436348 - DNA, 22 bp, Homo sapiens
tggtgggagtccgctgtgctgc

SEQ ID NO: 8436349 - DNA, 22 bp, Homo sapiens
tggtgggagtgagggcatgcca

SEQ ID NO: 8436350 - DNA, 22 bp, Homo sapiens
tggtgcagtcattggcccaggg

SEQ ID NO: 8436351 - DNA, 22 bp, Homo sapiens
tggtgcagtcattggcccaggg

SEQ ID NO: 8436352 - DNA, 22 bp, Homo sapiens
tggtgcagtagagctgtctggg

SEQ ID NO: 8436353 - DNA, 22 bp, Homo sapiens
tggtgcagtagaaggccgactt

SEQ ID NO: 8436354 - DNA, 22 bp, Homo sapiens
tggtgcagatgcaggtcactgg

SEQ ID NO: 8436355 - DNA, 22 bp, Homo sapiens
tggtgcagatagtggtgtagta

SEQ ID NO: 8436356 - DNA, 22 bp, Homo sapiens
tggtgcccatgtatcccttcac

SEQ ID NO: 8436357 - DNA, 22 bp, Homo sapiens
tggtgcagttcccagggccggg

SEQ ID NO: 8436358 - DNA, 22 bp, Homo sapiens
tggtgccaagcatgaggactct

SEQ ID NO: 8436359 - DNA, 21 bp, Homo sapiens
tggtggagtgtgctgagcatg

SEQ ID NO: 8436360 - DNA, 20 bp, Homo sapiens
tggtggagagaagctatttg

SEQ ID NO: 8436361 - DNA, 22 bp, Homo sapiens
tggtggacaccgcagccatgaa

SEQ ID NO: 8436362 - DNA, 22 bp, Homo sapiens
tggtggaattgtaaaatagtgt

SEQ ID NO: 8436363 - DNA, 22 bp, Homo sapiens
tggtggaaggcagagctacacc

SEQ ID NO: 8436364 - DNA, 21 bp, Homo sapiens
tggtgccttcagctgtctttt

SEQ ID NO: 8436365 - DNA, 22 bp, Homo sapiens
tggtctaagagcctaactgctg

SEQ ID NO: 8436366 - DNA, 22 bp, Homo sapiens
tggtctcccagagcagggacgc

SEQ ID NO: 8436367 - DNA, 22 bp, Homo sapiens
tggtcctttaagtctttctctg

SEQ ID NO: 8436368 - DNA, 22 bp, Homo sapiens
tggtccttcttgaagagtgagt

SEQ ID NO: 8436369 - DNA, 21 bp, Homo sapiens
tggtccttctttactgcctcc

SEQ ID NO: 8436370 - DNA, 22 bp, Homo sapiens
tggtccttgctatagagtgata

SEQ ID NO: 8436371 - DNA, 22 bp, Homo sapiens
tggtcctggtagcggtgtgctt

SEQ ID NO: 8436372 - DNA, 22 bp, Homo sapiens
tggtcctggtcatctgggctgg

SEQ ID NO: 8436373 - DNA, 22 bp, Homo sapiens
tggtcctggtgcaagtgcattt

SEQ ID NO: 8436374 - DNA, 22 bp, Homo sapiens
tggtcctggtgcaagtgcattt

SEQ ID NO: 8436375 - DNA, 22 bp, Homo sapiens
tggtcctggggtgcaggctgac

SEQ ID NO: 8436376 - DNA, 22 bp, Homo sapiens
tggtcctggggtgcaggctgac

SEQ ID NO: 8436377 - DNA, 22 bp, Homo sapiens
tggtcctggggatctgcagtga

SEQ ID NO: 8436378 - DNA, 20 bp, Homo sapiens
tggtcctgtcccacccactc

SEQ ID NO: 8436379 - DNA, 22 bp, Homo sapiens
tggtcctgtagctctctaagtt

SEQ ID NO: 8436380 - DNA, 23 bp, Homo sapiens
tggtcctggttgaggtgggcccc

SEQ ID NO: 8436381 - DNA, 22 bp, Homo sapiens
tggtcctgtagcacttgattag

SEQ ID NO: 8436382 - DNA, 22 bp, Homo sapiens
tggtcctgtgttcttcctgcct

SEQ ID NO: 8436383 - DNA, 22 bp, Homo sapiens
tggtcctgtctcaaggagcctt

SEQ ID NO: 8436384 - DNA, 22 bp, Homo sapiens
tggtgcagacaggagccccgct

SEQ ID NO: 8436385 - DNA, 22 bp, Homo sapiens
tggtgcagagagggatctaggg

SEQ ID NO: 8436386 - DNA, 22 bp, Homo sapiens
tggtgatcagtcaactgtcttc

SEQ ID NO: 8436387 - DNA, 22 bp, Homo sapiens
tggtgagctctggcagtctgtg

SEQ ID NO: 8436388 - DNA, 22 bp, Homo sapiens
tggtgagatgtatggagggttg

SEQ ID NO: 8436389 - DNA, 22 bp, Homo sapiens
tggtctctgtgctcgggcatgg

SEQ ID NO: 8436390 - DNA, 22 bp, Homo sapiens
tggtgagaattggttggattta

SEQ ID NO: 8436391 - DNA, 20 bp, Homo sapiens
tggtgagagcacctgatggg

SEQ ID NO: 8436392 - DNA, 22 bp, Homo sapiens
tggtgagaccttgttccttatg

SEQ ID NO: 8436393 - DNA, 22 bp, Homo sapiens
tggtgagagctgaccgtgcgag

SEQ ID NO: 8436394 - DNA, 22 bp, Homo sapiens
tggtgagataactttcggcaag

SEQ ID NO: 8436395 - DNA, 22 bp, Homo sapiens
tggtcaggggcttctgagctgt

SEQ ID NO: 8436396 - DNA, 22 bp, Homo sapiens
tggtcaggctgctctgcggcgt

SEQ ID NO: 8436397 - DNA, 22 bp, Homo sapiens
tggtcaggattctcagcccttc

SEQ ID NO: 8436398 - DNA, 22 bp, Homo sapiens
tggtcagaactcagcgtgcttg

SEQ ID NO: 8436399 - DNA, 22 bp, Homo sapiens
tggtcagaaggaagggctccta

SEQ ID NO: 8436400 - DNA, 22 bp, Homo sapiens
tggtcacccactgggactgcgg

SEQ ID NO: 8436401 - DNA, 22 bp, Homo sapiens
tggtcaggtacctctggctgtc

SEQ ID NO: 8436402 - DNA, 22 bp, Homo sapiens
tggtcattaattcttaccttta

SEQ ID NO: 8436403 - DNA, 22 bp, Homo sapiens
tggtccagacatttctgaggta

SEQ ID NO: 8436404 - DNA, 22 bp, Homo sapiens
tggtccagactttgacctctca

SEQ ID NO: 8436405 - DNA, 22 bp, Homo sapiens
tggtccagatgccttggcttta

SEQ ID NO: 8436406 - DNA, 19 bp, Homo sapiens
tggtccagcttcttctcct

SEQ ID NO: 8436407 - DNA, 22 bp, Homo sapiens
tggtccagaagatattcaacca

SEQ ID NO: 8436408 - DNA, 17 bp, Homo sapiens
tggtccaggtggagcca

SEQ ID NO: 8436409 - DNA, 20 bp, Homo sapiens
tggtcctcacatgccatctt

SEQ ID NO: 8436410 - DNA, 22 bp, Homo sapiens
tggtccagggtgtagtacagag

SEQ ID NO: 8436411 - DNA, 22 bp, Homo sapiens
tggtccaggcacccttctagag

SEQ ID NO: 8436412 - DNA, 20 bp, Homo sapiens
tggtccaggacctggtgtcc

SEQ ID NO: 8436413 - DNA, 22 bp, Homo sapiens
tggtccagcttgattctcttct

SEQ ID NO: 8436414 - DNA, 22 bp, Homo sapiens
tggtcctgaggcttgtttccac

SEQ ID NO: 8436415 - DNA, 22 bp, Homo sapiens
tggtcctgcagtaatagacatc

SEQ ID NO: 8436416 - DNA, 22 bp, Homo sapiens
tggtcctgatcaccgctgggca

SEQ ID NO: 8436417 - DNA, 22 bp, Homo sapiens
tggtcctgagcaccagcctgac

SEQ ID NO: 8436418 - DNA, 22 bp, Homo sapiens
tggtcctgagaatcctgtcctc

SEQ ID NO: 8436419 - DNA, 22 bp, Homo sapiens
tggtcctgggcacagtatatgc

SEQ ID NO: 8436420 - DNA, 22 bp, Homo sapiens
tggtcctggagatcaatatgca

SEQ ID NO: 8436421 - DNA, 22 bp, Homo sapiens
tggtcctggccttgaccccagg

SEQ ID NO: 8436422 - DNA, 22 bp, Homo sapiens
tggtcctggagagtgttccata

SEQ ID NO: 8436423 - DNA, 22 bp, Homo sapiens
tggtcctggaaggtcctgaggg

SEQ ID NO: 8436424 - DNA, 22 bp, Homo sapiens
tggtcctgctacaggggattag

SEQ ID NO: 8436425 - DNA, 22 bp, Homo sapiens
tggtcctgcttgctgcttaaga

SEQ ID NO: 8436426 - DNA, 22 bp, Homo sapiens
tggtcctgccccgtgcacagag

SEQ ID NO: 8436427 - DNA, 22 bp, Homo sapiens
tggtcctgcccacgcccatctg

SEQ ID NO: 8436428 - DNA, 22 bp, Homo sapiens
tggtcctgcccacgcccatctg

SEQ ID NO: 8436429 - DNA, 23 bp, Homo sapiens
tggtcctgccaacggtgcccctc

SEQ ID NO: 8436430 - DNA, 21 bp, Homo sapiens
tggtttctaagctgtcagtct

SEQ ID NO: 8436431 - DNA, 22 bp, Homo sapiens
tggtttctctgaactctacgac

SEQ ID NO: 8436432 - DNA, 22 bp, Homo sapiens
tggttcctggttcacttggcag

SEQ ID NO: 8436433 - DNA, 22 bp, Homo sapiens
tggttgcctctcagagattccg

SEQ ID NO: 8436434 - DNA, 23 bp, Homo sapiens
tggtggggtcttggagacagcac

SEQ ID NO: 8436435 - DNA, 22 bp, Homo sapiens
tggtgttggagatggttgcatt

SEQ ID NO: 8436436 - DNA, 20 bp, Homo sapiens
tgtaaataggcattgtagtt

SEQ ID NO: 8436437 - DNA, 22 bp, Homo sapiens
tgtaaagggtgttaaattactc

SEQ ID NO: 8436438 - DNA, 22 bp, Homo sapiens
tgtaaagggtgttaaattactc

SEQ ID NO: 8436439 - DNA, 22 bp, Homo sapiens
tgtaaaggtaggtgcaaaatga

SEQ ID NO: 8436440 - DNA, 22 bp, Homo sapiens
tgtaaaggtaggtgcaaaatga

SEQ ID NO: 8436441 - DNA, 22 bp, Homo sapiens
tgtaaagatccttagcaacatc

SEQ ID NO: 8436442 - DNA, 18 bp, Homo sapiens
tgtaaacactttcattct

SEQ ID NO: 8436443 - DNA, 22 bp, Homo sapiens
tgtaaagagaaggcttataaag

SEQ ID NO: 8436444 - DNA, 22 bp, Homo sapiens
tgtaaagagaaggcttataaag

SEQ ID NO: 8436445 - DNA, 22 bp, Homo sapiens
tgtaaagagaatggtatatgga

SEQ ID NO: 8436446 - DNA, 22 bp, Homo sapiens
tgtaaacaaatgcattcttgct

SEQ ID NO: 8436447 - DNA, 20 bp, Homo sapiens
tgtaaaacaaggtgaatcct

SEQ ID NO: 8436448 - DNA, 22 bp, Homo sapiens
tgtaaaaccaaatcaatctagt

SEQ ID NO: 8436449 - DNA, 22 bp, Homo sapiens
tgtaaaagacatttctaagcaa

SEQ ID NO: 8436450 - DNA, 23 bp, Homo sapiens
tgtaaaagcatttgtcagcctgg

SEQ ID NO: 8436451 - DNA, 22 bp, Homo sapiens
tggtttttggtttaacactatg

SEQ ID NO: 8436452 - DNA, 23 bp, Homo sapiens
tgtaaaatggggtagtgttacca

SEQ ID NO: 8436453 - DNA, 22 bp, Homo sapiens
tgtaaaataccattccttgtca

SEQ ID NO: 8436454 - DNA, 22 bp, Homo sapiens
tgtaaaaggaaatcaaagcact

SEQ ID NO: 8436455 - DNA, 22 bp, Homo sapiens
tgtaaaaggaaatcaaagcact

SEQ ID NO: 8436456 - DNA, 22 bp, Homo sapiens
tgtaaaataattctccatgttt

SEQ ID NO: 8436457 - DNA, 22 bp, Homo sapiens
tgtaaaataattctccatgttt

SEQ ID NO: 8436458 - DNA, 22 bp, Homo sapiens
tggttttgctaaaatagaaaga

SEQ ID NO: 8436459 - DNA, 22 bp, Homo sapiens
tgtacacaatgtgcaggtttgt

SEQ ID NO: 8436460 - DNA, 22 bp, Homo sapiens
tgtacacaacgtgcaggtttgt

SEQ ID NO: 8436461 - DNA, 22 bp, Homo sapiens
tgtacacaacctacagtctgct

SEQ ID NO: 8436462 - DNA, 22 bp, Homo sapiens
tgtacaatagctattatctcca

SEQ ID NO: 8436463 - DNA, 22 bp, Homo sapiens
tgtacaatctgatgatgtatgg

SEQ ID NO: 8436464 - DNA, 22 bp, Homo sapiens
tgtacaaattcagttctagggt

SEQ ID NO: 8436465 - DNA, 22 bp, Homo sapiens
tgtacaaattcattgaactgta

SEQ ID NO: 8436466 - DNA, 22 bp, Homo sapiens
tgtacacagtatgaggcatctt

SEQ ID NO: 8436467 - DNA, 22 bp, Homo sapiens
tgtacacatggtgtacactccc

SEQ ID NO: 8436468 - DNA, 22 bp, Homo sapiens
tgtacagaggtgtacatatgat

SEQ ID NO: 8436469 - DNA, 22 bp, Homo sapiens
tgtacagactgtatttacaagt

SEQ ID NO: 8436470 - DNA, 22 bp, Homo sapiens
tgtacagtctgcagcttgctgt

SEQ ID NO: 8436471 - DNA, 22 bp, Homo sapiens
tgtacagtgccatgcagtttgc

SEQ ID NO: 8436472 - DNA, 22 bp, Homo sapiens
tgtaccgcaaatgctgctgcct

SEQ ID NO: 8436473 - DNA, 22 bp, Homo sapiens
tgtacagtatatttcaaagcca

SEQ ID NO: 8436474 - DNA, 22 bp, Homo sapiens
tgtacaggagaacaatgagaaa

SEQ ID NO: 8436475 - DNA, 22 bp, Homo sapiens
tgtacaggagaacaatgagaaa

SEQ ID NO: 8436476 - DNA, 22 bp, Homo sapiens
tgtacagattgatcatggagag

SEQ ID NO: 8436477 - DNA, 22 bp, Homo sapiens
tgtacagattgatcatggagag

SEQ ID NO: 8436478 - DNA, 22 bp, Homo sapiens
tgtaagaagggccagagctcca

SEQ ID NO: 8436479 - DNA, 22 bp, Homo sapiens
tgtacaaagccagaactcccaa

SEQ ID NO: 8436480 - DNA, 22 bp, Homo sapiens
tgtacaaagagtatagctttga

SEQ ID NO: 8436481 - DNA, 22 bp, Homo sapiens
tgtacaaagagtatagctttga

SEQ ID NO: 8436482 - DNA, 22 bp, Homo sapiens
tgtacaaagagtatagctttga

SEQ ID NO: 8436483 - DNA, 22 bp, Homo sapiens
tgtaacagtagttactattctt

SEQ ID NO: 8436484 - DNA, 22 bp, Homo sapiens
tgtaacagtagttactattctt

SEQ ID NO: 8436485 - DNA, 22 bp, Homo sapiens
tgtaacagtagataaggtcttg

SEQ ID NO: 8436486 - DNA, 22 bp, Homo sapiens
tgtaacagttataacaatgtgg

SEQ ID NO: 8436487 - DNA, 22 bp, Homo sapiens
tgtaacagttataacaatgtgg

SEQ ID NO: 8436488 - DNA, 22 bp, Homo sapiens
tgtaaccatgatgagcaggtat

SEQ ID NO: 8436489 - DNA, 23 bp, Homo sapiens
tgtaacaatttcatatacatgca

SEQ ID NO: 8436490 - DNA, 22 bp, Homo sapiens
tgtagataagtaaaagcccagt

SEQ ID NO: 8436491 - DNA, 22 bp, Homo sapiens
tgtagaggaggaaactgaggct

SEQ ID NO: 8436492 - DNA, 22 bp, Homo sapiens
tgtagatgtagacacaggtcta

SEQ ID NO: 8436493 - DNA, 19 bp, Homo sapiens
tgtagcagtttaaaacaac

SEQ ID NO: 8436494 - DNA, 22 bp, Homo sapiens
tgtagcaccagtcaccagccca

SEQ ID NO: 8436495 - DNA, 22 bp, Homo sapiens
tgtagaagtaggagtcatctca

SEQ ID NO: 8436496 - DNA, 22 bp, Homo sapiens
tgtagattttggagtctacaag

SEQ ID NO: 8436497 - DNA, 20 bp, Homo sapiens
tgtaggaaggaccctgtctg

SEQ ID NO: 8436498 - DNA, 17 bp, Homo sapiens
tgtagcttctccttctc

SEQ ID NO: 8436499 - DNA, 17 bp, Homo sapiens
tgtagcttctccttctc

SEQ ID NO: 8436500 - DNA, 17 bp, Homo sapiens
tgtagcttctccttctc

SEQ ID NO: 8436501 - DNA, 18 bp, Homo sapiens
tgtagctggaggccaggc

SEQ ID NO: 8436502 - DNA, 22 bp, Homo sapiens
tgtagctctccagccagcaagg

SEQ ID NO: 8436503 - DNA, 22 bp, Homo sapiens
tgtagctctccagccagcaagg

SEQ ID NO: 8436504 - DNA, 22 bp, Homo sapiens
tgtagctatagaggctgtacct

SEQ ID NO: 8436505 - DNA, 22 bp, Homo sapiens
tgtagctatagaggctgtacct

SEQ ID NO: 8436506 - DNA, 22 bp, Homo sapiens
tgtagaaagaatatgtttcata

SEQ ID NO: 8436507 - DNA, 22 bp, Homo sapiens
tgtagaaagctcttctgaaatc

SEQ ID NO: 8436508 - DNA, 22 bp, Homo sapiens
tgtagaaattagtaagatcaac

SEQ ID NO: 8436509 - DNA, 22 bp, Homo sapiens
tgtagaaggctatagactagga

SEQ ID NO: 8436510 - DNA, 22 bp, Homo sapiens
tgtagaacctgtttattataga

SEQ ID NO: 8436511 - DNA, 22 bp, Homo sapiens
tgtagaactgacattttggact

SEQ ID NO: 8436512 - DNA, 22 bp, Homo sapiens
tgtacttgaacttgactgtaga

SEQ ID NO: 8436513 - DNA, 22 bp, Homo sapiens
tgtacttgcttattagaaatct

SEQ ID NO: 8436514 - DNA, 22 bp, Homo sapiens
tgtagaaaattggagcattcat

SEQ ID NO: 8436515 - DNA, 22 bp, Homo sapiens
tgtagaaaattggagcattcat

SEQ ID NO: 8436516 - DNA, 22 bp, Homo sapiens
tgtatattctgcctaaaagctt

SEQ ID NO: 8436517 - DNA, 22 bp, Homo sapiens
tgtatattctgcctaaaagctt

SEQ ID NO: 8436518 - DNA, 22 bp, Homo sapiens
tgtatattcactgagcaagggg

SEQ ID NO: 8436519 - DNA, 22 bp, Homo sapiens
tgtatatatttctttcattcta

SEQ ID NO: 8436520 - DNA, 22 bp, Homo sapiens
tgtatcagatcaaatactggct

SEQ ID NO: 8436521 - DNA, 22 bp, Homo sapiens
tgtatcatatggggaagcttca

SEQ ID NO: 8436522 - DNA, 22 bp, Homo sapiens
tgtatctgtaatcccagatcaa

SEQ ID NO: 8436523 - DNA, 22 bp, Homo sapiens
tgtatctgacagtggagcggag

SEQ ID NO: 8436524 - DNA, 22 bp, Homo sapiens
tgtatctttctgtacttttatg

SEQ ID NO: 8436525 - DNA, 22 bp, Homo sapiens
tgtatcttcagtttgtctttcc

SEQ ID NO: 8436526 - DNA, 22 bp, Homo sapiens
tgtatataagcatttacttgtt

SEQ ID NO: 8436527 - DNA, 21 bp, Homo sapiens
tgtataacttctctccctcag

SEQ ID NO: 8436528 - DNA, 22 bp, Homo sapiens
tgtatttttagacctttagacc

SEQ ID NO: 8436529 - DNA, 22 bp, Homo sapiens
tgtatttttagacctttagacc

SEQ ID NO: 8436530 - DNA, 22 bp, Homo sapiens
tgtcaaaaagctgggacaagca

SEQ ID NO: 8436531 - DNA, 22 bp, Homo sapiens
tgtcaaaatgactttactacag

SEQ ID NO: 8436532 - DNA, 22 bp, Homo sapiens
tgtcaaactgtgacttctaatg

SEQ ID NO: 8436533 - DNA, 22 bp, Homo sapiens
tgtcaaagcaaggattaaatgt

SEQ ID NO: 8436534 - DNA, 22 bp, Homo sapiens
tgtcaaaaataagagagattgt

SEQ ID NO: 8436535 - DNA, 22 bp, Homo sapiens
tgtcacaaaaatcagtaattgc

SEQ ID NO: 8436536 - DNA, 22 bp, Homo sapiens
tgtcacagagcaactatttctt

SEQ ID NO: 8436537 - DNA, 22 bp, Homo sapiens
tgtcacatcaggggtgttgaca

SEQ ID NO: 8436538 - DNA, 22 bp, Homo sapiens
tgtcacatcaggtggtggctgt

SEQ ID NO: 8436539 - DNA, 22 bp, Homo sapiens
tgtcacatccattttgcaagta

SEQ ID NO: 8436540 - DNA, 22 bp, Homo sapiens
tgtcacatgaaacttgctcatc

SEQ ID NO: 8436541 - DNA, 22 bp, Homo sapiens
tgtcacatgaagccaacatagc

SEQ ID NO: 8436542 - DNA, 22 bp, Homo sapiens
tgtcacatgacacaaatatcta

SEQ ID NO: 8436543 - DNA, 22 bp, Homo sapiens
tgtcacatatataatgttcaat

SEQ ID NO: 8436544 - DNA, 22 bp, Homo sapiens
tgtcacataggcaaaatgtttt

SEQ ID NO: 8436545 - DNA, 22 bp, Homo sapiens
tgtcacataatttatctgtagg

SEQ ID NO: 8436546 - DNA, 21 bp, Homo sapiens
tgtcacagattctcagcttgc

SEQ ID NO: 8436547 - DNA, 22 bp, Homo sapiens
tgtcacagtctcgtgagcatct

SEQ ID NO: 8436548 - DNA, 22 bp, Homo sapiens
tgtcacagtctcgtgagcatct

SEQ ID NO: 8436549 - DNA, 22 bp, Homo sapiens
tgtcacctctttggctgcagct

SEQ ID NO: 8436550 - DNA, 22 bp, Homo sapiens
tgtcaccaccggaagaaactgc

SEQ ID NO: 8436551 - DNA, 21 bp, Homo sapiens
tgtcacatgtggatggtattt

SEQ ID NO: 8436552 - DNA, 21 bp, Homo sapiens
tgtcacatgtggatggtattt

SEQ ID NO: 8436553 - DNA, 22 bp, Homo sapiens
tgtcacatgtgtggcatttttc

SEQ ID NO: 8436554 - DNA, 22 bp, Homo sapiens
tgtcacatgtttaatgtggact

SEQ ID NO: 8436555 - DNA, 22 bp, Homo sapiens
tgtcacattatatgtgaggata

SEQ ID NO: 8436556 - DNA, 22 bp, Homo sapiens
tgtcacattgaatatgatttat

SEQ ID NO: 8436557 - DNA, 22 bp, Homo sapiens
tgtcacattctgatgtgaggtg

SEQ ID NO: 8436558 - DNA, 21 bp, Homo sapiens
tgtcacattgtccctgctgct

SEQ ID NO: 8436559 - DNA, 23 bp, Homo sapiens
tgtcacatttagttggcattgtt

SEQ ID NO: 8436560 - DNA, 22 bp, Homo sapiens
tgtattgaggattcatttttgt

SEQ ID NO: 8436561 - DNA, 22 bp, Homo sapiens
tgtatttaagctttacctaaaa

SEQ ID NO: 8436562 - DNA, 22 bp, Homo sapiens
tgtatttaattgtatcatcaca

SEQ ID NO: 8436563 - DNA, 22 bp, Homo sapiens
tgtatttatattagaatggttg

SEQ ID NO: 8436564 - DNA, 22 bp, Homo sapiens
tgtattttcttctggaagctta

SEQ ID NO: 8436565 - DNA, 22 bp, Homo sapiens
tgtattttctgaagataatcaa

SEQ ID NO: 8436566 - DNA, 22 bp, Homo sapiens
tgtattttctgaggagcattag

SEQ ID NO: 8436567 - DNA, 22 bp, Homo sapiens
tgtattttcagagtggcatttc

SEQ ID NO: 8436568 - DNA, 17 bp, Homo sapiens
tgtatttatcatgtcag

SEQ ID NO: 8436569 - DNA, 22 bp, Homo sapiens
tgtccaggctggagtgcagtgg

SEQ ID NO: 8436570 - DNA, 22 bp, Homo sapiens
tgtccaggctaaagtgcagtgg

SEQ ID NO: 8436571 - DNA, 22 bp, Homo sapiens
tgtccaggctcccttggtgctg

SEQ ID NO: 8436572 - DNA, 22 bp, Homo sapiens
tgtccaggctggagtgcagtgg

SEQ ID NO: 8436573 - DNA, 22 bp, Homo sapiens
tgtccagggatggggtcaggga

SEQ ID NO: 8436574 - DNA, 22 bp, Homo sapiens
tgtccaggctaaagtgcagtgg

SEQ ID NO: 8436575 - DNA, 22 bp, Homo sapiens
tgtccaggcggccttgcctgtt

SEQ ID NO: 8436576 - DNA, 22 bp, Homo sapiens
tgtccaggcactgggactctag

SEQ ID NO: 8436577 - DNA, 22 bp, Homo sapiens
tgtccaggcactgggactctag

SEQ ID NO: 8436578 - DNA, 22 bp, Homo sapiens
tgtcccagcactttgggagtct

SEQ ID NO: 8436579 - DNA, 22 bp, Homo sapiens
tgtccaggtgtgtctaaagaga

SEQ ID NO: 8436580 - DNA, 22 bp, Homo sapiens
tgtccaggtgtgtctaaagaga

SEQ ID NO: 8436581 - DNA, 22 bp, Homo sapiens
tgtccaggtggcctctgctgct

SEQ ID NO: 8436582 - DNA, 22 bp, Homo sapiens
tgtccaggtggcctctgctgct

SEQ ID NO: 8436583 - DNA, 22 bp, Homo sapiens
tgtccagggggcttacctggag

SEQ ID NO: 8436584 - DNA, 20 bp, Homo sapiens
tgtccaggggatcgttggcc

SEQ ID NO: 8436585 - DNA, 22 bp, Homo sapiens
tgtccaggtcagcagcagggac

SEQ ID NO: 8436586 - DNA, 22 bp, Homo sapiens
tgtcccagtttatctgggactg

SEQ ID NO: 8436587 - DNA, 22 bp, Homo sapiens
tgtcccagggaaggcccagcac

SEQ ID NO: 8436588 - DNA, 22 bp, Homo sapiens
tgtcccagggaaggcccagcac

SEQ ID NO: 8436589 - DNA, 22 bp, Homo sapiens
tgtccccaaggttcagcccaca

SEQ ID NO: 8436590 - DNA, 20 bp, Homo sapiens
tgtcccctagatcccagctc

SEQ ID NO: 8436591 - DNA, 22 bp, Homo sapiens
tgtccctcattgacgctgtgcc

SEQ ID NO: 8436592 - DNA, 22 bp, Homo sapiens
tgtccctcattgacgctgtgcc

SEQ ID NO: 8436593 - DNA, 22 bp, Homo sapiens
tgtccctctgaggcttccctgg

SEQ ID NO: 8436594 - DNA, 22 bp, Homo sapiens
tgtccctctgaggcttccctgg

SEQ ID NO: 8436595 - DNA, 22 bp, Homo sapiens
tgtccctgatccactggacccc

SEQ ID NO: 8436596 - DNA, 22 bp, Homo sapiens
tgtccctgatccactggacccc

SEQ ID NO: 8436597 - DNA, 22 bp, Homo sapiens
tgtccctggtggaggctggcag

SEQ ID NO: 8436598 - DNA, 22 bp, Homo sapiens
tgtccctggactccaggagcca

SEQ ID NO: 8436599 - DNA, 22 bp, Homo sapiens
tgtccctggaactatggctcca

SEQ ID NO: 8436600 - DNA, 22 bp, Homo sapiens
tgtccctggactccaggagcca

SEQ ID NO: 8436601 - DNA, 22 bp, Homo sapiens
tgtcctcacaggaatgaacttt

SEQ ID NO: 8436602 - DNA, 22 bp, Homo sapiens
tgtcctcagatatgtctactct

SEQ ID NO: 8436603 - DNA, 22 bp, Homo sapiens
tgtcctggccaaggccttgctt

SEQ ID NO: 8436604 - DNA, 22 bp, Homo sapiens
tgtcctgggaggcggggtccag

SEQ ID NO: 8436605 - DNA, 22 bp, Homo sapiens
tgtcctgggaatgggatgcagt

SEQ ID NO: 8436606 - DNA, 22 bp, Homo sapiens
tgtcctgggaatgggatgcagt

SEQ ID NO: 8436607 - DNA, 22 bp, Homo sapiens
tgtcctgggaatgggatgcagt

SEQ ID NO: 8436608 - DNA, 22 bp, Homo sapiens
tgtcctggggacaagaggccct

SEQ ID NO: 8436609 - DNA, 22 bp, Homo sapiens
tgtcctggggcgacttggggcc

SEQ ID NO: 8436610 - DNA, 22 bp, Homo sapiens
tgtcctggggacaagaggccct

SEQ ID NO: 8436611 - DNA, 22 bp, Homo sapiens
tgtcctggggacaagaggccct

SEQ ID NO: 8436612 - DNA, 22 bp, Homo sapiens
tgtcctgggtcaaatcctggtc

SEQ ID NO: 8436613 - DNA, 22 bp, Homo sapiens
tgtcctgggtccctgctagaag

SEQ ID NO: 8436614 - DNA, 22 bp, Homo sapiens
tgtcctgggtccctgctagaag

SEQ ID NO: 8436615 - DNA, 22 bp, Homo sapiens
tgtcctggtgctccaggtggct

SEQ ID NO: 8436616 - DNA, 22 bp, Homo sapiens
tgtcctgtaggtttatttgtgt

SEQ ID NO: 8436617 - DNA, 22 bp, Homo sapiens
tgtcctgtctctttcctaattg

SEQ ID NO: 8436618 - DNA, 22 bp, Homo sapiens
tgtccttttccccaaattcact

SEQ ID NO: 8436619 - DNA, 22 bp, Homo sapiens
tgtcctttttcttaggaaatat

SEQ ID NO: 8436620 - DNA, 22 bp, Homo sapiens
tgtcctttgggagggcacagct

SEQ ID NO: 8436621 - DNA, 22 bp, Homo sapiens
tgtcaggttggttttcagagaa

SEQ ID NO: 8436622 - DNA, 22 bp, Homo sapiens
tgtcagggatttaaagacacaa

SEQ ID NO: 8436623 - DNA, 22 bp, Homo sapiens
tgtcaggcaaaggaaggtattt

SEQ ID NO: 8436624 - DNA, 22 bp, Homo sapiens
tgtcagggctggacacagctgc

SEQ ID NO: 8436625 - DNA, 21 bp, Homo sapiens
tgtcagaaataagcatgtgat

SEQ ID NO: 8436626 - DNA, 22 bp, Homo sapiens
tgtcactttggggagagttttg

SEQ ID NO: 8436627 - DNA, 22 bp, Homo sapiens
tgtcagttcaattatagtaatt

SEQ ID NO: 8436628 - DNA, 22 bp, Homo sapiens
tgtcagttcagtgattacaaaa

SEQ ID NO: 8436629 - DNA, 22 bp, Homo sapiens
tgtcagttcagtgattacaaaa

SEQ ID NO: 8436630 - DNA, 22 bp, Homo sapiens
tgtcagttaaatgaggtacaag

SEQ ID NO: 8436631 - DNA, 22 bp, Homo sapiens
tgtcagtttagttgaagaaaga

SEQ ID NO: 8436632 - DNA, 22 bp, Homo sapiens
tgtcagtttagttgaagaaaga

SEQ ID NO: 8436633 - DNA, 22 bp, Homo sapiens
tgtcatagtgtggtagcagtgg

SEQ ID NO: 8436634 - DNA, 19 bp, Homo sapiens
tgtcagtgatacatgcttt

SEQ ID NO: 8436635 - DNA, 20 bp, Homo sapiens
tgtcagtgcctgaggcacag

SEQ ID NO: 8436636 - DNA, 22 bp, Homo sapiens
tgtcagtggtagacccagaggt

SEQ ID NO: 8436637 - DNA, 22 bp, Homo sapiens
tgtcagtgtctatgaagaattt

SEQ ID NO: 8436638 - DNA, 22 bp, Homo sapiens
tgtcagtgtctgaggttttata

SEQ ID NO: 8436639 - DNA, 22 bp, Homo sapiens
tgtcatttggactttggtatta

SEQ ID NO: 8436640 - DNA, 22 bp, Homo sapiens
tgtcatttcctgaatgctgagt

SEQ ID NO: 8436641 - DNA, 22 bp, Homo sapiens
tgtcattttatgtatgtggtct

SEQ ID NO: 8436642 - DNA, 22 bp, Homo sapiens
tgtcattttcagcttatgcttc

SEQ ID NO: 8436643 - DNA, 22 bp, Homo sapiens
tgtcattttcatcctaaggagc

SEQ ID NO: 8436644 - DNA, 22 bp, Homo sapiens
tgtcattttctaatctgttgtc

SEQ ID NO: 8436645 - DNA, 22 bp, Homo sapiens
tgtcattttctaatctgttgtc

SEQ ID NO: 8436646 - DNA, 22 bp, Homo sapiens
tgtccagcggcctggctgctga

SEQ ID NO: 8436647 - DNA, 22 bp, Homo sapiens
tgtccagcggcctggctgctga

SEQ ID NO: 8436648 - DNA, 22 bp, Homo sapiens
tgtccaggaccctattctcact

SEQ ID NO: 8436649 - DNA, 22 bp, Homo sapiens
tgtccaggaccctattctcact

SEQ ID NO: 8436650 - DNA, 22 bp, Homo sapiens
tgtccaggcactgggactctag

SEQ ID NO: 8436651 - DNA, 22 bp, Homo sapiens
tgtccaggagtaaaaagacctg

SEQ ID NO: 8436652 - DNA, 22 bp, Homo sapiens
tgtccaggagtaaaaagacctg

SEQ ID NO: 8436653 - DNA, 22 bp, Homo sapiens
tgtccagctgaaggcagcctca

SEQ ID NO: 8436654 - DNA, 22 bp, Homo sapiens
tgtccagctgacattcccttcc

SEQ ID NO: 8436655 - DNA, 22 bp, Homo sapiens
tgtccaggaattgaccctgcaa

SEQ ID NO: 8436656 - DNA, 22 bp, Homo sapiens
tgtcattttctggttagttaat

SEQ ID NO: 8436657 - DNA, 22 bp, Homo sapiens
tgtccagagtcacagagctcaa

SEQ ID NO: 8436658 - DNA, 22 bp, Homo sapiens
tgtccaatgccctttccacatg

SEQ ID NO: 8436659 - DNA, 22 bp, Homo sapiens
tgtcatttactccataccctca

SEQ ID NO: 8436660 - DNA, 22 bp, Homo sapiens
tgtcatttaatagatatgatgg

SEQ ID NO: 8436661 - DNA, 20 bp, Homo sapiens
tgtcatttatttatcaaatg

SEQ ID NO: 8436662 - DNA, 20 bp, Homo sapiens
tgtcatttatttatcaaatg

SEQ ID NO: 8436663 - DNA, 22 bp, Homo sapiens
tgtcatttattctcttattcta

SEQ ID NO: 8436664 - DNA, 22 bp, Homo sapiens
tgtcatttatgcttcttcagtg

SEQ ID NO: 8436665 - DNA, 22 bp, Homo sapiens
tgtcatttagtcctctgtgtgt

SEQ ID NO: 8436666 - DNA, 22 bp, Homo sapiens
tgtcatcagcatataagacagt

SEQ ID NO: 8436667 - DNA, 22 bp, Homo sapiens
tgtcatctggcctgattggtgt

SEQ ID NO: 8436668 - DNA, 22 bp, Homo sapiens
tgtcatcttcactgggtcacaa

SEQ ID NO: 8436669 - DNA, 22 bp, Homo sapiens
tgtcatcttgtccagccaggca

SEQ ID NO: 8436670 - DNA, 22 bp, Homo sapiens
tggtaacacaggcattaaagtt

SEQ ID NO: 8436671 - DNA, 22 bp, Homo sapiens
tggtaactttcagcatggtgac

SEQ ID NO: 8436672 - DNA, 22 bp, Homo sapiens
tggtaagaataggggctttgga

SEQ ID NO: 8436673 - DNA, 22 bp, Homo sapiens
tggtaagataagagccaggcct

SEQ ID NO: 8436674 - DNA, 22 bp, Homo sapiens
tgggttctagagggaccagaac

SEQ ID NO: 8436675 - DNA, 22 bp, Homo sapiens
tgggttcttaaagggctaggtt

SEQ ID NO: 8436676 - DNA, 22 bp, Homo sapiens
tgggttctttcacttctcagtt

SEQ ID NO: 8436677 - DNA, 22 bp, Homo sapiens
tggtatctgtgaatgtgacatt

SEQ ID NO: 8436678 - DNA, 22 bp, Homo sapiens
tggtcaaggcttggagatagta

SEQ ID NO: 8436679 - DNA, 22 bp, Homo sapiens
tggtatgtaataagtgttctaa

SEQ ID NO: 8436680 - DNA, 22 bp, Homo sapiens
tggtatttccaggcttatggta

SEQ ID NO: 8436681 - DNA, 22 bp, Homo sapiens
tgggtgcaggatgagtgctggc

SEQ ID NO: 8436682 - DNA, 22 bp, Homo sapiens
tgggtgccaacctctggtggcc

SEQ ID NO: 8436683 - DNA, 21 bp, Homo sapiens
tgggtggaagcgggaggccgc

SEQ ID NO: 8436684 - DNA, 22 bp, Homo sapiens
tgggtggaataaatcagttctg

SEQ ID NO: 8436685 - DNA, 22 bp, Homo sapiens
tgggtgggagcgccctgtctgg

SEQ ID NO: 8436686 - DNA, 22 bp, Homo sapiens
tgggtgcttcgtcagctctgag

SEQ ID NO: 8436687 - DNA, 22 bp, Homo sapiens
tgggtgcttcgtcagctctgag

SEQ ID NO: 8436688 - DNA, 22 bp, Homo sapiens
tgggtgctctgcgaccgtaggg

SEQ ID NO: 8436689 - DNA, 22 bp, Homo sapiens
tgggttaacagtttataccaga

SEQ ID NO: 8436690 - DNA, 21 bp, Homo sapiens
tgggtgggcagagtctcttca

SEQ ID NO: 8436691 - DNA, 21 bp, Homo sapiens
tgggtgggcagagtctcttca

SEQ ID NO: 8436692 - DNA, 21 bp, Homo sapiens
tgggtgggcagagtctcttca

SEQ ID NO: 8436693 - DNA, 22 bp, Homo sapiens
tgggtgggagcgccctgtctgg

SEQ ID NO: 8436694 - DNA, 16 bp, Homo sapiens
tgggtgggaggagcgg

SEQ ID NO: 8436695 - DNA, 16 bp, Homo sapiens
tgggtgggaggagcgg

SEQ ID NO: 8436696 - DNA, 16 bp, Homo sapiens
tgggtgggaggagcgg

SEQ ID NO: 8436697 - DNA, 22 bp, Homo sapiens
tgggtagaaacaaggctggact

SEQ ID NO: 8436698 - DNA, 22 bp, Homo sapiens
tgggtaggaatcgagtgtatgg

SEQ ID NO: 8436699 - DNA, 22 bp, Homo sapiens
tgggtaaacaatgtttgcctaa

SEQ ID NO: 8436700 - DNA, 22 bp, Homo sapiens
tgggtaaactgggtctggagag

SEQ ID NO: 8436701 - DNA, 23 bp, Homo sapiens
tggggttgaattgtagctgtgcc

SEQ ID NO: 8436702 - DNA, 22 bp, Homo sapiens
tggggttgaagaaaggatctag

SEQ ID NO: 8436703 - DNA, 22 bp, Homo sapiens
tgggtccagtgcagctgcgcgt

SEQ ID NO: 8436704 - DNA, 22 bp, Homo sapiens
tgggtccacggaagacttaggg

SEQ ID NO: 8436705 - DNA, 22 bp, Homo sapiens
tgggtccacttctgcactgtgg

SEQ ID NO: 8436706 - DNA, 22 bp, Homo sapiens
tgggtagggagctggaatccta

SEQ ID NO: 8436707 - DNA, 22 bp, Homo sapiens
tgggtctccagttcagggcagg

SEQ ID NO: 8436708 - DNA, 22 bp, Homo sapiens
tgggtctcctgtgcctgggagg

SEQ ID NO: 8436709 - DNA, 20 bp, Homo sapiens
tgggtctgcttggcttcagt

SEQ ID NO: 8436710 - DNA, 23 bp, Homo sapiens
tgggtctctagtacaggcaggca

SEQ ID NO: 8436711 - DNA, 22 bp, Homo sapiens
tgggtctgtagggctgtccaat

SEQ ID NO: 8436712 - DNA, 22 bp, Homo sapiens
tgggtctccagttcagggcagg

SEQ ID NO: 8436713 - DNA, 22 bp, Homo sapiens
tgggtcctggaaggcgacaggt

SEQ ID NO: 8436714 - DNA, 22 bp, Homo sapiens
tgggtcctttttggacttcttc

SEQ ID NO: 8436715 - DNA, 22 bp, Homo sapiens
tgggtccttgctgattgctgag

SEQ ID NO: 8436716 - DNA, 22 bp, Homo sapiens
tgggtccttgctggcttcaaag

SEQ ID NO: 8436717 - DNA, 22 bp, Homo sapiens
tgggtcctgtctccttgttctg

SEQ ID NO: 8436718 - DNA, 20 bp, Homo sapiens
tgggtcctgtgggagaagaa

SEQ ID NO: 8436719 - DNA, 22 bp, Homo sapiens
tgggtccttcaaagctgggtct

SEQ ID NO: 8436720 - DNA, 22 bp, Homo sapiens
tgggtccttgccatcttggagt

SEQ ID NO: 8436721 - DNA, 22 bp, Homo sapiens
tgggtccttgctaacttctatg

SEQ ID NO: 8436722 - DNA, 22 bp, Homo sapiens
tgggtccatggaacagaggtgc

SEQ ID NO: 8436723 - DNA, 22 bp, Homo sapiens
tgggtccagtgtcctggctatg

SEQ ID NO: 8436724 - DNA, 22 bp, Homo sapiens
tgggtcccaaactcctagaggt

SEQ ID NO: 8436725 - DNA, 22 bp, Homo sapiens
tgggtcccaggaaggaccagca

SEQ ID NO: 8436726 - DNA, 22 bp, Homo sapiens
tgggtcctaaatgcagtcacat

SEQ ID NO: 8436727 - DNA, 22 bp, Homo sapiens
tgggtcctcgtcttccaaggca

SEQ ID NO: 8436728 - DNA, 22 bp, Homo sapiens
tgggtcctggctttgtcagggt

SEQ ID NO: 8436729 - DNA, 22 bp, Homo sapiens
tgggtcctggaaggcgacaggt

SEQ ID NO: 8436730 - DNA, 20 bp, Homo sapiens
tgggtcctgcttcttcctga

SEQ ID NO: 8436731 - DNA, 22 bp, Homo sapiens
tgggtcctgcactgcaagcacc

SEQ ID NO: 8436732 - DNA, 22 bp, Homo sapiens
tgggtcctctggagcagcagca

SEQ ID NO: 8436733 - DNA, 22 bp, Homo sapiens
tgggtcctgcactgcaagcacc

SEQ ID NO: 8436734 - DNA, 20 bp, Homo sapiens
tgggtcctgcacattctcca

SEQ ID NO: 8436735 - DNA, 22 bp, Homo sapiens
tgggtcctctgagagggcagcg

SEQ ID NO: 8436736 - DNA, 22 bp, Homo sapiens
tgggtcctctggagcagcagca

SEQ ID NO: 8436737 - DNA, 22 bp, Homo sapiens
tggggggcatgaacctccacgg

SEQ ID NO: 8436738 - DNA, 18 bp, Homo sapiens
tggggggcttgtctgaag

SEQ ID NO: 8436739 - DNA, 22 bp, Homo sapiens
tgggggtgactatctcgggaat

SEQ ID NO: 8436740 - DNA, 21 bp, Homo sapiens
tgggggtgaggcctaggaatc

SEQ ID NO: 8436741 - DNA, 22 bp, Homo sapiens
tgggggtgactatctcgggaat

SEQ ID NO: 8436742 - DNA, 22 bp, Homo sapiens
tgggggtgaaagtctggacagt

SEQ ID NO: 8436743 - DNA, 22 bp, Homo sapiens
tgggggtgaaagtctggacagt

SEQ ID NO: 8436744 - DNA, 22 bp, Homo sapiens
tgggggtgccctatgaggaagc

SEQ ID NO: 8436745 - DNA, 21 bp, Homo sapiens
tgggggtgaggcctaggaatc

SEQ ID NO: 8436746 - DNA, 20 bp, Homo sapiens
tggggtctagttggcctggg

SEQ ID NO: 8436747 - DNA, 22 bp, Homo sapiens
tggggtctggagttgcccatga

SEQ ID NO: 8436748 - DNA, 22 bp, Homo sapiens
tggggtgccgacagggagggca

SEQ ID NO: 8436749 - DNA, 22 bp, Homo sapiens
tggggtggaacccttctgctgg

SEQ ID NO: 8436750 - DNA, 22 bp, Homo sapiens
tggggtggaacccttctgctgg

SEQ ID NO: 8436751 - DNA, 22 bp, Homo sapiens
tggggtggatagaaagtgatgt

SEQ ID NO: 8436752 - DNA, 22 bp, Homo sapiens
tggggtgggcatgcgctgtcct

SEQ ID NO: 8436753 - DNA, 22 bp, Homo sapiens
tggggtggggttactcattctg

SEQ ID NO: 8436754 - DNA, 22 bp, Homo sapiens
tggggtggtaatacaccgttct

SEQ ID NO: 8436755 - DNA, 22 bp, Homo sapiens
tgggctggcgtggagagtttag

SEQ ID NO: 8436756 - DNA, 18 bp, Homo sapiens
tgggctgcctggcctctg

SEQ ID NO: 8436757 - DNA, 22 bp, Homo sapiens
tgggcttctggagtggggcaga

SEQ ID NO: 8436758 - DNA, 22 bp, Homo sapiens
tggggaaaatgcagaagattac

SEQ ID NO: 8436759 - DNA, 23 bp, Homo sapiens
tgggcttctgagaaagcacctaa

SEQ ID NO: 8436760 - DNA, 19 bp, Homo sapiens
tgggcttccccagggcaga

SEQ ID NO: 8436761 - DNA, 22 bp, Homo sapiens
tgggcttcctggagcctgtgct

SEQ ID NO: 8436762 - DNA, 22 bp, Homo sapiens
tgggcttcataattggtcctag

SEQ ID NO: 8436763 - DNA, 22 bp, Homo sapiens
tgggcttcataattggtcctag

SEQ ID NO: 8436764 - DNA, 22 bp, Homo sapiens
tggggaagacagcagacactgt

SEQ ID NO: 8436765 - DNA, 22 bp, Homo sapiens
tggggaagcactttgaacttaa

SEQ ID NO: 8436766 - DNA, 22 bp, Homo sapiens
tggggaaaggaaagttaacctg

SEQ ID NO: 8436767 - DNA, 22 bp, Homo sapiens
tggggaaaggagagcattattt

SEQ ID NO: 8436768 - DNA, 20 bp, Homo sapiens
tggggaaagccatcgatgag

SEQ ID NO: 8436769 - DNA, 22 bp, Homo sapiens
tggggaaagggatggctcccgc

SEQ ID NO: 8436770 - DNA, 22 bp, Homo sapiens
tggggaaagacattcatacagt

SEQ ID NO: 8436771 - DNA, 22 bp, Homo sapiens
tggggaaagacattcatacagt

SEQ ID NO: 8436772 - DNA, 22 bp, Homo sapiens
tggggaagggcaccctggagac

SEQ ID NO: 8436773 - DNA, 22 bp, Homo sapiens
tggggaagggcaccctggagac

SEQ ID NO: 8436774 - DNA, 22 bp, Homo sapiens
tggggacaggagacttacagct

SEQ ID NO: 8436775 - DNA, 22 bp, Homo sapiens
tggggaaggcggagcttgcagc

SEQ ID NO: 8436776 - DNA, 17 bp, Homo sapiens
tggggaagctcagattt

SEQ ID NO: 8436777 - DNA, 22 bp, Homo sapiens
tggggatgtagaaatgaacaac

SEQ ID NO: 8436778 - DNA, 22 bp, Homo sapiens
tggggatgtaaatgaggtgata

SEQ ID NO: 8436779 - DNA, 22 bp, Homo sapiens
tggggatgtaaatgaggtgata

SEQ ID NO: 8436780 - DNA, 22 bp, Homo sapiens
tggggatgaaacccaggcatct

SEQ ID NO: 8436781 - DNA, 22 bp, Homo sapiens
tggggagtgatgcctcggataa

SEQ ID NO: 8436782 - DNA, 22 bp, Homo sapiens
tggggaggtaacaatttcaggc

SEQ ID NO: 8436783 - DNA, 21 bp, Homo sapiens
tggggaggggacctgattatg

SEQ ID NO: 8436784 - DNA, 22 bp, Homo sapiens
tggggaggttcgggaatcttgt

SEQ ID NO: 8436785 - DNA, 22 bp, Homo sapiens
tggggaggttcgggaatcttgt

SEQ ID NO: 8436786 - DNA, 22 bp, Homo sapiens
tggggacatagccagtctggct

SEQ ID NO: 8436787 - DNA, 22 bp, Homo sapiens
tggggacatagccagtctggct

SEQ ID NO: 8436788 - DNA, 22 bp, Homo sapiens
tggggacccggactcctgggtc

SEQ ID NO: 8436789 - DNA, 22 bp, Homo sapiens
tggggaggaagtcagatttcag

SEQ ID NO: 8436790 - DNA, 22 bp, Homo sapiens
tggggaggatatgtgagttatt

SEQ ID NO: 8436791 - DNA, 23 bp, Homo sapiens
tggggagggaagtcatttctgta

SEQ ID NO: 8436792 - DNA, 23 bp, Homo sapiens
tggggagggaagtcatttctgta

SEQ ID NO: 8436793 - DNA, 22 bp, Homo sapiens
tggggctggggatcttgagcct

SEQ ID NO: 8436794 - DNA, 22 bp, Homo sapiens
tggggctggggatcttgagcct

SEQ ID NO: 8436795 - DNA, 22 bp, Homo sapiens
tggggctgtccttagtctgaga

SEQ ID NO: 8436796 - DNA, 22 bp, Homo sapiens
tggggctggctattgtctccct

SEQ ID NO: 8436797 - DNA, 22 bp, Homo sapiens
tggggctggcacagtctctatt

SEQ ID NO: 8436798 - DNA, 22 bp, Homo sapiens
tgggggagagtgcaagcatgaa

SEQ ID NO: 8436799 - DNA, 22 bp, Homo sapiens
tgggggagagtgcaagcatgaa

SEQ ID NO: 8436800 - DNA, 22 bp, Homo sapiens
tgggggagattgtgcatctcta

SEQ ID NO: 8436801 - DNA, 22 bp, Homo sapiens
tgggggagccttcacagtagct

SEQ ID NO: 8436802 - DNA, 22 bp, Homo sapiens
tgggggcacttcgaggtcgcct

SEQ ID NO: 8436803 - DNA, 22 bp, Homo sapiens
tgggggcacttcgaggtcgcct

SEQ ID NO: 8436804 - DNA, 22 bp, Homo sapiens
tgggggcacttcgaggtcgcct

SEQ ID NO: 8436805 - DNA, 22 bp, Homo sapiens
tgggggagtatagtctggcctc

SEQ ID NO: 8436806 - DNA, 22 bp, Homo sapiens
tgggggagtatagtctggcctc

SEQ ID NO: 8436807 - DNA, 22 bp, Homo sapiens
tgggggcatggaccagcctggc

SEQ ID NO: 8436808 - DNA, 22 bp, Homo sapiens
tgggggcagccaggctgtcaag

SEQ ID NO: 8436809 - DNA, 22 bp, Homo sapiens
tgggggcagccaggctgtcaag

SEQ ID NO: 8436810 - DNA, 22 bp, Homo sapiens
tgggggcagaggattcaggaat

SEQ ID NO: 8436811 - DNA, 22 bp, Homo sapiens
tgggggcatggaccagcctggc

SEQ ID NO: 8436812 - DNA, 22 bp, Homo sapiens
tgggggctccaggctccaggga

SEQ ID NO: 8436813 - DNA, 22 bp, Homo sapiens
tgggggctgggatgtcactttc

SEQ ID NO: 8436814 - DNA, 22 bp, Homo sapiens
tgggggctgagtaagatgagat

SEQ ID NO: 8436815 - DNA, 22 bp, Homo sapiens
tggggccagagctgcagggagc

SEQ ID NO: 8436816 - DNA, 22 bp, Homo sapiens
tggggcagcagacctttcttgg

SEQ ID NO: 8436817 - DNA, 22 bp, Homo sapiens
tggggcagcagacctttcttgg

SEQ ID NO: 8436818 - DNA, 22 bp, Homo sapiens
tggggccagggaggaccagaca

SEQ ID NO: 8436819 - DNA, 22 bp, Homo sapiens
tggggccaggtggctgcaggtc

SEQ ID NO: 8436820 - DNA, 22 bp, Homo sapiens
tggggccatctcacccactgtt

SEQ ID NO: 8436821 - DNA, 19 bp, Homo sapiens
tggggcctcctgtccctgg

SEQ ID NO: 8436822 - DNA, 22 bp, Homo sapiens
tggggcctgaaaggttctcgcc

SEQ ID NO: 8436823 - DNA, 22 bp, Homo sapiens
tggggctctccacagtgtctca

SEQ ID NO: 8436824 - DNA, 22 bp, Homo sapiens
tggggctcctcctggcaggagg

SEQ ID NO: 8436825 - DNA, 22 bp, Homo sapiens
tggggctcacctaggctggaag

SEQ ID NO: 8436826 - DNA, 22 bp, Homo sapiens
tggggctagaatcctgcaggaa

SEQ ID NO: 8436827 - DNA, 22 bp, Homo sapiens
tggggctaaacacgcctggcct

SEQ ID NO: 8436828 - DNA, 22 bp, Homo sapiens
tggggcctgaggtggagctgca

SEQ ID NO: 8436829 - DNA, 22 bp, Homo sapiens
tgggctgagtggcagccagagt

SEQ ID NO: 8436830 - DNA, 21 bp, Homo sapiens
tgggctctttaacccaggcac

SEQ ID NO: 8436831 - DNA, 21 bp, Homo sapiens
tgggctctttaacccaggcac

SEQ ID NO: 8436832 - DNA, 22 bp, Homo sapiens
tgggctctgtgccaggttggtg

SEQ ID NO: 8436833 - DNA, 22 bp, Homo sapiens
tgggctcttcctatagtttata

SEQ ID NO: 8436834 - DNA, 22 bp, Homo sapiens
tgggctctggtttcctggctgg

SEQ ID NO: 8436835 - DNA, 22 bp, Homo sapiens
tgggctctggtttcctggctgg

SEQ ID NO: 8436836 - DNA, 22 bp, Homo sapiens
tgggctctggtttcctggctgg

SEQ ID NO: 8436837 - DNA, 22 bp, Homo sapiens
tgggctgcaccctcagcctctg

SEQ ID NO: 8436838 - DNA, 22 bp, Homo sapiens
tgggctgcaccctcagcctctg

SEQ ID NO: 8436839 - DNA, 22 bp, Homo sapiens
tgggctgagtgtggaactagtt

SEQ ID NO: 8436840 - DNA, 22 bp, Homo sapiens
tgggctgagtgtggaactagtt

SEQ ID NO: 8436841 - DNA, 22 bp, Homo sapiens
tgggctgcagagcccggccttc

SEQ ID NO: 8436842 - DNA, 22 bp, Homo sapiens
tgggctgccctgatggtcctca

SEQ ID NO: 8436843 - DNA, 22 bp, Homo sapiens
tgggctctcacacatgttctga

SEQ ID NO: 8436844 - DNA, 22 bp, Homo sapiens
tgggctctcagtcagactggca

SEQ ID NO: 8436845 - DNA, 22 bp, Homo sapiens
tgggctctctttacctcataac

SEQ ID NO: 8436846 - DNA, 22 bp, Homo sapiens
tgggctctctttacctcataac

SEQ ID NO: 8436847 - DNA, 22 bp, Homo sapiens
tgggctctcgtccctgcagaag

SEQ ID NO: 8436848 - DNA, 22 bp, Homo sapiens
tgggctctcgtccctgcagaag

SEQ ID NO: 8436849 - DNA, 22 bp, Homo sapiens
tgggctctctcacctggaggct

SEQ ID NO: 8436850 - DNA, 22 bp, Homo sapiens
tgggctctggagggcctaggat

SEQ ID NO: 8436851 - DNA, 22 bp, Homo sapiens
tgggctctgggtggcctgagca

SEQ ID NO: 8436852 - DNA, 22 bp, Homo sapiens
tgggctctcagtcagactggca

SEQ ID NO: 8436853 - DNA, 22 bp, Homo sapiens
tgggctctgaagtcagtctgct

SEQ ID NO: 8436854 - DNA, 22 bp, Homo sapiens
tgggctctgaagtcagtctgct

SEQ ID NO: 8436855 - DNA, 22 bp, Homo sapiens
tgggctctgaagtcagtctgct

SEQ ID NO: 8436856 - DNA, 20 bp, Homo sapiens
tgggctctgcttcctggagt

SEQ ID NO: 8436857 - DNA, 22 bp, Homo sapiens
tgggcgacagagcaagactccg

SEQ ID NO: 8436858 - DNA, 22 bp, Homo sapiens
tgggcgacagagcaagactccg

SEQ ID NO: 8436859 - DNA, 22 bp, Homo sapiens
tgggcctgtttcccttcagggc

SEQ ID NO: 8436860 - DNA, 20 bp, Homo sapiens
tgggcctgtggcagaagtct

SEQ ID NO: 8436861 - DNA, 22 bp, Homo sapiens
tgggcctgtggcttggctctag

SEQ ID NO: 8436862 - DNA, 22 bp, Homo sapiens
tgggctcagggaagcttggcct

SEQ ID NO: 8436863 - DNA, 21 bp, Homo sapiens
tgggctcagccccagccctgc

SEQ ID NO: 8436864 - DNA, 22 bp, Homo sapiens
tgggctattaggaccaggccat

SEQ ID NO: 8436865 - DNA, 22 bp, Homo sapiens
tgggctaattctttgattgttt

SEQ ID NO: 8436866 - DNA, 21 bp, Homo sapiens
tgggcgcttgacctctgcact

SEQ ID NO: 8436867 - DNA, 19 bp, Homo sapiens
tgggcctcacaatgctccc

SEQ ID NO: 8436868 - DNA, 22 bp, Homo sapiens
tgggccagtttctcattgaaat

SEQ ID NO: 8436869 - DNA, 22 bp, Homo sapiens
tgggccagttctttactcgtcc

SEQ ID NO: 8436870 - DNA, 22 bp, Homo sapiens
tgggcctccgcatggcccagcg

SEQ ID NO: 8436871 - DNA, 22 bp, Homo sapiens
tgggcctccgcatggcccagcg

SEQ ID NO: 8436872 - DNA, 22 bp, Homo sapiens
tgggcctccgcatggcccagcg

SEQ ID NO: 8436873 - DNA, 22 bp, Homo sapiens
tgggcctcctccgacagccggg

SEQ ID NO: 8436874 - DNA, 22 bp, Homo sapiens
tgggcctcctgccctggcctag

SEQ ID NO: 8436875 - DNA, 22 bp, Homo sapiens
tgggcctcctgccctggcctag

SEQ ID NO: 8436876 - DNA, 22 bp, Homo sapiens
tgggcctcctgccctggcctag

SEQ ID NO: 8436877 - DNA, 22 bp, Homo sapiens
tgggcctcctgccctggcctag

SEQ ID NO: 8436878 - DNA, 22 bp, Homo sapiens
tgggcctcatgcccagccaccc

SEQ ID NO: 8436879 - DNA, 22 bp, Homo sapiens
tgggcctcatgcccagccaccc

SEQ ID NO: 8436880 - DNA, 22 bp, Homo sapiens
tgggcctcatgcccagccaccc

SEQ ID NO: 8436881 - DNA, 21 bp, Homo sapiens
tgggccagtagaaaggaaggc

SEQ ID NO: 8436882 - DNA, 17 bp, Homo sapiens
tgggccagtagaaggga

SEQ ID NO: 8436883 - DNA, 22 bp, Homo sapiens
tgggccagtccagccccaggga

SEQ ID NO: 8436884 - DNA, 22 bp, Homo sapiens
tgggccagggcacccagtccag

SEQ ID NO: 8436885 - DNA, 22 bp, Homo sapiens
tgggccagggcacccagtccag

SEQ ID NO: 8436886 - DNA, 22 bp, Homo sapiens
tgggcctctgtttcctcatctg

SEQ ID NO: 8436887 - DNA, 22 bp, Homo sapiens
tgggcctctgtttcctcatctg

SEQ ID NO: 8436888 - DNA, 20 bp, Homo sapiens
tgggcctctggtgcctctgg

SEQ ID NO: 8436889 - DNA, 20 bp, Homo sapiens
tgggcctctggtgcctctgg

SEQ ID NO: 8436890 - DNA, 22 bp, Homo sapiens
tgggcctcggagcacaggagac

SEQ ID NO: 8436891 - DNA, 22 bp, Homo sapiens
tgggcctcggggaagcccgtgt

SEQ ID NO: 8436892 - DNA, 22 bp, Homo sapiens
tgggcctcggggaagcccgtgt

SEQ ID NO: 8436893 - DNA, 20 bp, Homo sapiens
tgggcctctggtgcctctgg

SEQ ID NO: 8436894 - DNA, 22 bp, Homo sapiens
tgggcctctgccacgctccccc

SEQ ID NO: 8436895 - DNA, 22 bp, Homo sapiens
tgggcctctgggttagtcccta

SEQ ID NO: 8436896 - DNA, 23 bp, Homo sapiens
tgggcctctccacccttttctgt

SEQ ID NO: 8436897 - DNA, 22 bp, Homo sapiens
tgggcctctgccacgctccccc

SEQ ID NO: 8436898 - DNA, 22 bp, Homo sapiens
tgggcctgagtttgggaactgg

SEQ ID NO: 8436899 - DNA, 21 bp, Homo sapiens
tgggcctgattcccagggtca

SEQ ID NO: 8436900 - DNA, 18 bp, Homo sapiens
tgggcctgcatcctagtc

SEQ ID NO: 8436901 - DNA, 22 bp, Homo sapiens
tgggcctgccccaggcttcagc

SEQ ID NO: 8436902 - DNA, 22 bp, Homo sapiens
tgggcctgccccaggcttcagc

SEQ ID NO: 8436903 - DNA, 22 bp, Homo sapiens
tgggcctgccccaggcttcagc

SEQ ID NO: 8436904 - DNA, 22 bp, Homo sapiens
tgggcctgccccaggcttcagc

SEQ ID NO: 8436905 - DNA, 22 bp, Homo sapiens
tgggcctgggctggacagcctg

SEQ ID NO: 8436906 - DNA, 22 bp, Homo sapiens
tgggcctgggctggacagcctg

SEQ ID NO: 8436907 - DNA, 22 bp, Homo sapiens
tgggcagggatctcttttgcaa

SEQ ID NO: 8436908 - DNA, 22 bp, Homo sapiens
tgggcagggatctcttttgcaa

SEQ ID NO: 8436909 - DNA, 22 bp, Homo sapiens
tgggcaggggccctgcttccgt

SEQ ID NO: 8436910 - DNA, 22 bp, Homo sapiens
tgggcaggggccctgcttccgt

SEQ ID NO: 8436911 - DNA, 22 bp, Homo sapiens
tgggcagggagctggaaccaca

SEQ ID NO: 8436912 - DNA, 22 bp, Homo sapiens
tgggcagggagctggaaccaca

SEQ ID NO: 8436913 - DNA, 22 bp, Homo sapiens
tgggcagggagctggaaccaca

SEQ ID NO: 8436914 - DNA, 22 bp, Homo sapiens
tgggcagggagctggaaccaca

SEQ ID NO: 8436915 - DNA, 22 bp, Homo sapiens
tgggcagggagctggaaccaca

SEQ ID NO: 8436916 - DNA, 19 bp, Homo sapiens
tgggcagctccctctgtcc

SEQ ID NO: 8436917 - DNA, 23 bp, Homo sapiens
tgggcagcttctgcatgcccacc

SEQ ID NO: 8436918 - DNA, 23 bp, Homo sapiens
tgggcagcttctgcatgcccacc

SEQ ID NO: 8436919 - DNA, 22 bp, Homo sapiens
tgggcagcagcaaagccagact

SEQ ID NO: 8436920 - DNA, 22 bp, Homo sapiens
tgggcagagtcgtggggaatag

SEQ ID NO: 8436921 - DNA, 22 bp, Homo sapiens
tgggccacgggggtggagagct

SEQ ID NO: 8436922 - DNA, 22 bp, Homo sapiens
tgggccacgggggtggagagct

SEQ ID NO: 8436923 - DNA, 22 bp, Homo sapiens
tgggccagcaattgctgctcag

SEQ ID NO: 8436924 - DNA, 22 bp, Homo sapiens
tgggccacctgctctgtttcta

SEQ ID NO: 8436925 - DNA, 22 bp, Homo sapiens
tgggccacaagccatgggacca

SEQ ID NO: 8436926 - DNA, 22 bp, Homo sapiens
tgggccagctgaagtgccgccc

SEQ ID NO: 8436927 - DNA, 22 bp, Homo sapiens
tgggccagctgaagtgccgccc

SEQ ID NO: 8436928 - DNA, 22 bp, Homo sapiens
tgggccagcactgggtgctcat

SEQ ID NO: 8436929 - DNA, 22 bp, Homo sapiens
tgggccagctccctgcccctgg

SEQ ID NO: 8436930 - DNA, 22 bp, Homo sapiens
tgggccagctccctgcccctgg

SEQ ID NO: 8436931 - DNA, 22 bp, Homo sapiens
tgggccagctccctgcccctgg

SEQ ID NO: 8436932 - DNA, 19 bp, Homo sapiens
tgggcaggttcagtaatgg

SEQ ID NO: 8436933 - DNA, 22 bp, Homo sapiens
tgggcaggtgctattttccatg

SEQ ID NO: 8436934 - DNA, 22 bp, Homo sapiens
tgggcaggggccctgcttccgt

SEQ ID NO: 8436935 - DNA, 22 bp, Homo sapiens
tgggcagggtctctgttatcag

SEQ ID NO: 8436936 - DNA, 22 bp, Homo sapiens
tgggcaggttgttatttgacat

SEQ ID NO: 8436937 - DNA, 22 bp, Homo sapiens
tgggcagtggctgggcctctct

SEQ ID NO: 8436938 - DNA, 22 bp, Homo sapiens
tgggcagtgagaaaggtcaggt

SEQ ID NO: 8436939 - DNA, 22 bp, Homo sapiens
tgggcatcgttcccttggctat

SEQ ID NO: 8436940 - DNA, 22 bp, Homo sapiens
tgggcatgagtggacagagaag

SEQ ID NO: 8436941 - DNA, 22 bp, Homo sapiens
tgggagtccaaggtttttatag

SEQ ID NO: 8436942 - DNA, 22 bp, Homo sapiens
tgggagtactatgtgataggat

SEQ ID NO: 8436943 - DNA, 22 bp, Homo sapiens
tgggaggccgaggcaggtggat

SEQ ID NO: 8436944 - DNA, 22 bp, Homo sapiens
tgggaggcagaagttgactgga

SEQ ID NO: 8436945 - DNA, 22 bp, Homo sapiens
tgggaggcaggtaggtgatgat

SEQ ID NO: 8436946 - DNA, 22 bp, Homo sapiens
tgggaggcaggtaggtgatgat

SEQ ID NO: 8436947 - DNA, 22 bp, Homo sapiens
tgggaggccaaggcaggcggat

SEQ ID NO: 8436948 - DNA, 22 bp, Homo sapiens
tgggaggccgaggcaggtggat

SEQ ID NO: 8436949 - DNA, 22 bp, Homo sapiens
tgggaggcccaggcctggcagg

SEQ ID NO: 8436950 - DNA, 22 bp, Homo sapiens
tgggaggcccaggcctggcagg

SEQ ID NO: 8436951 - DNA, 22 bp, Homo sapiens
tgggatctgcagtttaacaaaa

SEQ ID NO: 8436952 - DNA, 22 bp, Homo sapiens
tgggatcttttgagatactgtg

SEQ ID NO: 8436953 - DNA, 22 bp, Homo sapiens
tgggatgagctatatagaaagt

SEQ ID NO: 8436954 - DNA, 23 bp, Homo sapiens
tgggatagaatttcatggctgct

SEQ ID NO: 8436955 - DNA, 22 bp, Homo sapiens
tgggatgataggtaagtaatta

SEQ ID NO: 8436956 - DNA, 19 bp, Homo sapiens
tgggatgatgcagaaggta

SEQ ID NO: 8436957 - DNA, 23 bp, Homo sapiens
tgggatggattcaccagtgtgct

SEQ ID NO: 8436958 - DNA, 22 bp, Homo sapiens
tgggatgtctttaggggaagag

SEQ ID NO: 8436959 - DNA, 21 bp, Homo sapiens
tgggatgggtctgggaccagc

SEQ ID NO: 8436960 - DNA, 22 bp, Homo sapiens
tgggcaaatgtcactttctttt

SEQ ID NO: 8436961 - DNA, 22 bp, Homo sapiens
tgggcaaactgtcaaccatgtc

SEQ ID NO: 8436962 - DNA, 22 bp, Homo sapiens
tgggcaaaggctgtaacccatc

SEQ ID NO: 8436963 - DNA, 22 bp, Homo sapiens
tgggcaaagtcacatacatgat

SEQ ID NO: 8436964 - DNA, 22 bp, Homo sapiens
tgggcaaatgctttttagtcaa

SEQ ID NO: 8436965 - DNA, 22 bp, Homo sapiens
tgggcaagtatcggactctgag

SEQ ID NO: 8436966 - DNA, 22 bp, Homo sapiens
tgggcacaaacatctgcctgtt

SEQ ID NO: 8436967 - DNA, 22 bp, Homo sapiens
tgggcacagaatagatggccca

SEQ ID NO: 8436968 - DNA, 18 bp, Homo sapiens
tgggcacaatgaacagca

SEQ ID NO: 8436969 - DNA, 22 bp, Homo sapiens
tgggcacctgaggcctggcagg

SEQ ID NO: 8436970 - DNA, 22 bp, Homo sapiens
tgggcactcctggggacagctg

SEQ ID NO: 8436971 - DNA, 21 bp, Homo sapiens
tgggcaccaaaacctaggagt

SEQ ID NO: 8436972 - DNA, 22 bp, Homo sapiens
tgggcacaggggaatggatgaa

SEQ ID NO: 8436973 - DNA, 20 bp, Homo sapiens
tgggcacagctttggagggc

SEQ ID NO: 8436974 - DNA, 22 bp, Homo sapiens
tgggcacaggggtaggaatgag

SEQ ID NO: 8436975 - DNA, 22 bp, Homo sapiens
tgggcacaggggtaggaatgag

SEQ ID NO: 8436976 - DNA, 22 bp, Homo sapiens
tgggcacaggggtaggaatgag

SEQ ID NO: 8436977 - DNA, 22 bp, Homo sapiens
tgggcagaggacagggaagatc

SEQ ID NO: 8436978 - DNA, 22 bp, Homo sapiens
tgggcagagtcatacaggagac

SEQ ID NO: 8436979 - DNA, 22 bp, Homo sapiens
tgttagcagagcagctgacaga

SEQ ID NO: 8436980 - DNA, 22 bp, Homo sapiens
tgttagaagttaatcactaatt

SEQ ID NO: 8436981 - DNA, 22 bp, Homo sapiens
tgttctttgctgttgatgtaga

SEQ ID NO: 8436982 - DNA, 22 bp, Homo sapiens
tgttctttgctgttgatgtaga

SEQ ID NO: 8436983 - DNA, 22 bp, Homo sapiens
tgttctttgccagtgatttaat

SEQ ID NO: 8436984 - DNA, 22 bp, Homo sapiens
tgttctttgccagtgatttaat

SEQ ID NO: 8436985 - DNA, 22 bp, Homo sapiens
tgttctttgccagtgatttaat

SEQ ID NO: 8436986 - DNA, 22 bp, Homo sapiens
tgttctttggcttcctttccgt

SEQ ID NO: 8436987 - DNA, 22 bp, Homo sapiens
tgttctttggcttcacagctct

SEQ ID NO: 8436988 - DNA, 22 bp, Homo sapiens
tgttctttagcagaccatgttg

SEQ ID NO: 8436989 - DNA, 22 bp, Homo sapiens
tgttctttagcagaccatgttg

SEQ ID NO: 8436990 - DNA, 22 bp, Homo sapiens
tgttctttagcagaccatgttg

SEQ ID NO: 8436991 - DNA, 22 bp, Homo sapiens
tgttctttcagttagacacagt

SEQ ID NO: 8436992 - DNA, 22 bp, Homo sapiens
tgttaagaagaggcagtactta

SEQ ID NO: 8436993 - DNA, 22 bp, Homo sapiens
tgttacagtgactaatgtttta

SEQ ID NO: 8436994 - DNA, 22 bp, Homo sapiens
tgttacagtggctttttaaaca

SEQ ID NO: 8436995 - DNA, 22 bp, Homo sapiens
tgttactattagtttgagcata

SEQ ID NO: 8436996 - DNA, 22 bp, Homo sapiens
tgttagaaaggctattggacca

SEQ ID NO: 8436997 - DNA, 22 bp, Homo sapiens
tgttagaaattattagtaatat

SEQ ID NO: 8436998 - DNA, 22 bp, Homo sapiens
tgttactgtggttaccagaagc

SEQ ID NO: 8436999 - DNA, 22 bp, Homo sapiens
tgttactctggggttgtggtga

SEQ ID NO: 8437000 - DNA, 22 bp, Homo sapiens
tgttactccttccctactcatg

SEQ ID NO: 8437001 - DNA, 22 bp, Homo sapiens
tgttactgatttgatatacagt

SEQ ID NO: 8437002 - DNA, 18 bp, Homo sapiens
tgttaaatgaagatttgc

SEQ ID NO: 8437003 - DNA, 18 bp, Homo sapiens
tgttaaatgaagatttgc

SEQ ID NO: 8437004 - DNA, 22 bp, Homo sapiens
tgttaaatgtattatgtgttct

SEQ ID NO: 8437005 - DNA, 22 bp, Homo sapiens
tgttaaatgctcagctcgggga

SEQ ID NO: 8437006 - DNA, 22 bp, Homo sapiens
tgttaacagaggtcattttggg

SEQ ID NO: 8437007 - DNA, 22 bp, Homo sapiens
tgttaacagccagatttggtga

SEQ ID NO: 8437008 - DNA, 22 bp, Homo sapiens
tgttaacacaattctggagaga

SEQ ID NO: 8437009 - DNA, 22 bp, Homo sapiens
tgttaacaaaggttggctgggc

SEQ ID NO: 8437010 - DNA, 22 bp, Homo sapiens
tgttaacatactgctttctaat

SEQ ID NO: 8437011 - DNA, 15 bp, Homo sapiens
tgttaacagctggga

SEQ ID NO: 8437012 - DNA, 22 bp, Homo sapiens
tgttaacaggtaactgaggctg

SEQ ID NO: 8437013 - DNA, 22 bp, Homo sapiens
tgttaacatgtgtattgtatga

SEQ ID NO: 8437014 - DNA, 22 bp, Homo sapiens
tgttaacatagtggcgcatctg

SEQ ID NO: 8437015 - DNA, 22 bp, Homo sapiens
tgttaaatgttttgctagtgtc

SEQ ID NO: 8437016 - DNA, 22 bp, Homo sapiens
tgttaaatgttcctttactgga

SEQ ID NO: 8437017 - DNA, 22 bp, Homo sapiens
tgtttatgcatcgttaatacca

SEQ ID NO: 8437018 - DNA, 22 bp, Homo sapiens
tgtttatagatggccacaatga

SEQ ID NO: 8437019 - DNA, 22 bp, Homo sapiens
tgtttataccttggtataacca

SEQ ID NO: 8437020 - DNA, 22 bp, Homo sapiens
tgtttactcctgatatattttt

SEQ ID NO: 8437021 - DNA, 22 bp, Homo sapiens
tgtttactgcattctatttgct

SEQ ID NO: 8437022 - DNA, 21 bp, Homo sapiens
tgtttactccctgcaagcacg

SEQ ID NO: 8437023 - DNA, 22 bp, Homo sapiens
tgtttaaatagaacatactgca

SEQ ID NO: 8437024 - DNA, 22 bp, Homo sapiens
tgtttaaatagaacatactgca

SEQ ID NO: 8437025 - DNA, 22 bp, Homo sapiens
tgttggggtcaggagctagcct

SEQ ID NO: 8437026 - DNA, 19 bp, Homo sapiens
tgttggtgcggatgtggag

SEQ ID NO: 8437027 - DNA, 22 bp, Homo sapiens
tgttgactggtaactttaaaca

SEQ ID NO: 8437028 - DNA, 22 bp, Homo sapiens
tgttgacttgaaccaaagtgtt

SEQ ID NO: 8437029 - DNA, 22 bp, Homo sapiens
tgttgagtatatacctacaagt

SEQ ID NO: 8437030 - DNA, 18 bp, Homo sapiens
tgtttatttttctcttac

SEQ ID NO: 8437031 - DNA, 22 bp, Homo sapiens
tgtttgtgctgcctggtgggca

SEQ ID NO: 8437032 - DNA, 22 bp, Homo sapiens
tgtttgtatggacctgttctat

SEQ ID NO: 8437033 - DNA, 22 bp, Homo sapiens
tgtttgtatggacctgttctat

SEQ ID NO: 8437034 - DNA, 22 bp, Homo sapiens
tgtttgtagagacagctgatgc

SEQ ID NO: 8437035 - DNA, 22 bp, Homo sapiens
tgttttaatctcccattgctct

SEQ ID NO: 8437036 - DNA, 22 bp, Homo sapiens
tgttttaagggtcaactgtcac

SEQ ID NO: 8437037 - DNA, 23 bp, Homo sapiens
tgtttgtttctatgagagatagc

SEQ ID NO: 8437038 - DNA, 22 bp, Homo sapiens
tgttttaagctctagaagggga

SEQ ID NO: 8437039 - DNA, 22 bp, Homo sapiens
tgttttatgagccatataacct

SEQ ID NO: 8437040 - DNA, 22 bp, Homo sapiens
tgtttttccatgtgcagaacaa

SEQ ID NO: 8437041 - DNA, 22 bp, Homo sapiens
tgtttttccatgtgcagaacaa

SEQ ID NO: 8437042 - DNA, 22 bp, Homo sapiens
ttaaaatttccccaccatgtat

SEQ ID NO: 8437043 - DNA, 22 bp, Homo sapiens
ttaaaaccatcagctgtaagat

SEQ ID NO: 8437044 - DNA, 22 bp, Homo sapiens
ttaaaagagacttcctttgttt

SEQ ID NO: 8437045 - DNA, 22 bp, Homo sapiens
ttaaaagacctgttgaggttag

SEQ ID NO: 8437046 - DNA, 22 bp, Homo sapiens
ttaaaagacctgttgaggttag

SEQ ID NO: 8437047 - DNA, 22 bp, Homo sapiens
ttaaaacagcgtgaatctggca

SEQ ID NO: 8437048 - DNA, 22 bp, Homo sapiens
ttaaaaaccatcttcctttcct

SEQ ID NO: 8437049 - DNA, 17 bp, Homo sapiens
tgttttttccctgttct

SEQ ID NO: 8437050 - DNA, 22 bp, Homo sapiens
tgttttttccttatgcaatctg

SEQ ID NO: 8437051 - DNA, 22 bp, Homo sapiens
tgtggctgcaaaggaaggctgc

SEQ ID NO: 8437052 - DNA, 22 bp, Homo sapiens
tgtggctgcaaaggaaggctgc

SEQ ID NO: 8437053 - DNA, 22 bp, Homo sapiens
tgtggctgcagacactggagcc

SEQ ID NO: 8437054 - DNA, 22 bp, Homo sapiens
tgtggctgcaggcgatggagga

SEQ ID NO: 8437055 - DNA, 22 bp, Homo sapiens
tgtgggaagagcagtggcagca

SEQ ID NO: 8437056 - DNA, 22 bp, Homo sapiens
tgtggctgccaccctgaagccg

SEQ ID NO: 8437057 - DNA, 22 bp, Homo sapiens
tgtgggaagatgttgcaggaga

SEQ ID NO: 8437058 - DNA, 22 bp, Homo sapiens
tgtgggaatcagccaggggggc

SEQ ID NO: 8437059 - DNA, 22 bp, Homo sapiens
tgtgggaagtttggagggaaag

SEQ ID NO: 8437060 - DNA, 23 bp, Homo sapiens
tgtgggaatgttggagaggaaac

SEQ ID NO: 8437061 - DNA, 22 bp, Homo sapiens
tgtgggaatgacgaggaagagg

SEQ ID NO: 8437062 - DNA, 22 bp, Homo sapiens
tgtgggaggaacacagccagaa

SEQ ID NO: 8437063 - DNA, 22 bp, Homo sapiens
tgtgggagaaggaagcaagctg

SEQ ID NO: 8437064 - DNA, 22 bp, Homo sapiens
tgtgggagaaggaagcaagctg

SEQ ID NO: 8437065 - DNA, 22 bp, Homo sapiens
tgtggaatgctcctaagtgaat

SEQ ID NO: 8437066 - DNA, 22 bp, Homo sapiens
tgtggccttgcagcctggaggt

SEQ ID NO: 8437067 - DNA, 22 bp, Homo sapiens
tgtggaaggggccccatgacca

SEQ ID NO: 8437068 - DNA, 22 bp, Homo sapiens
tgtggaagtgccaatgacaaat

SEQ ID NO: 8437069 - DNA, 22 bp, Homo sapiens
tgtggaagccggtgggaagcag

SEQ ID NO: 8437070 - DNA, 22 bp, Homo sapiens
tgtggctctgcctggcagtatt

SEQ ID NO: 8437071 - DNA, 22 bp, Homo sapiens
tgtggctctcctcctgctgccc

SEQ ID NO: 8437072 - DNA, 22 bp, Homo sapiens
tgtggctgactcctggtcccca

SEQ ID NO: 8437073 - DNA, 23 bp, Homo sapiens
tgtggctgagaaattgacaactt

SEQ ID NO: 8437074 - DNA, 21 bp, Homo sapiens
tgtggctgacaccctttggga

SEQ ID NO: 8437075 - DNA, 19 bp, Homo sapiens
tgtggctgagcactcctta

SEQ ID NO: 8437076 - DNA, 19 bp, Homo sapiens
tgtggctgagcactcctta

SEQ ID NO: 8437077 - DNA, 22 bp, Homo sapiens
tgtggctgatcaaagcgctcag

SEQ ID NO: 8437078 - DNA, 22 bp, Homo sapiens
tgtgggatggttttgccagaat

SEQ ID NO: 8437079 - DNA, 22 bp, Homo sapiens
tgtgggaggtctggaaggctcc

SEQ ID NO: 8437080 - DNA, 22 bp, Homo sapiens
tgtgggaggtctggaaggctcc

SEQ ID NO: 8437081 - DNA, 22 bp, Homo sapiens
tgtgggaggaattagaatggga

SEQ ID NO: 8437082 - DNA, 22 bp, Homo sapiens
tgtgggaggaattagaatggga

SEQ ID NO: 8437083 - DNA, 22 bp, Homo sapiens
tgtgggaggattcagaattggg

SEQ ID NO: 8437084 - DNA, 23 bp, Homo sapiens
tgtgggcgcattgtaagggtagc

SEQ ID NO: 8437085 - DNA, 22 bp, Homo sapiens
tgtgggctgtactgagggcagg

SEQ ID NO: 8437086 - DNA, 22 bp, Homo sapiens
tgtgtacacaatgattgcagag

SEQ ID NO: 8437087 - DNA, 22 bp, Homo sapiens
tgtggggacccatgccatgggc

SEQ ID NO: 8437088 - DNA, 22 bp, Homo sapiens
tgtggggacccatgccatgggc

SEQ ID NO: 8437089 - DNA, 22 bp, Homo sapiens
tgtggggactgagtggaggctt

SEQ ID NO: 8437090 - DNA, 22 bp, Homo sapiens
tgtgtacacgagaggttatata

SEQ ID NO: 8437091 - DNA, 22 bp, Homo sapiens
tgttaaaaattcagctctagat

SEQ ID NO: 8437092 - DNA, 22 bp, Homo sapiens
tgtgttaagtatttgatacact

SEQ ID NO: 8437093 - DNA, 22 bp, Homo sapiens
tgttaaaaccacaggtgaggac

SEQ ID NO: 8437094 - DNA, 22 bp, Homo sapiens
tgttaaaaccacaggtgaggac

SEQ ID NO: 8437095 - DNA, 22 bp, Homo sapiens
tgtgtgtgtttctgctcataca

SEQ ID NO: 8437096 - DNA, 22 bp, Homo sapiens
tgtgtgtgcaggagagcaggtg

SEQ ID NO: 8437097 - DNA, 22 bp, Homo sapiens
tgtgtgtggggaggcagcagat

SEQ ID NO: 8437098 - DNA, 22 bp, Homo sapiens
tgtgtgtgttcctcctcagcta

SEQ ID NO: 8437099 - DNA, 22 bp, Homo sapiens
tgtgtgtgttcctcctcagcta

SEQ ID NO: 8437100 - DNA, 22 bp, Homo sapiens
tgtgtcagaatttttgtggcaa

SEQ ID NO: 8437101 - DNA, 22 bp, Homo sapiens
tgtgtgcatgcttggggcagca

SEQ ID NO: 8437102 - DNA, 22 bp, Homo sapiens
tgtgtgcatgttaatgagaaaa

SEQ ID NO: 8437103 - DNA, 22 bp, Homo sapiens
tgtgtgtgagtcctggctttcc

SEQ ID NO: 8437104 - DNA, 22 bp, Homo sapiens
tgtctagaggccaacaggaaag

SEQ ID NO: 8437105 - DNA, 22 bp, Homo sapiens
tgtctagaggccaacaggaaag

SEQ ID NO: 8437106 - DNA, 22 bp, Homo sapiens
tgtctagacattagcttcagct

SEQ ID NO: 8437107 - DNA, 22 bp, Homo sapiens
tgtctagacaagaagtattgcc

SEQ ID NO: 8437108 - DNA, 22 bp, Homo sapiens
tgtctacttgggctctacagca

SEQ ID NO: 8437109 - DNA, 22 bp, Homo sapiens
tgtctaaatgaaaagagatgcc

SEQ ID NO: 8437110 - DNA, 22 bp, Homo sapiens
tgtcgggcatgcattctgagaa

SEQ ID NO: 8437111 - DNA, 22 bp, Homo sapiens
tgtcgcagctgaaaatctcaat

SEQ ID NO: 8437112 - DNA, 22 bp, Homo sapiens
tgtcgattcagctcttcagaga

SEQ ID NO: 8437113 - DNA, 22 bp, Homo sapiens
tgtctaacccagtggcaggagg

SEQ ID NO: 8437114 - DNA, 22 bp, Homo sapiens
tgtctccacaggtgtcagctca

SEQ ID NO: 8437115 - DNA, 20 bp, Homo sapiens
tgtctccagggctgagtgga

SEQ ID NO: 8437116 - DNA, 22 bp, Homo sapiens
tgtctccaccatcatcttacca

SEQ ID NO: 8437117 - DNA, 22 bp, Homo sapiens
tgtctccagaaagcaccaggag

SEQ ID NO: 8437118 - DNA, 22 bp, Homo sapiens
tgtctccatagaagagactgca

SEQ ID NO: 8437119 - DNA, 22 bp, Homo sapiens
tgtctccaggggcaggccagcc

SEQ ID NO: 8437120 - DNA, 22 bp, Homo sapiens
tgtctccaactcactgtatact

SEQ ID NO: 8437121 - DNA, 22 bp, Homo sapiens
tgtctccaaaacaatctcagat

SEQ ID NO: 8437122 - DNA, 22 bp, Homo sapiens
tgtctctccacacagccagtgc

SEQ ID NO: 8437123 - DNA, 22 bp, Homo sapiens
tgtctcctcaactcatgctcga

SEQ ID NO: 8437124 - DNA, 22 bp, Homo sapiens
tgtctccattttcaagtagcag

SEQ ID NO: 8437125 - DNA, 22 bp, Homo sapiens
tgtctccatagagtagcttgat

SEQ ID NO: 8437126 - DNA, 23 bp, Homo sapiens
tgtctccatctcattacttgggg

SEQ ID NO: 8437127 - DNA, 22 bp, Homo sapiens
tgtctccatggtgaagcagggt

SEQ ID NO: 8437128 - DNA, 22 bp, Homo sapiens
tgtctcctactgcctgtggatc

SEQ ID NO: 8437129 - DNA, 22 bp, Homo sapiens
tgtctccatgtgatagtggcct

SEQ ID NO: 8437130 - DNA, 22 bp, Homo sapiens
tgtctgcagaagatggcatggg

SEQ ID NO: 8437131 - DNA, 22 bp, Homo sapiens
tgtctgagtggtgcaaggctga

SEQ ID NO: 8437132 - DNA, 22 bp, Homo sapiens
tgtctgagctttatgatggaag

SEQ ID NO: 8437133 - DNA, 22 bp, Homo sapiens
tgtctgagtcatgcagagatat

SEQ ID NO: 8437134 - DNA, 22 bp, Homo sapiens
tgtctgagtgcatatgtgctgg

SEQ ID NO: 8437135 - DNA, 22 bp, Homo sapiens
tgtctgaagcagccagtgctgt

SEQ ID NO: 8437136 - DNA, 22 bp, Homo sapiens
tgtctctgaaatatgtggctcc

SEQ ID NO: 8437137 - DNA, 18 bp, Homo sapiens
tgtctctgaattccagtg

SEQ ID NO: 8437138 - DNA, 19 bp, Homo sapiens
tgtctctgaaagatgagct

SEQ ID NO: 8437139 - DNA, 22 bp, Homo sapiens
tgtctctgaaatatgtggctcc

SEQ ID NO: 8437140 - DNA, 22 bp, Homo sapiens
tgtctctgataagtagttcagt

SEQ ID NO: 8437141 - DNA, 22 bp, Homo sapiens
tgtctctgagatgactcccacc

SEQ ID NO: 8437142 - DNA, 22 bp, Homo sapiens
tgtctctgctttccttgcaggg

SEQ ID NO: 8437143 - DNA, 22 bp, Homo sapiens
tgtctctgctttccttgcaggg

SEQ ID NO: 8437144 - DNA, 22 bp, Homo sapiens
tgtctctgccagctagcagaat

SEQ ID NO: 8437145 - DNA, 23 bp, Homo sapiens
tgtcttcgactcctgcgtgcttc

SEQ ID NO: 8437146 - DNA, 22 bp, Homo sapiens
tgtcttcgctacaatgaaaagg

SEQ ID NO: 8437147 - DNA, 20 bp, Homo sapiens
tgtcttcattatggtgccct

SEQ ID NO: 8437148 - DNA, 20 bp, Homo sapiens
tgtcttcattatggtgccct

SEQ ID NO: 8437149 - DNA, 22 bp, Homo sapiens
tgtcttcatgcctgaaagaaga

SEQ ID NO: 8437150 - DNA, 22 bp, Homo sapiens
tgtcttcagtaaaatacactat

SEQ ID NO: 8437151 - DNA, 22 bp, Homo sapiens
tgtcttcaggagtaaatatcat

SEQ ID NO: 8437152 - DNA, 22 bp, Homo sapiens
tgtcttcatctccatgcacaga

SEQ ID NO: 8437153 - DNA, 21 bp, Homo sapiens
tgtcttcatatgagatggtgt

SEQ ID NO: 8437154 - DNA, 22 bp, Homo sapiens
tgtctttaaaattaaacacatc

SEQ ID NO: 8437155 - DNA, 22 bp, Homo sapiens
tgtctttaagcaaacagtgttt

SEQ ID NO: 8437156 - DNA, 22 bp, Homo sapiens
tgtcttgactttagagccagga

SEQ ID NO: 8437157 - DNA, 17 bp, Homo sapiens
tgtcttctgaagagagc

SEQ ID NO: 8437158 - DNA, 22 bp, Homo sapiens
tgtcttcgctacaatgaaaagg

SEQ ID NO: 8437159 - DNA, 22 bp, Homo sapiens
tgtcttttgccaaagatcagtt

SEQ ID NO: 8437160 - DNA, 22 bp, Homo sapiens
tgtcttttctactgtaagcata

SEQ ID NO: 8437161 - DNA, 22 bp, Homo sapiens
tgtcttttacctaatgagctgg

SEQ ID NO: 8437162 - DNA, 22 bp, Homo sapiens
tgtcttttagtttgtgagatct

SEQ ID NO: 8437163 - DNA, 22 bp, Homo sapiens
tgtcttttagtttgtgagatct

SEQ ID NO: 8437164 - DNA, 22 bp, Homo sapiens
tgtcttttataactgacatata

SEQ ID NO: 8437165 - DNA, 22 bp, Homo sapiens
tgtctttaattctacatatctc

SEQ ID NO: 8437166 - DNA, 22 bp, Homo sapiens
tgtcttttacctaatgagctgg

SEQ ID NO: 8437167 - DNA, 22 bp, Homo sapiens
tgtcttttacctaatgagctgg

SEQ ID NO: 8437168 - DNA, 22 bp, Homo sapiens
tgtgaaaaaagttctagaagga

SEQ ID NO: 8437169 - DNA, 22 bp, Homo sapiens
tgtctttttactatgttcaatc

SEQ ID NO: 8437170 - DNA, 22 bp, Homo sapiens
tgtcttttggagcatctttctt

SEQ ID NO: 8437171 - DNA, 22 bp, Homo sapiens
tgtcttttggagcatctttctt

SEQ ID NO: 8437172 - DNA, 22 bp, Homo sapiens
tgtctttttacctgtgatgagt

SEQ ID NO: 8437173 - DNA, 22 bp, Homo sapiens
tgtcttcagcagtcatctgggg

SEQ ID NO: 8437174 - DNA, 22 bp, Homo sapiens
tgtcttcagaattaagagtatg

SEQ ID NO: 8437175 - DNA, 22 bp, Homo sapiens
tgtcttattgcctttgtaattt

SEQ ID NO: 8437176 - DNA, 22 bp, Homo sapiens
tgtcttcaaatattgaaatcct

SEQ ID NO: 8437177 - DNA, 22 bp, Homo sapiens
tgtctgtgatttaggccagggc

SEQ ID NO: 8437178 - DNA, 22 bp, Homo sapiens
tgtctgtggcaattgtgggtaa

SEQ ID NO: 8437179 - DNA, 22 bp, Homo sapiens
tgtctgtgtgagcaaatgactt

SEQ ID NO: 8437180 - DNA, 22 bp, Homo sapiens
tgtctgggagggacagggctac

SEQ ID NO: 8437181 - DNA, 23 bp, Homo sapiens
tgtctggctcatggtgggtctca

SEQ ID NO: 8437182 - DNA, 22 bp, Homo sapiens
tgtctggcatagttgctccctg

SEQ ID NO: 8437183 - DNA, 22 bp, Homo sapiens
tgtctggcatagttgctccctg

SEQ ID NO: 8437184 - DNA, 22 bp, Homo sapiens
tgtctgggatgttggcagccac

SEQ ID NO: 8437185 - DNA, 22 bp, Homo sapiens
tgtctgggatgttggcagccac

SEQ ID NO: 8437186 - DNA, 22 bp, Homo sapiens
tgtctgggatgttggcagccac

SEQ ID NO: 8437187 - DNA, 22 bp, Homo sapiens
tgtctgtgacagacctttgcta

SEQ ID NO: 8437188 - DNA, 22 bp, Homo sapiens
tgtctgtgacctcttaggcaag

SEQ ID NO: 8437189 - DNA, 22 bp, Homo sapiens
tgtgctcttctgttacttgtag

SEQ ID NO: 8437190 - DNA, 22 bp, Homo sapiens
tgtgctgagtgatcccattcct

SEQ ID NO: 8437191 - DNA, 22 bp, Homo sapiens
tgtgctgctctcagtgacagcc

SEQ ID NO: 8437192 - DNA, 22 bp, Homo sapiens
tgtgctaagtattttcttattt

SEQ ID NO: 8437193 - DNA, 22 bp, Homo sapiens
tgtgcctgtgacagcgacctgg

SEQ ID NO: 8437194 - DNA, 22 bp, Homo sapiens
tgtgcctgttcccactttgcct

SEQ ID NO: 8437195 - DNA, 22 bp, Homo sapiens
tgtgcctgtcccgcattctggt

SEQ ID NO: 8437196 - DNA, 22 bp, Homo sapiens
tgtgcctggagtccctgaggag

SEQ ID NO: 8437197 - DNA, 22 bp, Homo sapiens
tgtgcctgatggtcacgtggcc

SEQ ID NO: 8437198 - DNA, 22 bp, Homo sapiens
tgtgcctgagtctcggcccacc

SEQ ID NO: 8437199 - DNA, 22 bp, Homo sapiens
tgtgcctggcattctgggcttc

SEQ ID NO: 8437200 - DNA, 22 bp, Homo sapiens
tgtgcctggcattctgggcttc

SEQ ID NO: 8437201 - DNA, 22 bp, Homo sapiens
tgtgccctgttaaatgcacagt

SEQ ID NO: 8437202 - DNA, 22 bp, Homo sapiens
tgtgcatgacagcatacaaacg

SEQ ID NO: 8437203 - DNA, 22 bp, Homo sapiens
tgtgcatcttgcctggatgttt

SEQ ID NO: 8437204 - DNA, 22 bp, Homo sapiens
tgtgcaacatgagacagaacag

SEQ ID NO: 8437205 - DNA, 22 bp, Homo sapiens
tgtgcaacatgagacagaacag

SEQ ID NO: 8437206 - DNA, 22 bp, Homo sapiens
tgtgcaactccttccacagaca

SEQ ID NO: 8437207 - DNA, 22 bp, Homo sapiens
tgtgcaactccttccacagaca

SEQ ID NO: 8437208 - DNA, 22 bp, Homo sapiens
tgtgcacattctaggactagta

SEQ ID NO: 8437209 - DNA, 22 bp, Homo sapiens
tgtgcacaatgtgcaggtttgt

SEQ ID NO: 8437210 - DNA, 22 bp, Homo sapiens
tgtgcacataaaacagtactag

SEQ ID NO: 8437211 - DNA, 23 bp, Homo sapiens
tgtgcacatctgacgggtgaagg

SEQ ID NO: 8437212 - DNA, 22 bp, Homo sapiens
tgtgcaggtgcaggaagggggc

SEQ ID NO: 8437213 - DNA, 22 bp, Homo sapiens
tgtgcagggaagggcatgctat

SEQ ID NO: 8437214 - DNA, 20 bp, Homo sapiens
tgtgcaggagagtgaggctg

SEQ ID NO: 8437215 - DNA, 22 bp, Homo sapiens
tgtgcagcagcagctgtggaga

SEQ ID NO: 8437216 - DNA, 22 bp, Homo sapiens
tgtgcagcaaaatagaatcttt

SEQ ID NO: 8437217 - DNA, 22 bp, Homo sapiens
tgtgaaggtttttatgggatat

SEQ ID NO: 8437218 - DNA, 23 bp, Homo sapiens
tgtgaattgaggacatcaaaagc

SEQ ID NO: 8437219 - DNA, 22 bp, Homo sapiens
tgtgacagaattggtctgttct

SEQ ID NO: 8437220 - DNA, 22 bp, Homo sapiens
tgtgacagatctttaaataatg

SEQ ID NO: 8437221 - DNA, 23 bp, Homo sapiens
tgtgacagggtcattgaaaaggg

SEQ ID NO: 8437222 - DNA, 22 bp, Homo sapiens
tgtgaaagatactaggcagagg

SEQ ID NO: 8437223 - DNA, 22 bp, Homo sapiens
tgtgagaattcctgatcacagg

SEQ ID NO: 8437224 - DNA, 22 bp, Homo sapiens
tgtgacttataacatagaattt

SEQ ID NO: 8437225 - DNA, 22 bp, Homo sapiens
tgtgacccccgtcacggctgct

SEQ ID NO: 8437226 - DNA, 22 bp, Homo sapiens
tgtgacccagactcatcttctt

SEQ ID NO: 8437227 - DNA, 19 bp, Homo sapiens
tgtgaccccagacaagctg

SEQ ID NO: 8437228 - DNA, 22 bp, Homo sapiens
tgtgaccataatttgtaaataa

SEQ ID NO: 8437229 - DNA, 22 bp, Homo sapiens
tgtgaccctctccgatgggcag

SEQ ID NO: 8437230 - DNA, 23 bp, Homo sapiens
tgtgacccctaggagtggggacc

SEQ ID NO: 8437231 - DNA, 22 bp, Homo sapiens
tgtgactgagctgcagagtgtc

SEQ ID NO: 8437232 - DNA, 22 bp, Homo sapiens
tgtgactggagtccagcccact

SEQ ID NO: 8437233 - DNA, 22 bp, Homo sapiens
tgtgatttcactggtgacatgt

SEQ ID NO: 8437234 - DNA, 19 bp, Homo sapiens
tgtgatagttgaacctgcc

SEQ ID NO: 8437235 - DNA, 22 bp, Homo sapiens
ttattccagtaatctctgtaat

SEQ ID NO: 8437236 - DNA, 22 bp, Homo sapiens
ttattcagggataacatccagg

SEQ ID NO: 8437237 - DNA, 22 bp, Homo sapiens
ttattcatcagtgcattaattt

SEQ ID NO: 8437238 - DNA, 22 bp, Homo sapiens
ttattcttggatctgagtctct

SEQ ID NO: 8437239 - DNA, 22 bp, Homo sapiens
ttatgaagttcctgttacagtg

SEQ ID NO: 8437240 - DNA, 22 bp, Homo sapiens
ttatgaaagacatttctgttgg

SEQ ID NO: 8437241 - DNA, 22 bp, Homo sapiens
ttatgaacaatttctaggaatg

SEQ ID NO: 8437242 - DNA, 22 bp, Homo sapiens
ttatgaaagacatttctgttgg

SEQ ID NO: 8437243 - DNA, 22 bp, Homo sapiens
ttatgaaagacatttctgttgg

SEQ ID NO: 8437244 - DNA, 22 bp, Homo sapiens
ttatctgttgcttaatgcgcat

SEQ ID NO: 8437245 - DNA, 22 bp, Homo sapiens
ttatcttgagtattgagattct

SEQ ID NO: 8437246 - DNA, 22 bp, Homo sapiens
ttatcttgtagagatattttcg

SEQ ID NO: 8437247 - DNA, 22 bp, Homo sapiens
ttatgaaaacaatcagtaggca

SEQ ID NO: 8437248 - DNA, 22 bp, Homo sapiens
ttatcttggtgttttagtaatt

SEQ ID NO: 8437249 - DNA, 22 bp, Homo sapiens
ttattattccccaagtcattat

SEQ ID NO: 8437250 - DNA, 22 bp, Homo sapiens
ttattattccccaagtcattat

SEQ ID NO: 8437251 - DNA, 22 bp, Homo sapiens
ttattattgattcgctctcaaa

SEQ ID NO: 8437252 - DNA, 22 bp, Homo sapiens
ttagtcttctcatagtaaaact

SEQ ID NO: 8437253 - DNA, 22 bp, Homo sapiens
ttagtgatcaaaatcaaaattg

SEQ ID NO: 8437254 - DNA, 22 bp, Homo sapiens
ttagtcttcttccttatatgtt

SEQ ID NO: 8437255 - DNA, 22 bp, Homo sapiens
ttagtgcaaacctcagagacac

SEQ ID NO: 8437256 - DNA, 22 bp, Homo sapiens
ttagtgcaaacctcagagacac

SEQ ID NO: 8437257 - DNA, 22 bp, Homo sapiens
ttagtgcaattcagagaacaat

SEQ ID NO: 8437258 - DNA, 22 bp, Homo sapiens
ttatctgaaaacctcaaaatat

SEQ ID NO: 8437259 - DNA, 22 bp, Homo sapiens
ttatatgtatgcttataaacca

SEQ ID NO: 8437260 - DNA, 22 bp, Homo sapiens
ttagtgctcacgtgttagaaag

SEQ ID NO: 8437261 - DNA, 22 bp, Homo sapiens
ttagtgctcatccagatggggg

SEQ ID NO: 8437262 - DNA, 22 bp, Homo sapiens
ttagtgctaaatactcccacag

SEQ ID NO: 8437263 - DNA, 22 bp, Homo sapiens
ttatctgttgttttagtacaat

SEQ ID NO: 8437264 - DNA, 22 bp, Homo sapiens
ttatctgtcatcaggcagacag

SEQ ID NO: 8437265 - DNA, 22 bp, Homo sapiens
ttatctgtctatcaagactagc

SEQ ID NO: 8437266 - DNA, 22 bp, Homo sapiens
ttagtaaataaagtctactttc

SEQ ID NO: 8437267 - DNA, 22 bp, Homo sapiens
ttaggtttaagtgactggaatc

SEQ ID NO: 8437268 - DNA, 22 bp, Homo sapiens
ttaggtaagtaggatcaaaaaa

SEQ ID NO: 8437269 - DNA, 22 bp, Homo sapiens
ttagtacagaatcaaaagcaat

SEQ ID NO: 8437270 - DNA, 22 bp, Homo sapiens
ttagtacaagagattaattact

SEQ ID NO: 8437271 - DNA, 22 bp, Homo sapiens
ttagtagaagacagataacaaa

SEQ ID NO: 8437272 - DNA, 22 bp, Homo sapiens
ttagtagaatgttatagcaatt

SEQ ID NO: 8437273 - DNA, 22 bp, Homo sapiens
ttagtacatagatgatggttga

SEQ ID NO: 8437274 - DNA, 22 bp, Homo sapiens
ttaggaaattccacctgtattc

SEQ ID NO: 8437275 - DNA, 22 bp, Homo sapiens
ttaggaacttctgtctcagtgt

SEQ ID NO: 8437276 - DNA, 22 bp, Homo sapiens
ttagcatttcagtacacatgtt

SEQ ID NO: 8437277 - DNA, 22 bp, Homo sapiens
ttagggcaaagtttcaacagtt

SEQ ID NO: 8437278 - DNA, 22 bp, Homo sapiens
ttagggcaggcatgagagaact

SEQ ID NO: 8437279 - DNA, 22 bp, Homo sapiens
ttagggaagcatggaggagatg

SEQ ID NO: 8437280 - DNA, 22 bp, Homo sapiens
ttagggaaggacagtgaagaaa

SEQ ID NO: 8437281 - DNA, 22 bp, Homo sapiens
ttagcagctaaactgacagacc

SEQ ID NO: 8437282 - DNA, 22 bp, Homo sapiens
ttagcagcggtcagttttgaag

SEQ ID NO: 8437283 - DNA, 22 bp, Homo sapiens
ttagcattctctgtgtgcataa

SEQ ID NO: 8437284 - DNA, 22 bp, Homo sapiens
ttagcaggtttctggctcttgg

SEQ ID NO: 8437285 - DNA, 22 bp, Homo sapiens
ttagcaggaagagttggctgga

SEQ ID NO: 8437286 - DNA, 22 bp, Homo sapiens
ttagatgtggacttatgttatt

SEQ ID NO: 8437287 - DNA, 22 bp, Homo sapiens
ttagatcattttagctaaatgg

SEQ ID NO: 8437288 - DNA, 22 bp, Homo sapiens
ttagaaaggttttgctctgaaa

SEQ ID NO: 8437289 - DNA, 22 bp, Homo sapiens
ttagaaaggttttgctctgaaa

SEQ ID NO: 8437290 - DNA, 22 bp, Homo sapiens
ttagaaagggtgtctgaatctg

SEQ ID NO: 8437291 - DNA, 22 bp, Homo sapiens
ttagaaagggtgtctgaatctg

SEQ ID NO: 8437292 - DNA, 22 bp, Homo sapiens
ttagaaaggggtgaatcaatgg

SEQ ID NO: 8437293 - DNA, 22 bp, Homo sapiens
ttagaaaggagcttatttcttt

SEQ ID NO: 8437294 - DNA, 22 bp, Homo sapiens
ttagaaaggaatcttcatttca

SEQ ID NO: 8437295 - DNA, 22 bp, Homo sapiens
ttagaaatgtcacagatctgat

SEQ ID NO: 8437296 - DNA, 22 bp, Homo sapiens
ttagaaatgtcacagatctgat

SEQ ID NO: 8437297 - DNA, 22 bp, Homo sapiens
ttagaacaatattctccctaca

SEQ ID NO: 8437298 - DNA, 22 bp, Homo sapiens
ttagaacaccattctatattac

SEQ ID NO: 8437299 - DNA, 21 bp, Homo sapiens
ttagaacaatatttggtatag

SEQ ID NO: 8437300 - DNA, 22 bp, Homo sapiens
ttagaaatcacctctgaagatc

SEQ ID NO: 8437301 - DNA, 22 bp, Homo sapiens
ttagaaatcacctctgaagatc

SEQ ID NO: 8437302 - DNA, 22 bp, Homo sapiens
ttagaaatgcacccaagaccta

SEQ ID NO: 8437303 - DNA, 22 bp, Homo sapiens
ttagaaatgatttcacctcttt

SEQ ID NO: 8437304 - DNA, 22 bp, Homo sapiens
ttagataaattgcaacttgatt

SEQ ID NO: 8437305 - DNA, 22 bp, Homo sapiens
ttagaacttttcaactccattc

SEQ ID NO: 8437306 - DNA, 22 bp, Homo sapiens
ttagaagcactaattactcaca

SEQ ID NO: 8437307 - DNA, 22 bp, Homo sapiens
ttagataatgtagagatatgag

SEQ ID NO: 8437308 - DNA, 22 bp, Homo sapiens
ttagatacattctcatttgttt

SEQ ID NO: 8437309 - DNA, 22 bp, Homo sapiens
ttagatacccaagtggatctgt

SEQ ID NO: 8437310 - DNA, 22 bp, Homo sapiens
ttagaacatagcaacagaatta

SEQ ID NO: 8437311 - DNA, 19 bp, Homo sapiens
ttagaacatcctctaggga

SEQ ID NO: 8437312 - DNA, 22 bp, Homo sapiens
ttagaacactgagaaagtgatg

SEQ ID NO: 8437313 - DNA, 21 bp, Homo sapiens
ttagaacacttgctcttggaa

SEQ ID NO: 8437314 - DNA, 22 bp, Homo sapiens
ttagaacagtagaagaaagggt

SEQ ID NO: 8437315 - DNA, 22 bp, Homo sapiens
ttagaacatctctcttctgcca

SEQ ID NO: 8437316 - DNA, 22 bp, Homo sapiens
ttagaaccacctggagagcttt

SEQ ID NO: 8437317 - DNA, 22 bp, Homo sapiens
ttagaaccactgaagactcaca

SEQ ID NO: 8437318 - DNA, 22 bp, Homo sapiens
ttagaacattccatcactgggt

SEQ ID NO: 8437319 - DNA, 22 bp, Homo sapiens
ttagaaccataatgaatcaatg

SEQ ID NO: 8437320 - DNA, 22 bp, Homo sapiens
ttagaaccataatgaatcaatg

SEQ ID NO: 8437321 - DNA, 22 bp, Homo sapiens
ttagaactgaagaagattaagg

SEQ ID NO: 8437322 - DNA, 22 bp, Homo sapiens
ttagaacttaagaatactgtct

SEQ ID NO: 8437323 - DNA, 22 bp, Homo sapiens
ttagaacttaaacttcagaaag

SEQ ID NO: 8437324 - DNA, 22 bp, Homo sapiens
ttagaaccagggttacgattct

SEQ ID NO: 8437325 - DNA, 22 bp, Homo sapiens
ttagaaccagggttacgattct

SEQ ID NO: 8437326 - DNA, 22 bp, Homo sapiens
ttagaaccaggaactctaatat

SEQ ID NO: 8437327 - DNA, 22 bp, Homo sapiens
ttagaaccactgaagactcaca

SEQ ID NO: 8437328 - DNA, 22 bp, Homo sapiens
ttagaaccaggaactctaatat

SEQ ID NO: 8437329 - DNA, 22 bp, Homo sapiens
ttagaaccagcatttgtcctgg

SEQ ID NO: 8437330 - DNA, 22 bp, Homo sapiens
ttacagcagtgggaaggagtca

SEQ ID NO: 8437331 - DNA, 22 bp, Homo sapiens
ttacatgcagagggaagggaga

SEQ ID NO: 8437332 - DNA, 22 bp, Homo sapiens
ttacatgcagagggaagggaga

SEQ ID NO: 8437333 - DNA, 22 bp, Homo sapiens
ttacatgatgatttcataaaca

SEQ ID NO: 8437334 - DNA, 22 bp, Homo sapiens
ttacatgggccatttagacatg

SEQ ID NO: 8437335 - DNA, 22 bp, Homo sapiens
ttacatgggcttgtgagtcctt

SEQ ID NO: 8437336 - DNA, 22 bp, Homo sapiens
ttacatgcttagagatgcatgc

SEQ ID NO: 8437337 - DNA, 22 bp, Homo sapiens
ttacattcattgaagtgattca

SEQ ID NO: 8437338 - DNA, 22 bp, Homo sapiens
ttacattcccagtgtgcagcat

SEQ ID NO: 8437339 - DNA, 22 bp, Homo sapiens
ttacattcttggaatcttgttt

SEQ ID NO: 8437340 - DNA, 22 bp, Homo sapiens
ttacattcttatctcagttatt

SEQ ID NO: 8437341 - DNA, 22 bp, Homo sapiens
ttacattcagaaagatttgagt

SEQ ID NO: 8437342 - DNA, 21 bp, Homo sapiens
ttacattcagaggagtggaag

SEQ ID NO: 8437343 - DNA, 22 bp, Homo sapiens
ttacattcaatttctagaggta

SEQ ID NO: 8437344 - DNA, 22 bp, Homo sapiens
ttacattcaaggaactcattct

SEQ ID NO: 8437345 - DNA, 22 bp, Homo sapiens
ttacattagacccactttcatg

SEQ ID NO: 8437346 - DNA, 22 bp, Homo sapiens
ttacatttcccccttggaggct

SEQ ID NO: 8437347 - DNA, 22 bp, Homo sapiens
ttacattttagttaacctgtga

SEQ ID NO: 8437348 - DNA, 22 bp, Homo sapiens
ttacatgtggtgtgaagaagag

SEQ ID NO: 8437349 - DNA, 22 bp, Homo sapiens
ttacatgtggagtctgattgca

SEQ ID NO: 8437350 - DNA, 22 bp, Homo sapiens
ttacatgtggagtctgattgca

SEQ ID NO: 8437351 - DNA, 22 bp, Homo sapiens
ttacatgtactggtttgactta

SEQ ID NO: 8437352 - DNA, 22 bp, Homo sapiens
ttacatgtactggtttgactta

SEQ ID NO: 8437353 - DNA, 22 bp, Homo sapiens
ttacatggtttatttacctaag

SEQ ID NO: 8437354 - DNA, 22 bp, Homo sapiens
ttacatgtacaaacaattctta

SEQ ID NO: 8437355 - DNA, 21 bp, Homo sapiens
ttacatggtttatcatatgga

SEQ ID NO: 8437356 - DNA, 22 bp, Homo sapiens
ttacatgtttacggatacactt

SEQ ID NO: 8437357 - DNA, 22 bp, Homo sapiens
ttacatgttctcatacacagag

SEQ ID NO: 8437358 - DNA, 23 bp, Homo sapiens
ttacatgtgtgcacacattctgg

SEQ ID NO: 8437359 - DNA, 22 bp, Homo sapiens
ttacatgtttatgtggtacatg

SEQ ID NO: 8437360 - DNA, 22 bp, Homo sapiens
ttacattagacccactttcatg

SEQ ID NO: 8437361 - DNA, 22 bp, Homo sapiens
ttacattaagccaatggattct

SEQ ID NO: 8437362 - DNA, 22 bp, Homo sapiens
ttacacttttgacaaacctgag

SEQ ID NO: 8437363 - DNA, 22 bp, Homo sapiens
ttacacaaaaataagatatggc

SEQ ID NO: 8437364 - DNA, 22 bp, Homo sapiens
ttacagaatgttcttccaacag

SEQ ID NO: 8437365 - DNA, 22 bp, Homo sapiens
ttacagaatgttcttccaacag

SEQ ID NO: 8437366 - DNA, 22 bp, Homo sapiens
ttacagagaggtgattgtgaag

SEQ ID NO: 8437367 - DNA, 22 bp, Homo sapiens
ttacagagaggtgattgtgaag

SEQ ID NO: 8437368 - DNA, 22 bp, Homo sapiens
ttacagagcctcattttagaga

SEQ ID NO: 8437369 - DNA, 22 bp, Homo sapiens
ttacagagataaactgtaagtg

SEQ ID NO: 8437370 - DNA, 22 bp, Homo sapiens
ttacagagcctcattttagaga

SEQ ID NO: 8437371 - DNA, 22 bp, Homo sapiens
ttacagagctcatttctaaggg

SEQ ID NO: 8437372 - DNA, 22 bp, Homo sapiens
ttacagagctcatttctaaggg

SEQ ID NO: 8437373 - DNA, 22 bp, Homo sapiens
ttacagagctgggtggagagag

SEQ ID NO: 8437374 - DNA, 22 bp, Homo sapiens
ttacagaggcttccagggccca

SEQ ID NO: 8437375 - DNA, 22 bp, Homo sapiens
ttacagagggcttctctgaact

SEQ ID NO: 8437376 - DNA, 17 bp, Homo sapiens
ttacagaggtaattaag

SEQ ID NO: 8437377 - DNA, 22 bp, Homo sapiens
ttacagaggtatgtatgtctct

SEQ ID NO: 8437378 - DNA, 22 bp, Homo sapiens
ttacagagtagggaattgaagt

SEQ ID NO: 8437379 - DNA, 22 bp, Homo sapiens
ttacagagtagggaattgaagt

SEQ ID NO: 8437380 - DNA, 22 bp, Homo sapiens
ttacagagtggtctggctatgt

SEQ ID NO: 8437381 - DNA, 22 bp, Homo sapiens
ttacagagtagtgcagaactca

SEQ ID NO: 8437382 - DNA, 22 bp, Homo sapiens
ttacagagtggtctggctatgt

SEQ ID NO: 8437383 - DNA, 22 bp, Homo sapiens
ttacagagttcgcacctggtgg

SEQ ID NO: 8437384 - DNA, 22 bp, Homo sapiens
ttacagatactttgtaggcaag

SEQ ID NO: 8437385 - DNA, 22 bp, Homo sapiens
ttacaagataacctgatgctgt

SEQ ID NO: 8437386 - DNA, 22 bp, Homo sapiens
ttacaagataacctgatgctgt

SEQ ID NO: 8437387 - DNA, 22 bp, Homo sapiens
ttacaagcagctacatatcaca

SEQ ID NO: 8437388 - DNA, 22 bp, Homo sapiens
ttacaatgggtatacttccatt

SEQ ID NO: 8437389 - DNA, 22 bp, Homo sapiens
ttacaattgagtctattgtatg

SEQ ID NO: 8437390 - DNA, 22 bp, Homo sapiens
ttacaagtactgaatatgattt

SEQ ID NO: 8437391 - DNA, 22 bp, Homo sapiens
ttacaatgcactcacctttaga

SEQ ID NO: 8437392 - DNA, 22 bp, Homo sapiens
ttacaaggaggatagcatttcc

SEQ ID NO: 8437393 - DNA, 22 bp, Homo sapiens
ttacaaggtaagttgttaagtc

SEQ ID NO: 8437394 - DNA, 22 bp, Homo sapiens
ttacaagctaattgtttcagct

SEQ ID NO: 8437395 - DNA, 22 bp, Homo sapiens
ttaattaagagatactgcagta

SEQ ID NO: 8437396 - DNA, 22 bp, Homo sapiens
ttaattaactagccaaccacta

SEQ ID NO: 8437397 - DNA, 22 bp, Homo sapiens
ttaattaactagccaaccacta

SEQ ID NO: 8437398 - DNA, 22 bp, Homo sapiens
ttaatgttttaagttatagaga

SEQ ID NO: 8437399 - DNA, 22 bp, Homo sapiens
ttaattaaattcatgagcattg

SEQ ID NO: 8437400 - DNA, 20 bp, Homo sapiens
ttacaaagaggcatcgcttt

SEQ ID NO: 8437401 - DNA, 22 bp, Homo sapiens
ttacaaagttctgagttcaaac

SEQ ID NO: 8437402 - DNA, 22 bp, Homo sapiens
ttacaaagtgttatgataaaca

SEQ ID NO: 8437403 - DNA, 22 bp, Homo sapiens
ttacaaagttctgagttcaaac

SEQ ID NO: 8437404 - DNA, 22 bp, Homo sapiens
ttacaacaaaggcacgtgcatg

SEQ ID NO: 8437405 - DNA, 17 bp, Homo sapiens
ttacaacaattcatgag

SEQ ID NO: 8437406 - DNA, 17 bp, Homo sapiens
ttacaacaattcatgag

SEQ ID NO: 8437407 - DNA, 22 bp, Homo sapiens
ttacaacaccaggcagtatcct

SEQ ID NO: 8437408 - DNA, 22 bp, Homo sapiens
ttacaacagcgatttacctgtc

SEQ ID NO: 8437409 - DNA, 22 bp, Homo sapiens
ttacaacactacttatccttga

SEQ ID NO: 8437410 - DNA, 22 bp, Homo sapiens
ttacaacactacttatccttga

SEQ ID NO: 8437411 - DNA, 21 bp, Homo sapiens
ttacaacatttgtgttctatg

SEQ ID NO: 8437412 - DNA, 17 bp, Homo sapiens
ttacaacgtcatctctg

SEQ ID NO: 8437413 - DNA, 21 bp, Homo sapiens
ttacaacatttgtgttctatg

SEQ ID NO: 8437414 - DNA, 21 bp, Homo sapiens
ttacaacatttgtgttctatg

SEQ ID NO: 8437415 - DNA, 22 bp, Homo sapiens
ttacaacatatttagcttgatt

SEQ ID NO: 8437416 - DNA, 22 bp, Homo sapiens
ttacaacagacacatattctaa

SEQ ID NO: 8437417 - DNA, 22 bp, Homo sapiens
ttacaacttgcagaggatgttg

SEQ ID NO: 8437418 - DNA, 22 bp, Homo sapiens
ttacaagacacagtgctgaagg

SEQ ID NO: 8437419 - DNA, 22 bp, Homo sapiens
ttaatacagtctccagaagtaa

SEQ ID NO: 8437420 - DNA, 22 bp, Homo sapiens
ttaatacagtctccagaagtaa

SEQ ID NO: 8437421 - DNA, 22 bp, Homo sapiens
ttaatacagaagcaagacactg

SEQ ID NO: 8437422 - DNA, 21 bp, Homo sapiens
ttaatgctatgcagaaaatct

SEQ ID NO: 8437423 - DNA, 22 bp, Homo sapiens
ttaatacatttcagactgttat

SEQ ID NO: 8437424 - DNA, 22 bp, Homo sapiens
ttaatacaagcatatgcacaca

SEQ ID NO: 8437425 - DNA, 22 bp, Homo sapiens
ttaatacaactgttgtcactgg

SEQ ID NO: 8437426 - DNA, 22 bp, Homo sapiens
ttaataacattgtgtatcaccc

SEQ ID NO: 8437427 - DNA, 22 bp, Homo sapiens
ttaataagtagtagttattgtt

SEQ ID NO: 8437428 - DNA, 22 bp, Homo sapiens
ttaataaagtatgaattggaaa

SEQ ID NO: 8437429 - DNA, 22 bp, Homo sapiens
ttaataaagtatgaattggaaa

SEQ ID NO: 8437430 - DNA, 22 bp, Homo sapiens
ttaataaagtatgaattggaaa

SEQ ID NO: 8437431 - DNA, 22 bp, Homo sapiens
ttaaagaggcaggttaaataat

SEQ ID NO: 8437432 - DNA, 22 bp, Homo sapiens
ttaaagaatagtgcccctattg

SEQ ID NO: 8437433 - DNA, 22 bp, Homo sapiens
ttaaagacatcacagattacac

SEQ ID NO: 8437434 - DNA, 22 bp, Homo sapiens
ttaaagaatagtgcccctattg

SEQ ID NO: 8437435 - DNA, 19 bp, Homo sapiens
ttcacattttgctctgagg

SEQ ID NO: 8437436 - DNA, 19 bp, Homo sapiens
ttcacatttttgtggcact

SEQ ID NO: 8437437 - DNA, 22 bp, Homo sapiens
ttcacatttctctgctgtttga

SEQ ID NO: 8437438 - DNA, 20 bp, Homo sapiens
ttcacatttctgtagtgatt

SEQ ID NO: 8437439 - DNA, 22 bp, Homo sapiens
ttcacatttgaaaggaaagata

SEQ ID NO: 8437440 - DNA, 22 bp, Homo sapiens
ttcacatttgcccttatgtgtg

SEQ ID NO: 8437441 - DNA, 22 bp, Homo sapiens
ttcacatttactggtttgtccg

SEQ ID NO: 8437442 - DNA, 22 bp, Homo sapiens
ttcacattgttttaatgtgaat

SEQ ID NO: 8437443 - DNA, 22 bp, Homo sapiens
ttcacatttcataccacagctt

SEQ ID NO: 8437444 - DNA, 22 bp, Homo sapiens
ttcacatttactggtttgtccg

SEQ ID NO: 8437445 - DNA, 22 bp, Homo sapiens
ttcacatttctctgctgtttga

SEQ ID NO: 8437446 - DNA, 22 bp, Homo sapiens
ttcacattgttttaatgtgaat

SEQ ID NO: 8437447 - DNA, 22 bp, Homo sapiens
ttcacattgtggttcatgtgaa

SEQ ID NO: 8437448 - DNA, 22 bp, Homo sapiens
ttcacattggtgatatgtttct

SEQ ID NO: 8437449 - DNA, 22 bp, Homo sapiens
ttcacattggttcttgatagct

SEQ ID NO: 8437450 - DNA, 22 bp, Homo sapiens
ttcacattggtgatatgtttct

SEQ ID NO: 8437451 - DNA, 22 bp, Homo sapiens
ttcacattgtgcagattatggt

SEQ ID NO: 8437452 - DNA, 22 bp, Homo sapiens
ttatttgcccatgtttagcaga

SEQ ID NO: 8437453 - DNA, 22 bp, Homo sapiens
ttatttggttgctgacttggaa

SEQ ID NO: 8437454 - DNA, 22 bp, Homo sapiens
ttatttctactattttgcctga

SEQ ID NO: 8437455 - DNA, 22 bp, Homo sapiens
ttatttgaatgatggcacaatt

SEQ ID NO: 8437456 - DNA, 21 bp, Homo sapiens
ttcagcagtcctctagagata

SEQ ID NO: 8437457 - DNA, 22 bp, Homo sapiens
ttcagcagtgcagacacccagt

SEQ ID NO: 8437458 - DNA, 22 bp, Homo sapiens
ttcaccccaaattcccagtgga

SEQ ID NO: 8437459 - DNA, 22 bp, Homo sapiens
ttcagcttgctgactgcggcag

SEQ ID NO: 8437460 - DNA, 22 bp, Homo sapiens
ttcaggaagtgctgcctggtgt

SEQ ID NO: 8437461 - DNA, 22 bp, Homo sapiens
ttcaggaaatgtctgcctacca

SEQ ID NO: 8437462 - DNA, 22 bp, Homo sapiens
ttcaggaaattggagtccttct

SEQ ID NO: 8437463 - DNA, 22 bp, Homo sapiens
ttcagcctgttcatgctgttgc

SEQ ID NO: 8437464 - DNA, 22 bp, Homo sapiens
ttccagctaactcacatccctt

SEQ ID NO: 8437465 - DNA, 22 bp, Homo sapiens
ttccagcctttatccatccaga

SEQ ID NO: 8437466 - DNA, 22 bp, Homo sapiens
ttccagccagatttgctgggtt

SEQ ID NO: 8437467 - DNA, 22 bp, Homo sapiens
ttccagccactttatactgcta

SEQ ID NO: 8437468 - DNA, 22 bp, Homo sapiens
ttccagccatggtttccctatg

SEQ ID NO: 8437469 - DNA, 22 bp, Homo sapiens
ttccagcccgcgacttgttcag

SEQ ID NO: 8437470 - DNA, 20 bp, Homo sapiens
ttccagccgccacttccgcc

SEQ ID NO: 8437471 - DNA, 22 bp, Homo sapiens
ttccagccactttatactgcta

SEQ ID NO: 8437472 - DNA, 22 bp, Homo sapiens
ttccagcaggcagacaggagat

SEQ ID NO: 8437473 - DNA, 22 bp, Homo sapiens
ttccagcagcgtgggagaagta

SEQ ID NO: 8437474 - DNA, 22 bp, Homo sapiens
ttccagcacagaagtatacatt

SEQ ID NO: 8437475 - DNA, 22 bp, Homo sapiens
ttccagatgtttaagttctgct

SEQ ID NO: 8437476 - DNA, 22 bp, Homo sapiens
ttccagatgtttaagttctgct

SEQ ID NO: 8437477 - DNA, 22 bp, Homo sapiens
ttccagatatttttatgtggaa

SEQ ID NO: 8437478 - DNA, 22 bp, Homo sapiens
ttcattcattcatgaatgttaa

SEQ ID NO: 8437479 - DNA, 22 bp, Homo sapiens
ttcattcatgtattgtctatgg

SEQ ID NO: 8437480 - DNA, 22 bp, Homo sapiens
ttcattgaaatacagtcttgac

SEQ ID NO: 8437481 - DNA, 22 bp, Homo sapiens
ttcattgaaccactttattctt

SEQ ID NO: 8437482 - DNA, 22 bp, Homo sapiens
ttcattgaaatgtttctagctg

SEQ ID NO: 8437483 - DNA, 22 bp, Homo sapiens
ttcattgaaatacagtcttgac

SEQ ID NO: 8437484 - DNA, 23 bp, Homo sapiens
ttcattgattgcaaggagattgg

SEQ ID NO: 8437485 - DNA, 22 bp, Homo sapiens
ttcattgagctgtacacttagg

SEQ ID NO: 8437486 - DNA, 22 bp, Homo sapiens
ttcattgagtggtttattctaa

SEQ ID NO: 8437487 - DNA, 21 bp, Homo sapiens
ttcattgaactatttgtggag

SEQ ID NO: 8437488 - DNA, 22 bp, Homo sapiens
ttcattgactggttcgttaagt

SEQ ID NO: 8437489 - DNA, 22 bp, Homo sapiens
ttcattgaaggagggacttgct

SEQ ID NO: 8437490 - DNA, 22 bp, Homo sapiens
ttcattgagtggtttattctaa

SEQ ID NO: 8437491 - DNA, 22 bp, Homo sapiens
ttcattgatagttttatgtatg

SEQ ID NO: 8437492 - DNA, 23 bp, Homo sapiens
ttcattgattgcaaggagattgg

SEQ ID NO: 8437493 - DNA, 17 bp, Homo sapiens
ttcattaataaaagcaa

SEQ ID NO: 8437494 - DNA, 22 bp, Homo sapiens
ttcaggaatcaaccaagtcatt

SEQ ID NO: 8437495 - DNA, 22 bp, Homo sapiens
ttcattcaaggggttcctgatt

SEQ ID NO: 8437496 - DNA, 22 bp, Homo sapiens
ttcattcaggtgtatttatggg

SEQ ID NO: 8437497 - DNA, 22 bp, Homo sapiens
ttcattcagtgcatttgggaga

SEQ ID NO: 8437498 - DNA, 21 bp, Homo sapiens
ttcattcatggcataatatag

SEQ ID NO: 8437499 - DNA, 22 bp, Homo sapiens
ttccaggaacaaactcacctta

SEQ ID NO: 8437500 - DNA, 22 bp, Homo sapiens
ttccaggaaaacagttggaagt

SEQ ID NO: 8437501 - DNA, 22 bp, Homo sapiens
actgactttggaatatttctag

SEQ ID NO: 8437502 - DNA, 20 bp, Homo sapiens
actgacagggaactaaggct

SEQ ID NO: 8437503 - DNA, 22 bp, Homo sapiens
aagttttattggctatagcact

SEQ ID NO: 8437504 - DNA, 22 bp, Homo sapiens
aagttttattggaacatagcca

SEQ ID NO: 8437505 - DNA, 22 bp, Homo sapiens
aagttttattggaacatagcca

SEQ ID NO: 8437506 - DNA, 21 bp, Homo sapiens
aagttttatgttgccatttgt

SEQ ID NO: 8437507 - DNA, 22 bp, Homo sapiens
aagttttatgggaagatgtgca

SEQ ID NO: 8437508 - DNA, 22 bp, Homo sapiens
aagttttatgggaagatgtgca

SEQ ID NO: 8437509 - DNA, 22 bp, Homo sapiens
actgagaagctcgcagtgatgc

SEQ ID NO: 8437510 - DNA, 19 bp, Homo sapiens
actgagaccacagacaagt

SEQ ID NO: 8437511 - DNA, 22 bp, Homo sapiens
actgagactgaatctgaatgat

SEQ ID NO: 8437512 - DNA, 22 bp, Homo sapiens
aataaatgttaagattgtctca

SEQ ID NO: 8437513 - DNA, 22 bp, Homo sapiens
aataaatcaatcctattggtag

SEQ ID NO: 8437514 - DNA, 22 bp, Homo sapiens
aagtggcagttcaggaagcaga

SEQ ID NO: 8437515 - DNA, 22 bp, Homo sapiens
aagtggcagttcaggaagcaga

SEQ ID NO: 8437516 - DNA, 22 bp, Homo sapiens
aagtggcagaatagtggcagga

SEQ ID NO: 8437517 - DNA, 22 bp, Homo sapiens
aagtggcagccttagaaggaga

SEQ ID NO: 8437518 - DNA, 22 bp, Homo sapiens
aagtggcatgtataagaaagaa

SEQ ID NO: 8437519 - DNA, 22 bp, Homo sapiens
aagtggctcatgtggcttctgc

SEQ ID NO: 8437520 - DNA, 22 bp, Homo sapiens
aagtggctttgagcttctgcca

SEQ ID NO: 8437521 - DNA, 22 bp, Homo sapiens
aagtggctttgagcttctgcca

SEQ ID NO: 8437522 - DNA, 22 bp, Homo sapiens
aagtttctcaatggcaactggg

SEQ ID NO: 8437523 - DNA, 22 bp, Homo sapiens
aagtggggcctggtggtacagt

SEQ ID NO: 8437524 - DNA, 22 bp, Homo sapiens
aagttttaacaagtacttacta

SEQ ID NO: 8437525 - DNA, 22 bp, Homo sapiens
aagttttactgaggacacatgt

SEQ ID NO: 8437526 - DNA, 22 bp, Homo sapiens
aagttttactgaggacacatgt

SEQ ID NO: 8437527 - DNA, 22 bp, Homo sapiens
aagttttactgaggacacatgt

SEQ ID NO: 8437528 - DNA, 22 bp, Homo sapiens
aagtttgtcgaaattatcagca

SEQ ID NO: 8437529 - DNA, 22 bp, Homo sapiens
aagtggcagaatagtggcagga

SEQ ID NO: 8437530 - DNA, 22 bp, Homo sapiens
actcatgtcctaggagtaaagc

SEQ ID NO: 8437531 - DNA, 22 bp, Homo sapiens
actcatctgccattcctgtacc

SEQ ID NO: 8437532 - DNA, 23 bp, Homo sapiens
actcatcttctggtatccacagt

SEQ ID NO: 8437533 - DNA, 22 bp, Homo sapiens
actcatcagcctctaggaaaga

SEQ ID NO: 8437534 - DNA, 20 bp, Homo sapiens
actcatctactccagaccct

SEQ ID NO: 8437535 - DNA, 22 bp, Homo sapiens
actcagagcagagcagcctgag

SEQ ID NO: 8437536 - DNA, 23 bp, Homo sapiens
actcagtgaagcaaacagatagt

SEQ ID NO: 8437537 - DNA, 22 bp, Homo sapiens
actcagagatatggtggttgat

SEQ ID NO: 8437538 - DNA, 22 bp, Homo sapiens
actcagagcagagcagcctgag

SEQ ID NO: 8437539 - DNA, 22 bp, Homo sapiens
aagtgcataagtatgattattt

SEQ ID NO: 8437540 - DNA, 22 bp, Homo sapiens
actcagagatatggtggttgat

SEQ ID NO: 8437541 - DNA, 23 bp, Homo sapiens
actcagagaccccgggaagtgac

SEQ ID NO: 8437542 - DNA, 22 bp, Homo sapiens
aagtgagttcagcattcactcg

SEQ ID NO: 8437543 - DNA, 22 bp, Homo sapiens
aagtgaggtttctgctttcaga

SEQ ID NO: 8437544 - DNA, 22 bp, Homo sapiens
aagtgaggcctaggcactgggt

SEQ ID NO: 8437545 - DNA, 22 bp, Homo sapiens
aagtgatgctacgactttgaca

SEQ ID NO: 8437546 - DNA, 22 bp, Homo sapiens
aagtgattattgttttcaggtt

SEQ ID NO: 8437547 - DNA, 22 bp, Homo sapiens
aagtgattctagtcatgattct

SEQ ID NO: 8437548 - DNA, 22 bp, Homo sapiens
aagtgatttgcatgcttaattc

SEQ ID NO: 8437549 - DNA, 22 bp, Homo sapiens
aagtgattctagtcatgattct

SEQ ID NO: 8437550 - DNA, 22 bp, Homo sapiens
aagtgattgttccgttgagtgt

SEQ ID NO: 8437551 - DNA, 22 bp, Homo sapiens
aagtgattttcctacttgctaa

SEQ ID NO: 8437552 - DNA, 22 bp, Homo sapiens
aagtgattttcttcttagttat

SEQ ID NO: 8437553 - DNA, 22 bp, Homo sapiens
aagtgcaggagtggggaaagta

SEQ ID NO: 8437554 - DNA, 22 bp, Homo sapiens
aagtgcaggtctcagctactct

SEQ ID NO: 8437555 - DNA, 22 bp, Homo sapiens
aagtgcaaatttaagaaggcat

SEQ ID NO: 8437556 - DNA, 22 bp, Homo sapiens
aagtgacctcatggtttctcct

SEQ ID NO: 8437557 - DNA, 22 bp, Homo sapiens
aagtgaattcattgtgttatat

SEQ ID NO: 8437558 - DNA, 22 bp, Homo sapiens
aagtgaatagcctatttactag

SEQ ID NO: 8437559 - DNA, 22 bp, Homo sapiens
aagtgaatctcctttctttatt

SEQ ID NO: 8437560 - DNA, 22 bp, Homo sapiens
aagtgaatctcctttctttatt

SEQ ID NO: 8437561 - DNA, 22 bp, Homo sapiens
aagtgaataaaattgtgttctt

SEQ ID NO: 8437562 - DNA, 22 bp, Homo sapiens
aagtctctttgggtactttatt

SEQ ID NO: 8437563 - DNA, 22 bp, Homo sapiens
aagtctcttttcttcctgtatt

SEQ ID NO: 8437564 - DNA, 22 bp, Homo sapiens
aagtgaagaaatacatgagaat

SEQ ID NO: 8437565 - DNA, 22 bp, Homo sapiens
aagtgaaattgccattcttata

SEQ ID NO: 8437566 - DNA, 22 bp, Homo sapiens
accttgtctgtgcacctgggct

SEQ ID NO: 8437567 - DNA, 22 bp, Homo sapiens
accttgtcttttatagaacaag

SEQ ID NO: 8437568 - DNA, 21 bp, Homo sapiens
aagtaaatcagagaaataacc

SEQ ID NO: 8437569 - DNA, 22 bp, Homo sapiens
aagtaaaccacagagaagccac

SEQ ID NO: 8437570 - DNA, 22 bp, Homo sapiens
aagtaacacatgttacttctgc

SEQ ID NO: 8437571 - DNA, 23 bp, Homo sapiens
accttggacttcccagcttccag

SEQ ID NO: 8437572 - DNA, 23 bp, Homo sapiens
accttggacttcccagcttccag

SEQ ID NO: 8437573 - DNA, 22 bp, Homo sapiens
accttgggcaagttggaaactg

SEQ ID NO: 8437574 - DNA, 22 bp, Homo sapiens
accttggcagtttctacctttt

SEQ ID NO: 8437575 - DNA, 22 bp, Homo sapiens
accttggaactgaagtgttttt

SEQ ID NO: 8437576 - DNA, 22 bp, Homo sapiens
accttggaaatgcccattgcct

SEQ ID NO: 8437577 - DNA, 22 bp, Homo sapiens
accttggaaagtttaattgagg

SEQ ID NO: 8437578 - DNA, 22 bp, Homo sapiens
accttgaacccagcttgctgca

SEQ ID NO: 8437579 - DNA, 22 bp, Homo sapiens
accttgaacccagcttgctgca

SEQ ID NO: 8437580 - DNA, 20 bp, Homo sapiens
acctgggattagatacccaa

SEQ ID NO: 8437581 - DNA, 22 bp, Homo sapiens
acctgggatggggccaggttta

SEQ ID NO: 8437582 - DNA, 22 bp, Homo sapiens
acctgggagtcacacctgagaa

SEQ ID NO: 8437583 - DNA, 22 bp, Homo sapiens
acctgggagtatgcagtggtga

SEQ ID NO: 8437584 - DNA, 22 bp, Homo sapiens
acctgggaggcggaggttgcag

SEQ ID NO: 8437585 - DNA, 22 bp, Homo sapiens
acctgggaggcggaggttgcag

SEQ ID NO: 8437586 - DNA, 22 bp, Homo sapiens
acctgggaggcagaggttgcag

SEQ ID NO: 8437587 - DNA, 22 bp, Homo sapiens
acctgggaggcagaggttgcag

SEQ ID NO: 8437588 - DNA, 22 bp, Homo sapiens
acctgggagagaggagccggcg

SEQ ID NO: 8437589 - DNA, 22 bp, Homo sapiens
acctgggaagatctttgaagct

SEQ ID NO: 8437590 - DNA, 22 bp, Homo sapiens
acctgggaacgctttgtggagg

SEQ ID NO: 8437591 - DNA, 22 bp, Homo sapiens
acctgggaacgctttgtggagg

SEQ ID NO: 8437592 - DNA, 22 bp, Homo sapiens
acctgggaaaaggagtggccat

SEQ ID NO: 8437593 - DNA, 22 bp, Homo sapiens
acctgggaaagccgtggaaagg

SEQ ID NO: 8437594 - DNA, 20 bp, Homo sapiens
acctgggaaaaccttttcct

SEQ ID NO: 8437595 - DNA, 22 bp, Homo sapiens
aatactggctgtcaaagatgga

SEQ ID NO: 8437596 - DNA, 22 bp, Homo sapiens
aatacttgtcagatgaataaga

SEQ ID NO: 8437597 - DNA, 22 bp, Homo sapiens
aatacttgtgaattcaaagtct

SEQ ID NO: 8437598 - DNA, 22 bp, Homo sapiens
aatactttgccaagttcgaaga

SEQ ID NO: 8437599 - DNA, 22 bp, Homo sapiens
aatacttttgaactgaaaggca

SEQ ID NO: 8437600 - DNA, 22 bp, Homo sapiens
aatacttttgaactgaaaggca

SEQ ID NO: 8437601 - DNA, 22 bp, Homo sapiens
aatagaaaggaggggctcttgt

SEQ ID NO: 8437602 - DNA, 22 bp, Homo sapiens
actgtggccaaagcctctggga

SEQ ID NO: 8437603 - DNA, 22 bp, Homo sapiens
actgtgctgctctccgcagccc

SEQ ID NO: 8437604 - DNA, 19 bp, Homo sapiens
actgtgctcgggaaccact

SEQ ID NO: 8437605 - DNA, 22 bp, Homo sapiens
aataactggcacatatcacata

SEQ ID NO: 8437606 - DNA, 22 bp, Homo sapiens
aataacagggttgatttgcaat

SEQ ID NO: 8437607 - DNA, 22 bp, Homo sapiens
aataacagtgccatgaaattga

SEQ ID NO: 8437608 - DNA, 21 bp, Homo sapiens
aataaccactaatatagtggc

SEQ ID NO: 8437609 - DNA, 22 bp, Homo sapiens
acttagaattagtgtagaatga

SEQ ID NO: 8437610 - DNA, 22 bp, Homo sapiens
aatagaaaggaggggctcttgt

SEQ ID NO: 8437611 - DNA, 22 bp, Homo sapiens
aatagaacaataattgtaaact

SEQ ID NO: 8437612 - DNA, 20 bp, Homo sapiens
actgttggaagtggagaatg

SEQ ID NO: 8437613 - DNA, 22 bp, Homo sapiens
acttagaattaaatatttttgg

SEQ ID NO: 8437614 - DNA, 22 bp, Homo sapiens
acttatatttgctttatgcttc

SEQ ID NO: 8437615 - DNA, 22 bp, Homo sapiens
acttatttcatggatcataatg

SEQ ID NO: 8437616 - DNA, 22 bp, Homo sapiens
acttccaggaggtgtcactgaa

SEQ ID NO: 8437617 - DNA, 16 bp, Homo sapiens
acttccaggggagccc

SEQ ID NO: 8437618 - DNA, 22 bp, Homo sapiens
acttccagggtagaggggaaga

SEQ ID NO: 8437619 - DNA, 22 bp, Homo sapiens
aatatcttggcccaactccaga

SEQ ID NO: 8437620 - DNA, 22 bp, Homo sapiens
aatatgaattattgttacaagt

SEQ ID NO: 8437621 - DNA, 22 bp, Homo sapiens
aatatcttctaaggatagaact

SEQ ID NO: 8437622 - DNA, 22 bp, Homo sapiens
aatatcagctctgtcacttact

SEQ ID NO: 8437623 - DNA, 19 bp, Homo sapiens
acttcctgcccgctccttt

SEQ ID NO: 8437624 - DNA, 22 bp, Homo sapiens
acttcctgcaatcgtccactcc

SEQ ID NO: 8437625 - DNA, 23 bp, Homo sapiens
acttccagttataggaactcttc

SEQ ID NO: 8437626 - DNA, 22 bp, Homo sapiens
acttccaggttccacccaagac

SEQ ID NO: 8437627 - DNA, 22 bp, Homo sapiens
acttcccaacacttttgagatg

SEQ ID NO: 8437628 - DNA, 22 bp, Homo sapiens
acttcccaacacttttgagatg

SEQ ID NO: 8437629 - DNA, 22 bp, Homo sapiens
acttcccactgcagtgactgag

SEQ ID NO: 8437630 - DNA, 22 bp, Homo sapiens
acttcccacaccctgttttctc

SEQ ID NO: 8437631 - DNA, 22 bp, Homo sapiens
acttcccaacgtgggcctccca

SEQ ID NO: 8437632 - DNA, 22 bp, Homo sapiens
acttcccatttctctgctttag

SEQ ID NO: 8437633 - DNA, 22 bp, Homo sapiens
acttcccaggtggtgtggagtt

SEQ ID NO: 8437634 - DNA, 22 bp, Homo sapiens
aatctatatgcttttcacatac

SEQ ID NO: 8437635 - DNA, 22 bp, Homo sapiens
aatctatatgcttttcacatac

SEQ ID NO: 8437636 - DNA, 22 bp, Homo sapiens
aatctatatgcttttcacatac

SEQ ID NO: 8437637 - DNA, 22 bp, Homo sapiens
aatctatatgcttttcacatac

SEQ ID NO: 8437638 - DNA, 22 bp, Homo sapiens
agaaactgaacacaagagtcgg

SEQ ID NO: 8437639 - DNA, 22 bp, Homo sapiens
agaaactgaacacaagagtcgg

SEQ ID NO: 8437640 - DNA, 22 bp, Homo sapiens
agaaactcacctttccagccat

SEQ ID NO: 8437641 - DNA, 22 bp, Homo sapiens
agaaactctaggtcaattgagg

SEQ ID NO: 8437642 - DNA, 22 bp, Homo sapiens
agaaactctggaagaactttta

SEQ ID NO: 8437643 - DNA, 22 bp, Homo sapiens
agaaactctggaagaactttta

SEQ ID NO: 8437644 - DNA, 22 bp, Homo sapiens
agaaactattatggtaaacaaa

SEQ ID NO: 8437645 - DNA, 22 bp, Homo sapiens
agaaactattatggtaaacaaa

SEQ ID NO: 8437646 - DNA, 22 bp, Homo sapiens
agaaactaagtcataactcttt

SEQ ID NO: 8437647 - DNA, 22 bp, Homo sapiens
aatctcaagctgtaaatacctc

SEQ ID NO: 8437648 - DNA, 22 bp, Homo sapiens
aatcttaaagaatattctacca

SEQ ID NO: 8437649 - DNA, 22 bp, Homo sapiens
aatcttacaccgaatttaaact

SEQ ID NO: 8437650 - DNA, 22 bp, Homo sapiens
aatcttcacagagaaaattagg

SEQ ID NO: 8437651 - DNA, 22 bp, Homo sapiens
aatcttcataaaaatctagtag

SEQ ID NO: 8437652 - DNA, 22 bp, Homo sapiens
aatcttcagcactccagagact

SEQ ID NO: 8437653 - DNA, 22 bp, Homo sapiens
aatcttcactcattcagagttg

SEQ ID NO: 8437654 - DNA, 22 bp, Homo sapiens
aatcttttgattctagggctgt

SEQ ID NO: 8437655 - DNA, 22 bp, Homo sapiens
aatcttttaggggatcctgagg

SEQ ID NO: 8437656 - DNA, 22 bp, Homo sapiens
aatctttttcacaagaaagcac

SEQ ID NO: 8437657 - DNA, 22 bp, Homo sapiens
aatctttttcacaagaaagcac

SEQ ID NO: 8437658 - DNA, 22 bp, Homo sapiens
aatctttttcacaagaaagcac

SEQ ID NO: 8437659 - DNA, 22 bp, Homo sapiens
aatctttaaggactcagtctct

SEQ ID NO: 8437660 - DNA, 22 bp, Homo sapiens
aatcttggttgcagtatatccg

SEQ ID NO: 8437661 - DNA, 22 bp, Homo sapiens
aatctttaaggactcagtctct

SEQ ID NO: 8437662 - DNA, 22 bp, Homo sapiens
agaaaactgggaggagagcttc

SEQ ID NO: 8437663 - DNA, 22 bp, Homo sapiens
agaaaataatttcttggctggt

SEQ ID NO: 8437664 - DNA, 22 bp, Homo sapiens
agaaaataatttcttggctggt

SEQ ID NO: 8437665 - DNA, 22 bp, Homo sapiens
aatattcatttgcagaagaagt

SEQ ID NO: 8437666 - DNA, 22 bp, Homo sapiens
aatattcaagttattctttctt

SEQ ID NO: 8437667 - DNA, 22 bp, Homo sapiens
agaaaatattcattgagaggct

SEQ ID NO: 8437668 - DNA, 22 bp, Homo sapiens
agaaaataatttcttggctggt

SEQ ID NO: 8437669 - DNA, 21 bp, Homo sapiens
agaaaatggcgttttagattt

SEQ ID NO: 8437670 - DNA, 22 bp, Homo sapiens
agaaaatattcattgagaggct

SEQ ID NO: 8437671 - DNA, 20 bp, Homo sapiens
agaaaatgttttcagctgga

SEQ ID NO: 8437672 - DNA, 23 bp, Homo sapiens
agaaaccactgaagagatccagt

SEQ ID NO: 8437673 - DNA, 22 bp, Homo sapiens
agaaaccatctttatatatctg

SEQ ID NO: 8437674 - DNA, 22 bp, Homo sapiens
agaaaccatctttatatatctg

SEQ ID NO: 8437675 - DNA, 22 bp, Homo sapiens
agaaacctcacagcaattctga

SEQ ID NO: 8437676 - DNA, 22 bp, Homo sapiens
aatatggctccattcctttagg

SEQ ID NO: 8437677 - DNA, 22 bp, Homo sapiens
aatatggcttgttactatgttt

SEQ ID NO: 8437678 - DNA, 22 bp, Homo sapiens
aatatgcagcatgatgaagtaa

SEQ ID NO: 8437679 - DNA, 22 bp, Homo sapiens
aatatgatgccaaattgctaca

SEQ ID NO: 8437680 - DNA, 22 bp, Homo sapiens
aatatgtttataagatatcttc

SEQ ID NO: 8437681 - DNA, 22 bp, Homo sapiens
aatatgtttataagatatcttc

SEQ ID NO: 8437682 - DNA, 22 bp, Homo sapiens
aatatgttcaaaatagatcact

SEQ ID NO: 8437683 - DNA, 22 bp, Homo sapiens
aatatgttcaaaatagatcact

SEQ ID NO: 8437684 - DNA, 21 bp, Homo sapiens
acataactgtcaagtaacgtt

SEQ ID NO: 8437685 - DNA, 22 bp, Homo sapiens
acataagtgcacaataaatatt

SEQ ID NO: 8437686 - DNA, 22 bp, Homo sapiens
acataacatagttgacattttt

SEQ ID NO: 8437687 - DNA, 22 bp, Homo sapiens
acataataggtacctgaataat

SEQ ID NO: 8437688 - DNA, 22 bp, Homo sapiens
acataatagcatttctaatttg

SEQ ID NO: 8437689 - DNA, 22 bp, Homo sapiens
acataataaaaataacagctca

SEQ ID NO: 8437690 - DNA, 22 bp, Homo sapiens
acataagttatggataaaatgt

SEQ ID NO: 8437691 - DNA, 18 bp, Homo sapiens
acatacattctgtctgca

SEQ ID NO: 8437692 - DNA, 22 bp, Homo sapiens
acataataggtgcctgaatatt

SEQ ID NO: 8437693 - DNA, 22 bp, Homo sapiens
acataatggacaataatgcatc

SEQ ID NO: 8437694 - DNA, 22 bp, Homo sapiens
acatgccaagatcctcgtcttt

SEQ ID NO: 8437695 - DNA, 22 bp, Homo sapiens
acatagaaatttatttcttaca

SEQ ID NO: 8437696 - DNA, 22 bp, Homo sapiens
acatacttaacattaaagtcat

SEQ ID NO: 8437697 - DNA, 22 bp, Homo sapiens
acatggggcccaaagagaggtc

SEQ ID NO: 8437698 - DNA, 17 bp, Homo sapiens
acatgggctgagactcc

SEQ ID NO: 8437699 - DNA, 22 bp, Homo sapiens
acatgggatcaatgaggcaggc

SEQ ID NO: 8437700 - DNA, 22 bp, Homo sapiens
acatggctggcaccttaaattt

SEQ ID NO: 8437701 - DNA, 19 bp, Homo sapiens
acatggctctccagtctgg

SEQ ID NO: 8437702 - DNA, 23 bp, Homo sapiens
acatgggagggacatggaggctg

SEQ ID NO: 8437703 - DNA, 22 bp, Homo sapiens
acatgtaaaaattaaggtaaga

SEQ ID NO: 8437704 - DNA, 22 bp, Homo sapiens
acatggtgtgctgagaatgaca

SEQ ID NO: 8437705 - DNA, 22 bp, Homo sapiens
acatggtgagcggcaggcctat

SEQ ID NO: 8437706 - DNA, 22 bp, Homo sapiens
acatggtgagcggcaggcctat

SEQ ID NO: 8437707 - DNA, 22 bp, Homo sapiens
aaggccagctggagggatgagg

SEQ ID NO: 8437708 - DNA, 22 bp, Homo sapiens
aaggccagcgcagaccattgtc

SEQ ID NO: 8437709 - DNA, 22 bp, Homo sapiens
aaggccaggacaccaggggact

SEQ ID NO: 8437710 - DNA, 22 bp, Homo sapiens
aaggccaggaaattatccctat

SEQ ID NO: 8437711 - DNA, 22 bp, Homo sapiens
aaggccagcttgtagggctggt

SEQ ID NO: 8437712 - DNA, 22 bp, Homo sapiens
aaggccagcttgtagggctggt

SEQ ID NO: 8437713 - DNA, 21 bp, Homo sapiens
acattacagggtgatgtgtct

SEQ ID NO: 8437714 - DNA, 22 bp, Homo sapiens
acattacagcaagtttacgtta

SEQ ID NO: 8437715 - DNA, 22 bp, Homo sapiens
acattacataagattgtaacct

SEQ ID NO: 8437716 - DNA, 22 bp, Homo sapiens
aaggccaggccagatgacagtc

SEQ ID NO: 8437717 - DNA, 22 bp, Homo sapiens
aaggccaggcctagcacggagg

SEQ ID NO: 8437718 - DNA, 22 bp, Homo sapiens
aaggccaggagacttggagtca

SEQ ID NO: 8437719 - DNA, 22 bp, Homo sapiens
aaggccaggcagggagctgtga

SEQ ID NO: 8437720 - DNA, 22 bp, Homo sapiens
aaggccaggccagatgacagtc

SEQ ID NO: 8437721 - DNA, 22 bp, Homo sapiens
aaggccaggccagatgacagtc

SEQ ID NO: 8437722 - DNA, 21 bp, Homo sapiens
acattataattcatattccac

SEQ ID NO: 8437723 - DNA, 22 bp, Homo sapiens
acattcaaaaagcatctgtcac

SEQ ID NO: 8437724 - DNA, 22 bp, Homo sapiens
acattagaacattaatattggg

SEQ ID NO: 8437725 - DNA, 22 bp, Homo sapiens
acattagagaagcttggagatg

SEQ ID NO: 8437726 - DNA, 22 bp, Homo sapiens
acattcaaaattgtggtttaga

SEQ ID NO: 8437727 - DNA, 22 bp, Homo sapiens
acattcaaaatatttctgatgt

SEQ ID NO: 8437728 - DNA, 22 bp, Homo sapiens
acattcaaaattaggttagttg

SEQ ID NO: 8437729 - DNA, 22 bp, Homo sapiens
acattcaaaaagcatctgtcac

SEQ ID NO: 8437730 - DNA, 22 bp, Homo sapiens
acattctattctgcaggacaag

SEQ ID NO: 8437731 - DNA, 22 bp, Homo sapiens
acattcaagatgcattcactta

SEQ ID NO: 8437732 - DNA, 22 bp, Homo sapiens
acattctctccatgtcttcttt

SEQ ID NO: 8437733 - DNA, 22 bp, Homo sapiens
acattctcttttagaaagctgt

SEQ ID NO: 8437734 - DNA, 22 bp, Homo sapiens
acattctggatgtctgatgaga

SEQ ID NO: 8437735 - DNA, 22 bp, Homo sapiens
aagtaaaatgtttcctttatta

SEQ ID NO: 8437736 - DNA, 22 bp, Homo sapiens
aagtaaaatgtttcctttatta

SEQ ID NO: 8437737 - DNA, 22 bp, Homo sapiens
aagtaaaagctttaccatgcgc

SEQ ID NO: 8437738 - DNA, 22 bp, Homo sapiens
aagtaaaattcaatcttcactg

SEQ ID NO: 8437739 - DNA, 22 bp, Homo sapiens
aagtaaaagcaggtgtgctggg

SEQ ID NO: 8437740 - DNA, 22 bp, Homo sapiens
accaggccaaaatcatatttac

SEQ ID NO: 8437741 - DNA, 22 bp, Homo sapiens
accaggccaaaatcatatttac

SEQ ID NO: 8437742 - DNA, 22 bp, Homo sapiens
accaggccaaaatcatatttac

SEQ ID NO: 8437743 - DNA, 22 bp, Homo sapiens
accaggccaacagctaagttaa

SEQ ID NO: 8437744 - DNA, 21 bp, Homo sapiens
accaggccaggaggctggcac

SEQ ID NO: 8437745 - DNA, 21 bp, Homo sapiens
accaggccaggaggctggcac

SEQ ID NO: 8437746 - DNA, 22 bp, Homo sapiens
aaggttgcagcagtgttgatga

SEQ ID NO: 8437747 - DNA, 22 bp, Homo sapiens
aaggttgctgttttgcttcaaa

SEQ ID NO: 8437748 - DNA, 22 bp, Homo sapiens
aaggttagtaatatttctatat

SEQ ID NO: 8437749 - DNA, 22 bp, Homo sapiens
aaggttagtgcatcttttgttt

SEQ ID NO: 8437750 - DNA, 22 bp, Homo sapiens
accaggcagcaccaaagccggt

SEQ ID NO: 8437751 - DNA, 22 bp, Homo sapiens
accaggcagctgggggtgatgt

SEQ ID NO: 8437752 - DNA, 22 bp, Homo sapiens
accaggcagagctgggccttaa

SEQ ID NO: 8437753 - DNA, 22 bp, Homo sapiens
accaggcagtcaccgtccagga

SEQ ID NO: 8437754 - DNA, 22 bp, Homo sapiens
accaggcaaaaccacaggagca

SEQ ID NO: 8437755 - DNA, 17 bp, Homo sapiens
accaggcaacacgccca

SEQ ID NO: 8437756 - DNA, 22 bp, Homo sapiens
accaggcactcctgaggtctga

SEQ ID NO: 8437757 - DNA, 22 bp, Homo sapiens
accaggcactcttgtggcagtg

SEQ ID NO: 8437758 - DNA, 22 bp, Homo sapiens
accagctgttatctgtagtatc

SEQ ID NO: 8437759 - DNA, 22 bp, Homo sapiens
accaggagttttgaccaggggc

SEQ ID NO: 8437760 - DNA, 22 bp, Homo sapiens
accaggaaaaacactgtgttgg

SEQ ID NO: 8437761 - DNA, 22 bp, Homo sapiens
accaggaaactctcgtctagtt

SEQ ID NO: 8437762 - DNA, 22 bp, Homo sapiens
accaggaaactgtgcccacgac

SEQ ID NO: 8437763 - DNA, 22 bp, Homo sapiens
acattcttaacagttaaaaact

SEQ ID NO: 8437764 - DNA, 22 bp, Homo sapiens
acattcttcagctttgtcaggc

SEQ ID NO: 8437765 - DNA, 22 bp, Homo sapiens
acattcttccagctggctgttg

SEQ ID NO: 8437766 - DNA, 22 bp, Homo sapiens
acattttgcccttatttgctga

SEQ ID NO: 8437767 - DNA, 22 bp, Homo sapiens
accacaggacccatgagtcagt

SEQ ID NO: 8437768 - DNA, 22 bp, Homo sapiens
accacaggaggatggctgctgg

SEQ ID NO: 8437769 - DNA, 22 bp, Homo sapiens
accacaggaggatggctgctgg

SEQ ID NO: 8437770 - DNA, 22 bp, Homo sapiens
accacccccttgggtgtggaag

SEQ ID NO: 8437771 - DNA, 22 bp, Homo sapiens
accaccccagaatttttcaagg

SEQ ID NO: 8437772 - DNA, 22 bp, Homo sapiens
accacccacctcacagcatagt

SEQ ID NO: 8437773 - DNA, 22 bp, Homo sapiens
accacatctagattgcagccct

SEQ ID NO: 8437774 - DNA, 22 bp, Homo sapiens
accacatcgggcggacactggg

SEQ ID NO: 8437775 - DNA, 22 bp, Homo sapiens
accacaggggaggaatgatgcc

SEQ ID NO: 8437776 - DNA, 22 bp, Homo sapiens
aagggcagcctgactcacggtc

SEQ ID NO: 8437777 - DNA, 23 bp, Homo sapiens
accagctgccctgaactttgtgc

SEQ ID NO: 8437778 - DNA, 22 bp, Homo sapiens
accagctgccttttcttagtag

SEQ ID NO: 8437779 - DNA, 22 bp, Homo sapiens
accagctgcctggtctatctgc

SEQ ID NO: 8437780 - DNA, 22 bp, Homo sapiens
aagggcagcttaaattggtagc

SEQ ID NO: 8437781 - DNA, 22 bp, Homo sapiens
accagcacggattagaatgctt

SEQ ID NO: 8437782 - DNA, 23 bp, Homo sapiens
acagcttgccaattagccttccg

SEQ ID NO: 8437783 - DNA, 22 bp, Homo sapiens
acagcttttgaaaaattactgg

SEQ ID NO: 8437784 - DNA, 22 bp, Homo sapiens
acagctttttactaatagattg

SEQ ID NO: 8437785 - DNA, 22 bp, Homo sapiens
acaggaaattggcatatcagtt

SEQ ID NO: 8437786 - DNA, 22 bp, Homo sapiens
acaggaaatgaaatggtatcta

SEQ ID NO: 8437787 - DNA, 22 bp, Homo sapiens
acaggaaatgaaatggtatcta

SEQ ID NO: 8437788 - DNA, 21 bp, Homo sapiens
acaggagaccgcctggcagtc

SEQ ID NO: 8437789 - DNA, 22 bp, Homo sapiens
acaggaacccagaaacatttct

SEQ ID NO: 8437790 - DNA, 21 bp, Homo sapiens
acagattttatatctctgctg

SEQ ID NO: 8437791 - DNA, 22 bp, Homo sapiens
acagattttggtatttgcaatg

SEQ ID NO: 8437792 - DNA, 22 bp, Homo sapiens
acagcttgcatgcagaggcact

SEQ ID NO: 8437793 - DNA, 22 bp, Homo sapiens
acagctggagtgttggtgaggt

SEQ ID NO: 8437794 - DNA, 22 bp, Homo sapiens
acagctggagtgttggtgaggt

SEQ ID NO: 8437795 - DNA, 22 bp, Homo sapiens
acagattttaaatgacactccc

SEQ ID NO: 8437796 - DNA, 22 bp, Homo sapiens
acagatttggcccagccaatgc

SEQ ID NO: 8437797 - DNA, 22 bp, Homo sapiens
acagatttggcccagccaatgc

SEQ ID NO: 8437798 - DNA, 22 bp, Homo sapiens
acagatttggaggcctcacccc

SEQ ID NO: 8437799 - DNA, 22 bp, Homo sapiens
acagatgaggaatttatttggt

SEQ ID NO: 8437800 - DNA, 20 bp, Homo sapiens
acagatgaggaaaatgaagt

SEQ ID NO: 8437801 - DNA, 22 bp, Homo sapiens
acaggcagagaactcagccaga

SEQ ID NO: 8437802 - DNA, 19 bp, Homo sapiens
acaggcagaattgggtgtg

SEQ ID NO: 8437803 - DNA, 22 bp, Homo sapiens
acaggcactgtcaagtcatgaa

SEQ ID NO: 8437804 - DNA, 22 bp, Homo sapiens
acaggcactttgacatgccatc

SEQ ID NO: 8437805 - DNA, 22 bp, Homo sapiens
acaggcactctcattaaaatag

SEQ ID NO: 8437806 - DNA, 22 bp, Homo sapiens
acaggagctctagggacagcac

SEQ ID NO: 8437807 - DNA, 22 bp, Homo sapiens
acaggagctctagggacagcac

SEQ ID NO: 8437808 - DNA, 22 bp, Homo sapiens
acaggagccaaacacatgccag

SEQ ID NO: 8437809 - DNA, 22 bp, Homo sapiens
acaggagccaaacacatgccag

SEQ ID NO: 8437810 - DNA, 22 bp, Homo sapiens
acaggagcaacagactaagaca

SEQ ID NO: 8437811 - DNA, 20 bp, Homo sapiens
acaggagatctgaggaaagg

SEQ ID NO: 8437812 - DNA, 20 bp, Homo sapiens
acaggagatctgaggaaagg

SEQ ID NO: 8437813 - DNA, 22 bp, Homo sapiens
acaggctctggggcaggatggc

SEQ ID NO: 8437814 - DNA, 22 bp, Homo sapiens
aagccctggcccaaccttgatt

SEQ ID NO: 8437815 - DNA, 22 bp, Homo sapiens
aagccctggcgggtggagggcc

SEQ ID NO: 8437816 - DNA, 22 bp, Homo sapiens
aagccctggcgggtggagggcc

SEQ ID NO: 8437817 - DNA, 22 bp, Homo sapiens
aagccctggaactttcctagcc

SEQ ID NO: 8437818 - DNA, 22 bp, Homo sapiens
aagccctggacggcccttcccc

SEQ ID NO: 8437819 - DNA, 22 bp, Homo sapiens
aagccctggacggcccttcccc

SEQ ID NO: 8437820 - DNA, 22 bp, Homo sapiens
aagccctggattaaagatgcca

SEQ ID NO: 8437821 - DNA, 22 bp, Homo sapiens
aagccctggcaatgtcagatga

SEQ ID NO: 8437822 - DNA, 22 bp, Homo sapiens
aagccctgccacccattcactg

SEQ ID NO: 8437823 - DNA, 22 bp, Homo sapiens
aagccctgagcactgcagagaa

SEQ ID NO: 8437824 - DNA, 22 bp, Homo sapiens
aagccctgagcactgcagagaa

SEQ ID NO: 8437825 - DNA, 22 bp, Homo sapiens
acaggcagagagtggcggactc

SEQ ID NO: 8437826 - DNA, 22 bp, Homo sapiens
acaggcagagtcaggttgggtt

SEQ ID NO: 8437827 - DNA, 22 bp, Homo sapiens
acagtgtagcatggtagcaatg

SEQ ID NO: 8437828 - DNA, 22 bp, Homo sapiens
acagtgtccccagctctgtgag

SEQ ID NO: 8437829 - DNA, 22 bp, Homo sapiens
acagtgctcatgtgacatggtg

SEQ ID NO: 8437830 - DNA, 22 bp, Homo sapiens
acagtgctgaacgacatggaag

SEQ ID NO: 8437831 - DNA, 22 bp, Homo sapiens
acagtgctaatgatgccaagat

SEQ ID NO: 8437832 - DNA, 22 bp, Homo sapiens
acagtgctgatctagactgacc

SEQ ID NO: 8437833 - DNA, 22 bp, Homo sapiens
acagtgctgaacgacatggaag

SEQ ID NO: 8437834 - DNA, 18 bp, Homo sapiens
acagtgctgtcactgctt

SEQ ID NO: 8437835 - DNA, 22 bp, Homo sapiens
acagtgctgtctatctcactaa

SEQ ID NO: 8437836 - DNA, 20 bp, Homo sapiens
acagtgggtggggagcactg

SEQ ID NO: 8437837 - DNA, 22 bp, Homo sapiens
acagtgcattattgctgaatgc

SEQ ID NO: 8437838 - DNA, 22 bp, Homo sapiens
acagtgcattattgctgaatgc

SEQ ID NO: 8437839 - DNA, 22 bp, Homo sapiens
acagtgctaaacacttcttgaa

SEQ ID NO: 8437840 - DNA, 19 bp, Homo sapiens
acagtgcatgggacctggt

SEQ ID NO: 8437841 - DNA, 19 bp, Homo sapiens
acagtgcatgggacctggt

SEQ ID NO: 8437842 - DNA, 19 bp, Homo sapiens
acagtgcatgggacctggt

SEQ ID NO: 8437843 - DNA, 20 bp, Homo sapiens
acagtgcatggggggacagc

SEQ ID NO: 8437844 - DNA, 20 bp, Homo sapiens
acagtgcatggggggacagc

SEQ ID NO: 8437845 - DNA, 22 bp, Homo sapiens
acagtctttgcaaagtcctggt

SEQ ID NO: 8437846 - DNA, 22 bp, Homo sapiens
acagtctttgcaggagaaagga

SEQ ID NO: 8437847 - DNA, 22 bp, Homo sapiens
acagtgcaggtctcaacaatta

SEQ ID NO: 8437848 - DNA, 22 bp, Homo sapiens
acagtgcaggtctcaacaatta

SEQ ID NO: 8437849 - DNA, 22 bp, Homo sapiens
acagtgcaggtctcaacaatta

SEQ ID NO: 8437850 - DNA, 22 bp, Homo sapiens
acagtgcataaaaacaactttt

SEQ ID NO: 8437851 - DNA, 22 bp, Homo sapiens
acagtgcataaaaacaactttt

SEQ ID NO: 8437852 - DNA, 22 bp, Homo sapiens
acagtgcagtgtgatgagtatt

SEQ ID NO: 8437853 - DNA, 22 bp, Homo sapiens
acagtgcagtgtgatgagtatt

SEQ ID NO: 8437854 - DNA, 22 bp, Homo sapiens
acagtctttgcaaagtcctggt

SEQ ID NO: 8437855 - DNA, 22 bp, Homo sapiens
acagtgcagtgtgatgagtatt

SEQ ID NO: 8437856 - DNA, 22 bp, Homo sapiens
acaggtgtgagaacatgccttg

SEQ ID NO: 8437857 - DNA, 22 bp, Homo sapiens
acagtctttctacattctgtgc

SEQ ID NO: 8437858 - DNA, 23 bp, Homo sapiens
acagggcttatctgtcactcatc

SEQ ID NO: 8437859 - DNA, 22 bp, Homo sapiens
acaggcttttttgctctcgaat

SEQ ID NO: 8437860 - DNA, 22 bp, Homo sapiens
acaggtcagataaaggctggtg

SEQ ID NO: 8437861 - DNA, 22 bp, Homo sapiens
acaggtagtgggctagatctgg

SEQ ID NO: 8437862 - DNA, 22 bp, Homo sapiens
acaggtctactggcaagcagtg

SEQ ID NO: 8437863 - DNA, 22 bp, Homo sapiens
acaggtctccagagtgagagga

SEQ ID NO: 8437864 - DNA, 22 bp, Homo sapiens
acaggtctccagagtgagagga

SEQ ID NO: 8437865 - DNA, 22 bp, Homo sapiens
acaggtctgcagtaactgggaa

SEQ ID NO: 8437866 - DNA, 22 bp, Homo sapiens
acaggtctgtgtgcacagtgct

SEQ ID NO: 8437867 - DNA, 22 bp, Homo sapiens
acaggtctggtctgggtgggac

SEQ ID NO: 8437868 - DNA, 22 bp, Homo sapiens
acaggctgaggatgattgcatc

SEQ ID NO: 8437869 - DNA, 22 bp, Homo sapiens
acaggctgaggatgattgcatc

SEQ ID NO: 8437870 - DNA, 22 bp, Homo sapiens
acaggctgagcgtccatcttca

SEQ ID NO: 8437871 - DNA, 22 bp, Homo sapiens
acaggctgagcgtccatcttca

SEQ ID NO: 8437872 - DNA, 22 bp, Homo sapiens
acaggctgacttcctgccatgt

SEQ ID NO: 8437873 - DNA, 22 bp, Homo sapiens
acaggctgacttcctgccatgt

SEQ ID NO: 8437874 - DNA, 23 bp, Homo sapiens
acaggctcttaatcagtgctcct

SEQ ID NO: 8437875 - DNA, 22 bp, Homo sapiens
acaggctctggggcaggatggc

SEQ ID NO: 8437876 - DNA, 22 bp, Homo sapiens
acaggctgaaagttaagttctg

SEQ ID NO: 8437877 - DNA, 22 bp, Homo sapiens
acaggctgaaagttaagttctg

SEQ ID NO: 8437878 - DNA, 22 bp, Homo sapiens
acaggcttacaggctgcaagta

SEQ ID NO: 8437879 - DNA, 22 bp, Homo sapiens
acaggctgccacttgcatccaa

SEQ ID NO: 8437880 - DNA, 22 bp, Homo sapiens
acaggctgccacttgcatccaa

SEQ ID NO: 8437881 - DNA, 22 bp, Homo sapiens
acaggctgccacttgcatccaa

SEQ ID NO: 8437882 - DNA, 22 bp, Homo sapiens
acaggctgatagaccataaata

SEQ ID NO: 8437883 - DNA, 22 bp, Homo sapiens
acaggctgatagaccataaata

SEQ ID NO: 8437884 - DNA, 22 bp, Homo sapiens
acaggcttagggcttgggcccg

SEQ ID NO: 8437885 - DNA, 22 bp, Homo sapiens
acaggctttaaatttaaaacca

SEQ ID NO: 8437886 - DNA, 22 bp, Homo sapiens
acaggcttgcactagggtggca

SEQ ID NO: 8437887 - DNA, 17 bp, Homo sapiens
agcagctgaagcagcca

SEQ ID NO: 8437888 - DNA, 17 bp, Homo sapiens
agcagctgaagcagcca

SEQ ID NO: 8437889 - DNA, 21 bp, Homo sapiens
agcagccatggatggtatgta

SEQ ID NO: 8437890 - DNA, 22 bp, Homo sapiens
agcagctctgagaggccagcac

SEQ ID NO: 8437891 - DNA, 22 bp, Homo sapiens
agcagctcttaacaaagcatgg

SEQ ID NO: 8437892 - DNA, 21 bp, Homo sapiens
agcagccatttcacagagact

SEQ ID NO: 8437893 - DNA, 22 bp, Homo sapiens
agcagccatagatagcatgcaa

SEQ ID NO: 8437894 - DNA, 22 bp, Homo sapiens
agcagccagttctctgtggtag

SEQ ID NO: 8437895 - DNA, 21 bp, Homo sapiens
agcaggaggcagtcacagctc

SEQ ID NO: 8437896 - DNA, 21 bp, Homo sapiens
agcaggaggcagtcacagctc

SEQ ID NO: 8437897 - DNA, 22 bp, Homo sapiens
agcaggagggttttgtagagtc

SEQ ID NO: 8437898 - DNA, 22 bp, Homo sapiens
agcaggcaggctgccagtgaat

SEQ ID NO: 8437899 - DNA, 22 bp, Homo sapiens
agcaggcaggctgccagtgaat

SEQ ID NO: 8437900 - DNA, 22 bp, Homo sapiens
agcaggagggttttgtagagtc

SEQ ID NO: 8437901 - DNA, 22 bp, Homo sapiens
agcaggagctgtgggaagatgg

SEQ ID NO: 8437902 - DNA, 22 bp, Homo sapiens
agcaggagctgtgggaagatgg

SEQ ID NO: 8437903 - DNA, 22 bp, Homo sapiens
agcaggaacgagttcatgggga

SEQ ID NO: 8437904 - DNA, 22 bp, Homo sapiens
agcaggaacgagttcatgggga

SEQ ID NO: 8437905 - DNA, 22 bp, Homo sapiens
agcagctgagatggtaagattc

SEQ ID NO: 8437906 - DNA, 22 bp, Homo sapiens
agcagttactagttaaatgcat

SEQ ID NO: 8437907 - DNA, 22 bp, Homo sapiens
agcagttatattactctcaggt

SEQ ID NO: 8437908 - DNA, 22 bp, Homo sapiens
agcagttatattgaaataaaaa

SEQ ID NO: 8437909 - DNA, 23 bp, Homo sapiens
agcagttagggatacaagttatc

SEQ ID NO: 8437910 - DNA, 19 bp, Homo sapiens
agcagttatatgcatggga

SEQ ID NO: 8437911 - DNA, 22 bp, Homo sapiens
agcagttatcgaagaatcaggt

SEQ ID NO: 8437912 - DNA, 22 bp, Homo sapiens
agcatcagcagactctcagcta

SEQ ID NO: 8437913 - DNA, 22 bp, Homo sapiens
agcatcagcagactctcagcta

SEQ ID NO: 8437914 - DNA, 22 bp, Homo sapiens
agcatccactcactgggagagg

SEQ ID NO: 8437915 - DNA, 22 bp, Homo sapiens
agcatccaactttgattagaga

SEQ ID NO: 8437916 - DNA, 22 bp, Homo sapiens
agcatcagcctctgtcctggag

SEQ ID NO: 8437917 - DNA, 22 bp, Homo sapiens
agcatcagcctctgtcctggag

SEQ ID NO: 8437918 - DNA, 19 bp, Homo sapiens
agcatccagtcatgggatc

SEQ ID NO: 8437919 - DNA, 22 bp, Homo sapiens
agcatccaggccaggttgggca

SEQ ID NO: 8437920 - DNA, 22 bp, Homo sapiens
agcaggtgacccaagcaggctg

SEQ ID NO: 8437921 - DNA, 22 bp, Homo sapiens
agcaggtgacccaagcaggctg

SEQ ID NO: 8437922 - DNA, 22 bp, Homo sapiens
agcaggtgacccaagcaggctg

SEQ ID NO: 8437923 - DNA, 22 bp, Homo sapiens
agcaggtcttgctctcaacagg

SEQ ID NO: 8437924 - DNA, 22 bp, Homo sapiens
agcagggctttggctggctttc

SEQ ID NO: 8437925 - DNA, 19 bp, Homo sapiens
agcaggccacagggccagc

SEQ ID NO: 8437926 - DNA, 23 bp, Homo sapiens
agcaggcatctgtggcacaaggc

SEQ ID NO: 8437927 - DNA, 23 bp, Homo sapiens
agcaggcatctgtggcacaaggc

SEQ ID NO: 8437928 - DNA, 22 bp, Homo sapiens
agcaggcatagagtagcactca

SEQ ID NO: 8437929 - DNA, 22 bp, Homo sapiens
agcaggcagtgtagagccttca

SEQ ID NO: 8437930 - DNA, 22 bp, Homo sapiens
agcaggcagtgtagagccttca

SEQ ID NO: 8437931 - DNA, 19 bp, Homo sapiens
agcaggcaggtggcccagg

SEQ ID NO: 8437932 - DNA, 19 bp, Homo sapiens
agcaggcaggtggcccagg

SEQ ID NO: 8437933 - DNA, 21 bp, Homo sapiens
agcaggcagtgggctggattt

SEQ ID NO: 8437934 - DNA, 21 bp, Homo sapiens
agcaggcagtgggctggattt

SEQ ID NO: 8437935 - DNA, 20 bp, Homo sapiens
acacactttgatcttgagcc

SEQ ID NO: 8437936 - DNA, 20 bp, Homo sapiens
acacactttgatcttgagcc

SEQ ID NO: 8437937 - DNA, 22 bp, Homo sapiens
acacacttcacccttgagctaa

SEQ ID NO: 8437938 - DNA, 22 bp, Homo sapiens
agcagcagctcattcttcctgt

SEQ ID NO: 8437939 - DNA, 16 bp, Homo sapiens
agcagccagcactgga

SEQ ID NO: 8437940 - DNA, 22 bp, Homo sapiens
agcagccaggaatctgcagagc

SEQ ID NO: 8437941 - DNA, 23 bp, Homo sapiens
acacagaagaagacccaaggaag

SEQ ID NO: 8437942 - DNA, 22 bp, Homo sapiens
acacagaacctcatagcctctc

SEQ ID NO: 8437943 - DNA, 23 bp, Homo sapiens
acacagaagaagacccaaggaag

SEQ ID NO: 8437944 - DNA, 19 bp, Homo sapiens
agcagcagctaccacttgt

SEQ ID NO: 8437945 - DNA, 22 bp, Homo sapiens
agcagcagctcagttctcagct

SEQ ID NO: 8437946 - DNA, 23 bp, Homo sapiens
agcagcagcaattaagtggatat

SEQ ID NO: 8437947 - DNA, 19 bp, Homo sapiens
agcagcagcaccagggatt

SEQ ID NO: 8437948 - DNA, 21 bp, Homo sapiens
agcagcagcagtggggcttct

SEQ ID NO: 8437949 - DNA, 21 bp, Homo sapiens
agcagcagcagtggggcttct

SEQ ID NO: 8437950 - DNA, 22 bp, Homo sapiens
agcagcagattcagcaggaatg

SEQ ID NO: 8437951 - DNA, 22 bp, Homo sapiens
agcagcagattatggtctacat

SEQ ID NO: 8437952 - DNA, 21 bp, Homo sapiens
agcagcaaccacatagttttt

SEQ ID NO: 8437953 - DNA, 22 bp, Homo sapiens
acacactgagtgccataggacc

SEQ ID NO: 8437954 - DNA, 21 bp, Homo sapiens
acacactacacattcctagtt

SEQ ID NO: 8437955 - DNA, 21 bp, Homo sapiens
acacactacacattcctagtt

SEQ ID NO: 8437956 - DNA, 19 bp, Homo sapiens
acacaccagtgcctgtgac

SEQ ID NO: 8437957 - DNA, 22 bp, Homo sapiens
acacacgtgctcaacacgctcc

SEQ ID NO: 8437958 - DNA, 22 bp, Homo sapiens
acacacgtatatatacgtatgt

SEQ ID NO: 8437959 - DNA, 22 bp, Homo sapiens
acacaccatgatttatttaccc

SEQ ID NO: 8437960 - DNA, 22 bp, Homo sapiens
agcactttagaatttagagttg

SEQ ID NO: 8437961 - DNA, 22 bp, Homo sapiens
agcactttaagcaacagatcaa

SEQ ID NO: 8437962 - DNA, 22 bp, Homo sapiens
agcactttgtgcatttctgaag

SEQ ID NO: 8437963 - DNA, 22 bp, Homo sapiens
agcagaaagcttattttgactg

SEQ ID NO: 8437964 - DNA, 23 bp, Homo sapiens
agatttggaaagctgagtggcgt

SEQ ID NO: 8437965 - DNA, 22 bp, Homo sapiens
agatttgggggctagggctggt

SEQ ID NO: 8437966 - DNA, 22 bp, Homo sapiens
agatttgtatgtctaaatgtaa

SEQ ID NO: 8437967 - DNA, 22 bp, Homo sapiens
agatttccgttctctcttcagt

SEQ ID NO: 8437968 - DNA, 22 bp, Homo sapiens
agattttatagataatttccca

SEQ ID NO: 8437969 - DNA, 22 bp, Homo sapiens
agattttagtttggggaggtgc

SEQ ID NO: 8437970 - DNA, 22 bp, Homo sapiens
agattttagtgtagaggacttg

SEQ ID NO: 8437971 - DNA, 22 bp, Homo sapiens
agatttgttgtgagcaggaata

SEQ ID NO: 8437972 - DNA, 21 bp, Homo sapiens
agatttgtcccttcccattta

SEQ ID NO: 8437973 - DNA, 22 bp, Homo sapiens
acacacatggtattgttcagaa

SEQ ID NO: 8437974 - DNA, 22 bp, Homo sapiens
acacacatggtattgttcagaa

SEQ ID NO: 8437975 - DNA, 22 bp, Homo sapiens
acacacatggtattgttcagaa

SEQ ID NO: 8437976 - DNA, 21 bp, Homo sapiens
acagaactgtatagtgataaa

SEQ ID NO: 8437977 - DNA, 22 bp, Homo sapiens
agcccagggctaataggaacca

SEQ ID NO: 8437978 - DNA, 22 bp, Homo sapiens
agcccagggctaataggaacca

SEQ ID NO: 8437979 - DNA, 22 bp, Homo sapiens
agcccaggtccagttcactgca

SEQ ID NO: 8437980 - DNA, 22 bp, Homo sapiens
agcccagctttgaaccatatca

SEQ ID NO: 8437981 - DNA, 22 bp, Homo sapiens
acagaactggaattggaactca

SEQ ID NO: 8437982 - DNA, 22 bp, Homo sapiens
acagaactgcaggaggaaaagc

SEQ ID NO: 8437983 - DNA, 22 bp, Homo sapiens
acagaactgcaggaggaaaagc

SEQ ID NO: 8437984 - DNA, 22 bp, Homo sapiens
acagaactgcagacagtgccaa

SEQ ID NO: 8437985 - DNA, 22 bp, Homo sapiens
acagaacaggctgagaaaaaca

SEQ ID NO: 8437986 - DNA, 22 bp, Homo sapiens
acagaacaggctgagaaaaaca

SEQ ID NO: 8437987 - DNA, 22 bp, Homo sapiens
acagaacaggctgagaaaaaca

SEQ ID NO: 8437988 - DNA, 21 bp, Homo sapiens
acagacagggccagtgtcccc

SEQ ID NO: 8437989 - DNA, 22 bp, Homo sapiens
acagacagtaaatagtgtggct

SEQ ID NO: 8437990 - DNA, 22 bp, Homo sapiens
acagacatatttggcccatagc

SEQ ID NO: 8437991 - DNA, 22 bp, Homo sapiens
acagacatcatcaacatcttcc

SEQ ID NO: 8437992 - DNA, 22 bp, Homo sapiens
acagacatctatccatttaatt

SEQ ID NO: 8437993 - DNA, 22 bp, Homo sapiens
agcccaggtgaggggttcgaaa

SEQ ID NO: 8437994 - DNA, 22 bp, Homo sapiens
agcccaggtgactcatacaccc

SEQ ID NO: 8437995 - DNA, 22 bp, Homo sapiens
agcccaggtgactcatacaccc

SEQ ID NO: 8437996 - DNA, 22 bp, Homo sapiens
agcccaggtctggcccagcctg

SEQ ID NO: 8437997 - DNA, 22 bp, Homo sapiens
agcccaggtctcaaagtacagg

SEQ ID NO: 8437998 - DNA, 22 bp, Homo sapiens
agcatcctgcttgctgtctgtg

SEQ ID NO: 8437999 - DNA, 22 bp, Homo sapiens
agcatcctccttcccagagatg

SEQ ID NO: 8438000 - DNA, 22 bp, Homo sapiens
agcatcctgcctctcctcccaa

SEQ ID NO: 8438001 - DNA, 22 bp, Homo sapiens
agcatctgcataatgccttccc

SEQ ID NO: 8438002 - DNA, 22 bp, Homo sapiens
agcatctctgggagtcatccgt

SEQ ID NO: 8438003 - DNA, 22 bp, Homo sapiens
agcatctgcatattgggagacc

SEQ ID NO: 8438004 - DNA, 22 bp, Homo sapiens
agcatctgcttaatggcttaac

SEQ ID NO: 8438005 - DNA, 22 bp, Homo sapiens
agcatctggatggaaagcaagg

SEQ ID NO: 8438006 - DNA, 22 bp, Homo sapiens
agcatctgtgatattttgttat

SEQ ID NO: 8438007 - DNA, 22 bp, Homo sapiens
agcatctgttaagtgccttcaa

SEQ ID NO: 8438008 - DNA, 20 bp, Homo sapiens
agcatcttgcatcttcaagt

SEQ ID NO: 8438009 - DNA, 22 bp, Homo sapiens
agcatctttaggaagagaaaga

SEQ ID NO: 8438010 - DNA, 22 bp, Homo sapiens
agcattcattgctagaatgtaa

SEQ ID NO: 8438011 - DNA, 22 bp, Homo sapiens
agcattctcagaatgtcatttt

SEQ ID NO: 8438012 - DNA, 22 bp, Homo sapiens
agcattccacactgaagtctgc

SEQ ID NO: 8438013 - DNA, 20 bp, Homo sapiens
agccaggctcaagctccccc

SEQ ID NO: 8438014 - DNA, 22 bp, Homo sapiens
agccaggaatgcatgctctgct

SEQ ID NO: 8438015 - DNA, 22 bp, Homo sapiens
agccaggaatgcatgctctgct

SEQ ID NO: 8438016 - DNA, 22 bp, Homo sapiens
agcatttaatcctacatagatc

SEQ ID NO: 8438017 - DNA, 22 bp, Homo sapiens
agcattgtctccaagcaggtct

SEQ ID NO: 8438018 - DNA, 22 bp, Homo sapiens
agccctgggttagggtgggagc

SEQ ID NO: 8438019 - DNA, 22 bp, Homo sapiens
agccctgggtcccagtcctggc

SEQ ID NO: 8438020 - DNA, 22 bp, Homo sapiens
agccctgggtcccagtcctggc

SEQ ID NO: 8438021 - DNA, 20 bp, Homo sapiens
agccctgtaaatcccctgga

SEQ ID NO: 8438022 - DNA, 20 bp, Homo sapiens
agccctgtaaatcccctgga

SEQ ID NO: 8438023 - DNA, 22 bp, Homo sapiens
agccctgtctctcactccaggt

SEQ ID NO: 8438024 - DNA, 22 bp, Homo sapiens
agccctggtagcctgctgccat

SEQ ID NO: 8438025 - DNA, 22 bp, Homo sapiens
agcctggcctgggcaggcacat

SEQ ID NO: 8438026 - DNA, 22 bp, Homo sapiens
agcctggcctgggcaggcacat

SEQ ID NO: 8438027 - DNA, 22 bp, Homo sapiens
agcctggccaggcctgcccagg

SEQ ID NO: 8438028 - DNA, 22 bp, Homo sapiens
agcctgctgggaagggaggctt

SEQ ID NO: 8438029 - DNA, 20 bp, Homo sapiens
agcctgctgtagaagtttgg

SEQ ID NO: 8438030 - DNA, 22 bp, Homo sapiens
agccctggggctggtcttggaa

SEQ ID NO: 8438031 - DNA, 22 bp, Homo sapiens
agccctggggctggtcttggaa

SEQ ID NO: 8438032 - DNA, 22 bp, Homo sapiens
agccctgcgctcacgttctgca

SEQ ID NO: 8438033 - DNA, 22 bp, Homo sapiens
agccctgcgtgccaggggactg

SEQ ID NO: 8438034 - DNA, 22 bp, Homo sapiens
agccctgcgctcacgttctgca

SEQ ID NO: 8438035 - DNA, 22 bp, Homo sapiens
agccctgcgatcgtgatttctt

SEQ ID NO: 8438036 - DNA, 22 bp, Homo sapiens
agccctgcgatcgtgatttctt

SEQ ID NO: 8438037 - DNA, 22 bp, Homo sapiens
agccctgccctgccatgtggca

SEQ ID NO: 8438038 - DNA, 22 bp, Homo sapiens
agccctgccctgccatgtggca

SEQ ID NO: 8438039 - DNA, 22 bp, Homo sapiens
agccctgcctctccaatgccca

SEQ ID NO: 8438040 - DNA, 16 bp, Homo sapiens
agccctgccgtgtact

SEQ ID NO: 8438041 - DNA, 22 bp, Homo sapiens
agccctgcatagaagggaacac

SEQ ID NO: 8438042 - DNA, 22 bp, Homo sapiens
agccctgccattctctggagct

SEQ ID NO: 8438043 - DNA, 22 bp, Homo sapiens
agccctgccattctctggagct

SEQ ID NO: 8438044 - DNA, 22 bp, Homo sapiens
acagacatgggccgctcttgag

SEQ ID NO: 8438045 - DNA, 22 bp, Homo sapiens
acagacatgggccgctcttgag

SEQ ID NO: 8438046 - DNA, 22 bp, Homo sapiens
agcccctgtcctctctgatgac

SEQ ID NO: 8438047 - DNA, 22 bp, Homo sapiens
agccctgcacaggtctgtggct

SEQ ID NO: 8438048 - DNA, 22 bp, Homo sapiens
agccctgcacaggtctgtggct

SEQ ID NO: 8438049 - DNA, 22 bp, Homo sapiens
agccctgcacagttcgggagga

SEQ ID NO: 8438050 - DNA, 22 bp, Homo sapiens
agccctgcacagttcgggagga

SEQ ID NO: 8438051 - DNA, 22 bp, Homo sapiens
agccctgcaggaggtgggagag

SEQ ID NO: 8438052 - DNA, 22 bp, Homo sapiens
agccctgcaggaggtgggagag

SEQ ID NO: 8438053 - DNA, 22 bp, Homo sapiens
agccctgcaggaggtgggagag

SEQ ID NO: 8438054 - DNA, 22 bp, Homo sapiens
agccctgcaggatgagggaggt

SEQ ID NO: 8438055 - DNA, 22 bp, Homo sapiens
agccctgcaggatgagggaggt

SEQ ID NO: 8438056 - DNA, 22 bp, Homo sapiens
agccctgcataaatcagttggt

SEQ ID NO: 8438057 - DNA, 22 bp, Homo sapiens
agccctgcataaatcagttggt

SEQ ID NO: 8438058 - DNA, 22 bp, Homo sapiens
agctcagggccaggcgcgtttc

SEQ ID NO: 8438059 - DNA, 22 bp, Homo sapiens
agctcagggcaaagactcaaat

SEQ ID NO: 8438060 - DNA, 22 bp, Homo sapiens
agctcaggctctgcagggacta

SEQ ID NO: 8438061 - DNA, 22 bp, Homo sapiens
agctcagggccatcggcccttt

SEQ ID NO: 8438062 - DNA, 22 bp, Homo sapiens
agctcagggcgatctgtctcgg

SEQ ID NO: 8438063 - DNA, 22 bp, Homo sapiens
agctcaggccggagctacaggc

SEQ ID NO: 8438064 - DNA, 22 bp, Homo sapiens
agctcaggccggagctacaggc

SEQ ID NO: 8438065 - DNA, 23 bp, Homo sapiens
agctcaaggcagtccacatttcc

SEQ ID NO: 8438066 - DNA, 22 bp, Homo sapiens
agccttagatttgggcaagaac

SEQ ID NO: 8438067 - DNA, 22 bp, Homo sapiens
agctcaagtgcaagcattctat

SEQ ID NO: 8438068 - DNA, 22 bp, Homo sapiens
agctcaggtctcaggaggtgtc

SEQ ID NO: 8438069 - DNA, 22 bp, Homo sapiens
agctcaggtcattccagggatg

SEQ ID NO: 8438070 - DNA, 22 bp, Homo sapiens
agctcaggtagactcagcatct

SEQ ID NO: 8438071 - DNA, 22 bp, Homo sapiens
agctcaggtagactcagcatct

SEQ ID NO: 8438072 - DNA, 22 bp, Homo sapiens
agctcagggctccaggaccgct

SEQ ID NO: 8438073 - DNA, 22 bp, Homo sapiens
agctccaaggttgaggagtgag

SEQ ID NO: 8438074 - DNA, 22 bp, Homo sapiens
agctccagaaaggtacacacag

SEQ ID NO: 8438075 - DNA, 22 bp, Homo sapiens
agctccagaaaggtacacacag

SEQ ID NO: 8438076 - DNA, 22 bp, Homo sapiens
agcctggcggtcgtcggtcagg

SEQ ID NO: 8438077 - DNA, 22 bp, Homo sapiens
agcctggctaaattctcccatg

SEQ ID NO: 8438078 - DNA, 22 bp, Homo sapiens
agccttagagacttaaaacagg

SEQ ID NO: 8438079 - DNA, 22 bp, Homo sapiens
agccttagataaatgctagctc

SEQ ID NO: 8438080 - DNA, 22 bp, Homo sapiens
agccttagaggaaaacattagt

SEQ ID NO: 8438081 - DNA, 22 bp, Homo sapiens
agccttagaggaaaacattagt

SEQ ID NO: 8438082 - DNA, 22 bp, Homo sapiens
agcctgtgtgctttggacaggg

SEQ ID NO: 8438083 - DNA, 22 bp, Homo sapiens
agcctgtgttgctctggcgata

SEQ ID NO: 8438084 - DNA, 22 bp, Homo sapiens
agcctgtggatccctgcactgg

SEQ ID NO: 8438085 - DNA, 22 bp, Homo sapiens
agaatctgaaggcacctctggt

SEQ ID NO: 8438086 - DNA, 20 bp, Homo sapiens
agaatctgacccagagagac

SEQ ID NO: 8438087 - DNA, 22 bp, Homo sapiens
agaatctacattttaacaagat

SEQ ID NO: 8438088 - DNA, 22 bp, Homo sapiens
agaatctaagtacacagacaga

SEQ ID NO: 8438089 - DNA, 22 bp, Homo sapiens
agaatctctactcaagtacttg

SEQ ID NO: 8438090 - DNA, 22 bp, Homo sapiens
agaatctctactcaagtacttg

SEQ ID NO: 8438091 - DNA, 22 bp, Homo sapiens
agaatcttcagatgatttgtca

SEQ ID NO: 8438092 - DNA, 22 bp, Homo sapiens
agaatctgcatttttaataaca

SEQ ID NO: 8438093 - DNA, 22 bp, Homo sapiens
agaatctgcatttctaataagc

SEQ ID NO: 8438094 - DNA, 22 bp, Homo sapiens
agaatcctgttttacttcatca

SEQ ID NO: 8438095 - DNA, 22 bp, Homo sapiens
agaatcctgttttacttcatca

SEQ ID NO: 8438096 - DNA, 22 bp, Homo sapiens
agaatctaaatatgcaatttga

SEQ ID NO: 8438097 - DNA, 22 bp, Homo sapiens
agaatccttgactcaggctgag

SEQ ID NO: 8438098 - DNA, 19 bp, Homo sapiens
agaatctaaattatttctg

SEQ ID NO: 8438099 - DNA, 22 bp, Homo sapiens
agaatcctgatgaaaaggagag

SEQ ID NO: 8438100 - DNA, 22 bp, Homo sapiens
agaatcctggccaggtcagagc

SEQ ID NO: 8438101 - DNA, 22 bp, Homo sapiens
agaatcctggagaagctgtacc

SEQ ID NO: 8438102 - DNA, 22 bp, Homo sapiens
agaatcctcttcagtaaattct

SEQ ID NO: 8438103 - DNA, 22 bp, Homo sapiens
agaatcctattgtcagattctt

SEQ ID NO: 8438104 - DNA, 21 bp, Homo sapiens
agaatccattcagaccttctc

SEQ ID NO: 8438105 - DNA, 22 bp, Homo sapiens
agaatttaggatgcatgtgaat

SEQ ID NO: 8438106 - DNA, 22 bp, Homo sapiens
agaatttagctccttggtcata

SEQ ID NO: 8438107 - DNA, 23 bp, Homo sapiens
agaattgtaaatagaatatacct

SEQ ID NO: 8438108 - DNA, 22 bp, Homo sapiens
agaatcttgggcaaattcatct

SEQ ID NO: 8438109 - DNA, 22 bp, Homo sapiens
agaatcttcagtctaattccta

SEQ ID NO: 8438110 - DNA, 22 bp, Homo sapiens
agaatcttcggtaactggaaga

SEQ ID NO: 8438111 - DNA, 22 bp, Homo sapiens
agaatcttggaactcagatcac

SEQ ID NO: 8438112 - DNA, 22 bp, Homo sapiens
agaattgtaataataatagcat

SEQ ID NO: 8438113 - DNA, 23 bp, Homo sapiens
agacaaaagcctcagtcttaggc

SEQ ID NO: 8438114 - DNA, 23 bp, Homo sapiens
agacaaaagcctcagtcttaggc

SEQ ID NO: 8438115 - DNA, 22 bp, Homo sapiens
aatgtaaacagcaagagaaggg

SEQ ID NO: 8438116 - DNA, 22 bp, Homo sapiens
aatgtaaacagcaagagaaggg

SEQ ID NO: 8438117 - DNA, 22 bp, Homo sapiens
aatgtacaccgtgggtttttta

SEQ ID NO: 8438118 - DNA, 22 bp, Homo sapiens
aatgtacactgaaagcctatca

SEQ ID NO: 8438119 - DNA, 22 bp, Homo sapiens
agaatttttgattatctactcg

SEQ ID NO: 8438120 - DNA, 22 bp, Homo sapiens
agaatttttgattatctactcg

SEQ ID NO: 8438121 - DNA, 22 bp, Homo sapiens
aatgtacagctgtctttcctcc

SEQ ID NO: 8438122 - DNA, 22 bp, Homo sapiens
aatgtacagctgtctttcctcc

SEQ ID NO: 8438123 - DNA, 22 bp, Homo sapiens
aatgtacagctgctgctgaagg

SEQ ID NO: 8438124 - DNA, 22 bp, Homo sapiens
aatgtacatctcagtgtagtac

SEQ ID NO: 8438125 - DNA, 22 bp, Homo sapiens
aatgtacatctcagtgtagtac

SEQ ID NO: 8438126 - DNA, 22 bp, Homo sapiens
aatgtacaggctggctatgggg

SEQ ID NO: 8438127 - DNA, 22 bp, Homo sapiens
agaataaatgttggacttagga

SEQ ID NO: 8438128 - DNA, 22 bp, Homo sapiens
agaatcagtgctggctattagc

SEQ ID NO: 8438129 - DNA, 22 bp, Homo sapiens
agaatcattagagagaaaactt

SEQ ID NO: 8438130 - DNA, 22 bp, Homo sapiens
agaatcattatatttattaagc

SEQ ID NO: 8438131 - DNA, 22 bp, Homo sapiens
agaatcagtgagcagttgtgat

SEQ ID NO: 8438132 - DNA, 22 bp, Homo sapiens
agaataaatgctacctatcaca

SEQ ID NO: 8438133 - DNA, 22 bp, Homo sapiens
agaagtttgttatgtaaacaaa

SEQ ID NO: 8438134 - DNA, 19 bp, Homo sapiens
aatggacaggcaatagtct

SEQ ID NO: 8438135 - DNA, 22 bp, Homo sapiens
aatgctttgactatatctataa

SEQ ID NO: 8438136 - DNA, 22 bp, Homo sapiens
aatgctttgactatatctataa

SEQ ID NO: 8438137 - DNA, 22 bp, Homo sapiens
aatgaaaattggaccctagaac

SEQ ID NO: 8438138 - DNA, 22 bp, Homo sapiens
aatgaaaattggaccctagaac

SEQ ID NO: 8438139 - DNA, 22 bp, Homo sapiens
aatgctggaagcctcagtagat

SEQ ID NO: 8438140 - DNA, 21 bp, Homo sapiens
agagaaagtcatggctgtggc

SEQ ID NO: 8438141 - DNA, 22 bp, Homo sapiens
agagaaagtaaagattctacct

SEQ ID NO: 8438142 - DNA, 20 bp, Homo sapiens
agagagacctaggcctagtc

SEQ ID NO: 8438143 - DNA, 22 bp, Homo sapiens
agagacagggttttgccatgtt

SEQ ID NO: 8438144 - DNA, 22 bp, Homo sapiens
agagagaggggcgagcaaacac

SEQ ID NO: 8438145 - DNA, 22 bp, Homo sapiens
agagagacgggggctgctgctt

SEQ ID NO: 8438146 - DNA, 22 bp, Homo sapiens
agagatcagttaaaatcttttt

SEQ ID NO: 8438147 - DNA, 22 bp, Homo sapiens
aattatgtagccatatgaaaca

SEQ ID NO: 8438148 - DNA, 22 bp, Homo sapiens
agagatctgtgcttactacaag

SEQ ID NO: 8438149 - DNA, 22 bp, Homo sapiens
agagatctgtctactatttaag

SEQ ID NO: 8438150 - DNA, 21 bp, Homo sapiens
agagatctgaagaaccattag

SEQ ID NO: 8438151 - DNA, 22 bp, Homo sapiens
agagagcagtctggaagaaaca

SEQ ID NO: 8438152 - DNA, 22 bp, Homo sapiens
agagagcaggacttcactgagc

SEQ ID NO: 8438153 - DNA, 23 bp, Homo sapiens
agagagagtttgtgtcaggtacc

SEQ ID NO: 8438154 - DNA, 20 bp, Homo sapiens
agagagcacaggcaggaaag

SEQ ID NO: 8438155 - DNA, 22 bp, Homo sapiens
agacactggtgaagaaatcagg

SEQ ID NO: 8438156 - DNA, 19 bp, Homo sapiens
agacactggatggaaaatg

SEQ ID NO: 8438157 - DNA, 22 bp, Homo sapiens
agacactgatgttcagctcaat

SEQ ID NO: 8438158 - DNA, 17 bp, Homo sapiens
agacactgagccaagta

SEQ ID NO: 8438159 - DNA, 22 bp, Homo sapiens
agacacctaatagatgaattca

SEQ ID NO: 8438160 - DNA, 22 bp, Homo sapiens
agacactgaaatgtattgaaga

SEQ ID NO: 8438161 - DNA, 18 bp, Homo sapiens
agagaaagaccaaagcat

SEQ ID NO: 8438162 - DNA, 22 bp, Homo sapiens
agagaaactgatgtcctttgaa

SEQ ID NO: 8438163 - DNA, 22 bp, Homo sapiens
agactggggttctggcaaggag

SEQ ID NO: 8438164 - DNA, 23 bp, Homo sapiens
agactggggcataagaagatggc

SEQ ID NO: 8438165 - DNA, 22 bp, Homo sapiens
agactcttggtcattggcatta

SEQ ID NO: 8438166 - DNA, 22 bp, Homo sapiens
agactcttggagaagagctata

SEQ ID NO: 8438167 - DNA, 22 bp, Homo sapiens
agactgggccatttccccagct

SEQ ID NO: 8438168 - DNA, 22 bp, Homo sapiens
agactgggccatttccccagct

SEQ ID NO: 8438169 - DNA, 22 bp, Homo sapiens
agactgggattctccctgatca

SEQ ID NO: 8438170 - DNA, 22 bp, Homo sapiens
agactggcttgctttacaagga

SEQ ID NO: 8438171 - DNA, 23 bp, Homo sapiens
agactgaggctgccagggtcaga

SEQ ID NO: 8438172 - DNA, 22 bp, Homo sapiens
aattcactgaacttctctgaga

SEQ ID NO: 8438173 - DNA, 22 bp, Homo sapiens
aattcacatgttgaagtcctaa

SEQ ID NO: 8438174 - DNA, 22 bp, Homo sapiens
aattcacagttctgcaccttac

SEQ ID NO: 8438175 - DNA, 22 bp, Homo sapiens
aattcacatatacattattcct

SEQ ID NO: 8438176 - DNA, 22 bp, Homo sapiens
aattcacaggaggtatttgtcc

SEQ ID NO: 8438177 - DNA, 22 bp, Homo sapiens
agagcagctcgctacctctcta

SEQ ID NO: 8438178 - DNA, 18 bp, Homo sapiens
agagcagcggcatcacac

SEQ ID NO: 8438179 - DNA, 22 bp, Homo sapiens
agagcagctgacagcctgccat

SEQ ID NO: 8438180 - DNA, 22 bp, Homo sapiens
aattcagagactcattctggag

SEQ ID NO: 8438181 - DNA, 22 bp, Homo sapiens
aattcagatggaagattctggc

SEQ ID NO: 8438182 - DNA, 22 bp, Homo sapiens
agaggcatgcacagatgtgctg

SEQ ID NO: 8438183 - DNA, 23 bp, Homo sapiens
agaggccaacttcttgcccctcc

SEQ ID NO: 8438184 - DNA, 23 bp, Homo sapiens
agaggccaacttcttgcccctcc

SEQ ID NO: 8438185 - DNA, 22 bp, Homo sapiens
agaggccaagccagactgtgca

SEQ ID NO: 8438186 - DNA, 19 bp, Homo sapiens
agaggcagtctccaacagg

SEQ ID NO: 8438187 - DNA, 22 bp, Homo sapiens
agaggcaacatggggaacagat

SEQ ID NO: 8438188 - DNA, 22 bp, Homo sapiens
agagcagctgtgacatggacag

SEQ ID NO: 8438189 - DNA, 22 bp, Homo sapiens
agagggctgcctcagtcagcta

SEQ ID NO: 8438190 - DNA, 21 bp, Homo sapiens
aattttgaaggaagattaagg

SEQ ID NO: 8438191 - DNA, 21 bp, Homo sapiens
aattttgaaggaagattaagg

SEQ ID NO: 8438192 - DNA, 21 bp, Homo sapiens
aattttgaaggaagattaagg

SEQ ID NO: 8438193 - DNA, 22 bp, Homo sapiens
agagggcatgcttggtggcctg

SEQ ID NO: 8438194 - DNA, 22 bp, Homo sapiens
agagggcccatgttgggctgct

SEQ ID NO: 8438195 - DNA, 22 bp, Homo sapiens
agagggctaactgggaagcagg

SEQ ID NO: 8438196 - DNA, 22 bp, Homo sapiens
agaggccaatagtaggtggcat

SEQ ID NO: 8438197 - DNA, 21 bp, Homo sapiens
agaggccaagtcatcatttcc

SEQ ID NO: 8438198 - DNA, 22 bp, Homo sapiens
aatttcaaactaataggaacca

SEQ ID NO: 8438199 - DNA, 22 bp, Homo sapiens
aatttcaaagctcactggcata

SEQ ID NO: 8438200 - DNA, 22 bp, Homo sapiens
aatttcaagtggcatctttgat

SEQ ID NO: 8438201 - DNA, 22 bp, Homo sapiens
agatatatttcctgcccaaggc

SEQ ID NO: 8438202 - DNA, 22 bp, Homo sapiens
agatatctccagtgatgctcgt

SEQ ID NO: 8438203 - DNA, 22 bp, Homo sapiens
agatatatttaaggtaataagt

SEQ ID NO: 8438204 - DNA, 22 bp, Homo sapiens
agatatatttaaggtaataagt

SEQ ID NO: 8438205 - DNA, 22 bp, Homo sapiens
agatatctgcaatataatttaa

SEQ ID NO: 8438206 - DNA, 22 bp, Homo sapiens
agatatcttacactttgaagtt

SEQ ID NO: 8438207 - DNA, 22 bp, Homo sapiens
agatatctgatgaaaatactct

SEQ ID NO: 8438208 - DNA, 22 bp, Homo sapiens
agatatctggaaaaaatgtatg

SEQ ID NO: 8438209 - DNA, 22 bp, Homo sapiens
agatctgagtggctgcatgtaa

SEQ ID NO: 8438210 - DNA, 22 bp, Homo sapiens
agatcctgccaatggaagcagg

SEQ ID NO: 8438211 - DNA, 22 bp, Homo sapiens
agatccatgtgatttggagttc

SEQ ID NO: 8438212 - DNA, 22 bp, Homo sapiens
agatccatcatcatattttcta

SEQ ID NO: 8438213 - DNA, 22 bp, Homo sapiens
agatccattttggtgtcaactc

SEQ ID NO: 8438214 - DNA, 22 bp, Homo sapiens
agatcccaaatcacctgcttat

SEQ ID NO: 8438215 - DNA, 21 bp, Homo sapiens
agattacaggtgtgatccacc

SEQ ID NO: 8438216 - DNA, 20 bp, Homo sapiens
agattaggggctttcttctt

SEQ ID NO: 8438217 - DNA, 22 bp, Homo sapiens
agattaggtatggtttaagtag

SEQ ID NO: 8438218 - DNA, 22 bp, Homo sapiens
agattacaacatgggacgcata

SEQ ID NO: 8438219 - DNA, 22 bp, Homo sapiens
agattacagcatgggaatggga

SEQ ID NO: 8438220 - DNA, 22 bp, Homo sapiens
agatctttaaaagttattatta

SEQ ID NO: 8438221 - DNA, 22 bp, Homo sapiens
agatctggaaaatcacaggtgc

SEQ ID NO: 8438222 - DNA, 22 bp, Homo sapiens
agatctggttggagtcctgaca

SEQ ID NO: 8438223 - DNA, 22 bp, Homo sapiens
agatatacacccatatcacata

SEQ ID NO: 8438224 - DNA, 22 bp, Homo sapiens
agatataataatttacaagtgt

SEQ ID NO: 8438225 - DNA, 22 bp, Homo sapiens
agataatgtcaaattctgtctg

SEQ ID NO: 8438226 - DNA, 22 bp, Homo sapiens
agagtcttagcctcattagtca

SEQ ID NO: 8438227 - DNA, 22 bp, Homo sapiens
agagtcttagcctcattagtca

SEQ ID NO: 8438228 - DNA, 22 bp, Homo sapiens
agagtcttatcttttacaagta

SEQ ID NO: 8438229 - DNA, 22 bp, Homo sapiens
agagtcttatcttttacaagta

SEQ ID NO: 8438230 - DNA, 22 bp, Homo sapiens
agagtcttccaggcagcctgag

SEQ ID NO: 8438231 - DNA, 22 bp, Homo sapiens
agagtctgttacttgtccccta

SEQ ID NO: 8438232 - DNA, 22 bp, Homo sapiens
agagtcttttgtcagtaatgtt

SEQ ID NO: 8438233 - DNA, 22 bp, Homo sapiens
agagtcttttgtcagtaatgtt

SEQ ID NO: 8438234 - DNA, 22 bp, Homo sapiens
agagtcttttgtcagtaatgtt

SEQ ID NO: 8438235 - DNA, 22 bp, Homo sapiens
agagtcttccaggcagcctgag

SEQ ID NO: 8438236 - DNA, 22 bp, Homo sapiens
agagtcttctggggccactttc

SEQ ID NO: 8438237 - DNA, 22 bp, Homo sapiens
agagtcttggctgagaacaaga

SEQ ID NO: 8438238 - DNA, 22 bp, Homo sapiens
agagtcttctttaggccattta

SEQ ID NO: 8438239 - DNA, 22 bp, Homo sapiens
agagtcttggcattcatgcgtt

SEQ ID NO: 8438240 - DNA, 22 bp, Homo sapiens
agagtcttgttaacttgctaag

SEQ ID NO: 8438241 - DNA, 22 bp, Homo sapiens
agagtcttggctgagaacaaga

SEQ ID NO: 8438242 - DNA, 22 bp, Homo sapiens
agagtcttgttaacttgctaag

SEQ ID NO: 8438243 - DNA, 19 bp, Homo sapiens
agagtctgtgctcttccta

SEQ ID NO: 8438244 - DNA, 21 bp, Homo sapiens
agagtctgcatttctgacaag

SEQ ID NO: 8438245 - DNA, 22 bp, Homo sapiens
agagtctgatgtcaacagttct

SEQ ID NO: 8438246 - DNA, 22 bp, Homo sapiens
agagtaatttttggacaatgcc

SEQ ID NO: 8438247 - DNA, 22 bp, Homo sapiens
agagtacactgtacacacaatt

SEQ ID NO: 8438248 - DNA, 16 bp, Homo sapiens
agaggtttacagcctg

SEQ ID NO: 8438249 - DNA, 22 bp, Homo sapiens
agaggtgtggccaggactcaag

SEQ ID NO: 8438250 - DNA, 22 bp, Homo sapiens
agagtaaataggagatgacagc

SEQ ID NO: 8438251 - DNA, 22 bp, Homo sapiens
agaggtgggagcctggtcacat

SEQ ID NO: 8438252 - DNA, 22 bp, Homo sapiens
acaaaaagctccattactgtcc

SEQ ID NO: 8438253 - DNA, 22 bp, Homo sapiens
acaaaaaccgtggattcagcat

SEQ ID NO: 8438254 - DNA, 22 bp, Homo sapiens
agagggtaacaagaggcctgga

SEQ ID NO: 8438255 - DNA, 22 bp, Homo sapiens
agaggtggccatgggcgctgga

SEQ ID NO: 8438256 - DNA, 22 bp, Homo sapiens
agaggtggagctcttggcatca

SEQ ID NO: 8438257 - DNA, 22 bp, Homo sapiens
aattttgtttaagtgatctgct

SEQ ID NO: 8438258 - DNA, 22 bp, Homo sapiens
aattttgtttaagtgatctgct

SEQ ID NO: 8438259 - DNA, 22 bp, Homo sapiens
acaaaaaccgtggattcagcat

SEQ ID NO: 8438260 - DNA, 22 bp, Homo sapiens
acaaaaaccgtggattcagcat

SEQ ID NO: 8438261 - DNA, 22 bp, Homo sapiens
aactttctgaaaagcttgatca

SEQ ID NO: 8438262 - DNA, 22 bp, Homo sapiens
aactttctctggatggcttcct

SEQ ID NO: 8438263 - DNA, 20 bp, Homo sapiens
aactttctcccattggactg

SEQ ID NO: 8438264 - DNA, 22 bp, Homo sapiens
aactttctccagtgccaactat

SEQ ID NO: 8438265 - DNA, 20 bp, Homo sapiens
aactttctcccattggactg

SEQ ID NO: 8438266 - DNA, 22 bp, Homo sapiens
aactttctataggttgggattt

SEQ ID NO: 8438267 - DNA, 22 bp, Homo sapiens
aactttctccagtgccaactat

SEQ ID NO: 8438268 - DNA, 22 bp, Homo sapiens
aattagaaccagaagccatatt

SEQ ID NO: 8438269 - DNA, 22 bp, Homo sapiens
aactttctggctttggggagag

SEQ ID NO: 8438270 - DNA, 22 bp, Homo sapiens
aattactgtaattttctacagc

SEQ ID NO: 8438271 - DNA, 22 bp, Homo sapiens
aactttctaattttggctgagc

SEQ ID NO: 8438272 - DNA, 22 bp, Homo sapiens
aactttctaattttggctgagc

SEQ ID NO: 8438273 - DNA, 22 bp, Homo sapiens
aactttcagaatcctatgcatt

SEQ ID NO: 8438274 - DNA, 20 bp, Homo sapiens
aactttagacataatctctt

SEQ ID NO: 8438275 - DNA, 22 bp, Homo sapiens
aactttagctatttaatctgat

SEQ ID NO: 8438276 - DNA, 22 bp, Homo sapiens
aatgttattacacttgtgaaat

SEQ ID NO: 8438277 - DNA, 20 bp, Homo sapiens
aactttagacataatctctt

SEQ ID NO: 8438278 - DNA, 21 bp, Homo sapiens
aactttagaaagactgggaag

SEQ ID NO: 8438279 - DNA, 22 bp, Homo sapiens
aatgttattacacttgtgaaat

SEQ ID NO: 8438280 - DNA, 22 bp, Homo sapiens
aatgtgttttatgagagaatat

SEQ ID NO: 8438281 - DNA, 22 bp, Homo sapiens
aatgttaaaaccttcagtgctt

SEQ ID NO: 8438282 - DNA, 21 bp, Homo sapiens
aatgtctttgtccatgctctg

SEQ ID NO: 8438283 - DNA, 22 bp, Homo sapiens
aatgttaattcacagccaaata

SEQ ID NO: 8438284 - DNA, 22 bp, Homo sapiens
aatgttaatttactgtcttcat

SEQ ID NO: 8438285 - DNA, 22 bp, Homo sapiens
aatgttaagtttagattataac

SEQ ID NO: 8438286 - DNA, 22 bp, Homo sapiens
aatgttaatgtgtttgcttatg

SEQ ID NO: 8438287 - DNA, 22 bp, Homo sapiens
aatgttacgatcaacaacacat

SEQ ID NO: 8438288 - DNA, 22 bp, Homo sapiens
aatgttagtaacttgagtattt

SEQ ID NO: 8438289 - DNA, 22 bp, Homo sapiens
aactctatttaccctactaaac

SEQ ID NO: 8438290 - DNA, 22 bp, Homo sapiens
aactctgattagctcaagttaa

SEQ ID NO: 8438291 - DNA, 22 bp, Homo sapiens
aactctagtgctccttggagga

SEQ ID NO: 8438292 - DNA, 22 bp, Homo sapiens
aactctatttaccctactaaac

SEQ ID NO: 8438293 - DNA, 22 bp, Homo sapiens
aactctagtgctccttggagga

SEQ ID NO: 8438294 - DNA, 22 bp, Homo sapiens
aactccttaatgcatttcagag

SEQ ID NO: 8438295 - DNA, 22 bp, Homo sapiens
aactcctgaggaaatggtctca

SEQ ID NO: 8438296 - DNA, 22 bp, Homo sapiens
aactcctatgacccactgaact

SEQ ID NO: 8438297 - DNA, 22 bp, Homo sapiens
aatgtattctgggaaaatgtta

SEQ ID NO: 8438298 - DNA, 22 bp, Homo sapiens
aatgtattctgggaaaatgtta

SEQ ID NO: 8438299 - DNA, 22 bp, Homo sapiens
aatgtattctgggaaaatgtta

SEQ ID NO: 8438300 - DNA, 22 bp, Homo sapiens
aatgtattcttcaaccttgcta

SEQ ID NO: 8438301 - DNA, 22 bp, Homo sapiens
aactgaaacggtgatcttttaa

SEQ ID NO: 8438302 - DNA, 22 bp, Homo sapiens
aatgtattctctttataagata

SEQ ID NO: 8438303 - DNA, 22 bp, Homo sapiens
aatgtacaataagacaaagagg

SEQ ID NO: 8438304 - DNA, 22 bp, Homo sapiens
aactctttgtggacattaaatt

SEQ ID NO: 8438305 - DNA, 22 bp, Homo sapiens
aactctttggtctcaggaaagg

SEQ ID NO: 8438306 - DNA, 20 bp, Homo sapiens
aatgtattgttttgtttcag

SEQ ID NO: 8438307 - DNA, 22 bp, Homo sapiens
aatgtatttgatgtattagcct

SEQ ID NO: 8438308 - DNA, 22 bp, Homo sapiens
aatgtatttgatgtattagcct

SEQ ID NO: 8438309 - DNA, 22 bp, Homo sapiens
aatgtcaaaatggaatgagact

SEQ ID NO: 8438310 - DNA, 22 bp, Homo sapiens
aatgtcaaaggctatacattca

SEQ ID NO: 8438311 - DNA, 22 bp, Homo sapiens
aatgtcaaaatggaatgagact

SEQ ID NO: 8438312 - DNA, 22 bp, Homo sapiens
aatgtcaaacagagcagagcta

SEQ ID NO: 8438313 - DNA, 22 bp, Homo sapiens
aatgtcaaagtgctttgcaaac

SEQ ID NO: 8438314 - DNA, 22 bp, Homo sapiens
aatgtcaatctcagagaacaca

SEQ ID NO: 8438315 - DNA, 22 bp, Homo sapiens
aatgtctttaaagtgcaataga

SEQ ID NO: 8438316 - DNA, 22 bp, Homo sapiens
aatgtctttaaagtgcaataga

SEQ ID NO: 8438317 - DNA, 22 bp, Homo sapiens
aatgtctttctcataacagata

SEQ ID NO: 8438318 - DNA, 22 bp, Homo sapiens
aagacattggcattgactgtaa

SEQ ID NO: 8438319 - DNA, 22 bp, Homo sapiens
aagacattgtcattttataatt

SEQ ID NO: 8438320 - DNA, 22 bp, Homo sapiens
aagacattgtggagatgttgct

SEQ ID NO: 8438321 - DNA, 22 bp, Homo sapiens
acaagaatgtagattagttaag

SEQ ID NO: 8438322 - DNA, 22 bp, Homo sapiens
aagacattcatgaagaagggat

SEQ ID NO: 8438323 - DNA, 22 bp, Homo sapiens
aagacattccaaagtggctaat

SEQ ID NO: 8438324 - DNA, 22 bp, Homo sapiens
acaagaaccaaagaaggatatt

SEQ ID NO: 8438325 - DNA, 22 bp, Homo sapiens
acaagaaaggtaggattcaggt

SEQ ID NO: 8438326 - DNA, 22 bp, Homo sapiens
acaacaaaatgaggaagtggtc

SEQ ID NO: 8438327 - DNA, 22 bp, Homo sapiens
aagacacacacatatgctgagt

SEQ ID NO: 8438328 - DNA, 22 bp, Homo sapiens
aagacacacacatatgctgagt

SEQ ID NO: 8438329 - DNA, 22 bp, Homo sapiens
acaactgtcttcttcatgctcc

SEQ ID NO: 8438330 - DNA, 22 bp, Homo sapiens
acaactgtcagtaaagaatatt

SEQ ID NO: 8438331 - DNA, 22 bp, Homo sapiens
aagacaatgcattactaagaag

SEQ ID NO: 8438332 - DNA, 22 bp, Homo sapiens
aagacacaaagcttcccttttc

SEQ ID NO: 8438333 - DNA, 22 bp, Homo sapiens
aagacacaatgtagcccagcac

SEQ ID NO: 8438334 - DNA, 22 bp, Homo sapiens
aagacaattttgagtatgcaca

SEQ ID NO: 8438335 - DNA, 22 bp, Homo sapiens
aattagaagggagttattgata

SEQ ID NO: 8438336 - DNA, 22 bp, Homo sapiens
aattagaagggagttattgata

SEQ ID NO: 8438337 - DNA, 22 bp, Homo sapiens
aattagaagggagttattgata

SEQ ID NO: 8438338 - DNA, 22 bp, Homo sapiens
aattagaatcttatttggggaa

SEQ ID NO: 8438339 - DNA, 22 bp, Homo sapiens
aattagaagctgttagcaaaat

SEQ ID NO: 8438340 - DNA, 22 bp, Homo sapiens
aattagaagctgttagcaaaat

SEQ ID NO: 8438341 - DNA, 22 bp, Homo sapiens
aattagaagctgttagcaaaat

SEQ ID NO: 8438342 - DNA, 20 bp, Homo sapiens
aattagatgtttaatcaata

SEQ ID NO: 8438343 - DNA, 22 bp, Homo sapiens
aattagagtagagcctaagaat

SEQ ID NO: 8438344 - DNA, 20 bp, Homo sapiens
aattagatgtttaatcaata

SEQ ID NO: 8438345 - DNA, 20 bp, Homo sapiens
aattagatgtttaatcaata

SEQ ID NO: 8438346 - DNA, 23 bp, Homo sapiens
aattcaaattcagtgtgactagg

SEQ ID NO: 8438347 - DNA, 22 bp, Homo sapiens
aattcaacagtcagttatctca

SEQ ID NO: 8438348 - DNA, 22 bp, Homo sapiens
aattcaatctgtagattgtgat

SEQ ID NO: 8438349 - DNA, 22 bp, Homo sapiens
aattcaatctaagaaatgatca

SEQ ID NO: 8438350 - DNA, 22 bp, Homo sapiens
aattcaatctaagaaatgatca

SEQ ID NO: 8438351 - DNA, 22 bp, Homo sapiens
aattcaaattacaatagttgtt

SEQ ID NO: 8438352 - DNA, 22 bp, Homo sapiens
aagacaagcatcaaatcaggca

SEQ ID NO: 8438353 - DNA, 17 bp, Homo sapiens
aagacaagacaaatgca

SEQ ID NO: 8438354 - DNA, 22 bp, Homo sapiens
aagaattttccagcatgtcagt

SEQ ID NO: 8438355 - DNA, 22 bp, Homo sapiens
aagacaaaggggtccttggatg

SEQ ID NO: 8438356 - DNA, 22 bp, Homo sapiens
aagacaaaggggtccttggatg

SEQ ID NO: 8438357 - DNA, 22 bp, Homo sapiens
aattcacaaaaccagattgctt

SEQ ID NO: 8438358 - DNA, 22 bp, Homo sapiens
aattcacaaaaccagattgctt

SEQ ID NO: 8438359 - DNA, 22 bp, Homo sapiens
aagaatctgttgattccccact

SEQ ID NO: 8438360 - DNA, 22 bp, Homo sapiens
aagaatctgacataatttcctg

SEQ ID NO: 8438361 - DNA, 22 bp, Homo sapiens
aagaatcttaatccagaaacct

SEQ ID NO: 8438362 - DNA, 22 bp, Homo sapiens
aagaatctttccagttttgatg

SEQ ID NO: 8438363 - DNA, 22 bp, Homo sapiens
aagatactgatgatgtaggcta

SEQ ID NO: 8438364 - DNA, 22 bp, Homo sapiens
aagatacattttcttcagagaa

SEQ ID NO: 8438365 - DNA, 22 bp, Homo sapiens
aagatatactattaagtaccat

SEQ ID NO: 8438366 - DNA, 19 bp, Homo sapiens
acagaaatgtaagtgagac

SEQ ID NO: 8438367 - DNA, 22 bp, Homo sapiens
acagaagacagagtgttcatct

SEQ ID NO: 8438368 - DNA, 22 bp, Homo sapiens
aagattttcagctaatggtgca

SEQ ID NO: 8438369 - DNA, 22 bp, Homo sapiens
aagattttcagtgcctaaaaca

SEQ ID NO: 8438370 - DNA, 22 bp, Homo sapiens
aagattttctcaactgtatttg

SEQ ID NO: 8438371 - DNA, 22 bp, Homo sapiens
aagatttttttccacagactca

SEQ ID NO: 8438372 - DNA, 22 bp, Homo sapiens
aagattttctcaactgtatttg

SEQ ID NO: 8438373 - DNA, 22 bp, Homo sapiens
aagatttttttccacagactca

SEQ ID NO: 8438374 - DNA, 22 bp, Homo sapiens
aagcaaaaggttacacttctgg

SEQ ID NO: 8438375 - DNA, 22 bp, Homo sapiens
aagcaaaacgtgctctaggagg

SEQ ID NO: 8438376 - DNA, 22 bp, Homo sapiens
acagaagcaaaagcaggatctt

SEQ ID NO: 8438377 - DNA, 22 bp, Homo sapiens
acagaagcaaagactcaggcaa

SEQ ID NO: 8438378 - DNA, 22 bp, Homo sapiens
acagagctgtactacttactga

SEQ ID NO: 8438379 - DNA, 22 bp, Homo sapiens
acagagctgtactacttactga

SEQ ID NO: 8438380 - DNA, 22 bp, Homo sapiens
acagagcttaattcaggagctt

SEQ ID NO: 8438381 - DNA, 22 bp, Homo sapiens
acagagcttaggatgactccca

SEQ ID NO: 8438382 - DNA, 22 bp, Homo sapiens
acagagcttaggatgactccca

SEQ ID NO: 8438383 - DNA, 22 bp, Homo sapiens
acagagcttcccagcctgagca

SEQ ID NO: 8438384 - DNA, 22 bp, Homo sapiens
aagcaaaaggttacacttctgg

SEQ ID NO: 8438385 - DNA, 22 bp, Homo sapiens
aagcaaagacagtttgagtgga

SEQ ID NO: 8438386 - DNA, 22 bp, Homo sapiens
aagcaaacaggagaagagctgt

SEQ ID NO: 8438387 - DNA, 22 bp, Homo sapiens
aagcacagttcttagagttaca

SEQ ID NO: 8438388 - DNA, 22 bp, Homo sapiens
aagcacatcatgttgttcagac

SEQ ID NO: 8438389 - DNA, 22 bp, Homo sapiens
acagaggacaactaggcgctca

SEQ ID NO: 8438390 - DNA, 18 bp, Homo sapiens
acagaggcagacatgtat

SEQ ID NO: 8438391 - DNA, 22 bp, Homo sapiens
acagaggacaactaggcgctca

SEQ ID NO: 8438392 - DNA, 22 bp, Homo sapiens
acagaggaagcatatagcacaa

SEQ ID NO: 8438393 - DNA, 22 bp, Homo sapiens
acagaggaaggctgagctgccc

SEQ ID NO: 8438394 - DNA, 22 bp, Homo sapiens
acagaggaaggctgagctgccc

SEQ ID NO: 8438395 - DNA, 22 bp, Homo sapiens
acagatgaaacccagctagttg

SEQ ID NO: 8438396 - DNA, 22 bp, Homo sapiens
acagatgagaagctgcattcaa

SEQ ID NO: 8438397 - DNA, 22 bp, Homo sapiens
acagatctcaaagcctggaccc

SEQ ID NO: 8438398 - DNA, 22 bp, Homo sapiens
acagatcctggttacagccatt

SEQ ID NO: 8438399 - DNA, 22 bp, Homo sapiens
aagcacatttggaaaacatgga

SEQ ID NO: 8438400 - DNA, 22 bp, Homo sapiens
aagcacatgagctattcatgct

SEQ ID NO: 8438401 - DNA, 22 bp, Homo sapiens
aagcacatgaaaatgtgaagct

SEQ ID NO: 8438402 - DNA, 22 bp, Homo sapiens
aagcacatctcctgtgcagaac

SEQ ID NO: 8438403 - DNA, 22 bp, Homo sapiens
aagagttatacctatttctaac

SEQ ID NO: 8438404 - DNA, 22 bp, Homo sapiens
aagagttatataatgtgtagtt

SEQ ID NO: 8438405 - DNA, 22 bp, Homo sapiens
aagagttagctcaataacttga

SEQ ID NO: 8438406 - DNA, 22 bp, Homo sapiens
aagagttaaatgaatgagtggg

SEQ ID NO: 8438407 - DNA, 22 bp, Homo sapiens
aagagtttaattttgtctagac

SEQ ID NO: 8438408 - DNA, 22 bp, Homo sapiens
aagagtttaccagtgctgcttc

SEQ ID NO: 8438409 - DNA, 22 bp, Homo sapiens
aagagttatgaaagcaaggcat

SEQ ID NO: 8438410 - DNA, 22 bp, Homo sapiens
aagagtttaattttgtctagac

SEQ ID NO: 8438411 - DNA, 22 bp, Homo sapiens
aagagtcttatagtgtaattaa

SEQ ID NO: 8438412 - DNA, 22 bp, Homo sapiens
aagagtctattggaactagaca

SEQ ID NO: 8438413 - DNA, 22 bp, Homo sapiens
aagagtggagctggaaagtggg

SEQ ID NO: 8438414 - DNA, 21 bp, Homo sapiens
aagagtggctgaggaggtgat

SEQ ID NO: 8438415 - DNA, 22 bp, Homo sapiens
aagagtaaagcaaagcacttgt

SEQ ID NO: 8438416 - DNA, 22 bp, Homo sapiens
aagagtaaatgtctaattagga

SEQ ID NO: 8438417 - DNA, 22 bp, Homo sapiens
aagaggttgtctgtgatgagtt

SEQ ID NO: 8438418 - DNA, 23 bp, Homo sapiens
acacgtgtgtgtacatagatagt

SEQ ID NO: 8438419 - DNA, 21 bp, Homo sapiens
acacgtgtgtgtaaacacaca

SEQ ID NO: 8438420 - DNA, 22 bp, Homo sapiens
acacggcactttaggaaggggc

SEQ ID NO: 8438421 - DNA, 22 bp, Homo sapiens
acacggtggccagcagtaggtg

SEQ ID NO: 8438422 - DNA, 22 bp, Homo sapiens
acacgcataaatacacagtcta

SEQ ID NO: 8438423 - DNA, 22 bp, Homo sapiens
acacctttgccccaagtcatag

SEQ ID NO: 8438424 - DNA, 22 bp, Homo sapiens
acacctgggtcagtgtgacagt

SEQ ID NO: 8438425 - DNA, 22 bp, Homo sapiens
aagagtttaccagtgctgcttc

SEQ ID NO: 8438426 - DNA, 23 bp, Homo sapiens
aagagtttagagtcttgcagagt

SEQ ID NO: 8438427 - DNA, 22 bp, Homo sapiens
acacacagaaggaagccccact

SEQ ID NO: 8438428 - DNA, 22 bp, Homo sapiens
acacacagagtttatacaggca

SEQ ID NO: 8438429 - DNA, 22 bp, Homo sapiens
acacacagagtttatacaggca

SEQ ID NO: 8438430 - DNA, 20 bp, Homo sapiens
acacacagagacatgcgcat

SEQ ID NO: 8438431 - DNA, 22 bp, Homo sapiens
acacacagcgcctaccatgtgc

SEQ ID NO: 8438432 - DNA, 22 bp, Homo sapiens
acacacagagtttatacaggca

SEQ ID NO: 8438433 - DNA, 22 bp, Homo sapiens
acacacagcgcctaccatgtgc

SEQ ID NO: 8438434 - DNA, 22 bp, Homo sapiens
acacacagcgcctaccatgtgc

SEQ ID NO: 8438435 - DNA, 22 bp, Homo sapiens
aagaggtgggttggacagatac

SEQ ID NO: 8438436 - DNA, 20 bp, Homo sapiens
aagaggtgataacaggtgag

SEQ ID NO: 8438437 - DNA, 19 bp, Homo sapiens
aagagggaaagtgctatgc

SEQ ID NO: 8438438 - DNA, 22 bp, Homo sapiens
acacacatgcatgcttgccatt

SEQ ID NO: 8438439 - DNA, 22 bp, Homo sapiens
acacacaggtaaaggagcctgg

SEQ ID NO: 8438440 - DNA, 22 bp, Homo sapiens
acacacaggtaaaggagcctgg

SEQ ID NO: 8438441 - DNA, 22 bp, Homo sapiens
aagaggaggattgatgtgggag

SEQ ID NO: 8438442 - DNA, 22 bp, Homo sapiens
aagacatttatgaaaagtgctg

SEQ ID NO: 8438443 - DNA, 22 bp, Homo sapiens
aagacattttagagatagggaa

SEQ ID NO: 8438444 - DNA, 22 bp, Homo sapiens
aagaggcagaaatatcgctgaa

SEQ ID NO: 8438445 - DNA, 23 bp, Homo sapiens
aagaggaggccctgctcccgtcc

SEQ ID NO: 8438446 - DNA, 22 bp, Homo sapiens
aagaggagggcagattcaaggc

SEQ ID NO: 8438447 - DNA, 19 bp, Homo sapiens
aagaggcaaccctcgagcc

SEQ ID NO: 8438448 - DNA, 19 bp, Homo sapiens
aagaggcaaccctcgagcc

SEQ ID NO: 8438449 - DNA, 22 bp, Homo sapiens
aaattataggtgccaccttgga

SEQ ID NO: 8438450 - DNA, 22 bp, Homo sapiens
aaattaactatcacttttgtga

SEQ ID NO: 8438451 - DNA, 22 bp, Homo sapiens
aaggaaacactgaactttgtag

SEQ ID NO: 8438452 - DNA, 21 bp, Homo sapiens
aaggaaaagcttggtctctga

SEQ ID NO: 8438453 - DNA, 18 bp, Homo sapiens
aaattagatggacctgtg

SEQ ID NO: 8438454 - DNA, 18 bp, Homo sapiens
aaattagatggacctgtg

SEQ ID NO: 8438455 - DNA, 22 bp, Homo sapiens
aaattattatgcccctctataa

SEQ ID NO: 8438456 - DNA, 22 bp, Homo sapiens
aaggacaggttggggcttcagg

SEQ ID NO: 8438457 - DNA, 22 bp, Homo sapiens
aaattattacaagctagttggc

SEQ ID NO: 8438458 - DNA, 22 bp, Homo sapiens
aaattattataggcagagctga

SEQ ID NO: 8438459 - DNA, 22 bp, Homo sapiens
aaggagaaatggtagatgtgca

SEQ ID NO: 8438460 - DNA, 22 bp, Homo sapiens
aaggacctatattgtcagagga

SEQ ID NO: 8438461 - DNA, 22 bp, Homo sapiens
aaggacctgattttgagcatct

SEQ ID NO: 8438462 - DNA, 22 bp, Homo sapiens
aaggactaatgaatagatgaat

SEQ ID NO: 8438463 - DNA, 22 bp, Homo sapiens
aaatttaaaaagcagcattgca

SEQ ID NO: 8438464 - DNA, 20 bp, Homo sapiens
aaatttaggaaattttacgc

SEQ ID NO: 8438465 - DNA, 22 bp, Homo sapiens
aagctgtagaggcagtacattt

SEQ ID NO: 8438466 - DNA, 22 bp, Homo sapiens
aagctgtagcttttcaaaacgt

SEQ ID NO: 8438467 - DNA, 22 bp, Homo sapiens
aagctgtatgttaccactgtca

SEQ ID NO: 8438468 - DNA, 20 bp, Homo sapiens
aagctgggtaggagaggagc

SEQ ID NO: 8438469 - DNA, 22 bp, Homo sapiens
aagctgtacttagcattgactc

SEQ ID NO: 8438470 - DNA, 22 bp, Homo sapiens
aagctttcagagcagaatgtga

SEQ ID NO: 8438471 - DNA, 21 bp, Homo sapiens
aaggaaaagcttggtctctga

SEQ ID NO: 8438472 - DNA, 22 bp, Homo sapiens
aagctgattctaaaatttatta

SEQ ID NO: 8438473 - DNA, 22 bp, Homo sapiens
aagctgcaaaaaatttctgtct

SEQ ID NO: 8438474 - DNA, 22 bp, Homo sapiens
aagcccagatgagatccctgga

SEQ ID NO: 8438475 - DNA, 22 bp, Homo sapiens
aagctggcatgtcacctgagaa

SEQ ID NO: 8438476 - DNA, 22 bp, Homo sapiens
aagctggcctgtacctgctgag

SEQ ID NO: 8438477 - DNA, 22 bp, Homo sapiens
aagctggcctgtacctgctgag

SEQ ID NO: 8438478 - DNA, 22 bp, Homo sapiens
aagctggcatgtcacctgagaa

SEQ ID NO: 8438479 - DNA, 20 bp, Homo sapiens
aagctggcaggtcatagctt

SEQ ID NO: 8438480 - DNA, 20 bp, Homo sapiens
aagctggcaggtcatagctt

SEQ ID NO: 8438481 - DNA, 18 bp, Homo sapiens
aagctgggaaggagacag

SEQ ID NO: 8438482 - DNA, 22 bp, Homo sapiens
aagccagtattcaatggggcta

SEQ ID NO: 8438483 - DNA, 22 bp, Homo sapiens
aagccagtaagtttttgtcatt

SEQ ID NO: 8438484 - DNA, 22 bp, Homo sapiens
aagccagtgtccagaatgggca

SEQ ID NO: 8438485 - DNA, 22 bp, Homo sapiens
aagccagtggtgagaagatagc

SEQ ID NO: 8438486 - DNA, 22 bp, Homo sapiens
aagccagtggcttctccctgct

SEQ ID NO: 8438487 - DNA, 22 bp, Homo sapiens
aagccagtgggcatagcagttg

SEQ ID NO: 8438488 - DNA, 22 bp, Homo sapiens
aagccagtcctctactgggcac

SEQ ID NO: 8438489 - DNA, 22 bp, Homo sapiens
aagccagttagcacatcattgc

SEQ ID NO: 8438490 - DNA, 16 bp, Homo sapiens
aagccagttcagcatt

SEQ ID NO: 8438491 - DNA, 22 bp, Homo sapiens
aagccagtgtgacaggaaactt

SEQ ID NO: 8438492 - DNA, 22 bp, Homo sapiens
aagccagtgtggtctgcccatt

SEQ ID NO: 8438493 - DNA, 22 bp, Homo sapiens
aagccagtgtttttgagagttg

SEQ ID NO: 8438494 - DNA, 22 bp, Homo sapiens
aagccatggtagaaaactcagt

SEQ ID NO: 8438495 - DNA, 22 bp, Homo sapiens
aagccatggctgcatcagcctg

SEQ ID NO: 8438496 - DNA, 22 bp, Homo sapiens
aagccatggcatgccaggatca

SEQ ID NO: 8438497 - DNA, 22 bp, Homo sapiens
aagccatgcaagccacaaggtg

SEQ ID NO: 8438498 - DNA, 22 bp, Homo sapiens
aagggagacagttgtgtgagga

SEQ ID NO: 8438499 - DNA, 22 bp, Homo sapiens
aacaagatgttttgatatatgt

SEQ ID NO: 8438500 - DNA, 22 bp, Homo sapiens
aacaaggctggtatcttaaaga

SEQ ID NO: 8438501 - DNA, 22 bp, Homo sapiens
aacaagcagatgcaatgcactt

SEQ ID NO: 8438502 - DNA, 22 bp, Homo sapiens
aacaagtcattccatttgacag

SEQ ID NO: 8438503 - DNA, 22 bp, Homo sapiens
aacaagtctaagagaatggcag

SEQ ID NO: 8438504 - DNA, 22 bp, Homo sapiens
aacaagtctttggttttggcta

SEQ ID NO: 8438505 - DNA, 22 bp, Homo sapiens
aacaagtaagtttatatatatt

SEQ ID NO: 8438506 - DNA, 22 bp, Homo sapiens
aacaagtgtattaatggaaata

SEQ ID NO: 8438507 - DNA, 22 bp, Homo sapiens
aaatttctaagcagccacttcc

SEQ ID NO: 8438508 - DNA, 22 bp, Homo sapiens
aaggcatttgttggatttctca

SEQ ID NO: 8438509 - DNA, 22 bp, Homo sapiens
aaggccagacaggaccacatct

SEQ ID NO: 8438510 - DNA, 22 bp, Homo sapiens
aaggccagacaggaccacatct

SEQ ID NO: 8438511 - DNA, 22 bp, Homo sapiens
aaggccagactctggaatgaca

SEQ ID NO: 8438512 - DNA, 23 bp, Homo sapiens
aaggccagaatttcaatggtgcc

SEQ ID NO: 8438513 - DNA, 23 bp, Homo sapiens
aaggccagaatttcaatggtgcc

SEQ ID NO: 8438514 - DNA, 22 bp, Homo sapiens
aaggccacagagcctcagagag

SEQ ID NO: 8438515 - DNA, 22 bp, Homo sapiens
aagtatgtgtgggatgctggga

SEQ ID NO: 8438516 - DNA, 22 bp, Homo sapiens
aagtattatttaacaaatttgt

SEQ ID NO: 8438517 - DNA, 22 bp, Homo sapiens
aagtatgtctttgggtattatt

SEQ ID NO: 8438518 - DNA, 22 bp, Homo sapiens
aagtacagaaatagcaggtgca

SEQ ID NO: 8438519 - DNA, 22 bp, Homo sapiens
aacaatgctgaactgaggaaag

SEQ ID NO: 8438520 - DNA, 22 bp, Homo sapiens
aagtacaatctttctgtaaagg

SEQ ID NO: 8438521 - DNA, 22 bp, Homo sapiens
aacaatgcactatcgtaagtgg

SEQ ID NO: 8438522 - DNA, 22 bp, Homo sapiens
aacaatgccaacagcatgctgg

SEQ ID NO: 8438523 - DNA, 22 bp, Homo sapiens
aacaatcaagtttctaaatgac

SEQ ID NO: 8438524 - DNA, 22 bp, Homo sapiens
aacaataggacctttatgttct

SEQ ID NO: 8438525 - DNA, 22 bp, Homo sapiens
aaggggctcttgtcaggcgcag

SEQ ID NO: 8438526 - DNA, 22 bp, Homo sapiens
aagggagaggagggtcttgttg

SEQ ID NO: 8438527 - DNA, 22 bp, Homo sapiens
aagggagcggggagaccctatg

SEQ ID NO: 8438528 - DNA, 22 bp, Homo sapiens
aagggaggaggatttattgtac

SEQ ID NO: 8438529 - DNA, 22 bp, Homo sapiens
aaggggaatagagtgggttgtg

SEQ ID NO: 8438530 - DNA, 22 bp, Homo sapiens
aaggggaatagagtgggttgtg

SEQ ID NO: 8438531 - DNA, 22 bp, Homo sapiens
aaggggaagtagcaccagaggt

SEQ ID NO: 8438532 - DNA, 22 bp, Homo sapiens
aaggggcacaattgtacccaag

SEQ ID NO: 8438533 - DNA, 22 bp, Homo sapiens
aaggggcctcacagatgggctt

SEQ ID NO: 8438534 - DNA, 22 bp, Homo sapiens
aaggggatttaaggtaagaaga

SEQ ID NO: 8438535 - DNA, 22 bp, Homo sapiens
aaggggatagagcagacactcc

SEQ ID NO: 8438536 - DNA, 22 bp, Homo sapiens
aactatacatatttacatagac

SEQ ID NO: 8438537 - DNA, 22 bp, Homo sapiens
aaccattcacagtgtagccaaa

SEQ ID NO: 8438538 - DNA, 22 bp, Homo sapiens
aactatacatatttacatagac

SEQ ID NO: 8438539 - DNA, 22 bp, Homo sapiens
aaccagtactttacacagctct

SEQ ID NO: 8438540 - DNA, 22 bp, Homo sapiens
aactccaggcagggaggccact

SEQ ID NO: 8438541 - DNA, 22 bp, Homo sapiens
aactccagggggtcaatattta

SEQ ID NO: 8438542 - DNA, 21 bp, Homo sapiens
aactcccagtgccttcccagc

SEQ ID NO: 8438543 - DNA, 22 bp, Homo sapiens
aactccatttccctgcctcctg

SEQ ID NO: 8438544 - DNA, 22 bp, Homo sapiens
aatcacatttacattgctaatt

SEQ ID NO: 8438545 - DNA, 22 bp, Homo sapiens
aatcacttaatagctacactgg

SEQ ID NO: 8438546 - DNA, 22 bp, Homo sapiens
aaccagctctgcaaaatgtcat

SEQ ID NO: 8438547 - DNA, 22 bp, Homo sapiens
aaccagctgagaatgcttctgc

SEQ ID NO: 8438548 - DNA, 17 bp, Homo sapiens
aaccagctgtcccctcc

SEQ ID NO: 8438549 - DNA, 22 bp, Homo sapiens
aaccagctttgatacgcattat

SEQ ID NO: 8438550 - DNA, 22 bp, Homo sapiens
aaccagctaacatgtggaatga

SEQ ID NO: 8438551 - DNA, 22 bp, Homo sapiens
aaccagctcctcaccccattgt

SEQ ID NO: 8438552 - DNA, 22 bp, Homo sapiens
aatcagaaaattcagtggaatt

SEQ ID NO: 8438553 - DNA, 22 bp, Homo sapiens
aatcagaaaattcagtggaatt

SEQ ID NO: 8438554 - DNA, 22 bp, Homo sapiens
aaccagagtgacactctacaga

SEQ ID NO: 8438555 - DNA, 22 bp, Homo sapiens
aaccagctaaactttgctcgaa

SEQ ID NO: 8438556 - DNA, 22 bp, Homo sapiens
aaccagctccagcctccattca

SEQ ID NO: 8438557 - DNA, 22 bp, Homo sapiens
aatatttcttctaaagcccttt

SEQ ID NO: 8438558 - DNA, 22 bp, Homo sapiens
aatcacatgtgctcaattttaa

SEQ ID NO: 8438559 - DNA, 22 bp, Homo sapiens
aacataaatttgaagtggcaaa

SEQ ID NO: 8438560 - DNA, 22 bp, Homo sapiens
aacagtttgggtaggtatgtag

SEQ ID NO: 8438561 - DNA, 20 bp, Homo sapiens
aacattgaaagtctagaaga

SEQ ID NO: 8438562 - DNA, 20 bp, Homo sapiens
aacattgaaagtctagaaga

SEQ ID NO: 8438563 - DNA, 22 bp, Homo sapiens
aacattgcattctctatgagat

SEQ ID NO: 8438564 - DNA, 22 bp, Homo sapiens
aacattgctgaaagctgggaca

SEQ ID NO: 8438565 - DNA, 22 bp, Homo sapiens
aacactggaagggacatcaagt

SEQ ID NO: 8438566 - DNA, 22 bp, Homo sapiens
aacactgatggaaagtatgttt

SEQ ID NO: 8438567 - DNA, 22 bp, Homo sapiens
aacactgagtatcagagttggg

SEQ ID NO: 8438568 - DNA, 22 bp, Homo sapiens
aagtcaagataaaggtgctggc

SEQ ID NO: 8438569 - DNA, 20 bp, Homo sapiens
aacactgaggcctactcttc

SEQ ID NO: 8438570 - DNA, 20 bp, Homo sapiens
aacactgagggctactcttc

SEQ ID NO: 8438571 - DNA, 22 bp, Homo sapiens
aagtatttcgttctgaaaaagt

SEQ ID NO: 8438572 - DNA, 22 bp, Homo sapiens
aagtatttcagcggttctttgt

SEQ ID NO: 8438573 - DNA, 22 bp, Homo sapiens
aagtattcataaggacatatgt

SEQ ID NO: 8438574 - DNA, 22 bp, Homo sapiens
aagtattcataaggacatatgt

SEQ ID NO: 8438575 - DNA, 22 bp, Homo sapiens
aagtattatttaacaaatttgt

SEQ ID NO: 8438576 - DNA, 22 bp, Homo sapiens
aagtattcataaggacatatgt

SEQ ID NO: 8438577 - DNA, 22 bp, Homo sapiens
aagtattctacaaagaaattga

SEQ ID NO: 8438578 - DNA, 22 bp, Homo sapiens
aagtattctggcagtcattcag

SEQ ID NO: 8438579 - DNA, 20 bp, Homo sapiens
aagttacattgtattgtacc

SEQ ID NO: 8438580 - DNA, 20 bp, Homo sapiens
aagttacattgtattgtacc

SEQ ID NO: 8438581 - DNA, 22 bp, Homo sapiens
aagttctggggtaatgagaatt

SEQ ID NO: 8438582 - DNA, 22 bp, Homo sapiens
aacactgtaacagcatcatttt

SEQ ID NO: 8438583 - DNA, 22 bp, Homo sapiens
aagttgaatcagtaacacagtt

SEQ ID NO: 8438584 - DNA, 22 bp, Homo sapiens
aagttcttgaagactttaaata

SEQ ID NO: 8438585 - DNA, 23 bp, Homo sapiens
aagttcttaggttgatactaatg

SEQ ID NO: 8438586 - DNA, 22 bp, Homo sapiens
aagttcttagacaagcttgtgg

SEQ ID NO: 8438587 - DNA, 23 bp, Homo sapiens
aagttcttttagatgtcttcgtg

SEQ ID NO: 8438588 - DNA, 20 bp, Homo sapiens
aataaactactgagagatgt

SEQ ID NO: 8438589 - DNA, 22 bp, Homo sapiens
aataaactgctcaattgcatca

SEQ ID NO: 8438590 - DNA, 22 bp, Homo sapiens
aacagtttgagctttgaatttc

SEQ ID NO: 8438591 - DNA, 22 bp, Homo sapiens
aataaaatggtcagttttctca

SEQ ID NO: 8438592 - DNA, 22 bp, Homo sapiens
aataaaatggtcagttttctca

SEQ ID NO: 8438593 - DNA, 22 bp, Homo sapiens
aagtttctttattagcttgtcc

SEQ ID NO: 8438594 - DNA, 22 bp, Homo sapiens
aagtttctgttcatatctctga

SEQ ID NO: 8438595 - DNA, 22 bp, Homo sapiens
aagtttctgtatgctcttctgt

SEQ ID NO: 8438596 - DNA, 20 bp, Homo sapiens
aagtttctggtttatatctt

SEQ ID NO: 8438597 - DNA, 22 bp, Homo sapiens
aagtttctggaccttacctgct

SEQ ID NO: 8438598 - DNA, 22 bp, Homo sapiens
aagtttctgccatactgtggtg

SEQ ID NO: 8438599 - DNA, 22 bp, Homo sapiens
aagtttctgatattgttaaagc

SEQ ID NO: 8438600 - DNA, 22 bp, Homo sapiens
aagtttctgatattgttaaagc

SEQ ID NO: 8438601 - DNA, 22 bp, Homo sapiens
aaatgcctctgggttattctag

SEQ ID NO: 8438602 - DNA, 22 bp, Homo sapiens
aaatgctaaatgcagcaagtag

SEQ ID NO: 8438603 - DNA, 22 bp, Homo sapiens
aaatgctgagtgtttagagatc

SEQ ID NO: 8438604 - DNA, 22 bp, Homo sapiens
aaatggcagtagaaaagaatcc

SEQ ID NO: 8438605 - DNA, 22 bp, Homo sapiens
aaatggcagtagaaaagaatcc

SEQ ID NO: 8438606 - DNA, 22 bp, Homo sapiens
aaatgctagggagaaactctcc

SEQ ID NO: 8438607 - DNA, 22 bp, Homo sapiens
aaatgctatttgggaacaacat

SEQ ID NO: 8438608 - DNA, 22 bp, Homo sapiens
aaatgctctccaaaatgaaagt

SEQ ID NO: 8438609 - DNA, 22 bp, Homo sapiens
aaatcatggtggaagaaacaga

SEQ ID NO: 8438610 - DNA, 22 bp, Homo sapiens
aaatccaggagaatttccactt

SEQ ID NO: 8438611 - DNA, 22 bp, Homo sapiens
aaatgcagctgggcatgagagg

SEQ ID NO: 8438612 - DNA, 22 bp, Homo sapiens
aaatccaacgacaggtgtactt

SEQ ID NO: 8438613 - DNA, 21 bp, Homo sapiens
aaatccaaacactagtccaca

SEQ ID NO: 8438614 - DNA, 22 bp, Homo sapiens
aaatattattgcttaaggggag

SEQ ID NO: 8438615 - DNA, 22 bp, Homo sapiens
aaatatgttttccagttgtcat

SEQ ID NO: 8438616 - DNA, 22 bp, Homo sapiens
aaatatgtgatcagtgaataaa

SEQ ID NO: 8438617 - DNA, 22 bp, Homo sapiens
aaacggaatgagtaagagtatc

SEQ ID NO: 8438618 - DNA, 22 bp, Homo sapiens
aaatagaattggaagcagagtt

SEQ ID NO: 8438619 - DNA, 22 bp, Homo sapiens
aaatagaattggaagcagagtt

SEQ ID NO: 8438620 - DNA, 22 bp, Homo sapiens
aaatagaattaactagctactg

SEQ ID NO: 8438621 - DNA, 22 bp, Homo sapiens
aaatacagattccagggtctta

SEQ ID NO: 8438622 - DNA, 22 bp, Homo sapiens
aaatagaaaccaacaaggtcag

SEQ ID NO: 8438623 - DNA, 22 bp, Homo sapiens
aaatagaaaccaacaaggtcag

SEQ ID NO: 8438624 - DNA, 23 bp, Homo sapiens
aaactacaacgccaggcactgag

SEQ ID NO: 8438625 - DNA, 23 bp, Homo sapiens
aaactacaacgccaggcactgag

SEQ ID NO: 8438626 - DNA, 22 bp, Homo sapiens
aaactaaggtgctgtggactga

SEQ ID NO: 8438627 - DNA, 19 bp, Homo sapiens
aaactaaggggaaatgttt

SEQ ID NO: 8438628 - DNA, 20 bp, Homo sapiens
aaactaaaggtgtttggttt

SEQ ID NO: 8438629 - DNA, 22 bp, Homo sapiens
aaactaaacctggcttagtaag

SEQ ID NO: 8438630 - DNA, 22 bp, Homo sapiens
aaactacatctcatggatgagg

SEQ ID NO: 8438631 - DNA, 23 bp, Homo sapiens
aaactacatttatagtttttctc

SEQ ID NO: 8438632 - DNA, 22 bp, Homo sapiens
aaatatgtaagattagcactag

SEQ ID NO: 8438633 - DNA, 22 bp, Homo sapiens
aaatatgtaagattagcactag

SEQ ID NO: 8438634 - DNA, 23 bp, Homo sapiens
aaagtgcagttgaggaatcatag

SEQ ID NO: 8438635 - DNA, 22 bp, Homo sapiens
aaagtgcagtccatgaaattaa

SEQ ID NO: 8438636 - DNA, 22 bp, Homo sapiens
aaagtgcattgtttgtgttcct

SEQ ID NO: 8438637 - DNA, 22 bp, Homo sapiens
aaagtgcattgtttgtgttcct

SEQ ID NO: 8438638 - DNA, 22 bp, Homo sapiens
aaagtgcatagagtagtgccta

SEQ ID NO: 8438639 - DNA, 22 bp, Homo sapiens
aaagtgcatcaaatgacttccc

SEQ ID NO: 8438640 - DNA, 22 bp, Homo sapiens
aaagtgcattcgaaagtccatc

SEQ ID NO: 8438641 - DNA, 22 bp, Homo sapiens
aaacactggcaatttcatgcac

SEQ ID NO: 8438642 - DNA, 22 bp, Homo sapiens
aaacactgcgtggtggcaactc

SEQ ID NO: 8438643 - DNA, 22 bp, Homo sapiens
aaacactggtatgatgtatagt

SEQ ID NO: 8438644 - DNA, 22 bp, Homo sapiens
aaacactgtacaatctgcaggg

SEQ ID NO: 8438645 - DNA, 22 bp, Homo sapiens
aaacactggtatgatgtatagt

SEQ ID NO: 8438646 - DNA, 22 bp, Homo sapiens
aaacatcataggcatgcatgat

SEQ ID NO: 8438647 - DNA, 22 bp, Homo sapiens
aaacatctattatgtgctgagc

SEQ ID NO: 8438648 - DNA, 22 bp, Homo sapiens
aaacatctatcagcatttttta

SEQ ID NO: 8438649 - DNA, 22 bp, Homo sapiens
aaacatcaccattttacctaat

SEQ ID NO: 8438650 - DNA, 22 bp, Homo sapiens
aaacatcaccattttacctaat

SEQ ID NO: 8438651 - DNA, 22 bp, Homo sapiens
aaacatagataatagatagatg

SEQ ID NO: 8438652 - DNA, 20 bp, Homo sapiens
aaacatagtggataccacag

SEQ ID NO: 8438653 - DNA, 22 bp, Homo sapiens
aaacatagcacacacagctctt

SEQ ID NO: 8438654 - DNA, 22 bp, Homo sapiens
aaagtgctgggattacaagtgt

SEQ ID NO: 8438655 - DNA, 22 bp, Homo sapiens
aaacagttttctcatttagtgt

SEQ ID NO: 8438656 - DNA, 22 bp, Homo sapiens
aaaggccaagcatgaggtggac

SEQ ID NO: 8438657 - DNA, 22 bp, Homo sapiens
aaaggccacacagagcagggag

SEQ ID NO: 8438658 - DNA, 22 bp, Homo sapiens
aaaggccacactgctctttctc

SEQ ID NO: 8438659 - DNA, 22 bp, Homo sapiens
aaaggccaataaagacaagctg

SEQ ID NO: 8438660 - DNA, 22 bp, Homo sapiens
aaaggccaataaagacaagctg

SEQ ID NO: 8438661 - DNA, 22 bp, Homo sapiens
aaaggccaccaacatgaagcat

SEQ ID NO: 8438662 - DNA, 22 bp, Homo sapiens
aaaggccaccaacatgaagcat

SEQ ID NO: 8438663 - DNA, 22 bp, Homo sapiens
aaaggccactgcaagggaaggt

SEQ ID NO: 8438664 - DNA, 22 bp, Homo sapiens
aaaggccaggttggctggtatt

SEQ ID NO: 8438665 - DNA, 22 bp, Homo sapiens
aaaggccaggttggctggtatt

SEQ ID NO: 8438666 - DNA, 22 bp, Homo sapiens
aaaggccacttgaaggattttt

SEQ ID NO: 8438667 - DNA, 21 bp, Homo sapiens
aaaggccataatcacggagca

SEQ ID NO: 8438668 - DNA, 22 bp, Homo sapiens
aaaggccatggttggagtgttt

SEQ ID NO: 8438669 - DNA, 23 bp, Homo sapiens
aaaggctatcaaagttttgctga

SEQ ID NO: 8438670 - DNA, 22 bp, Homo sapiens
aaaggctagtggattcattgat

SEQ ID NO: 8438671 - DNA, 22 bp, Homo sapiens
aaaggctacgggggccgtgtgc

SEQ ID NO: 8438672 - DNA, 22 bp, Homo sapiens
aaaggctaattaaccacctggt

SEQ ID NO: 8438673 - DNA, 22 bp, Homo sapiens
aaaggcctctgtcctagtgcct

SEQ ID NO: 8438674 - DNA, 22 bp, Homo sapiens
aaaggccattacttgcttttag

SEQ ID NO: 8438675 - DNA, 22 bp, Homo sapiens
aaagcaatgcccgttcattatc

SEQ ID NO: 8438676 - DNA, 22 bp, Homo sapiens
aaagcaatgcttgtggaatgta

SEQ ID NO: 8438677 - DNA, 22 bp, Homo sapiens
aaagcaatcagattcagatgtc

SEQ ID NO: 8438678 - DNA, 22 bp, Homo sapiens
aaagcaatagtaatggtaatag

SEQ ID NO: 8438679 - DNA, 22 bp, Homo sapiens
aaagcaatcagattcagatgtc

SEQ ID NO: 8438680 - DNA, 22 bp, Homo sapiens
aaagatgtgcctgtttcatagt

SEQ ID NO: 8438681 - DNA, 22 bp, Homo sapiens
aaagcaataggttaggtcaaga

SEQ ID NO: 8438682 - DNA, 22 bp, Homo sapiens
aaagatgtcagtttgaaataac

SEQ ID NO: 8438683 - DNA, 22 bp, Homo sapiens
aaactggtgtcactgagggctg

SEQ ID NO: 8438684 - DNA, 22 bp, Homo sapiens
aaactggtgtcactgagggctg

SEQ ID NO: 8438685 - DNA, 22 bp, Homo sapiens
aaactggtttctgagatggaac

SEQ ID NO: 8438686 - DNA, 22 bp, Homo sapiens
aaactggtattcaaatgtttgg

SEQ ID NO: 8438687 - DNA, 22 bp, Homo sapiens
aaaccatttgaattattactga

SEQ ID NO: 8438688 - DNA, 22 bp, Homo sapiens
aaaccattgcatctttcttaat

SEQ ID NO: 8438689 - DNA, 22 bp, Homo sapiens
aaaccattaggttttatctact

SEQ ID NO: 8438690 - DNA, 22 bp, Homo sapiens
aaaccacacttagcagtttcgt

SEQ ID NO: 8438691 - DNA, 22 bp, Homo sapiens
aaaccaaccctggctggcctag

SEQ ID NO: 8438692 - DNA, 22 bp, Homo sapiens
aaaccacacttagcagtttcgt

SEQ ID NO: 8438693 - DNA, 22 bp, Homo sapiens
aaaccacagttcagtgcttttg

SEQ ID NO: 8438694 - DNA, 22 bp, Homo sapiens
aaacattgttatgataaattac

SEQ ID NO: 8438695 - DNA, 22 bp, Homo sapiens
aaacatctttctattgcaagtt

SEQ ID NO: 8438696 - DNA, 22 bp, Homo sapiens
aaacatctttctattgcaagtt

SEQ ID NO: 8438697 - DNA, 22 bp, Homo sapiens
aaacatgagcacttgcttcata

SEQ ID NO: 8438698 - DNA, 22 bp, Homo sapiens
aaacatgagcatctcttcaagc

SEQ ID NO: 8438699 - DNA, 22 bp, Homo sapiens
aaacacagggatatatattcca

SEQ ID NO: 8438700 - DNA, 22 bp, Homo sapiens
aaacacaggtactgcagaagtg

SEQ ID NO: 8438701 - DNA, 22 bp, Homo sapiens
aaacacagggatatatattcca

SEQ ID NO: 8438702 - DNA, 22 bp, Homo sapiens
aaacagtctgatgccatctgcc

SEQ ID NO: 8438703 - DNA, 21 bp, Homo sapiens
aaacatctctgcttttgtgtc

SEQ ID NO: 8438704 - DNA, 22 bp, Homo sapiens
aaacttgacagtagacagatta

SEQ ID NO: 8438705 - DNA, 22 bp, Homo sapiens
aaacttgatttagaactaaggc

SEQ ID NO: 8438706 - DNA, 22 bp, Homo sapiens
aaactttaggaaggaatttaca

SEQ ID NO: 8438707 - DNA, 22 bp, Homo sapiens
aaagaactacctgtatgatatt

SEQ ID NO: 8438708 - DNA, 22 bp, Homo sapiens
aaagaacttaagaaattaggct

SEQ ID NO: 8438709 - DNA, 22 bp, Homo sapiens
aaagaacttatcctagaatttg

SEQ ID NO: 8438710 - DNA, 22 bp, Homo sapiens
aaagaaggacctggaggaggat

SEQ ID NO: 8438711 - DNA, 22 bp, Homo sapiens
aaagaaggatgggagaaatcct

SEQ ID NO: 8438712 - DNA, 22 bp, Homo sapiens
aaagaagatggagacctgacta

SEQ ID NO: 8438713 - DNA, 22 bp, Homo sapiens
aaagaagacagacatttctttc

SEQ ID NO: 8438714 - DNA, 22 bp, Homo sapiens
aaagaagagctggaaggagtct

SEQ ID NO: 8438715 - DNA, 22 bp, Homo sapiens
aaagaagagctggaaggagtct

SEQ ID NO: 8438716 - DNA, 22 bp, Homo sapiens
aaagagctttagaaatctcaga

SEQ ID NO: 8438717 - DNA, 22 bp, Homo sapiens
aaagagctttccacactagtca

SEQ ID NO: 8438718 - DNA, 22 bp, Homo sapiens
aaagatctgacttagacacaga

SEQ ID NO: 8438719 - DNA, 22 bp, Homo sapiens
aaaaatgtcattatggaactga

SEQ ID NO: 8438720 - DNA, 22 bp, Homo sapiens
aaaaatgcttggacttaataaa

SEQ ID NO: 8438721 - DNA, 22 bp, Homo sapiens
aaaaggcttggaacctttccct

SEQ ID NO: 8438722 - DNA, 22 bp, Homo sapiens
aaaagggaaagcagaatgactt

SEQ ID NO: 8438723 - DNA, 22 bp, Homo sapiens
aaaaatgcttggacttaataaa

SEQ ID NO: 8438724 - DNA, 22 bp, Homo sapiens
aaaaatgctgtggtagctgtgt

SEQ ID NO: 8438725 - DNA, 22 bp, Homo sapiens
aaaagtctgctttctattatca

SEQ ID NO: 8438726 - DNA, 22 bp, Homo sapiens
aaaagtattttgagcactttat

SEQ ID NO: 8438727 - DNA, 22 bp, Homo sapiens
aaaagtattttggatctcagat

SEQ ID NO: 8438728 - DNA, 22 bp, Homo sapiens
aaaagtattttggatctcagat

SEQ ID NO: 8438729 - DNA, 22 bp, Homo sapiens
aaaagtctacaagcttcaacaa

SEQ ID NO: 8438730 - DNA, 22 bp, Homo sapiens
aaaaactggtaactattcccca

SEQ ID NO: 8438731 - DNA, 22 bp, Homo sapiens
aaaaactggtaactattcccca

SEQ ID NO: 8438732 - DNA, 22 bp, Homo sapiens
aaaaactgtaattacttttgca

SEQ ID NO: 8438733 - DNA, 22 bp, Homo sapiens
aaaaactgtaattacttttgca

SEQ ID NO: 8438734 - DNA, 22 bp, Homo sapiens
aaaaactgtaattacttttgca

SEQ ID NO: 8438735 - DNA, 20 bp, Homo sapiens
aaaaagacaaaacgagttgg

SEQ ID NO: 8438736 - DNA, 22 bp, Homo sapiens
aaaaagacttccaactcaggag

SEQ ID NO: 8438737 - DNA, 22 bp, Homo sapiens
aaaaagacttccaactcaggag

SEQ ID NO: 8438738 - DNA, 22 bp, Homo sapiens
aaaaagactagtcgagtgcagt

SEQ ID NO: 8438739 - DNA, 22 bp, Homo sapiens
aaaaagactagtcgagtgcagt

SEQ ID NO: 8438740 - DNA, 22 bp, Homo sapiens
aaaaagactagtcgagtgcagt

SEQ ID NO: 8438741 - DNA, 22 bp, Homo sapiens
aaaaagacagaggatgaggcag

SEQ ID NO: 8438742 - DNA, 21 bp, Homo sapiens
aaaaatgaagttgttcaggaa

SEQ ID NO: 8438743 - DNA, 21 bp, Homo sapiens
aaaaatgaagttgttcaggaa

SEQ ID NO: 8438744 - DNA, 22 bp, Homo sapiens
aaaaatgaaacggctggttggc

SEQ ID NO: 8438745 - DNA, 22 bp, Homo sapiens
aaaaatgaattcttcagtggca

SEQ ID NO: 8438746 - DNA, 22 bp, Homo sapiens
aaaaagatgtcctgaagtttag

SEQ ID NO: 8438747 - DNA, 22 bp, Homo sapiens
aaaaagatgtcctgaagtttag

SEQ ID NO: 8438748 - DNA, 22 bp, Homo sapiens
aaaaagatagcattgtgctcct

SEQ ID NO: 8438749 - DNA, 22 bp, Homo sapiens
aaaaagatagcattgtgctcct

SEQ ID NO: 8438750 - DNA, 22 bp, Homo sapiens
aaaaagagaaatgctctagtcc

SEQ ID NO: 8438751 - DNA, 19 bp, Homo sapiens
aaaaagaggctataatatt

SEQ ID NO: 8438752 - DNA, 22 bp, Homo sapiens
aaaattcattcctcagactgcc

SEQ ID NO: 8438753 - DNA, 22 bp, Homo sapiens
aaaatagcatgaaaggcctttg

SEQ ID NO: 8438754 - DNA, 22 bp, Homo sapiens
aaaagtctgctttctattatca

SEQ ID NO: 8438755 - DNA, 22 bp, Homo sapiens
aaaatagattctaggatgtctt

SEQ ID NO: 8438756 - DNA, 22 bp, Homo sapiens
aaaatagatgaaaggaagtctg

SEQ ID NO: 8438757 - DNA, 22 bp, Homo sapiens
aaacaaacaattagttgtgtgg

SEQ ID NO: 8438758 - DNA, 22 bp, Homo sapiens
aaacaaacataggtttgaaagt

SEQ ID NO: 8438759 - DNA, 22 bp, Homo sapiens
aaacaaacataggtttgaaagt

SEQ ID NO: 8438760 - DNA, 22 bp, Homo sapiens
aaacaaacaattagttgtgtgg

SEQ ID NO: 8438761 - DNA, 22 bp, Homo sapiens
aaacaaagcatcttgctatgca

SEQ ID NO: 8438762 - DNA, 22 bp, Homo sapiens
aaacaaacataggtttgaaagt

SEQ ID NO: 8438763 - DNA, 22 bp, Homo sapiens
aaacaaatagtgcatgggaatt

SEQ ID NO: 8438764 - DNA, 22 bp, Homo sapiens
aaacaaatagtgcatgggaatt

SEQ ID NO: 8438765 - DNA, 22 bp, Homo sapiens
aaacaaatttcaagctgtgaca

SEQ ID NO: 8438766 - DNA, 22 bp, Homo sapiens
aaacacaatgtttctttgttct

SEQ ID NO: 8438767 - DNA, 22 bp, Homo sapiens
aaacacaatgtttctttgttct

SEQ ID NO: 8438768 - DNA, 22 bp, Homo sapiens
aaacacacagaaatgaatgagg

SEQ ID NO: 8438769 - DNA, 22 bp, Homo sapiens
aaacacacagaaatgaatgagg

SEQ ID NO: 8438770 - DNA, 22 bp, Homo sapiens
aaacacacctttggaactgtga

SEQ ID NO: 8438771 - DNA, 19 bp, Homo sapiens
aaacacagatttcttacca

SEQ ID NO: 8438772 - DNA, 22 bp, Homo sapiens
aaacacacctttggaactgtga

SEQ ID NO: 8438773 - DNA, 22 bp, Homo sapiens
aaacacacctttggaactgtga

SEQ ID NO: 8438774 - DNA, 22 bp, Homo sapiens
aaacacaagatggcctcttctg

SEQ ID NO: 8438775 - DNA, 22 bp, Homo sapiens
aaacaagagcttacatggctgc

SEQ ID NO: 8438776 - DNA, 22 bp, Homo sapiens
aaacaacttctgcactatgggt

SEQ ID NO: 8438777 - DNA, 22 bp, Homo sapiens
aaacaacatggtgggtgtgtag

SEQ ID NO: 8438778 - DNA, 22 bp, Homo sapiens
aacaactgaaaagctttttctg

SEQ ID NO: 8438779 - DNA, 22 bp, Homo sapiens
aacaacaacggagaaagggttg

SEQ ID NO: 8438780 - DNA, 22 bp, Homo sapiens
aacaaattagttgcaagactgg

SEQ ID NO: 8438781 - DNA, 22 bp, Homo sapiens
aacaaattagttgcaagactgg

SEQ ID NO: 8438782 - DNA, 22 bp, Homo sapiens
aacaaattagttgcaagactgg

SEQ ID NO: 8438783 - DNA, 22 bp, Homo sapiens
aacaaattagttgcaagactgg

SEQ ID NO: 8438784 - DNA, 22 bp, Homo sapiens
aacaaatgtgttttgtaattaa

SEQ ID NO: 8438785 - DNA, 22 bp, Homo sapiens
aacaaattagttgcaagactgg

SEQ ID NO: 8438786 - DNA, 22 bp, Homo sapiens
aacaaatttagctctgagtgct

SEQ ID NO: 8438787 - DNA, 22 bp, Homo sapiens
aaagcacatgagtagtgtagta

SEQ ID NO: 8438788 - DNA, 22 bp, Homo sapiens
aaagcacattacaagctcagtc

SEQ ID NO: 8438789 - DNA, 22 bp, Homo sapiens
aaagcacagagctcccacagga

SEQ ID NO: 8438790 - DNA, 22 bp, Homo sapiens
aaagcacaggagagttcagtaa

SEQ ID NO: 8438791 - DNA, 22 bp, Homo sapiens
aaagcaatgggtctaaggtaaa

SEQ ID NO: 8438792 - DNA, 22 bp, Homo sapiens
aaagcaattacaaaagggataa

SEQ ID NO: 8438793 - DNA, 22 bp, Homo sapiens
aaagcaattgtggtttttgtca

SEQ ID NO: 8438794 - DNA, 22 bp, Homo sapiens
aaagcaagtctctacaaagtac

SEQ ID NO: 8438795 - DNA, 22 bp, Homo sapiens
aaagcaagtctctacaaagtac

SEQ ID NO: 8438796 - DNA, 22 bp, Homo sapiens
aaatggtaggttttcttaagaa

SEQ ID NO: 8438797 - DNA, 23 bp, Homo sapiens
aaatgggtttctgttttgtggac

SEQ ID NO: 8438798 - DNA, 22 bp, Homo sapiens
aaatggctgactaaattaaatt

SEQ ID NO: 8438799 - DNA, 22 bp, Homo sapiens
aaatgggcctggaaagaggatg

SEQ ID NO: 8438800 - DNA, 22 bp, Homo sapiens
aacagcttttttggtcagcatt

SEQ ID NO: 8438801 - DNA, 23 bp, Homo sapiens
aacacattgctaattacattcaa

SEQ ID NO: 8438802 - DNA, 22 bp, Homo sapiens
aacagcagctgaggagctgggc

SEQ ID NO: 8438803 - DNA, 22 bp, Homo sapiens
aacagcagcatgacagctgggt

SEQ ID NO: 8438804 - DNA, 22 bp, Homo sapiens
aacacatatttatatatgcaca

SEQ ID NO: 8438805 - DNA, 21 bp, Homo sapiens
aacacatccagagtatttgac

SEQ ID NO: 8438806 - DNA, 22 bp, Homo sapiens
aacacaaagaagctgcaggatc

SEQ ID NO: 8438807 - DNA, 22 bp, Homo sapiens
aacacaaagaagctgcaggatc

SEQ ID NO: 8438808 - DNA, 23 bp, Homo sapiens
aacacaaagctgattccagtggc

SEQ ID NO: 8438809 - DNA, 23 bp, Homo sapiens
aacacaaagctgattccagtggc

SEQ ID NO: 8438810 - DNA, 23 bp, Homo sapiens
aacacaaagctgattccagtggc

SEQ ID NO: 8438811 - DNA, 22 bp, Homo sapiens
aacacaaaaattctcaggggca

SEQ ID NO: 8438812 - DNA, 22 bp, Homo sapiens
aacaagaagggaaggcatgatt

SEQ ID NO: 8438813 - DNA, 22 bp, Homo sapiens
aacaagaagggaaggcatgatt

SEQ ID NO: 8438814 - DNA, 22 bp, Homo sapiens
aacaagaagagagggacgtaat

SEQ ID NO: 8438815 - DNA, 22 bp, Homo sapiens
aacaagaataagtggtttctgg

SEQ ID NO: 8438816 - DNA, 22 bp, Homo sapiens
aacaagaacacctacagttcta

SEQ ID NO: 8438817 - DNA, 22 bp, Homo sapiens
aacaatgtgattgaagctagaa

SEQ ID NO: 8438818 - DNA, 22 bp, Homo sapiens
aacaatgtgttcagcactgtgg

SEQ ID NO: 8438819 - DNA, 22 bp, Homo sapiens
aacaatgttcttttagcttgaa

SEQ ID NO: 8438820 - DNA, 22 bp, Homo sapiens
aacagtatcttttatcagaaat

SEQ ID NO: 8438821 - DNA, 22 bp, Homo sapiens
aacagtattggttgaactcaag

SEQ ID NO: 8438822 - DNA, 22 bp, Homo sapiens
aacagtaatggcattgccatga

SEQ ID NO: 8438823 - DNA, 22 bp, Homo sapiens
aacagtaatgtggtgttgggtt

SEQ ID NO: 8438824 - DNA, 20 bp, Homo sapiens
aacagtaccatttatctcag

SEQ ID NO: 8438825 - DNA, 22 bp, Homo sapiens
aacagtacaactccacaagact

SEQ ID NO: 8438826 - DNA, 22 bp, Homo sapiens
aacagtaatttgcggtttttgc

SEQ ID NO: 8438827 - DNA, 22 bp, Homo sapiens
aacagtaggtgtaaccaaacaa

SEQ ID NO: 8438828 - DNA, 22 bp, Homo sapiens
aacagtaggcatcacataatga

SEQ ID NO: 8438829 - DNA, 22 bp, Homo sapiens
aacattcacctctacctccttc

SEQ ID NO: 8438830 - DNA, 22 bp, Homo sapiens
aacattcaaaacccagttcagt

SEQ ID NO: 8438831 - DNA, 22 bp, Homo sapiens
aacattcaattgaggaagttaa

SEQ ID NO: 8438832 - DNA, 22 bp, Homo sapiens
aacattcaagttctggtttatg

SEQ ID NO: 8438833 - DNA, 22 bp, Homo sapiens
aacattcaagttctggtttatg

SEQ ID NO: 8438834 - DNA, 22 bp, Homo sapiens
aacattcaaaacccagttcagt

SEQ ID NO: 8438835 - DNA, 21 bp, Homo sapiens
aacattagtaatttgactttt

SEQ ID NO: 8438836 - DNA, 22 bp, Homo sapiens
aacattaattacagtcaaacat

SEQ ID NO: 8438837 - DNA, 22 bp, Homo sapiens
aacattaattacagtcaaacat

SEQ ID NO: 8438838 - DNA, 22 bp, Homo sapiens
aacatttcataacttgactttt

SEQ ID NO: 8438839 - DNA, 21 bp, Homo sapiens
aactgagaccagctaaagtgg

SEQ ID NO: 8438840 - DNA, 22 bp, Homo sapiens
aactgagacacgaactatgatt

SEQ ID NO: 8438841 - DNA, 22 bp, Homo sapiens
aactgaaatcaatcagtgattc

SEQ ID NO: 8438842 - DNA, 22 bp, Homo sapiens
aactcagaatagggtgcagggc

SEQ ID NO: 8438843 - DNA, 20 bp, Homo sapiens
aactcagagatgaaaaagac

SEQ ID NO: 8438844 - DNA, 20 bp, Homo sapiens
aactgagagttcaggaggag

SEQ ID NO: 8438845 - DNA, 22 bp, Homo sapiens
aactgagattacaagagacatt

SEQ ID NO: 8438846 - DNA, 22 bp, Homo sapiens
aactgagggccctgctgaagca

SEQ ID NO: 8438847 - DNA, 22 bp, Homo sapiens
aactgaggtatctgctgtgttt

SEQ ID NO: 8438848 - DNA, 22 bp, Homo sapiens
aactgaggccaagtgaggaaag

SEQ ID NO: 8438849 - DNA, 22 bp, Homo sapiens
aactgaggccaagtgaggaaag

SEQ ID NO: 8438850 - DNA, 22 bp, Homo sapiens
aactgaggaataactgagttgc

SEQ ID NO: 8438851 - DNA, 22 bp, Homo sapiens
aactgaggtctccagtgcagaa

SEQ ID NO: 8438852 - DNA, 22 bp, Homo sapiens
aactgcaaaaatggtagtctta

SEQ ID NO: 8438853 - DNA, 22 bp, Homo sapiens
aacatttgcatgctttattaga

SEQ ID NO: 8438854 - DNA, 22 bp, Homo sapiens
aacatttgtgaagtacttagat

SEQ ID NO: 8438855 - DNA, 22 bp, Homo sapiens
aactatactctgtaaatgtgct

SEQ ID NO: 8438856 - DNA, 20 bp, Homo sapiens
aactatgaatagaagagatt

SEQ ID NO: 8438857 - DNA, 22 bp, Homo sapiens
aactatttttggagctaactct

SEQ ID NO: 8438858 - DNA, 22 bp, Homo sapiens
aactcacacaagtattgcctgc

SEQ ID NO: 8438859 - DNA, 22 bp, Homo sapiens
aactcacagctgtttggattag

SEQ ID NO: 8438860 - DNA, 22 bp, Homo sapiens
aagacactgatactctgtgatt

SEQ ID NO: 8438861 - DNA, 22 bp, Homo sapiens
aagacactaagctttcaggata

SEQ ID NO: 8438862 - DNA, 22 bp, Homo sapiens
aagacactgatactctgtgatt

SEQ ID NO: 8438863 - DNA, 22 bp, Homo sapiens
aagacactttctaaatagaagt

SEQ ID NO: 8438864 - DNA, 22 bp, Homo sapiens
aagacagagactctgcaacagg

SEQ ID NO: 8438865 - DNA, 22 bp, Homo sapiens
aagacagagactctgcaacagg

SEQ ID NO: 8438866 - DNA, 22 bp, Homo sapiens
aagacagaccacgtgacagggc

SEQ ID NO: 8438867 - DNA, 22 bp, Homo sapiens
aagacagaagtgatttgatgtg

SEQ ID NO: 8438868 - DNA, 22 bp, Homo sapiens
aagagcatttccactggcactg

SEQ ID NO: 8438869 - DNA, 22 bp, Homo sapiens
aagagccaggacagatccagct

SEQ ID NO: 8438870 - DNA, 22 bp, Homo sapiens
aagaggaagtctccatggagag

SEQ ID NO: 8438871 - DNA, 22 bp, Homo sapiens
aagaggaccagtagataaattt

SEQ ID NO: 8438872 - DNA, 22 bp, Homo sapiens
aagagccctggttgaaaataac

SEQ ID NO: 8438873 - DNA, 22 bp, Homo sapiens
aagaagttggaaatgattgaga

SEQ ID NO: 8438874 - DNA, 22 bp, Homo sapiens
aagaatgagctcaaagatctta

SEQ ID NO: 8438875 - DNA, 22 bp, Homo sapiens
aagaatgtgggtggatatgatg

SEQ ID NO: 8438876 - DNA, 22 bp, Homo sapiens
aagaatgattacaaagcaacga

SEQ ID NO: 8438877 - DNA, 22 bp, Homo sapiens
aagaaagtgatgagctacagat

SEQ ID NO: 8438878 - DNA, 22 bp, Homo sapiens
aagaaagtgctttgtaaattat

SEQ ID NO: 8438879 - DNA, 22 bp, Homo sapiens
aactttctttcacagaagtatc

SEQ ID NO: 8438880 - DNA, 22 bp, Homo sapiens
aactttcttgtgacatttgggg

SEQ ID NO: 8438881 - DNA, 22 bp, Homo sapiens
aactttctttgcatctaagttt

SEQ ID NO: 8438882 - DNA, 22 bp, Homo sapiens
aactttgagtcattgcctcttt

SEQ ID NO: 8438883 - DNA, 22 bp, Homo sapiens
aactttgggcctaagtactgtt

SEQ ID NO: 8438884 - DNA, 22 bp, Homo sapiens
aactttggcaagtcagacttct

SEQ ID NO: 8438885 - DNA, 22 bp, Homo sapiens
aactttgggtaatgcttcaatt

SEQ ID NO: 8438886 - DNA, 22 bp, Homo sapiens
aacttttaaaatacacagacaa

SEQ ID NO: 8438887 - DNA, 23 bp, Homo sapiens
aacttttagagtttaacagtgtt

SEQ ID NO: 8438888 - DNA, 22 bp, Homo sapiens
aagaaagctgaatattctgtgt

SEQ ID NO: 8438889 - DNA, 22 bp, Homo sapiens
aagaaagctgaatattctgtgt

SEQ ID NO: 8438890 - DNA, 22 bp, Homo sapiens
aagaaagccaaagttcatacct

SEQ ID NO: 8438891 - DNA, 22 bp, Homo sapiens
aagcagcagcaggattaaagag

SEQ ID NO: 8438892 - DNA, 22 bp, Homo sapiens
aagcagcacagcaatgactcta

SEQ ID NO: 8438893 - DNA, 22 bp, Homo sapiens
aagccaatggattggttgcttt

SEQ ID NO: 8438894 - DNA, 22 bp, Homo sapiens
aagcatggtggatgatacagtg

SEQ ID NO: 8438895 - DNA, 22 bp, Homo sapiens
aagcactgagcacagtggctga

SEQ ID NO: 8438896 - DNA, 22 bp, Homo sapiens
aagcactgagcacagtggctga

SEQ ID NO: 8438897 - DNA, 22 bp, Homo sapiens
aagcactgagcacagtggctga

SEQ ID NO: 8438898 - DNA, 22 bp, Homo sapiens
aagcactgagcacagtggctga

SEQ ID NO: 8438899 - DNA, 22 bp, Homo sapiens
aagcactggagatgccagagtg

SEQ ID NO: 8438900 - DNA, 22 bp, Homo sapiens
aagcactggggccacagacacg

SEQ ID NO: 8438901 - DNA, 22 bp, Homo sapiens
aagcactgggaggaggctgaga

SEQ ID NO: 8438902 - DNA, 20 bp, Homo sapiens
aagcactgtggtggcatgga

SEQ ID NO: 8438903 - DNA, 22 bp, Homo sapiens
aagcactgggtatagcaatgat

SEQ ID NO: 8438904 - DNA, 22 bp, Homo sapiens
aagcagaactgggaagtagtgg

SEQ ID NO: 8438905 - DNA, 22 bp, Homo sapiens
aagcagagttagcttgtcacct

SEQ ID NO: 8438906 - DNA, 22 bp, Homo sapiens
aagcagaaaaactgagctccaa

SEQ ID NO: 8438907 - DNA, 22 bp, Homo sapiens
aagcactttatgtcaatgtcct

SEQ ID NO: 8438908 - DNA, 22 bp, Homo sapiens
aagcaactcctaggaggaaagg

SEQ ID NO: 8438909 - DNA, 22 bp, Homo sapiens
aagcaactaaggcaaggaaatg

SEQ ID NO: 8438910 - DNA, 22 bp, Homo sapiens
aaatatcatttataacttttaa

SEQ ID NO: 8438911 - DNA, 22 bp, Homo sapiens
aaatatcattctggtgcacaga

SEQ ID NO: 8438912 - DNA, 22 bp, Homo sapiens
aagcacagctggaacagcagga

SEQ ID NO: 8438913 - DNA, 22 bp, Homo sapiens
aagcacagctggaacagcagga

SEQ ID NO: 8438914 - DNA, 22 bp, Homo sapiens
aagcacctgcagttgacaaaaa

SEQ ID NO: 8438915 - DNA, 22 bp, Homo sapiens
aagcacagctggaacagcagga

SEQ ID NO: 8438916 - DNA, 22 bp, Homo sapiens
aaatatcttaggagtatatgag

SEQ ID NO: 8438917 - DNA, 22 bp, Homo sapiens
aaatatcttaggagtatatgag

SEQ ID NO: 8438918 - DNA, 22 bp, Homo sapiens
aaatatccataagcacatctat

SEQ ID NO: 8438919 - DNA, 22 bp, Homo sapiens
aagcaaatgtgggtgcagaatt

SEQ ID NO: 8438920 - DNA, 22 bp, Homo sapiens
aagcaaagagtttagtgggtga

SEQ ID NO: 8438921 - DNA, 22 bp, Homo sapiens
aagcaaagagataaccttttgg

SEQ ID NO: 8438922 - DNA, 22 bp, Homo sapiens
aagcaaagagtttagtgggtga

SEQ ID NO: 8438923 - DNA, 22 bp, Homo sapiens
aagcaaagtgaattttgccaag

SEQ ID NO: 8438924 - DNA, 22 bp, Homo sapiens
aagcaaagtgaattttgccaag

SEQ ID NO: 8438925 - DNA, 18 bp, Homo sapiens
aagaggaggagcaggttg

SEQ ID NO: 8438926 - DNA, 18 bp, Homo sapiens
aagaggaggagcaggttg

SEQ ID NO: 8438927 - DNA, 22 bp, Homo sapiens
aagaggaggacggttcccagaa

SEQ ID NO: 8438928 - DNA, 22 bp, Homo sapiens
aagaggagacttcagcaacttg

SEQ ID NO: 8438929 - DNA, 22 bp, Homo sapiens
agctccaggataagacaggtgc

SEQ ID NO: 8438930 - DNA, 22 bp, Homo sapiens
agctccaggataagacaggtgc

SEQ ID NO: 8438931 - DNA, 23 bp, Homo sapiens
agctccagctgacgtgggcagcc

SEQ ID NO: 8438932 - DNA, 22 bp, Homo sapiens
agctccaggataagacaggtgc

SEQ ID NO: 8438933 - DNA, 22 bp, Homo sapiens
agctccaggataagacaggtgc

SEQ ID NO: 8438934 - DNA, 22 bp, Homo sapiens
agctccaggatctgaaagttcg

SEQ ID NO: 8438935 - DNA, 19 bp, Homo sapiens
agctccaggcctggatgct

SEQ ID NO: 8438936 - DNA, 22 bp, Homo sapiens
agctccaggatctgaaagttcg

SEQ ID NO: 8438937 - DNA, 22 bp, Homo sapiens
agctccagcctcttctggaggt

SEQ ID NO: 8438938 - DNA, 22 bp, Homo sapiens
agctcctggacgaacagggagt

SEQ ID NO: 8438939 - DNA, 19 bp, Homo sapiens
agctcctgattgtgcctcg

SEQ ID NO: 8438940 - DNA, 22 bp, Homo sapiens
agctcctggaggtgcgcactcg

SEQ ID NO: 8438941 - DNA, 22 bp, Homo sapiens
agctcctggaggtgcgcactcg

SEQ ID NO: 8438942 - DNA, 22 bp, Homo sapiens
agctcctggatgaggcttatgt

SEQ ID NO: 8438943 - DNA, 22 bp, Homo sapiens
agctccagggaaagagtggatc

SEQ ID NO: 8438944 - DNA, 21 bp, Homo sapiens
agctccaggctcctggggttc

SEQ ID NO: 8438945 - DNA, 23 bp, Homo sapiens
agctccagaacatagcacaggaa

SEQ ID NO: 8438946 - DNA, 19 bp, Homo sapiens
agctcaggcccatcgtccc

SEQ ID NO: 8438947 - DNA, 20 bp, Homo sapiens
agctaggagaaagcatggag

SEQ ID NO: 8438948 - DNA, 22 bp, Homo sapiens
agctagcaaatagcatgtagga

SEQ ID NO: 8438949 - DNA, 22 bp, Homo sapiens
agctccagccctagtacagctg

SEQ ID NO: 8438950 - DNA, 22 bp, Homo sapiens
agctccagagccacatccatca

SEQ ID NO: 8438951 - DNA, 22 bp, Homo sapiens
agctccagattaattgtaggag

SEQ ID NO: 8438952 - DNA, 22 bp, Homo sapiens
agctccagcccatctgctcgtg

SEQ ID NO: 8438953 - DNA, 22 bp, Homo sapiens
agctccagaagcctgcaaggta

SEQ ID NO: 8438954 - DNA, 23 bp, Homo sapiens
agctccagaacatagcacaggaa

SEQ ID NO: 8438955 - DNA, 22 bp, Homo sapiens
agctcctgggagcaggtggtac

SEQ ID NO: 8438956 - DNA, 22 bp, Homo sapiens
agctcctgggccaagcccatgc

SEQ ID NO: 8438957 - DNA, 22 bp, Homo sapiens
agctcctgggccatcacaacca

SEQ ID NO: 8438958 - DNA, 22 bp, Homo sapiens
agctcctgggccatcacaacca

SEQ ID NO: 8438959 - DNA, 19 bp, Homo sapiens
agctcctgggctctgggcc

SEQ ID NO: 8438960 - DNA, 22 bp, Homo sapiens
agctcctggcaaggtcatggtg

SEQ ID NO: 8438961 - DNA, 22 bp, Homo sapiens
agctcctggctttcctctcacc

SEQ ID NO: 8438962 - DNA, 22 bp, Homo sapiens
agctcctggctttcctctcacc

SEQ ID NO: 8438963 - DNA, 22 bp, Homo sapiens
agctcctggctttcctctcacc

SEQ ID NO: 8438964 - DNA, 22 bp, Homo sapiens
agctcctgggggttccaagcag

SEQ ID NO: 8438965 - DNA, 22 bp, Homo sapiens
agctcctgggggttccaagcag

SEQ ID NO: 8438966 - DNA, 19 bp, Homo sapiens
agctcctgggctctgggcc

SEQ ID NO: 8438967 - DNA, 22 bp, Homo sapiens
agctcctgggggttccaagcag

SEQ ID NO: 8438968 - DNA, 20 bp, Homo sapiens
agctcctggtataggtgcct

SEQ ID NO: 8438969 - DNA, 17 bp, Homo sapiens
agctcctggggtcttta

SEQ ID NO: 8438970 - DNA, 18 bp, Homo sapiens
agctcctggtctcaggga

SEQ ID NO: 8438971 - DNA, 22 bp, Homo sapiens
agctcctgtctcaagggagcct

SEQ ID NO: 8438972 - DNA, 22 bp, Homo sapiens
agctcctggtgcctcagccgaa

SEQ ID NO: 8438973 - DNA, 22 bp, Homo sapiens
agctcctggtctttgtccagag

SEQ ID NO: 8438974 - DNA, 23 bp, Homo sapiens
agctcctgtaaggtggtcgtcac

SEQ ID NO: 8438975 - DNA, 22 bp, Homo sapiens
agctcttacatttaggtctatg

SEQ ID NO: 8438976 - DNA, 22 bp, Homo sapiens
agctcttccacctcatgatggg

SEQ ID NO: 8438977 - DNA, 22 bp, Homo sapiens
agctcttcctgcacctgtggct

SEQ ID NO: 8438978 - DNA, 22 bp, Homo sapiens
agctcctgtggcagctcttctg

SEQ ID NO: 8438979 - DNA, 22 bp, Homo sapiens
agctcctgtggcagctcttctg

SEQ ID NO: 8438980 - DNA, 22 bp, Homo sapiens
agctaagacttagtgacttagt

SEQ ID NO: 8438981 - DNA, 22 bp, Homo sapiens
agctaagaacttgagctctgga

SEQ ID NO: 8438982 - DNA, 22 bp, Homo sapiens
agcctggtttaagcattttata

SEQ ID NO: 8438983 - DNA, 22 bp, Homo sapiens
agcctggtttaagcattttata

SEQ ID NO: 8438984 - DNA, 22 bp, Homo sapiens
agcctgggtttttattaaggag

SEQ ID NO: 8438985 - DNA, 22 bp, Homo sapiens
agcctgggttagggttcttccc

SEQ ID NO: 8438986 - DNA, 18 bp, Homo sapiens
agcctgggctctgcctgg

SEQ ID NO: 8438987 - DNA, 18 bp, Homo sapiens
agcctgggctctgcctgg

SEQ ID NO: 8438988 - DNA, 18 bp, Homo sapiens
agcctgggctctgcctgg

SEQ ID NO: 8438989 - DNA, 22 bp, Homo sapiens
agcctgggcatgggacgggagg

SEQ ID NO: 8438990 - DNA, 22 bp, Homo sapiens
agcctgggccctgcctcttctc

SEQ ID NO: 8438991 - DNA, 22 bp, Homo sapiens
agcctggggcacttctccaaac

SEQ ID NO: 8438992 - DNA, 18 bp, Homo sapiens
agcctgggctctgcctgg

SEQ ID NO: 8438993 - DNA, 21 bp, Homo sapiens
agcctgggtatcctttgagga

SEQ ID NO: 8438994 - DNA, 22 bp, Homo sapiens
agcctggggtttcagtttgcac

SEQ ID NO: 8438995 - DNA, 22 bp, Homo sapiens
agctaaggactggagggtttct

SEQ ID NO: 8438996 - DNA, 20 bp, Homo sapiens
agctacaatgcgaagctggc

SEQ ID NO: 8438997 - DNA, 22 bp, Homo sapiens
agctacagatgagcccagtatc

SEQ ID NO: 8438998 - DNA, 22 bp, Homo sapiens
agctacaagtcatcagctatca

SEQ ID NO: 8438999 - DNA, 17 bp, Homo sapiens
agctacaaggcagttca

SEQ ID NO: 8439000 - DNA, 22 bp, Homo sapiens
agctagaatattgatctgaaat

SEQ ID NO: 8439001 - DNA, 22 bp, Homo sapiens
agctagaactacaggcatgtgc

SEQ ID NO: 8439002 - DNA, 22 bp, Homo sapiens
agctagaatgttccttttcatt

SEQ ID NO: 8439003 - DNA, 22 bp, Homo sapiens
agctagagctgagaagcacttg

SEQ ID NO: 8439004 - DNA, 22 bp, Homo sapiens
agctagagctgagaagcacttg

SEQ ID NO: 8439005 - DNA, 22 bp, Homo sapiens
agctacagtcggaaggacagac

SEQ ID NO: 8439006 - DNA, 22 bp, Homo sapiens
agctacagtcggaaggacagac

SEQ ID NO: 8439007 - DNA, 22 bp, Homo sapiens
agctacagctgtactctgcagg

SEQ ID NO: 8439008 - DNA, 22 bp, Homo sapiens
agctacagttgccctcagcagg

SEQ ID NO: 8439009 - DNA, 22 bp, Homo sapiens
agctacagttgccctcagcagg

SEQ ID NO: 8439010 - DNA, 22 bp, Homo sapiens
agctacagtggacaagtgaact

SEQ ID NO: 8439011 - DNA, 22 bp, Homo sapiens
cagcaagaacagcctgatgtgc

SEQ ID NO: 8439012 - DNA, 22 bp, Homo sapiens
cagcaagaaaattcacatgctc

SEQ ID NO: 8439013 - DNA, 22 bp, Homo sapiens
agcctggccactcagggcctga

SEQ ID NO: 8439014 - DNA, 22 bp, Homo sapiens
agcctggcttagctctctcact

SEQ ID NO: 8439015 - DNA, 21 bp, Homo sapiens
agcctgggaggcggaggttgc

SEQ ID NO: 8439016 - DNA, 22 bp, Homo sapiens
agcctgggcaacaacacagcga

SEQ ID NO: 8439017 - DNA, 22 bp, Homo sapiens
agcctgggaatttagagttcgg

SEQ ID NO: 8439018 - DNA, 17 bp, Homo sapiens
agcctgggaaggagtga

SEQ ID NO: 8439019 - DNA, 17 bp, Homo sapiens
agcctgggaaggagtga

SEQ ID NO: 8439020 - DNA, 22 bp, Homo sapiens
cagcaactgtgcctgacacaca

SEQ ID NO: 8439021 - DNA, 22 bp, Homo sapiens
cagcaactgtgcctgacacaca

SEQ ID NO: 8439022 - DNA, 22 bp, Homo sapiens
cagcaactggtcattgctctcc

SEQ ID NO: 8439023 - DNA, 22 bp, Homo sapiens
cagcaactcctgtagcttatgc

SEQ ID NO: 8439024 - DNA, 22 bp, Homo sapiens
cagcaactctcctgtgctcaaa

SEQ ID NO: 8439025 - DNA, 22 bp, Homo sapiens
cagcaactctcctgtgctcaaa

SEQ ID NO: 8439026 - DNA, 20 bp, Homo sapiens
cagcaactttggactgagtt

SEQ ID NO: 8439027 - DNA, 20 bp, Homo sapiens
cagcaactttggactgagtt

SEQ ID NO: 8439028 - DNA, 21 bp, Homo sapiens
cagcaaatcattgggcagact

SEQ ID NO: 8439029 - DNA, 21 bp, Homo sapiens
cagcaaatcattgggcagact

SEQ ID NO: 8439030 - DNA, 22 bp, Homo sapiens
cagcaaatgagtggcagggcag

SEQ ID NO: 8439031 - DNA, 22 bp, Homo sapiens
cagatggccagaggcagctgca

SEQ ID NO: 8439032 - DNA, 20 bp, Homo sapiens
cagatgggacgtggaggagt

SEQ ID NO: 8439033 - DNA, 22 bp, Homo sapiens
cagatgtaattactcaagtcaa

SEQ ID NO: 8439034 - DNA, 22 bp, Homo sapiens
cagatgtagtagctttattgca

SEQ ID NO: 8439035 - DNA, 22 bp, Homo sapiens
cagatgtgattcttccctcagc

SEQ ID NO: 8439036 - DNA, 22 bp, Homo sapiens
cactttctcatgaatttggccc

SEQ ID NO: 8439037 - DNA, 22 bp, Homo sapiens
cactttctcatgaatttggccc

SEQ ID NO: 8439038 - DNA, 22 bp, Homo sapiens
cactttctgtgttgtgcaaaaa

SEQ ID NO: 8439039 - DNA, 22 bp, Homo sapiens
cactttctgtgttgtgcaaaaa

SEQ ID NO: 8439040 - DNA, 22 bp, Homo sapiens
agccagagatccatccctagga

SEQ ID NO: 8439041 - DNA, 22 bp, Homo sapiens
agccagagagtgttggagatgt

SEQ ID NO: 8439042 - DNA, 22 bp, Homo sapiens
agccagcacggatttcccagga

SEQ ID NO: 8439043 - DNA, 22 bp, Homo sapiens
agccagcacggcgccatggagt

SEQ ID NO: 8439044 - DNA, 19 bp, Homo sapiens
agccagccagcaggtatgc

SEQ ID NO: 8439045 - DNA, 22 bp, Homo sapiens
agccagcccctgactgtgtcct

SEQ ID NO: 8439046 - DNA, 22 bp, Homo sapiens
agccagcccctgactgtgtcct

SEQ ID NO: 8439047 - DNA, 20 bp, Homo sapiens
agccagccacttcctgctcc

SEQ ID NO: 8439048 - DNA, 22 bp, Homo sapiens
agccagcatcccttcagtctcc

SEQ ID NO: 8439049 - DNA, 22 bp, Homo sapiens
agccagcatgaagacagaggcc

SEQ ID NO: 8439050 - DNA, 22 bp, Homo sapiens
agccagcaggaacgtctaggtt

SEQ ID NO: 8439051 - DNA, 22 bp, Homo sapiens
agccagcagggcttagaggaca

SEQ ID NO: 8439052 - DNA, 22 bp, Homo sapiens
agccagcaggtgagtgcagcct

SEQ ID NO: 8439053 - DNA, 17 bp, Homo sapiens
agccagcagtagctggt

SEQ ID NO: 8439054 - DNA, 22 bp, Homo sapiens
cagagacatccatgttagttgg

SEQ ID NO: 8439055 - DNA, 22 bp, Homo sapiens
cagagacatccattttatatgc

SEQ ID NO: 8439056 - DNA, 22 bp, Homo sapiens
cagagacatgtggcctgcacgt

SEQ ID NO: 8439057 - DNA, 22 bp, Homo sapiens
cagagacatgtggcctgcacgt

SEQ ID NO: 8439058 - DNA, 22 bp, Homo sapiens
cagagacattaagtgccatgat

SEQ ID NO: 8439059 - DNA, 22 bp, Homo sapiens
cagagacatgtggcctgcacgt

SEQ ID NO: 8439060 - DNA, 22 bp, Homo sapiens
cagagacatgtggcctgcacgt

SEQ ID NO: 8439061 - DNA, 22 bp, Homo sapiens
cagagacattcagtaaattatc

SEQ ID NO: 8439062 - DNA, 22 bp, Homo sapiens
cagagacattctccccattgga

SEQ ID NO: 8439063 - DNA, 22 bp, Homo sapiens
cagagaccctaggcaggtgaca

SEQ ID NO: 8439064 - DNA, 22 bp, Homo sapiens
cagagaccctaggcaggtgaca

SEQ ID NO: 8439065 - DNA, 22 bp, Homo sapiens
cagagaccctaggcaggtgaca

SEQ ID NO: 8439066 - DNA, 22 bp, Homo sapiens
cagagacccctggcatggtggt

SEQ ID NO: 8439067 - DNA, 22 bp, Homo sapiens
agccaggccagactcacaccct

SEQ ID NO: 8439068 - DNA, 22 bp, Homo sapiens
cagagacccttctcagtggcca

SEQ ID NO: 8439069 - DNA, 18 bp, Homo sapiens
cagagctcctggatgcag

SEQ ID NO: 8439070 - DNA, 22 bp, Homo sapiens
cagagctcagagctgccaggca

SEQ ID NO: 8439071 - DNA, 22 bp, Homo sapiens
cagagctcagagctgccaggca

SEQ ID NO: 8439072 - DNA, 22 bp, Homo sapiens
cagagctcagagcagggcactc

SEQ ID NO: 8439073 - DNA, 20 bp, Homo sapiens
cagagctatccctttattta

SEQ ID NO: 8439074 - DNA, 22 bp, Homo sapiens
cagagctcagagcagggcactc

SEQ ID NO: 8439075 - DNA, 22 bp, Homo sapiens
cagagccttcctagcagactct

SEQ ID NO: 8439076 - DNA, 22 bp, Homo sapiens
cagagccttcctagcagactct

SEQ ID NO: 8439077 - DNA, 22 bp, Homo sapiens
cagagccttagttctcctagaa

SEQ ID NO: 8439078 - DNA, 22 bp, Homo sapiens
cagagccttagttctcctagaa

SEQ ID NO: 8439079 - DNA, 19 bp, Homo sapiens
cagagccttcagtgactcc

SEQ ID NO: 8439080 - DNA, 22 bp, Homo sapiens
cagagcctggcgatgtcatgga

SEQ ID NO: 8439081 - DNA, 20 bp, Homo sapiens
cagagcccactttcttatca

SEQ ID NO: 8439082 - DNA, 21 bp, Homo sapiens
cagagcctgtgttgacagttg

SEQ ID NO: 8439083 - DNA, 22 bp, Homo sapiens
agccaggccagctgtcttgagt

SEQ ID NO: 8439084 - DNA, 22 bp, Homo sapiens
agccctggcagagccaggtagt

SEQ ID NO: 8439085 - DNA, 22 bp, Homo sapiens
agccctggcagagccaggtagt

SEQ ID NO: 8439086 - DNA, 22 bp, Homo sapiens
agccctggcagagccaggtagt

SEQ ID NO: 8439087 - DNA, 22 bp, Homo sapiens
agccctggattctgaggtccaa

SEQ ID NO: 8439088 - DNA, 22 bp, Homo sapiens
agccctggagcaaaggtgtctt

SEQ ID NO: 8439089 - DNA, 22 bp, Homo sapiens
agccctgcttcaccatttactt

SEQ ID NO: 8439090 - DNA, 22 bp, Homo sapiens
agccctgctgcttcttgtattt

SEQ ID NO: 8439091 - DNA, 22 bp, Homo sapiens
agccctggaagccacagtccta

SEQ ID NO: 8439092 - DNA, 22 bp, Homo sapiens
agccccagttccctggaagtct

SEQ ID NO: 8439093 - DNA, 23 bp, Homo sapiens
agccctgctgagacccagctccc

SEQ ID NO: 8439094 - DNA, 22 bp, Homo sapiens
agccctgctgcctgaattagct

SEQ ID NO: 8439095 - DNA, 22 bp, Homo sapiens
agccctgctgcctgaattagct

SEQ ID NO: 8439096 - DNA, 22 bp, Homo sapiens
agccctgcgtgccaggggactg

SEQ ID NO: 8439097 - DNA, 22 bp, Homo sapiens
agccctgagctggcctgggctt

SEQ ID NO: 8439098 - DNA, 22 bp, Homo sapiens
agccctgattaaccttggcttt

SEQ ID NO: 8439099 - DNA, 22 bp, Homo sapiens
agccctgctcatctggatcccg

SEQ ID NO: 8439100 - DNA, 22 bp, Homo sapiens
cagatggctgccaagatgggct

SEQ ID NO: 8439101 - DNA, 20 bp, Homo sapiens
cagatggcacgtcagggcat

SEQ ID NO: 8439102 - DNA, 22 bp, Homo sapiens
agccctgggctgtagataagca

SEQ ID NO: 8439103 - DNA, 22 bp, Homo sapiens
agccctgggaggccagcttgta

SEQ ID NO: 8439104 - DNA, 22 bp, Homo sapiens
agccctggcccggctgtgcttt

SEQ ID NO: 8439105 - DNA, 22 bp, Homo sapiens
agccctggctcccagcagcgct

SEQ ID NO: 8439106 - DNA, 22 bp, Homo sapiens
agccctggctcccagcagcgct

SEQ ID NO: 8439107 - DNA, 22 bp, Homo sapiens
agccctggcccggctgtgcttt

SEQ ID NO: 8439108 - DNA, 22 bp, Homo sapiens
cagagctctgacagctacagcc

SEQ ID NO: 8439109 - DNA, 22 bp, Homo sapiens
cagagctctctttgctactaca

SEQ ID NO: 8439110 - DNA, 22 bp, Homo sapiens
cagagctctatgttcatggagg

SEQ ID NO: 8439111 - DNA, 22 bp, Homo sapiens
cagagctctatgttcatggagg

SEQ ID NO: 8439112 - DNA, 22 bp, Homo sapiens
agccagtggaattcccaggggt

SEQ ID NO: 8439113 - DNA, 22 bp, Homo sapiens
agcccagggagttgattagcat

SEQ ID NO: 8439114 - DNA, 22 bp, Homo sapiens
agccccagtaagggagggcctg

SEQ ID NO: 8439115 - DNA, 22 bp, Homo sapiens
agccccaggcccggacgcctct

SEQ ID NO: 8439116 - DNA, 22 bp, Homo sapiens
agccccagcccctctctcacaa

SEQ ID NO: 8439117 - DNA, 22 bp, Homo sapiens
agccccagcccctctctcacaa

SEQ ID NO: 8439118 - DNA, 22 bp, Homo sapiens
agccccagcccctctctcacaa

SEQ ID NO: 8439119 - DNA, 22 bp, Homo sapiens
agccccaggatgggccgcagga

SEQ ID NO: 8439120 - DNA, 22 bp, Homo sapiens
agcccaggttgaggctgcagtg

SEQ ID NO: 8439121 - DNA, 22 bp, Homo sapiens
agcccaggttgaggctgcagtg

SEQ ID NO: 8439122 - DNA, 22 bp, Homo sapiens
agcccaggttgaggctgcagtg

SEQ ID NO: 8439123 - DNA, 22 bp, Homo sapiens
agccccacactctctctgagaa

SEQ ID NO: 8439124 - DNA, 22 bp, Homo sapiens
agccccaaacaccaggattact

SEQ ID NO: 8439125 - DNA, 22 bp, Homo sapiens
agcccatgcaacaggcctagcg

SEQ ID NO: 8439126 - DNA, 22 bp, Homo sapiens
agcccatgcaacaggcctagcg

SEQ ID NO: 8439127 - DNA, 20 bp, Homo sapiens
agcccatctcccacagctac

SEQ ID NO: 8439128 - DNA, 22 bp, Homo sapiens
cacagcaatagctaactgatac

SEQ ID NO: 8439129 - DNA, 22 bp, Homo sapiens
cacagcaatagctaactgatac

SEQ ID NO: 8439130 - DNA, 22 bp, Homo sapiens
cacagcaagagctaaatgacca

SEQ ID NO: 8439131 - DNA, 22 bp, Homo sapiens
agcaggaactcagggagttctc

SEQ ID NO: 8439132 - DNA, 22 bp, Homo sapiens
agcaggaaggctttgggggttc

SEQ ID NO: 8439133 - DNA, 22 bp, Homo sapiens
cacagcagaacttaatttcaaa

SEQ ID NO: 8439134 - DNA, 22 bp, Homo sapiens
cacagcagaaatatgaaggcag

SEQ ID NO: 8439135 - DNA, 22 bp, Homo sapiens
cacagcagaaatatgaaggcag

SEQ ID NO: 8439136 - DNA, 22 bp, Homo sapiens
cacagcagaaagtgtaggagga

SEQ ID NO: 8439137 - DNA, 22 bp, Homo sapiens
cacagcagaaagtgtaggagga

SEQ ID NO: 8439138 - DNA, 22 bp, Homo sapiens
cacagcagacagggaggcggct

SEQ ID NO: 8439139 - DNA, 22 bp, Homo sapiens
cacagcagacagggaggcggct

SEQ ID NO: 8439140 - DNA, 22 bp, Homo sapiens
agcaggctgggcaatatgggca

SEQ ID NO: 8439141 - DNA, 23 bp, Homo sapiens
agcaggctgcttctccacagctg

SEQ ID NO: 8439142 - DNA, 22 bp, Homo sapiens
cacagcagagggagccattgaa

SEQ ID NO: 8439143 - DNA, 22 bp, Homo sapiens
caccagagttgtccaaatgatt

SEQ ID NO: 8439144 - DNA, 23 bp, Homo sapiens
caccactttctccttctccttgg

SEQ ID NO: 8439145 - DNA, 22 bp, Homo sapiens
caccagcagaagactgagggtg

SEQ ID NO: 8439146 - DNA, 22 bp, Homo sapiens
caccagccagagtgacagctcc

SEQ ID NO: 8439147 - DNA, 22 bp, Homo sapiens
caccagccccctcacgctgtca

SEQ ID NO: 8439148 - DNA, 22 bp, Homo sapiens
caccagccccctcacgctgtca

SEQ ID NO: 8439149 - DNA, 22 bp, Homo sapiens
caccagcgactgtgaccagcaa

SEQ ID NO: 8439150 - DNA, 22 bp, Homo sapiens
caccagccccctcacgctgtca

SEQ ID NO: 8439151 - DNA, 22 bp, Homo sapiens
caccagctacagactactgtgt

SEQ ID NO: 8439152 - DNA, 22 bp, Homo sapiens
caccagctaattaaaacagcag

SEQ ID NO: 8439153 - DNA, 22 bp, Homo sapiens
agcagggcagctgatgcgcacg

SEQ ID NO: 8439154 - DNA, 22 bp, Homo sapiens
agcagggcactggaaggcactg

SEQ ID NO: 8439155 - DNA, 22 bp, Homo sapiens
cactggtgagtccagaagtcat

SEQ ID NO: 8439156 - DNA, 19 bp, Homo sapiens
agcattaggcaaattttga

SEQ ID NO: 8439157 - DNA, 22 bp, Homo sapiens
agcattagattaaaaatttaga

SEQ ID NO: 8439158 - DNA, 22 bp, Homo sapiens
agcattagaagaaatgattata

SEQ ID NO: 8439159 - DNA, 22 bp, Homo sapiens
cactgtggttattatcactgtt

SEQ ID NO: 8439160 - DNA, 22 bp, Homo sapiens
cactgtgtcagagtatgatgat

SEQ ID NO: 8439161 - DNA, 22 bp, Homo sapiens
cactgtgtctggagtgagctgg

SEQ ID NO: 8439162 - DNA, 22 bp, Homo sapiens
cactgtgtctggagtgagctgg

SEQ ID NO: 8439163 - DNA, 22 bp, Homo sapiens
cactgttcatcaaaactgctct

SEQ ID NO: 8439164 - DNA, 22 bp, Homo sapiens
cactgttctttttgtagtccaa

SEQ ID NO: 8439165 - DNA, 22 bp, Homo sapiens
cactgttcatcaaaactgctct

SEQ ID NO: 8439166 - DNA, 22 bp, Homo sapiens
cacttaaaactcctggaattgt

SEQ ID NO: 8439167 - DNA, 22 bp, Homo sapiens
cactttactatctataaaataa

SEQ ID NO: 8439168 - DNA, 22 bp, Homo sapiens
cactttacccttgttactcatg

SEQ ID NO: 8439169 - DNA, 21 bp, Homo sapiens
agcatgtctcagtcaacaagg

SEQ ID NO: 8439170 - DNA, 22 bp, Homo sapiens
agcatggctttggaggatagca

SEQ ID NO: 8439171 - DNA, 22 bp, Homo sapiens
agcatggctttggaggatagca

SEQ ID NO: 8439172 - DNA, 22 bp, Homo sapiens
agcatggacagtggcagcagtg

SEQ ID NO: 8439173 - DNA, 22 bp, Homo sapiens
agcatgcagtaaagcccatgtc

SEQ ID NO: 8439174 - DNA, 22 bp, Homo sapiens
agcatgcagtaagtaccctgtg

SEQ ID NO: 8439175 - DNA, 22 bp, Homo sapiens
agcatgcaggaaccacatggca

SEQ ID NO: 8439176 - DNA, 22 bp, Homo sapiens
agcatgctatattgattgtagt

SEQ ID NO: 8439177 - DNA, 22 bp, Homo sapiens
agcagtccaactgaggtggcat

SEQ ID NO: 8439178 - DNA, 22 bp, Homo sapiens
agcagtccttctttagagagcc

SEQ ID NO: 8439179 - DNA, 22 bp, Homo sapiens
agcagtcctccagtgtgtttta

SEQ ID NO: 8439180 - DNA, 22 bp, Homo sapiens
agcagtcagtcctgaatgaagg

SEQ ID NO: 8439181 - DNA, 20 bp, Homo sapiens
agcagtccaaaagggcagac

SEQ ID NO: 8439182 - DNA, 22 bp, Homo sapiens
agcagtaagtgaagactagttt

SEQ ID NO: 8439183 - DNA, 23 bp, Homo sapiens
agcagtcagggtggtaagccatc

SEQ ID NO: 8439184 - DNA, 18 bp, Homo sapiens
agcaggttctcacagcca

SEQ ID NO: 8439185 - DNA, 22 bp, Homo sapiens
agcaggttgttttgtggccagg

SEQ ID NO: 8439186 - DNA, 22 bp, Homo sapiens
agcaggtgtttgtatcataagg

SEQ ID NO: 8439187 - DNA, 22 bp, Homo sapiens
agcaggtgttagggatccaatg

SEQ ID NO: 8439188 - DNA, 19 bp, Homo sapiens
agcaggtgggtaagaaaat

SEQ ID NO: 8439189 - DNA, 22 bp, Homo sapiens
agcaggtgtcggcgagggtctt

SEQ ID NO: 8439190 - DNA, 22 bp, Homo sapiens
agcatgcacatgactggcttaa

SEQ ID NO: 8439191 - DNA, 22 bp, Homo sapiens
agcatgaaagcataggacagtc

SEQ ID NO: 8439192 - DNA, 22 bp, Homo sapiens
agcagtggcatacattttgagt

SEQ ID NO: 8439193 - DNA, 22 bp, Homo sapiens
agcatcagcagactctcagcta

SEQ ID NO: 8439194 - DNA, 22 bp, Homo sapiens
agcatcagagagaagttaacta

SEQ ID NO: 8439195 - DNA, 22 bp, Homo sapiens
agcagtgccgcatcttgtgacc

SEQ ID NO: 8439196 - DNA, 22 bp, Homo sapiens
agcagtggacctcagtgctatt

SEQ ID NO: 8439197 - DNA, 22 bp, Homo sapiens
caatacactaaacttctctgaa

SEQ ID NO: 8439198 - DNA, 22 bp, Homo sapiens
caatacactaaacttctctgaa

SEQ ID NO: 8439199 - DNA, 22 bp, Homo sapiens
caatacaattaccagttaatca

SEQ ID NO: 8439200 - DNA, 22 bp, Homo sapiens
caatacatcaggtcaaaatgtg

SEQ ID NO: 8439201 - DNA, 16 bp, Homo sapiens
caatacatggcatttc

SEQ ID NO: 8439202 - DNA, 22 bp, Homo sapiens
caatactgagtttacattcatc

SEQ ID NO: 8439203 - DNA, 19 bp, Homo sapiens
agcagcagaagtgtgcctt

SEQ ID NO: 8439204 - DNA, 22 bp, Homo sapiens
agcagcagatcaaacaggcttg

SEQ ID NO: 8439205 - DNA, 22 bp, Homo sapiens
agcagcagatcaaacaggcttg

SEQ ID NO: 8439206 - DNA, 22 bp, Homo sapiens
agcagcagagctctggtctgca

SEQ ID NO: 8439207 - DNA, 22 bp, Homo sapiens
agcagcagaggtcagaaaggta

SEQ ID NO: 8439208 - DNA, 22 bp, Homo sapiens
agcagccttaggtattgtgatt

SEQ ID NO: 8439209 - DNA, 22 bp, Homo sapiens
agcagccttgcaggggtcgcac

SEQ ID NO: 8439210 - DNA, 23 bp, Homo sapiens
agcagcccagatgccttccatcc

SEQ ID NO: 8439211 - DNA, 21 bp, Homo sapiens
agcagcagatctggtgagggc

SEQ ID NO: 8439212 - DNA, 21 bp, Homo sapiens
agcagcagatctggtgagggc

SEQ ID NO: 8439213 - DNA, 22 bp, Homo sapiens
agcagccagagaatgatgcagt

SEQ ID NO: 8439214 - DNA, 22 bp, Homo sapiens
cacagaacatccttagctcatg

SEQ ID NO: 8439215 - DNA, 22 bp, Homo sapiens
cacagaacatccttagctcatg

SEQ ID NO: 8439216 - DNA, 21 bp, Homo sapiens
cacagagatattggtgagcct

SEQ ID NO: 8439217 - DNA, 22 bp, Homo sapiens
cacagaacatttttagatgcag

SEQ ID NO: 8439218 - DNA, 22 bp, Homo sapiens
cacagagatcggaacagaagta

SEQ ID NO: 8439219 - DNA, 19 bp, Homo sapiens
agcagctcagggaggcacc

SEQ ID NO: 8439220 - DNA, 22 bp, Homo sapiens
agcagctcatggagtaggcact

SEQ ID NO: 8439221 - DNA, 22 bp, Homo sapiens
agcagctcaagacttaaatttg

SEQ ID NO: 8439222 - DNA, 22 bp, Homo sapiens
agcagctggaacatatgaagaa

SEQ ID NO: 8439223 - DNA, 21 bp, Homo sapiens
agcagctgggcaacatggagg

SEQ ID NO: 8439224 - DNA, 21 bp, Homo sapiens
agcagctgggcaacatggagg

SEQ ID NO: 8439225 - DNA, 21 bp, Homo sapiens
agcagctgggcaacatggagg

SEQ ID NO: 8439226 - DNA, 17 bp, Homo sapiens
agcagctggcacaggag

SEQ ID NO: 8439227 - DNA, 19 bp, Homo sapiens
agcagctggaggtggagtg

SEQ ID NO: 8439228 - DNA, 17 bp, Homo sapiens
agcagctggcacaggag

SEQ ID NO: 8439229 - DNA, 22 bp, Homo sapiens
agcagctggaactaatagtggt

SEQ ID NO: 8439230 - DNA, 22 bp, Homo sapiens
agcactgtggggaactcacaga

SEQ ID NO: 8439231 - DNA, 22 bp, Homo sapiens
agcactgtgagcaccagcacgc

SEQ ID NO: 8439232 - DNA, 22 bp, Homo sapiens
agcagagcgcctgctcagaggg

SEQ ID NO: 8439233 - DNA, 22 bp, Homo sapiens
agcagagcggggcctccggaag

SEQ ID NO: 8439234 - DNA, 22 bp, Homo sapiens
agcagagctgcagtggcctgct

SEQ ID NO: 8439235 - DNA, 22 bp, Homo sapiens
agcagagcgcctgctcagaggg

SEQ ID NO: 8439236 - DNA, 22 bp, Homo sapiens
agcagagcggggcctccggaag

SEQ ID NO: 8439237 - DNA, 21 bp, Homo sapiens
agcagaggctgcctggtgact

SEQ ID NO: 8439238 - DNA, 21 bp, Homo sapiens
agcagaggcagaatgtatgca

SEQ ID NO: 8439239 - DNA, 21 bp, Homo sapiens
agcagaggcagaatgtatgca

SEQ ID NO: 8439240 - DNA, 22 bp, Homo sapiens
agcagaggacagttcttaggaa

SEQ ID NO: 8439241 - DNA, 22 bp, Homo sapiens
agcagagctgggatcctgggtc

SEQ ID NO: 8439242 - DNA, 20 bp, Homo sapiens
caataatttacttccctatt

SEQ ID NO: 8439243 - DNA, 20 bp, Homo sapiens
caataatttacttccctatt

SEQ ID NO: 8439244 - DNA, 22 bp, Homo sapiens
caataatttacattggatacca

SEQ ID NO: 8439245 - DNA, 22 bp, Homo sapiens
caataatttacattggatacca

SEQ ID NO: 8439246 - DNA, 22 bp, Homo sapiens
caataatatcctgtgctgtttg

SEQ ID NO: 8439247 - DNA, 22 bp, Homo sapiens
caataattgctttccagagtta

SEQ ID NO: 8439248 - DNA, 22 bp, Homo sapiens
caataattgctttccagagtta

SEQ ID NO: 8439249 - DNA, 22 bp, Homo sapiens
caataattgctttccagagtta

SEQ ID NO: 8439250 - DNA, 22 bp, Homo sapiens
caataatatcctgtgctgtttg

SEQ ID NO: 8439251 - DNA, 22 bp, Homo sapiens
caataatatcctgtgctgtttg

SEQ ID NO: 8439252 - DNA, 22 bp, Homo sapiens
agcagagtgccccatcacaagg

SEQ ID NO: 8439253 - DNA, 22 bp, Homo sapiens
agcagagtcttcaagggcaggc

SEQ ID NO: 8439254 - DNA, 22 bp, Homo sapiens
agcagagtcttcaagggcaggc

SEQ ID NO: 8439255 - DNA, 22 bp, Homo sapiens
agcagaggtttgttggaaacct

SEQ ID NO: 8439256 - DNA, 21 bp, Homo sapiens
agcagaggggacatgtttgat

SEQ ID NO: 8439257 - DNA, 23 bp, Homo sapiens
agcactcatgctgcagaagtcat

SEQ ID NO: 8439258 - DNA, 22 bp, Homo sapiens
agcactgtagttatagctaaca

SEQ ID NO: 8439259 - DNA, 22 bp, Homo sapiens
agcactgctttagagcctctgc

SEQ ID NO: 8439260 - DNA, 20 bp, Homo sapiens
agcacctgtgtagaagcatc

SEQ ID NO: 8439261 - DNA, 22 bp, Homo sapiens
agcacctgtgccctgatggaga

SEQ ID NO: 8439262 - DNA, 22 bp, Homo sapiens
caaagggcattttagtgaactg

SEQ ID NO: 8439263 - DNA, 22 bp, Homo sapiens
caaagggcggctgtcggagggt

SEQ ID NO: 8439264 - DNA, 22 bp, Homo sapiens
agcaccaggtcgctggcacgct

SEQ ID NO: 8439265 - DNA, 22 bp, Homo sapiens
agcacctggatttgatagtcag

SEQ ID NO: 8439266 - DNA, 18 bp, Homo sapiens
agcaccagtcactaacag

SEQ ID NO: 8439267 - DNA, 23 bp, Homo sapiens
agcacctgtgatttcctagctct

SEQ ID NO: 8439268 - DNA, 22 bp, Homo sapiens
agcacctgtcacaagcagaagg

SEQ ID NO: 8439269 - DNA, 22 bp, Homo sapiens
caaagggaaaagccatgtgggc

SEQ ID NO: 8439270 - DNA, 22 bp, Homo sapiens
caaaggctttgctatgatgcat

SEQ ID NO: 8439271 - DNA, 22 bp, Homo sapiens
caaaggcttcatctcagagcag

SEQ ID NO: 8439272 - DNA, 22 bp, Homo sapiens
caaaggcttccactgcatcctt

SEQ ID NO: 8439273 - DNA, 22 bp, Homo sapiens
caaagggcatggcctgagcact

SEQ ID NO: 8439274 - DNA, 22 bp, Homo sapiens
caaaggcatcggcaattaggga

SEQ ID NO: 8439275 - DNA, 22 bp, Homo sapiens
caaaggcatcggcaattaggga

SEQ ID NO: 8439276 - DNA, 22 bp, Homo sapiens
caaaggctgccactgtggctgt

SEQ ID NO: 8439277 - DNA, 22 bp, Homo sapiens
caaaggctcagtaaatctttgt

SEQ ID NO: 8439278 - DNA, 22 bp, Homo sapiens
caaaggcagttactgaatgaag

SEQ ID NO: 8439279 - DNA, 22 bp, Homo sapiens
caaaggctggtagaatgagcca

SEQ ID NO: 8439280 - DNA, 21 bp, Homo sapiens
agactgtggattttgacatgt

SEQ ID NO: 8439281 - DNA, 22 bp, Homo sapiens
agacttaggagctgacatctct

SEQ ID NO: 8439282 - DNA, 22 bp, Homo sapiens
agactgttgcctgaacttagcc

SEQ ID NO: 8439283 - DNA, 22 bp, Homo sapiens
agactgtagcttctgtcttgag

SEQ ID NO: 8439284 - DNA, 22 bp, Homo sapiens
agactgtagggatagaggtctt

SEQ ID NO: 8439285 - DNA, 21 bp, Homo sapiens
agacttctagaagtgagatag

SEQ ID NO: 8439286 - DNA, 20 bp, Homo sapiens
agacttaggcaatttaggct

SEQ ID NO: 8439287 - DNA, 22 bp, Homo sapiens
agacttagtgagttctaagttt

SEQ ID NO: 8439288 - DNA, 21 bp, Homo sapiens
agacttctagaagtgagatag

SEQ ID NO: 8439289 - DNA, 22 bp, Homo sapiens
agacttcttgagctggcacttc

SEQ ID NO: 8439290 - DNA, 22 bp, Homo sapiens
agacttcttgagctggcacttc

SEQ ID NO: 8439291 - DNA, 18 bp, Homo sapiens
agactttgagttagaggg

SEQ ID NO: 8439292 - DNA, 19 bp, Homo sapiens
agacttttgtaagttgaga

SEQ ID NO: 8439293 - DNA, 22 bp, Homo sapiens
agagaatgcagggcttcggaca

SEQ ID NO: 8439294 - DNA, 22 bp, Homo sapiens
agagaaggtcactaaggaccca

SEQ ID NO: 8439295 - DNA, 22 bp, Homo sapiens
agagagcccgggccagggcaca

SEQ ID NO: 8439296 - DNA, 21 bp, Homo sapiens
agagacagagaaagtaacatt

SEQ ID NO: 8439297 - DNA, 22 bp, Homo sapiens
agagacagacacatcgggctgc

SEQ ID NO: 8439298 - DNA, 22 bp, Homo sapiens
agagacacatcatataagtata

SEQ ID NO: 8439299 - DNA, 22 bp, Homo sapiens
agagacaccgcgcatcatggct

SEQ ID NO: 8439300 - DNA, 22 bp, Homo sapiens
agagaattctggtgctaacaag

SEQ ID NO: 8439301 - DNA, 22 bp, Homo sapiens
agagaattctggtgctaacaag

SEQ ID NO: 8439302 - DNA, 22 bp, Homo sapiens
agagacaaacactgcaacttct

SEQ ID NO: 8439303 - DNA, 22 bp, Homo sapiens
agagaattaacattccatggct

SEQ ID NO: 8439304 - DNA, 22 bp, Homo sapiens
agagaattaattaggagcactg

SEQ ID NO: 8439305 - DNA, 22 bp, Homo sapiens
agagacaagaaatacctgggac

SEQ ID NO: 8439306 - DNA, 22 bp, Homo sapiens
agagacacatcatataagtata

SEQ ID NO: 8439307 - DNA, 19 bp, Homo sapiens
agagacacaggtaagtagg

SEQ ID NO: 8439308 - DNA, 19 bp, Homo sapiens
agagaggctgtgtgaggga

SEQ ID NO: 8439309 - DNA, 22 bp, Homo sapiens
agagagggaatatttggggtat

SEQ ID NO: 8439310 - DNA, 19 bp, Homo sapiens
agagaggctgtgtgaggga

SEQ ID NO: 8439311 - DNA, 22 bp, Homo sapiens
agagagggaatatttggggtat

SEQ ID NO: 8439312 - DNA, 21 bp, Homo sapiens
agagagggagatgaaacatcc

SEQ ID NO: 8439313 - DNA, 22 bp, Homo sapiens
agagagggcatagaaaaaggga

SEQ ID NO: 8439314 - DNA, 22 bp, Homo sapiens
agagagggcatagaaaaaggga

SEQ ID NO: 8439315 - DNA, 22 bp, Homo sapiens
agagaggtctcaggagaaacca

SEQ ID NO: 8439316 - DNA, 22 bp, Homo sapiens
agagaggcgagttacctgtgct

SEQ ID NO: 8439317 - DNA, 22 bp, Homo sapiens
agagaggcattcggtgatccca

SEQ ID NO: 8439318 - DNA, 22 bp, Homo sapiens
agagagcccgggccagggcaca

SEQ ID NO: 8439319 - DNA, 22 bp, Homo sapiens
agagagcccgggccagggcaca

SEQ ID NO: 8439320 - DNA, 22 bp, Homo sapiens
agagagcctgagtggcagctat

SEQ ID NO: 8439321 - DNA, 22 bp, Homo sapiens
agagagctgactttggagtcag

SEQ ID NO: 8439322 - DNA, 22 bp, Homo sapiens
agagccagttgttaagcactta

SEQ ID NO: 8439323 - DNA, 22 bp, Homo sapiens
agagcccaggcaggcatccagg

SEQ ID NO: 8439324 - DNA, 22 bp, Homo sapiens
agagcccaggcaggcatccagg

SEQ ID NO: 8439325 - DNA, 22 bp, Homo sapiens
agagcccaggtcctggagaggg

SEQ ID NO: 8439326 - DNA, 22 bp, Homo sapiens
agagcccagaaagtatgtcata

SEQ ID NO: 8439327 - DNA, 22 bp, Homo sapiens
agagcccagtctttgtgtgaag

SEQ ID NO: 8439328 - DNA, 22 bp, Homo sapiens
agagcccaggtcctggagaggg

SEQ ID NO: 8439329 - DNA, 22 bp, Homo sapiens
agagcccaggtcctggagaggg

SEQ ID NO: 8439330 - DNA, 22 bp, Homo sapiens
agagcccagtgacatcagcaca

SEQ ID NO: 8439331 - DNA, 22 bp, Homo sapiens
agagcccatcagtggcagtgga

SEQ ID NO: 8439332 - DNA, 22 bp, Homo sapiens
agagcccatcagtggcagtgga

SEQ ID NO: 8439333 - DNA, 22 bp, Homo sapiens
agagcagatggagctggaagag

SEQ ID NO: 8439334 - DNA, 22 bp, Homo sapiens
agagcagatggccagggggcct

SEQ ID NO: 8439335 - DNA, 22 bp, Homo sapiens
agagcagatggagctggaagag

SEQ ID NO: 8439336 - DNA, 20 bp, Homo sapiens
agagcagcagttggtgaggt

SEQ ID NO: 8439337 - DNA, 22 bp, Homo sapiens
agagcagaggcatggccgtggg

SEQ ID NO: 8439338 - DNA, 22 bp, Homo sapiens
agagcactttcgagagccggag

SEQ ID NO: 8439339 - DNA, 22 bp, Homo sapiens
agagcaccccgggaagagcaag

SEQ ID NO: 8439340 - DNA, 22 bp, Homo sapiens
agagcacagccaccatttacaa

SEQ ID NO: 8439341 - DNA, 22 bp, Homo sapiens
agagctgaattcaagtgctggc

SEQ ID NO: 8439342 - DNA, 22 bp, Homo sapiens
agagctggacgtctgagcccta

SEQ ID NO: 8439343 - DNA, 22 bp, Homo sapiens
agagctggagcagccccactgg

SEQ ID NO: 8439344 - DNA, 22 bp, Homo sapiens
agagctggcagcagcttctcct

SEQ ID NO: 8439345 - DNA, 22 bp, Homo sapiens
agagctggcagcagcttctcct

SEQ ID NO: 8439346 - DNA, 22 bp, Homo sapiens
agagctggatggtcaagatggc

SEQ ID NO: 8439347 - DNA, 21 bp, Homo sapiens
agagctggcctgccaggccct

SEQ ID NO: 8439348 - DNA, 22 bp, Homo sapiens
agagctggccagggatcactct

SEQ ID NO: 8439349 - DNA, 22 bp, Homo sapiens
agagctggctgctgcggtgctt

SEQ ID NO: 8439350 - DNA, 22 bp, Homo sapiens
agagctggctggtagccctgat

SEQ ID NO: 8439351 - DNA, 21 bp, Homo sapiens
agagcctgagatcttccagca

SEQ ID NO: 8439352 - DNA, 21 bp, Homo sapiens
agagcctgagatcttccagca

SEQ ID NO: 8439353 - DNA, 22 bp, Homo sapiens
agagcctgagcctgaaagccct

SEQ ID NO: 8439354 - DNA, 22 bp, Homo sapiens
agagcctctgtcatggagagaa

SEQ ID NO: 8439355 - DNA, 23 bp, Homo sapiens
agagcctgaaagacttctggcac

SEQ ID NO: 8439356 - DNA, 22 bp, Homo sapiens
agagccctggagggcagtcccg

SEQ ID NO: 8439357 - DNA, 22 bp, Homo sapiens
agagccctgccaatggatgagg

SEQ ID NO: 8439358 - DNA, 22 bp, Homo sapiens
agagccctggagggcagtcccg

SEQ ID NO: 8439359 - DNA, 22 bp, Homo sapiens
agagccctcttcactgcccctt

SEQ ID NO: 8439360 - DNA, 22 bp, Homo sapiens
agagccctctcattggcttatt

SEQ ID NO: 8439361 - DNA, 22 bp, Homo sapiens
agagccctaaaccctgccttgg

SEQ ID NO: 8439362 - DNA, 22 bp, Homo sapiens
agagccctgaagcagagctaaa

SEQ ID NO: 8439363 - DNA, 22 bp, Homo sapiens
agagccctgacggggacagatg

SEQ ID NO: 8439364 - DNA, 22 bp, Homo sapiens
agacctggaagttcaagagaaa

SEQ ID NO: 8439365 - DNA, 22 bp, Homo sapiens
agaccccatacctcagcaggta

SEQ ID NO: 8439366 - DNA, 22 bp, Homo sapiens
atgccaagctctatccctgacc

SEQ ID NO: 8439367 - DNA, 22 bp, Homo sapiens
atgccacataaccagttcactt

SEQ ID NO: 8439368 - DNA, 22 bp, Homo sapiens
agacctgggttcgagtcctaac

SEQ ID NO: 8439369 - DNA, 22 bp, Homo sapiens
agacctgggtgccctgtgcttt

SEQ ID NO: 8439370 - DNA, 22 bp, Homo sapiens
agacctggatgtgagggaagta

SEQ ID NO: 8439371 - DNA, 22 bp, Homo sapiens
agacctggatgtgagggaagta

SEQ ID NO: 8439372 - DNA, 22 bp, Homo sapiens
agacctggtttatcaccagcat

SEQ ID NO: 8439373 - DNA, 22 bp, Homo sapiens
agacctttatttcatgatagga

SEQ ID NO: 8439374 - DNA, 22 bp, Homo sapiens
agacctgttgggttcattggct

SEQ ID NO: 8439375 - DNA, 22 bp, Homo sapiens
agacctgtgatcacatggaatg

SEQ ID NO: 8439376 - DNA, 22 bp, Homo sapiens
atgcctggtcccacctctaggt

SEQ ID NO: 8439377 - DNA, 22 bp, Homo sapiens
atgcctggtcccacctctaggt

SEQ ID NO: 8439378 - DNA, 22 bp, Homo sapiens
atgccttattccaacaatctag

SEQ ID NO: 8439379 - DNA, 22 bp, Homo sapiens
atgccttattgtaatctttcca

SEQ ID NO: 8439380 - DNA, 22 bp, Homo sapiens
atgccttaaggcgagatactta

SEQ ID NO: 8439381 - DNA, 20 bp, Homo sapiens
atgcctttgatagtcaggct

SEQ ID NO: 8439382 - DNA, 22 bp, Homo sapiens
atgcctttctttggtgcaggtt

SEQ ID NO: 8439383 - DNA, 22 bp, Homo sapiens
atgcctttcccaacagggtggg

SEQ ID NO: 8439384 - DNA, 22 bp, Homo sapiens
atgcgagtgatgcagagtggct

SEQ ID NO: 8439385 - DNA, 22 bp, Homo sapiens
atgcctttttatcatggatgat

SEQ ID NO: 8439386 - DNA, 22 bp, Homo sapiens
agactggggttctggcaaggag

SEQ ID NO: 8439387 - DNA, 22 bp, Homo sapiens
atgatacattgcaaaattttaa

SEQ ID NO: 8439388 - DNA, 22 bp, Homo sapiens
atgatacatcttcatgtcagtg

SEQ ID NO: 8439389 - DNA, 22 bp, Homo sapiens
atgatacatcttcatgtcagtg

SEQ ID NO: 8439390 - DNA, 20 bp, Homo sapiens
agacagaatcagagataaag

SEQ ID NO: 8439391 - DNA, 20 bp, Homo sapiens
agacagaatcagagataaag

SEQ ID NO: 8439392 - DNA, 22 bp, Homo sapiens
agacagaatttgtcagataaat

SEQ ID NO: 8439393 - DNA, 22 bp, Homo sapiens
agacagaatttgtcagataaat

SEQ ID NO: 8439394 - DNA, 22 bp, Homo sapiens
agacagaatttgtcagataaat

SEQ ID NO: 8439395 - DNA, 22 bp, Homo sapiens
atgatatagagagtagattaaa

SEQ ID NO: 8439396 - DNA, 22 bp, Homo sapiens
atgcagggttctgggctagaga

SEQ ID NO: 8439397 - DNA, 17 bp, Homo sapiens
atgcaggtgtgaggggc

SEQ ID NO: 8439398 - DNA, 22 bp, Homo sapiens
atgccaaagcccaagttcatca

SEQ ID NO: 8439399 - DNA, 22 bp, Homo sapiens
atgccaaattctactttcagca

SEQ ID NO: 8439400 - DNA, 22 bp, Homo sapiens
atgcatttgtaaaatataatcg

SEQ ID NO: 8439401 - DNA, 22 bp, Homo sapiens
atgcatcaggcactaggaatag

SEQ ID NO: 8439402 - DNA, 22 bp, Homo sapiens
atgcatattgtcatttagtcct

SEQ ID NO: 8439403 - DNA, 22 bp, Homo sapiens
atgcatatgtacccatgttctg

SEQ ID NO: 8439404 - DNA, 22 bp, Homo sapiens
atgaaggctgtgtggagccccc

SEQ ID NO: 8439405 - DNA, 22 bp, Homo sapiens
atgaagggtgtccctgtgagca

SEQ ID NO: 8439406 - DNA, 22 bp, Homo sapiens
atgaagtctctttttcatgaga

SEQ ID NO: 8439407 - DNA, 22 bp, Homo sapiens
atgaagttctcaataatcatgt

SEQ ID NO: 8439408 - DNA, 22 bp, Homo sapiens
atgaagtctgccaaggaaaggc

SEQ ID NO: 8439409 - DNA, 22 bp, Homo sapiens
atgaacaatgactacatattga

SEQ ID NO: 8439410 - DNA, 22 bp, Homo sapiens
atctgctgttcttcacagcttg

SEQ ID NO: 8439411 - DNA, 22 bp, Homo sapiens
atctgctggcatctctagccca

SEQ ID NO: 8439412 - DNA, 22 bp, Homo sapiens
atctgctgcccagccacttgct

SEQ ID NO: 8439413 - DNA, 18 bp, Homo sapiens
atctgctggcaggtctgg

SEQ ID NO: 8439414 - DNA, 22 bp, Homo sapiens
atctgctgtcacatgtttgaag

SEQ ID NO: 8439415 - DNA, 22 bp, Homo sapiens
agacaactagaaaactagacag

SEQ ID NO: 8439416 - DNA, 22 bp, Homo sapiens
agacaagactaggcagttgttg

SEQ ID NO: 8439417 - DNA, 22 bp, Homo sapiens
agacaacatcactaaagctgag

SEQ ID NO: 8439418 - DNA, 22 bp, Homo sapiens
agacaaatttcctgcaatgaag

SEQ ID NO: 8439419 - DNA, 22 bp, Homo sapiens
agacaacatcactaaagctgag

SEQ ID NO: 8439420 - DNA, 22 bp, Homo sapiens
agacaactagaaaactagacag

SEQ ID NO: 8439421 - DNA, 22 bp, Homo sapiens
agacaactagaaaactagacag

SEQ ID NO: 8439422 - DNA, 22 bp, Homo sapiens
agacaagtgtggtgagagcagt

SEQ ID NO: 8439423 - DNA, 22 bp, Homo sapiens
agacacattttcagctctgcca

SEQ ID NO: 8439424 - DNA, 23 bp, Homo sapiens
agacactgtaaagaattgcagtt

SEQ ID NO: 8439425 - DNA, 22 bp, Homo sapiens
agacactgtgtacagaaaaaga

SEQ ID NO: 8439426 - DNA, 22 bp, Homo sapiens
agacactttcagaagtgtttgc

SEQ ID NO: 8439427 - DNA, 22 bp, Homo sapiens
agacagaaataggagaaaccag

SEQ ID NO: 8439428 - DNA, 22 bp, Homo sapiens
agacactgttctcacatgcttg

SEQ ID NO: 8439429 - DNA, 22 bp, Homo sapiens
agacactgttctcacatgcttg

SEQ ID NO: 8439430 - DNA, 22 bp, Homo sapiens
atgaggcacgtgttactggcct

SEQ ID NO: 8439431 - DNA, 22 bp, Homo sapiens
atgaggcacgtgttactggcct

SEQ ID NO: 8439432 - DNA, 22 bp, Homo sapiens
atgaggcacttaaaagtgaaga

SEQ ID NO: 8439433 - DNA, 22 bp, Homo sapiens
atgaggcagaaaaaagtcggag

SEQ ID NO: 8439434 - DNA, 22 bp, Homo sapiens
agaatcaaagagaaatactttg

SEQ ID NO: 8439435 - DNA, 22 bp, Homo sapiens
agaatcaattagattctatgag

SEQ ID NO: 8439436 - DNA, 22 bp, Homo sapiens
agaatcaactgaaaattggtga

SEQ ID NO: 8439437 - DNA, 22 bp, Homo sapiens
agaatcaaggtgaagcccacag

SEQ ID NO: 8439438 - DNA, 22 bp, Homo sapiens
atgagggaagctcacgtgtcca

SEQ ID NO: 8439439 - DNA, 22 bp, Homo sapiens
atgagggaggcaaggagatgct

SEQ ID NO: 8439440 - DNA, 22 bp, Homo sapiens
atgaggctctcaggggagctgt

SEQ ID NO: 8439441 - DNA, 22 bp, Homo sapiens
atgagggaggggtggtgccgca

SEQ ID NO: 8439442 - DNA, 22 bp, Homo sapiens
atgaggctatgaatggggagat

SEQ ID NO: 8439443 - DNA, 22 bp, Homo sapiens
atgaggctatttcatagatttt

SEQ ID NO: 8439444 - DNA, 22 bp, Homo sapiens
attacacagcggttactactag

SEQ ID NO: 8439445 - DNA, 22 bp, Homo sapiens
attacacagcggttactactag

SEQ ID NO: 8439446 - DNA, 23 bp, Homo sapiens
agaggcactaattattcagagat

SEQ ID NO: 8439447 - DNA, 22 bp, Homo sapiens
attacacatagacattcgttca

SEQ ID NO: 8439448 - DNA, 22 bp, Homo sapiens
attacacatagacattcgttca

SEQ ID NO: 8439449 - DNA, 22 bp, Homo sapiens
attacacaggctggctctttga

SEQ ID NO: 8439450 - DNA, 22 bp, Homo sapiens
attacacaggctggctctttga

SEQ ID NO: 8439451 - DNA, 22 bp, Homo sapiens
attacagaaatatggtcaaaga

SEQ ID NO: 8439452 - DNA, 22 bp, Homo sapiens
attacagaaatatggtcaaaga

SEQ ID NO: 8439453 - DNA, 22 bp, Homo sapiens
attacagaagatatgctcaaca

SEQ ID NO: 8439454 - DNA, 22 bp, Homo sapiens
attacagtaaatgctacaggca

SEQ ID NO: 8439455 - DNA, 23 bp, Homo sapiens
agaggcaggagtggcttgcccgg

SEQ ID NO: 8439456 - DNA, 22 bp, Homo sapiens
attacagtaacagctacaatgc

SEQ ID NO: 8439457 - DNA, 22 bp, Homo sapiens
attacagtaacagctacaatgc

SEQ ID NO: 8439458 - DNA, 19 bp, Homo sapiens
agaggcaagggtggaagta

SEQ ID NO: 8439459 - DNA, 19 bp, Homo sapiens
agaggcaagggtggaagta

SEQ ID NO: 8439460 - DNA, 22 bp, Homo sapiens
agaggcaagttcagagctagga

SEQ ID NO: 8439461 - DNA, 22 bp, Homo sapiens
agaggcaaggcaggattcttct

SEQ ID NO: 8439462 - DNA, 22 bp, Homo sapiens
agaggcaaggcaggattcttct

SEQ ID NO: 8439463 - DNA, 19 bp, Homo sapiens
agaggcaagggctcatgac

SEQ ID NO: 8439464 - DNA, 23 bp, Homo sapiens
agaggcacagcacttggctggcc

SEQ ID NO: 8439465 - DNA, 22 bp, Homo sapiens
agaggcaccatctggaacagcc

SEQ ID NO: 8439466 - DNA, 22 bp, Homo sapiens
agaggcaatgaaagcagtctct

SEQ ID NO: 8439467 - DNA, 22 bp, Homo sapiens
agaggcaatgaaagcagtctct

SEQ ID NO: 8439468 - DNA, 22 bp, Homo sapiens
agagctggctgtgggtgacttt

SEQ ID NO: 8439469 - DNA, 22 bp, Homo sapiens
agagctggctgtgggtgacttt

SEQ ID NO: 8439470 - DNA, 20 bp, Homo sapiens
agagctgggaagctccctat

SEQ ID NO: 8439471 - DNA, 22 bp, Homo sapiens
agaggcaagattatcagggcat

SEQ ID NO: 8439472 - DNA, 22 bp, Homo sapiens
agagctgggaccgtctggaagt

SEQ ID NO: 8439473 - DNA, 22 bp, Homo sapiens
agagctgggaccgtctggaagt

SEQ ID NO: 8439474 - DNA, 23 bp, Homo sapiens
agaggccagcctttggagacacc

SEQ ID NO: 8439475 - DNA, 23 bp, Homo sapiens
agaggccagcctttggagacacc

SEQ ID NO: 8439476 - DNA, 22 bp, Homo sapiens
agaggccagcagtgcctatctg

SEQ ID NO: 8439477 - DNA, 22 bp, Homo sapiens
agaggccagcccaggccaccga

SEQ ID NO: 8439478 - DNA, 22 bp, Homo sapiens
agaggccagatcatcatagatg

SEQ ID NO: 8439479 - DNA, 22 bp, Homo sapiens
agaggccagcactgcagggaag

SEQ ID NO: 8439480 - DNA, 22 bp, Homo sapiens
agaggccagcaaccacagtaaa

SEQ ID NO: 8439481 - DNA, 22 bp, Homo sapiens
agaggccagcactgcagggaag

SEQ ID NO: 8439482 - DNA, 22 bp, Homo sapiens
agaggccagcagtgcctatctg

SEQ ID NO: 8439483 - DNA, 22 bp, Homo sapiens
agaggccaccagaggtggtgcc

SEQ ID NO: 8439484 - DNA, 22 bp, Homo sapiens
agaggccaccttctcttgagaa

SEQ ID NO: 8439485 - DNA, 22 bp, Homo sapiens
agaggccaccttctcttgagaa

SEQ ID NO: 8439486 - DNA, 22 bp, Homo sapiens
agaggccaccactgtcagggac

SEQ ID NO: 8439487 - DNA, 22 bp, Homo sapiens
agaggccaccactgtcagggac

SEQ ID NO: 8439488 - DNA, 22 bp, Homo sapiens
agaggccagatcatcatagatg

SEQ ID NO: 8439489 - DNA, 22 bp, Homo sapiens
agaggccagaaggcgcaccccg

SEQ ID NO: 8439490 - DNA, 22 bp, Homo sapiens
agaggccagaaagtatgccacc

SEQ ID NO: 8439491 - DNA, 22 bp, Homo sapiens
agaggccactttgcctgtgatg

SEQ ID NO: 8439492 - DNA, 18 bp, Homo sapiens
agaggctggacaggggat

SEQ ID NO: 8439493 - DNA, 22 bp, Homo sapiens
agaggctgcacttgctcatgat

SEQ ID NO: 8439494 - DNA, 23 bp, Homo sapiens
agaggctgcagggtattgagaat

SEQ ID NO: 8439495 - DNA, 22 bp, Homo sapiens
agaggctccttcactctggcac

SEQ ID NO: 8439496 - DNA, 22 bp, Homo sapiens
agaggctgatggagtagtgtct

SEQ ID NO: 8439497 - DNA, 22 bp, Homo sapiens
agaggctgcacttgctcatgat

SEQ ID NO: 8439498 - DNA, 22 bp, Homo sapiens
agaggccaggctgcagagggat

SEQ ID NO: 8439499 - DNA, 23 bp, Homo sapiens
agaggccagcctttggagacacc

SEQ ID NO: 8439500 - DNA, 22 bp, Homo sapiens
agaggccaggcagcccaaggtg

SEQ ID NO: 8439501 - DNA, 22 bp, Homo sapiens
agaggccaggcagcccaaggtg

SEQ ID NO: 8439502 - DNA, 22 bp, Homo sapiens
agagtcagcttatgacacagtc

SEQ ID NO: 8439503 - DNA, 22 bp, Homo sapiens
agagtcagcttatgacacagtc

SEQ ID NO: 8439504 - DNA, 22 bp, Homo sapiens
agagtcagcttatgacacagtc

SEQ ID NO: 8439505 - DNA, 22 bp, Homo sapiens
agagtcagaaccaagatgaggc

SEQ ID NO: 8439506 - DNA, 22 bp, Homo sapiens
agagtcagaaagcagacagggg

SEQ ID NO: 8439507 - DNA, 22 bp, Homo sapiens
agagtcagaaagcagacagggg

SEQ ID NO: 8439508 - DNA, 22 bp, Homo sapiens
agagtcaagtagggcatgggct

SEQ ID NO: 8439509 - DNA, 19 bp, Homo sapiens
agagtattgaatttgccct

SEQ ID NO: 8439510 - DNA, 22 bp, Homo sapiens
agagtcaaaatttaccagaatg

SEQ ID NO: 8439511 - DNA, 22 bp, Homo sapiens
agagtactgctgctgggtactg

SEQ ID NO: 8439512 - DNA, 22 bp, Homo sapiens
agagtctgaggcagctgcagcc

SEQ ID NO: 8439513 - DNA, 21 bp, Homo sapiens
agagtctgagtgtgcaagggc

SEQ ID NO: 8439514 - DNA, 22 bp, Homo sapiens
agagtctgatatttgtaccaga

SEQ ID NO: 8439515 - DNA, 22 bp, Homo sapiens
agagtctgaggcagctgcagcc

SEQ ID NO: 8439516 - DNA, 22 bp, Homo sapiens
agagtctgaggaggaccaacag

SEQ ID NO: 8439517 - DNA, 22 bp, Homo sapiens
agagtctgaggaggaccaacag

SEQ ID NO: 8439518 - DNA, 22 bp, Homo sapiens
agagtctgaatgctcagagttg

SEQ ID NO: 8439519 - DNA, 23 bp, Homo sapiens
agagtgcagagatatgcttgtgt

SEQ ID NO: 8439520 - DNA, 22 bp, Homo sapiens
agagtgcagaggtcaaagaaca

SEQ ID NO: 8439521 - DNA, 22 bp, Homo sapiens
agagtgctcagatgcatgtctt

SEQ ID NO: 8439522 - DNA, 22 bp, Homo sapiens
agagtgctagcctgagggaggt

SEQ ID NO: 8439523 - DNA, 22 bp, Homo sapiens
agagtgctagcctgagggaggt

SEQ ID NO: 8439524 - DNA, 20 bp, Homo sapiens
agagtgctggactgaggagc

SEQ ID NO: 8439525 - DNA, 22 bp, Homo sapiens
agaggggaaggatgtgatgtga

SEQ ID NO: 8439526 - DNA, 22 bp, Homo sapiens
agaggggaaggatgtgatgtga

SEQ ID NO: 8439527 - DNA, 22 bp, Homo sapiens
agaggggaagtaatgaatgata

SEQ ID NO: 8439528 - DNA, 22 bp, Homo sapiens
agagggctggacgcaggttgga

SEQ ID NO: 8439529 - DNA, 22 bp, Homo sapiens
agaggctgggcaggacccacag

SEQ ID NO: 8439530 - DNA, 22 bp, Homo sapiens
agaggctgggcaggacccacag

SEQ ID NO: 8439531 - DNA, 22 bp, Homo sapiens
agaggctgggaagggtccccgg

SEQ ID NO: 8439532 - DNA, 22 bp, Homo sapiens
agaggggaggcgaaccagagtc

SEQ ID NO: 8439533 - DNA, 22 bp, Homo sapiens
agaggggaggcgaaccagagtc

SEQ ID NO: 8439534 - DNA, 22 bp, Homo sapiens
agaggggaggcgaaccagagtc

SEQ ID NO: 8439535 - DNA, 23 bp, Homo sapiens
agaggggagcatctgctggctga

SEQ ID NO: 8439536 - DNA, 23 bp, Homo sapiens
agaggggagcatctgctggctga

SEQ ID NO: 8439537 - DNA, 22 bp, Homo sapiens
agaggggagagctaagcaattc

SEQ ID NO: 8439538 - DNA, 23 bp, Homo sapiens
agaggggagcatctgctggctga

SEQ ID NO: 8439539 - DNA, 22 bp, Homo sapiens
agaggggagtcctaatctgatt

SEQ ID NO: 8439540 - DNA, 22 bp, Homo sapiens
agaggggcaagtaaagagtctt

SEQ ID NO: 8439541 - DNA, 22 bp, Homo sapiens
agaggtgacataggagaggctc

SEQ ID NO: 8439542 - DNA, 22 bp, Homo sapiens
agaggggctcaagcagtggtct

SEQ ID NO: 8439543 - DNA, 22 bp, Homo sapiens
agaggggcgggaactcaacctc

SEQ ID NO: 8439544 - DNA, 22 bp, Homo sapiens
agaggggcccggttctccgtct

SEQ ID NO: 8439545 - DNA, 22 bp, Homo sapiens
agatcaatgtgtcagaagagat

SEQ ID NO: 8439546 - DNA, 22 bp, Homo sapiens
agatcaaatctgggatttctaa

SEQ ID NO: 8439547 - DNA, 22 bp, Homo sapiens
agatcaaatctgggatttctaa

SEQ ID NO: 8439548 - DNA, 22 bp, Homo sapiens
agatattaatcgtacataaggt

SEQ ID NO: 8439549 - DNA, 22 bp, Homo sapiens
agatattaatcgtacataaggt

SEQ ID NO: 8439550 - DNA, 22 bp, Homo sapiens
agatattaggaggattcataat

SEQ ID NO: 8439551 - DNA, 22 bp, Homo sapiens
agatataataatttacaagtgt

SEQ ID NO: 8439552 - DNA, 22 bp, Homo sapiens
attggccatttgcatgtattat

SEQ ID NO: 8439553 - DNA, 22 bp, Homo sapiens
attggctccttctaacatgtct

SEQ ID NO: 8439554 - DNA, 22 bp, Homo sapiens
attggctttcttttgtgaaaat

SEQ ID NO: 8439555 - DNA, 22 bp, Homo sapiens
attggctttgatatctaaaggg

SEQ ID NO: 8439556 - DNA, 22 bp, Homo sapiens
agagtggcagcaagtcaggtag

SEQ ID NO: 8439557 - DNA, 22 bp, Homo sapiens
agagtggcagcaaaaagtgtgc

SEQ ID NO: 8439558 - DNA, 22 bp, Homo sapiens
agagtggcagcaaaaagtgtgc

SEQ ID NO: 8439559 - DNA, 21 bp, Homo sapiens
agagtggcaaagtgtccaaga

SEQ ID NO: 8439560 - DNA, 21 bp, Homo sapiens
agagtggcaaagtgtccaaga

SEQ ID NO: 8439561 - DNA, 22 bp, Homo sapiens
attggtctaaagttaagaagat

SEQ ID NO: 8439562 - DNA, 22 bp, Homo sapiens
attggtctccacttgttttaga

SEQ ID NO: 8439563 - DNA, 22 bp, Homo sapiens
attggtctaggctttaaaaaga

SEQ ID NO: 8439564 - DNA, 22 bp, Homo sapiens
attggtctctgctaaagggagg

SEQ ID NO: 8439565 - DNA, 22 bp, Homo sapiens
attggtctctagagtctattgt

SEQ ID NO: 8439566 - DNA, 22 bp, Homo sapiens
attggtctggggaaatgaagag

SEQ ID NO: 8439567 - DNA, 22 bp, Homo sapiens
attggtatgtattctgaaaact

SEQ ID NO: 8439568 - DNA, 22 bp, Homo sapiens
agatggctttgcttttagaagc

SEQ ID NO: 8439569 - DNA, 22 bp, Homo sapiens
agatggcttccttctcactgtg

SEQ ID NO: 8439570 - DNA, 22 bp, Homo sapiens
agatgggccttcgagcatgccc

SEQ ID NO: 8439571 - DNA, 22 bp, Homo sapiens
agatggctgggagctctgtttg

SEQ ID NO: 8439572 - DNA, 22 bp, Homo sapiens
agatggctgggagctctgtttg

SEQ ID NO: 8439573 - DNA, 22 bp, Homo sapiens
agatggctgattaactccatgg

SEQ ID NO: 8439574 - DNA, 22 bp, Homo sapiens
agatggctgggccccaccccag

SEQ ID NO: 8439575 - DNA, 20 bp, Homo sapiens
agatggctgtcatttctgtc

SEQ ID NO: 8439576 - DNA, 21 bp, Homo sapiens
agatggctcccaggtctctgg

SEQ ID NO: 8439577 - DNA, 22 bp, Homo sapiens
agatggctatagatagcctttc

SEQ ID NO: 8439578 - DNA, 22 bp, Homo sapiens
agatggcaggccctgtgggggt

SEQ ID NO: 8439579 - DNA, 22 bp, Homo sapiens
agatggccccaggtgcccaggg

SEQ ID NO: 8439580 - DNA, 17 bp, Homo sapiens
agatggcaggaggcaga

SEQ ID NO: 8439581 - DNA, 22 bp, Homo sapiens
agatcagacacggcttgtgacg

SEQ ID NO: 8439582 - DNA, 22 bp, Homo sapiens
agatcagaaatgtaatggcagt

SEQ ID NO: 8439583 - DNA, 22 bp, Homo sapiens
agatcatagcacaaaagtgaca

SEQ ID NO: 8439584 - DNA, 22 bp, Homo sapiens
agatcagattctgcctttgtga

SEQ ID NO: 8439585 - DNA, 22 bp, Homo sapiens
agatcatatgaaaaatttcaag

SEQ ID NO: 8439586 - DNA, 22 bp, Homo sapiens
agatcatatgcagtaatgaact

SEQ ID NO: 8439587 - DNA, 22 bp, Homo sapiens
agatccactatggtgctgatga

SEQ ID NO: 8439588 - DNA, 22 bp, Homo sapiens
agatgattatgatagcactgtt

SEQ ID NO: 8439589 - DNA, 22 bp, Homo sapiens
agatgctgggaggctgagtgca

SEQ ID NO: 8439590 - DNA, 22 bp, Homo sapiens
agatgctggggcccctcggatg

SEQ ID NO: 8439591 - DNA, 22 bp, Homo sapiens
agcaacagtgtatatcataggc

SEQ ID NO: 8439592 - DNA, 22 bp, Homo sapiens
agcaacattgagactgcagttg

SEQ ID NO: 8439593 - DNA, 22 bp, Homo sapiens
agcaacaggtttattatcttat

SEQ ID NO: 8439594 - DNA, 23 bp, Homo sapiens
agcaacagtgggtgagtgttgct

SEQ ID NO: 8439595 - DNA, 22 bp, Homo sapiens
agcaacagggtggtcttcagaa

SEQ ID NO: 8439596 - DNA, 18 bp, Homo sapiens
agcaacaggatcccaggg

SEQ ID NO: 8439597 - DNA, 22 bp, Homo sapiens
agcaacaggaccatggagccca

SEQ ID NO: 8439598 - DNA, 22 bp, Homo sapiens
agcaacaggcataatgtgttga

SEQ ID NO: 8439599 - DNA, 22 bp, Homo sapiens
agcaacagggggatggccactg

SEQ ID NO: 8439600 - DNA, 22 bp, Homo sapiens
agcaactttattccactgggca

SEQ ID NO: 8439601 - DNA, 22 bp, Homo sapiens
agcaagaagggcaaggaagttt

SEQ ID NO: 8439602 - DNA, 20 bp, Homo sapiens
agcaagagtaaggacagcga

SEQ ID NO: 8439603 - DNA, 22 bp, Homo sapiens
caaagcaaggctcagtttgaac

SEQ ID NO: 8439604 - DNA, 22 bp, Homo sapiens
caaagcaagggctgaagactcc

SEQ ID NO: 8439605 - DNA, 22 bp, Homo sapiens
caaagcaagggctgaagactcc

SEQ ID NO: 8439606 - DNA, 22 bp, Homo sapiens
caaagcaagggctgaagactcc

SEQ ID NO: 8439607 - DNA, 22 bp, Homo sapiens
caaagcaagggctgaagactcc

SEQ ID NO: 8439608 - DNA, 22 bp, Homo sapiens
caaagcagaaggttctgtggta

SEQ ID NO: 8439609 - DNA, 22 bp, Homo sapiens
caaagcagacctttacccttta

SEQ ID NO: 8439610 - DNA, 22 bp, Homo sapiens
caaagataatcacagaataccc

SEQ ID NO: 8439611 - DNA, 22 bp, Homo sapiens
caaagataatcacagaataccc

SEQ ID NO: 8439612 - DNA, 20 bp, Homo sapiens
agcaagagtaaggacagcga

SEQ ID NO: 8439613 - DNA, 22 bp, Homo sapiens
caaagatatgacatggaaaatg

SEQ ID NO: 8439614 - DNA, 22 bp, Homo sapiens
attttcaccctgaatatattga

SEQ ID NO: 8439615 - DNA, 22 bp, Homo sapiens
attttcagaacattcattcact

SEQ ID NO: 8439616 - DNA, 22 bp, Homo sapiens
agatgtggccggctagggagag

SEQ ID NO: 8439617 - DNA, 22 bp, Homo sapiens
agatgtggatcctagggtagaa

SEQ ID NO: 8439618 - DNA, 22 bp, Homo sapiens
agatgtggccggctagggagag

SEQ ID NO: 8439619 - DNA, 22 bp, Homo sapiens
agatgtggcctttgggagatta

SEQ ID NO: 8439620 - DNA, 22 bp, Homo sapiens
attttagatttaagaataaggt

SEQ ID NO: 8439621 - DNA, 22 bp, Homo sapiens
agcaacagcaggtttgcactcc

SEQ ID NO: 8439622 - DNA, 22 bp, Homo sapiens
agcaacagcaacgacatttctc

SEQ ID NO: 8439623 - DNA, 22 bp, Homo sapiens
agcaacagcaggtttgcactcc

SEQ ID NO: 8439624 - DNA, 22 bp, Homo sapiens
agcaacagaagatagagtgaat

SEQ ID NO: 8439625 - DNA, 22 bp, Homo sapiens
agcaacaggaatattatggcaa

SEQ ID NO: 8439626 - DNA, 22 bp, Homo sapiens
agcaacagccctgtttcattag

SEQ ID NO: 8439627 - DNA, 22 bp, Homo sapiens
agcaacagccctgaggttcatg

SEQ ID NO: 8439628 - DNA, 22 bp, Homo sapiens
agcaacaggaaatagctgatta

SEQ ID NO: 8439629 - DNA, 18 bp, Homo sapiens
agcaacagaaacatatgg

SEQ ID NO: 8439630 - DNA, 22 bp, Homo sapiens
agatgttatcattcagagtagc

SEQ ID NO: 8439631 - DNA, 22 bp, Homo sapiens
agatgtgtttctagttcctgca

SEQ ID NO: 8439632 - DNA, 22 bp, Homo sapiens
agatgtttaaaaagatgactct

SEQ ID NO: 8439633 - DNA, 22 bp, Homo sapiens
acccagagaactgtgccttgag

SEQ ID NO: 8439634 - DNA, 22 bp, Homo sapiens
acccacgaagatgagcggcatg

SEQ ID NO: 8439635 - DNA, 19 bp, Homo sapiens
agggcctgagcagatgttg

SEQ ID NO: 8439636 - DNA, 22 bp, Homo sapiens
acccaccctactagcagtgtcc

SEQ ID NO: 8439637 - DNA, 22 bp, Homo sapiens
agggcctctgagccagttctgg

SEQ ID NO: 8439638 - DNA, 21 bp, Homo sapiens
agggcctctgtgtactggggg

SEQ ID NO: 8439639 - DNA, 23 bp, Homo sapiens
agggcctctgtcccccagcactc

SEQ ID NO: 8439640 - DNA, 22 bp, Homo sapiens
agggcctctggaacactgaggg

SEQ ID NO: 8439641 - DNA, 22 bp, Homo sapiens
agggcctgagaccgtggcttga

SEQ ID NO: 8439642 - DNA, 22 bp, Homo sapiens
agggcctgacacccttgccagc

SEQ ID NO: 8439643 - DNA, 19 bp, Homo sapiens
acccagggttgatgtccag

SEQ ID NO: 8439644 - DNA, 22 bp, Homo sapiens
acccagggtcaccccgtagggt

SEQ ID NO: 8439645 - DNA, 22 bp, Homo sapiens
acccagggttcctgggtcccag

SEQ ID NO: 8439646 - DNA, 22 bp, Homo sapiens
acccagggtttgagctctgcag

SEQ ID NO: 8439647 - DNA, 22 bp, Homo sapiens
acccatacacacatatttatgt

SEQ ID NO: 8439648 - DNA, 22 bp, Homo sapiens
acccagggtagagtgcagtggc

SEQ ID NO: 8439649 - DNA, 22 bp, Homo sapiens
acccagggtagagtgcagtggc

SEQ ID NO: 8439650 - DNA, 22 bp, Homo sapiens
acccagggaccccgctgacgcc

SEQ ID NO: 8439651 - DNA, 22 bp, Homo sapiens
acccagagatggacctggctgc

SEQ ID NO: 8439652 - DNA, 22 bp, Homo sapiens
acccagagactagcacggtaca

SEQ ID NO: 8439653 - DNA, 22 bp, Homo sapiens
acccagagaactgtgccttgag

SEQ ID NO: 8439654 - DNA, 22 bp, Homo sapiens
acccagagcacagatgcaacgt

SEQ ID NO: 8439655 - DNA, 22 bp, Homo sapiens
acccagagcagagcttggcttc

SEQ ID NO: 8439656 - DNA, 22 bp, Homo sapiens
acccaggctggcgtgcagtggc

SEQ ID NO: 8439657 - DNA, 22 bp, Homo sapiens
accccagaggcggaggctgcag

SEQ ID NO: 8439658 - DNA, 22 bp, Homo sapiens
accccagcgcatatggtctgcg

SEQ ID NO: 8439659 - DNA, 18 bp, Homo sapiens
accctctggcttctgagc

SEQ ID NO: 8439660 - DNA, 22 bp, Homo sapiens
accctctgccttgagcagtgcc

SEQ ID NO: 8439661 - DNA, 22 bp, Homo sapiens
accctggactggggctgaggct

SEQ ID NO: 8439662 - DNA, 22 bp, Homo sapiens
acccatgagtgtatctttaaaa

SEQ ID NO: 8439663 - DNA, 23 bp, Homo sapiens
acccatctctcctgtcatgcaga

SEQ ID NO: 8439664 - DNA, 22 bp, Homo sapiens
acccattcctttacttcatctg

SEQ ID NO: 8439665 - DNA, 22 bp, Homo sapiens
acccatttttaaatataacttg

SEQ ID NO: 8439666 - DNA, 22 bp, Homo sapiens
accccaaaagagtaatagaatt

SEQ ID NO: 8439667 - DNA, 22 bp, Homo sapiens
accccaagacagtagaagagaa

SEQ ID NO: 8439668 - DNA, 22 bp, Homo sapiens
accctggggtcacccttctctg

SEQ ID NO: 8439669 - DNA, 22 bp, Homo sapiens
accctgggcttggcctgctcag

SEQ ID NO: 8439670 - DNA, 22 bp, Homo sapiens
accctgggggtggccagtgcca

SEQ ID NO: 8439671 - DNA, 22 bp, Homo sapiens
accctgggtatttcccaaactt

SEQ ID NO: 8439672 - DNA, 16 bp, Homo sapiens
accctgggtagtcctg

SEQ ID NO: 8439673 - DNA, 22 bp, Homo sapiens
accctgggtcatatacagtgtg

SEQ ID NO: 8439674 - DNA, 22 bp, Homo sapiens
accctgggttcccgcagcacca

SEQ ID NO: 8439675 - DNA, 22 bp, Homo sapiens
accctgggtctcaatcatccta

SEQ ID NO: 8439676 - DNA, 22 bp, Homo sapiens
accctgggtgagaggcaaacag

SEQ ID NO: 8439677 - DNA, 22 bp, Homo sapiens
accctgggtgagaggcaaacag

SEQ ID NO: 8439678 - DNA, 21 bp, Homo sapiens
accctgggttctccataccct

SEQ ID NO: 8439679 - DNA, 22 bp, Homo sapiens
accctggcctggttcatgtgat

SEQ ID NO: 8439680 - DNA, 22 bp, Homo sapiens
accctggagcaataatccctgg

SEQ ID NO: 8439681 - DNA, 22 bp, Homo sapiens
accctggagcttttctggccct

SEQ ID NO: 8439682 - DNA, 22 bp, Homo sapiens
accctgggagggagaaatcaga

SEQ ID NO: 8439683 - DNA, 22 bp, Homo sapiens
accctgggacttccgagttgag

SEQ ID NO: 8439684 - DNA, 22 bp, Homo sapiens
accctgggaactggaaactgga

SEQ ID NO: 8439685 - DNA, 22 bp, Homo sapiens
accctgggacctggaggtggat

SEQ ID NO: 8439686 - DNA, 22 bp, Homo sapiens
accctgggaactggaaactgga

SEQ ID NO: 8439687 - DNA, 23 bp, Homo sapiens
accctgggcaagtcacctaacct

SEQ ID NO: 8439688 - DNA, 22 bp, Homo sapiens
accctgggagggagaaatcaga

SEQ ID NO: 8439689 - DNA, 18 bp, Homo sapiens
accctgggcaattcactc

SEQ ID NO: 8439690 - DNA, 22 bp, Homo sapiens
accctgggcttggcctgctcag

SEQ ID NO: 8439691 - DNA, 22 bp, Homo sapiens
accctgggcacaccatttcccc

SEQ ID NO: 8439692 - DNA, 22 bp, Homo sapiens
agggcctctaccatccaaggtt

SEQ ID NO: 8439693 - DNA, 22 bp, Homo sapiens
agggcctcgaaggcagagggat

SEQ ID NO: 8439694 - DNA, 21 bp, Homo sapiens
accagtttggggggcttcctg

SEQ ID NO: 8439695 - DNA, 22 bp, Homo sapiens
accagtttgtaacctgttttca

SEQ ID NO: 8439696 - DNA, 22 bp, Homo sapiens
accagtttatagcgatctgtca

SEQ ID NO: 8439697 - DNA, 22 bp, Homo sapiens
accagtttctgggggaggttgg

SEQ ID NO: 8439698 - DNA, 22 bp, Homo sapiens
accagttattagccctacaact

SEQ ID NO: 8439699 - DNA, 20 bp, Homo sapiens
accataatgttaattacaaa

SEQ ID NO: 8439700 - DNA, 22 bp, Homo sapiens
accatagactggaggatctcct

SEQ ID NO: 8439701 - DNA, 22 bp, Homo sapiens
accatataacaagtttaggaga

SEQ ID NO: 8439702 - DNA, 22 bp, Homo sapiens
accatacattaaatgactttca

SEQ ID NO: 8439703 - DNA, 22 bp, Homo sapiens
accagtaggagttggagaggaa

SEQ ID NO: 8439704 - DNA, 22 bp, Homo sapiens
accagtgtcttattgaccatct

SEQ ID NO: 8439705 - DNA, 22 bp, Homo sapiens
accaggagtaacagtgagtggt

SEQ ID NO: 8439706 - DNA, 22 bp, Homo sapiens
accaggagggaccctggtggcc

SEQ ID NO: 8439707 - DNA, 22 bp, Homo sapiens
accaggagggaccctggtggcc

SEQ ID NO: 8439708 - DNA, 19 bp, Homo sapiens
accaggagtatcagagctg

SEQ ID NO: 8439709 - DNA, 22 bp, Homo sapiens
accaggctgttgggcccagtgt

SEQ ID NO: 8439710 - DNA, 22 bp, Homo sapiens
accaggctgttgggcccagtgt

SEQ ID NO: 8439711 - DNA, 22 bp, Homo sapiens
accagggccgcgggcgactagc

SEQ ID NO: 8439712 - DNA, 22 bp, Homo sapiens
accaagtgagtacttggcagaa

SEQ ID NO: 8439713 - DNA, 22 bp, Homo sapiens
accaatctcctattttgtttca

SEQ ID NO: 8439714 - DNA, 22 bp, Homo sapiens
accaattttagagcaccaagaa

SEQ ID NO: 8439715 - DNA, 22 bp, Homo sapiens
accaatttcttggcttccaaat

SEQ ID NO: 8439716 - DNA, 20 bp, Homo sapiens
accaatttcagaggtgcaga

SEQ ID NO: 8439717 - DNA, 22 bp, Homo sapiens
accaatttttacagctgtggtt

SEQ ID NO: 8439718 - DNA, 22 bp, Homo sapiens
accacagctttgcaccaggtgt

SEQ ID NO: 8439719 - DNA, 22 bp, Homo sapiens
accacaggaattgctctgtggt

SEQ ID NO: 8439720 - DNA, 22 bp, Homo sapiens
accagctctttcttttcactat

SEQ ID NO: 8439721 - DNA, 22 bp, Homo sapiens
accacaggaattgctctgtggt

SEQ ID NO: 8439722 - DNA, 22 bp, Homo sapiens
accaaccagggacttggctccc

SEQ ID NO: 8439723 - DNA, 23 bp, Homo sapiens
accaacaagcctctggagagtgg

SEQ ID NO: 8439724 - DNA, 23 bp, Homo sapiens
aggcttcctatcttagagctggg

SEQ ID NO: 8439725 - DNA, 23 bp, Homo sapiens
aggcttcctatcttagagctggg

SEQ ID NO: 8439726 - DNA, 22 bp, Homo sapiens
aggcttcctcgtgccttagata

SEQ ID NO: 8439727 - DNA, 22 bp, Homo sapiens
accaggaggctacactgtccca

SEQ ID NO: 8439728 - DNA, 22 bp, Homo sapiens
accaggaggaagtgttaatgat

SEQ ID NO: 8439729 - DNA, 22 bp, Homo sapiens
accaggagccatagagtcaggc

SEQ ID NO: 8439730 - DNA, 20 bp, Homo sapiens
accaggagatggaggcaggg

SEQ ID NO: 8439731 - DNA, 20 bp, Homo sapiens
accaggagatggaggcaggg

SEQ ID NO: 8439732 - DNA, 22 bp, Homo sapiens
accaggagccacaggaggagcc

SEQ ID NO: 8439733 - DNA, 22 bp, Homo sapiens
accaggagccacaggaggagcc

SEQ ID NO: 8439734 - DNA, 19 bp, Homo sapiens
accaggagacagtgagctt

SEQ ID NO: 8439735 - DNA, 22 bp, Homo sapiens
accaggagaggcacttgcaatg

SEQ ID NO: 8439736 - DNA, 22 bp, Homo sapiens
accaggactttgtattcagctt

SEQ ID NO: 8439737 - DNA, 22 bp, Homo sapiens
accaggacttcattaggttctt

SEQ ID NO: 8439738 - DNA, 22 bp, Homo sapiens
accaggacattttagtcatctt

SEQ ID NO: 8439739 - DNA, 22 bp, Homo sapiens
accaggaagctgtgagaccttt

SEQ ID NO: 8439740 - DNA, 22 bp, Homo sapiens
accaggaagcatccctttgtaa

SEQ ID NO: 8439741 - DNA, 18 bp, Homo sapiens
accaggaagcttcttgtc

SEQ ID NO: 8439742 - DNA, 22 bp, Homo sapiens
accaggaatattttgctcattt

SEQ ID NO: 8439743 - DNA, 19 bp, Homo sapiens
accaggaacttccctaggc

SEQ ID NO: 8439744 - DNA, 22 bp, Homo sapiens
accaggaactcacccgcagagg

SEQ ID NO: 8439745 - DNA, 22 bp, Homo sapiens
acattcaagatgcattcactta

SEQ ID NO: 8439746 - DNA, 22 bp, Homo sapiens
aggccctgcattgtactgaggg

SEQ ID NO: 8439747 - DNA, 22 bp, Homo sapiens
aggccctgcattgtactgaggg

SEQ ID NO: 8439748 - DNA, 22 bp, Homo sapiens
acattcaagtttctgctcatgg

SEQ ID NO: 8439749 - DNA, 22 bp, Homo sapiens
acattcatgtcccacttctagc

SEQ ID NO: 8439750 - DNA, 22 bp, Homo sapiens
acattcattccaggtcagtcag

SEQ ID NO: 8439751 - DNA, 22 bp, Homo sapiens
acattcatgggttttacattat

SEQ ID NO: 8439752 - DNA, 22 bp, Homo sapiens
acattcatgcaccttcctatcc

SEQ ID NO: 8439753 - DNA, 22 bp, Homo sapiens
acattcccttggcttgaagcag

SEQ ID NO: 8439754 - DNA, 22 bp, Homo sapiens
acattcccaccaacagtgtaaa

SEQ ID NO: 8439755 - DNA, 19 bp, Homo sapiens
acattcccatcagcaatgt

SEQ ID NO: 8439756 - DNA, 22 bp, Homo sapiens
acattccaaaaactagcagata

SEQ ID NO: 8439757 - DNA, 22 bp, Homo sapiens
acattctttcgatgtctgattt

SEQ ID NO: 8439758 - DNA, 22 bp, Homo sapiens
acattctttgagttttgttaaa

SEQ ID NO: 8439759 - DNA, 22 bp, Homo sapiens
acattctttgagttttgttaaa

SEQ ID NO: 8439760 - DNA, 22 bp, Homo sapiens
acattctatagcaagctgatct

SEQ ID NO: 8439761 - DNA, 22 bp, Homo sapiens
acattctagatatgttatattt

SEQ ID NO: 8439762 - DNA, 22 bp, Homo sapiens
acattctatgaagataatttta

SEQ ID NO: 8439763 - DNA, 22 bp, Homo sapiens
aggctgtgcaattagggtaaga

SEQ ID NO: 8439764 - DNA, 18 bp, Homo sapiens
aggcttcccaggcaggcc

SEQ ID NO: 8439765 - DNA, 23 bp, Homo sapiens
aggcttcctatcttagagctggg

SEQ ID NO: 8439766 - DNA, 23 bp, Homo sapiens
aggcttcctatcttagagctggg

SEQ ID NO: 8439767 - DNA, 22 bp, Homo sapiens
aggcttcccaagcagctgcaaa

SEQ ID NO: 8439768 - DNA, 22 bp, Homo sapiens
aggcttcccagctgagctcagc

SEQ ID NO: 8439769 - DNA, 22 bp, Homo sapiens
aggcttcccagctgagctcagc

SEQ ID NO: 8439770 - DNA, 22 bp, Homo sapiens
aggcttcagtagggagcatgtc

SEQ ID NO: 8439771 - DNA, 22 bp, Homo sapiens
acattgaaagcatattatctcc

SEQ ID NO: 8439772 - DNA, 22 bp, Homo sapiens
acattgaagctgtgaaatcaaa

SEQ ID NO: 8439773 - DNA, 22 bp, Homo sapiens
acattgaattcaaaattactga

SEQ ID NO: 8439774 - DNA, 22 bp, Homo sapiens
acattgaattcaaaattactga

SEQ ID NO: 8439775 - DNA, 22 bp, Homo sapiens
aggctccacggtcactggctct

SEQ ID NO: 8439776 - DNA, 19 bp, Homo sapiens
acattgaattttcttcttt

SEQ ID NO: 8439777 - DNA, 22 bp, Homo sapiens
aggctccagccaatgggtctgt

SEQ ID NO: 8439778 - DNA, 22 bp, Homo sapiens
aggctccagcccaaggctgcag

SEQ ID NO: 8439779 - DNA, 22 bp, Homo sapiens
aggcagtgttcttctaagggca

SEQ ID NO: 8439780 - DNA, 22 bp, Homo sapiens
acatacatgtaaaggaaattat

SEQ ID NO: 8439781 - DNA, 22 bp, Homo sapiens
acatacatgggattaaaaaatt

SEQ ID NO: 8439782 - DNA, 20 bp, Homo sapiens
aggcatgggatgcccagatt

SEQ ID NO: 8439783 - DNA, 20 bp, Homo sapiens
aggcatgggatgcccagatt

SEQ ID NO: 8439784 - DNA, 22 bp, Homo sapiens
aggcatggggctgcagtcaggt

SEQ ID NO: 8439785 - DNA, 22 bp, Homo sapiens
aggcatggggctgcagtcaggt

SEQ ID NO: 8439786 - DNA, 19 bp, Homo sapiens
aggcatgggaagagaagtc

SEQ ID NO: 8439787 - DNA, 22 bp, Homo sapiens
aggccacagcctgggaggtgac

SEQ ID NO: 8439788 - DNA, 22 bp, Homo sapiens
aggccacaggtggaagccagag

SEQ ID NO: 8439789 - DNA, 22 bp, Homo sapiens
aggccagcacgacagccgcagg

SEQ ID NO: 8439790 - DNA, 22 bp, Homo sapiens
aggccagcaccagagtcaagaa

SEQ ID NO: 8439791 - DNA, 22 bp, Homo sapiens
aggccagcaccagagtcaagaa

SEQ ID NO: 8439792 - DNA, 18 bp, Homo sapiens
aggcatggtggtgcgcac

SEQ ID NO: 8439793 - DNA, 17 bp, Homo sapiens
aggcatggtctggggtg

SEQ ID NO: 8439794 - DNA, 17 bp, Homo sapiens
aggcatggtctggggtg

SEQ ID NO: 8439795 - DNA, 22 bp, Homo sapiens
aggcatgggtagaagagaagcc

SEQ ID NO: 8439796 - DNA, 18 bp, Homo sapiens
aggccacactccagaaca

SEQ ID NO: 8439797 - DNA, 22 bp, Homo sapiens
aggccacacaactcttagagat

SEQ ID NO: 8439798 - DNA, 22 bp, Homo sapiens
aggccacagagagtgcatgtgc

SEQ ID NO: 8439799 - DNA, 22 bp, Homo sapiens
acatgaaactgttgcattagaa

SEQ ID NO: 8439800 - DNA, 20 bp, Homo sapiens
acatgaaaggaaacaggaaa

SEQ ID NO: 8439801 - DNA, 22 bp, Homo sapiens
acatgaaacctgagtctaactc

SEQ ID NO: 8439802 - DNA, 22 bp, Homo sapiens
aggcccagctgggccaggaaca

SEQ ID NO: 8439803 - DNA, 22 bp, Homo sapiens
aggcccagcttgaagtgggaag

SEQ ID NO: 8439804 - DNA, 22 bp, Homo sapiens
aggcccagcttgaagtgggaag

SEQ ID NO: 8439805 - DNA, 22 bp, Homo sapiens
aggcccagcttgaagtgggaag

SEQ ID NO: 8439806 - DNA, 21 bp, Homo sapiens
aggcccagctttcctcttgct

SEQ ID NO: 8439807 - DNA, 21 bp, Homo sapiens
aggcccagctttcctcttgct

SEQ ID NO: 8439808 - DNA, 21 bp, Homo sapiens
aggcccaggaatatgcatttt

SEQ ID NO: 8439809 - DNA, 22 bp, Homo sapiens
aggcccagggctgctctctgaa

SEQ ID NO: 8439810 - DNA, 22 bp, Homo sapiens
aggcccagggctgctctctgaa

SEQ ID NO: 8439811 - DNA, 22 bp, Homo sapiens
aggcccagggctgctctctgaa

SEQ ID NO: 8439812 - DNA, 23 bp, Homo sapiens
aggcccaggtatgtttgttttgg

SEQ ID NO: 8439813 - DNA, 22 bp, Homo sapiens
aggccctgagaaaatccctgca

SEQ ID NO: 8439814 - DNA, 22 bp, Homo sapiens
aggccctgagaaaatccctgca

SEQ ID NO: 8439815 - DNA, 22 bp, Homo sapiens
aggccctgagaaaatccctgca

SEQ ID NO: 8439816 - DNA, 22 bp, Homo sapiens
acatctttgctcttatagagct

SEQ ID NO: 8439817 - DNA, 22 bp, Homo sapiens
acatcttttactctggttcggg

SEQ ID NO: 8439818 - DNA, 22 bp, Homo sapiens
acatctttgtttcttagtgtat

SEQ ID NO: 8439819 - DNA, 22 bp, Homo sapiens
acatctttttggaaacggctga

SEQ ID NO: 8439820 - DNA, 22 bp, Homo sapiens
acatctttgctcttatagagct

SEQ ID NO: 8439821 - DNA, 22 bp, Homo sapiens
aggccagcctcaggcagggacc

SEQ ID NO: 8439822 - DNA, 22 bp, Homo sapiens
acatcttttttctctaattgtg

SEQ ID NO: 8439823 - DNA, 22 bp, Homo sapiens
acatgaaaactggttccttcag

SEQ ID NO: 8439824 - DNA, 22 bp, Homo sapiens
aggccagcagcatgacggcatc

SEQ ID NO: 8439825 - DNA, 22 bp, Homo sapiens
aggccagcattctctctccagg

SEQ ID NO: 8439826 - DNA, 22 bp, Homo sapiens
aggccagcattctctctccagg

SEQ ID NO: 8439827 - DNA, 22 bp, Homo sapiens
aggccagcattctctctccagg

SEQ ID NO: 8439828 - DNA, 21 bp, Homo sapiens
agctggctctctctggagaga

SEQ ID NO: 8439829 - DNA, 22 bp, Homo sapiens
agctgggagctgaaggctgatt

SEQ ID NO: 8439830 - DNA, 22 bp, Homo sapiens
agctgtgggagaatctctgggt

SEQ ID NO: 8439831 - DNA, 22 bp, Homo sapiens
agctgtgggatttgggtgtgcc

SEQ ID NO: 8439832 - DNA, 22 bp, Homo sapiens
agctgggcaaaatgtgaggttg

SEQ ID NO: 8439833 - DNA, 22 bp, Homo sapiens
agctgggatgaggagcatcctt

SEQ ID NO: 8439834 - DNA, 22 bp, Homo sapiens
agctgtgtagggaatcagagaa

SEQ ID NO: 8439835 - DNA, 22 bp, Homo sapiens
agcttatcttgttagtttcatt

SEQ ID NO: 8439836 - DNA, 22 bp, Homo sapiens
agcttcagcttgcagctgtgat

SEQ ID NO: 8439837 - DNA, 22 bp, Homo sapiens
agcttcaggaacaggcagcctg

SEQ ID NO: 8439838 - DNA, 22 bp, Homo sapiens
agctgtggggaggaggctagca

SEQ ID NO: 8439839 - DNA, 22 bp, Homo sapiens
agctgtgggcctgggagagctg

SEQ ID NO: 8439840 - DNA, 22 bp, Homo sapiens
agctgtgggcctgggagagctg

SEQ ID NO: 8439841 - DNA, 22 bp, Homo sapiens
agctgtggggcaggcagcgagg

SEQ ID NO: 8439842 - DNA, 22 bp, Homo sapiens
agctgtggggcaggcagcgagg

SEQ ID NO: 8439843 - DNA, 19 bp, Homo sapiens
agctgtggggcctagcacc

SEQ ID NO: 8439844 - DNA, 22 bp, Homo sapiens
agctgtggttagatagagtcct

SEQ ID NO: 8439845 - DNA, 22 bp, Homo sapiens
agctgtggttctgggcagcgac

SEQ ID NO: 8439846 - DNA, 22 bp, Homo sapiens
agctgtggttctgggcagcgac

SEQ ID NO: 8439847 - DNA, 22 bp, Homo sapiens
agctgtgtaagtcatgtaggtg

SEQ ID NO: 8439848 - DNA, 22 bp, Homo sapiens
agctttgtgactttgagctagt

SEQ ID NO: 8439849 - DNA, 22 bp, Homo sapiens
agctttgtggctttgcaagact

SEQ ID NO: 8439850 - DNA, 23 bp, Homo sapiens
agctttgtgaaagcagacatggg

SEQ ID NO: 8439851 - DNA, 20 bp, Homo sapiens
agcttcattatagcccacag

SEQ ID NO: 8439852 - DNA, 19 bp, Homo sapiens
agcttttactaacagcaga

SEQ ID NO: 8439853 - DNA, 19 bp, Homo sapiens
agcttttactaacagcaga

SEQ ID NO: 8439854 - DNA, 22 bp, Homo sapiens
aggaaaaacctgttaatggtag

SEQ ID NO: 8439855 - DNA, 22 bp, Homo sapiens
aggaaaaagagttgctgccttc

SEQ ID NO: 8439856 - DNA, 22 bp, Homo sapiens
aggaaaaaagtctgtgattata

SEQ ID NO: 8439857 - DNA, 22 bp, Homo sapiens
aggaaaaacctgttaatggtag

SEQ ID NO: 8439858 - DNA, 22 bp, Homo sapiens
aggaaaaaagtctgtgattata

SEQ ID NO: 8439859 - DNA, 22 bp, Homo sapiens
aggaaaaaagtctgtgattata

SEQ ID NO: 8439860 - DNA, 22 bp, Homo sapiens
aggaaactgaagcccagagagg

SEQ ID NO: 8439861 - DNA, 22 bp, Homo sapiens
aggaaactctgagcggaccagc

SEQ ID NO: 8439862 - DNA, 22 bp, Homo sapiens
aggaaactgaggttacgggact

SEQ ID NO: 8439863 - DNA, 23 bp, Homo sapiens
aggaaactgaaggggccctctat

SEQ ID NO: 8439864 - DNA, 22 bp, Homo sapiens
aggaaactcccctacatctcaa

SEQ ID NO: 8439865 - DNA, 22 bp, Homo sapiens
aggaaactcaaagtgtcaggta

SEQ ID NO: 8439866 - DNA, 22 bp, Homo sapiens
aggaaactaattagtagaataa

SEQ ID NO: 8439867 - DNA, 22 bp, Homo sapiens
aggaaactaaggctcagtgaag

SEQ ID NO: 8439868 - DNA, 22 bp, Homo sapiens
aggaaactaacttatctttata

SEQ ID NO: 8439869 - DNA, 22 bp, Homo sapiens
aggaaactttcttttgcttcat

SEQ ID NO: 8439870 - DNA, 22 bp, Homo sapiens
aggaaacttcagagttttggtc

SEQ ID NO: 8439871 - DNA, 22 bp, Homo sapiens
aggaaactgggcctcaggttag

SEQ ID NO: 8439872 - DNA, 22 bp, Homo sapiens
aggaaactgatgttttttacaa

SEQ ID NO: 8439873 - DNA, 22 bp, Homo sapiens
aggaaactgggtatggttatac

SEQ ID NO: 8439874 - DNA, 19 bp, Homo sapiens
aggaaactgtcttttccag

SEQ ID NO: 8439875 - DNA, 22 bp, Homo sapiens
aggaaactgtcccctcatccta

SEQ ID NO: 8439876 - DNA, 22 bp, Homo sapiens
aggaagagcattcacatggtag

SEQ ID NO: 8439877 - DNA, 20 bp, Homo sapiens
aggaagccaaaggctgtctt

SEQ ID NO: 8439878 - DNA, 22 bp, Homo sapiens
aggaagccacgagtggcacggg

SEQ ID NO: 8439879 - DNA, 22 bp, Homo sapiens
aggaagccaagcctgacactca

SEQ ID NO: 8439880 - DNA, 22 bp, Homo sapiens
aggaagccatggtggacgtcta

SEQ ID NO: 8439881 - DNA, 22 bp, Homo sapiens
aggaagccaggcccttgggtgg

SEQ ID NO: 8439882 - DNA, 22 bp, Homo sapiens
aggaagccactgaatgaaagtt

SEQ ID NO: 8439883 - DNA, 18 bp, Homo sapiens
aggaagcaggaggaaggc

SEQ ID NO: 8439884 - DNA, 22 bp, Homo sapiens
aggaagcagtttataatgcatt

SEQ ID NO: 8439885 - DNA, 20 bp, Homo sapiens
acagccagaggaggcagaca

SEQ ID NO: 8439886 - DNA, 22 bp, Homo sapiens
agctccaggtgcaagtcatggt

SEQ ID NO: 8439887 - DNA, 22 bp, Homo sapiens
agctccaggtgcaagtcatggt

SEQ ID NO: 8439888 - DNA, 22 bp, Homo sapiens
acagccaggtaaaggcatggca

SEQ ID NO: 8439889 - DNA, 22 bp, Homo sapiens
acagccagggtctcaggaggcg

SEQ ID NO: 8439890 - DNA, 22 bp, Homo sapiens
acagccagtcctcccacagggt

SEQ ID NO: 8439891 - DNA, 22 bp, Homo sapiens
acagccagtcatctcagcaggg

SEQ ID NO: 8439892 - DNA, 22 bp, Homo sapiens
acagccagtcatctcagcaggg

SEQ ID NO: 8439893 - DNA, 22 bp, Homo sapiens
agctgcagccgcagctgtggcc

SEQ ID NO: 8439894 - DNA, 22 bp, Homo sapiens
agctgcagccgcagctgtggcc

SEQ ID NO: 8439895 - DNA, 22 bp, Homo sapiens
agctgcagccctcctgcatggc

SEQ ID NO: 8439896 - DNA, 22 bp, Homo sapiens
agctgcagccctcctgcatggc

SEQ ID NO: 8439897 - DNA, 22 bp, Homo sapiens
acagccagtgactggacaagct

SEQ ID NO: 8439898 - DNA, 22 bp, Homo sapiens
acagccagtgctccgtgaggac

SEQ ID NO: 8439899 - DNA, 23 bp, Homo sapiens
acagccagttcacctctccttgg

SEQ ID NO: 8439900 - DNA, 22 bp, Homo sapiens
agctgcagctacagtgttggtt

SEQ ID NO: 8439901 - DNA, 22 bp, Homo sapiens
agctgcagctacagtgttggtt

SEQ ID NO: 8439902 - DNA, 22 bp, Homo sapiens
agctgcagcgttcatttttcca

SEQ ID NO: 8439903 - DNA, 22 bp, Homo sapiens
agctgcaggagtcgcctaggat

SEQ ID NO: 8439904 - DNA, 22 bp, Homo sapiens
agctgcaggagtcgcctaggat

SEQ ID NO: 8439905 - DNA, 22 bp, Homo sapiens
agctgcaggattatggaatgga

SEQ ID NO: 8439906 - DNA, 22 bp, Homo sapiens
agctgcaggattatggaatgga

SEQ ID NO: 8439907 - DNA, 22 bp, Homo sapiens
agctggccttcggtgtcactgg

SEQ ID NO: 8439908 - DNA, 22 bp, Homo sapiens
agctggctatacttgaaaagtc

SEQ ID NO: 8439909 - DNA, 21 bp, Homo sapiens
agctggctatagttagtgatg

SEQ ID NO: 8439910 - DNA, 22 bp, Homo sapiens
agctggctatgccctgtgaacc

SEQ ID NO: 8439911 - DNA, 22 bp, Homo sapiens
agctggctcagccgggtggtct

SEQ ID NO: 8439912 - DNA, 21 bp, Homo sapiens
agctggctctctctggagaga

SEQ ID NO: 8439913 - DNA, 22 bp, Homo sapiens
agctggctatgccctgtgaacc

SEQ ID NO: 8439914 - DNA, 22 bp, Homo sapiens
agctggcagctctcaggggtac

SEQ ID NO: 8439915 - DNA, 22 bp, Homo sapiens
acagcctgcagccccaggtcgc

SEQ ID NO: 8439916 - DNA, 22 bp, Homo sapiens
acagcctgcagccccaggtcgc

SEQ ID NO: 8439917 - DNA, 22 bp, Homo sapiens
acagcctgcagccccaggtcgc

SEQ ID NO: 8439918 - DNA, 22 bp, Homo sapiens
acagcctgatttatggagcagt

SEQ ID NO: 8439919 - DNA, 22 bp, Homo sapiens
acagcctgatttatggagcagt

SEQ ID NO: 8439920 - DNA, 22 bp, Homo sapiens
acagcctgacttttgttgtcac

SEQ ID NO: 8439921 - DNA, 22 bp, Homo sapiens
acagcctgagagtggagctggc

SEQ ID NO: 8439922 - DNA, 22 bp, Homo sapiens
agctgctgtcctaggcactgta

SEQ ID NO: 8439923 - DNA, 22 bp, Homo sapiens
agctgctgtcctaggcactgta

SEQ ID NO: 8439924 - DNA, 22 bp, Homo sapiens
agctgctgtggggctcggcctg

SEQ ID NO: 8439925 - DNA, 22 bp, Homo sapiens
agctgcttagagtctcttctta

SEQ ID NO: 8439926 - DNA, 22 bp, Homo sapiens
agctgcttagagtctcttctta

SEQ ID NO: 8439927 - DNA, 18 bp, Homo sapiens
agctgcttgcaggccttc

SEQ ID NO: 8439928 - DNA, 22 bp, Homo sapiens
agctgcttgtacatgaccacat

SEQ ID NO: 8439929 - DNA, 22 bp, Homo sapiens
aggagacatggaatagtgaggc

SEQ ID NO: 8439930 - DNA, 22 bp, Homo sapiens
aggagacatggaatagtgaggc

SEQ ID NO: 8439931 - DNA, 22 bp, Homo sapiens
aggagacataactatgatgaga

SEQ ID NO: 8439932 - DNA, 22 bp, Homo sapiens
aggagacatactataggaatat

SEQ ID NO: 8439933 - DNA, 22 bp, Homo sapiens
aggagactcagagacctggccg

SEQ ID NO: 8439934 - DNA, 21 bp, Homo sapiens
aggagaccggcttgtttgtgc

SEQ ID NO: 8439935 - DNA, 22 bp, Homo sapiens
aggagaccttcaccacttccac

SEQ ID NO: 8439936 - DNA, 20 bp, Homo sapiens
aggagaccaagccaagtgga

SEQ ID NO: 8439937 - DNA, 22 bp, Homo sapiens
aggagacccaatgccagaaaga

SEQ ID NO: 8439938 - DNA, 22 bp, Homo sapiens
aggagacccagaatgttgctgt

SEQ ID NO: 8439939 - DNA, 22 bp, Homo sapiens
aggagacataactatgatgaga

SEQ ID NO: 8439940 - DNA, 18 bp, Homo sapiens
aggagacagcctcacctg

SEQ ID NO: 8439941 - DNA, 20 bp, Homo sapiens
aggacttgtttgggcagagt

SEQ ID NO: 8439942 - DNA, 19 bp, Homo sapiens
aggaaggcggcggctgccc

SEQ ID NO: 8439943 - DNA, 22 bp, Homo sapiens
aggaagctagagccaccggact

SEQ ID NO: 8439944 - DNA, 23 bp, Homo sapiens
aggaaggaggtcctaacagtatc

SEQ ID NO: 8439945 - DNA, 22 bp, Homo sapiens
aggaaggcacattgttggctaa

SEQ ID NO: 8439946 - DNA, 23 bp, Homo sapiens
aggaaggaggtcctaacagtatc

SEQ ID NO: 8439947 - DNA, 22 bp, Homo sapiens
aggaaggagggcagatattaag

SEQ ID NO: 8439948 - DNA, 23 bp, Homo sapiens
aggaagctaccaattttgtaggc

SEQ ID NO: 8439949 - DNA, 22 bp, Homo sapiens
aggaagctagaaggtcttcttt

SEQ ID NO: 8439950 - DNA, 23 bp, Homo sapiens
aggaagctaagtgtggctgcgga

SEQ ID NO: 8439951 - DNA, 22 bp, Homo sapiens
aggaagcctggggctgccctcg

SEQ ID NO: 8439952 - DNA, 17 bp, Homo sapiens
aggaagcgagctggcct

SEQ ID NO: 8439953 - DNA, 22 bp, Homo sapiens
aggaagcctggagtcctgccca

SEQ ID NO: 8439954 - DNA, 22 bp, Homo sapiens
aggaagcctggcattaaaaagc

SEQ ID NO: 8439955 - DNA, 22 bp, Homo sapiens
aggaagcctgggaggtttggga

SEQ ID NO: 8439956 - DNA, 22 bp, Homo sapiens
aggaagcccttgtcatttctgt

SEQ ID NO: 8439957 - DNA, 22 bp, Homo sapiens
aggaagcctgcaggtgactgct

SEQ ID NO: 8439958 - DNA, 23 bp, Homo sapiens
aggaagcccattttagtctacct

SEQ ID NO: 8439959 - DNA, 22 bp, Homo sapiens
aggaagcccaagtctcatcttc

SEQ ID NO: 8439960 - DNA, 23 bp, Homo sapiens
aggagccatgagttggatatgtt

SEQ ID NO: 8439961 - DNA, 22 bp, Homo sapiens
aggagccatgagtgacatcaca

SEQ ID NO: 8439962 - DNA, 21 bp, Homo sapiens
aggagccatgtggtctgatgg

SEQ ID NO: 8439963 - DNA, 20 bp, Homo sapiens
aggagccattgactgcagca

SEQ ID NO: 8439964 - DNA, 20 bp, Homo sapiens
aggagccattgactgcagca

SEQ ID NO: 8439965 - DNA, 22 bp, Homo sapiens
aggagccattttccaagggcga

SEQ ID NO: 8439966 - DNA, 22 bp, Homo sapiens
acagggtgactttgtgacagat

SEQ ID NO: 8439967 - DNA, 22 bp, Homo sapiens
acagggtgactttgtgacagat

SEQ ID NO: 8439968 - DNA, 22 bp, Homo sapiens
acagggtggggatggtgagctt

SEQ ID NO: 8439969 - DNA, 22 bp, Homo sapiens
acagggtgactttgtgacagat

SEQ ID NO: 8439970 - DNA, 22 bp, Homo sapiens
acaggggtgcatggtgcatggt

SEQ ID NO: 8439971 - DNA, 22 bp, Homo sapiens
acagggggtcccatggcctgga

SEQ ID NO: 8439972 - DNA, 22 bp, Homo sapiens
aggagaccttttgagtgtgaga

SEQ ID NO: 8439973 - DNA, 22 bp, Homo sapiens
acaggggctccgaaggtgaggg

SEQ ID NO: 8439974 - DNA, 22 bp, Homo sapiens
aggagcctccatggtcacattc

SEQ ID NO: 8439975 - DNA, 22 bp, Homo sapiens
aggagcccagcctgggctcgga

SEQ ID NO: 8439976 - DNA, 22 bp, Homo sapiens
aggagcccctcttcagtcctgg

SEQ ID NO: 8439977 - DNA, 23 bp, Homo sapiens
aggagcccctaattctgggcagc

SEQ ID NO: 8439978 - DNA, 23 bp, Homo sapiens
aggagcccctaattctgggcagc

SEQ ID NO: 8439979 - DNA, 22 bp, Homo sapiens
aggagcccctcttcagtcctgg

SEQ ID NO: 8439980 - DNA, 22 bp, Homo sapiens
aggagccctccgttgcttcatc

SEQ ID NO: 8439981 - DNA, 22 bp, Homo sapiens
aggagctgcagattctgccttg

SEQ ID NO: 8439982 - DNA, 22 bp, Homo sapiens
aggagctgcatggatacctggt

SEQ ID NO: 8439983 - DNA, 22 bp, Homo sapiens
aggagctgcatggatacctggt

SEQ ID NO: 8439984 - DNA, 22 bp, Homo sapiens
aggagctgctttggtgcggttt

SEQ ID NO: 8439985 - DNA, 22 bp, Homo sapiens
aggagctgctttggtgcggttt

SEQ ID NO: 8439986 - DNA, 22 bp, Homo sapiens
acatacatcaagtatcacaaga

SEQ ID NO: 8439987 - DNA, 22 bp, Homo sapiens
aggcaacaagggtagtcagtga

SEQ ID NO: 8439988 - DNA, 22 bp, Homo sapiens
aggcaaattgtgagaaaatgaa

SEQ ID NO: 8439989 - DNA, 22 bp, Homo sapiens
aggcaacatgggccaggcagaa

SEQ ID NO: 8439990 - DNA, 22 bp, Homo sapiens
aggcacagagaatgccctccat

SEQ ID NO: 8439991 - DNA, 22 bp, Homo sapiens
aggcacagagaggttaaatgca

SEQ ID NO: 8439992 - DNA, 18 bp, Homo sapiens
aggcacagagcatacata

SEQ ID NO: 8439993 - DNA, 22 bp, Homo sapiens
aggcacagaatggcattcagtg

SEQ ID NO: 8439994 - DNA, 22 bp, Homo sapiens
aggcacagagaatgccctccat

SEQ ID NO: 8439995 - DNA, 22 bp, Homo sapiens
aggcacagatttggggaaagca

SEQ ID NO: 8439996 - DNA, 22 bp, Homo sapiens
aggcacagatttggggaaagca

SEQ ID NO: 8439997 - DNA, 22 bp, Homo sapiens
aggcacagatttggggaaagca

SEQ ID NO: 8439998 - DNA, 20 bp, Homo sapiens
aggagggacctggattggcg

SEQ ID NO: 8439999 - DNA, 22 bp, Homo sapiens
aggagggacaccaatatatgtt

SEQ ID NO: 8440000 - DNA, 22 bp, Homo sapiens
aggagggagatgcccatcctgg

SEQ ID NO: 8440001 - DNA, 22 bp, Homo sapiens
aggagggagatgcccatcctgg

SEQ ID NO: 8440002 - DNA, 22 bp, Homo sapiens
aggaggggcatagaaatgtaat

SEQ ID NO: 8440003 - DNA, 17 bp, Homo sapiens
aggagggaaatagcttg

SEQ ID NO: 8440004 - DNA, 22 bp, Homo sapiens
aggagggacaccaatatatgtt

SEQ ID NO: 8440005 - DNA, 22 bp, Homo sapiens
aggaggcttttgcaggtgccac

SEQ ID NO: 8440006 - DNA, 22 bp, Homo sapiens
aggcaaattattgtatgcagtt

SEQ ID NO: 8440007 - DNA, 22 bp, Homo sapiens
aggcaaatagatagtccataca

SEQ ID NO: 8440008 - DNA, 22 bp, Homo sapiens
aggcaaagcgataccagagcta

SEQ ID NO: 8440009 - DNA, 22 bp, Homo sapiens
aggcaaaagaatgtcataaatg

SEQ ID NO: 8440010 - DNA, 22 bp, Homo sapiens
aggcaaaagaatgtcataaatg

SEQ ID NO: 8440011 - DNA, 22 bp, Homo sapiens
aggcaaaataagcctctcctgt

SEQ ID NO: 8440012 - DNA, 22 bp, Homo sapiens
aggcaaaattacaaagttatta

SEQ ID NO: 8440013 - DNA, 22 bp, Homo sapiens
aggaggggttctcgggtgctga

SEQ ID NO: 8440014 - DNA, 21 bp, Homo sapiens
aggaggggtctttcccactga

SEQ ID NO: 8440015 - DNA, 22 bp, Homo sapiens
aggagggtacaatgggtggaaa

SEQ ID NO: 8440016 - DNA, 22 bp, Homo sapiens
aggaggggttctcgggtgctga

SEQ ID NO: 8440017 - DNA, 20 bp, Homo sapiens
aggatggcaagcaagtgcat

SEQ ID NO: 8440018 - DNA, 22 bp, Homo sapiens
agtagtgaacagccacaggatt

SEQ ID NO: 8440019 - DNA, 22 bp, Homo sapiens
agtacctgatttcacagaccag

SEQ ID NO: 8440020 - DNA, 22 bp, Homo sapiens
agtactgtcagcagggtgttga

SEQ ID NO: 8440021 - DNA, 22 bp, Homo sapiens
agtactttagcataaagcagtt

SEQ ID NO: 8440022 - DNA, 22 bp, Homo sapiens
agtagtgtgacaattaatattt

SEQ ID NO: 8440023 - DNA, 21 bp, Homo sapiens
agtagtttagcacagggtttg

SEQ ID NO: 8440024 - DNA, 22 bp, Homo sapiens
agtataattagatatcaaaagt

SEQ ID NO: 8440025 - DNA, 22 bp, Homo sapiens
agtataatttacatttggtatt

SEQ ID NO: 8440026 - DNA, 22 bp, Homo sapiens
agtataattagatatcaaaagt

SEQ ID NO: 8440027 - DNA, 22 bp, Homo sapiens
agtatacatagtgcttcctctt

SEQ ID NO: 8440028 - DNA, 22 bp, Homo sapiens
agtatacagtaatgacatatct

SEQ ID NO: 8440029 - DNA, 22 bp, Homo sapiens
agtatacagtaatgacatatct

SEQ ID NO: 8440030 - DNA, 22 bp, Homo sapiens
agtatacagtaatgacatatct

SEQ ID NO: 8440031 - DNA, 22 bp, Homo sapiens
agtatacagtaatgacatatct

SEQ ID NO: 8440032 - DNA, 22 bp, Homo sapiens
aggtggggaaaccagcgatccc

SEQ ID NO: 8440033 - DNA, 22 bp, Homo sapiens
agtcactgtttcagaactgagt

SEQ ID NO: 8440034 - DNA, 22 bp, Homo sapiens
agtcactgtttcagaactgagt

SEQ ID NO: 8440035 - DNA, 22 bp, Homo sapiens
actctaaatagataaccatgca

SEQ ID NO: 8440036 - DNA, 22 bp, Homo sapiens
agtcactgtcaaagccacacac

SEQ ID NO: 8440037 - DNA, 22 bp, Homo sapiens
agtcactgtcttgcaaaggtca

SEQ ID NO: 8440038 - DNA, 22 bp, Homo sapiens
agtcactgctttgtccctgtgt

SEQ ID NO: 8440039 - DNA, 22 bp, Homo sapiens
agtcactgagatggtgaggcta

SEQ ID NO: 8440040 - DNA, 22 bp, Homo sapiens
agtcactgaataccttaatgtt

SEQ ID NO: 8440041 - DNA, 22 bp, Homo sapiens
actctctgtctaaatgcagttt

SEQ ID NO: 8440042 - DNA, 22 bp, Homo sapiens
actctctgggcatgccccacca

SEQ ID NO: 8440043 - DNA, 22 bp, Homo sapiens
agtcaccttgaaatgtcttgaa

SEQ ID NO: 8440044 - DNA, 22 bp, Homo sapiens
agtcactctgctacatgacagc

SEQ ID NO: 8440045 - DNA, 22 bp, Homo sapiens
actcctgggtgctgaccagcgt

SEQ ID NO: 8440046 - DNA, 22 bp, Homo sapiens
actcctgggttccggagattct

SEQ ID NO: 8440047 - DNA, 22 bp, Homo sapiens
actcctggggatccattccttt

SEQ ID NO: 8440048 - DNA, 22 bp, Homo sapiens
actcctggggatccattccttt

SEQ ID NO: 8440049 - DNA, 22 bp, Homo sapiens
actcctggggctgccatcacag

SEQ ID NO: 8440050 - DNA, 22 bp, Homo sapiens
actcctggggctgccatcacag

SEQ ID NO: 8440051 - DNA, 22 bp, Homo sapiens
actcctggaaaagaacgcaggg

SEQ ID NO: 8440052 - DNA, 22 bp, Homo sapiens
actcctggaaaagaacgcaggg

SEQ ID NO: 8440053 - DNA, 22 bp, Homo sapiens
actcctgggtgcatttctgatt

SEQ ID NO: 8440054 - DNA, 22 bp, Homo sapiens
actcctgggtgcatttctgatt

SEQ ID NO: 8440055 - DNA, 22 bp, Homo sapiens
actcctgggtgcatttctgatt

SEQ ID NO: 8440056 - DNA, 22 bp, Homo sapiens
actcctgggtgctgaccagcgt

SEQ ID NO: 8440057 - DNA, 22 bp, Homo sapiens
actcctgggtgctgaccagcgt

SEQ ID NO: 8440058 - DNA, 22 bp, Homo sapiens
actccctggcaggtctttatct

SEQ ID NO: 8440059 - DNA, 22 bp, Homo sapiens
actccctgcaagattttccatg

SEQ ID NO: 8440060 - DNA, 22 bp, Homo sapiens
actacatttctcagtacctgaa

SEQ ID NO: 8440061 - DNA, 22 bp, Homo sapiens
actaccttatacaaaatgtagg

SEQ ID NO: 8440062 - DNA, 22 bp, Homo sapiens
actacattcatgctcgtgttgg

SEQ ID NO: 8440063 - DNA, 22 bp, Homo sapiens
aggtgagaaaacgagggttgca

SEQ ID NO: 8440064 - DNA, 22 bp, Homo sapiens
aggtgactggtttatctggcag

SEQ ID NO: 8440065 - DNA, 22 bp, Homo sapiens
aggtgactggtttatctggcag

SEQ ID NO: 8440066 - DNA, 22 bp, Homo sapiens
actacagtaagggaggcagcat

SEQ ID NO: 8440067 - DNA, 23 bp, Homo sapiens
actacagatactcctgctgtttg

SEQ ID NO: 8440068 - DNA, 22 bp, Homo sapiens
actagaaagtttccagagttat

SEQ ID NO: 8440069 - DNA, 22 bp, Homo sapiens
actagaaaattcctagaaacta

SEQ ID NO: 8440070 - DNA, 22 bp, Homo sapiens
aggtgacaggacaggagctggt

SEQ ID NO: 8440071 - DNA, 22 bp, Homo sapiens
aggtgacaggacaggagctggt

SEQ ID NO: 8440072 - DNA, 22 bp, Homo sapiens
aggtgacatcccggcagcagag

SEQ ID NO: 8440073 - DNA, 22 bp, Homo sapiens
aggtgacatcccggcagcagag

SEQ ID NO: 8440074 - DNA, 19 bp, Homo sapiens
aggtgacatgtgacagcct

SEQ ID NO: 8440075 - DNA, 22 bp, Homo sapiens
acgagtctgctcttgaaaaagt

SEQ ID NO: 8440076 - DNA, 22 bp, Homo sapiens
aggtcttaggagcatggtgctg

SEQ ID NO: 8440077 - DNA, 22 bp, Homo sapiens
acccttggttttgcagagctgt

SEQ ID NO: 8440078 - DNA, 22 bp, Homo sapiens
acccttggttttgcagagctgt

SEQ ID NO: 8440079 - DNA, 22 bp, Homo sapiens
accctgtgcagagaagtgagcg

SEQ ID NO: 8440080 - DNA, 22 bp, Homo sapiens
acccttcatagaggagaagctg

SEQ ID NO: 8440081 - DNA, 23 bp, Homo sapiens
aggtcaaccacaagctgacaaac

SEQ ID NO: 8440082 - DNA, 22 bp, Homo sapiens
aggtcaagggcaagagtgaggt

SEQ ID NO: 8440083 - DNA, 22 bp, Homo sapiens
aggtcaagattctacatttgta

SEQ ID NO: 8440084 - DNA, 22 bp, Homo sapiens
aggtcaaggctgcagtgagctg

SEQ ID NO: 8440085 - DNA, 22 bp, Homo sapiens
aggtcaagggagctgagggcca

SEQ ID NO: 8440086 - DNA, 22 bp, Homo sapiens
aggtccagaggttgaacggtgg

SEQ ID NO: 8440087 - DNA, 22 bp, Homo sapiens
aggtccagagttgagatacaga

SEQ ID NO: 8440088 - DNA, 22 bp, Homo sapiens
aggtccagcctgccctctctcc

SEQ ID NO: 8440089 - DNA, 22 bp, Homo sapiens
aggtccagctctattgaaaaga

SEQ ID NO: 8440090 - DNA, 22 bp, Homo sapiens
aggtccagaacgtgcctactct

SEQ ID NO: 8440091 - DNA, 22 bp, Homo sapiens
aggtccagactgtgtaccctag

SEQ ID NO: 8440092 - DNA, 22 bp, Homo sapiens
aggtccagaggctccttattac

SEQ ID NO: 8440093 - DNA, 22 bp, Homo sapiens
aggtccaggatttgtggggtct

SEQ ID NO: 8440094 - DNA, 22 bp, Homo sapiens
aggtccaggagatttggcaatt

SEQ ID NO: 8440095 - DNA, 22 bp, Homo sapiens
aggtccagctgttgcagcctcc

SEQ ID NO: 8440096 - DNA, 22 bp, Homo sapiens
aggtccagctgttgcagcctcc

SEQ ID NO: 8440097 - DNA, 22 bp, Homo sapiens
aggtccaggcatttgggttggg

SEQ ID NO: 8440098 - DNA, 22 bp, Homo sapiens
aggtccaggcctcatgatggcc

SEQ ID NO: 8440099 - DNA, 22 bp, Homo sapiens
aggtccaggttccgtttctgcg

SEQ ID NO: 8440100 - DNA, 22 bp, Homo sapiens
accttcctctaagacatttagc

SEQ ID NO: 8440101 - DNA, 22 bp, Homo sapiens
accttcctctaagacatttagc

SEQ ID NO: 8440102 - DNA, 21 bp, Homo sapiens
aggtccagttctgtcttggac

SEQ ID NO: 8440103 - DNA, 22 bp, Homo sapiens
aggtccagtgctcttggtggtt

SEQ ID NO: 8440104 - DNA, 22 bp, Homo sapiens
aggtccagtgaaactttatttg

SEQ ID NO: 8440105 - DNA, 22 bp, Homo sapiens
acctttgacgctatttaatttg

SEQ ID NO: 8440106 - DNA, 22 bp, Homo sapiens
acctttctgcaagttctgggac

SEQ ID NO: 8440107 - DNA, 22 bp, Homo sapiens
actgccattttgaataattact

SEQ ID NO: 8440108 - DNA, 22 bp, Homo sapiens
actgccctgtaactgccaggta

SEQ ID NO: 8440109 - DNA, 22 bp, Homo sapiens
actgcccttgtcctggcacacc

SEQ ID NO: 8440110 - DNA, 22 bp, Homo sapiens
actgccctggcaccacacatgc

SEQ ID NO: 8440111 - DNA, 22 bp, Homo sapiens
actgccctggagacagcagagt

SEQ ID NO: 8440112 - DNA, 22 bp, Homo sapiens
actgcctcttggtgctgagaga

SEQ ID NO: 8440113 - DNA, 22 bp, Homo sapiens
actgccctccagcctgggtgac

SEQ ID NO: 8440114 - DNA, 22 bp, Homo sapiens
actgccctcccatctattgcaa

SEQ ID NO: 8440115 - DNA, 22 bp, Homo sapiens
actgcccattaaaggtgctttg

SEQ ID NO: 8440116 - DNA, 22 bp, Homo sapiens
actgcccagtgattggtggtta

SEQ ID NO: 8440117 - DNA, 19 bp, Homo sapiens
actgcctgaggctcacagg

SEQ ID NO: 8440118 - DNA, 23 bp, Homo sapiens
actgcctgctactatgcccacgg

SEQ ID NO: 8440119 - DNA, 22 bp, Homo sapiens
actgcctgccttccaggtactg

SEQ ID NO: 8440120 - DNA, 22 bp, Homo sapiens
actgcctggcctggcctcactg

SEQ ID NO: 8440121 - DNA, 21 bp, Homo sapiens
actgcctggggtgctggccaa

SEQ ID NO: 8440122 - DNA, 22 bp, Homo sapiens
actgcctgtagccctgagatgt

SEQ ID NO: 8440123 - DNA, 22 bp, Homo sapiens
actggctgatcacctgcctcag

SEQ ID NO: 8440124 - DNA, 21 bp, Homo sapiens
actggctgccatgatccaggg

SEQ ID NO: 8440125 - DNA, 22 bp, Homo sapiens
actggctggactctgacctctt

SEQ ID NO: 8440126 - DNA, 22 bp, Homo sapiens
actggctggccgcgctcttcgc

SEQ ID NO: 8440127 - DNA, 22 bp, Homo sapiens
actggcttggcaggaggaagat

SEQ ID NO: 8440128 - DNA, 22 bp, Homo sapiens
actgggcatcccatggcagagc

SEQ ID NO: 8440129 - DNA, 22 bp, Homo sapiens
actgggccagatcagagcaact

SEQ ID NO: 8440130 - DNA, 22 bp, Homo sapiens
actgggccagacactgattccc

SEQ ID NO: 8440131 - DNA, 22 bp, Homo sapiens
actgggccaggtgtgggtgagt

SEQ ID NO: 8440132 - DNA, 22 bp, Homo sapiens
actgggcccagtggtgtggctg

SEQ ID NO: 8440133 - DNA, 22 bp, Homo sapiens
actgggccaggggctttggagc

SEQ ID NO: 8440134 - DNA, 22 bp, Homo sapiens
actgggccagatcagagcaact

SEQ ID NO: 8440135 - DNA, 22 bp, Homo sapiens
actgggccggtgcagagtagtt

SEQ ID NO: 8440136 - DNA, 22 bp, Homo sapiens
actgggcctacccagattggca

SEQ ID NO: 8440137 - DNA, 22 bp, Homo sapiens
actgggccgcgctgcagagggc

SEQ ID NO: 8440138 - DNA, 22 bp, Homo sapiens
actgggcctgattgggtcggag

SEQ ID NO: 8440139 - DNA, 22 bp, Homo sapiens
actgggcctggattggcgtgtc

SEQ ID NO: 8440140 - DNA, 22 bp, Homo sapiens
actgggcctggattggcgtgtc

SEQ ID NO: 8440141 - DNA, 22 bp, Homo sapiens
actgggcctgtacagagaaaac

SEQ ID NO: 8440142 - DNA, 22 bp, Homo sapiens
actgggccttgccatggcagcc

SEQ ID NO: 8440143 - DNA, 22 bp, Homo sapiens
actgggcctgtacagagaaaac

SEQ ID NO: 8440144 - DNA, 22 bp, Homo sapiens
actgcacctcagcctgggcgac

SEQ ID NO: 8440145 - DNA, 22 bp, Homo sapiens
actgcacctgtgtaccaagatg

SEQ ID NO: 8440146 - DNA, 22 bp, Homo sapiens
agtgaaggaaacaattggttga

SEQ ID NO: 8440147 - DNA, 22 bp, Homo sapiens
agtgaaggtttacagggcccct

SEQ ID NO: 8440148 - DNA, 22 bp, Homo sapiens
agtgaaggaagtttgtcttggg

SEQ ID NO: 8440149 - DNA, 22 bp, Homo sapiens
actgcactccagcctgggtgat

SEQ ID NO: 8440150 - DNA, 22 bp, Homo sapiens
actgcactccagcctgggtgat

SEQ ID NO: 8440151 - DNA, 22 bp, Homo sapiens
actgcaccttgcggtcctgtgg

SEQ ID NO: 8440152 - DNA, 22 bp, Homo sapiens
actgcactccagcctgggtgat

SEQ ID NO: 8440153 - DNA, 22 bp, Homo sapiens
actgcactcctgcctgggtaac

SEQ ID NO: 8440154 - DNA, 22 bp, Homo sapiens
actgcactcctgcctgggtaac

SEQ ID NO: 8440155 - DNA, 22 bp, Homo sapiens
actgcacttcaccctgggtgac

SEQ ID NO: 8440156 - DNA, 22 bp, Homo sapiens
actgcacttcaccctgggtgac

SEQ ID NO: 8440157 - DNA, 22 bp, Homo sapiens
actgcacttcaccctgggtgac

SEQ ID NO: 8440158 - DNA, 22 bp, Homo sapiens
agtgctcataaaaatgtgaaac

SEQ ID NO: 8440159 - DNA, 23 bp, Homo sapiens
agtgctcccaggacctggggcag

SEQ ID NO: 8440160 - DNA, 22 bp, Homo sapiens
agtgctccacattgcactattc

SEQ ID NO: 8440161 - DNA, 22 bp, Homo sapiens
agtgctcacctgtcaggtcaag

SEQ ID NO: 8440162 - DNA, 22 bp, Homo sapiens
agtgctcacctgtcaggtcaag

SEQ ID NO: 8440163 - DNA, 22 bp, Homo sapiens
agtgctcactctccacagtgcc

SEQ ID NO: 8440164 - DNA, 23 bp, Homo sapiens
agtgctcagggcattaggctaga

SEQ ID NO: 8440165 - DNA, 22 bp, Homo sapiens
agtgctcctgaagcttgaggca

SEQ ID NO: 8440166 - DNA, 22 bp, Homo sapiens
agtgctccctagagttgtgcaa

SEQ ID NO: 8440167 - DNA, 22 bp, Homo sapiens
agtgctcctttcattgctgccc

SEQ ID NO: 8440168 - DNA, 21 bp, Homo sapiens
agtgctgaaaaagcatgtctc

SEQ ID NO: 8440169 - DNA, 21 bp, Homo sapiens
actctgaaaattaatagttat

SEQ ID NO: 8440170 - DNA, 22 bp, Homo sapiens
actctgaggaatgtacaggacc

SEQ ID NO: 8440171 - DNA, 19 bp, Homo sapiens
actctgagcttgctctatc

SEQ ID NO: 8440172 - DNA, 22 bp, Homo sapiens
actctgaggagtgactagaggt

SEQ ID NO: 8440173 - DNA, 19 bp, Homo sapiens
actctgaggctgagacaag

SEQ ID NO: 8440174 - DNA, 22 bp, Homo sapiens
actctgagtcatgcactccttg

SEQ ID NO: 8440175 - DNA, 22 bp, Homo sapiens
actgaattttaattagatctgc

SEQ ID NO: 8440176 - DNA, 22 bp, Homo sapiens
actgaattttaattagatctgc

SEQ ID NO: 8440177 - DNA, 22 bp, Homo sapiens
actctgccttggtgtcacaaga

SEQ ID NO: 8440178 - DNA, 22 bp, Homo sapiens
actctgaggggtatgttcctat

SEQ ID NO: 8440179 - DNA, 22 bp, Homo sapiens
actgagctccctgagggcaggc

SEQ ID NO: 8440180 - DNA, 23 bp, Homo sapiens
actgagcattagtatttttataa

SEQ ID NO: 8440181 - DNA, 22 bp, Homo sapiens
actgagctctaggttttgaacc

SEQ ID NO: 8440182 - DNA, 22 bp, Homo sapiens
actgagcactcacttttgttat

SEQ ID NO: 8440183 - DNA, 22 bp, Homo sapiens
actgagcacttggtatatttcc

SEQ ID NO: 8440184 - DNA, 22 bp, Homo sapiens
actgagcagaagagatctgtga

SEQ ID NO: 8440185 - DNA, 22 bp, Homo sapiens
actgagcataaatatgtgtcca

SEQ ID NO: 8440186 - DNA, 22 bp, Homo sapiens
actgagcagtagattttctgtt

SEQ ID NO: 8440187 - DNA, 22 bp, Homo sapiens
actttctgtcatctagacaagt

SEQ ID NO: 8440188 - DNA, 22 bp, Homo sapiens
actttctgtcatctagacaagt

SEQ ID NO: 8440189 - DNA, 22 bp, Homo sapiens
actttctgtcatctagacaagt

SEQ ID NO: 8440190 - DNA, 22 bp, Homo sapiens
actttctgccttacaggagtcc

SEQ ID NO: 8440191 - DNA, 22 bp, Homo sapiens
actttctgcagtgttggaaatg

SEQ ID NO: 8440192 - DNA, 22 bp, Homo sapiens
actttgcaatacttaatacaaa

SEQ ID NO: 8440193 - DNA, 22 bp, Homo sapiens
atacatcatgctccatatattt

SEQ ID NO: 8440194 - DNA, 22 bp, Homo sapiens
actttgcaggtacatgagcatc

SEQ ID NO: 8440195 - DNA, 22 bp, Homo sapiens
actttgcacttcaatataactt

SEQ ID NO: 8440196 - DNA, 23 bp, Homo sapiens
actttgcagagccccttgaaaca

SEQ ID NO: 8440197 - DNA, 22 bp, Homo sapiens
actttggaataagctatataac

SEQ ID NO: 8440198 - DNA, 22 bp, Homo sapiens
actttggaaattgtctataaga

SEQ ID NO: 8440199 - DNA, 22 bp, Homo sapiens
atagatattagcaaaattttat

SEQ ID NO: 8440200 - DNA, 22 bp, Homo sapiens
actttggacgccatgctgtttg

SEQ ID NO: 8440201 - DNA, 22 bp, Homo sapiens
actttggagggtgttgtagatg

SEQ ID NO: 8440202 - DNA, 22 bp, Homo sapiens
actttgggaagctgcaattgcc

SEQ ID NO: 8440203 - DNA, 22 bp, Homo sapiens
actttggagggtgttgtagatg

SEQ ID NO: 8440204 - DNA, 22 bp, Homo sapiens
atagagtccaaagtatgaatat

SEQ ID NO: 8440205 - DNA, 22 bp, Homo sapiens
actttaaggaggcactcatctc

SEQ ID NO: 8440206 - DNA, 21 bp, Homo sapiens
actttaatatacatgaggagg

SEQ ID NO: 8440207 - DNA, 22 bp, Homo sapiens
actttaaagcagaatggctatg

SEQ ID NO: 8440208 - DNA, 22 bp, Homo sapiens
actttaaagcagaatggctatg

SEQ ID NO: 8440209 - DNA, 21 bp, Homo sapiens
actttacaatttacatagtga

SEQ ID NO: 8440210 - DNA, 21 bp, Homo sapiens
actttacaatttacatagtga

SEQ ID NO: 8440211 - DNA, 21 bp, Homo sapiens
actttacaatttacatagtga

SEQ ID NO: 8440212 - DNA, 22 bp, Homo sapiens
actttacaatatcctgtgactt

SEQ ID NO: 8440213 - DNA, 22 bp, Homo sapiens
actttacaaactcctcactgtt

SEQ ID NO: 8440214 - DNA, 21 bp, Homo sapiens
actttacaatttacatagtga

SEQ ID NO: 8440215 - DNA, 20 bp, Homo sapiens
actttacagagaagactgac

SEQ ID NO: 8440216 - DNA, 22 bp, Homo sapiens
atacaaaatatatactggagac

SEQ ID NO: 8440217 - DNA, 22 bp, Homo sapiens
atacaaaatatatactggagac

SEQ ID NO: 8440218 - DNA, 22 bp, Homo sapiens
atacaaaaattagccgggagta

SEQ ID NO: 8440219 - DNA, 22 bp, Homo sapiens
acttctctgctacctgcaaaga

SEQ ID NO: 8440220 - DNA, 22 bp, Homo sapiens
acttctctcattcagacatagc

SEQ ID NO: 8440221 - DNA, 22 bp, Homo sapiens
acttctctccacccaagtccct

SEQ ID NO: 8440222 - DNA, 22 bp, Homo sapiens
acttctctccacccaagtccct

SEQ ID NO: 8440223 - DNA, 22 bp, Homo sapiens
acttctcttcataggtggcaat

SEQ ID NO: 8440224 - DNA, 22 bp, Homo sapiens
acttctctggttgaggtccaat

SEQ ID NO: 8440225 - DNA, 18 bp, Homo sapiens
ataaagtgctaataatgg

SEQ ID NO: 8440226 - DNA, 18 bp, Homo sapiens
ataaagtgctaataatgg

SEQ ID NO: 8440227 - DNA, 22 bp, Homo sapiens
acttaaaaagaatcttttcacg

SEQ ID NO: 8440228 - DNA, 22 bp, Homo sapiens
acttaaaaacagatccagcagg

SEQ ID NO: 8440229 - DNA, 22 bp, Homo sapiens
actgttttctgtaaagggccag

SEQ ID NO: 8440230 - DNA, 22 bp, Homo sapiens
actgttttcttagctccctgct

SEQ ID NO: 8440231 - DNA, 22 bp, Homo sapiens
actgttttctgtaaagggccag

SEQ ID NO: 8440232 - DNA, 22 bp, Homo sapiens
actgttttcttagctccctgct

SEQ ID NO: 8440233 - DNA, 22 bp, Homo sapiens
actgtttctgccacaatagccc

SEQ ID NO: 8440234 - DNA, 22 bp, Homo sapiens
actgtttgctgatagatattta

SEQ ID NO: 8440235 - DNA, 22 bp, Homo sapiens
actgttttctgtaaagggccag

SEQ ID NO: 8440236 - DNA, 22 bp, Homo sapiens
acttccagcccctgtcagcaaa

SEQ ID NO: 8440237 - DNA, 22 bp, Homo sapiens
acttccagcacctcaagcggaa

SEQ ID NO: 8440238 - DNA, 19 bp, Homo sapiens
ataaataaaaagtgggaga

SEQ ID NO: 8440239 - DNA, 22 bp, Homo sapiens
acttcctgttatgtgtgcctct

SEQ ID NO: 8440240 - DNA, 22 bp, Homo sapiens
acttcctgtatttatccatagc

SEQ ID NO: 8440241 - DNA, 22 bp, Homo sapiens
acttcctgtaaatagaattcca

SEQ ID NO: 8440242 - DNA, 22 bp, Homo sapiens
acttctattggtcatgataaaa

SEQ ID NO: 8440243 - DNA, 22 bp, Homo sapiens
acttctaagctcaaattggtat

SEQ ID NO: 8440244 - DNA, 22 bp, Homo sapiens
acttctatgcacagagcttgga

SEQ ID NO: 8440245 - DNA, 18 bp, Homo sapiens
agtttttaggaagaaatg

SEQ ID NO: 8440246 - DNA, 18 bp, Homo sapiens
agtttttaggaagaaatg

SEQ ID NO: 8440247 - DNA, 22 bp, Homo sapiens
agtttttcctgattttacagaa

SEQ ID NO: 8440248 - DNA, 23 bp, Homo sapiens
agtttttaatggtcatagctgag

SEQ ID NO: 8440249 - DNA, 23 bp, Homo sapiens
agtttttaatggtcatagctgag

SEQ ID NO: 8440250 - DNA, 22 bp, Homo sapiens
agttttatggctcaacctaata

SEQ ID NO: 8440251 - DNA, 22 bp, Homo sapiens
agttttatgtagacaattcatt

SEQ ID NO: 8440252 - DNA, 21 bp, Homo sapiens
actgttattcccattttcacc

SEQ ID NO: 8440253 - DNA, 22 bp, Homo sapiens
actgtttaggaggcttatatgc

SEQ ID NO: 8440254 - DNA, 22 bp, Homo sapiens
agtttttccgtggctacgataa

SEQ ID NO: 8440255 - DNA, 22 bp, Homo sapiens
agtttttctcccctggcttcat

SEQ ID NO: 8440256 - DNA, 22 bp, Homo sapiens
agtttttctgctggtctcacta

SEQ ID NO: 8440257 - DNA, 23 bp, Homo sapiens
agtttttctgcatggttctgtat

SEQ ID NO: 8440258 - DNA, 23 bp, Homo sapiens
agtttttctgcatggttctgtat

SEQ ID NO: 8440259 - DNA, 22 bp, Homo sapiens
agtttttgagaatttactatgt

SEQ ID NO: 8440260 - DNA, 22 bp, Homo sapiens
agtttttctgggaggcactgct

SEQ ID NO: 8440261 - DNA, 22 bp, Homo sapiens
actgggctcataatgtcataga

SEQ ID NO: 8440262 - DNA, 22 bp, Homo sapiens
actgggctcataatgtcataga

SEQ ID NO: 8440263 - DNA, 22 bp, Homo sapiens
actgggctccaaggacctggag

SEQ ID NO: 8440264 - DNA, 22 bp, Homo sapiens
actgggctccagatgtgatacg

SEQ ID NO: 8440265 - DNA, 22 bp, Homo sapiens
actgggctcccaggcttgtcat

SEQ ID NO: 8440266 - DNA, 22 bp, Homo sapiens
actgggctcccaggcttgtcat

SEQ ID NO: 8440267 - DNA, 22 bp, Homo sapiens
agtttctagcaaggattgttga

SEQ ID NO: 8440268 - DNA, 22 bp, Homo sapiens
actgggctagagtggaagctgg

SEQ ID NO: 8440269 - DNA, 22 bp, Homo sapiens
actgggctcaagtgattgtcct

SEQ ID NO: 8440270 - DNA, 21 bp, Homo sapiens
actgggctagcctgacttctg

SEQ ID NO: 8440271 - DNA, 22 bp, Homo sapiens
actgggctaccccaccattacc

SEQ ID NO: 8440272 - DNA, 22 bp, Homo sapiens
actgggccttgtgtgtctcatc

SEQ ID NO: 8440273 - DNA, 22 bp, Homo sapiens
agttttaagatgcgcttctgtt

SEQ ID NO: 8440274 - DNA, 22 bp, Homo sapiens
agttttaaatgatggtggtggt

SEQ ID NO: 8440275 - DNA, 21 bp, Homo sapiens
agttttatattataagctaaa

SEQ ID NO: 8440276 - DNA, 20 bp, Homo sapiens
agaaggcaggagacaaaagg

SEQ ID NO: 8440277 - DNA, 22 bp, Homo sapiens
agaaggcaggttttaaaatgtc

SEQ ID NO: 8440278 - DNA, 22 bp, Homo sapiens
agaaggcatcagaagtgtgtag

SEQ ID NO: 8440279 - DNA, 22 bp, Homo sapiens
agaaggcactcacactggcacg

SEQ ID NO: 8440280 - DNA, 22 bp, Homo sapiens
agaaggcagaaagtccaggtat

SEQ ID NO: 8440281 - DNA, 22 bp, Homo sapiens
agaaggcagatgggacggagca

SEQ ID NO: 8440282 - DNA, 22 bp, Homo sapiens
agaaggagtgtacaggtcatgc

SEQ ID NO: 8440283 - DNA, 22 bp, Homo sapiens
agaagccacaggcctcgtctgg

SEQ ID NO: 8440284 - DNA, 19 bp, Homo sapiens
agaagctgtgaaatgaagg

SEQ ID NO: 8440285 - DNA, 23 bp, Homo sapiens
agaagctgggagcctggggatgg

SEQ ID NO: 8440286 - DNA, 21 bp, Homo sapiens
agaaggcaaaagcagacatct

SEQ ID NO: 8440287 - DNA, 22 bp, Homo sapiens
agaaggcacagtgctgctaaga

SEQ ID NO: 8440288 - DNA, 22 bp, Homo sapiens
atctctggccttccttttccaa

SEQ ID NO: 8440289 - DNA, 22 bp, Homo sapiens
atctctgggctttgagtttgtt

SEQ ID NO: 8440290 - DNA, 22 bp, Homo sapiens
atctctggcccctggggtccga

SEQ ID NO: 8440291 - DNA, 22 bp, Homo sapiens
atctctgggctttgagtttgtt

SEQ ID NO: 8440292 - DNA, 22 bp, Homo sapiens
atctctggttgttttgctccca

SEQ ID NO: 8440293 - DNA, 22 bp, Homo sapiens
atctctggtccaaatgttacct

SEQ ID NO: 8440294 - DNA, 22 bp, Homo sapiens
atctctgggtccatagaagaga

SEQ ID NO: 8440295 - DNA, 22 bp, Homo sapiens
atctctgtaaaccataaattga

SEQ ID NO: 8440296 - DNA, 22 bp, Homo sapiens
atctctgtaattacatgatatt

SEQ ID NO: 8440297 - DNA, 22 bp, Homo sapiens
atctctgttagatctgcttaaa

SEQ ID NO: 8440298 - DNA, 22 bp, Homo sapiens
atctctgtgccatcattgcccc

SEQ ID NO: 8440299 - DNA, 22 bp, Homo sapiens
atctctgttttaggagatagtg

SEQ ID NO: 8440300 - DNA, 22 bp, Homo sapiens
atctcttctgagcaattcctgt

SEQ ID NO: 8440301 - DNA, 22 bp, Homo sapiens
atctcttctagctctgaaatta

SEQ ID NO: 8440302 - DNA, 22 bp, Homo sapiens
atctcttctcccaacacctggc

SEQ ID NO: 8440303 - DNA, 22 bp, Homo sapiens
agaagccaatccttgtctctct

SEQ ID NO: 8440304 - DNA, 22 bp, Homo sapiens
agaagccaatcagctctctgct

SEQ ID NO: 8440305 - DNA, 22 bp, Homo sapiens
agaagccacaggaaagcagctt

SEQ ID NO: 8440306 - DNA, 22 bp, Homo sapiens
agaagccaagaacagacagtgc

SEQ ID NO: 8440307 - DNA, 22 bp, Homo sapiens
agaaccagtttaagatttgggt

SEQ ID NO: 8440308 - DNA, 22 bp, Homo sapiens
agaacatttgtcgatcaatttg

SEQ ID NO: 8440309 - DNA, 22 bp, Homo sapiens
agaaccattttgacagatatac

SEQ ID NO: 8440310 - DNA, 22 bp, Homo sapiens
agaaccattttgacagatatac

SEQ ID NO: 8440311 - DNA, 22 bp, Homo sapiens
agaaccatgagtttgagtatct

SEQ ID NO: 8440312 - DNA, 22 bp, Homo sapiens
agaaccagtttaagatttgggt

SEQ ID NO: 8440313 - DNA, 20 bp, Homo sapiens
agaacctaagttaaaacaca

SEQ ID NO: 8440314 - DNA, 20 bp, Homo sapiens
agaacctaagttaaaacaca

SEQ ID NO: 8440315 - DNA, 22 bp, Homo sapiens
agaacctcacgagattccttca

SEQ ID NO: 8440316 - DNA, 22 bp, Homo sapiens
agaaccttcagattaggaggtg

SEQ ID NO: 8440317 - DNA, 22 bp, Homo sapiens
agaacctcacgagattccttca

SEQ ID NO: 8440318 - DNA, 22 bp, Homo sapiens
atctcagggctggagccctgga

SEQ ID NO: 8440319 - DNA, 22 bp, Homo sapiens
atctctggcaatgcagcatcgt

SEQ ID NO: 8440320 - DNA, 22 bp, Homo sapiens
atcccatttcctgttttgtcaa

SEQ ID NO: 8440321 - DNA, 22 bp, Homo sapiens
agaacatctaaatatctgagac

SEQ ID NO: 8440322 - DNA, 22 bp, Homo sapiens
agaaatcattgaattatttgct

SEQ ID NO: 8440323 - DNA, 22 bp, Homo sapiens
agaaatcattttaggcttgatg

SEQ ID NO: 8440324 - DNA, 22 bp, Homo sapiens
agaaatcccaaggcatcaacca

SEQ ID NO: 8440325 - DNA, 22 bp, Homo sapiens
agaaatctcagtatctcaggga

SEQ ID NO: 8440326 - DNA, 22 bp, Homo sapiens
agaaatctctagcacatcgaat

SEQ ID NO: 8440327 - DNA, 22 bp, Homo sapiens
agaaatctgactgctgtgcaca

SEQ ID NO: 8440328 - DNA, 22 bp, Homo sapiens
agaaatcttatcaagaaatgcc

SEQ ID NO: 8440329 - DNA, 22 bp, Homo sapiens
atccaggaaggatggcattgag

SEQ ID NO: 8440330 - DNA, 22 bp, Homo sapiens
atccaggcattctgacttcaag

SEQ ID NO: 8440331 - DNA, 22 bp, Homo sapiens
atccattttaactgttagtgca

SEQ ID NO: 8440332 - DNA, 22 bp, Homo sapiens
atcccatgagaccacgttggct

SEQ ID NO: 8440333 - DNA, 22 bp, Homo sapiens
atcccatttcctagtacatcat

SEQ ID NO: 8440334 - DNA, 22 bp, Homo sapiens
atcccagatagtgaccctcagg

SEQ ID NO: 8440335 - DNA, 22 bp, Homo sapiens
atcccagatggaggctggtcac

SEQ ID NO: 8440336 - DNA, 21 bp, Homo sapiens
atcccagcacccaggagtgca

SEQ ID NO: 8440337 - DNA, 22 bp, Homo sapiens
atcccacctcaatctgaagctc

SEQ ID NO: 8440338 - DNA, 22 bp, Homo sapiens
atccattttttcagaatgctct

SEQ ID NO: 8440339 - DNA, 21 bp, Homo sapiens
agaaaaacacgatataagccc

SEQ ID NO: 8440340 - DNA, 23 bp, Homo sapiens
agaaaaacaggattgtgttccta

SEQ ID NO: 8440341 - DNA, 23 bp, Homo sapiens
agaaaaacaggattgtgttccta

SEQ ID NO: 8440342 - DNA, 23 bp, Homo sapiens
agaaaaacaggattgtgttccta

SEQ ID NO: 8440343 - DNA, 21 bp, Homo sapiens
agaaaaacacgatataagccc

SEQ ID NO: 8440344 - DNA, 21 bp, Homo sapiens
agaaaaacacgatataagccc

SEQ ID NO: 8440345 - DNA, 21 bp, Homo sapiens
agaaaaacacgatataagccc

SEQ ID NO: 8440346 - DNA, 22 bp, Homo sapiens
actttttacagggtgtatacca

SEQ ID NO: 8440347 - DNA, 22 bp, Homo sapiens
agaaaaacacaatcgggcctcc

SEQ ID NO: 8440348 - DNA, 22 bp, Homo sapiens
agaaaaacacaatcgggcctcc

SEQ ID NO: 8440349 - DNA, 22 bp, Homo sapiens
actttttacagggtgtatacca

SEQ ID NO: 8440350 - DNA, 22 bp, Homo sapiens
actttttacagggtgtatacca

SEQ ID NO: 8440351 - DNA, 22 bp, Homo sapiens
acttttgaggactttattgtat

SEQ ID NO: 8440352 - DNA, 21 bp, Homo sapiens
atatttctcataaggttatgg

SEQ ID NO: 8440353 - DNA, 22 bp, Homo sapiens
agaaaaagtcaaggaattggac

SEQ ID NO: 8440354 - DNA, 19 bp, Homo sapiens
agaaaaactggtactgctg

SEQ ID NO: 8440355 - DNA, 22 bp, Homo sapiens
agaaaaactaagagtgggtggt

SEQ ID NO: 8440356 - DNA, 19 bp, Homo sapiens
agaaaaactggtactgctg

SEQ ID NO: 8440357 - DNA, 21 bp, Homo sapiens
agaaaaaccagcatgttttca

SEQ ID NO: 8440358 - DNA, 21 bp, Homo sapiens
agaaaaaccagcatgttttca

SEQ ID NO: 8440359 - DNA, 21 bp, Homo sapiens
agaaaaaccagcatgttttca

SEQ ID NO: 8440360 - DNA, 21 bp, Homo sapiens
agaaaaaccagcatgttttca

SEQ ID NO: 8440361 - DNA, 22 bp, Homo sapiens
agaaaaactaagagtgggtggt

SEQ ID NO: 8440362 - DNA, 22 bp, Homo sapiens
atatttttccatgtgggactct

SEQ ID NO: 8440363 - DNA, 21 bp, Homo sapiens
atatttttgtttggactgtca

SEQ ID NO: 8440364 - DNA, 22 bp, Homo sapiens
atcaaaaccttgacttttaatg

SEQ ID NO: 8440365 - DNA, 22 bp, Homo sapiens
atcaaaaccttgacttttaatg

SEQ ID NO: 8440366 - DNA, 21 bp, Homo sapiens
atatttttgtttggactgtca

SEQ ID NO: 8440367 - DNA, 22 bp, Homo sapiens
atattttgtaacttggaatagg

SEQ ID NO: 8440368 - DNA, 22 bp, Homo sapiens
agaaagcaccctgcactttctg

SEQ ID NO: 8440369 - DNA, 22 bp, Homo sapiens
agaaagcacgggccccaggctc

SEQ ID NO: 8440370 - DNA, 22 bp, Homo sapiens
agaaagcacgggccccaggctc

SEQ ID NO: 8440371 - DNA, 22 bp, Homo sapiens
atcagcaatcaaattgcagagt

SEQ ID NO: 8440372 - DNA, 22 bp, Homo sapiens
atcagcaatctcgtgtattagg

SEQ ID NO: 8440373 - DNA, 22 bp, Homo sapiens
agaaagcccacccagaagatgt

SEQ ID NO: 8440374 - DNA, 22 bp, Homo sapiens
agaaagcctcaatcttcaggcc

SEQ ID NO: 8440375 - DNA, 22 bp, Homo sapiens
agaaagcactctgtcttttacc

SEQ ID NO: 8440376 - DNA, 22 bp, Homo sapiens
atcagtgctgggagatgtcaga

SEQ ID NO: 8440377 - DNA, 22 bp, Homo sapiens
atcagtatacaggggacattca

SEQ ID NO: 8440378 - DNA, 22 bp, Homo sapiens
atcagtctgtgttagaaaagag

SEQ ID NO: 8440379 - DNA, 22 bp, Homo sapiens
atcagtctgttggaatatcgct

SEQ ID NO: 8440380 - DNA, 22 bp, Homo sapiens
atcagtctgttggaatatcgct

SEQ ID NO: 8440381 - DNA, 22 bp, Homo sapiens
agaaatcatgtcttatttctat

SEQ ID NO: 8440382 - DNA, 22 bp, Homo sapiens
agaaatcatgactaagagcagt

SEQ ID NO: 8440383 - DNA, 22 bp, Homo sapiens
agaaatcattcccaaacccata

SEQ ID NO: 8440384 - DNA, 22 bp, Homo sapiens
agaaatcatgtcttatttctat

SEQ ID NO: 8440385 - DNA, 22 bp, Homo sapiens
agaaatcatgtcttatttctat

SEQ ID NO: 8440386 - DNA, 22 bp, Homo sapiens
atacacattactttctgtctga

SEQ ID NO: 8440387 - DNA, 20 bp, Homo sapiens
atacacattcatagaaaaat

SEQ ID NO: 8440388 - DNA, 22 bp, Homo sapiens
atacacatgttattgtggaagc

SEQ ID NO: 8440389 - DNA, 22 bp, Homo sapiens
atacacattactttctgtctga

SEQ ID NO: 8440390 - DNA, 22 bp, Homo sapiens
atacacatgttattgtggaagc

SEQ ID NO: 8440391 - DNA, 22 bp, Homo sapiens
atacacatgtgtatgtgcatgc

SEQ ID NO: 8440392 - DNA, 22 bp, Homo sapiens
atacacatgtgtatgtgcatgc

SEQ ID NO: 8440393 - DNA, 22 bp, Homo sapiens
atacacatgcacacatgtgtgt

SEQ ID NO: 8440394 - DNA, 22 bp, Homo sapiens
ctggcacagagtgagcattcaa

SEQ ID NO: 8440395 - DNA, 22 bp, Homo sapiens
ctggcacaactccacctcagcg

SEQ ID NO: 8440396 - DNA, 22 bp, Homo sapiens
atacatgtaactgcattgtaat

SEQ ID NO: 8440397 - DNA, 22 bp, Homo sapiens
ctggcacagttaacatatgcta

SEQ ID NO: 8440398 - DNA, 22 bp, Homo sapiens
atacatgtgtccctgatttatt

SEQ ID NO: 8440399 - DNA, 22 bp, Homo sapiens
ctggcagcttagcactctggtt

SEQ ID NO: 8440400 - DNA, 22 bp, Homo sapiens
ctggcagcttagcactctggtt

SEQ ID NO: 8440401 - DNA, 22 bp, Homo sapiens
atacatgtgtgagcgaagatgt

SEQ ID NO: 8440402 - DNA, 22 bp, Homo sapiens
atacatgtgtgtgcatacatgt

SEQ ID NO: 8440403 - DNA, 22 bp, Homo sapiens
atacatgtcatcatatgtttgt

SEQ ID NO: 8440404 - DNA, 22 bp, Homo sapiens
ctggcctcagagggtcatggtg

SEQ ID NO: 8440405 - DNA, 22 bp, Homo sapiens
ctggcctcatagccaagctgtg

SEQ ID NO: 8440406 - DNA, 23 bp, Homo sapiens
ctggcctccgacactggccaaga

SEQ ID NO: 8440407 - DNA, 22 bp, Homo sapiens
ctggcctcacagaggctaagcc

SEQ ID NO: 8440408 - DNA, 22 bp, Homo sapiens
ctggcctaggaatggttttccg

SEQ ID NO: 8440409 - DNA, 22 bp, Homo sapiens
ctggcctaaaaatacagaacaa

SEQ ID NO: 8440410 - DNA, 20 bp, Homo sapiens
ctggccagaacgcctacaca

SEQ ID NO: 8440411 - DNA, 22 bp, Homo sapiens
ctggccagactacacatgtgtg

SEQ ID NO: 8440412 - DNA, 22 bp, Homo sapiens
ctggccagaagcacctttggcg

SEQ ID NO: 8440413 - DNA, 22 bp, Homo sapiens
ctggcaggttatagagctgccc

SEQ ID NO: 8440414 - DNA, 22 bp, Homo sapiens
ctggcaggtggaggttgcagtg

SEQ ID NO: 8440415 - DNA, 22 bp, Homo sapiens
ctggcaggtggaggttgcagtg

SEQ ID NO: 8440416 - DNA, 22 bp, Homo sapiens
ctggcaggtggaggttgcagtg

SEQ ID NO: 8440417 - DNA, 22 bp, Homo sapiens
ctggcaggtggaggttgcagtg

SEQ ID NO: 8440418 - DNA, 22 bp, Homo sapiens
ctggcaggtggatggggactcc

SEQ ID NO: 8440419 - DNA, 22 bp, Homo sapiens
ctggcaggtccagctggactca

SEQ ID NO: 8440420 - DNA, 22 bp, Homo sapiens
ctggcaggtccagctggactca

SEQ ID NO: 8440421 - DNA, 22 bp, Homo sapiens
ctggcaggtctcgctgacgtgt

SEQ ID NO: 8440422 - DNA, 22 bp, Homo sapiens
ctggcaggtctcgctgacgtgt

SEQ ID NO: 8440423 - DNA, 22 bp, Homo sapiens
ctggcaggtttggtgtctggtg

SEQ ID NO: 8440424 - DNA, 22 bp, Homo sapiens
ctggcaggtttggtgtctggtg

SEQ ID NO: 8440425 - DNA, 22 bp, Homo sapiens
ctggcaggtttggtgtctggtg

SEQ ID NO: 8440426 - DNA, 22 bp, Homo sapiens
ctggcaggttatagagctgccc

SEQ ID NO: 8440427 - DNA, 22 bp, Homo sapiens
ctggcaggttatagagctgccc

SEQ ID NO: 8440428 - DNA, 22 bp, Homo sapiens
ctggccactgcgggcctctgcc

SEQ ID NO: 8440429 - DNA, 22 bp, Homo sapiens
ctggccactggaggtggcaccc

SEQ ID NO: 8440430 - DNA, 22 bp, Homo sapiens
ctggccactggtggtcataggc

SEQ ID NO: 8440431 - DNA, 22 bp, Homo sapiens
atatacatgggaatatgtggag

SEQ ID NO: 8440432 - DNA, 22 bp, Homo sapiens
atatacttccccattatggggg

SEQ ID NO: 8440433 - DNA, 22 bp, Homo sapiens
ctgggagaggctgctccgctct

SEQ ID NO: 8440434 - DNA, 22 bp, Homo sapiens
ctgggagaggaacctcgagggt

SEQ ID NO: 8440435 - DNA, 22 bp, Homo sapiens
ctgggagaggaacctcgagggt

SEQ ID NO: 8440436 - DNA, 22 bp, Homo sapiens
ctggctgcaaaatctattcact

SEQ ID NO: 8440437 - DNA, 22 bp, Homo sapiens
atataatagtttcataaaggct

SEQ ID NO: 8440438 - DNA, 19 bp, Homo sapiens
ctggctgcaatgccagggt

SEQ ID NO: 8440439 - DNA, 22 bp, Homo sapiens
atatacacatttgcttatgtgt

SEQ ID NO: 8440440 - DNA, 22 bp, Homo sapiens
atatacacatgtgtatacattt

SEQ ID NO: 8440441 - DNA, 22 bp, Homo sapiens
atatacaggtggtatgtgtaaa

SEQ ID NO: 8440442 - DNA, 22 bp, Homo sapiens
atatacaggtggtatgtgtaaa

SEQ ID NO: 8440443 - DNA, 22 bp, Homo sapiens
atatacactccactgatacagg

SEQ ID NO: 8440444 - DNA, 22 bp, Homo sapiens
atatacactccactgatacagg

SEQ ID NO: 8440445 - DNA, 22 bp, Homo sapiens
atataaagaagtggaaaatgag

SEQ ID NO: 8440446 - DNA, 23 bp, Homo sapiens
atataaacaccagatagattgta

SEQ ID NO: 8440447 - DNA, 22 bp, Homo sapiens
atagttttatagatattgtgta

SEQ ID NO: 8440448 - DNA, 22 bp, Homo sapiens
atagtttgtgaaacacagcagt

SEQ ID NO: 8440449 - DNA, 22 bp, Homo sapiens
atagttttctatgcactgttat

SEQ ID NO: 8440450 - DNA, 22 bp, Homo sapiens
atagttttctatgcactgttat

SEQ ID NO: 8440451 - DNA, 23 bp, Homo sapiens
atataaacaccagatagattgta

SEQ ID NO: 8440452 - DNA, 23 bp, Homo sapiens
atataaacaccagatagattgta

SEQ ID NO: 8440453 - DNA, 22 bp, Homo sapiens
ctggctctttcagccgctggag

SEQ ID NO: 8440454 - DNA, 22 bp, Homo sapiens
ctggctctttcctagctaggct

SEQ ID NO: 8440455 - DNA, 22 bp, Homo sapiens
ctggcctttagccccagtgtct

SEQ ID NO: 8440456 - DNA, 22 bp, Homo sapiens
ctggcctttcgtgagagctggg

SEQ ID NO: 8440457 - DNA, 22 bp, Homo sapiens
ctggccttttgtttctggagaa

SEQ ID NO: 8440458 - DNA, 19 bp, Homo sapiens
ctggcctgtgtcctgtgct

SEQ ID NO: 8440459 - DNA, 22 bp, Homo sapiens
ctggcctgtgggctgtctccgg

SEQ ID NO: 8440460 - DNA, 22 bp, Homo sapiens
ctggcctcggcagcaggaacag

SEQ ID NO: 8440461 - DNA, 22 bp, Homo sapiens
ctggctcaatttgtactgctgt

SEQ ID NO: 8440462 - DNA, 22 bp, Homo sapiens
ctggctatgtggttagacataa

SEQ ID NO: 8440463 - DNA, 22 bp, Homo sapiens
ctggctagcacctcagctcaga

SEQ ID NO: 8440464 - DNA, 21 bp, Homo sapiens
atagtttggagtgggaaagtc

SEQ ID NO: 8440465 - DNA, 22 bp, Homo sapiens
ctggctcacaggtgagatgcat

SEQ ID NO: 8440466 - DNA, 22 bp, Homo sapiens
atacacatatgtgtgtatatgt

SEQ ID NO: 8440467 - DNA, 20 bp, Homo sapiens
atacacatattcttgcaact

SEQ ID NO: 8440468 - DNA, 20 bp, Homo sapiens
atacacatattcttgcaact

SEQ ID NO: 8440469 - DNA, 15 bp, Homo sapiens
atacacatgagggag

SEQ ID NO: 8440470 - DNA, 22 bp, Homo sapiens
atacacatctatttaagagaca

SEQ ID NO: 8440471 - DNA, 20 bp, Homo sapiens
atacacatgcagacagatgc

SEQ ID NO: 8440472 - DNA, 22 bp, Homo sapiens
atacacatgcacacatgtgtgt

SEQ ID NO: 8440473 - DNA, 19 bp, Homo sapiens
atacacatacgtaaactga

SEQ ID NO: 8440474 - DNA, 21 bp, Homo sapiens
atacacatacacataaatgtg

SEQ ID NO: 8440475 - DNA, 22 bp, Homo sapiens
atacacatatatacacgtttaa

SEQ ID NO: 8440476 - DNA, 22 bp, Homo sapiens
atacacatatcaggtgtataca

SEQ ID NO: 8440477 - DNA, 22 bp, Homo sapiens
atacacatatatacacgtttaa

SEQ ID NO: 8440478 - DNA, 21 bp, Homo sapiens
atacacatacacataaatgtg

SEQ ID NO: 8440479 - DNA, 22 bp, Homo sapiens
atacaagttgcccaaatgatta

SEQ ID NO: 8440480 - DNA, 22 bp, Homo sapiens
ctgctggggtcagagcactggg

SEQ ID NO: 8440481 - DNA, 22 bp, Homo sapiens
ctgctgggggacacaggtccgg

SEQ ID NO: 8440482 - DNA, 22 bp, Homo sapiens
ctgctgtggatgcaggacctca

SEQ ID NO: 8440483 - DNA, 22 bp, Homo sapiens
ctgctgtgcagacagactctct

SEQ ID NO: 8440484 - DNA, 22 bp, Homo sapiens
ctgctgtgcaggtgcctatgat

SEQ ID NO: 8440485 - DNA, 22 bp, Homo sapiens
ctgctgtggccagccaggtcaa

SEQ ID NO: 8440486 - DNA, 22 bp, Homo sapiens
ctgctgtggccagccaggtcaa

SEQ ID NO: 8440487 - DNA, 21 bp, Homo sapiens
ctgctgtggcccccgacatgc

SEQ ID NO: 8440488 - DNA, 22 bp, Homo sapiens
ctgctgggcctggtctctgagg

SEQ ID NO: 8440489 - DNA, 19 bp, Homo sapiens
ctgctcaggtcagtctgtc

SEQ ID NO: 8440490 - DNA, 19 bp, Homo sapiens
ctgctcagagcagctccag

SEQ ID NO: 8440491 - DNA, 19 bp, Homo sapiens
ctgctcagagcagctccag

SEQ ID NO: 8440492 - DNA, 20 bp, Homo sapiens
ctgctcagaccaactcttct

SEQ ID NO: 8440493 - DNA, 19 bp, Homo sapiens
ctgctcagagcagctccag

SEQ ID NO: 8440494 - DNA, 22 bp, Homo sapiens
ctgctcagaggaaggaatgtct

SEQ ID NO: 8440495 - DNA, 19 bp, Homo sapiens
ctgctcagagcagctccag

SEQ ID NO: 8440496 - DNA, 19 bp, Homo sapiens
ctgctcaggtcagtctgtc

SEQ ID NO: 8440497 - DNA, 22 bp, Homo sapiens
ctgctcagcggaaggaagagcg

SEQ ID NO: 8440498 - DNA, 22 bp, Homo sapiens
ctgctcagcggaaggaagagcg

SEQ ID NO: 8440499 - DNA, 22 bp, Homo sapiens
ctgctaaacctctctgagagct

SEQ ID NO: 8440500 - DNA, 22 bp, Homo sapiens
ctgctacaccggaatagtgaca

SEQ ID NO: 8440501 - DNA, 22 bp, Homo sapiens
ctgcctgtgccaatgctccttt

SEQ ID NO: 8440502 - DNA, 22 bp, Homo sapiens
ctgcctgtgccaatgctccttt

SEQ ID NO: 8440503 - DNA, 22 bp, Homo sapiens
ctgcctgtattgtctgcttggg

SEQ ID NO: 8440504 - DNA, 22 bp, Homo sapiens
ctgcctgtattgtctgcttggg

SEQ ID NO: 8440505 - DNA, 22 bp, Homo sapiens
ctgcctgtaactttctgaagca

SEQ ID NO: 8440506 - DNA, 22 bp, Homo sapiens
ctgcctggtgcggtgcccaccc

SEQ ID NO: 8440507 - DNA, 22 bp, Homo sapiens
ctgcctgtgatttttctctagt

SEQ ID NO: 8440508 - DNA, 22 bp, Homo sapiens
ctgcctgtgaacatactggggg

SEQ ID NO: 8440509 - DNA, 22 bp, Homo sapiens
ctgcctggtctcaggcatgggg

SEQ ID NO: 8440510 - DNA, 22 bp, Homo sapiens
ctgcctggtctcaggcatgggg

SEQ ID NO: 8440511 - DNA, 22 bp, Homo sapiens
ctgcctgggttcaagtcctgtt

SEQ ID NO: 8440512 - DNA, 22 bp, Homo sapiens
ctgcctgggttcaagtcctgtt

SEQ ID NO: 8440513 - DNA, 22 bp, Homo sapiens
ctgcctggaaggagcaagggga

SEQ ID NO: 8440514 - DNA, 22 bp, Homo sapiens
ataaagctttgaaatggagata

SEQ ID NO: 8440515 - DNA, 22 bp, Homo sapiens
ataaaaggaaagcctgttgtga

SEQ ID NO: 8440516 - DNA, 22 bp, Homo sapiens
ataaaaccaaagcagcagtgtt

SEQ ID NO: 8440517 - DNA, 22 bp, Homo sapiens
ataaaacttattagaattgtgt

SEQ ID NO: 8440518 - DNA, 22 bp, Homo sapiens
agttttgtaattctcaaaaata

SEQ ID NO: 8440519 - DNA, 22 bp, Homo sapiens
agttcttattgaatagaaatca

SEQ ID NO: 8440520 - DNA, 21 bp, Homo sapiens
agttctgttatgctggactca

SEQ ID NO: 8440521 - DNA, 22 bp, Homo sapiens
agttctgttgtctagggaagcc

SEQ ID NO: 8440522 - DNA, 22 bp, Homo sapiens
ataaaaaggacagatgtggtct

SEQ ID NO: 8440523 - DNA, 22 bp, Homo sapiens
ataaaaaggacagatgtggtct

SEQ ID NO: 8440524 - DNA, 22 bp, Homo sapiens
ataaaaaggacagatgtggtct

SEQ ID NO: 8440525 - DNA, 22 bp, Homo sapiens
ataaaaatgagggcggtagcta

SEQ ID NO: 8440526 - DNA, 23 bp, Homo sapiens
agttctcattcatcacggcctat

SEQ ID NO: 8440527 - DNA, 22 bp, Homo sapiens
agttctaagtaaatattttata

SEQ ID NO: 8440528 - DNA, 22 bp, Homo sapiens
agttctgtggctgtgccctgta

SEQ ID NO: 8440529 - DNA, 22 bp, Homo sapiens
ctgcagggaactgaggcccaga

SEQ ID NO: 8440530 - DNA, 22 bp, Homo sapiens
ctgcagggaactgaggcccaga

SEQ ID NO: 8440531 - DNA, 22 bp, Homo sapiens
ctgcagggaactgaggcccaga

SEQ ID NO: 8440532 - DNA, 22 bp, Homo sapiens
ctgcaggcttccagggctgtgg

SEQ ID NO: 8440533 - DNA, 22 bp, Homo sapiens
ctgcaggctgagcgcctgccgg

SEQ ID NO: 8440534 - DNA, 22 bp, Homo sapiens
ctgcaggctgagcgcctgccgg

SEQ ID NO: 8440535 - DNA, 22 bp, Homo sapiens
ctgcagggagaggggacagcct

SEQ ID NO: 8440536 - DNA, 22 bp, Homo sapiens
ctgcagggacccaagtctttgg

SEQ ID NO: 8440537 - DNA, 22 bp, Homo sapiens
ctgcagggacccaagtctttgg

SEQ ID NO: 8440538 - DNA, 22 bp, Homo sapiens
ctgcagggaccacaagcaggtt

SEQ ID NO: 8440539 - DNA, 22 bp, Homo sapiens
ctgcagggaccacaagcaggtt

SEQ ID NO: 8440540 - DNA, 22 bp, Homo sapiens
ctgcagggaccacaagcaggtt

SEQ ID NO: 8440541 - DNA, 22 bp, Homo sapiens
ctgcagggagaggggacagcct

SEQ ID NO: 8440542 - DNA, 22 bp, Homo sapiens
ctgcagggagaggggacagcct

SEQ ID NO: 8440543 - DNA, 21 bp, Homo sapiens
ataaactgcatcaagttggtg

SEQ ID NO: 8440544 - DNA, 22 bp, Homo sapiens
ataaactgggtatcaagaggcc

SEQ ID NO: 8440545 - DNA, 22 bp, Homo sapiens
ataaactgaagggaacactgag

SEQ ID NO: 8440546 - DNA, 22 bp, Homo sapiens
ataaactcatgctgaaaaccca

SEQ ID NO: 8440547 - DNA, 22 bp, Homo sapiens
ataaagcaatagattgtgtaat

SEQ ID NO: 8440548 - DNA, 22 bp, Homo sapiens
ataaagcatctagtctgtcact

SEQ ID NO: 8440549 - DNA, 22 bp, Homo sapiens
ataaagcatactttgtatgact

SEQ ID NO: 8440550 - DNA, 22 bp, Homo sapiens
ataaagcatttcccctgtgtgg

SEQ ID NO: 8440551 - DNA, 22 bp, Homo sapiens
ataaagacatgcttacttgccc

SEQ ID NO: 8440552 - DNA, 21 bp, Homo sapiens
ataaagacaaacactatttgg

SEQ ID NO: 8440553 - DNA, 22 bp, Homo sapiens
ataaactggtaggaaaacagta

SEQ ID NO: 8440554 - DNA, 23 bp, Homo sapiens
ataaactgtcaaaagccagccct

SEQ ID NO: 8440555 - DNA, 22 bp, Homo sapiens
ataaactgtgctggatgatgag

SEQ ID NO: 8440556 - DNA, 22 bp, Homo sapiens
atcagctgctacattggcctct

SEQ ID NO: 8440557 - DNA, 22 bp, Homo sapiens
atcaggaaagaaaagcttggcg

SEQ ID NO: 8440558 - DNA, 22 bp, Homo sapiens
ctgtctagttaggatgccagca

SEQ ID NO: 8440559 - DNA, 19 bp, Homo sapiens
ctgtccttggctgcactgt

SEQ ID NO: 8440560 - DNA, 21 bp, Homo sapiens
ctgtcgcaggtcgccccaccc

SEQ ID NO: 8440561 - DNA, 22 bp, Homo sapiens
ctgtctcctccactgcatggga

SEQ ID NO: 8440562 - DNA, 22 bp, Homo sapiens
ctgtctccgccctcttggtagg

SEQ ID NO: 8440563 - DNA, 22 bp, Homo sapiens
atcatacactcacataaacaga

SEQ ID NO: 8440564 - DNA, 22 bp, Homo sapiens
atcataagacccagccagtatt

SEQ ID NO: 8440565 - DNA, 22 bp, Homo sapiens
atcataaagtgctatctgattg

SEQ ID NO: 8440566 - DNA, 22 bp, Homo sapiens
atcataaaccactttgtaatct

SEQ ID NO: 8440567 - DNA, 22 bp, Homo sapiens
atcataaagtgctatctgattg

SEQ ID NO: 8440568 - DNA, 22 bp, Homo sapiens
atcataaaccactttgtaatct

SEQ ID NO: 8440569 - DNA, 22 bp, Homo sapiens
atcagtttatacttataaatct

SEQ ID NO: 8440570 - DNA, 22 bp, Homo sapiens
atcataaaattgcaccatttct

SEQ ID NO: 8440571 - DNA, 22 bp, Homo sapiens
ctgtaacttagcatggttacta

SEQ ID NO: 8440572 - DNA, 22 bp, Homo sapiens
ctgtaacttaatgagaggcaga

SEQ ID NO: 8440573 - DNA, 22 bp, Homo sapiens
ctgtaactctgccaagaaggct

SEQ ID NO: 8440574 - DNA, 22 bp, Homo sapiens
ctgtaacagctgtcagagcagg

SEQ ID NO: 8440575 - DNA, 22 bp, Homo sapiens
ctgtaatcccagctacctggga

SEQ ID NO: 8440576 - DNA, 22 bp, Homo sapiens
ctgtaatcccagctacctggga

SEQ ID NO: 8440577 - DNA, 22 bp, Homo sapiens
ctgtaagggcctgactaccctg

SEQ ID NO: 8440578 - DNA, 22 bp, Homo sapiens
ctgtaatcccagctactcggga

SEQ ID NO: 8440579 - DNA, 22 bp, Homo sapiens
ctgtaatcccagctactcggga

SEQ ID NO: 8440580 - DNA, 22 bp, Homo sapiens
ctgtaatcccagctactcggga

SEQ ID NO: 8440581 - DNA, 22 bp, Homo sapiens
atcagagccttatgcttctcat

SEQ ID NO: 8440582 - DNA, 22 bp, Homo sapiens
atcagagctagtacttgcaggt

SEQ ID NO: 8440583 - DNA, 22 bp, Homo sapiens
atcagagccctgatgacagact

SEQ ID NO: 8440584 - DNA, 22 bp, Homo sapiens
atcagagccttatgcttctcat

SEQ ID NO: 8440585 - DNA, 22 bp, Homo sapiens
atcagagccttatgcttctcat

SEQ ID NO: 8440586 - DNA, 22 bp, Homo sapiens
atcagagcccggcaatttattt

SEQ ID NO: 8440587 - DNA, 22 bp, Homo sapiens
atcagagcccggcaatttattt

SEQ ID NO: 8440588 - DNA, 22 bp, Homo sapiens
atcagagccctgatgacagact

SEQ ID NO: 8440589 - DNA, 22 bp, Homo sapiens
ctgtaatcccagctacctggga

SEQ ID NO: 8440590 - DNA, 22 bp, Homo sapiens
atcagcagatgctcaatgaaca

SEQ ID NO: 8440591 - DNA, 22 bp, Homo sapiens
atcagagctagtacttgcaggt

SEQ ID NO: 8440592 - DNA, 22 bp, Homo sapiens
atcagagctagtacttgcaggt

SEQ ID NO: 8440593 - DNA, 22 bp, Homo sapiens
atcagagctgcattttagagcc

SEQ ID NO: 8440594 - DNA, 22 bp, Homo sapiens
atcagcagtgagtggctttcat

SEQ ID NO: 8440595 - DNA, 22 bp, Homo sapiens
atcagcaggtgctggtggagac

SEQ ID NO: 8440596 - DNA, 22 bp, Homo sapiens
atcacaatgtacgttaaaatgt

SEQ ID NO: 8440597 - DNA, 22 bp, Homo sapiens
atcacaaaggtctcagagcaca

SEQ ID NO: 8440598 - DNA, 22 bp, Homo sapiens
atcacaaaggctgcttcatgat

SEQ ID NO: 8440599 - DNA, 22 bp, Homo sapiens
atcaagaattgggagctattga

SEQ ID NO: 8440600 - DNA, 22 bp, Homo sapiens
atcacaaagggttttctctgag

SEQ ID NO: 8440601 - DNA, 22 bp, Homo sapiens
atattcactgagcataaagcca

SEQ ID NO: 8440602 - DNA, 18 bp, Homo sapiens
ctgggtctccaggctgcc

SEQ ID NO: 8440603 - DNA, 22 bp, Homo sapiens
atattcactcctggtgagacta

SEQ ID NO: 8440604 - DNA, 23 bp, Homo sapiens
atattcacgccgccagaggtccc

SEQ ID NO: 8440605 - DNA, 22 bp, Homo sapiens
atattcacagtaagtgtagcag

SEQ ID NO: 8440606 - DNA, 22 bp, Homo sapiens
atattattctagtaacagtgat

SEQ ID NO: 8440607 - DNA, 22 bp, Homo sapiens
atattattctagtaacagtgat

SEQ ID NO: 8440608 - DNA, 22 bp, Homo sapiens
atattattttccctggagttgt

SEQ ID NO: 8440609 - DNA, 22 bp, Homo sapiens
atattcaaattacatttactaa

SEQ ID NO: 8440610 - DNA, 22 bp, Homo sapiens
ctgggtggcgtctggggccagt

SEQ ID NO: 8440611 - DNA, 22 bp, Homo sapiens
ctggtcagggctctttgggagc

SEQ ID NO: 8440612 - DNA, 22 bp, Homo sapiens
ctggtccctgtaggtatttgac

SEQ ID NO: 8440613 - DNA, 22 bp, Homo sapiens
ctggtccctgcagtgtgctggg

SEQ ID NO: 8440614 - DNA, 22 bp, Homo sapiens
ctggtcccagcagagctctgag

SEQ ID NO: 8440615 - DNA, 22 bp, Homo sapiens
ctggtccccagactgggcttag

SEQ ID NO: 8440616 - DNA, 22 bp, Homo sapiens
atattattctagtaacagtgat

SEQ ID NO: 8440617 - DNA, 22 bp, Homo sapiens
ctgggggcaatggtcagagtgt

SEQ ID NO: 8440618 - DNA, 22 bp, Homo sapiens
atattattctagctcttgtgtg

SEQ ID NO: 8440619 - DNA, 22 bp, Homo sapiens
ctgggggcaatggtcagagtgt

SEQ ID NO: 8440620 - DNA, 22 bp, Homo sapiens
ctgggggcaatggtcagagtgt

SEQ ID NO: 8440621 - DNA, 22 bp, Homo sapiens
ctgggggcaagcagacagctgt

SEQ ID NO: 8440622 - DNA, 22 bp, Homo sapiens
ctgggggcaagcagacagctgt

SEQ ID NO: 8440623 - DNA, 19 bp, Homo sapiens
ctggggctttggtactgcc

SEQ ID NO: 8440624 - DNA, 19 bp, Homo sapiens
ctggggctttggtactgcc

SEQ ID NO: 8440625 - DNA, 19 bp, Homo sapiens
ctgggaggtgttcagagaa

SEQ ID NO: 8440626 - DNA, 23 bp, Homo sapiens
ctggggctttcaaatctgggcag

SEQ ID NO: 8440627 - DNA, 22 bp, Homo sapiens
ctgggaggggtagccaatccta

SEQ ID NO: 8440628 - DNA, 20 bp, Homo sapiens
ctgggaggtcttccaaatca

SEQ ID NO: 8440629 - DNA, 22 bp, Homo sapiens
ctgggaggggtagccaatccta

SEQ ID NO: 8440630 - DNA, 22 bp, Homo sapiens
ctgggaggcggaggttgtagtg

SEQ ID NO: 8440631 - DNA, 22 bp, Homo sapiens
ctgggaggacaacttggagctc

SEQ ID NO: 8440632 - DNA, 22 bp, Homo sapiens
ctgggaggacaacttggagctc

SEQ ID NO: 8440633 - DNA, 22 bp, Homo sapiens
ctgggaggcggaggttgcagtg

SEQ ID NO: 8440634 - DNA, 22 bp, Homo sapiens
ctgggaggcggaggttgcagtg

SEQ ID NO: 8440635 - DNA, 22 bp, Homo sapiens
atccattattgggccaataaag

SEQ ID NO: 8440636 - DNA, 21 bp, Homo sapiens
atccattctccggttaatgag

SEQ ID NO: 8440637 - DNA, 23 bp, Homo sapiens
atccatgtgagaatagactagca

SEQ ID NO: 8440638 - DNA, 22 bp, Homo sapiens
atccattctatgtgaaatgtcc

SEQ ID NO: 8440639 - DNA, 22 bp, Homo sapiens
atccattgtcttgttggcttct

SEQ ID NO: 8440640 - DNA, 22 bp, Homo sapiens
atccattgtggtcttgtacatt

SEQ ID NO: 8440641 - DNA, 22 bp, Homo sapiens
atccatttcagtgttccacttg

SEQ ID NO: 8440642 - DNA, 22 bp, Homo sapiens
atccatttgacataatttcagc

SEQ ID NO: 8440643 - DNA, 22 bp, Homo sapiens
cttaataaatggtagctgttat

SEQ ID NO: 8440644 - DNA, 22 bp, Homo sapiens
cttaataataggtgaggctatg

SEQ ID NO: 8440645 - DNA, 22 bp, Homo sapiens
cttaatctcacctgcaaagtcc

SEQ ID NO: 8440646 - DNA, 22 bp, Homo sapiens
cttaatgaaaggttgcacatgg

SEQ ID NO: 8440647 - DNA, 20 bp, Homo sapiens
atccatcatgtccatgactt

SEQ ID NO: 8440648 - DNA, 22 bp, Homo sapiens
atcatacatgtaactaagtaaa

SEQ ID NO: 8440649 - DNA, 19 bp, Homo sapiens
atcatacatgttacactct

SEQ ID NO: 8440650 - DNA, 22 bp, Homo sapiens
atcatacagaacctgagcactt

SEQ ID NO: 8440651 - DNA, 22 bp, Homo sapiens
atcatcatcaacaagaaacatt

SEQ ID NO: 8440652 - DNA, 22 bp, Homo sapiens
ctgtttctccacactcttccca

SEQ ID NO: 8440653 - DNA, 22 bp, Homo sapiens
ctgtttctccacactcttccca

SEQ ID NO: 8440654 - DNA, 22 bp, Homo sapiens
cttaaattttcatctacaagaa

SEQ ID NO: 8440655 - DNA, 22 bp, Homo sapiens
cttaagaaattgcattctaatc

SEQ ID NO: 8440656 - DNA, 21 bp, Homo sapiens
cttaagatggcatagtacgaa

SEQ ID NO: 8440657 - DNA, 22 bp, Homo sapiens
cttaagattgtcagcttcagcc

SEQ ID NO: 8440658 - DNA, 22 bp, Homo sapiens
cttaagaagcaagtctcagcaa

SEQ ID NO: 8440659 - DNA, 22 bp, Homo sapiens
cttaagaagcaagtctcagcaa

SEQ ID NO: 8440660 - DNA, 22 bp, Homo sapiens
cttaagaatattgaagttgtgg

SEQ ID NO: 8440661 - DNA, 22 bp, Homo sapiens
cttcaagagaatgcagggatgt

SEQ ID NO: 8440662 - DNA, 22 bp, Homo sapiens
cttcaagatatttctagaatca

SEQ ID NO: 8440663 - DNA, 22 bp, Homo sapiens
cttcaagttgtctgagggtggg

SEQ ID NO: 8440664 - DNA, 22 bp, Homo sapiens
cttcaagttgggcggcgggcag

SEQ ID NO: 8440665 - DNA, 22 bp, Homo sapiens
cttcaatttttggtatgatgga

SEQ ID NO: 8440666 - DNA, 22 bp, Homo sapiens
cttcctctcttgcccataagag

SEQ ID NO: 8440667 - DNA, 22 bp, Homo sapiens
cttattcaatgctggaaatgtt

SEQ ID NO: 8440668 - DNA, 22 bp, Homo sapiens
cttatgtataatgttccacata

SEQ ID NO: 8440669 - DNA, 22 bp, Homo sapiens
cttattcatatattctcggtag

SEQ ID NO: 8440670 - DNA, 22 bp, Homo sapiens
cttattcataagtcagacacac

SEQ ID NO: 8440671 - DNA, 22 bp, Homo sapiens
cttattcagaccttggattctt

SEQ ID NO: 8440672 - DNA, 22 bp, Homo sapiens
cttattcagaaggagaaatgga

SEQ ID NO: 8440673 - DNA, 21 bp, Homo sapiens
cttattcactgttatttatca

SEQ ID NO: 8440674 - DNA, 22 bp, Homo sapiens
cttattcagcacttgctctgta

SEQ ID NO: 8440675 - DNA, 22 bp, Homo sapiens
cttattcagatacagactcttg

SEQ ID NO: 8440676 - DNA, 22 bp, Homo sapiens
cttattcagcaagtttgggtac

SEQ ID NO: 8440677 - DNA, 22 bp, Homo sapiens
atctgtaacacacagaggagaa

SEQ ID NO: 8440678 - DNA, 22 bp, Homo sapiens
atctggtatttcctttgatagc

SEQ ID NO: 8440679 - DNA, 22 bp, Homo sapiens
atctgtaaataaaaagggaggt

SEQ ID NO: 8440680 - DNA, 22 bp, Homo sapiens
atctgtaacatcagtagcagaa

SEQ ID NO: 8440681 - DNA, 22 bp, Homo sapiens
atctgtactaattaattaatgt

SEQ ID NO: 8440682 - DNA, 22 bp, Homo sapiens
atctgtacaagattttatgcgt

SEQ ID NO: 8440683 - DNA, 22 bp, Homo sapiens
atctgtagtcactgcacagctc

SEQ ID NO: 8440684 - DNA, 22 bp, Homo sapiens
atctgtagaagatactctgaga

SEQ ID NO: 8440685 - DNA, 22 bp, Homo sapiens
atctgtagaagatactctgaga

SEQ ID NO: 8440686 - DNA, 22 bp, Homo sapiens
cttcttaaagattacacaatga

SEQ ID NO: 8440687 - DNA, 22 bp, Homo sapiens
atctggctcgctaggctctggg

SEQ ID NO: 8440688 - DNA, 22 bp, Homo sapiens
atctggtatgaggttttgcttt

SEQ ID NO: 8440689 - DNA, 22 bp, Homo sapiens
atctgtctggaggcctggcatg

SEQ ID NO: 8440690 - DNA, 22 bp, Homo sapiens
atctgtctggaggcctggcatg

SEQ ID NO: 8440691 - DNA, 22 bp, Homo sapiens
atctgtctatgatatagtctgt

SEQ ID NO: 8440692 - DNA, 22 bp, Homo sapiens
atctgtcttttattcatgagct

SEQ ID NO: 8440693 - DNA, 22 bp, Homo sapiens
atctgtcttttattcatgagct

SEQ ID NO: 8440694 - DNA, 22 bp, Homo sapiens
atctgtggaaaggtaaccagta

SEQ ID NO: 8440695 - DNA, 22 bp, Homo sapiens
atctgtggatatgaccttcctg

SEQ ID NO: 8440696 - DNA, 22 bp, Homo sapiens
atcttatttaacacagcaaaac

SEQ ID NO: 8440697 - DNA, 22 bp, Homo sapiens
atctgttatttacccatctctg

SEQ ID NO: 8440698 - DNA, 22 bp, Homo sapiens
atctgtgtgttcaggaagtcct

SEQ ID NO: 8440699 - DNA, 22 bp, Homo sapiens
atctgtggctggtgagaggcag

SEQ ID NO: 8440700 - DNA, 22 bp, Homo sapiens
atctgtgtatgtgaccttatct

SEQ ID NO: 8440701 - DNA, 22 bp, Homo sapiens
atctgtgtccttataagagaca

SEQ ID NO: 8440702 - DNA, 22 bp, Homo sapiens
atctgtggcgcaaacaaaggct

SEQ ID NO: 8440703 - DNA, 22 bp, Homo sapiens
atctgtggatatgcacagagca

SEQ ID NO: 8440704 - DNA, 22 bp, Homo sapiens
atctgtggccaaaagactgttg

SEQ ID NO: 8440705 - DNA, 22 bp, Homo sapiens
atctgtggaaattggcaagtgc

SEQ ID NO: 8440706 - DNA, 22 bp, Homo sapiens
atctgtggcagtgatgagtctt

SEQ ID NO: 8440707 - DNA, 22 bp, Homo sapiens
atctgtggtcaaaatagaaact

SEQ ID NO: 8440708 - DNA, 22 bp, Homo sapiens
atctccgccatcgcgaacgcct

SEQ ID NO: 8440709 - DNA, 22 bp, Homo sapiens
atctcctaaagtttccagaaga

SEQ ID NO: 8440710 - DNA, 23 bp, Homo sapiens
atctcctgagaacccacagtggt

SEQ ID NO: 8440711 - DNA, 22 bp, Homo sapiens
atctcctcgcaggccagaacac

SEQ ID NO: 8440712 - DNA, 20 bp, Homo sapiens
atctcctgctaccacccatt

SEQ ID NO: 8440713 - DNA, 20 bp, Homo sapiens
atctcctgctaccacccatt

SEQ ID NO: 8440714 - DNA, 22 bp, Homo sapiens
cttctgagaggggctaggagca

SEQ ID NO: 8440715 - DNA, 22 bp, Homo sapiens
atctctagctaaccctctggca

SEQ ID NO: 8440716 - DNA, 23 bp, Homo sapiens
atctctctggtggtcacagtcag

SEQ ID NO: 8440717 - DNA, 22 bp, Homo sapiens
cttctgagggcctttgcttcca

SEQ ID NO: 8440718 - DNA, 22 bp, Homo sapiens
cttctgaggcagctattcagtt

SEQ ID NO: 8440719 - DNA, 22 bp, Homo sapiens
cttctgagcagacctcctgggg

SEQ ID NO: 8440720 - DNA, 22 bp, Homo sapiens
cttctgagatgttgttttacag

SEQ ID NO: 8440721 - DNA, 22 bp, Homo sapiens
cttctgtgttaaatgagtcttt

SEQ ID NO: 8440722 - DNA, 22 bp, Homo sapiens
cttctgtggatgttggatgcat

SEQ ID NO: 8440723 - DNA, 22 bp, Homo sapiens
cttctgtggtaaactttgttgt

SEQ ID NO: 8440724 - DNA, 22 bp, Homo sapiens
cttctgtggatatgttctctct

SEQ ID NO: 8440725 - DNA, 22 bp, Homo sapiens
cttctgtgcttcacagttgcca

SEQ ID NO: 8440726 - DNA, 22 bp, Homo sapiens
cttctgtgctaaatgcaaaacc

SEQ ID NO: 8440727 - DNA, 22 bp, Homo sapiens
ctaggaaagacacagagagttt

SEQ ID NO: 8440728 - DNA, 22 bp, Homo sapiens
ctaggaaagacacagagagttt

SEQ ID NO: 8440729 - DNA, 22 bp, Homo sapiens
ctaggaaatgaatacagtacac

SEQ ID NO: 8440730 - DNA, 22 bp, Homo sapiens
ctaggcacctgggccctgtggc

SEQ ID NO: 8440731 - DNA, 18 bp, Homo sapiens
ctaggcaccaggcacccc

SEQ ID NO: 8440732 - DNA, 22 bp, Homo sapiens
ctaggcacactgggccctttac

SEQ ID NO: 8440733 - DNA, 22 bp, Homo sapiens
agtcacattctggggtactggg

SEQ ID NO: 8440734 - DNA, 22 bp, Homo sapiens
agtcacatgggattagaaccca

SEQ ID NO: 8440735 - DNA, 22 bp, Homo sapiens
agtcacatggactcaggatgac

SEQ ID NO: 8440736 - DNA, 22 bp, Homo sapiens
agtcacatggcagagagaagtt

SEQ ID NO: 8440737 - DNA, 20 bp, Homo sapiens
agtcacattgagcttttgga

SEQ ID NO: 8440738 - DNA, 21 bp, Homo sapiens
agtcacattgggggtttaggg

SEQ ID NO: 8440739 - DNA, 22 bp, Homo sapiens
agtcacatttgggggtgtcaaa

SEQ ID NO: 8440740 - DNA, 23 bp, Homo sapiens
ctagaattttgctaaaagactag

SEQ ID NO: 8440741 - DNA, 22 bp, Homo sapiens
ctagcctgggatttgaacttat

SEQ ID NO: 8440742 - DNA, 22 bp, Homo sapiens
agtcaattcttttcaactcaag

SEQ ID NO: 8440743 - DNA, 22 bp, Homo sapiens
agtcacagaatgatggctccag

SEQ ID NO: 8440744 - DNA, 22 bp, Homo sapiens
agtcacagaaacccaggtgtgg

SEQ ID NO: 8440745 - DNA, 22 bp, Homo sapiens
agtcacagaaacccaggtgtgg

SEQ ID NO: 8440746 - DNA, 22 bp, Homo sapiens
agtcacaggcaagagggctcca

SEQ ID NO: 8440747 - DNA, 19 bp, Homo sapiens
agtcacagaccttgtctcc

SEQ ID NO: 8440748 - DNA, 20 bp, Homo sapiens
agtcacaggcctggaacatg

SEQ ID NO: 8440749 - DNA, 22 bp, Homo sapiens
agtcacaggttcttgggattag

SEQ ID NO: 8440750 - DNA, 22 bp, Homo sapiens
agtcacagggggcccctgcaac

SEQ ID NO: 8440751 - DNA, 22 bp, Homo sapiens
agtcacagttcctacccagtaa

SEQ ID NO: 8440752 - DNA, 20 bp, Homo sapiens
agtcacagtatcagtcttag

SEQ ID NO: 8440753 - DNA, 22 bp, Homo sapiens
agtcacatagctctggtttctt

SEQ ID NO: 8440754 - DNA, 22 bp, Homo sapiens
agtcacagtttccctgagagag

SEQ ID NO: 8440755 - DNA, 22 bp, Homo sapiens
agtcacatagaagtgggtttaa

SEQ ID NO: 8440756 - DNA, 22 bp, Homo sapiens
agtcacagttctgctgtctgag

SEQ ID NO: 8440757 - DNA, 23 bp, Homo sapiens
agtcacatcttagcagccaggtc

SEQ ID NO: 8440758 - DNA, 22 bp, Homo sapiens
agtcacatgagcactaattagg

SEQ ID NO: 8440759 - DNA, 22 bp, Homo sapiens
agtcacatagtgttttggaatc

SEQ ID NO: 8440760 - DNA, 22 bp, Homo sapiens
agtcacatcgattataaaattt

SEQ ID NO: 8440761 - DNA, 22 bp, Homo sapiens
agtcacatgcattttcttcaat

SEQ ID NO: 8440762 - DNA, 22 bp, Homo sapiens
agtcacatgagtttctctttat

SEQ ID NO: 8440763 - DNA, 22 bp, Homo sapiens
agtcacatgaggaaggggaagg

SEQ ID NO: 8440764 - DNA, 20 bp, Homo sapiens
agtcacatgcatacacaagt

SEQ ID NO: 8440765 - DNA, 22 bp, Homo sapiens
agtcacatgatccctgggcctg

SEQ ID NO: 8440766 - DNA, 22 bp, Homo sapiens
ctattgaattaactattaaagt

SEQ ID NO: 8440767 - DNA, 22 bp, Homo sapiens
ctattgaaagtgtacaattcaa

SEQ ID NO: 8440768 - DNA, 22 bp, Homo sapiens
ctatttatctatttctgaatga

SEQ ID NO: 8440769 - DNA, 22 bp, Homo sapiens
ctattgtttctatgctctgagg

SEQ ID NO: 8440770 - DNA, 22 bp, Homo sapiens
ctattgtttctatgctctgagg

SEQ ID NO: 8440771 - DNA, 22 bp, Homo sapiens
ctattgttataattgttgacat

SEQ ID NO: 8440772 - DNA, 22 bp, Homo sapiens
ctatgaccccagcatgaataag

SEQ ID NO: 8440773 - DNA, 22 bp, Homo sapiens
ctatgaaatgtcagattctgca

SEQ ID NO: 8440774 - DNA, 22 bp, Homo sapiens
ctatgaaaggatttggagttgt

SEQ ID NO: 8440775 - DNA, 22 bp, Homo sapiens
ctatctctccacaatgccagtg

SEQ ID NO: 8440776 - DNA, 22 bp, Homo sapiens
ctatctctccacaatgccagtg

SEQ ID NO: 8440777 - DNA, 18 bp, Homo sapiens
ctatccctggagcttggg

SEQ ID NO: 8440778 - DNA, 22 bp, Homo sapiens
ctatctcttgttttcctgaagc

SEQ ID NO: 8440779 - DNA, 22 bp, Homo sapiens
ctatctttcgattctagcttaa

SEQ ID NO: 8440780 - DNA, 22 bp, Homo sapiens
ctatcttttgttcattttgagt

SEQ ID NO: 8440781 - DNA, 22 bp, Homo sapiens
ctatcaaacagccattaatata

SEQ ID NO: 8440782 - DNA, 22 bp, Homo sapiens
ctatatttcttggctttaaaca

SEQ ID NO: 8440783 - DNA, 22 bp, Homo sapiens
agtcaggaagctggagctgggg

SEQ ID NO: 8440784 - DNA, 22 bp, Homo sapiens
agtcagcattttcactgagcta

SEQ ID NO: 8440785 - DNA, 22 bp, Homo sapiens
agtcagctgcagcagctttggt

SEQ ID NO: 8440786 - DNA, 22 bp, Homo sapiens
agtcagcagcctggccaggaga

SEQ ID NO: 8440787 - DNA, 22 bp, Homo sapiens
ctaggcagactgagctctaggg

SEQ ID NO: 8440788 - DNA, 22 bp, Homo sapiens
agtcagcagtgaaagcacagcc

SEQ ID NO: 8440789 - DNA, 22 bp, Homo sapiens
agtcagcagtgaaagcacagcc

SEQ ID NO: 8440790 - DNA, 19 bp, Homo sapiens
agtagcagaaagtgcagtg

SEQ ID NO: 8440791 - DNA, 22 bp, Homo sapiens
agtagcaccagggaagcagggc

SEQ ID NO: 8440792 - DNA, 22 bp, Homo sapiens
agtacatacttcaaatgtactt

SEQ ID NO: 8440793 - DNA, 22 bp, Homo sapiens
agtaacaaatgcatctgggcat

SEQ ID NO: 8440794 - DNA, 22 bp, Homo sapiens
agtaacacttggaatgatagca

SEQ ID NO: 8440795 - DNA, 22 bp, Homo sapiens
agtaacactattttcatatgta

SEQ ID NO: 8440796 - DNA, 22 bp, Homo sapiens
agtagcagtgacagctgaggta

SEQ ID NO: 8440797 - DNA, 22 bp, Homo sapiens
agtagcagtttggctgaattta

SEQ ID NO: 8440798 - DNA, 18 bp, Homo sapiens
agtaggcactgtggggtt

SEQ ID NO: 8440799 - DNA, 22 bp, Homo sapiens
agtcaagattctggcactagca

SEQ ID NO: 8440800 - DNA, 23 bp, Homo sapiens
agtcaagatgcatctgtgaggaa

SEQ ID NO: 8440801 - DNA, 22 bp, Homo sapiens
agtatttctgaatattatcata

SEQ ID NO: 8440802 - DNA, 20 bp, Homo sapiens
agtaggggaatgcaagagca

SEQ ID NO: 8440803 - DNA, 22 bp, Homo sapiens
agtaaacataatttacctgtag

SEQ ID NO: 8440804 - DNA, 22 bp, Homo sapiens
agtaaacagtttcttagaagaa

SEQ ID NO: 8440805 - DNA, 22 bp, Homo sapiens
agtaaacattttcatattttct

SEQ ID NO: 8440806 - DNA, 22 bp, Homo sapiens
agtaaatgaaagcaattttaga

SEQ ID NO: 8440807 - DNA, 21 bp, Homo sapiens
ccttctccattacagtaagct

SEQ ID NO: 8440808 - DNA, 20 bp, Homo sapiens
ccttctccagcttgttcttg

SEQ ID NO: 8440809 - DNA, 22 bp, Homo sapiens
ccttctcccctctgcagggtgt

SEQ ID NO: 8440810 - DNA, 22 bp, Homo sapiens
ccttccagtgactaaggaggaa

SEQ ID NO: 8440811 - DNA, 22 bp, Homo sapiens
ccttccaggttttggctccatt

SEQ ID NO: 8440812 - DNA, 22 bp, Homo sapiens
ccttctctaccatgtgaggaaa

SEQ ID NO: 8440813 - DNA, 22 bp, Homo sapiens
ccttctctactcctgatgcatg

SEQ ID NO: 8440814 - DNA, 22 bp, Homo sapiens
ccttctccctctgagaggaacc

SEQ ID NO: 8440815 - DNA, 22 bp, Homo sapiens
ccttctcctgccttgggttcat

SEQ ID NO: 8440816 - DNA, 22 bp, Homo sapiens
ccttctctctgaagaccccaaa

SEQ ID NO: 8440817 - DNA, 22 bp, Homo sapiens
aggtaactgtggctaggtaact

SEQ ID NO: 8440818 - DNA, 22 bp, Homo sapiens
aggtaaattcagcagtgacatt

SEQ ID NO: 8440819 - DNA, 22 bp, Homo sapiens
aggtaacactacttagtatact

SEQ ID NO: 8440820 - DNA, 22 bp, Homo sapiens
aggtacagatgaaagtctagtt

SEQ ID NO: 8440821 - DNA, 22 bp, Homo sapiens
aggtcacacaactgtcagaggc

SEQ ID NO: 8440822 - DNA, 22 bp, Homo sapiens
aggtaaacaggagaaaatgaga

SEQ ID NO: 8440823 - DNA, 22 bp, Homo sapiens
agggttctgccagtgtcttgag

SEQ ID NO: 8440824 - DNA, 20 bp, Homo sapiens
agggttcccttgttcagcag

SEQ ID NO: 8440825 - DNA, 22 bp, Homo sapiens
cctgagtcccataatgttgcca

SEQ ID NO: 8440826 - DNA, 22 bp, Homo sapiens
agggtgggctagactcttcccc

SEQ ID NO: 8440827 - DNA, 22 bp, Homo sapiens
cctgagtagctggaattaaagg

SEQ ID NO: 8440828 - DNA, 22 bp, Homo sapiens
aggtcagatgggagatgggatg

SEQ ID NO: 8440829 - DNA, 22 bp, Homo sapiens
aggtcagatgggagatgggatg

SEQ ID NO: 8440830 - DNA, 18 bp, Homo sapiens
aggtcaggaaagcagagt

SEQ ID NO: 8440831 - DNA, 22 bp, Homo sapiens
aggtcaggaggcctctgccatt

SEQ ID NO: 8440832 - DNA, 22 bp, Homo sapiens
aggtcaccatggcatgctccac

SEQ ID NO: 8440833 - DNA, 22 bp, Homo sapiens
aggtcaccatggcatgctccac

SEQ ID NO: 8440834 - DNA, 22 bp, Homo sapiens
aggtcacccgtttgactatcca

SEQ ID NO: 8440835 - DNA, 22 bp, Homo sapiens
aggtcagaagtgccagggaatt

SEQ ID NO: 8440836 - DNA, 22 bp, Homo sapiens
aggtcagaaaaggagagcattg

SEQ ID NO: 8440837 - DNA, 22 bp, Homo sapiens
aggtcaggtatcagcaggtatt

SEQ ID NO: 8440838 - DNA, 22 bp, Homo sapiens
cctgggaggtggaggttgcagc

SEQ ID NO: 8440839 - DNA, 22 bp, Homo sapiens
cctgggaggtggaggttgcagt

SEQ ID NO: 8440840 - DNA, 22 bp, Homo sapiens
cctgggagggcaagtgctgatg

SEQ ID NO: 8440841 - DNA, 21 bp, Homo sapiens
cctgtgccagtctatgtgttc

SEQ ID NO: 8440842 - DNA, 22 bp, Homo sapiens
aggtgcagcatgagtccaacgg

SEQ ID NO: 8440843 - DNA, 22 bp, Homo sapiens
cctgggtacgcagggctcctct

SEQ ID NO: 8440844 - DNA, 22 bp, Homo sapiens
cctgggtcactcaggcaggcgg

SEQ ID NO: 8440845 - DNA, 22 bp, Homo sapiens
cctgggtcactcaggcaggcgg

SEQ ID NO: 8440846 - DNA, 22 bp, Homo sapiens
cctgggtcaccaggcccaggca

SEQ ID NO: 8440847 - DNA, 22 bp, Homo sapiens
cctgggtcaccaggcccaggca

SEQ ID NO: 8440848 - DNA, 22 bp, Homo sapiens
cctgggtccaccctgtgaagta

SEQ ID NO: 8440849 - DNA, 22 bp, Homo sapiens
cctgggtccaattctggcttgt

SEQ ID NO: 8440850 - DNA, 22 bp, Homo sapiens
cctgggtcactcaggcaggcgg

SEQ ID NO: 8440851 - DNA, 22 bp, Homo sapiens
cctgggtccaattctggcttgt

SEQ ID NO: 8440852 - DNA, 22 bp, Homo sapiens
aggtcctggtgaccatggagtt

SEQ ID NO: 8440853 - DNA, 22 bp, Homo sapiens
aggtcctggtgaccatggagtt

SEQ ID NO: 8440854 - DNA, 20 bp, Homo sapiens
aggtcctggttctctgggat

SEQ ID NO: 8440855 - DNA, 22 bp, Homo sapiens
aggtcctgggagttctagtgtg

SEQ ID NO: 8440856 - DNA, 22 bp, Homo sapiens
aggtcctggtcttgagtcttaa

SEQ ID NO: 8440857 - DNA, 20 bp, Homo sapiens
aggtcctgggactggcagag

SEQ ID NO: 8440858 - DNA, 20 bp, Homo sapiens
aggtcctgggactggcagag

SEQ ID NO: 8440859 - DNA, 22 bp, Homo sapiens
aggtcctgggagttctagtgtg

SEQ ID NO: 8440860 - DNA, 22 bp, Homo sapiens
aggtcctggactgctcttgtta

SEQ ID NO: 8440861 - DNA, 22 bp, Homo sapiens
aggtcctgatgatctctgagag

SEQ ID NO: 8440862 - DNA, 22 bp, Homo sapiens
aggtcctgatgatctctgagag

SEQ ID NO: 8440863 - DNA, 23 bp, Homo sapiens
aggtcctggacatatgtgcatca

SEQ ID NO: 8440864 - DNA, 19 bp, Homo sapiens
aggtcctgatcagcaagga

SEQ ID NO: 8440865 - DNA, 22 bp, Homo sapiens
cctggggctctgcacagagcag

SEQ ID NO: 8440866 - DNA, 22 bp, Homo sapiens
cctggggctctgcacagagcag

SEQ ID NO: 8440867 - DNA, 22 bp, Homo sapiens
cctggggctttctttgtatcat

SEQ ID NO: 8440868 - DNA, 22 bp, Homo sapiens
cctggggctctgcacagagcag

SEQ ID NO: 8440869 - DNA, 22 bp, Homo sapiens
cctgggctttgagggcaggatg

SEQ ID NO: 8440870 - DNA, 22 bp, Homo sapiens
cctgggctttgagggcaggatg

SEQ ID NO: 8440871 - DNA, 20 bp, Homo sapiens
aggtcctggttctctgggat

SEQ ID NO: 8440872 - DNA, 22 bp, Homo sapiens
ccttccagaggcgtgacaccct

SEQ ID NO: 8440873 - DNA, 22 bp, Homo sapiens
ccttccagatgtaagagctgat

SEQ ID NO: 8440874 - DNA, 22 bp, Homo sapiens
ccttccaggagtctctgcaggt

SEQ ID NO: 8440875 - DNA, 22 bp, Homo sapiens
aggtggcagagtgacaggctga

SEQ ID NO: 8440876 - DNA, 22 bp, Homo sapiens
aggtggcagagtgacaggctga

SEQ ID NO: 8440877 - DNA, 22 bp, Homo sapiens
aggtggcagcagaatcagggag

SEQ ID NO: 8440878 - DNA, 22 bp, Homo sapiens
aggtggcagatgggggtgctcg

SEQ ID NO: 8440879 - DNA, 22 bp, Homo sapiens
aggtggcagcaggagatgtgga

SEQ ID NO: 8440880 - DNA, 22 bp, Homo sapiens
aggtggcagccgagacataagg

SEQ ID NO: 8440881 - DNA, 22 bp, Homo sapiens
ccttccaaaggagccacatctg

SEQ ID NO: 8440882 - DNA, 22 bp, Homo sapiens
ccttccaagtgctgctttttcc

SEQ ID NO: 8440883 - DNA, 22 bp, Homo sapiens
aggtggcagaggactcctcctg

SEQ ID NO: 8440884 - DNA, 22 bp, Homo sapiens
aggtggcagagctggcccagcg

SEQ ID NO: 8440885 - DNA, 22 bp, Homo sapiens
aggtggcagagctggcccagcg

SEQ ID NO: 8440886 - DNA, 22 bp, Homo sapiens
aggtggcagagctggcccagcg

SEQ ID NO: 8440887 - DNA, 22 bp, Homo sapiens
aggtggcaaggggcgcctctct

SEQ ID NO: 8440888 - DNA, 22 bp, Homo sapiens
cctgtgggcttgagtgtagggt

SEQ ID NO: 8440889 - DNA, 22 bp, Homo sapiens
cctgtgggcgcagctggagtca

SEQ ID NO: 8440890 - DNA, 22 bp, Homo sapiens
agttaaagaaagataattcgcc

SEQ ID NO: 8440891 - DNA, 22 bp, Homo sapiens
agttaaatcattactgacagag

SEQ ID NO: 8440892 - DNA, 22 bp, Homo sapiens
agttaaatcatggccattggaa

SEQ ID NO: 8440893 - DNA, 22 bp, Homo sapiens
agttaaatcatggccattggaa

SEQ ID NO: 8440894 - DNA, 22 bp, Homo sapiens
agttaaatcattactgacagag

SEQ ID NO: 8440895 - DNA, 22 bp, Homo sapiens
agttaacacaagtaagattcca

SEQ ID NO: 8440896 - DNA, 22 bp, Homo sapiens
agttaaatgtgttagccagggt

SEQ ID NO: 8440897 - DNA, 22 bp, Homo sapiens
agttaaatgtgttagccagggt

SEQ ID NO: 8440898 - DNA, 22 bp, Homo sapiens
agttaaatgtcagtagcttaac

SEQ ID NO: 8440899 - DNA, 22 bp, Homo sapiens
agttaaatgtcagtagcttaac

SEQ ID NO: 8440900 - DNA, 22 bp, Homo sapiens
agttaaatcattactgacagag

SEQ ID NO: 8440901 - DNA, 22 bp, Homo sapiens
agttaaatgtcagtagcttaac

SEQ ID NO: 8440902 - DNA, 22 bp, Homo sapiens
agtgttttattagaacacagcc

SEQ ID NO: 8440903 - DNA, 22 bp, Homo sapiens
agtgttttattagaacacagcc

SEQ ID NO: 8440904 - DNA, 22 bp, Homo sapiens
agtgtttttcaggagcagaaca

SEQ ID NO: 8440905 - DNA, 20 bp, Homo sapiens
agtgtttgctcacagtctcc

SEQ ID NO: 8440906 - DNA, 22 bp, Homo sapiens
agtgtttcaccgtatgttctca

SEQ ID NO: 8440907 - DNA, 17 bp, Homo sapiens
agtgtggccctggttaa

SEQ ID NO: 8440908 - DNA, 22 bp, Homo sapiens
agtgtgggcccccaggttagcc

SEQ ID NO: 8440909 - DNA, 22 bp, Homo sapiens
agtgtgggcccccaggttagcc

SEQ ID NO: 8440910 - DNA, 19 bp, Homo sapiens
agtgttctgagtactcctc

SEQ ID NO: 8440911 - DNA, 22 bp, Homo sapiens
agtgtttattgtgtgccacaca

SEQ ID NO: 8440912 - DNA, 22 bp, Homo sapiens
agtgtggaccttcacacagaga

SEQ ID NO: 8440913 - DNA, 22 bp, Homo sapiens
agtgtggaccttcacacagaga

SEQ ID NO: 8440914 - DNA, 22 bp, Homo sapiens
agtgtggaccttcacacagaga

SEQ ID NO: 8440915 - DNA, 22 bp, Homo sapiens
agtgtggacttttcctaggagg

SEQ ID NO: 8440916 - DNA, 22 bp, Homo sapiens
agtgtgcattcctctcctcagg

SEQ ID NO: 8440917 - DNA, 20 bp, Homo sapiens
agtgtgcatttagagtctgc

SEQ ID NO: 8440918 - DNA, 22 bp, Homo sapiens
agtgtgctattgcaccatcata

SEQ ID NO: 8440919 - DNA, 22 bp, Homo sapiens
ctgagccagctggcatgtgcta

SEQ ID NO: 8440920 - DNA, 22 bp, Homo sapiens
ctgagctcagtcccagctctac

SEQ ID NO: 8440921 - DNA, 22 bp, Homo sapiens
ctgagctcaagcgatcctccca

SEQ ID NO: 8440922 - DNA, 22 bp, Homo sapiens
ctgagccagggccacacatgga

SEQ ID NO: 8440923 - DNA, 22 bp, Homo sapiens
agttaactaaattaagagacaa

SEQ ID NO: 8440924 - DNA, 22 bp, Homo sapiens
agttaacacagtcaggagtaac

SEQ ID NO: 8440925 - DNA, 22 bp, Homo sapiens
agttaacacaagtaagattcca

SEQ ID NO: 8440926 - DNA, 22 bp, Homo sapiens
ctgagccaccggcagggacatc

SEQ ID NO: 8440927 - DNA, 22 bp, Homo sapiens
ctgagccagagggagtcgggtc

SEQ ID NO: 8440928 - DNA, 22 bp, Homo sapiens
agttcctgaacttcttaatgac

SEQ ID NO: 8440929 - DNA, 22 bp, Homo sapiens
agttcccaaattacaggccaca

SEQ ID NO: 8440930 - DNA, 22 bp, Homo sapiens
ctgagctgctcccgctgcagcg

SEQ ID NO: 8440931 - DNA, 22 bp, Homo sapiens
ctgagctgctttgcttttgggg

SEQ ID NO: 8440932 - DNA, 22 bp, Homo sapiens
ctgagctgctcccgctgcagcg

SEQ ID NO: 8440933 - DNA, 22 bp, Homo sapiens
ctgagctgcggcaggcacctgg

SEQ ID NO: 8440934 - DNA, 22 bp, Homo sapiens
ctgagctgaaacttgagaggct

SEQ ID NO: 8440935 - DNA, 20 bp, Homo sapiens
ctgagctgagctccatgggt

SEQ ID NO: 8440936 - DNA, 17 bp, Homo sapiens
agtgtcagggcccttcc

SEQ ID NO: 8440937 - DNA, 22 bp, Homo sapiens
agtgtcagttgccttgtcataa

SEQ ID NO: 8440938 - DNA, 22 bp, Homo sapiens
agtgtcagcctgggcaaggaac

SEQ ID NO: 8440939 - DNA, 22 bp, Homo sapiens
agtgtcagctaattattcatga

SEQ ID NO: 8440940 - DNA, 22 bp, Homo sapiens
agtgtcattccagggaccctcg

SEQ ID NO: 8440941 - DNA, 17 bp, Homo sapiens
agtgtcagaagacagtt

SEQ ID NO: 8440942 - DNA, 22 bp, Homo sapiens
agtgtcaattctcaaatctcgg

SEQ ID NO: 8440943 - DNA, 22 bp, Homo sapiens
agtgtattcagaatgtagcaaa

SEQ ID NO: 8440944 - DNA, 22 bp, Homo sapiens
agtgtattgattggaacagcct

SEQ ID NO: 8440945 - DNA, 22 bp, Homo sapiens
agtgtacaaaatgatagataaa

SEQ ID NO: 8440946 - DNA, 22 bp, Homo sapiens
agtgtcaaattaaataatctgg

SEQ ID NO: 8440947 - DNA, 22 bp, Homo sapiens
agtgtcaactgtctacagggag

SEQ ID NO: 8440948 - DNA, 22 bp, Homo sapiens
agtgtattgtctcacagttctt

SEQ ID NO: 8440949 - DNA, 22 bp, Homo sapiens
agtgtcctcctctgggagccag

SEQ ID NO: 8440950 - DNA, 21 bp, Homo sapiens
agtgtcatttgatcattgtta

SEQ ID NO: 8440951 - DNA, 22 bp, Homo sapiens
agtgtctttgtctctcaagcac

SEQ ID NO: 8440952 - DNA, 22 bp, Homo sapiens
agtgtgactacattacaagagt

SEQ ID NO: 8440953 - DNA, 22 bp, Homo sapiens
agtgtgaccttatttggaaaca

SEQ ID NO: 8440954 - DNA, 22 bp, Homo sapiens
agtggtataagtctgaagatca

SEQ ID NO: 8440955 - DNA, 22 bp, Homo sapiens
ctctggagtgtctggccagggt

SEQ ID NO: 8440956 - DNA, 22 bp, Homo sapiens
ctctggagtgtctggccagggt

SEQ ID NO: 8440957 - DNA, 22 bp, Homo sapiens
ctctggagttagtgatctgggc

SEQ ID NO: 8440958 - DNA, 21 bp, Homo sapiens
ctctggagtttgaaggctggg

SEQ ID NO: 8440959 - DNA, 21 bp, Homo sapiens
ctctggagtttgaaggctggg

SEQ ID NO: 8440960 - DNA, 22 bp, Homo sapiens
ctctggagttcttcaagctact

SEQ ID NO: 8440961 - DNA, 22 bp, Homo sapiens
ctctggagttctcatgaggaac

SEQ ID NO: 8440962 - DNA, 22 bp, Homo sapiens
ctctggagttctcatgaggaac

SEQ ID NO: 8440963 - DNA, 22 bp, Homo sapiens
agtggctaataacagctaaaca

SEQ ID NO: 8440964 - DNA, 22 bp, Homo sapiens
agtggctatgcatgactggaat

SEQ ID NO: 8440965 - DNA, 22 bp, Homo sapiens
agtggcctggagccccgcctgg

SEQ ID NO: 8440966 - DNA, 22 bp, Homo sapiens
agtggcctggagccccgcctgg

SEQ ID NO: 8440967 - DNA, 22 bp, Homo sapiens
agtggcctggagccccgcctgg

SEQ ID NO: 8440968 - DNA, 22 bp, Homo sapiens
agtggcctggagccccgcctgg

SEQ ID NO: 8440969 - DNA, 22 bp, Homo sapiens
agtgggtgataagaccaaggag

SEQ ID NO: 8440970 - DNA, 22 bp, Homo sapiens
agtggctagatcatgagtgagc

SEQ ID NO: 8440971 - DNA, 20 bp, Homo sapiens
agtgccagggcaggtgagag

SEQ ID NO: 8440972 - DNA, 22 bp, Homo sapiens
agtgccagttaataagaaatgg

SEQ ID NO: 8440973 - DNA, 23 bp, Homo sapiens
agtgccattgaccctatgtctat

SEQ ID NO: 8440974 - DNA, 23 bp, Homo sapiens
agtgccagggagatcaggacgga

SEQ ID NO: 8440975 - DNA, 22 bp, Homo sapiens
agtgccaggagcaaggagctcc

SEQ ID NO: 8440976 - DNA, 22 bp, Homo sapiens
agtgccctgctggggcaggaga

SEQ ID NO: 8440977 - DNA, 22 bp, Homo sapiens
agtgccctggacggcggcccca

SEQ ID NO: 8440978 - DNA, 22 bp, Homo sapiens
agtgccctcgtgcccagggcct

SEQ ID NO: 8440979 - DNA, 22 bp, Homo sapiens
agtgcgtgggcaggcatggaag

SEQ ID NO: 8440980 - DNA, 22 bp, Homo sapiens
agtgcccttcatgaagcaagag

SEQ ID NO: 8440981 - DNA, 22 bp, Homo sapiens
agtgcctggaccccatgacata

SEQ ID NO: 8440982 - DNA, 22 bp, Homo sapiens
agtgcagggggaaagggtgtct

SEQ ID NO: 8440983 - DNA, 22 bp, Homo sapiens
agtgcattatatgtttcaatgg

SEQ ID NO: 8440984 - DNA, 22 bp, Homo sapiens
agtgcattcagtattcataggc

SEQ ID NO: 8440985 - DNA, 22 bp, Homo sapiens
agtgcattcctggggaagaagc

SEQ ID NO: 8440986 - DNA, 22 bp, Homo sapiens
agtgcattcagtattcataggc

SEQ ID NO: 8440987 - DNA, 22 bp, Homo sapiens
agtgcattctccatcatctagg

SEQ ID NO: 8440988 - DNA, 22 bp, Homo sapiens
agtgcattctctaattacaggt

SEQ ID NO: 8440989 - DNA, 22 bp, Homo sapiens
agtgcattctggcagaacaggt

SEQ ID NO: 8440990 - DNA, 22 bp, Homo sapiens
agtgcattctgtcatcttggtt

SEQ ID NO: 8440991 - DNA, 22 bp, Homo sapiens
agtgcattgcatctctgcttca

SEQ ID NO: 8440992 - DNA, 22 bp, Homo sapiens
agtgcatttggggtagtggaag

SEQ ID NO: 8440993 - DNA, 22 bp, Homo sapiens
agtgccagctccacacagcagc

SEQ ID NO: 8440994 - DNA, 19 bp, Homo sapiens
agtgcattttatgtttcaa

SEQ ID NO: 8440995 - DNA, 22 bp, Homo sapiens
agtgcagggcctgcccagcagg

SEQ ID NO: 8440996 - DNA, 22 bp, Homo sapiens
agtgatttcatcattttatcaa

SEQ ID NO: 8440997 - DNA, 22 bp, Homo sapiens
agtgattgagtgttagcagtct

SEQ ID NO: 8440998 - DNA, 22 bp, Homo sapiens
agtgattctttaaagtggtatt

SEQ ID NO: 8440999 - DNA, 22 bp, Homo sapiens
agtgattgcttgcttaaggaca

SEQ ID NO: 8441000 - DNA, 22 bp, Homo sapiens
agtgattagaaagtacacttgg

SEQ ID NO: 8441001 - DNA, 22 bp, Homo sapiens
agtgatgtgggagagtatagct

SEQ ID NO: 8441002 - DNA, 22 bp, Homo sapiens
agtgatgtcacaaactatggtg

SEQ ID NO: 8441003 - DNA, 22 bp, Homo sapiens
agtggatggtattgggaccagg

SEQ ID NO: 8441004 - DNA, 22 bp, Homo sapiens
agtggcacaattttgactcccc

SEQ ID NO: 8441005 - DNA, 22 bp, Homo sapiens
agtggcaatgggagtggagaca

SEQ ID NO: 8441006 - DNA, 22 bp, Homo sapiens
agtggccaccatgccagctctc

SEQ ID NO: 8441007 - DNA, 22 bp, Homo sapiens
agtggccactagaagctcagct

SEQ ID NO: 8441008 - DNA, 20 bp, Homo sapiens
agtggccactgcagagatgc

SEQ ID NO: 8441009 - DNA, 22 bp, Homo sapiens
agtggcagtggggcagggccct

SEQ ID NO: 8441010 - DNA, 22 bp, Homo sapiens
agtggcatcaaatcaaggtttg

SEQ ID NO: 8441011 - DNA, 22 bp, Homo sapiens
agtggcatcaactttatctgta

SEQ ID NO: 8441012 - DNA, 22 bp, Homo sapiens
agtggcagtggggcagggccct

SEQ ID NO: 8441013 - DNA, 22 bp, Homo sapiens
agtggcagtttgggagctacag

SEQ ID NO: 8441014 - DNA, 22 bp, Homo sapiens
agtggagaagaggatggtctcc

SEQ ID NO: 8441015 - DNA, 22 bp, Homo sapiens
agtggaatgtagaaaaaagatg

SEQ ID NO: 8441016 - DNA, 22 bp, Homo sapiens
agtggaaggtcaggggacagtg

SEQ ID NO: 8441017 - DNA, 22 bp, Homo sapiens
agtgcttttatatcattaatcc

SEQ ID NO: 8441018 - DNA, 22 bp, Homo sapiens
agtgcttttattatatacagga

SEQ ID NO: 8441019 - DNA, 22 bp, Homo sapiens
agtctcagaaaatatgcttttt

SEQ ID NO: 8441020 - DNA, 22 bp, Homo sapiens
agtctcagaaaagaagcatgga

SEQ ID NO: 8441021 - DNA, 22 bp, Homo sapiens
agtctagatgatcctaggaata

SEQ ID NO: 8441022 - DNA, 22 bp, Homo sapiens
agtctagatccccagtgctgtc

SEQ ID NO: 8441023 - DNA, 22 bp, Homo sapiens
agtctagaggatgggtccagat

SEQ ID NO: 8441024 - DNA, 22 bp, Homo sapiens
agtctagaaacaaggtagagct

SEQ ID NO: 8441025 - DNA, 22 bp, Homo sapiens
agtctagaatgtgcaccaagct

SEQ ID NO: 8441026 - DNA, 22 bp, Homo sapiens
agtctacatttttgttaatggt

SEQ ID NO: 8441027 - DNA, 22 bp, Homo sapiens
agtctattgcctaacagagagg

SEQ ID NO: 8441028 - DNA, 22 bp, Homo sapiens
agtctagatgtgtactaggtta

SEQ ID NO: 8441029 - DNA, 22 bp, Homo sapiens
ctcacattccacttgtgccaac

SEQ ID NO: 8441030 - DNA, 22 bp, Homo sapiens
ctcacattcacaggacagaagg

SEQ ID NO: 8441031 - DNA, 22 bp, Homo sapiens
ctcaccacagagcctgtccagc

SEQ ID NO: 8441032 - DNA, 22 bp, Homo sapiens
agtctttggttataagagacag

SEQ ID NO: 8441033 - DNA, 21 bp, Homo sapiens
agtctttgataaagacaaagt

SEQ ID NO: 8441034 - DNA, 22 bp, Homo sapiens
agtctttccttttggaagaaaa

SEQ ID NO: 8441035 - DNA, 18 bp, Homo sapiens
agtctttatttctttcat

SEQ ID NO: 8441036 - DNA, 22 bp, Homo sapiens
agtctttatacagaaatatatg

SEQ ID NO: 8441037 - DNA, 22 bp, Homo sapiens
agtctttatacagaaatatatg

SEQ ID NO: 8441038 - DNA, 22 bp, Homo sapiens
agtcttctgggtgtttccagag

SEQ ID NO: 8441039 - DNA, 22 bp, Homo sapiens
agtcttctgggtgtttccagag

SEQ ID NO: 8441040 - DNA, 22 bp, Homo sapiens
agtcttctgctctgtcactaac

SEQ ID NO: 8441041 - DNA, 22 bp, Homo sapiens
agtgaggtaattagagctgctg

SEQ ID NO: 8441042 - DNA, 22 bp, Homo sapiens
agtgaggggcagctgagtgggc

SEQ ID NO: 8441043 - DNA, 22 bp, Homo sapiens
agtgagtcaaaaaacttagata

SEQ ID NO: 8441044 - DNA, 22 bp, Homo sapiens
agtgagtggagagctctaggtt

SEQ ID NO: 8441045 - DNA, 22 bp, Homo sapiens
agtgagggactagtgctgggga

SEQ ID NO: 8441046 - DNA, 22 bp, Homo sapiens
agtgagggatgaagaactgcgg

SEQ ID NO: 8441047 - DNA, 22 bp, Homo sapiens
agtgaggggcagctgagtgggc

SEQ ID NO: 8441048 - DNA, 22 bp, Homo sapiens
agtgagttgaacattgataatg

SEQ ID NO: 8441049 - DNA, 20 bp, Homo sapiens
agtgagttatcagctacagt

SEQ ID NO: 8441050 - DNA, 22 bp, Homo sapiens
agtgatggtttccagtcactga

SEQ ID NO: 8441051 - DNA, 22 bp, Homo sapiens
agtgatggcatcgggtccagca

SEQ ID NO: 8441052 - DNA, 22 bp, Homo sapiens
agtgatctgactcccagttaga

SEQ ID NO: 8441053 - DNA, 22 bp, Homo sapiens
agtgatggcagtgaataaggct

SEQ ID NO: 8441054 - DNA, 22 bp, Homo sapiens
agtgaaatagcatttatgaagc

SEQ ID NO: 8441055 - DNA, 22 bp, Homo sapiens
agtcttttattcaaggctaagt

SEQ ID NO: 8441056 - DNA, 22 bp, Homo sapiens
agtgacttctccgtggcaggat

SEQ ID NO: 8441057 - DNA, 22 bp, Homo sapiens
agtgacttctcctaatgtcata

SEQ ID NO: 8441058 - DNA, 19 bp, Homo sapiens
agtgaaatggagtattcaa

SEQ ID NO: 8441059 - DNA, 21 bp, Homo sapiens
agtgaaatgaagtgtatgctc

SEQ ID NO: 8441060 - DNA, 20 bp, Homo sapiens
aggaaaaatggaaactggag

SEQ ID NO: 8441061 - DNA, 22 bp, Homo sapiens
aggaaaaataaggcagcagggc

SEQ ID NO: 8441062 - DNA, 20 bp, Homo sapiens
aggaaaaatggaaactggag

SEQ ID NO: 8441063 - DNA, 22 bp, Homo sapiens
aggaaaaataaggcagcagggc

SEQ ID NO: 8441064 - DNA, 22 bp, Homo sapiens
aggaaaaataaggcagcagggc

SEQ ID NO: 8441065 - DNA, 22 bp, Homo sapiens
aggaaaaataaggcagcagggc

SEQ ID NO: 8441066 - DNA, 22 bp, Homo sapiens
aggaaaacacagtattgatgga

SEQ ID NO: 8441067 - DNA, 22 bp, Homo sapiens
aggaaaagtgtgaagtatggag

SEQ ID NO: 8441068 - DNA, 22 bp, Homo sapiens
aggaaaagtgtgaagtatggag

SEQ ID NO: 8441069 - DNA, 22 bp, Homo sapiens
aggaaaagtgtgaagtatggag

SEQ ID NO: 8441070 - DNA, 22 bp, Homo sapiens
aggaaaagtgtgaagtatggag

SEQ ID NO: 8441071 - DNA, 22 bp, Homo sapiens
aggaaaatgaaacagcaactgt

SEQ ID NO: 8441072 - DNA, 21 bp, Homo sapiens
aggaaaattgagggttgttgt

SEQ ID NO: 8441073 - DNA, 22 bp, Homo sapiens
aggaaaatggaccagagttgtt

SEQ ID NO: 8441074 - DNA, 22 bp, Homo sapiens
aggaaaatggaccagagttgtt

SEQ ID NO: 8441075 - DNA, 22 bp, Homo sapiens
cagggactacagccagccctcc

SEQ ID NO: 8441076 - DNA, 22 bp, Homo sapiens
cagggactgagatccagactgt

SEQ ID NO: 8441077 - DNA, 22 bp, Homo sapiens
agctttgggggaggtagtctgt

SEQ ID NO: 8441078 - DNA, 22 bp, Homo sapiens
cagggacatgactggtctctgt

SEQ ID NO: 8441079 - DNA, 22 bp, Homo sapiens
cagggacataagaggaacatgg

SEQ ID NO: 8441080 - DNA, 22 bp, Homo sapiens
agctttctctcagccaggctgc

SEQ ID NO: 8441081 - DNA, 22 bp, Homo sapiens
cagggacagggatcatttgctt

SEQ ID NO: 8441082 - DNA, 22 bp, Homo sapiens
cagggacaggggagaaaagatg

SEQ ID NO: 8441083 - DNA, 22 bp, Homo sapiens
agcttctctctttgcactcaca

SEQ ID NO: 8441084 - DNA, 22 bp, Homo sapiens
agcttctctctttgcactcaca

SEQ ID NO: 8441085 - DNA, 22 bp, Homo sapiens
agcttctctcagggtatctttc

SEQ ID NO: 8441086 - DNA, 22 bp, Homo sapiens
agcttctccctttcctattggt

SEQ ID NO: 8441087 - DNA, 22 bp, Homo sapiens
caggcttgctgctagagcactt

SEQ ID NO: 8441088 - DNA, 22 bp, Homo sapiens
agcttctcctggtacagaactg

SEQ ID NO: 8441089 - DNA, 22 bp, Homo sapiens
agcttctcggctgggagtattt

SEQ ID NO: 8441090 - DNA, 22 bp, Homo sapiens
agcttctctggtcttctgccaa

SEQ ID NO: 8441091 - DNA, 22 bp, Homo sapiens
agcttctgaaagtctgttttcc

SEQ ID NO: 8441092 - DNA, 22 bp, Homo sapiens
agcttctgcccgtgtttgctct

SEQ ID NO: 8441093 - DNA, 22 bp, Homo sapiens
agcttctgcatcttttcttccc

SEQ ID NO: 8441094 - DNA, 22 bp, Homo sapiens
agcttctggaagcctggcagca

SEQ ID NO: 8441095 - DNA, 22 bp, Homo sapiens
agcttctggaaggcaaggcttg

SEQ ID NO: 8441096 - DNA, 23 bp, Homo sapiens
agcttctggttcaggtcaagcag

SEQ ID NO: 8441097 - DNA, 23 bp, Homo sapiens
agcttctggttcaggtcaagcag

SEQ ID NO: 8441098 - DNA, 22 bp, Homo sapiens
agcttctcaggagtctgaggca

SEQ ID NO: 8441099 - DNA, 22 bp, Homo sapiens
agcttctcatcttccaaaattg

SEQ ID NO: 8441100 - DNA, 22 bp, Homo sapiens
agcttctcaggagtctgaggca

SEQ ID NO: 8441101 - DNA, 22 bp, Homo sapiens
agcttctccatctgcccagaga

SEQ ID NO: 8441102 - DNA, 22 bp, Homo sapiens
agcttctccatctgcccagaga

SEQ ID NO: 8441103 - DNA, 22 bp, Homo sapiens
caggcttgctagaggagccaaa

SEQ ID NO: 8441104 - DNA, 22 bp, Homo sapiens
caggcttgatgtgtctatactt

SEQ ID NO: 8441105 - DNA, 22 bp, Homo sapiens
caggcttgattattcagacaat

SEQ ID NO: 8441106 - DNA, 22 bp, Homo sapiens
caggcttgctagaggagccaaa

SEQ ID NO: 8441107 - DNA, 22 bp, Homo sapiens
caggcttgaagcttcagagtat

SEQ ID NO: 8441108 - DNA, 21 bp, Homo sapiens
caggcttgaggaatgtgcctg

SEQ ID NO: 8441109 - DNA, 22 bp, Homo sapiens
caggcttgagggcaggcccagt

SEQ ID NO: 8441110 - DNA, 22 bp, Homo sapiens
caggcttgagggcaggcccagt

SEQ ID NO: 8441111 - DNA, 21 bp, Homo sapiens
caggcttgaggaatgtgcctg

SEQ ID NO: 8441112 - DNA, 22 bp, Homo sapiens
caggcttcgctctgtgggcagg

SEQ ID NO: 8441113 - DNA, 22 bp, Homo sapiens
caggcttcttttctttccagac

SEQ ID NO: 8441114 - DNA, 22 bp, Homo sapiens
caggcttcagggaacgcagtct

SEQ ID NO: 8441115 - DNA, 22 bp, Homo sapiens
caggcttccgccaggtttccag

SEQ ID NO: 8441116 - DNA, 22 bp, Homo sapiens
caggcttcatgaattatgcacc

SEQ ID NO: 8441117 - DNA, 22 bp, Homo sapiens
caggcttccgccaggtttccag

SEQ ID NO: 8441118 - DNA, 22 bp, Homo sapiens
caggcttcatgaattatgcacc

SEQ ID NO: 8441119 - DNA, 22 bp, Homo sapiens
agctggtgctgaagctcttgag

SEQ ID NO: 8441120 - DNA, 22 bp, Homo sapiens
agctggtgctcggggagctggc

SEQ ID NO: 8441121 - DNA, 22 bp, Homo sapiens
caggctggagttacctttaggg

SEQ ID NO: 8441122 - DNA, 22 bp, Homo sapiens
agctggtgctgaagctcttgag

SEQ ID NO: 8441123 - DNA, 22 bp, Homo sapiens
caggctggagttacctttaggg

SEQ ID NO: 8441124 - DNA, 22 bp, Homo sapiens
caggctggagttcagtggtgtg

SEQ ID NO: 8441125 - DNA, 22 bp, Homo sapiens
caggctgtgaaactgagatgcg

SEQ ID NO: 8441126 - DNA, 22 bp, Homo sapiens
caggcttcagcatccacttagt

SEQ ID NO: 8441127 - DNA, 22 bp, Homo sapiens
caggctgtgggagtcaggaccc

SEQ ID NO: 8441128 - DNA, 22 bp, Homo sapiens
caggctgtggatcaggagcctt

SEQ ID NO: 8441129 - DNA, 22 bp, Homo sapiens
caggctgtggatcaggagcctt

SEQ ID NO: 8441130 - DNA, 22 bp, Homo sapiens
caggctgtgaaactgagatgcg

SEQ ID NO: 8441131 - DNA, 22 bp, Homo sapiens
aggaagaggtagctgtcaaggg

SEQ ID NO: 8441132 - DNA, 22 bp, Homo sapiens
aggaagaggtagctgtcaaggg

SEQ ID NO: 8441133 - DNA, 22 bp, Homo sapiens
aggaagagggtggcagataatc

SEQ ID NO: 8441134 - DNA, 22 bp, Homo sapiens
aggaagagggtggcagataatc

SEQ ID NO: 8441135 - DNA, 21 bp, Homo sapiens
aggaagatctggaggtcggcg

SEQ ID NO: 8441136 - DNA, 22 bp, Homo sapiens
aggaagagtgttacctatgggt

SEQ ID NO: 8441137 - DNA, 22 bp, Homo sapiens
aggaagagtgttacctatgggt

SEQ ID NO: 8441138 - DNA, 22 bp, Homo sapiens
aggaagagtgttacctatgggt

SEQ ID NO: 8441139 - DNA, 22 bp, Homo sapiens
aggaagaggtgtgcaatggtgt

SEQ ID NO: 8441140 - DNA, 22 bp, Homo sapiens
aggaagcactggaaggggttgg

SEQ ID NO: 8441141 - DNA, 22 bp, Homo sapiens
aggaagcactggaaggggttgg

SEQ ID NO: 8441142 - DNA, 22 bp, Homo sapiens
aggaaacatgaatctgccttga

SEQ ID NO: 8441143 - DNA, 22 bp, Homo sapiens
aggaaacattgatattgggaaa

SEQ ID NO: 8441144 - DNA, 22 bp, Homo sapiens
cagggtggtaccagcatctagt

SEQ ID NO: 8441145 - DNA, 22 bp, Homo sapiens
cagggtggtaccagcatctagt

SEQ ID NO: 8441146 - DNA, 22 bp, Homo sapiens
cagggtggtaccagcatctagt

SEQ ID NO: 8441147 - DNA, 22 bp, Homo sapiens
cagggtggtgaatagctatagt

SEQ ID NO: 8441148 - DNA, 22 bp, Homo sapiens
cagggtggtgaatagctatagt

SEQ ID NO: 8441149 - DNA, 22 bp, Homo sapiens
cagggttatacagctgaacaaa

SEQ ID NO: 8441150 - DNA, 22 bp, Homo sapiens
cagggtgtgaacagtgtaaaac

SEQ ID NO: 8441151 - DNA, 22 bp, Homo sapiens
aggaatgtgtgtccaccgggga

SEQ ID NO: 8441152 - DNA, 21 bp, Homo sapiens
aggaatgtgtatatatacaat

SEQ ID NO: 8441153 - DNA, 22 bp, Homo sapiens
aggaatgttaaagattaagagc

SEQ ID NO: 8441154 - DNA, 22 bp, Homo sapiens
aggaatgtgtttctaggctgtt

SEQ ID NO: 8441155 - DNA, 22 bp, Homo sapiens
aggaatgttaagaaggtctacc

SEQ ID NO: 8441156 - DNA, 22 bp, Homo sapiens
aggaatgtttacacgacagaaa

SEQ ID NO: 8441157 - DNA, 22 bp, Homo sapiens
aggaatgttagttctgtataca

SEQ ID NO: 8441158 - DNA, 22 bp, Homo sapiens
aggaatgttaggagatgagtct

SEQ ID NO: 8441159 - DNA, 22 bp, Homo sapiens
aggaatgtttagaatgtcagaa

SEQ ID NO: 8441160 - DNA, 22 bp, Homo sapiens
aggaatgtggcaatcttcaagt

SEQ ID NO: 8441161 - DNA, 22 bp, Homo sapiens
aggaatgtggcctagggaggag

SEQ ID NO: 8441162 - DNA, 16 bp, Homo sapiens
aggaatgtggcggaac

SEQ ID NO: 8441163 - DNA, 22 bp, Homo sapiens
aggaatgtgcctagcctccctg

SEQ ID NO: 8441164 - DNA, 22 bp, Homo sapiens
aggaatgtggaaggtggcggcg

SEQ ID NO: 8441165 - DNA, 22 bp, Homo sapiens
aggaatgtgactattttttcag

SEQ ID NO: 8441166 - DNA, 22 bp, Homo sapiens
aggaatgtgaggcaagttgtga

SEQ ID NO: 8441167 - DNA, 23 bp, Homo sapiens
aggaatgtgcccacccatctcct

SEQ ID NO: 8441168 - DNA, 22 bp, Homo sapiens
aggaatgtgaccactagactct

SEQ ID NO: 8441169 - DNA, 22 bp, Homo sapiens
aggaatgtgaaacaggtggctg

SEQ ID NO: 8441170 - DNA, 22 bp, Homo sapiens
aggaatgtctgagaaagaggca

SEQ ID NO: 8441171 - DNA, 22 bp, Homo sapiens
aggaatgtcgtcataaacatga

SEQ ID NO: 8441172 - DNA, 14 bp, Homo sapiens
aggaatgtcctagg

SEQ ID NO: 8441173 - DNA, 22 bp, Homo sapiens
caggtcctggcatcaggcaggt

SEQ ID NO: 8441174 - DNA, 22 bp, Homo sapiens
caggtcctggcatcaggcaggt

SEQ ID NO: 8441175 - DNA, 22 bp, Homo sapiens
caggtcctgcagggagagtaaa

SEQ ID NO: 8441176 - DNA, 22 bp, Homo sapiens
caggtcctggcagctgactcag

SEQ ID NO: 8441177 - DNA, 22 bp, Homo sapiens
caggtcctgccttggttaccct

SEQ ID NO: 8441178 - DNA, 22 bp, Homo sapiens
caggtcccgttccccagagatt

SEQ ID NO: 8441179 - DNA, 22 bp, Homo sapiens
caggtcctcgggggaggccggc

SEQ ID NO: 8441180 - DNA, 22 bp, Homo sapiens
caggtccagtcactggtctgca

SEQ ID NO: 8441181 - DNA, 22 bp, Homo sapiens
caggtcccgccccgggctgacc

SEQ ID NO: 8441182 - DNA, 22 bp, Homo sapiens
caggtcccctcccctaccaggc

SEQ ID NO: 8441183 - DNA, 22 bp, Homo sapiens
aggaaggggagaagttaaagct

SEQ ID NO: 8441184 - DNA, 22 bp, Homo sapiens
aggaagggctgtttctccaaga

SEQ ID NO: 8441185 - DNA, 20 bp, Homo sapiens
aggaaggagaatctgagcaa

SEQ ID NO: 8441186 - DNA, 22 bp, Homo sapiens
agctggaagctgatgagcacag

SEQ ID NO: 8441187 - DNA, 22 bp, Homo sapiens
agctggaacgtcacaggagcag

SEQ ID NO: 8441188 - DNA, 23 bp, Homo sapiens
agctggaaatggccgagctctgc

SEQ ID NO: 8441189 - DNA, 22 bp, Homo sapiens
agctggaagctgatgagcacag

SEQ ID NO: 8441190 - DNA, 22 bp, Homo sapiens
agctggaagtgcatttctcact

SEQ ID NO: 8441191 - DNA, 22 bp, Homo sapiens
agctggaaagaaggtggcagcc

SEQ ID NO: 8441192 - DNA, 22 bp, Homo sapiens
agctgctgggagaagtgagcca

SEQ ID NO: 8441193 - DNA, 22 bp, Homo sapiens
agctggaaagaaggtggcagcc

SEQ ID NO: 8441194 - DNA, 22 bp, Homo sapiens
agctggaacccgggtgggcagc

SEQ ID NO: 8441195 - DNA, 22 bp, Homo sapiens
agctggaacccgggtgggcagc

SEQ ID NO: 8441196 - DNA, 21 bp, Homo sapiens
agctgctttcagctcctagag

SEQ ID NO: 8441197 - DNA, 22 bp, Homo sapiens
agctgcctctcttgaggttacg

SEQ ID NO: 8441198 - DNA, 21 bp, Homo sapiens
agctgcctgctctggacctgg

SEQ ID NO: 8441199 - DNA, 22 bp, Homo sapiens
agctgcctgccatgccgctggt

SEQ ID NO: 8441200 - DNA, 22 bp, Homo sapiens
agctgcctctcttgaggttacg

SEQ ID NO: 8441201 - DNA, 22 bp, Homo sapiens
agctgcctctcttgaggttacg

SEQ ID NO: 8441202 - DNA, 22 bp, Homo sapiens
agctgcctcctggtgccccatc

SEQ ID NO: 8441203 - DNA, 22 bp, Homo sapiens
agctgcctccatggtcaaagat

SEQ ID NO: 8441204 - DNA, 22 bp, Homo sapiens
agctgcctcagtcactcatggc

SEQ ID NO: 8441205 - DNA, 21 bp, Homo sapiens
agctgcctccacttctgaggc

SEQ ID NO: 8441206 - DNA, 21 bp, Homo sapiens
agctgcctccacttctgaggc

SEQ ID NO: 8441207 - DNA, 22 bp, Homo sapiens
agctgccctgggtcttgctgct

SEQ ID NO: 8441208 - DNA, 22 bp, Homo sapiens
agctgccagatgacagtgctat

SEQ ID NO: 8441209 - DNA, 22 bp, Homo sapiens
agctgcccccagggctgtgctt

SEQ ID NO: 8441210 - DNA, 22 bp, Homo sapiens
caggaaatgcgtagttgaactt

SEQ ID NO: 8441211 - DNA, 22 bp, Homo sapiens
caggaaatgaaagctagctaat

SEQ ID NO: 8441212 - DNA, 22 bp, Homo sapiens
caggaactggaaccctggccga

SEQ ID NO: 8441213 - DNA, 22 bp, Homo sapiens
caggaagaaagaggtgaggtgt

SEQ ID NO: 8441214 - DNA, 22 bp, Homo sapiens
caggaagaaagaggtgaggtgt

SEQ ID NO: 8441215 - DNA, 22 bp, Homo sapiens
caggaagaaagaggtgaggtgt

SEQ ID NO: 8441216 - DNA, 22 bp, Homo sapiens
caggaagaagggtggtgagtcc

SEQ ID NO: 8441217 - DNA, 22 bp, Homo sapiens
caggaagaagggtggtgagtcc

SEQ ID NO: 8441218 - DNA, 22 bp, Homo sapiens
caggaagaccagggctgtggct

SEQ ID NO: 8441219 - DNA, 22 bp, Homo sapiens
caggaagaccagggctgtggct

SEQ ID NO: 8441220 - DNA, 22 bp, Homo sapiens
caggaagaccagggctgtggct

SEQ ID NO: 8441221 - DNA, 22 bp, Homo sapiens
caggaagaccagggctgtggct

SEQ ID NO: 8441222 - DNA, 23 bp, Homo sapiens
caggaaatcaattcttccagcat

SEQ ID NO: 8441223 - DNA, 22 bp, Homo sapiens
caggaaatatctcctggcagag

SEQ ID NO: 8441224 - DNA, 22 bp, Homo sapiens
caggaaatcactctgattttgg

SEQ ID NO: 8441225 - DNA, 17 bp, Homo sapiens
caggaaaatatgagtga

SEQ ID NO: 8441226 - DNA, 22 bp, Homo sapiens
caggaaatatctcaacacttta

SEQ ID NO: 8441227 - DNA, 22 bp, Homo sapiens
caggaaatataggaaaaggaac

SEQ ID NO: 8441228 - DNA, 22 bp, Homo sapiens
agctgaaagggtgttggagtgt

SEQ ID NO: 8441229 - DNA, 22 bp, Homo sapiens
agctgaaacccaggcctcagct

SEQ ID NO: 8441230 - DNA, 22 bp, Homo sapiens
agctgaaagcttgactggggct

SEQ ID NO: 8441231 - DNA, 22 bp, Homo sapiens
agctgaaattcacaaggatcca

SEQ ID NO: 8441232 - DNA, 22 bp, Homo sapiens
agctgaaattctttgtcctcag

SEQ ID NO: 8441233 - DNA, 23 bp, Homo sapiens
agctgaaagcttgcaacgaggca

SEQ ID NO: 8441234 - DNA, 22 bp, Homo sapiens
agctgaaagtgctttgaggact

SEQ ID NO: 8441235 - DNA, 17 bp, Homo sapiens
agctgaaattgctgaag

SEQ ID NO: 8441236 - DNA, 22 bp, Homo sapiens
agctgaaattttactgagtata

SEQ ID NO: 8441237 - DNA, 21 bp, Homo sapiens
agctgaaaagttgtttacaag

SEQ ID NO: 8441238 - DNA, 22 bp, Homo sapiens
agctgaaaattagtgatagttt

SEQ ID NO: 8441239 - DNA, 22 bp, Homo sapiens
agctgaaacttcccattaattg

SEQ ID NO: 8441240 - DNA, 22 bp, Homo sapiens
agctggtaagtggcagagattc

SEQ ID NO: 8441241 - DNA, 22 bp, Homo sapiens
agctggtaaaggggaaagcaga

SEQ ID NO: 8441242 - DNA, 22 bp, Homo sapiens
agctggtatttctgaaggaaag

SEQ ID NO: 8441243 - DNA, 22 bp, Homo sapiens
agctggtcctaattgagccatt

SEQ ID NO: 8441244 - DNA, 22 bp, Homo sapiens
agctgggtttctggcaggctta

SEQ ID NO: 8441245 - DNA, 22 bp, Homo sapiens
agctgggttcagaggcacatgg

SEQ ID NO: 8441246 - DNA, 17 bp, Homo sapiens
agctgggttctcaggaa

SEQ ID NO: 8441247 - DNA, 22 bp, Homo sapiens
agctgggttgacaagatggaaa

SEQ ID NO: 8441248 - DNA, 17 bp, Homo sapiens
agctgggttctcaggaa

SEQ ID NO: 8441249 - DNA, 22 bp, Homo sapiens
agctgggtgttcttgggcctaa

SEQ ID NO: 8441250 - DNA, 22 bp, Homo sapiens
agctgggtgttcttgggcctaa

SEQ ID NO: 8441251 - DNA, 22 bp, Homo sapiens
agctggtgcctgcttttgtgtg

SEQ ID NO: 8441252 - DNA, 22 bp, Homo sapiens
agctggtgctcaggggcatgga

SEQ ID NO: 8441253 - DNA, 22 bp, Homo sapiens
agctggtgagggttgaggggta

SEQ ID NO: 8441254 - DNA, 22 bp, Homo sapiens
agctggtgagggttgaggggta

SEQ ID NO: 8441255 - DNA, 20 bp, Homo sapiens
agctggtcttaagtaactga

SEQ ID NO: 8441256 - DNA, 22 bp, Homo sapiens
agctggtccttggcagttctca

SEQ ID NO: 8441257 - DNA, 22 bp, Homo sapiens
agctggtctgctgcatggagtg

SEQ ID NO: 8441258 - DNA, 22 bp, Homo sapiens
caggcagagtgagaagcccttg

SEQ ID NO: 8441259 - DNA, 19 bp, Homo sapiens
agctggggcggtgtgtgtt

SEQ ID NO: 8441260 - DNA, 22 bp, Homo sapiens
agctgggtgcggtggctcatgc

SEQ ID NO: 8441261 - DNA, 22 bp, Homo sapiens
agctgggtgcggtggctcatgc

SEQ ID NO: 8441262 - DNA, 23 bp, Homo sapiens
agctgggtggcctgcgtgaagct

SEQ ID NO: 8441263 - DNA, 22 bp, Homo sapiens
agctgggtggcctctcctcggg

SEQ ID NO: 8441264 - DNA, 21 bp, Homo sapiens
agctgggtgggctgagtgaca

SEQ ID NO: 8441265 - DNA, 20 bp, Homo sapiens
caggcagaggatgctgacca

SEQ ID NO: 8441266 - DNA, 22 bp, Homo sapiens
caggcagaggaagtctgggtct

SEQ ID NO: 8441267 - DNA, 22 bp, Homo sapiens
caggcagagtcagattagactt

SEQ ID NO: 8441268 - DNA, 22 bp, Homo sapiens
agctgggactcaactgtctggg

SEQ ID NO: 8441269 - DNA, 22 bp, Homo sapiens
agctggaggagtttctcctagc

SEQ ID NO: 8441270 - DNA, 22 bp, Homo sapiens
agctgggcaccccgctgcgtct

SEQ ID NO: 8441271 - DNA, 22 bp, Homo sapiens
agctgggcctgagctggaagct

SEQ ID NO: 8441272 - DNA, 21 bp, Homo sapiens
agctgggcctcagcctgcagt

SEQ ID NO: 8441273 - DNA, 22 bp, Homo sapiens
agctggagagtttccaggaagg

SEQ ID NO: 8441274 - DNA, 22 bp, Homo sapiens
agctggagatcatgctgatact

SEQ ID NO: 8441275 - DNA, 20 bp, Homo sapiens
agctggagaagggcccttcc

SEQ ID NO: 8441276 - DNA, 22 bp, Homo sapiens
agctggagaaacctgggagggt

SEQ ID NO: 8441277 - DNA, 22 bp, Homo sapiens
agctggaattacaggagcccat

SEQ ID NO: 8441278 - DNA, 22 bp, Homo sapiens
agctggagaaacctgggagggt

SEQ ID NO: 8441279 - DNA, 22 bp, Homo sapiens
agctggaatcctacttctaaca

SEQ ID NO: 8441280 - DNA, 22 bp, Homo sapiens
agctggagcttcaagcaggtaa

SEQ ID NO: 8441281 - DNA, 22 bp, Homo sapiens
agctggagcttcaagcaggtaa

SEQ ID NO: 8441282 - DNA, 22 bp, Homo sapiens
agctggagcttcaagcaggtaa

SEQ ID NO: 8441283 - DNA, 22 bp, Homo sapiens
agctggagccagtgtgaggctt

SEQ ID NO: 8441284 - DNA, 22 bp, Homo sapiens
agctggagccagtgtgaggctt

SEQ ID NO: 8441285 - DNA, 22 bp, Homo sapiens
agctggagattctggggacagt

SEQ ID NO: 8441286 - DNA, 19 bp, Homo sapiens
agctggagattggagggca

SEQ ID NO: 8441287 - DNA, 19 bp, Homo sapiens
agctggagattggagggca

SEQ ID NO: 8441288 - DNA, 23 bp, Homo sapiens
cagtctgcagcccacttgggcag

SEQ ID NO: 8441289 - DNA, 22 bp, Homo sapiens
aggacaagacaaggaccagaga

SEQ ID NO: 8441290 - DNA, 22 bp, Homo sapiens
aggacaaaggaccagatctgga

SEQ ID NO: 8441291 - DNA, 22 bp, Homo sapiens
cagtgaggagtccagggcagag

SEQ ID NO: 8441292 - DNA, 22 bp, Homo sapiens
cagtctgatgttcgcaggtgaa

SEQ ID NO: 8441293 - DNA, 18 bp, Homo sapiens
cagtgaggatgaagggtt

SEQ ID NO: 8441294 - DNA, 22 bp, Homo sapiens
aggacaagacaaggaccagaga

SEQ ID NO: 8441295 - DNA, 22 bp, Homo sapiens
aggaattcaagaccagctgggc

SEQ ID NO: 8441296 - DNA, 22 bp, Homo sapiens
cagtgaggctctgctgagcggt

SEQ ID NO: 8441297 - DNA, 21 bp, Homo sapiens
cagtgaggccctcctgttccc

SEQ ID NO: 8441298 - DNA, 21 bp, Homo sapiens
cagtgaggccctcctgttccc

SEQ ID NO: 8441299 - DNA, 17 bp, Homo sapiens
cagtgaggcctttcctc

SEQ ID NO: 8441300 - DNA, 17 bp, Homo sapiens
cagtgcagataagtgag

SEQ ID NO: 8441301 - DNA, 22 bp, Homo sapiens
cagtgagggcccccttccaggt

SEQ ID NO: 8441302 - DNA, 22 bp, Homo sapiens
cagtgcagccaaggacaggcac

SEQ ID NO: 8441303 - DNA, 22 bp, Homo sapiens
cagtgagggcattcagtgctgg

SEQ ID NO: 8441304 - DNA, 23 bp, Homo sapiens
cagtgcagggcaactcagactcc

SEQ ID NO: 8441305 - DNA, 22 bp, Homo sapiens
cagtgcaggcttgtggccgcag

SEQ ID NO: 8441306 - DNA, 22 bp, Homo sapiens
cagtgcaggcttgtggccgcag

SEQ ID NO: 8441307 - DNA, 21 bp, Homo sapiens
cagtgcaggggttagcgtgta

SEQ ID NO: 8441308 - DNA, 22 bp, Homo sapiens
cagtgcaggctgggggccctgc

SEQ ID NO: 8441309 - DNA, 22 bp, Homo sapiens
cagtgcaggaagtgagatgcct

SEQ ID NO: 8441310 - DNA, 22 bp, Homo sapiens
cagtgcaggaagtgagatgcct

SEQ ID NO: 8441311 - DNA, 22 bp, Homo sapiens
cagtgcagctgccccgctggta

SEQ ID NO: 8441312 - DNA, 22 bp, Homo sapiens
cagtgcagctgccccgctggta

SEQ ID NO: 8441313 - DNA, 22 bp, Homo sapiens
cagtgcagccaaggacaggcac

SEQ ID NO: 8441314 - DNA, 22 bp, Homo sapiens
cagtgcagccaaggacaggcac

SEQ ID NO: 8441315 - DNA, 22 bp, Homo sapiens
aggagatggagctcagtgggca

SEQ ID NO: 8441316 - DNA, 22 bp, Homo sapiens
aggagcagaccgtagtcctgca

SEQ ID NO: 8441317 - DNA, 22 bp, Homo sapiens
aggagcagattggtaagatcat

SEQ ID NO: 8441318 - DNA, 22 bp, Homo sapiens
aggagccaaattactagctctg

SEQ ID NO: 8441319 - DNA, 22 bp, Homo sapiens
aggagccaaattttagactctg

SEQ ID NO: 8441320 - DNA, 22 bp, Homo sapiens
aggagccaaattttagactctg

SEQ ID NO: 8441321 - DNA, 22 bp, Homo sapiens
aggagctgggctgctgctggga

SEQ ID NO: 8441322 - DNA, 22 bp, Homo sapiens
aggagctgggagaaggactaaa

SEQ ID NO: 8441323 - DNA, 22 bp, Homo sapiens
aggagctgggcccaaggatgct

SEQ ID NO: 8441324 - DNA, 22 bp, Homo sapiens
aggagctgggcccaaggatgct

SEQ ID NO: 8441325 - DNA, 22 bp, Homo sapiens
aggagctgatagtctatggaga

SEQ ID NO: 8441326 - DNA, 22 bp, Homo sapiens
aggagctggccactaggatgca

SEQ ID NO: 8441327 - DNA, 22 bp, Homo sapiens
aggagctggcctagaaaggaga

SEQ ID NO: 8441328 - DNA, 22 bp, Homo sapiens
cagtggaaatcagagtgagagt

SEQ ID NO: 8441329 - DNA, 22 bp, Homo sapiens
cagtggaagactcagctctccc

SEQ ID NO: 8441330 - DNA, 22 bp, Homo sapiens
cagtggaatacgagcagatgtc

SEQ ID NO: 8441331 - DNA, 22 bp, Homo sapiens
cagttctctgtgcctcgctggg

SEQ ID NO: 8441332 - DNA, 22 bp, Homo sapiens
cagttctcttgatcgtctcttg

SEQ ID NO: 8441333 - DNA, 22 bp, Homo sapiens
cagttccttgagaatggttgct

SEQ ID NO: 8441334 - DNA, 22 bp, Homo sapiens
catcactacaaatttaagaaat

SEQ ID NO: 8441335 - DNA, 22 bp, Homo sapiens
cagttcaaaattttgaagaagg

SEQ ID NO: 8441336 - DNA, 22 bp, Homo sapiens
cagttataggagccattgtata

SEQ ID NO: 8441337 - DNA, 22 bp, Homo sapiens
catcagaagaaagacaaatgat

SEQ ID NO: 8441338 - DNA, 22 bp, Homo sapiens
catcagaatagctctgtggata

SEQ ID NO: 8441339 - DNA, 22 bp, Homo sapiens
aggaggctgcaaccctgaggcc

SEQ ID NO: 8441340 - DNA, 22 bp, Homo sapiens
aggaggctggttcaggccatat

SEQ ID NO: 8441341 - DNA, 19 bp, Homo sapiens
catcagagggcataggatg

SEQ ID NO: 8441342 - DNA, 22 bp, Homo sapiens
aggaggctgcaaccctgaggcc

SEQ ID NO: 8441343 - DNA, 22 bp, Homo sapiens
catcagaattacttggggagct

SEQ ID NO: 8441344 - DNA, 22 bp, Homo sapiens
aggagtgggggcgagaagttaa

SEQ ID NO: 8441345 - DNA, 22 bp, Homo sapiens
catcattgttagggactctaac

SEQ ID NO: 8441346 - DNA, 22 bp, Homo sapiens
catcatttcacttagatgaagt

SEQ ID NO: 8441347 - DNA, 22 bp, Homo sapiens
catcatttcacttagatgaagt

SEQ ID NO: 8441348 - DNA, 22 bp, Homo sapiens
aggaggctggttcaggccatat

SEQ ID NO: 8441349 - DNA, 22 bp, Homo sapiens
aggaggctgggcacagtggcct

SEQ ID NO: 8441350 - DNA, 22 bp, Homo sapiens
aggaggtgacagcctgcatctg

SEQ ID NO: 8441351 - DNA, 22 bp, Homo sapiens
aggaggtgagcggtcatgtggt

SEQ ID NO: 8441352 - DNA, 22 bp, Homo sapiens
ccaaaatattagtgcttaagta

SEQ ID NO: 8441353 - DNA, 22 bp, Homo sapiens
aggcagctttgtagtaaagcta

SEQ ID NO: 8441354 - DNA, 22 bp, Homo sapiens
ccaaaattaagcctcttatgtt

SEQ ID NO: 8441355 - DNA, 22 bp, Homo sapiens
ccaaaattattacatttgtagg

SEQ ID NO: 8441356 - DNA, 22 bp, Homo sapiens
ccaaacaaatccccattcttag

SEQ ID NO: 8441357 - DNA, 22 bp, Homo sapiens
ccaaagcaagtcacatgatcaa

SEQ ID NO: 8441358 - DNA, 22 bp, Homo sapiens
ccaaagcaagtcacatgatcaa

SEQ ID NO: 8441359 - DNA, 18 bp, Homo sapiens
aggcaggatcctggcctc

SEQ ID NO: 8441360 - DNA, 23 bp, Homo sapiens
aggcaggcagttcagctgttgtt

SEQ ID NO: 8441361 - DNA, 21 bp, Homo sapiens
aggcaggattcaaacacagag

SEQ ID NO: 8441362 - DNA, 22 bp, Homo sapiens
aggcaggcccctgagaatagac

SEQ ID NO: 8441363 - DNA, 22 bp, Homo sapiens
aggcaggcccctgagaatagac

SEQ ID NO: 8441364 - DNA, 22 bp, Homo sapiens
aggcaggctctgggtatgtgca

SEQ ID NO: 8441365 - DNA, 22 bp, Homo sapiens
aggcaggctagtcgcttgagcc

SEQ ID NO: 8441366 - DNA, 22 bp, Homo sapiens
aggcaggctcaatgcccagtct

SEQ ID NO: 8441367 - DNA, 22 bp, Homo sapiens
aggcaggctcaggcccatgctt

SEQ ID NO: 8441368 - DNA, 22 bp, Homo sapiens
aggcaggctcaggcccatgctt

SEQ ID NO: 8441369 - DNA, 22 bp, Homo sapiens
aggcaggctcaggcccatgctt

SEQ ID NO: 8441370 - DNA, 18 bp, Homo sapiens
aggcaggcggatcacaag

SEQ ID NO: 8441371 - DNA, 18 bp, Homo sapiens
aggcaggcggatcacaag

SEQ ID NO: 8441372 - DNA, 22 bp, Homo sapiens
aggcaggccgtgtccctcctca

SEQ ID NO: 8441373 - DNA, 22 bp, Homo sapiens
aggcaggccgtgtccctcctca

SEQ ID NO: 8441374 - DNA, 22 bp, Homo sapiens
aggcaggccctctggaaaggta

SEQ ID NO: 8441375 - DNA, 22 bp, Homo sapiens
aggcaggccctctggaaaggta

SEQ ID NO: 8441376 - DNA, 22 bp, Homo sapiens
aggcaggccctgggccatcccg

SEQ ID NO: 8441377 - DNA, 22 bp, Homo sapiens
aggcaggccctgggccatcccg

SEQ ID NO: 8441378 - DNA, 20 bp, Homo sapiens
aggcagctgggaaatgaggg

SEQ ID NO: 8441379 - DNA, 21 bp, Homo sapiens
aggcagcgtgagggccactca

SEQ ID NO: 8441380 - DNA, 19 bp, Homo sapiens
aggcagaggcttggctagc

SEQ ID NO: 8441381 - DNA, 22 bp, Homo sapiens
ccaaaataacagcccaattcac

SEQ ID NO: 8441382 - DNA, 22 bp, Homo sapiens
aggcagctttctggtgcaccat

SEQ ID NO: 8441383 - DNA, 22 bp, Homo sapiens
aggcagctttcagtgtctctca

SEQ ID NO: 8441384 - DNA, 22 bp, Homo sapiens
aggcagctttctggtgcaccat

SEQ ID NO: 8441385 - DNA, 22 bp, Homo sapiens
aggcagctttaactggtagtag

SEQ ID NO: 8441386 - DNA, 22 bp, Homo sapiens
aggcagcttaagccctggccca

SEQ ID NO: 8441387 - DNA, 22 bp, Homo sapiens
aggcagcttaagccctggccca

SEQ ID NO: 8441388 - DNA, 22 bp, Homo sapiens
aggcagctgtgaggactggatt

SEQ ID NO: 8441389 - DNA, 22 bp, Homo sapiens
aggcagagctgggttttgaaat

SEQ ID NO: 8441390 - DNA, 22 bp, Homo sapiens
aggcagaggagaatgatcttcc

SEQ ID NO: 8441391 - DNA, 22 bp, Homo sapiens
aggcagagctaggaagaattgt

SEQ ID NO: 8441392 - DNA, 22 bp, Homo sapiens
aggcagagctgatgttctgtga

SEQ ID NO: 8441393 - DNA, 22 bp, Homo sapiens
aggcagagctgatgttctgtga

SEQ ID NO: 8441394 - DNA, 20 bp, Homo sapiens
aggcagagcgcacttttaga

SEQ ID NO: 8441395 - DNA, 20 bp, Homo sapiens
aggcagagcgcacttttaga

SEQ ID NO: 8441396 - DNA, 22 bp, Homo sapiens
aggcagagctaggaagaattgt

SEQ ID NO: 8441397 - DNA, 22 bp, Homo sapiens
aggcagagctaggaagaattgt

SEQ ID NO: 8441398 - DNA, 22 bp, Homo sapiens
catgtgtgaatcttgtgatcat

SEQ ID NO: 8441399 - DNA, 22 bp, Homo sapiens
catgtgtgaatcttgtgatcat

SEQ ID NO: 8441400 - DNA, 22 bp, Homo sapiens
aggatcttatgtaataattatg

SEQ ID NO: 8441401 - DNA, 22 bp, Homo sapiens
aggatcttgctgtagaggatag

SEQ ID NO: 8441402 - DNA, 22 bp, Homo sapiens
catgtctgagtagagtgtgatt

SEQ ID NO: 8441403 - DNA, 22 bp, Homo sapiens
catgtgtgagtgagcagtcttc

SEQ ID NO: 8441404 - DNA, 22 bp, Homo sapiens
catgtgtgggacccttaggttg

SEQ ID NO: 8441405 - DNA, 22 bp, Homo sapiens
aggcacaggtggacttcacagt

SEQ ID NO: 8441406 - DNA, 22 bp, Homo sapiens
aggcacaggtggacttcacagt

SEQ ID NO: 8441407 - DNA, 22 bp, Homo sapiens
aggcacagggatgcggagccag

SEQ ID NO: 8441408 - DNA, 22 bp, Homo sapiens
aggagttatggcagaatcaaat

SEQ ID NO: 8441409 - DNA, 23 bp, Homo sapiens
aggataaactaaactcattttgg

SEQ ID NO: 8441410 - DNA, 22 bp, Homo sapiens
aggataactttgaaagtaaatt

SEQ ID NO: 8441411 - DNA, 22 bp, Homo sapiens
aggatagaagccccatgttctt

SEQ ID NO: 8441412 - DNA, 22 bp, Homo sapiens
aggcacagtggccctgtttggg

SEQ ID NO: 8441413 - DNA, 22 bp, Homo sapiens
aggcacagtggctcacacctgt

SEQ ID NO: 8441414 - DNA, 22 bp, Homo sapiens
aggcacagtggctcacacctgt

SEQ ID NO: 8441415 - DNA, 20 bp, Homo sapiens
aggcacagttcctagttggg

SEQ ID NO: 8441416 - DNA, 22 bp, Homo sapiens
aggcacagtgcctggaatcaaa

SEQ ID NO: 8441417 - DNA, 19 bp, Homo sapiens
aggcacaggttgtctggac

SEQ ID NO: 8441418 - DNA, 19 bp, Homo sapiens
aggcacaggttgtctggac

SEQ ID NO: 8441419 - DNA, 22 bp, Homo sapiens
aggcactgaaaggtggccagag

SEQ ID NO: 8441420 - DNA, 22 bp, Homo sapiens
aggcacagtttcatccccgggc

SEQ ID NO: 8441421 - DNA, 20 bp, Homo sapiens
aggcacagttcctagttggg

SEQ ID NO: 8441422 - DNA, 22 bp, Homo sapiens
aggcactgaaaggtggccagag

SEQ ID NO: 8441423 - DNA, 22 bp, Homo sapiens
aggcactgacaattctggactg

SEQ ID NO: 8441424 - DNA, 22 bp, Homo sapiens
aggcactgactcaagggagcca

SEQ ID NO: 8441425 - DNA, 22 bp, Homo sapiens
aggcagagagcagtggccgtct

SEQ ID NO: 8441426 - DNA, 22 bp, Homo sapiens
aggcagagagcagtggccgtct

SEQ ID NO: 8441427 - DNA, 22 bp, Homo sapiens
aggcagagagcagtggccgtct

SEQ ID NO: 8441428 - DNA, 17 bp, Homo sapiens
ccagagctactgagact

SEQ ID NO: 8441429 - DNA, 22 bp, Homo sapiens
ccagagctccagggctacagaa

SEQ ID NO: 8441430 - DNA, 22 bp, Homo sapiens
ccagagctgagggagcctgagc

SEQ ID NO: 8441431 - DNA, 22 bp, Homo sapiens
ccagagctgaggagatgggctt

SEQ ID NO: 8441432 - DNA, 22 bp, Homo sapiens
ccagagctgaggagatgggctt

SEQ ID NO: 8441433 - DNA, 22 bp, Homo sapiens
ccagagctccagggctacagaa

SEQ ID NO: 8441434 - DNA, 23 bp, Homo sapiens
ccagagctctttcatgcttccat

SEQ ID NO: 8441435 - DNA, 22 bp, Homo sapiens
aggccacagttgaggccagcaa

SEQ ID NO: 8441436 - DNA, 22 bp, Homo sapiens
aggccacatagcttgcatgtag

SEQ ID NO: 8441437 - DNA, 22 bp, Homo sapiens
aggccacggcgggtggattact

SEQ ID NO: 8441438 - DNA, 22 bp, Homo sapiens
aggccagaaatgtcagggagtg

SEQ ID NO: 8441439 - DNA, 22 bp, Homo sapiens
ccagagcctggcatctgcataa

SEQ ID NO: 8441440 - DNA, 22 bp, Homo sapiens
aggccatgggatttccaattgg

SEQ ID NO: 8441441 - DNA, 22 bp, Homo sapiens
aggccatgtggccccagagtct

SEQ ID NO: 8441442 - DNA, 22 bp, Homo sapiens
aggcccagactcagcggggcgg

SEQ ID NO: 8441443 - DNA, 22 bp, Homo sapiens
ccagcaggactttggaaatatg

SEQ ID NO: 8441444 - DNA, 22 bp, Homo sapiens
ccagcaggactttggaaatatg

SEQ ID NO: 8441445 - DNA, 22 bp, Homo sapiens
ccagcaggaaagtgacgtttga

SEQ ID NO: 8441446 - DNA, 22 bp, Homo sapiens
aggccaggcaacattctgaagt

SEQ ID NO: 8441447 - DNA, 22 bp, Homo sapiens
aggccaggtggtcatgcttgct

SEQ ID NO: 8441448 - DNA, 22 bp, Homo sapiens
aggccaggtggtcatgcttgct

SEQ ID NO: 8441449 - DNA, 22 bp, Homo sapiens
aggccaggtggtcatgcttgct

SEQ ID NO: 8441450 - DNA, 22 bp, Homo sapiens
aggccaggcaacattctgaagt

SEQ ID NO: 8441451 - DNA, 22 bp, Homo sapiens
aggccaggttcctcaatcttga

SEQ ID NO: 8441452 - DNA, 22 bp, Homo sapiens
aggccaggttcctcaatcttga

SEQ ID NO: 8441453 - DNA, 22 bp, Homo sapiens
aggccaggttcctcaatcttga

SEQ ID NO: 8441454 - DNA, 22 bp, Homo sapiens
aggccagttgttcagtgggccg

SEQ ID NO: 8441455 - DNA, 22 bp, Homo sapiens
aggccagtgtggctggagcaca

SEQ ID NO: 8441456 - DNA, 22 bp, Homo sapiens
aggccagtgcagctggaacaga

SEQ ID NO: 8441457 - DNA, 22 bp, Homo sapiens
aggccagtgcctttccagggct

SEQ ID NO: 8441458 - DNA, 22 bp, Homo sapiens
ccagaccctgctctggggctct

SEQ ID NO: 8441459 - DNA, 22 bp, Homo sapiens
ccagaccctttcttggcatgtg

SEQ ID NO: 8441460 - DNA, 22 bp, Homo sapiens
ccagaccctccattcaagctcc

SEQ ID NO: 8441461 - DNA, 22 bp, Homo sapiens
ccagaccctgctctggggctct

SEQ ID NO: 8441462 - DNA, 22 bp, Homo sapiens
ccagacctaaccagcttttgta

SEQ ID NO: 8441463 - DNA, 22 bp, Homo sapiens
ccagactggggctccttgaggg

SEQ ID NO: 8441464 - DNA, 22 bp, Homo sapiens
ccagactgagggtccctgagct

SEQ ID NO: 8441465 - DNA, 22 bp, Homo sapiens
ccagaccagactgacttgagcc

SEQ ID NO: 8441466 - DNA, 22 bp, Homo sapiens
ccagactggggctccttgaggg

SEQ ID NO: 8441467 - DNA, 22 bp, Homo sapiens
aggccacagttgaggccagcaa

SEQ ID NO: 8441468 - DNA, 22 bp, Homo sapiens
aggccacagtcagtgggtgctg

SEQ ID NO: 8441469 - DNA, 22 bp, Homo sapiens
ccagaactgagaaaataaattt

SEQ ID NO: 8441470 - DNA, 22 bp, Homo sapiens
ccagaaaggtaaacactggatt

SEQ ID NO: 8441471 - DNA, 22 bp, Homo sapiens
ccagaaagttcagctgtgaatg

SEQ ID NO: 8441472 - DNA, 22 bp, Homo sapiens
ccagaaaaggagctgcaggatg

SEQ ID NO: 8441473 - DNA, 22 bp, Homo sapiens
ccagaaagaatgaactgaaccc

SEQ ID NO: 8441474 - DNA, 22 bp, Homo sapiens
ccagctctggcttcttgctggg

SEQ ID NO: 8441475 - DNA, 22 bp, Homo sapiens
ccagctctgcttgcccagtcag

SEQ ID NO: 8441476 - DNA, 22 bp, Homo sapiens
ccagctctgcttgcccagtcag

SEQ ID NO: 8441477 - DNA, 20 bp, Homo sapiens
ccagctctgtggttagatac

SEQ ID NO: 8441478 - DNA, 22 bp, Homo sapiens
ccagcaggagatgcctgtgtct

SEQ ID NO: 8441479 - DNA, 22 bp, Homo sapiens
ccagcaggagagaacatttccc

SEQ ID NO: 8441480 - DNA, 22 bp, Homo sapiens
ccagcaggagactagcaacata

SEQ ID NO: 8441481 - DNA, 22 bp, Homo sapiens
ccagcaggcagtcatatccttt

SEQ ID NO: 8441482 - DNA, 22 bp, Homo sapiens
ccagctggaagagtgcagaact

SEQ ID NO: 8441483 - DNA, 22 bp, Homo sapiens
ccagctggaagagtgcagaact

SEQ ID NO: 8441484 - DNA, 22 bp, Homo sapiens
ccagctggaagagtgcagaact

SEQ ID NO: 8441485 - DNA, 22 bp, Homo sapiens
ccagctggagccaaggtggact

SEQ ID NO: 8441486 - DNA, 22 bp, Homo sapiens
ccagctggagccaaggtggact

SEQ ID NO: 8441487 - DNA, 22 bp, Homo sapiens
ccagctggagccaaggtggact

SEQ ID NO: 8441488 - DNA, 22 bp, Homo sapiens
ccagctcttttggctgagtgag

SEQ ID NO: 8441489 - DNA, 22 bp, Homo sapiens
ccagctgacgatgcctggtctc

SEQ ID NO: 8441490 - DNA, 22 bp, Homo sapiens
ccagctcttttggctgagtgag

SEQ ID NO: 8441491 - DNA, 22 bp, Homo sapiens
ccagctggaaacaaatagagtg

SEQ ID NO: 8441492 - DNA, 22 bp, Homo sapiens
ccagctggcaggagagtcaggg

SEQ ID NO: 8441493 - DNA, 22 bp, Homo sapiens
ccagctggcaggagagtcaggg

SEQ ID NO: 8441494 - DNA, 22 bp, Homo sapiens
ccagctggcactgtggctgccc

SEQ ID NO: 8441495 - DNA, 22 bp, Homo sapiens
ccagctggcactgtggctgccc

SEQ ID NO: 8441496 - DNA, 22 bp, Homo sapiens
ccagctggagctcgcagatagg

SEQ ID NO: 8441497 - DNA, 22 bp, Homo sapiens
aggcctctggaggtggcagtgt

SEQ ID NO: 8441498 - DNA, 22 bp, Homo sapiens
aggcctctggaggtggcagtgt

SEQ ID NO: 8441499 - DNA, 22 bp, Homo sapiens
aggcctctgggcctgcgggttt

SEQ ID NO: 8441500 - DNA, 22 bp, Homo sapiens
ccagctggcccagctgtgctcc

SEQ ID NO: 8441501 - DNA, 17 bp, Homo sapiens
aggcctctgccggtgcc

SEQ ID NO: 8441502 - DNA, 17 bp, Homo sapiens
aggcctctgccggtgcc

SEQ ID NO: 8441503 - DNA, 22 bp, Homo sapiens
aggcctctggaggtggcagtgt

SEQ ID NO: 8441504 - DNA, 22 bp, Homo sapiens
aggcctgggacgggagccgtga

SEQ ID NO: 8441505 - DNA, 22 bp, Homo sapiens
ccaggaaggcaggcctccccgc

SEQ ID NO: 8441506 - DNA, 22 bp, Homo sapiens
ccaggaagggctctttaaagac

SEQ ID NO: 8441507 - DNA, 22 bp, Homo sapiens
ccaggaaggtatgggaagaaaa

SEQ ID NO: 8441508 - DNA, 22 bp, Homo sapiens
ccaggaaggcctggatgccccc

SEQ ID NO: 8441509 - DNA, 22 bp, Homo sapiens
ccaggaaggcgttgttcctctc

SEQ ID NO: 8441510 - DNA, 22 bp, Homo sapiens
ccaggaaggcaggcctccccgc

SEQ ID NO: 8441511 - DNA, 22 bp, Homo sapiens
aggcctggccccagttgctagg

SEQ ID NO: 8441512 - DNA, 22 bp, Homo sapiens
aggcctggccccagttgctagg

SEQ ID NO: 8441513 - DNA, 22 bp, Homo sapiens
aggcctggccccagttgctagg

SEQ ID NO: 8441514 - DNA, 22 bp, Homo sapiens
aggcctggcatgagacctgaga

SEQ ID NO: 8441515 - DNA, 22 bp, Homo sapiens
aggcctgctgtgtagcctgttg

SEQ ID NO: 8441516 - DNA, 22 bp, Homo sapiens
aggcctggcctttatgttcaag

SEQ ID NO: 8441517 - DNA, 22 bp, Homo sapiens
aggcctggctttggtttgctga

SEQ ID NO: 8441518 - DNA, 22 bp, Homo sapiens
aggcggctggtgtcctgcaggt

SEQ ID NO: 8441519 - DNA, 22 bp, Homo sapiens
ccaggaaggtgtttaactagag

SEQ ID NO: 8441520 - DNA, 22 bp, Homo sapiens
ccaggaagtatgacccaacaga

SEQ ID NO: 8441521 - DNA, 22 bp, Homo sapiens
ccaggacaagccagagggacag

SEQ ID NO: 8441522 - DNA, 22 bp, Homo sapiens
aggcctgtcccagctgaggacg

SEQ ID NO: 8441523 - DNA, 22 bp, Homo sapiens
aggctgcttcttgtccttggca

SEQ ID NO: 8441524 - DNA, 22 bp, Homo sapiens
aggctgcttcttgtccttggca

SEQ ID NO: 8441525 - DNA, 22 bp, Homo sapiens
aggctgcttcttgtccttggca

SEQ ID NO: 8441526 - DNA, 22 bp, Homo sapiens
aggctgcttccttacgtggctg

SEQ ID NO: 8441527 - DNA, 22 bp, Homo sapiens
ccaggtctgtcttcttagctca

SEQ ID NO: 8441528 - DNA, 22 bp, Homo sapiens
ccaggtctgtcttcttagctca

SEQ ID NO: 8441529 - DNA, 22 bp, Homo sapiens
ccaggtcttcactttactgaag

SEQ ID NO: 8441530 - DNA, 19 bp, Homo sapiens
ccaggtctggggccagatt

SEQ ID NO: 8441531 - DNA, 19 bp, Homo sapiens
ccaggtctggggccagatt

SEQ ID NO: 8441532 - DNA, 22 bp, Homo sapiens
ccaggtctggaaccaccagggc

SEQ ID NO: 8441533 - DNA, 22 bp, Homo sapiens
ccaggtctggcactggccagtc

SEQ ID NO: 8441534 - DNA, 22 bp, Homo sapiens
ccaggtctttggccttggcact

SEQ ID NO: 8441535 - DNA, 22 bp, Homo sapiens
ccaggtctttggccttggcact

SEQ ID NO: 8441536 - DNA, 22 bp, Homo sapiens
ccaggtctttgactaatatgct

SEQ ID NO: 8441537 - DNA, 22 bp, Homo sapiens
ccaggtcttgtttgacatcaat

SEQ ID NO: 8441538 - DNA, 22 bp, Homo sapiens
ccaggtcttgtttgacatcaat

SEQ ID NO: 8441539 - DNA, 21 bp, Homo sapiens
ccaggtcttggtccttggact

SEQ ID NO: 8441540 - DNA, 22 bp, Homo sapiens
ccaggtcttggcccccggacct

SEQ ID NO: 8441541 - DNA, 21 bp, Homo sapiens
ccaggtcttggtccttggact

SEQ ID NO: 8441542 - DNA, 21 bp, Homo sapiens
ccaggtcttggtccttggact

SEQ ID NO: 8441543 - DNA, 19 bp, Homo sapiens
aggctggagacaccaggcc

SEQ ID NO: 8441544 - DNA, 22 bp, Homo sapiens
aggctggagacccgccaagaaa

SEQ ID NO: 8441545 - DNA, 22 bp, Homo sapiens
aggctggagagtgcagtggcgt

SEQ ID NO: 8441546 - DNA, 22 bp, Homo sapiens
aggctggagagtgcagtggcgt

SEQ ID NO: 8441547 - DNA, 22 bp, Homo sapiens
aggctggagagtgcagtggcgt

SEQ ID NO: 8441548 - DNA, 22 bp, Homo sapiens
aggctggagcaagggggcatat

SEQ ID NO: 8441549 - DNA, 22 bp, Homo sapiens
aggctggagcaagggggcatat

SEQ ID NO: 8441550 - DNA, 22 bp, Homo sapiens
aggctggagggcaatggcaaga

SEQ ID NO: 8441551 - DNA, 22 bp, Homo sapiens
aggctggagtgtagcagtgcag

SEQ ID NO: 8441552 - DNA, 22 bp, Homo sapiens
aggctggccagtgctgcagtgg

SEQ ID NO: 8441553 - DNA, 22 bp, Homo sapiens
aggctggcccacctcttgtctt

SEQ ID NO: 8441554 - DNA, 22 bp, Homo sapiens
aggctggcccacctcttgtctt

SEQ ID NO: 8441555 - DNA, 22 bp, Homo sapiens
aggctggagtgcaatggcgtga

SEQ ID NO: 8441556 - DNA, 22 bp, Homo sapiens
aggctggagtgctggagtgctg

SEQ ID NO: 8441557 - DNA, 22 bp, Homo sapiens
aggctggagtgctggagtgctg

SEQ ID NO: 8441558 - DNA, 22 bp, Homo sapiens
aggctggagtgctggagtgctg

SEQ ID NO: 8441559 - DNA, 22 bp, Homo sapiens
aggctggctggggatgcgtctt

SEQ ID NO: 8441560 - DNA, 22 bp, Homo sapiens
ccattttattagtgacatttag

SEQ ID NO: 8441561 - DNA, 22 bp, Homo sapiens
ccatttgttttcgctaccatgg

SEQ ID NO: 8441562 - DNA, 22 bp, Homo sapiens
ccatttgttgtgtattaatatt

SEQ ID NO: 8441563 - DNA, 22 bp, Homo sapiens
ccatttgtaccatttctttgta

SEQ ID NO: 8441564 - DNA, 22 bp, Homo sapiens
ccatttgtggtttatttgctct

SEQ ID NO: 8441565 - DNA, 22 bp, Homo sapiens
aggctgggtacctgtcatatgc

SEQ ID NO: 8441566 - DNA, 22 bp, Homo sapiens
aggctggggaattgaatttgct

SEQ ID NO: 8441567 - DNA, 20 bp, Homo sapiens
aggctggggtgttttgccca

SEQ ID NO: 8441568 - DNA, 22 bp, Homo sapiens
aggctgggctccgcccaactcc

SEQ ID NO: 8441569 - DNA, 22 bp, Homo sapiens
aggctgggcaccgttttgatcc

SEQ ID NO: 8441570 - DNA, 22 bp, Homo sapiens
aggctgggaaggtaaagttgta

SEQ ID NO: 8441571 - DNA, 22 bp, Homo sapiens
aggctggcgtcaggggctgtac

SEQ ID NO: 8441572 - DNA, 22 bp, Homo sapiens
aggctggcgtcaggggctgtac

SEQ ID NO: 8441573 - DNA, 22 bp, Homo sapiens
aggctggcgtcaggggctgtac

SEQ ID NO: 8441574 - DNA, 22 bp, Homo sapiens
aggctggcggtgactgctctga

SEQ ID NO: 8441575 - DNA, 22 bp, Homo sapiens
aggctggcggtgactgctctga

SEQ ID NO: 8441576 - DNA, 22 bp, Homo sapiens
ccatttagtaaggaagaacagc

SEQ ID NO: 8441577 - DNA, 22 bp, Homo sapiens
ccatttacattgtactctgtga

SEQ ID NO: 8441578 - DNA, 22 bp, Homo sapiens
ccatttagtaaggaagaacagc

SEQ ID NO: 8441579 - DNA, 22 bp, Homo sapiens
ccatttggaggtcattaggaca

SEQ ID NO: 8441580 - DNA, 22 bp, Homo sapiens
ccatttggcaagaaagagtcat

SEQ ID NO: 8441581 - DNA, 22 bp, Homo sapiens
aggctggcgacatctggcgggc

SEQ ID NO: 8441582 - DNA, 22 bp, Homo sapiens
aggctggcgacatctggcgggc

SEQ ID NO: 8441583 - DNA, 22 bp, Homo sapiens
aggctggcggtgactgctctga

SEQ ID NO: 8441584 - DNA, 17 bp, Homo sapiens
aggctggccttcacagt

SEQ ID NO: 8441585 - DNA, 22 bp, Homo sapiens
aggctggcgacatctggcgggc

SEQ ID NO: 8441586 - DNA, 22 bp, Homo sapiens
aggctggccctactggctgcct

SEQ ID NO: 8441587 - DNA, 22 bp, Homo sapiens
aggctggccctactggctgcct

SEQ ID NO: 8441588 - DNA, 17 bp, Homo sapiens
aggctggccttcacagt

SEQ ID NO: 8441589 - DNA, 22 bp, Homo sapiens
ccaggctctgcgctggacatgg

SEQ ID NO: 8441590 - DNA, 22 bp, Homo sapiens
ccaggctgctgttggtgtccgc

SEQ ID NO: 8441591 - DNA, 22 bp, Homo sapiens
ccaggctgctgttggtgtccgc

SEQ ID NO: 8441592 - DNA, 22 bp, Homo sapiens
aggctacaggagacgccaggag

SEQ ID NO: 8441593 - DNA, 22 bp, Homo sapiens
aggctacaataattcccatgca

SEQ ID NO: 8441594 - DNA, 22 bp, Homo sapiens
aggctaagtgggtgtcagggcc

SEQ ID NO: 8441595 - DNA, 22 bp, Homo sapiens
aggctaagatgtggtctgagca

SEQ ID NO: 8441596 - DNA, 19 bp, Homo sapiens
aggctaaagagtcttgcgt

SEQ ID NO: 8441597 - DNA, 22 bp, Homo sapiens
ccaggctggagtatagtggcgc

SEQ ID NO: 8441598 - DNA, 22 bp, Homo sapiens
ccaggctggagtatagtggcgc

SEQ ID NO: 8441599 - DNA, 22 bp, Homo sapiens
ccaggctgcttagccttatctt

SEQ ID NO: 8441600 - DNA, 22 bp, Homo sapiens
ccaggctgcttagccttatctt

SEQ ID NO: 8441601 - DNA, 22 bp, Homo sapiens
ccaggctgcttagccttatctt

SEQ ID NO: 8441602 - DNA, 22 bp, Homo sapiens
ccaggctgctttattactctgt

SEQ ID NO: 8441603 - DNA, 22 bp, Homo sapiens
ccaggctgctttattactctgt

SEQ ID NO: 8441604 - DNA, 22 bp, Homo sapiens
ccaggctgctttattactctgt

SEQ ID NO: 8441605 - DNA, 22 bp, Homo sapiens
ccaggctggaatcaatattctg

SEQ ID NO: 8441606 - DNA, 22 bp, Homo sapiens
ccaggctggaatcaatattctg

SEQ ID NO: 8441607 - DNA, 21 bp, Homo sapiens
ccaggctgggagggcagttcc

SEQ ID NO: 8441608 - DNA, 22 bp, Homo sapiens
ccaggctgggcggggaacctgg

SEQ ID NO: 8441609 - DNA, 22 bp, Homo sapiens
ccaggctgggcggggaacctgg

SEQ ID NO: 8441610 - DNA, 22 bp, Homo sapiens
ccaggctgggctacaagttgag

SEQ ID NO: 8441611 - DNA, 22 bp, Homo sapiens
ccaggctgggctacaagttgag

SEQ ID NO: 8441612 - DNA, 22 bp, Homo sapiens
ccaggctgggctacaagttgag

SEQ ID NO: 8441613 - DNA, 15 bp, Homo sapiens
ccaggctgggtgagc

SEQ ID NO: 8441614 - DNA, 15 bp, Homo sapiens
ccaggctgggtgagc

SEQ ID NO: 8441615 - DNA, 22 bp, Homo sapiens
ccaggctggtctgaatttctag

SEQ ID NO: 8441616 - DNA, 22 bp, Homo sapiens
ccagggcctgagggcgacgccc

SEQ ID NO: 8441617 - DNA, 22 bp, Homo sapiens
ccagggcctcgtgttctgagtg

SEQ ID NO: 8441618 - DNA, 22 bp, Homo sapiens
ccaggctgtaaacaccttcaaa

SEQ ID NO: 8441619 - DNA, 22 bp, Homo sapiens
ccaggctggtctgaatttctag

SEQ ID NO: 8441620 - DNA, 22 bp, Homo sapiens
ccagggctccattgctcatcct

SEQ ID NO: 8441621 - DNA, 22 bp, Homo sapiens
ccagggctggaccagtgcttgg

SEQ ID NO: 8441622 - DNA, 22 bp, Homo sapiens
ccagggctcaggctcccagtgg

SEQ ID NO: 8441623 - DNA, 22 bp, Homo sapiens
aggctgaggcaggtggatcacc

SEQ ID NO: 8441624 - DNA, 22 bp, Homo sapiens
ccaggtctggaaccaccagggc

SEQ ID NO: 8441625 - DNA, 22 bp, Homo sapiens
ccaggtctgcgggcggcaggca

SEQ ID NO: 8441626 - DNA, 22 bp, Homo sapiens
ccaggtctcgggtctgctcgtg

SEQ ID NO: 8441627 - DNA, 22 bp, Homo sapiens
aggctgaggcaagaggatcact

SEQ ID NO: 8441628 - DNA, 22 bp, Homo sapiens
aggctgaggcaagaggatcact

SEQ ID NO: 8441629 - DNA, 22 bp, Homo sapiens
aggctgaggatccctgtgttct

SEQ ID NO: 8441630 - DNA, 22 bp, Homo sapiens
aggctgaggatcgtactttcca

SEQ ID NO: 8441631 - DNA, 22 bp, Homo sapiens
ccagggctggtggctgcagagg

SEQ ID NO: 8441632 - DNA, 22 bp, Homo sapiens
aggctgagctgacctggtttgg

SEQ ID NO: 8441633 - DNA, 22 bp, Homo sapiens
aggctgaggatccctgtgttct

SEQ ID NO: 8441634 - DNA, 22 bp, Homo sapiens
aggctgaggatcgtactttcca

SEQ ID NO: 8441635 - DNA, 22 bp, Homo sapiens
aggctgagctgacctggtttgg

SEQ ID NO: 8441636 - DNA, 22 bp, Homo sapiens
agggcctggaactgtgggcagg

SEQ ID NO: 8441637 - DNA, 22 bp, Homo sapiens
agggcctggaactgtgggcagg

SEQ ID NO: 8441638 - DNA, 20 bp, Homo sapiens
agggcctgctctgtggtgtc

SEQ ID NO: 8441639 - DNA, 20 bp, Homo sapiens
agggcctgctctgtggtgtc

SEQ ID NO: 8441640 - DNA, 23 bp, Homo sapiens
agggcctggcgtggagtgtgtgc

SEQ ID NO: 8441641 - DNA, 23 bp, Homo sapiens
agggcctggcgtggagtgtgtgc

SEQ ID NO: 8441642 - DNA, 20 bp, Homo sapiens
cctcagagcgcaggccccct

SEQ ID NO: 8441643 - DNA, 22 bp, Homo sapiens
cctcagagcgcgtggcattatt

SEQ ID NO: 8441644 - DNA, 18 bp, Homo sapiens
cctcagaggcaaattgtt

SEQ ID NO: 8441645 - DNA, 19 bp, Homo sapiens
cctcagagctagtgaacat

SEQ ID NO: 8441646 - DNA, 19 bp, Homo sapiens
cctcagagctagtgaacat

SEQ ID NO: 8441647 - DNA, 22 bp, Homo sapiens
cctcagcttgatttctgcagag

SEQ ID NO: 8441648 - DNA, 18 bp, Homo sapiens
cctcagaggcaaattgtt

SEQ ID NO: 8441649 - DNA, 22 bp, Homo sapiens
cctcagcttgatttctgcagag

SEQ ID NO: 8441650 - DNA, 22 bp, Homo sapiens
cctcaggaaatgaataaatggc

SEQ ID NO: 8441651 - DNA, 22 bp, Homo sapiens
cctcaggaaccacattgctgct

SEQ ID NO: 8441652 - DNA, 22 bp, Homo sapiens
agggcctggcgcgtggccgccg

SEQ ID NO: 8441653 - DNA, 20 bp, Homo sapiens
agggcctggagtacagcagg

SEQ ID NO: 8441654 - DNA, 19 bp, Homo sapiens
agggcctgcagctcaagct

SEQ ID NO: 8441655 - DNA, 19 bp, Homo sapiens
agggcctgcagctcaagct

SEQ ID NO: 8441656 - DNA, 22 bp, Homo sapiens
agggcctgcatcaggagcttgg

SEQ ID NO: 8441657 - DNA, 22 bp, Homo sapiens
agggcctgcatcaggagcttgg

SEQ ID NO: 8441658 - DNA, 22 bp, Homo sapiens
agggcctgcatcaggagcttgg

SEQ ID NO: 8441659 - DNA, 22 bp, Homo sapiens
agggcctgaggctgacggggag

SEQ ID NO: 8441660 - DNA, 22 bp, Homo sapiens
agggcctgagctggctgacctc

SEQ ID NO: 8441661 - DNA, 22 bp, Homo sapiens
agggcctccagggcagcagtgg

SEQ ID NO: 8441662 - DNA, 22 bp, Homo sapiens
ccctgcttgtcacccctgggtc

SEQ ID NO: 8441663 - DNA, 22 bp, Homo sapiens
agggccttgctgtctgaagctg

SEQ ID NO: 8441664 - DNA, 22 bp, Homo sapiens
agggcgctgtctggccagcggt

SEQ ID NO: 8441665 - DNA, 22 bp, Homo sapiens
cctcaggatccgcaggtgcagt

SEQ ID NO: 8441666 - DNA, 22 bp, Homo sapiens
cctcaggatacaggagccacag

SEQ ID NO: 8441667 - DNA, 22 bp, Homo sapiens
cctcaggatacaggagccacag

SEQ ID NO: 8441668 - DNA, 22 bp, Homo sapiens
cctcaggcaggaaactgtcccg

SEQ ID NO: 8441669 - DNA, 22 bp, Homo sapiens
cctcaggcaagtcacttaacat

SEQ ID NO: 8441670 - DNA, 22 bp, Homo sapiens
cctcaggccctgtccctgcgcc

SEQ ID NO: 8441671 - DNA, 22 bp, Homo sapiens
cctcaggccctgtccctgcgcc

SEQ ID NO: 8441672 - DNA, 22 bp, Homo sapiens
cctcaggccctgtccctgcgcc

SEQ ID NO: 8441673 - DNA, 20 bp, Homo sapiens
cctcaggccagttttaaagt

SEQ ID NO: 8441674 - DNA, 22 bp, Homo sapiens
cctcaggcaggaaactgtcccg

SEQ ID NO: 8441675 - DNA, 22 bp, Homo sapiens
cctcaggcagtggtatggatgg

SEQ ID NO: 8441676 - DNA, 22 bp, Homo sapiens
cctcaggcaggaaactgtcccg

SEQ ID NO: 8441677 - DNA, 22 bp, Homo sapiens
cctcaggccagggggcggccag

SEQ ID NO: 8441678 - DNA, 22 bp, Homo sapiens
cctcaggccagggggcggccag

SEQ ID NO: 8441679 - DNA, 22 bp, Homo sapiens
cctcaggccagggggcggccag

SEQ ID NO: 8441680 - DNA, 22 bp, Homo sapiens
agggctgctgctccgggcccag

SEQ ID NO: 8441681 - DNA, 22 bp, Homo sapiens
agggctgccatttctggcccaa

SEQ ID NO: 8441682 - DNA, 22 bp, Homo sapiens
agggctggagccacagctggga

SEQ ID NO: 8441683 - DNA, 22 bp, Homo sapiens
aggggcagcctcacaatcctct

SEQ ID NO: 8441684 - DNA, 22 bp, Homo sapiens
aggggcagcctcacaatcctct

SEQ ID NO: 8441685 - DNA, 18 bp, Homo sapiens
aggggcagcttgtgtgga

SEQ ID NO: 8441686 - DNA, 23 bp, Homo sapiens
aggggcagcaagttttggtgtta

SEQ ID NO: 8441687 - DNA, 22 bp, Homo sapiens
aggggatggagctggaaggcag

SEQ ID NO: 8441688 - DNA, 22 bp, Homo sapiens
aggggatggagctggaaggcag

SEQ ID NO: 8441689 - DNA, 22 bp, Homo sapiens
aggggatgcctgaggatctgta

SEQ ID NO: 8441690 - DNA, 22 bp, Homo sapiens
aggggaggcagcgataaacctg

SEQ ID NO: 8441691 - DNA, 22 bp, Homo sapiens
aggggaggagcttttcttgcct

SEQ ID NO: 8441692 - DNA, 22 bp, Homo sapiens
agggctggctaggtgcgttccc

SEQ ID NO: 8441693 - DNA, 22 bp, Homo sapiens
agggctggctaggtgcgttccc

SEQ ID NO: 8441694 - DNA, 22 bp, Homo sapiens
aggggagagttaatgtgaatgt

SEQ ID NO: 8441695 - DNA, 22 bp, Homo sapiens
aggggagagttaatgtgaatgt

SEQ ID NO: 8441696 - DNA, 22 bp, Homo sapiens
aggggagcaacatagtcactct

SEQ ID NO: 8441697 - DNA, 22 bp, Homo sapiens
agggtagggccgtagggccatg

SEQ ID NO: 8441698 - DNA, 22 bp, Homo sapiens
agggtagggcccggagacagac

SEQ ID NO: 8441699 - DNA, 22 bp, Homo sapiens
agggtagggtaaatgatgcatc

SEQ ID NO: 8441700 - DNA, 22 bp, Homo sapiens
agggtaggtgtaagatagccct

SEQ ID NO: 8441701 - DNA, 22 bp, Homo sapiens
agggtatgttttaggctgagtt

SEQ ID NO: 8441702 - DNA, 22 bp, Homo sapiens
agggtaggaactgagtggaagg

SEQ ID NO: 8441703 - DNA, 22 bp, Homo sapiens
cctgagagtaggtgtctcttta

SEQ ID NO: 8441704 - DNA, 22 bp, Homo sapiens
cctgagagtgagggcctcctta

SEQ ID NO: 8441705 - DNA, 22 bp, Homo sapiens
cctgagagtgagtgccacctta

SEQ ID NO: 8441706 - DNA, 22 bp, Homo sapiens
cctgaagatgctgtggcctggt

SEQ ID NO: 8441707 - DNA, 22 bp, Homo sapiens
cctgagagagtgagccctgaca

SEQ ID NO: 8441708 - DNA, 22 bp, Homo sapiens
cctgagagccagtgcctgccca

SEQ ID NO: 8441709 - DNA, 22 bp, Homo sapiens
cctgagagccctagccaggcgc

SEQ ID NO: 8441710 - DNA, 22 bp, Homo sapiens
cctgagagccctagccaggcgc

SEQ ID NO: 8441711 - DNA, 22 bp, Homo sapiens
cctgagaggccctctcactgtc

SEQ ID NO: 8441712 - DNA, 22 bp, Homo sapiens
cctgagaggccctctcactgtc

SEQ ID NO: 8441713 - DNA, 22 bp, Homo sapiens
cctgagagggggccctagaaat

SEQ ID NO: 8441714 - DNA, 22 bp, Homo sapiens
cctgaagagtgaatgtggcagt

SEQ ID NO: 8441715 - DNA, 22 bp, Homo sapiens
cctgaagagtgaatgtggcagt

SEQ ID NO: 8441716 - DNA, 22 bp, Homo sapiens
cctgaaatgactccagctgagt

SEQ ID NO: 8441717 - DNA, 21 bp, Homo sapiens
cctgaaattctcactagctta

SEQ ID NO: 8441718 - DNA, 22 bp, Homo sapiens
cctgaagaaaattccacgagaa

SEQ ID NO: 8441719 - DNA, 22 bp, Homo sapiens
ccccagagagcaccatgaagcc

SEQ ID NO: 8441720 - DNA, 22 bp, Homo sapiens
ccccagagaaagtcagcagcat

SEQ ID NO: 8441721 - DNA, 18 bp, Homo sapiens
cccatgttgccagtcagc

SEQ ID NO: 8441722 - DNA, 22 bp, Homo sapiens
cccattcatcctcgcttccttc

SEQ ID NO: 8441723 - DNA, 22 bp, Homo sapiens
cccatgccttctgactcacagg

SEQ ID NO: 8441724 - DNA, 22 bp, Homo sapiens
cccatggagtgcctgagggcca

SEQ ID NO: 8441725 - DNA, 22 bp, Homo sapiens
cccatgctgagtggcctgagat

SEQ ID NO: 8441726 - DNA, 22 bp, Homo sapiens
cccatgctgagtggcctgagat

SEQ ID NO: 8441727 - DNA, 22 bp, Homo sapiens
cccatggcaataaggtcacagg

SEQ ID NO: 8441728 - DNA, 22 bp, Homo sapiens
cccatggcaataaggtcacagg

SEQ ID NO: 8441729 - DNA, 22 bp, Homo sapiens
cccatgcatccctctcctgggc

SEQ ID NO: 8441730 - DNA, 22 bp, Homo sapiens
ccccagcacaggctcctcagat

SEQ ID NO: 8441731 - DNA, 22 bp, Homo sapiens
ccccagcacaggctcctcagat

SEQ ID NO: 8441732 - DNA, 22 bp, Homo sapiens
ccccttccaggaagcagaatcg

SEQ ID NO: 8441733 - DNA, 22 bp, Homo sapiens
ccctaggctgggctcttggctt

SEQ ID NO: 8441734 - DNA, 22 bp, Homo sapiens
ccctaggctgaggccagggtgc

SEQ ID NO: 8441735 - DNA, 22 bp, Homo sapiens
ccctagggtttggccagagccc

SEQ ID NO: 8441736 - DNA, 22 bp, Homo sapiens
ccctagggctaagcaggactgc

SEQ ID NO: 8441737 - DNA, 22 bp, Homo sapiens
ccctcaccaggctccaggcatg

SEQ ID NO: 8441738 - DNA, 22 bp, Homo sapiens
ccctcaccaggctccaggcatg

SEQ ID NO: 8441739 - DNA, 22 bp, Homo sapiens
ccctcacttcacgctctgcaga

SEQ ID NO: 8441740 - DNA, 20 bp, Homo sapiens
ccctcccagatgcttcccaa

SEQ ID NO: 8441741 - DNA, 20 bp, Homo sapiens
ccctcccagatgcttcccaa

SEQ ID NO: 8441742 - DNA, 22 bp, Homo sapiens
ccctcccaagcactctgacata

SEQ ID NO: 8441743 - DNA, 22 bp, Homo sapiens
ccctcagagcctgaagcaagca

SEQ ID NO: 8441744 - DNA, 22 bp, Homo sapiens
ccctcagctccaccctcagcag

SEQ ID NO: 8441745 - DNA, 22 bp, Homo sapiens
ccctccatgagtgtgctgctgg

SEQ ID NO: 8441746 - DNA, 22 bp, Homo sapiens
ccctgccaatcccgtctctctg

SEQ ID NO: 8441747 - DNA, 18 bp, Homo sapiens
ccctgccagctcccagca

SEQ ID NO: 8441748 - DNA, 22 bp, Homo sapiens
ccctcccaggagtggccagaga

SEQ ID NO: 8441749 - DNA, 22 bp, Homo sapiens
ccctgctgtgtcccacctggaa

SEQ ID NO: 8441750 - DNA, 22 bp, Homo sapiens
ccctgctgtcaggtgctgggag

SEQ ID NO: 8441751 - DNA, 22 bp, Homo sapiens
ccctgctgccttcacccaggac

SEQ ID NO: 8441752 - DNA, 22 bp, Homo sapiens
ccctgccctggagacacttaaa

SEQ ID NO: 8441753 - DNA, 22 bp, Homo sapiens
ccctgcccaccacatgctggga

SEQ ID NO: 8441754 - DNA, 22 bp, Homo sapiens
ccctgccagggtcctgacagac

SEQ ID NO: 8441755 - DNA, 22 bp, Homo sapiens
ccctgccccaggcggcttcact

SEQ ID NO: 8441756 - DNA, 22 bp, Homo sapiens
cccagttttctgattgaagagc

SEQ ID NO: 8441757 - DNA, 22 bp, Homo sapiens
cccatatactttttctggtcca

SEQ ID NO: 8441758 - DNA, 22 bp, Homo sapiens
cccatcaggaacccaggagccc

SEQ ID NO: 8441759 - DNA, 22 bp, Homo sapiens
cccatccctgattttcactcgt

SEQ ID NO: 8441760 - DNA, 22 bp, Homo sapiens
cccagtattgagctacaggcct

SEQ ID NO: 8441761 - DNA, 22 bp, Homo sapiens
cccaggcttttctcttgcccca

SEQ ID NO: 8441762 - DNA, 22 bp, Homo sapiens
cccaggcttttctcttgcccca

SEQ ID NO: 8441763 - DNA, 22 bp, Homo sapiens
cccaggcttttaagttagacag

SEQ ID NO: 8441764 - DNA, 22 bp, Homo sapiens
cccaggctgtgcaaacttcaaa

SEQ ID NO: 8441765 - DNA, 22 bp, Homo sapiens
cccaggctgtctgtcctttgct

SEQ ID NO: 8441766 - DNA, 22 bp, Homo sapiens
cccaggctggaattccaggcct

SEQ ID NO: 8441767 - DNA, 22 bp, Homo sapiens
cccaggctgtgcaaacttcaaa

SEQ ID NO: 8441768 - DNA, 22 bp, Homo sapiens
cccaggcttcccaatcagaagg

SEQ ID NO: 8441769 - DNA, 18 bp, Homo sapiens
cccaggctttgtgggtct

SEQ ID NO: 8441770 - DNA, 18 bp, Homo sapiens
cccaggctttgtgggtct

SEQ ID NO: 8441771 - DNA, 22 bp, Homo sapiens
cccaggcttttaagttagacag

SEQ ID NO: 8441772 - DNA, 22 bp, Homo sapiens
cccaggctgcgtatccacaata

SEQ ID NO: 8441773 - DNA, 22 bp, Homo sapiens
cccaggctgccacgattactgc

SEQ ID NO: 8441774 - DNA, 22 bp, Homo sapiens
cccaggctgccacgattactgc

SEQ ID NO: 8441775 - DNA, 22 bp, Homo sapiens
cccaggctgcatgagtccatgg

SEQ ID NO: 8441776 - DNA, 22 bp, Homo sapiens
cccaggctgcatgagtccatgg

SEQ ID NO: 8441777 - DNA, 22 bp, Homo sapiens
cccaggctgatgggatgggcca

SEQ ID NO: 8441778 - DNA, 22 bp, Homo sapiens
cccaggctgatgttcagcgggt

SEQ ID NO: 8441779 - DNA, 22 bp, Homo sapiens
cccaggctgatgttcagcgggt

SEQ ID NO: 8441780 - DNA, 22 bp, Homo sapiens
cccaggaggtcaaggctgcagt

SEQ ID NO: 8441781 - DNA, 22 bp, Homo sapiens
cccaggaggtcaaggctgcagt

SEQ ID NO: 8441782 - DNA, 23 bp, Homo sapiens
cccaggctacaaattatgctctg

SEQ ID NO: 8441783 - DNA, 23 bp, Homo sapiens
cccaggctacaaattatgctctg

SEQ ID NO: 8441784 - DNA, 22 bp, Homo sapiens
cccaggaggtcgaagctgcagt

SEQ ID NO: 8441785 - DNA, 22 bp, Homo sapiens
cccaggaggtcgaagctgcagt

SEQ ID NO: 8441786 - DNA, 22 bp, Homo sapiens
aggctgtatgtttccatttgaa

SEQ ID NO: 8441787 - DNA, 22 bp, Homo sapiens
aggctgggtacctgtcatatgc

SEQ ID NO: 8441788 - DNA, 22 bp, Homo sapiens
aggctgtgaaatgtggcaagga

SEQ ID NO: 8441789 - DNA, 22 bp, Homo sapiens
aggctgtgacagggtcatggag

SEQ ID NO: 8441790 - DNA, 22 bp, Homo sapiens
aggctgtctcagcctgcttgca

SEQ ID NO: 8441791 - DNA, 22 bp, Homo sapiens
aggctgtcatggctataggccc

SEQ ID NO: 8441792 - DNA, 20 bp, Homo sapiens
aggctgtcatttctggcagg

SEQ ID NO: 8441793 - DNA, 20 bp, Homo sapiens
cccaggagctgtgccccatc

SEQ ID NO: 8441794 - DNA, 20 bp, Homo sapiens
cccaggagctgtgccccatc

SEQ ID NO: 8441795 - DNA, 23 bp, Homo sapiens
cccaggagcctgagtcctctctg

SEQ ID NO: 8441796 - DNA, 22 bp, Homo sapiens
cccaggagcttctctctgcctc

SEQ ID NO: 8441797 - DNA, 22 bp, Homo sapiens
cccaggagggtggcctctgccc

SEQ ID NO: 8441798 - DNA, 22 bp, Homo sapiens
cccaggagatgcactccattgg

SEQ ID NO: 8441799 - DNA, 22 bp, Homo sapiens
cccaggagccatctgtcttggc

SEQ ID NO: 8441800 - DNA, 22 bp, Homo sapiens
gctctgggttctgatttatgag

SEQ ID NO: 8441801 - DNA, 22 bp, Homo sapiens
gctctgggttctgatttatgag

SEQ ID NO: 8441802 - DNA, 22 bp, Homo sapiens
gctgagaaatgcagacatgctg

SEQ ID NO: 8441803 - DNA, 22 bp, Homo sapiens
gctgagctgggacagtcctggg

SEQ ID NO: 8441804 - DNA, 22 bp, Homo sapiens
gctgaggacatcatggaaggaa

SEQ ID NO: 8441805 - DNA, 22 bp, Homo sapiens
gctgaggaaaggctggaaggga

SEQ ID NO: 8441806 - DNA, 22 bp, Homo sapiens
gctgagctgggacagtcctggg

SEQ ID NO: 8441807 - DNA, 22 bp, Homo sapiens
caaatgaatttccctgcaaatg

SEQ ID NO: 8441808 - DNA, 22 bp, Homo sapiens
caaatgaatatttccatgggtt

SEQ ID NO: 8441809 - DNA, 22 bp, Homo sapiens
caaatgaatagggagtgtgatg

SEQ ID NO: 8441810 - DNA, 22 bp, Homo sapiens
caaattcaaatttcatcagtgt

SEQ ID NO: 8441811 - DNA, 22 bp, Homo sapiens
caaattcaaatttcatcagtgt

SEQ ID NO: 8441812 - DNA, 22 bp, Homo sapiens
caaatgtgttttttcttctaca

SEQ ID NO: 8441813 - DNA, 22 bp, Homo sapiens
caaattaccctcaacatctaga

SEQ ID NO: 8441814 - DNA, 22 bp, Homo sapiens
caaatgaagtccaaagggctta

SEQ ID NO: 8441815 - DNA, 22 bp, Homo sapiens
caaatgaagggagctgaagtct

SEQ ID NO: 8441816 - DNA, 22 bp, Homo sapiens
caaatgaaggtggtgggtcatt

SEQ ID NO: 8441817 - DNA, 22 bp, Homo sapiens
caaatgaagaaccttctcacct

SEQ ID NO: 8441818 - DNA, 20 bp, Homo sapiens
caaatgaagctgttggcctc

SEQ ID NO: 8441819 - DNA, 22 bp, Homo sapiens
caaatgaagagggcaacttctg

SEQ ID NO: 8441820 - DNA, 22 bp, Homo sapiens
caaatgaaaatggcgtcttgga

SEQ ID NO: 8441821 - DNA, 22 bp, Homo sapiens
caaatgaaaatggcgtcttgga

SEQ ID NO: 8441822 - DNA, 22 bp, Homo sapiens
caaatctttaattgaggaatca

SEQ ID NO: 8441823 - DNA, 15 bp, Homo sapiens
gctctgggtatttga

SEQ ID NO: 8441824 - DNA, 22 bp, Homo sapiens
gctctgggtgaacttggagcaa

SEQ ID NO: 8441825 - DNA, 22 bp, Homo sapiens
gctctgggtgaacttggagcaa

SEQ ID NO: 8441826 - DNA, 22 bp, Homo sapiens
gctctgggtgaagggtaccatt

SEQ ID NO: 8441827 - DNA, 22 bp, Homo sapiens
gctctgggtgaagggtaccatt

SEQ ID NO: 8441828 - DNA, 20 bp, Homo sapiens
gctctgggtggtaaatgact

SEQ ID NO: 8441829 - DNA, 22 bp, Homo sapiens
gctctgggttctgatttatgag

SEQ ID NO: 8441830 - DNA, 20 bp, Homo sapiens
gctctgggtggtaaatgact

SEQ ID NO: 8441831 - DNA, 22 bp, Homo sapiens
gctctgggtgaatggcagattg

SEQ ID NO: 8441832 - DNA, 22 bp, Homo sapiens
caaatctttaattgaggaatca

SEQ ID NO: 8441833 - DNA, 22 bp, Homo sapiens
caaatctgagtctacaatttta

SEQ ID NO: 8441834 - DNA, 22 bp, Homo sapiens
caaatctaggatgcatgtagtg

SEQ ID NO: 8441835 - DNA, 20 bp, Homo sapiens
caaatccctgctctgtgctg

SEQ ID NO: 8441836 - DNA, 22 bp, Homo sapiens
caaatccagatcccagtcgtag

SEQ ID NO: 8441837 - DNA, 22 bp, Homo sapiens
caaatccagatcccagtcgtag

SEQ ID NO: 8441838 - DNA, 22 bp, Homo sapiens
caaatccagatcccagtcgtag

SEQ ID NO: 8441839 - DNA, 22 bp, Homo sapiens
gctctgagagagcaaagtcacc

SEQ ID NO: 8441840 - DNA, 22 bp, Homo sapiens
gctctgagacagtagagatggc

SEQ ID NO: 8441841 - DNA, 22 bp, Homo sapiens
gctctgagagctacacagggta

SEQ ID NO: 8441842 - DNA, 22 bp, Homo sapiens
gctctgagaggatgctgagcag

SEQ ID NO: 8441843 - DNA, 22 bp, Homo sapiens
caaatagacttcaatctcttga

SEQ ID NO: 8441844 - DNA, 22 bp, Homo sapiens
caaatattccaggtacatccct

SEQ ID NO: 8441845 - DNA, 22 bp, Homo sapiens
gctctgagaggtgcagcagtaa

SEQ ID NO: 8441846 - DNA, 22 bp, Homo sapiens
caaatagactctagaatttatt

SEQ ID NO: 8441847 - DNA, 19 bp, Homo sapiens
gctctgagaggggcatggg

SEQ ID NO: 8441848 - DNA, 22 bp, Homo sapiens
gctaacattgattcagtgcctg

SEQ ID NO: 8441849 - DNA, 22 bp, Homo sapiens
gctaaaaggagcactagagatt

SEQ ID NO: 8441850 - DNA, 22 bp, Homo sapiens
gcgtgtgtgatatgcctctgca

SEQ ID NO: 8441851 - DNA, 22 bp, Homo sapiens
gcgcaggcccgggtcagggccg

SEQ ID NO: 8441852 - DNA, 21 bp, Homo sapiens
gcctggctctcactggcctgg

SEQ ID NO: 8441853 - DNA, 22 bp, Homo sapiens
gcctggctcctaaggactggct

SEQ ID NO: 8441854 - DNA, 22 bp, Homo sapiens
gcctggctcctaaggactggct

SEQ ID NO: 8441855 - DNA, 22 bp, Homo sapiens
gcctggctcctaaggactggct

SEQ ID NO: 8441856 - DNA, 22 bp, Homo sapiens
gcctggctcctaagagcacaac

SEQ ID NO: 8441857 - DNA, 22 bp, Homo sapiens
gctaataattcctttgtgaact

SEQ ID NO: 8441858 - DNA, 22 bp, Homo sapiens
gctaattcacagtaggaaattt

SEQ ID NO: 8441859 - DNA, 22 bp, Homo sapiens
gctacaagtcttgtcattcatt

SEQ ID NO: 8441860 - DNA, 22 bp, Homo sapiens
gctacagactgagcatggctct

SEQ ID NO: 8441861 - DNA, 22 bp, Homo sapiens
gctattcatggagcatgtactg

SEQ ID NO: 8441862 - DNA, 22 bp, Homo sapiens
gctattgtgacagcttttcgcc

SEQ ID NO: 8441863 - DNA, 22 bp, Homo sapiens
gctatgttcccttttgctataa

SEQ ID NO: 8441864 - DNA, 22 bp, Homo sapiens
gctcaaaggccaggtagcagca

SEQ ID NO: 8441865 - DNA, 22 bp, Homo sapiens
gctcaaagaggcctccaaatcc

SEQ ID NO: 8441866 - DNA, 22 bp, Homo sapiens
gctcaaaggttgatagctgtgc

SEQ ID NO: 8441867 - DNA, 21 bp, Homo sapiens
gctcaaagggcttgccatgct

SEQ ID NO: 8441868 - DNA, 23 bp, Homo sapiens
gctcaggcatcattcttcctggc

SEQ ID NO: 8441869 - DNA, 22 bp, Homo sapiens
gctcagggctaaggctgagggg

SEQ ID NO: 8441870 - DNA, 23 bp, Homo sapiens
gctcaggcatcattcttcctggc

SEQ ID NO: 8441871 - DNA, 22 bp, Homo sapiens
gctcaaagaccagacagaggag

SEQ ID NO: 8441872 - DNA, 22 bp, Homo sapiens
gctcaaagaccagacagaggag

SEQ ID NO: 8441873 - DNA, 22 bp, Homo sapiens
gctatttttgagccatttataa

SEQ ID NO: 8441874 - DNA, 22 bp, Homo sapiens
gctatttttgagccatttataa

SEQ ID NO: 8441875 - DNA, 22 bp, Homo sapiens
gctctagtaggaatgtccctct

SEQ ID NO: 8441876 - DNA, 22 bp, Homo sapiens
gctctagtaggaatgtccctct

SEQ ID NO: 8441877 - DNA, 22 bp, Homo sapiens
gctctaggttcctagccaagtc

SEQ ID NO: 8441878 - DNA, 22 bp, Homo sapiens
gctctagctggcgctgacctgg

SEQ ID NO: 8441879 - DNA, 22 bp, Homo sapiens
gctctagcccatttcctgcttg

SEQ ID NO: 8441880 - DNA, 22 bp, Homo sapiens
gctctagcaaggctggcctggg

SEQ ID NO: 8441881 - DNA, 22 bp, Homo sapiens
gctctagatcataggtcattat

SEQ ID NO: 8441882 - DNA, 22 bp, Homo sapiens
gctcgtgagagcggctcgtcat

SEQ ID NO: 8441883 - DNA, 22 bp, Homo sapiens
gctccaggctgctctgtcccat

SEQ ID NO: 8441884 - DNA, 22 bp, Homo sapiens
gctccaggctgctctgtcccat

SEQ ID NO: 8441885 - DNA, 22 bp, Homo sapiens
gctcctggatgttcaagtcggc

SEQ ID NO: 8441886 - DNA, 22 bp, Homo sapiens
gctcctggatgttcaagtcggc

SEQ ID NO: 8441887 - DNA, 22 bp, Homo sapiens
gctccagggaacagaatgtact

SEQ ID NO: 8441888 - DNA, 22 bp, Homo sapiens
gctcgcagatcacctgggggcg

SEQ ID NO: 8441889 - DNA, 22 bp, Homo sapiens
gctcagggtcccttggtgctgg

SEQ ID NO: 8441890 - DNA, 22 bp, Homo sapiens
gctcagggtcccttggtgctgg

SEQ ID NO: 8441891 - DNA, 22 bp, Homo sapiens
gctcaggggaatgggctgccgt

SEQ ID NO: 8441892 - DNA, 22 bp, Homo sapiens
gctcagggctaaggctgagggg

SEQ ID NO: 8441893 - DNA, 22 bp, Homo sapiens
gctcaggggaatgggctgccgt

SEQ ID NO: 8441894 - DNA, 22 bp, Homo sapiens
gctcaggggaatgggctgccgt

SEQ ID NO: 8441895 - DNA, 20 bp, Homo sapiens
gctcaggtttgggctttgtg

SEQ ID NO: 8441896 - DNA, 22 bp, Homo sapiens
gctcaggtgttacctcctctag

SEQ ID NO: 8441897 - DNA, 22 bp, Homo sapiens
gctcaggtcttacccatgcctg

SEQ ID NO: 8441898 - DNA, 20 bp, Homo sapiens
gctcaggtgacagtcaggag

SEQ ID NO: 8441899 - DNA, 22 bp, Homo sapiens
gctcagggtgcagtgtccatga

SEQ ID NO: 8441900 - DNA, 18 bp, Homo sapiens
gctcaggtatagacaggg

SEQ ID NO: 8441901 - DNA, 22 bp, Homo sapiens
gctcaggtcttacccatgcctg

SEQ ID NO: 8441902 - DNA, 22 bp, Homo sapiens
gctcaggtgttacctcctctag

SEQ ID NO: 8441903 - DNA, 22 bp, Homo sapiens
gctcagtgaaacatcaaatagt

SEQ ID NO: 8441904 - DNA, 22 bp, Homo sapiens
gctccaggccacggcttcttgg

SEQ ID NO: 8441905 - DNA, 22 bp, Homo sapiens
gctccaggccccagcgttccgc

SEQ ID NO: 8441906 - DNA, 22 bp, Homo sapiens
gctccaggccccagcgttccgc

SEQ ID NO: 8441907 - DNA, 22 bp, Homo sapiens
gctccaggcgagctggaccaga

SEQ ID NO: 8441908 - DNA, 17 bp, Homo sapiens
gctccaggcgtgagtga

SEQ ID NO: 8441909 - DNA, 23 bp, Homo sapiens
attttacaggtcagttccttgaa

SEQ ID NO: 8441910 - DNA, 22 bp, Homo sapiens
attttaataagattcccaagta

SEQ ID NO: 8441911 - DNA, 22 bp, Homo sapiens
attttaataagattcccaagta

SEQ ID NO: 8441912 - DNA, 22 bp, Homo sapiens
attttaataagatccatttggt

SEQ ID NO: 8441913 - DNA, 22 bp, Homo sapiens
atttgcctttcgaatcaacagg

SEQ ID NO: 8441914 - DNA, 22 bp, Homo sapiens
atttgccttgtgatttgtaagt

SEQ ID NO: 8441915 - DNA, 22 bp, Homo sapiens
atttgccttactgaagaaggag

SEQ ID NO: 8441916 - DNA, 22 bp, Homo sapiens
atttgccttgtgaattggatat

SEQ ID NO: 8441917 - DNA, 22 bp, Homo sapiens
atttgccttactgaagaaggag

SEQ ID NO: 8441918 - DNA, 22 bp, Homo sapiens
atttgccttggtgatttgtaaa

SEQ ID NO: 8441919 - DNA, 22 bp, Homo sapiens
atttgcatttagaaagatcact

SEQ ID NO: 8441920 - DNA, 22 bp, Homo sapiens
atttgcctctgctttcaaggat

SEQ ID NO: 8441921 - DNA, 22 bp, Homo sapiens
atttgcctgtaagacaaggcct

SEQ ID NO: 8441922 - DNA, 22 bp, Homo sapiens
atttgcctgtaagacaaggcct

SEQ ID NO: 8441923 - DNA, 21 bp, Homo sapiens
atttgcattaaaatattacgc

SEQ ID NO: 8441924 - DNA, 22 bp, Homo sapiens
atttgcatttacatagcataga

SEQ ID NO: 8441925 - DNA, 22 bp, Homo sapiens
atttgcatgacctttgcaagtg

SEQ ID NO: 8441926 - DNA, 22 bp, Homo sapiens
atttgcatatctgatagactaa

SEQ ID NO: 8441927 - DNA, 20 bp, Homo sapiens
atttgcatctgaataactta

SEQ ID NO: 8441928 - DNA, 22 bp, Homo sapiens
atttgcataaggatgctactgt

SEQ ID NO: 8441929 - DNA, 22 bp, Homo sapiens
atttgcaagcatgcacaaaagc

SEQ ID NO: 8441930 - DNA, 22 bp, Homo sapiens
atttgcaaaggttaacagcagt

SEQ ID NO: 8441931 - DNA, 22 bp, Homo sapiens
atttgcaaagtcgtatctgtga

SEQ ID NO: 8441932 - DNA, 22 bp, Homo sapiens
atttgcaaagtcgtatctgtga

SEQ ID NO: 8441933 - DNA, 22 bp, Homo sapiens
attttacataaggaaggtttaa

SEQ ID NO: 8441934 - DNA, 23 bp, Homo sapiens
attttacaggtcagttccttgaa

SEQ ID NO: 8441935 - DNA, 23 bp, Homo sapiens
attttacaggtcagttccttgaa

SEQ ID NO: 8441936 - DNA, 22 bp, Homo sapiens
attttacataaggaaggtttaa

SEQ ID NO: 8441937 - DNA, 22 bp, Homo sapiens
attttacataaggaaggtttaa

SEQ ID NO: 8441938 - DNA, 22 bp, Homo sapiens
attttaccttaaagtctatatt

SEQ ID NO: 8441939 - DNA, 21 bp, Homo sapiens
gcctgccctctgtgatggcca

SEQ ID NO: 8441940 - DNA, 21 bp, Homo sapiens
gcctgccctctgtgatggcca

SEQ ID NO: 8441941 - DNA, 22 bp, Homo sapiens
gcctgcctagaattgcagcttt

SEQ ID NO: 8441942 - DNA, 22 bp, Homo sapiens
gcctgcctagaattgcagcttt

SEQ ID NO: 8441943 - DNA, 22 bp, Homo sapiens
attttgaaaagcatttgagtaa

SEQ ID NO: 8441944 - DNA, 22 bp, Homo sapiens
attttgaaaagcatttgagtaa

SEQ ID NO: 8441945 - DNA, 22 bp, Homo sapiens
attttgaaaccaagttatttcc

SEQ ID NO: 8441946 - DNA, 22 bp, Homo sapiens
attttgaaaccaagttatttcc

SEQ ID NO: 8441947 - DNA, 22 bp, Homo sapiens
attttcttctctccctggctgc

SEQ ID NO: 8441948 - DNA, 22 bp, Homo sapiens
attttgaaatacttgaaggaaa

SEQ ID NO: 8441949 - DNA, 18 bp, Homo sapiens
attttgaacaatgctgta

SEQ ID NO: 8441950 - DNA, 18 bp, Homo sapiens
attttgaactgggaatat

SEQ ID NO: 8441951 - DNA, 22 bp, Homo sapiens
attttgaagggaattgaagttc

SEQ ID NO: 8441952 - DNA, 22 bp, Homo sapiens
attttgaagggaattgaagttc

SEQ ID NO: 8441953 - DNA, 22 bp, Homo sapiens
gcctggctcacagagcagcctt

SEQ ID NO: 8441954 - DNA, 22 bp, Homo sapiens
gcctggctccctctgcagctcc

SEQ ID NO: 8441955 - DNA, 22 bp, Homo sapiens
gcctggctccctctgcagctcc

SEQ ID NO: 8441956 - DNA, 17 bp, Homo sapiens
atttacattgtcaccga

SEQ ID NO: 8441957 - DNA, 22 bp, Homo sapiens
atttacattccatggtggttac

SEQ ID NO: 8441958 - DNA, 22 bp, Homo sapiens
atttacataatagactttaggt

SEQ ID NO: 8441959 - DNA, 22 bp, Homo sapiens
atttacagtttagcatttcaag

SEQ ID NO: 8441960 - DNA, 22 bp, Homo sapiens
atttacagacgtggattagtgc

SEQ ID NO: 8441961 - DNA, 22 bp, Homo sapiens
atttacatttatttgagaaggt

SEQ ID NO: 8441962 - DNA, 18 bp, Homo sapiens
atttacccagcaacgtgg

SEQ ID NO: 8441963 - DNA, 18 bp, Homo sapiens
gccagagggaagcaggtg

SEQ ID NO: 8441964 - DNA, 22 bp, Homo sapiens
gccagaggggctcgaaggcgcg

SEQ ID NO: 8441965 - DNA, 22 bp, Homo sapiens
gccagaggggctcgaaggcgcg

SEQ ID NO: 8441966 - DNA, 18 bp, Homo sapiens
gccagaggtactactgat

SEQ ID NO: 8441967 - DNA, 19 bp, Homo sapiens
gcccacggccctgctctgc

SEQ ID NO: 8441968 - DNA, 22 bp, Homo sapiens
gcccagccagagctgtgtgatg

SEQ ID NO: 8441969 - DNA, 22 bp, Homo sapiens
gcccagcccagaaaggttcgga

SEQ ID NO: 8441970 - DNA, 22 bp, Homo sapiens
gcccagccagagctgtgtgatg

SEQ ID NO: 8441971 - DNA, 22 bp, Homo sapiens
gcccagccacagtcactttcat

SEQ ID NO: 8441972 - DNA, 22 bp, Homo sapiens
gcccagcaggggatggcagctc

SEQ ID NO: 8441973 - DNA, 22 bp, Homo sapiens
gcccagcaggacagagtggttt

SEQ ID NO: 8441974 - DNA, 22 bp, Homo sapiens
gcccagcaggacagagtggttt

SEQ ID NO: 8441975 - DNA, 19 bp, Homo sapiens
gccctcctcactgagctct

SEQ ID NO: 8441976 - DNA, 22 bp, Homo sapiens
gccctcctgcaggggcttctgg

SEQ ID NO: 8441977 - DNA, 22 bp, Homo sapiens
gccctcctgagctagcacgtgt

SEQ ID NO: 8441978 - DNA, 22 bp, Homo sapiens
gccctcctggcaggcagtgatg

SEQ ID NO: 8441979 - DNA, 22 bp, Homo sapiens
gccctccatggtgatccaggcc

SEQ ID NO: 8441980 - DNA, 22 bp, Homo sapiens
gccctgccctgagccgtagacc

SEQ ID NO: 8441981 - DNA, 22 bp, Homo sapiens
gccctgcagtgcggaggtggca

SEQ ID NO: 8441982 - DNA, 22 bp, Homo sapiens
gccctccatgagacacagtgta

SEQ ID NO: 8441983 - DNA, 22 bp, Homo sapiens
gccctccagctgttgcgcgtcg

SEQ ID NO: 8441984 - DNA, 22 bp, Homo sapiens
gccctccacctggtctctctgg

SEQ ID NO: 8441985 - DNA, 22 bp, Homo sapiens
gccctccacctggtctctctgg

SEQ ID NO: 8441986 - DNA, 22 bp, Homo sapiens
gccctccaccagagcccttctc

SEQ ID NO: 8441987 - DNA, 22 bp, Homo sapiens
gcccaggagttgaagggctgac

SEQ ID NO: 8441988 - DNA, 22 bp, Homo sapiens
gcccaggagttgaagggctgac

SEQ ID NO: 8441989 - DNA, 22 bp, Homo sapiens
gcccagcccctgggtggacgtg

SEQ ID NO: 8441990 - DNA, 22 bp, Homo sapiens
gcccagcccctgggtggacgtg

SEQ ID NO: 8441991 - DNA, 22 bp, Homo sapiens
gcccaggaggtcaagtagctat

SEQ ID NO: 8441992 - DNA, 22 bp, Homo sapiens
gcccaggaggtggaggtgcagt

SEQ ID NO: 8441993 - DNA, 22 bp, Homo sapiens
gcccaggagttcaaggctgcag

SEQ ID NO: 8441994 - DNA, 22 bp, Homo sapiens
gcccaggaggttgggctgtgca

SEQ ID NO: 8441995 - DNA, 22 bp, Homo sapiens
gcagtgcagtgggacagggcgc

SEQ ID NO: 8441996 - DNA, 22 bp, Homo sapiens
gcagtgcagtgggacagggcgc

SEQ ID NO: 8441997 - DNA, 22 bp, Homo sapiens
gcagtgcaggacaaatcagtgc

SEQ ID NO: 8441998 - DNA, 18 bp, Homo sapiens
gcagtgcaggaagaagag

SEQ ID NO: 8441999 - DNA, 22 bp, Homo sapiens
gcagtgcaggaacatagcttct

SEQ ID NO: 8442000 - DNA, 18 bp, Homo sapiens
gcagtgcaggaagaagag

SEQ ID NO: 8442001 - DNA, 22 bp, Homo sapiens
gcagtgcatgtcggaactcatt

SEQ ID NO: 8442002 - DNA, 22 bp, Homo sapiens
gcagtgcattactcacatgttt

SEQ ID NO: 8442003 - DNA, 22 bp, Homo sapiens
gcagtgctgatcccatggcaga

SEQ ID NO: 8442004 - DNA, 22 bp, Homo sapiens
gcagtgctgatcccatggcaga

SEQ ID NO: 8442005 - DNA, 22 bp, Homo sapiens
gcagtgctaagtagctggccca

SEQ ID NO: 8442006 - DNA, 22 bp, Homo sapiens
gcagtgctaaggattctgcctt

SEQ ID NO: 8442007 - DNA, 18 bp, Homo sapiens
gcagtgccagcctctcct

SEQ ID NO: 8442008 - DNA, 22 bp, Homo sapiens
attgtacaaaaaagtagacctt

SEQ ID NO: 8442009 - DNA, 21 bp, Homo sapiens
gcagtgcagcttggagggtag

SEQ ID NO: 8442010 - DNA, 22 bp, Homo sapiens
attgttcattgtacacctagta

SEQ ID NO: 8442011 - DNA, 22 bp, Homo sapiens
gcattagacccaaggtattttg

SEQ ID NO: 8442012 - DNA, 22 bp, Homo sapiens
gcattagagcccatcacctgta

SEQ ID NO: 8442013 - DNA, 20 bp, Homo sapiens
gcattagagtactatatgct

SEQ ID NO: 8442014 - DNA, 22 bp, Homo sapiens
gcattagatatccttgaagtta

SEQ ID NO: 8442015 - DNA, 22 bp, Homo sapiens
gcattagatttgcctttgaagc

SEQ ID NO: 8442016 - DNA, 22 bp, Homo sapiens
attgttgggtctcactcctaga

SEQ ID NO: 8442017 - DNA, 22 bp, Homo sapiens
attgtttaaagatacatccctg

SEQ ID NO: 8442018 - DNA, 22 bp, Homo sapiens
attgtttacactaacttcataa

SEQ ID NO: 8442019 - DNA, 22 bp, Homo sapiens
attgttcctggaaaagaacagg

SEQ ID NO: 8442020 - DNA, 22 bp, Homo sapiens
gccactgtcatcttgtgaagca

SEQ ID NO: 8442021 - DNA, 22 bp, Homo sapiens
gccactgtcataccctggcaat

SEQ ID NO: 8442022 - DNA, 22 bp, Homo sapiens
gccactgtcataccctggcaat

SEQ ID NO: 8442023 - DNA, 22 bp, Homo sapiens
gccactgtactccagcctgcga

SEQ ID NO: 8442024 - DNA, 22 bp, Homo sapiens
gccactggcgctgtgcagagtg

SEQ ID NO: 8442025 - DNA, 20 bp, Homo sapiens
gccactgggcaccagcaggg

SEQ ID NO: 8442026 - DNA, 20 bp, Homo sapiens
attgtttcatttaatgtaca

SEQ ID NO: 8442027 - DNA, 22 bp, Homo sapiens
gccactgtcctgtgcctgtgct

SEQ ID NO: 8442028 - DNA, 22 bp, Homo sapiens
atttaaatgcttaagagggttt

SEQ ID NO: 8442029 - DNA, 22 bp, Homo sapiens
atttaaatgcttaagagggttt

SEQ ID NO: 8442030 - DNA, 22 bp, Homo sapiens
gccactgcactccagcccaggc

SEQ ID NO: 8442031 - DNA, 21 bp, Homo sapiens
gccactgcactccagcctggg

SEQ ID NO: 8442032 - DNA, 21 bp, Homo sapiens
gccactgcactccagcctggg

SEQ ID NO: 8442033 - DNA, 22 bp, Homo sapiens
gcattcagcctaaagagaaaag

SEQ ID NO: 8442034 - DNA, 22 bp, Homo sapiens
gcattcatacatcaataagctt

SEQ ID NO: 8442035 - DNA, 18 bp, Homo sapiens
gcattcagtagtgaacaa

SEQ ID NO: 8442036 - DNA, 22 bp, Homo sapiens
gcattcatgtccttcctgaacg

SEQ ID NO: 8442037 - DNA, 22 bp, Homo sapiens
gcagggctgggatttgagccca

SEQ ID NO: 8442038 - DNA, 22 bp, Homo sapiens
gcagggatgctgaggctcagtg

SEQ ID NO: 8442039 - DNA, 22 bp, Homo sapiens
gcagggaggtttgctgacctgg

SEQ ID NO: 8442040 - DNA, 22 bp, Homo sapiens
gcagggattgtgcagggggcta

SEQ ID NO: 8442041 - DNA, 22 bp, Homo sapiens
gcagggattgtcaatgctgctc

SEQ ID NO: 8442042 - DNA, 22 bp, Homo sapiens
gcagggattgtcaatgctgctc

SEQ ID NO: 8442043 - DNA, 22 bp, Homo sapiens
gcagggtccatggaggcagccc

SEQ ID NO: 8442044 - DNA, 22 bp, Homo sapiens
gcagggtaggtgacaggtagtc

SEQ ID NO: 8442045 - DNA, 22 bp, Homo sapiens
gcagggtcttgagaggcagcca

SEQ ID NO: 8442046 - DNA, 21 bp, Homo sapiens
gcagggtcctttccattccta

SEQ ID NO: 8442047 - DNA, 22 bp, Homo sapiens
attggttaactctgtgtgtcaa

SEQ ID NO: 8442048 - DNA, 22 bp, Homo sapiens
attggtggtgaggacatgccag

SEQ ID NO: 8442049 - DNA, 22 bp, Homo sapiens
attgtaaatagtgccacaataa

SEQ ID NO: 8442050 - DNA, 22 bp, Homo sapiens
attgtaaatagtgccacaataa

SEQ ID NO: 8442051 - DNA, 22 bp, Homo sapiens
gcaggtggatcaccacgtcagg

SEQ ID NO: 8442052 - DNA, 22 bp, Homo sapiens
gcaggtggatcaccacgtcagg

SEQ ID NO: 8442053 - DNA, 22 bp, Homo sapiens
gcagggtgaaggtcacatagaa

SEQ ID NO: 8442054 - DNA, 22 bp, Homo sapiens
gcagggtgaaggtcacatagaa

SEQ ID NO: 8442055 - DNA, 22 bp, Homo sapiens
gcaggtggatcacctgaggtca

SEQ ID NO: 8442056 - DNA, 22 bp, Homo sapiens
gcaggctgtggtatgttgggca

SEQ ID NO: 8442057 - DNA, 22 bp, Homo sapiens
gcaggctgtggtatgttgggca

SEQ ID NO: 8442058 - DNA, 22 bp, Homo sapiens
gcaggctgtggtatgttgggca

SEQ ID NO: 8442059 - DNA, 22 bp, Homo sapiens
gcagggaggaagagatgcttcc

SEQ ID NO: 8442060 - DNA, 22 bp, Homo sapiens
gcagggaggaagagatgcttcc

SEQ ID NO: 8442061 - DNA, 22 bp, Homo sapiens
gcagggagggcctttcatgaca

SEQ ID NO: 8442062 - DNA, 22 bp, Homo sapiens
gcagggagggcctttcatgaca

SEQ ID NO: 8442063 - DNA, 22 bp, Homo sapiens
gcaggctgtgaggctcagatgg

SEQ ID NO: 8442064 - DNA, 22 bp, Homo sapiens
gcaggctgtgaggctcagatgg

SEQ ID NO: 8442065 - DNA, 22 bp, Homo sapiens
gcaggctgtgaggctcagatgg

SEQ ID NO: 8442066 - DNA, 22 bp, Homo sapiens
gcaggctgtgaggctcagatgg

SEQ ID NO: 8442067 - DNA, 22 bp, Homo sapiens
gcaggctgtagacaccaaacta

SEQ ID NO: 8442068 - DNA, 22 bp, Homo sapiens
gcaggctgtagacaccaaacta

SEQ ID NO: 8442069 - DNA, 22 bp, Homo sapiens
gcaggctgtctaaagttagagt

SEQ ID NO: 8442070 - DNA, 22 bp, Homo sapiens
gcaggctgtctaaagttagagt

SEQ ID NO: 8442071 - DNA, 22 bp, Homo sapiens
gcaggctgtctaaagttagagt

SEQ ID NO: 8442072 - DNA, 22 bp, Homo sapiens
gcaggagccacttcagggatgc

SEQ ID NO: 8442073 - DNA, 22 bp, Homo sapiens
gcaggagcagtcaggggcagct

SEQ ID NO: 8442074 - DNA, 22 bp, Homo sapiens
gcaggagcagtcaggggcagct

SEQ ID NO: 8442075 - DNA, 22 bp, Homo sapiens
gcaggagcaatggcctatcaga

SEQ ID NO: 8442076 - DNA, 22 bp, Homo sapiens
gcaggagcaaactgcagtgtgg

SEQ ID NO: 8442077 - DNA, 22 bp, Homo sapiens
gcaggcgtgtttcacgtgccag

SEQ ID NO: 8442078 - DNA, 14 bp, Homo sapiens
gcaggcggatcact

SEQ ID NO: 8442079 - DNA, 18 bp, Homo sapiens
gcagatgagtagtgtacc

SEQ ID NO: 8442080 - DNA, 22 bp, Homo sapiens
gcagatagggtattaggagtaa

SEQ ID NO: 8442081 - DNA, 22 bp, Homo sapiens
gcagagttggagccagcccagg

SEQ ID NO: 8442082 - DNA, 22 bp, Homo sapiens
gcagagttgatgcaagtactga

SEQ ID NO: 8442083 - DNA, 22 bp, Homo sapiens
gcagaggctgggtgtcccagtc

SEQ ID NO: 8442084 - DNA, 22 bp, Homo sapiens
gcagaggcctgaaggtggcggg

SEQ ID NO: 8442085 - DNA, 22 bp, Homo sapiens
gcactgtgacccagagcaggtg

SEQ ID NO: 8442086 - DNA, 22 bp, Homo sapiens
gcagaagggaataaggagcttt

SEQ ID NO: 8442087 - DNA, 22 bp, Homo sapiens
gcagaagtggattctacaattt

SEQ ID NO: 8442088 - DNA, 22 bp, Homo sapiens
gcagaagtggattctacaattt

SEQ ID NO: 8442089 - DNA, 22 bp, Homo sapiens
gcagaagtcagaccatctgaat

SEQ ID NO: 8442090 - DNA, 22 bp, Homo sapiens
gcagaagtacctcgttctagtt

SEQ ID NO: 8442091 - DNA, 22 bp, Homo sapiens
gcagaattgatggagaacttaa

SEQ ID NO: 8442092 - DNA, 22 bp, Homo sapiens
gcagaatttaggaattaggaaa

SEQ ID NO: 8442093 - DNA, 22 bp, Homo sapiens
gcagaggcctaggtggaaggcc

SEQ ID NO: 8442094 - DNA, 22 bp, Homo sapiens
gcagaataatagaaaggcacac

SEQ ID NO: 8442095 - DNA, 22 bp, Homo sapiens
gcagaatacattttgttttcct

SEQ ID NO: 8442096 - DNA, 22 bp, Homo sapiens
gcagaagtggtgctgtgccact

SEQ ID NO: 8442097 - DNA, 22 bp, Homo sapiens
gcagaagttaatcgaaggccat

SEQ ID NO: 8442098 - DNA, 22 bp, Homo sapiens
gcagaatactgagagctgattg

SEQ ID NO: 8442099 - DNA, 22 bp, Homo sapiens
gcagaatagggcataactttgc

SEQ ID NO: 8442100 - DNA, 21 bp, Homo sapiens
gcagaatagtctctgtcttca

SEQ ID NO: 8442101 - DNA, 22 bp, Homo sapiens
gcagaatacatttgggattact

SEQ ID NO: 8442102 - DNA, 22 bp, Homo sapiens
gcagaatagtgactttccttaa

SEQ ID NO: 8442103 - DNA, 22 bp, Homo sapiens
gcagaatatattactgagcctc

SEQ ID NO: 8442104 - DNA, 22 bp, Homo sapiens
gcagaatattatggaaaaagta

SEQ ID NO: 8442105 - DNA, 22 bp, Homo sapiens
gcagctttagaaacaagggctg

SEQ ID NO: 8442106 - DNA, 22 bp, Homo sapiens
gcagccttccgtggacctggac

SEQ ID NO: 8442107 - DNA, 22 bp, Homo sapiens
gcagccttccgtggacctggac

SEQ ID NO: 8442108 - DNA, 18 bp, Homo sapiens
gcaggagatgggtggggt

SEQ ID NO: 8442109 - DNA, 22 bp, Homo sapiens
gcaggagagtctgtgccaggtt

SEQ ID NO: 8442110 - DNA, 22 bp, Homo sapiens
gcagcctgttgtaccagcctgt

SEQ ID NO: 8442111 - DNA, 22 bp, Homo sapiens
gcagcctgttgtaccagcctgt

SEQ ID NO: 8442112 - DNA, 22 bp, Homo sapiens
gcagcctgggcaacagagtgag

SEQ ID NO: 8442113 - DNA, 17 bp, Homo sapiens
gcagcctcttggtagtg

SEQ ID NO: 8442114 - DNA, 22 bp, Homo sapiens
gcagccaggtttgaggaccact

SEQ ID NO: 8442115 - DNA, 22 bp, Homo sapiens
gcagccaggctacagcgggctt

SEQ ID NO: 8442116 - DNA, 22 bp, Homo sapiens
gcagccagggctaagctgggga

SEQ ID NO: 8442117 - DNA, 22 bp, Homo sapiens
gcagccaggggctgtgacctgt

SEQ ID NO: 8442118 - DNA, 22 bp, Homo sapiens
gcagccagggctaagctgggga

SEQ ID NO: 8442119 - DNA, 19 bp, Homo sapiens
gcagccaggtgctctacct

SEQ ID NO: 8442120 - DNA, 22 bp, Homo sapiens
gcagatgccagatcatgcaggg

SEQ ID NO: 8442121 - DNA, 22 bp, Homo sapiens
gcagatgcagagatggctgggg

SEQ ID NO: 8442122 - DNA, 22 bp, Homo sapiens
gcagatgcagaactcagtgggt

SEQ ID NO: 8442123 - DNA, 22 bp, Homo sapiens
gcagcaggtccgcatcatcatc

SEQ ID NO: 8442124 - DNA, 22 bp, Homo sapiens
gcagcaggtccgcatcatcatc

SEQ ID NO: 8442125 - DNA, 22 bp, Homo sapiens
gcagccaggaagcctttccctc

SEQ ID NO: 8442126 - DNA, 22 bp, Homo sapiens
gcaactgttttgagcacccagt

SEQ ID NO: 8442127 - DNA, 22 bp, Homo sapiens
gcacacaggcagtttccagcca

SEQ ID NO: 8442128 - DNA, 22 bp, Homo sapiens
gcaactgttttgagcacccagt

SEQ ID NO: 8442129 - DNA, 22 bp, Homo sapiens
gcacacagggatttttgaatgg

SEQ ID NO: 8442130 - DNA, 22 bp, Homo sapiens
gcacacaggggagttctcagaa

SEQ ID NO: 8442131 - DNA, 17 bp, Homo sapiens
gcaaccagcccccatct

SEQ ID NO: 8442132 - DNA, 20 bp, Homo sapiens
gcaactagggagacacagct

SEQ ID NO: 8442133 - DNA, 22 bp, Homo sapiens
gcaacagttggattccagagga

SEQ ID NO: 8442134 - DNA, 18 bp, Homo sapiens
gcaacagtatcagcaggc

SEQ ID NO: 8442135 - DNA, 22 bp, Homo sapiens
gcaacatgaagaaaacagaacc

SEQ ID NO: 8442136 - DNA, 18 bp, Homo sapiens
gcaacagatcaacagaaa

SEQ ID NO: 8442137 - DNA, 22 bp, Homo sapiens
gcaaatggagtgaagagctgga

SEQ ID NO: 8442138 - DNA, 22 bp, Homo sapiens
gcaaacaagctgcctgaagatt

SEQ ID NO: 8442139 - DNA, 22 bp, Homo sapiens
gcaaatgtttttgagtgtttac

SEQ ID NO: 8442140 - DNA, 22 bp, Homo sapiens
gcaaattcaacagcacattctc

SEQ ID NO: 8442141 - DNA, 22 bp, Homo sapiens
gcaacaagtgtaaacatgcatt

SEQ ID NO: 8442142 - DNA, 22 bp, Homo sapiens
gcaacacaatatcccagtacat

SEQ ID NO: 8442143 - DNA, 22 bp, Homo sapiens
gcaacacagatcttctttgttg

SEQ ID NO: 8442144 - DNA, 22 bp, Homo sapiens
gcaaaaaatgcttgttgcttag

SEQ ID NO: 8442145 - DNA, 22 bp, Homo sapiens
gcaaaaaatgcttgttgcttag

SEQ ID NO: 8442146 - DNA, 22 bp, Homo sapiens
gcaaaaaatgcttgttgcttag

SEQ ID NO: 8442147 - DNA, 22 bp, Homo sapiens
atgtttctcactgtttctctat

SEQ ID NO: 8442148 - DNA, 22 bp, Homo sapiens
atgtttctagttgtatgtcact

SEQ ID NO: 8442149 - DNA, 22 bp, Homo sapiens
atgtttctagttgtatgtcact

SEQ ID NO: 8442150 - DNA, 22 bp, Homo sapiens
atgtttctagttgtatgtcact

SEQ ID NO: 8442151 - DNA, 20 bp, Homo sapiens
gcaaaataggctctgttggt

SEQ ID NO: 8442152 - DNA, 22 bp, Homo sapiens
gcaaaagtacagccggatttct

SEQ ID NO: 8442153 - DNA, 22 bp, Homo sapiens
gcaaaatttacactccttcttc

SEQ ID NO: 8442154 - DNA, 22 bp, Homo sapiens
gcaaaatttacactccttcttc

SEQ ID NO: 8442155 - DNA, 22 bp, Homo sapiens
gcaaaaagtagtgctggttagg

SEQ ID NO: 8442156 - DNA, 22 bp, Homo sapiens
gcactggtatcacctgagagct

SEQ ID NO: 8442157 - DNA, 22 bp, Homo sapiens
gcactggtatcacctgagagct

SEQ ID NO: 8442158 - DNA, 22 bp, Homo sapiens
gcactggttaccctgagtggct

SEQ ID NO: 8442159 - DNA, 22 bp, Homo sapiens
gcactggggtcatagcctccag

SEQ ID NO: 8442160 - DNA, 22 bp, Homo sapiens
gcacagggccctgtgcgtaggt

SEQ ID NO: 8442161 - DNA, 22 bp, Homo sapiens
gcactcagtaccaggtcactgc

SEQ ID NO: 8442162 - DNA, 22 bp, Homo sapiens
gcacagagcctggtaccgagaa

SEQ ID NO: 8442163 - DNA, 22 bp, Homo sapiens
gcacagagctggccctccaggc

SEQ ID NO: 8442164 - DNA, 23 bp, Homo sapiens
gcacagagcagttaggggaagat

SEQ ID NO: 8442165 - DNA, 18 bp, Homo sapiens
gcacagagcccaggctct

SEQ ID NO: 8442166 - DNA, 23 bp, Homo sapiens
gcacagagcagttaggggaagat

SEQ ID NO: 8442167 - DNA, 22 bp, Homo sapiens
gcacaggctgttggccttcaga

SEQ ID NO: 8442168 - DNA, 22 bp, Homo sapiens
gcacagaggatgaggcagctct

SEQ ID NO: 8442169 - DNA, 22 bp, Homo sapiens
gcacagaggatgaggcagctct

SEQ ID NO: 8442170 - DNA, 22 bp, Homo sapiens
gcacagaggatgaggcagctct

SEQ ID NO: 8442171 - DNA, 21 bp, Homo sapiens
gcacagggacagatcatcaca

SEQ ID NO: 8442172 - DNA, 22 bp, Homo sapiens
atgtaactgaaggaaatgcatg

SEQ ID NO: 8442173 - DNA, 22 bp, Homo sapiens
atggtttaaagagtatgacttt

SEQ ID NO: 8442174 - DNA, 22 bp, Homo sapiens
atggtttacaatgttttcagtt

SEQ ID NO: 8442175 - DNA, 22 bp, Homo sapiens
atgtaatttatgttatccataa

SEQ ID NO: 8442176 - DNA, 22 bp, Homo sapiens
atgtaattgtagcaaaatgatg

SEQ ID NO: 8442177 - DNA, 22 bp, Homo sapiens
atgtacaaaatgttttgaaatg

SEQ ID NO: 8442178 - DNA, 22 bp, Homo sapiens
atgtacaaaatgttttgaaatg

SEQ ID NO: 8442179 - DNA, 22 bp, Homo sapiens
atgtacaagctgttttactgca

SEQ ID NO: 8442180 - DNA, 22 bp, Homo sapiens
atgtacaagctgttttactgca

SEQ ID NO: 8442181 - DNA, 22 bp, Homo sapiens
atgtacaagctgttttactgca

SEQ ID NO: 8442182 - DNA, 22 bp, Homo sapiens
atgtacaaaatgttttgaaatg

SEQ ID NO: 8442183 - DNA, 22 bp, Homo sapiens
atgtatttgaaatttgagacat

SEQ ID NO: 8442184 - DNA, 22 bp, Homo sapiens
atgtatttctatgtagtgaaga

SEQ ID NO: 8442185 - DNA, 22 bp, Homo sapiens
atgtacaatctatcacaagaag

SEQ ID NO: 8442186 - DNA, 21 bp, Homo sapiens
atgtcaaatgctttattttat

SEQ ID NO: 8442187 - DNA, 21 bp, Homo sapiens
atgtcaaatgctttattttat

SEQ ID NO: 8442188 - DNA, 22 bp, Homo sapiens
atgtcacagcaggagtattctt

SEQ ID NO: 8442189 - DNA, 22 bp, Homo sapiens
atgtcacagtctgactcagtga

SEQ ID NO: 8442190 - DNA, 22 bp, Homo sapiens
atgtcacagcaggagtattctt

SEQ ID NO: 8442191 - DNA, 22 bp, Homo sapiens
atgtcacagctcccattcctcc

SEQ ID NO: 8442192 - DNA, 22 bp, Homo sapiens
gagcttggtgttatttctgtgg

SEQ ID NO: 8442193 - DNA, 22 bp, Homo sapiens
gagcttggtgctgcctgttgtc

SEQ ID NO: 8442194 - DNA, 22 bp, Homo sapiens
gagcttggtgcacagtggttaa

SEQ ID NO: 8442195 - DNA, 22 bp, Homo sapiens
gagcttggtgctgcctgttgtc

SEQ ID NO: 8442196 - DNA, 22 bp, Homo sapiens
gagcttggtgctgcctgttgtc

SEQ ID NO: 8442197 - DNA, 22 bp, Homo sapiens
gagcttgggtgccatgctgagc

SEQ ID NO: 8442198 - DNA, 22 bp, Homo sapiens
gagcttggggcatatggtgcta

SEQ ID NO: 8442199 - DNA, 22 bp, Homo sapiens
gagcttggtgatgcctcctggt

SEQ ID NO: 8442200 - DNA, 22 bp, Homo sapiens
gagcttggtgatgcctcctggt

SEQ ID NO: 8442201 - DNA, 22 bp, Homo sapiens
gagctggggcggatactcagct

SEQ ID NO: 8442202 - DNA, 22 bp, Homo sapiens
gagctggggcggatactcagct

SEQ ID NO: 8442203 - DNA, 22 bp, Homo sapiens
gagcttggctggacctcacgga

SEQ ID NO: 8442204 - DNA, 22 bp, Homo sapiens
gagctctgcttgggttcttagg

SEQ ID NO: 8442205 - DNA, 22 bp, Homo sapiens
gaggaaggaatgcagtgtatgc

SEQ ID NO: 8442206 - DNA, 22 bp, Homo sapiens
gaggaagcttttgatcgcccag

SEQ ID NO: 8442207 - DNA, 22 bp, Homo sapiens
atggtttaagggagaatattga

SEQ ID NO: 8442208 - DNA, 22 bp, Homo sapiens
gaggaagcagggcttggctgag

SEQ ID NO: 8442209 - DNA, 22 bp, Homo sapiens
gaggaagcattgacataatctc

SEQ ID NO: 8442210 - DNA, 22 bp, Homo sapiens
gaggaagccccattgaagccag

SEQ ID NO: 8442211 - DNA, 22 bp, Homo sapiens
gagcagctcgagaaggaagcag

SEQ ID NO: 8442212 - DNA, 22 bp, Homo sapiens
gagcacagggaatagacagata

SEQ ID NO: 8442213 - DNA, 22 bp, Homo sapiens
gagcacagggaatagacagata

SEQ ID NO: 8442214 - DNA, 22 bp, Homo sapiens
gagcacagtaaagcagtgtcac

SEQ ID NO: 8442215 - DNA, 22 bp, Homo sapiens
gagaggctgatcctgcagagaa

SEQ ID NO: 8442216 - DNA, 22 bp, Homo sapiens
gagaggctggcagtgccaggtt

SEQ ID NO: 8442217 - DNA, 22 bp, Homo sapiens
gagaggctgcatatgcacactg

SEQ ID NO: 8442218 - DNA, 22 bp, Homo sapiens
gagaggctccgccactgctcag

SEQ ID NO: 8442219 - DNA, 22 bp, Homo sapiens
gagaggctctgaggactggggt

SEQ ID NO: 8442220 - DNA, 22 bp, Homo sapiens
gagaggctctgaggactggggt

SEQ ID NO: 8442221 - DNA, 21 bp, Homo sapiens
atggaaaaacaggtagagcat

SEQ ID NO: 8442222 - DNA, 22 bp, Homo sapiens
atgctttttaaacttaattgga

SEQ ID NO: 8442223 - DNA, 22 bp, Homo sapiens
atgctttttaaacttaattgga

SEQ ID NO: 8442224 - DNA, 22 bp, Homo sapiens
gagcctttctagataatccagg

SEQ ID NO: 8442225 - DNA, 21 bp, Homo sapiens
gagccttccctctgccctttc

SEQ ID NO: 8442226 - DNA, 22 bp, Homo sapiens
gagccttcatcgcagccttgtt

SEQ ID NO: 8442227 - DNA, 22 bp, Homo sapiens
gagcgattgcgggggtcagagg

SEQ ID NO: 8442228 - DNA, 22 bp, Homo sapiens
gagcctttgaagccctcagaga

SEQ ID NO: 8442229 - DNA, 23 bp, Homo sapiens
gagctctgcactaggccctggga

SEQ ID NO: 8442230 - DNA, 18 bp, Homo sapiens
gagctctgcctcccagtc

SEQ ID NO: 8442231 - DNA, 22 bp, Homo sapiens
gagcctgggtccttccctggga

SEQ ID NO: 8442232 - DNA, 22 bp, Homo sapiens
gagcctgggtccttccctggga

SEQ ID NO: 8442233 - DNA, 22 bp, Homo sapiens
gagcctggggaccctcctgagt

SEQ ID NO: 8442234 - DNA, 22 bp, Homo sapiens
gagcctgggactgggggtcatg

SEQ ID NO: 8442235 - DNA, 22 bp, Homo sapiens
gagcctgggactgggggtcatg

SEQ ID NO: 8442236 - DNA, 22 bp, Homo sapiens
gagcctggggaccctcctgagt

SEQ ID NO: 8442237 - DNA, 20 bp, Homo sapiens
gagcctgggaagtctaaggt

SEQ ID NO: 8442238 - DNA, 22 bp, Homo sapiens
gagcctgggactgggggtcatg

SEQ ID NO: 8442239 - DNA, 22 bp, Homo sapiens
gagcctggcctcctgcctcagc

SEQ ID NO: 8442240 - DNA, 22 bp, Homo sapiens
gagcagggagacaactctggtg

SEQ ID NO: 8442241 - DNA, 22 bp, Homo sapiens
gagcagggagacaactctggtg

SEQ ID NO: 8442242 - DNA, 22 bp, Homo sapiens
gagcagctgagctggaatgaga

SEQ ID NO: 8442243 - DNA, 22 bp, Homo sapiens
gagcagctctgtgcctggagac

SEQ ID NO: 8442244 - DNA, 17 bp, Homo sapiens
gagcagggatgcggttc

SEQ ID NO: 8442245 - DNA, 22 bp, Homo sapiens
gagcagggcttgtcctcctcat

SEQ ID NO: 8442246 - DNA, 22 bp, Homo sapiens
gagcaggtttcaatgctgatgc

SEQ ID NO: 8442247 - DNA, 22 bp, Homo sapiens
gagcagtaggagaaccctgagc

SEQ ID NO: 8442248 - DNA, 22 bp, Homo sapiens
gagcagtgaagacagaagtaca

SEQ ID NO: 8442249 - DNA, 22 bp, Homo sapiens
gagccctcttgtctatatggta

SEQ ID NO: 8442250 - DNA, 22 bp, Homo sapiens
gagcctggattgtcaccgactt

SEQ ID NO: 8442251 - DNA, 22 bp, Homo sapiens
gagccctcttccctagtgatcg

SEQ ID NO: 8442252 - DNA, 20 bp, Homo sapiens
gagccctctgcactagcgcc

SEQ ID NO: 8442253 - DNA, 22 bp, Homo sapiens
gagtccaggctgttgctcatct

SEQ ID NO: 8442254 - DNA, 22 bp, Homo sapiens
gagtccaggctgttgctcatct

SEQ ID NO: 8442255 - DNA, 22 bp, Homo sapiens
gagtccagtagttaggacagag

SEQ ID NO: 8442256 - DNA, 22 bp, Homo sapiens
gagtccagttagtgaggctggg

SEQ ID NO: 8442257 - DNA, 22 bp, Homo sapiens
gagtccagttctttccagcagt

SEQ ID NO: 8442258 - DNA, 22 bp, Homo sapiens
gagtgcaggcctgagcaccatc

SEQ ID NO: 8442259 - DNA, 21 bp, Homo sapiens
gagtgcagcaaggtagagtct

SEQ ID NO: 8442260 - DNA, 22 bp, Homo sapiens
gagtgcagatgccagccccagt

SEQ ID NO: 8442261 - DNA, 22 bp, Homo sapiens
gagttaaagtacctttgtatgt

SEQ ID NO: 8442262 - DNA, 22 bp, Homo sapiens
gagttaaatattttctgaagtt

SEQ ID NO: 8442263 - DNA, 21 bp, Homo sapiens
gagtgcaggtctgatgccatc

SEQ ID NO: 8442264 - DNA, 22 bp, Homo sapiens
atgtttatgttgggctatattt

SEQ ID NO: 8442265 - DNA, 22 bp, Homo sapiens
gagttacacagaagtcagtttg

SEQ ID NO: 8442266 - DNA, 22 bp, Homo sapiens
gagttacagagaggattatggt

SEQ ID NO: 8442267 - DNA, 22 bp, Homo sapiens
gagttacacagaagtcagtttg

SEQ ID NO: 8442268 - DNA, 22 bp, Homo sapiens
gagttacacaaaatttctattt

SEQ ID NO: 8442269 - DNA, 22 bp, Homo sapiens
gagttacacaaaatttctattt

SEQ ID NO: 8442270 - DNA, 22 bp, Homo sapiens
gagttactgggtggaaggcact

SEQ ID NO: 8442271 - DNA, 22 bp, Homo sapiens
gagttacatttggtgacacttc

SEQ ID NO: 8442272 - DNA, 22 bp, Homo sapiens
gagttacattcattgttacgct

SEQ ID NO: 8442273 - DNA, 22 bp, Homo sapiens
gagttacattcattgttacgct

SEQ ID NO: 8442274 - DNA, 22 bp, Homo sapiens
gagttacatggacattctctcc

SEQ ID NO: 8442275 - DNA, 22 bp, Homo sapiens
gagttacatttggtgacacttc

SEQ ID NO: 8442276 - DNA, 22 bp, Homo sapiens
gagttacatggacattctctcc

SEQ ID NO: 8442277 - DNA, 22 bp, Homo sapiens
gagttacagagaggattatggt

SEQ ID NO: 8442278 - DNA, 22 bp, Homo sapiens
gatcgggtgggttctgccatca

SEQ ID NO: 8442279 - DNA, 22 bp, Homo sapiens
gatctagaaggcaaatatagtg

SEQ ID NO: 8442280 - DNA, 22 bp, Homo sapiens
gatatttacaaatttgccaata

SEQ ID NO: 8442281 - DNA, 22 bp, Homo sapiens
gatcctcttttcctaggaaggt

SEQ ID NO: 8442282 - DNA, 22 bp, Homo sapiens
gatatttacaaatttgccaata

SEQ ID NO: 8442283 - DNA, 22 bp, Homo sapiens
gatatttaactctcacaggtcc

SEQ ID NO: 8442284 - DNA, 21 bp, Homo sapiens
gatctagacttgggcccagta

SEQ ID NO: 8442285 - DNA, 22 bp, Homo sapiens
gatctagaccagaagctgttgt

SEQ ID NO: 8442286 - DNA, 22 bp, Homo sapiens
gatctgagatctaaaccagagg

SEQ ID NO: 8442287 - DNA, 22 bp, Homo sapiens
atgtttccagatatgtcaccct

SEQ ID NO: 8442288 - DNA, 22 bp, Homo sapiens
atgtttccaggttcttcctatg

SEQ ID NO: 8442289 - DNA, 22 bp, Homo sapiens
atgtttccatagaagtcacagt

SEQ ID NO: 8442290 - DNA, 22 bp, Homo sapiens
atgtttccattttcttgtatca

SEQ ID NO: 8442291 - DNA, 22 bp, Homo sapiens
atgtttccgtgagcatccttga

SEQ ID NO: 8442292 - DNA, 22 bp, Homo sapiens
gagggatgtgcctgaaggcagg

SEQ ID NO: 8442293 - DNA, 22 bp, Homo sapiens
gagggatgtgcctgaaggcagg

SEQ ID NO: 8442294 - DNA, 22 bp, Homo sapiens
gagggatggtgtgagaggctca

SEQ ID NO: 8442295 - DNA, 22 bp, Homo sapiens
gagggatggtgtgagaggctca

SEQ ID NO: 8442296 - DNA, 22 bp, Homo sapiens
gagggatgtcaggggaccttgg

SEQ ID NO: 8442297 - DNA, 22 bp, Homo sapiens
gagggaaaggttaatacatgat

SEQ ID NO: 8442298 - DNA, 22 bp, Homo sapiens
gagggatggtgtgagaggctca

SEQ ID NO: 8442299 - DNA, 22 bp, Homo sapiens
gagggatggtgtgagaggctca

SEQ ID NO: 8442300 - DNA, 22 bp, Homo sapiens
gagggaagaaagaattgatgcg

SEQ ID NO: 8442301 - DNA, 22 bp, Homo sapiens
gaggcttctgtaaccctgtcct

SEQ ID NO: 8442302 - DNA, 22 bp, Homo sapiens
gaggcttctgttcactcacgct

SEQ ID NO: 8442303 - DNA, 22 bp, Homo sapiens
gaggcttctggaaagcctggca

SEQ ID NO: 8442304 - DNA, 22 bp, Homo sapiens
gaggcttcccgcccatgctgga

SEQ ID NO: 8442305 - DNA, 22 bp, Homo sapiens
gaggcttctgtaaccctgtcct

SEQ ID NO: 8442306 - DNA, 22 bp, Homo sapiens
gaggcttcccgcccatgctgga

SEQ ID NO: 8442307 - DNA, 22 bp, Homo sapiens
gaggctgttggctgatctgagt

SEQ ID NO: 8442308 - DNA, 22 bp, Homo sapiens
gaggctgttagggcctgaggta

SEQ ID NO: 8442309 - DNA, 22 bp, Homo sapiens
gaggcttttggctaataactgt

SEQ ID NO: 8442310 - DNA, 22 bp, Homo sapiens
gaggcttttctctaaatagtgg

SEQ ID NO: 8442311 - DNA, 22 bp, Homo sapiens
gagggaaacagatgggttgtgg

SEQ ID NO: 8442312 - DNA, 22 bp, Homo sapiens
gaggctttataactatttgttc

SEQ ID NO: 8442313 - DNA, 22 bp, Homo sapiens
gaggctttggttataaaagatc

SEQ ID NO: 8442314 - DNA, 22 bp, Homo sapiens
gaggccaagttggagaccaggt

SEQ ID NO: 8442315 - DNA, 22 bp, Homo sapiens
gaggccaactttggagaacagg

SEQ ID NO: 8442316 - DNA, 22 bp, Homo sapiens
gaggccaaggtgggcagatcac

SEQ ID NO: 8442317 - DNA, 22 bp, Homo sapiens
atgtcacatgagagcgcagcac

SEQ ID NO: 8442318 - DNA, 22 bp, Homo sapiens
atgtcacatctgggatggccct

SEQ ID NO: 8442319 - DNA, 22 bp, Homo sapiens
atgtcacatctgggatggccct

SEQ ID NO: 8442320 - DNA, 22 bp, Homo sapiens
atgtcacattggagctgctgga

SEQ ID NO: 8442321 - DNA, 22 bp, Homo sapiens
atgtcacatggttctggggcct

SEQ ID NO: 8442322 - DNA, 22 bp, Homo sapiens
atgtcacatggttctggggcct

SEQ ID NO: 8442323 - DNA, 22 bp, Homo sapiens
gaggctgtgtttcagtgaggcc

SEQ ID NO: 8442324 - DNA, 22 bp, Homo sapiens
gaggctgtgtcttggggtggaa

SEQ ID NO: 8442325 - DNA, 22 bp, Homo sapiens
gaggctgtgtgtccctctggac

SEQ ID NO: 8442326 - DNA, 22 bp, Homo sapiens
gaggctgttaggagggactctg

SEQ ID NO: 8442327 - DNA, 22 bp, Homo sapiens
gaggccacagtcctgaggcatc

SEQ ID NO: 8442328 - DNA, 22 bp, Homo sapiens
gagggcacgaaacaaccacttc

SEQ ID NO: 8442329 - DNA, 22 bp, Homo sapiens
gagggggcgtgcaaggctccgc

SEQ ID NO: 8442330 - DNA, 22 bp, Homo sapiens
gagggggcgtgcaaggctccgc

SEQ ID NO: 8442331 - DNA, 22 bp, Homo sapiens
gagggggctagcgcagtgccca

SEQ ID NO: 8442332 - DNA, 22 bp, Homo sapiens
gagggggctagcgcagtgccca

SEQ ID NO: 8442333 - DNA, 22 bp, Homo sapiens
gagggggctccctgaagccagt

SEQ ID NO: 8442334 - DNA, 22 bp, Homo sapiens
gagggggctctgccaacctgtc

SEQ ID NO: 8442335 - DNA, 22 bp, Homo sapiens
gagggggtctatgaggtagagc

SEQ ID NO: 8442336 - DNA, 22 bp, Homo sapiens
gagtccaggatttgagctctgt

SEQ ID NO: 8442337 - DNA, 22 bp, Homo sapiens
gagtccaggatttgagctctgt

SEQ ID NO: 8442338 - DNA, 18 bp, Homo sapiens
gagtccaggctcttcacc

SEQ ID NO: 8442339 - DNA, 22 bp, Homo sapiens
gactttctgaaggtctcgcagt

SEQ ID NO: 8442340 - DNA, 22 bp, Homo sapiens
gactttctctcctcccaggtgt

SEQ ID NO: 8442341 - DNA, 22 bp, Homo sapiens
gactttctaatgctctgtagat

SEQ ID NO: 8442342 - DNA, 22 bp, Homo sapiens
gactttctgagtcaaagaaagg

SEQ ID NO: 8442343 - DNA, 22 bp, Homo sapiens
gactttctaatgctctgtagat

SEQ ID NO: 8442344 - DNA, 22 bp, Homo sapiens
gaccctgataggagtagaagaa

SEQ ID NO: 8442345 - DNA, 22 bp, Homo sapiens
gaccctgaggattccctgctga

SEQ ID NO: 8442346 - DNA, 22 bp, Homo sapiens
gaccctctagatggaagcactg

SEQ ID NO: 8442347 - DNA, 22 bp, Homo sapiens
gacccggctccaggcccagcag

SEQ ID NO: 8442348 - DNA, 22 bp, Homo sapiens
gaccccaggcagatcagggggt

SEQ ID NO: 8442349 - DNA, 22 bp, Homo sapiens
gaccctccactcactgctgtgt

SEQ ID NO: 8442350 - DNA, 22 bp, Homo sapiens
gaccctcctgtcttctaaccaa

SEQ ID NO: 8442351 - DNA, 22 bp, Homo sapiens
gaccctcctactaccctggaaa

SEQ ID NO: 8442352 - DNA, 22 bp, Homo sapiens
atgctttattattttgcaggga

SEQ ID NO: 8442353 - DNA, 22 bp, Homo sapiens
atgctttatgttctggcatttt

SEQ ID NO: 8442354 - DNA, 19 bp, Homo sapiens
atgctttatgttatttctt

SEQ ID NO: 8442355 - DNA, 22 bp, Homo sapiens
gaccccagaggaaggggcgccg

SEQ ID NO: 8442356 - DNA, 22 bp, Homo sapiens
gactttcttaggccccctaata

SEQ ID NO: 8442357 - DNA, 22 bp, Homo sapiens
gactttcttgcagaaatattcc

SEQ ID NO: 8442358 - DNA, 22 bp, Homo sapiens
gactttcttgtagtgtctgatg

SEQ ID NO: 8442359 - DNA, 22 bp, Homo sapiens
gactttcttttacctcaaggat

SEQ ID NO: 8442360 - DNA, 22 bp, Homo sapiens
gactttctgatgtaaacattta

SEQ ID NO: 8442361 - DNA, 22 bp, Homo sapiens
gactttctgaaggtctcgcagt

SEQ ID NO: 8442362 - DNA, 22 bp, Homo sapiens
gactttctgctatactttctgt

SEQ ID NO: 8442363 - DNA, 21 bp, Homo sapiens
gactttcttaccagatttttg

SEQ ID NO: 8442364 - DNA, 22 bp, Homo sapiens
gactttctgtccagtgatttct

SEQ ID NO: 8442365 - DNA, 22 bp, Homo sapiens
gactttggcttttattctaggt

SEQ ID NO: 8442366 - DNA, 22 bp, Homo sapiens
gactttggagcagaaagaaatt

SEQ ID NO: 8442367 - DNA, 17 bp, Homo sapiens
gactttggagtttcata

SEQ ID NO: 8442368 - DNA, 17 bp, Homo sapiens
gactttggagtttcata

SEQ ID NO: 8442369 - DNA, 19 bp, Homo sapiens
gactttggaaatgctgttt

SEQ ID NO: 8442370 - DNA, 19 bp, Homo sapiens
gactttggaaatgctgttt

SEQ ID NO: 8442371 - DNA, 22 bp, Homo sapiens
atgcttttaactcctttatccc

SEQ ID NO: 8442372 - DNA, 22 bp, Homo sapiens
atgcttttaactcctttatccc

SEQ ID NO: 8442373 - DNA, 22 bp, Homo sapiens
atgctttctcttagttcattga

SEQ ID NO: 8442374 - DNA, 22 bp, Homo sapiens
atgctttgatttggtttctcta

SEQ ID NO: 8442375 - DNA, 22 bp, Homo sapiens
atgctttacagttttccaaaca

SEQ ID NO: 8442376 - DNA, 22 bp, Homo sapiens
atgctttagtgtcaagtttggg

SEQ ID NO: 8442377 - DNA, 19 bp, Homo sapiens
atgctttatgttatttctt

SEQ ID NO: 8442378 - DNA, 22 bp, Homo sapiens
gacataaaattcaataatttgt

SEQ ID NO: 8442379 - DNA, 22 bp, Homo sapiens
gacataaaatggaattctgttg

SEQ ID NO: 8442380 - DNA, 22 bp, Homo sapiens
gacataaaccttgagatattaa

SEQ ID NO: 8442381 - DNA, 22 bp, Homo sapiens
gacagtttaggttcaaatctca

SEQ ID NO: 8442382 - DNA, 22 bp, Homo sapiens
gacagggaggagcagagcttct

SEQ ID NO: 8442383 - DNA, 22 bp, Homo sapiens
gacagggaggagcagagcttct

SEQ ID NO: 8442384 - DNA, 22 bp, Homo sapiens
atgccacttcattccagcctcg

SEQ ID NO: 8442385 - DNA, 22 bp, Homo sapiens
atgcatatctcctatctcctca

SEQ ID NO: 8442386 - DNA, 22 bp, Homo sapiens
atgcatatcagtgattgtttgc

SEQ ID NO: 8442387 - DNA, 22 bp, Homo sapiens
atgccctgagcaggccttcaag

SEQ ID NO: 8442388 - DNA, 22 bp, Homo sapiens
atgccccaggaggtgccatcca

SEQ ID NO: 8442389 - DNA, 22 bp, Homo sapiens
atgccctgctctcgggaaggga

SEQ ID NO: 8442390 - DNA, 22 bp, Homo sapiens
atgccctgctgctggggcagtg

SEQ ID NO: 8442391 - DNA, 22 bp, Homo sapiens
atgccctgctgccatctggccg

SEQ ID NO: 8442392 - DNA, 22 bp, Homo sapiens
atgccctgcatcaagtgacact

SEQ ID NO: 8442393 - DNA, 22 bp, Homo sapiens
atgccctgccaagcaggctaaa

SEQ ID NO: 8442394 - DNA, 22 bp, Homo sapiens
atgccctttaatttcactgtta

SEQ ID NO: 8442395 - DNA, 18 bp, Homo sapiens
atgccctgttgacttcag

SEQ ID NO: 8442396 - DNA, 22 bp, Homo sapiens
atgccctgggagtgctgtacca

SEQ ID NO: 8442397 - DNA, 23 bp, Homo sapiens
atgccctgtagaggctgctgacc

SEQ ID NO: 8442398 - DNA, 22 bp, Homo sapiens
atgccctggggctacctctgag

SEQ ID NO: 8442399 - DNA, 23 bp, Homo sapiens
atgccctgtgcagaaatgtggaa

SEQ ID NO: 8442400 - DNA, 22 bp, Homo sapiens
atgccctgtgactctcctggac

SEQ ID NO: 8442401 - DNA, 22 bp, Homo sapiens
atgccctgtgactctcctggac

SEQ ID NO: 8442402 - DNA, 22 bp, Homo sapiens
atgcctctgctcttggtcctca

SEQ ID NO: 8442403 - DNA, 22 bp, Homo sapiens
atgcctgcttactccaggtgct

SEQ ID NO: 8442404 - DNA, 22 bp, Homo sapiens
atgcctgcttactccaggtgct

SEQ ID NO: 8442405 - DNA, 22 bp, Homo sapiens
atgcctggactgacatgcactg

SEQ ID NO: 8442406 - DNA, 22 bp, Homo sapiens
gaatgtttaaggaaggcgtggc

SEQ ID NO: 8442407 - DNA, 22 bp, Homo sapiens
atgcatatagaacatttgacat

SEQ ID NO: 8442408 - DNA, 22 bp, Homo sapiens
atgcatacagatttaaaatttt

SEQ ID NO: 8442409 - DNA, 22 bp, Homo sapiens
gaatgttactttgattttgtcc

SEQ ID NO: 8442410 - DNA, 22 bp, Homo sapiens
gaatgttaatgcacttctagct

SEQ ID NO: 8442411 - DNA, 22 bp, Homo sapiens
gaatgttatgtatccagtcaca

SEQ ID NO: 8442412 - DNA, 22 bp, Homo sapiens
gaatgttagagattcttaggtt

SEQ ID NO: 8442413 - DNA, 22 bp, Homo sapiens
gaatgttattggacagcagtgg

SEQ ID NO: 8442414 - DNA, 22 bp, Homo sapiens
gaatgttattgaactacgagct

SEQ ID NO: 8442415 - DNA, 23 bp, Homo sapiens
gaatcagtggctaacaaggaaac

SEQ ID NO: 8442416 - DNA, 22 bp, Homo sapiens
gaagcagagcctaaggcagaca

SEQ ID NO: 8442417 - DNA, 22 bp, Homo sapiens
gaagcagaacccactccccaac

SEQ ID NO: 8442418 - DNA, 22 bp, Homo sapiens
gaagcagagcctaaggcagaca

SEQ ID NO: 8442419 - DNA, 22 bp, Homo sapiens
gaaaacttggatctctagaatg

SEQ ID NO: 8442420 - DNA, 22 bp, Homo sapiens
gaaaagaactgcatgggattaa

SEQ ID NO: 8442421 - DNA, 22 bp, Homo sapiens
gaaaagaactgcatgggattaa

SEQ ID NO: 8442422 - DNA, 22 bp, Homo sapiens
gaaaagaactgcatgggattaa

SEQ ID NO: 8442423 - DNA, 22 bp, Homo sapiens
gaaaagagaacatctgaggatc

SEQ ID NO: 8442424 - DNA, 22 bp, Homo sapiens
gaaaagaactgcatgggattaa

SEQ ID NO: 8442425 - DNA, 22 bp, Homo sapiens
gaaaactgtgattagaatgcct

SEQ ID NO: 8442426 - DNA, 22 bp, Homo sapiens
gaaaactgtgattagaatgcct

SEQ ID NO: 8442427 - DNA, 22 bp, Homo sapiens
gaaaactaacggaaaagttagg

SEQ ID NO: 8442428 - DNA, 20 bp, Homo sapiens
gaaaataggccagccaggta

SEQ ID NO: 8442429 - DNA, 22 bp, Homo sapiens
gaaaatctgcttatattatttt

SEQ ID NO: 8442430 - DNA, 22 bp, Homo sapiens
gaaaatgagcctcagctacatt

SEQ ID NO: 8442431 - DNA, 19 bp, Homo sapiens
atgaatgagctgtgaggtt

SEQ ID NO: 8442432 - DNA, 22 bp, Homo sapiens
atgaatgagaaagctgaaatct

SEQ ID NO: 8442433 - DNA, 22 bp, Homo sapiens
gaaaaccacctcccatcaagca

SEQ ID NO: 8442434 - DNA, 21 bp, Homo sapiens
gaaaaccatttgcatcatgag

SEQ ID NO: 8442435 - DNA, 19 bp, Homo sapiens
gaaaacatgggtgagggtc

SEQ ID NO: 8442436 - DNA, 22 bp, Homo sapiens
atgaattgaggaaaacagtcgt

SEQ ID NO: 8442437 - DNA, 22 bp, Homo sapiens
atgaattaaggataactggtct

SEQ ID NO: 8442438 - DNA, 22 bp, Homo sapiens
atgaatgtaagtggatttcttt

SEQ ID NO: 8442439 - DNA, 22 bp, Homo sapiens
atgaatggatggggtcaagata

SEQ ID NO: 8442440 - DNA, 19 bp, Homo sapiens
atgaatgtgttcttacctc

SEQ ID NO: 8442441 - DNA, 22 bp, Homo sapiens
cttgagaagcattaagaggtag

SEQ ID NO: 8442442 - DNA, 22 bp, Homo sapiens
cttgagaacagggttaggtaac

SEQ ID NO: 8442443 - DNA, 22 bp, Homo sapiens
cttgagaatcttgatgtctacc

SEQ ID NO: 8442444 - DNA, 22 bp, Homo sapiens
cttgagaatcttctctgaagag

SEQ ID NO: 8442445 - DNA, 22 bp, Homo sapiens
cttgagaatgtgagccacagat

SEQ ID NO: 8442446 - DNA, 21 bp, Homo sapiens
cttgagaattaactgttcatt

SEQ ID NO: 8442447 - DNA, 22 bp, Homo sapiens
atcttcccaggctggggagagg

SEQ ID NO: 8442448 - DNA, 22 bp, Homo sapiens
atcttcccaggctggggagagg

SEQ ID NO: 8442449 - DNA, 22 bp, Homo sapiens
atcttcccaggctggggagagg

SEQ ID NO: 8442450 - DNA, 22 bp, Homo sapiens
cttgagaaaggaacaggaagct

SEQ ID NO: 8442451 - DNA, 22 bp, Homo sapiens
cttgagaaaggaacaggaagct

SEQ ID NO: 8442452 - DNA, 22 bp, Homo sapiens
atcttccttcactttctcccac

SEQ ID NO: 8442453 - DNA, 22 bp, Homo sapiens
atcttcatcaagttcacagtgg

SEQ ID NO: 8442454 - DNA, 18 bp, Homo sapiens
cttgagctaagggacccc

SEQ ID NO: 8442455 - DNA, 22 bp, Homo sapiens
cttgagctaggaaggctgaggc

SEQ ID NO: 8442456 - DNA, 22 bp, Homo sapiens
atgaatctgttttttgtcaata

SEQ ID NO: 8442457 - DNA, 22 bp, Homo sapiens
atgaatctgttttttgtcaata

SEQ ID NO: 8442458 - DNA, 22 bp, Homo sapiens
atgaatcaaagttcatttgatc

SEQ ID NO: 8442459 - DNA, 22 bp, Homo sapiens
atgaatcaagtgagaacagcat

SEQ ID NO: 8442460 - DNA, 23 bp, Homo sapiens
atgaatgaataaggcaggaaagc

SEQ ID NO: 8442461 - DNA, 22 bp, Homo sapiens
atgaatacgcggtcatacacat

SEQ ID NO: 8442462 - DNA, 22 bp, Homo sapiens
atgaatattgaatgtcttatga

SEQ ID NO: 8442463 - DNA, 22 bp, Homo sapiens
gaaatgaaatagcaccaaggtt

SEQ ID NO: 8442464 - DNA, 22 bp, Homo sapiens
gaaatgaactgattatcattgc

SEQ ID NO: 8442465 - DNA, 22 bp, Homo sapiens
gaaatgaaacaggcttttaagg

SEQ ID NO: 8442466 - DNA, 22 bp, Homo sapiens
gaaatctttgccttagctgtgt

SEQ ID NO: 8442467 - DNA, 22 bp, Homo sapiens
gaaatcttgctcattgtgacaa

SEQ ID NO: 8442468 - DNA, 22 bp, Homo sapiens
gaaaatgagcctcagctacatt

SEQ ID NO: 8442469 - DNA, 22 bp, Homo sapiens
gaaatatacatgaagtcggctg

SEQ ID NO: 8442470 - DNA, 23 bp, Homo sapiens
gaaatctagtcatttttagtctg

SEQ ID NO: 8442471 - DNA, 22 bp, Homo sapiens
gaaatctacttagtgtctggat

SEQ ID NO: 8442472 - DNA, 22 bp, Homo sapiens
gaaatctacttagtgtctggat

SEQ ID NO: 8442473 - DNA, 22 bp, Homo sapiens
gaacatatgcatgtttgttttg

SEQ ID NO: 8442474 - DNA, 22 bp, Homo sapiens
gaacataactattgtgaatagt

SEQ ID NO: 8442475 - DNA, 22 bp, Homo sapiens
gaacataattaaatgtcctggg

SEQ ID NO: 8442476 - DNA, 22 bp, Homo sapiens
atgaggcatgtgaggagaaggg

SEQ ID NO: 8442477 - DNA, 23 bp, Homo sapiens
atgaggcattaaacaggcttttt

SEQ ID NO: 8442478 - DNA, 22 bp, Homo sapiens
atgaggcattcacagaaggcac

SEQ ID NO: 8442479 - DNA, 22 bp, Homo sapiens
atgaggcattccactcaaactc

SEQ ID NO: 8442480 - DNA, 15 bp, Homo sapiens
atgaggcatttgggg

SEQ ID NO: 8442481 - DNA, 22 bp, Homo sapiens
atgaggcatatcctcctatggt

SEQ ID NO: 8442482 - DNA, 22 bp, Homo sapiens
atgaggcatatcctcctatggt

SEQ ID NO: 8442483 - DNA, 22 bp, Homo sapiens
atgaggcatctaacattgcaaa

SEQ ID NO: 8442484 - DNA, 22 bp, Homo sapiens
atgaggcatctgcagtcactag

SEQ ID NO: 8442485 - DNA, 21 bp, Homo sapiens
atgaggcatgagagggtttct

SEQ ID NO: 8442486 - DNA, 22 bp, Homo sapiens
atgaggcatgtgaggagaaggg

SEQ ID NO: 8442487 - DNA, 22 bp, Homo sapiens
atgaggcatgtgaggagaaggg

SEQ ID NO: 8442488 - DNA, 22 bp, Homo sapiens
atgaggcatgggatcaaaatga

SEQ ID NO: 8442489 - DNA, 22 bp, Homo sapiens
atgaggcatagcagggatcgga

SEQ ID NO: 8442490 - DNA, 16 bp, Homo sapiens
atgaggcataggctgc

SEQ ID NO: 8442491 - DNA, 22 bp, Homo sapiens
atgaggcatagcagggatcgga

SEQ ID NO: 8442492 - DNA, 22 bp, Homo sapiens
gaaatgatgtctgtgctgccac

SEQ ID NO: 8442493 - DNA, 22 bp, Homo sapiens
gaaatgattttagtttatcatg

SEQ ID NO: 8442494 - DNA, 22 bp, Homo sapiens
atgaggcagtctggcctgaggg

SEQ ID NO: 8442495 - DNA, 22 bp, Homo sapiens
gaaatgattttagtttatcatg

SEQ ID NO: 8442496 - DNA, 20 bp, Homo sapiens
gaacatggcaggtggagggg

SEQ ID NO: 8442497 - DNA, 22 bp, Homo sapiens
gaacattcctggaagagtgctt

SEQ ID NO: 8442498 - DNA, 22 bp, Homo sapiens
gaactttaccatttaggtaact

SEQ ID NO: 8442499 - DNA, 22 bp, Homo sapiens
gaactttaattagcttttgtct

SEQ ID NO: 8442500 - DNA, 22 bp, Homo sapiens
gaactttgtggggctgagagga

SEQ ID NO: 8442501 - DNA, 21 bp, Homo sapiens
atgcacaaaaagactctttct

SEQ ID NO: 8442502 - DNA, 22 bp, Homo sapiens
atgcacaaacccacaattagtc

SEQ ID NO: 8442503 - DNA, 22 bp, Homo sapiens
atgcacaagaggctagaaaaga

SEQ ID NO: 8442504 - DNA, 22 bp, Homo sapiens
atgcaatttactgtacataaat

SEQ ID NO: 8442505 - DNA, 22 bp, Homo sapiens
atgcaatatgtgtttctgttta

SEQ ID NO: 8442506 - DNA, 22 bp, Homo sapiens
atgcaatcatatggcatacagc

SEQ ID NO: 8442507 - DNA, 22 bp, Homo sapiens
atgcaatagtaattctagtctg

SEQ ID NO: 8442508 - DNA, 22 bp, Homo sapiens
atgcaatagtaattctagtctg

SEQ ID NO: 8442509 - DNA, 22 bp, Homo sapiens
atgcaatatagggaagatagat

SEQ ID NO: 8442510 - DNA, 18 bp, Homo sapiens
atgcaagctatggatttg

SEQ ID NO: 8442511 - DNA, 22 bp, Homo sapiens
atgcaataaatactttccagct

SEQ ID NO: 8442512 - DNA, 22 bp, Homo sapiens
gaagaaagattggcatgcttca

SEQ ID NO: 8442513 - DNA, 22 bp, Homo sapiens
atgcaaatgcagccattgcaga

SEQ ID NO: 8442514 - DNA, 22 bp, Homo sapiens
cacagcaaagacactctcaact

SEQ ID NO: 8442515 - DNA, 22 bp, Homo sapiens
cacagcaaagacactctcaact

SEQ ID NO: 8442516 - DNA, 22 bp, Homo sapiens
cacagcaggcactatacagggc

SEQ ID NO: 8442517 - DNA, 22 bp, Homo sapiens
cacagcaggcactatacagggc

SEQ ID NO: 8442518 - DNA, 22 bp, Homo sapiens
cacagcaaagacactctcaact

SEQ ID NO: 8442519 - DNA, 22 bp, Homo sapiens
cacagagaattcccatatgtga

SEQ ID NO: 8442520 - DNA, 22 bp, Homo sapiens
cacagagaactgtgggagtgtg

SEQ ID NO: 8442521 - DNA, 18 bp, Homo sapiens
ggagagtgacagagtcgt

SEQ ID NO: 8442522 - DNA, 22 bp, Homo sapiens
ggagagtctgccgagccagccc

SEQ ID NO: 8442523 - DNA, 22 bp, Homo sapiens
ggagagtggattccagctgtat

SEQ ID NO: 8442524 - DNA, 22 bp, Homo sapiens
ggacagcatatcagcagggcag

SEQ ID NO: 8442525 - DNA, 22 bp, Homo sapiens
ggacagcatatcagcagggcag

SEQ ID NO: 8442526 - DNA, 22 bp, Homo sapiens
ggacagcattctactgtaggca

SEQ ID NO: 8442527 - DNA, 22 bp, Homo sapiens
ggacagcatatcagcagggcag

SEQ ID NO: 8442528 - DNA, 22 bp, Homo sapiens
ggacagcccatacacatgtctg

SEQ ID NO: 8442529 - DNA, 22 bp, Homo sapiens
ggacagctgctttcaggccaca

SEQ ID NO: 8442530 - DNA, 22 bp, Homo sapiens
ggacagctctgccaggagctca

SEQ ID NO: 8442531 - DNA, 21 bp, Homo sapiens
ggacagctgcgcgcagggctc

SEQ ID NO: 8442532 - DNA, 22 bp, Homo sapiens
ggacacaaaagtgaataaaata

SEQ ID NO: 8442533 - DNA, 19 bp, Homo sapiens
ggacacagaaagctgcatt

SEQ ID NO: 8442534 - DNA, 19 bp, Homo sapiens
ggacacagaaagctgcatt

SEQ ID NO: 8442535 - DNA, 19 bp, Homo sapiens
ggacacagaaagctgcatt

SEQ ID NO: 8442536 - DNA, 19 bp, Homo sapiens
ggacacagaaagctgcatt

SEQ ID NO: 8442537 - DNA, 22 bp, Homo sapiens
ggacagcacagctcttgacaac

SEQ ID NO: 8442538 - DNA, 22 bp, Homo sapiens
ggacacagataatcacacagat

SEQ ID NO: 8442539 - DNA, 22 bp, Homo sapiens
ggacacagataatcacacagat

SEQ ID NO: 8442540 - DNA, 23 bp, Homo sapiens
ggacacagagataagtgagacaa

SEQ ID NO: 8442541 - DNA, 22 bp, Homo sapiens
ggacaacatgttttaattaagg

SEQ ID NO: 8442542 - DNA, 22 bp, Homo sapiens
ggacaagcctgtgagtgggttt

SEQ ID NO: 8442543 - DNA, 22 bp, Homo sapiens
ggaacaggaaaggagggatgct

SEQ ID NO: 8442544 - DNA, 22 bp, Homo sapiens
ggaacagactgacttcttgaat

SEQ ID NO: 8442545 - DNA, 22 bp, Homo sapiens
ggaacaggaaaggagggatgct

SEQ ID NO: 8442546 - DNA, 22 bp, Homo sapiens
ggaacaggaaaggagggatgct

SEQ ID NO: 8442547 - DNA, 22 bp, Homo sapiens
ggaacagggatttggcctggtt

SEQ ID NO: 8442548 - DNA, 22 bp, Homo sapiens
ggaagactgcatggcatagtga

SEQ ID NO: 8442549 - DNA, 22 bp, Homo sapiens
ggaagagaaatgagtcaagact

SEQ ID NO: 8442550 - DNA, 22 bp, Homo sapiens
ggaagagaaatgagtcaagact

SEQ ID NO: 8442551 - DNA, 22 bp, Homo sapiens
ggaagagaatttctctcttttt

SEQ ID NO: 8442552 - DNA, 22 bp, Homo sapiens
ggaagagaatgatggctatggg

SEQ ID NO: 8442553 - DNA, 19 bp, Homo sapiens
ggaagagaggaaaggtgga

SEQ ID NO: 8442554 - DNA, 22 bp, Homo sapiens
ggaagagagatcccatagatgt

SEQ ID NO: 8442555 - DNA, 22 bp, Homo sapiens
ggaagagagatcccatagatgt

SEQ ID NO: 8442556 - DNA, 22 bp, Homo sapiens
ggaagagagggctgggcctcaa

SEQ ID NO: 8442557 - DNA, 22 bp, Homo sapiens
ggaagagattctttacattcat

SEQ ID NO: 8442558 - DNA, 22 bp, Homo sapiens
ggaagagcctggggtgtcaggc

SEQ ID NO: 8442559 - DNA, 22 bp, Homo sapiens
ggaagagagggctgggcctcaa

SEQ ID NO: 8442560 - DNA, 22 bp, Homo sapiens
ggaagagaggttcagccctaag

SEQ ID NO: 8442561 - DNA, 22 bp, Homo sapiens
cacagctatgagcagcctagct

SEQ ID NO: 8442562 - DNA, 19 bp, Homo sapiens
cacagctctgctcagggaa

SEQ ID NO: 8442563 - DNA, 22 bp, Homo sapiens
ggagggcaacttttcagtaggt

SEQ ID NO: 8442564 - DNA, 22 bp, Homo sapiens
cacagcctcctctggctcacgg

SEQ ID NO: 8442565 - DNA, 22 bp, Homo sapiens
cacagcctccttcagagagcat

SEQ ID NO: 8442566 - DNA, 22 bp, Homo sapiens
cacagccttactgagatccact

SEQ ID NO: 8442567 - DNA, 22 bp, Homo sapiens
cacagcctttagggtacacaca

SEQ ID NO: 8442568 - DNA, 22 bp, Homo sapiens
cacagcgtgatgaatgtagcgt

SEQ ID NO: 8442569 - DNA, 22 bp, Homo sapiens
cacagctagatggatagataga

SEQ ID NO: 8442570 - DNA, 22 bp, Homo sapiens
cacagctacctgcatgcctgct

SEQ ID NO: 8442571 - DNA, 22 bp, Homo sapiens
ggaggggcagccatggaactcc

SEQ ID NO: 8442572 - DNA, 22 bp, Homo sapiens
ggaggggcagccatggaactcc

SEQ ID NO: 8442573 - DNA, 22 bp, Homo sapiens
ggaggggcatagttcaccatca

SEQ ID NO: 8442574 - DNA, 22 bp, Homo sapiens
cacaggagaaaggggaagctcg

SEQ ID NO: 8442575 - DNA, 22 bp, Homo sapiens
ggaggggccggctgcctgccac

SEQ ID NO: 8442576 - DNA, 22 bp, Homo sapiens
ggaggggccggctgcctgccac

SEQ ID NO: 8442577 - DNA, 22 bp, Homo sapiens
ggaggggccggctgcctgccac

SEQ ID NO: 8442578 - DNA, 22 bp, Homo sapiens
cacaggagagctgggaggtgcc

SEQ ID NO: 8442579 - DNA, 22 bp, Homo sapiens
cacaggagagctgggaggtgcc

SEQ ID NO: 8442580 - DNA, 22 bp, Homo sapiens
cacaggagaacccacagattct

SEQ ID NO: 8442581 - DNA, 22 bp, Homo sapiens
cacaggagaggttaatgggggc

SEQ ID NO: 8442582 - DNA, 18 bp, Homo sapiens
cacaggagatgacctgac

SEQ ID NO: 8442583 - DNA, 19 bp, Homo sapiens
cacagccacagccaacctc

SEQ ID NO: 8442584 - DNA, 22 bp, Homo sapiens
cacagccctgcgccccagtttg

SEQ ID NO: 8442585 - DNA, 22 bp, Homo sapiens
cacagcccccttgacactctgg

SEQ ID NO: 8442586 - DNA, 22 bp, Homo sapiens
cacagcagggatgaatggagtg

SEQ ID NO: 8442587 - DNA, 22 bp, Homo sapiens
cacagcagggatgaatggagtg

SEQ ID NO: 8442588 - DNA, 22 bp, Homo sapiens
cacagcagggatgaatggagtg

SEQ ID NO: 8442589 - DNA, 22 bp, Homo sapiens
cacagcaggcagaacgtgggca

SEQ ID NO: 8442590 - DNA, 22 bp, Homo sapiens
cacagcagggatgaatggagtg

SEQ ID NO: 8442591 - DNA, 22 bp, Homo sapiens
ggaggagcacttgacggggtct

SEQ ID NO: 8442592 - DNA, 22 bp, Homo sapiens
ggaggagcacttctgagctcag

SEQ ID NO: 8442593 - DNA, 22 bp, Homo sapiens
ggaggagattcccctctcactt

SEQ ID NO: 8442594 - DNA, 22 bp, Homo sapiens
ggaggagagaggttgcaaacac

SEQ ID NO: 8442595 - DNA, 22 bp, Homo sapiens
ggaggagacggagtgattagtg

SEQ ID NO: 8442596 - DNA, 22 bp, Homo sapiens
ggagcagcttgcatgctcaggg

SEQ ID NO: 8442597 - DNA, 18 bp, Homo sapiens
caaattcagtgctggaag

SEQ ID NO: 8442598 - DNA, 18 bp, Homo sapiens
caaattcagtgctggaag

SEQ ID NO: 8442599 - DNA, 20 bp, Homo sapiens
caaattctgttgaatacacc

SEQ ID NO: 8442600 - DNA, 22 bp, Homo sapiens
caaatttaagtgaggtctttgt

SEQ ID NO: 8442601 - DNA, 22 bp, Homo sapiens
caaattgtgtttgcttttctct

SEQ ID NO: 8442602 - DNA, 22 bp, Homo sapiens
caaatttaggtaacagtctgta

SEQ ID NO: 8442603 - DNA, 22 bp, Homo sapiens
caaatttaagttagaaagcaat

SEQ ID NO: 8442604 - DNA, 22 bp, Homo sapiens
caaatttaagttagaaagcaat

SEQ ID NO: 8442605 - DNA, 22 bp, Homo sapiens
gctgaggtccagcattcgccta

SEQ ID NO: 8442606 - DNA, 20 bp, Homo sapiens
gctgaggtcattatgcctca

SEQ ID NO: 8442607 - DNA, 22 bp, Homo sapiens
caaatttaggtaacagtctgta

SEQ ID NO: 8442608 - DNA, 22 bp, Homo sapiens
gctggcagagagctggtgagga

SEQ ID NO: 8442609 - DNA, 22 bp, Homo sapiens
gctggcagagctctgggctggg

SEQ ID NO: 8442610 - DNA, 22 bp, Homo sapiens
gctggcagagctctgggctggg

SEQ ID NO: 8442611 - DNA, 22 bp, Homo sapiens
gctggcagagagctggtgagga

SEQ ID NO: 8442612 - DNA, 22 bp, Homo sapiens
gctggccagtgtggtgaccacc

SEQ ID NO: 8442613 - DNA, 22 bp, Homo sapiens
gctggcagccaagtgaagaggg

SEQ ID NO: 8442614 - DNA, 22 bp, Homo sapiens
gctggcagcattagaccctggg

SEQ ID NO: 8442615 - DNA, 22 bp, Homo sapiens
gctggcagcattagaccctggg

SEQ ID NO: 8442616 - DNA, 19 bp, Homo sapiens
gctggcagatgtggccgtg

SEQ ID NO: 8442617 - DNA, 20 bp, Homo sapiens
gctggcagatgtcttgagat

SEQ ID NO: 8442618 - DNA, 20 bp, Homo sapiens
gctggcagatgtcttgagat

SEQ ID NO: 8442619 - DNA, 19 bp, Homo sapiens
gctggcagatgtggccgtg

SEQ ID NO: 8442620 - DNA, 19 bp, Homo sapiens
gctggcagatgtggccgtg

SEQ ID NO: 8442621 - DNA, 22 bp, Homo sapiens
gctggccatggcctgcgccatc

SEQ ID NO: 8442622 - DNA, 22 bp, Homo sapiens
gctggccatatattttgctgtt

SEQ ID NO: 8442623 - DNA, 22 bp, Homo sapiens
gctggccatagaagccaaagag

SEQ ID NO: 8442624 - DNA, 22 bp, Homo sapiens
gctggccatggggagtgaggag

SEQ ID NO: 8442625 - DNA, 22 bp, Homo sapiens
gctggccatggggagtgaggag

SEQ ID NO: 8442626 - DNA, 22 bp, Homo sapiens
gctggcccagcgcccagggcag

SEQ ID NO: 8442627 - DNA, 22 bp, Homo sapiens
gctgggagccccgagccagcgc

SEQ ID NO: 8442628 - DNA, 22 bp, Homo sapiens
gctgggagccctggtctgctcc

SEQ ID NO: 8442629 - DNA, 22 bp, Homo sapiens
gctgggagcaaagccatgcata

SEQ ID NO: 8442630 - DNA, 22 bp, Homo sapiens
gctgggagcaaagccatgcata

SEQ ID NO: 8442631 - DNA, 22 bp, Homo sapiens
gctgggagcaaagccatgcata

SEQ ID NO: 8442632 - DNA, 22 bp, Homo sapiens
gctgggagcaagtactcatctt

SEQ ID NO: 8442633 - DNA, 20 bp, Homo sapiens
gctgggctaccactggccct

SEQ ID NO: 8442634 - DNA, 20 bp, Homo sapiens
gctgggctaccactggccct

SEQ ID NO: 8442635 - DNA, 22 bp, Homo sapiens
gctgggccttccgattctcaag

SEQ ID NO: 8442636 - DNA, 22 bp, Homo sapiens
gctgggagccgtacctgtcacg

SEQ ID NO: 8442637 - DNA, 22 bp, Homo sapiens
gctgggaggaatttggggaata

SEQ ID NO: 8442638 - DNA, 22 bp, Homo sapiens
gctgggaggaatttggggaata

SEQ ID NO: 8442639 - DNA, 22 bp, Homo sapiens
gctgggagccgtacctgtcacg

SEQ ID NO: 8442640 - DNA, 22 bp, Homo sapiens
gctgggagccctggtctgctcc

SEQ ID NO: 8442641 - DNA, 22 bp, Homo sapiens
caatgatttttccattgcagga

SEQ ID NO: 8442642 - DNA, 22 bp, Homo sapiens
caatgcaagcaagatggtcaca

SEQ ID NO: 8442643 - DNA, 22 bp, Homo sapiens
caatgattgctatttacataaa

SEQ ID NO: 8442644 - DNA, 22 bp, Homo sapiens
gctggtggtgggccagttctgt

SEQ ID NO: 8442645 - DNA, 22 bp, Homo sapiens
gctggttagaaaacagagctca

SEQ ID NO: 8442646 - DNA, 22 bp, Homo sapiens
gctggttcacctggctcctccc

SEQ ID NO: 8442647 - DNA, 22 bp, Homo sapiens
gctggtttccttatctataaag

SEQ ID NO: 8442648 - DNA, 22 bp, Homo sapiens
gctggtggttaccgtgctaatg

SEQ ID NO: 8442649 - DNA, 22 bp, Homo sapiens
gctggtttcacccaaccgatgt

SEQ ID NO: 8442650 - DNA, 16 bp, Homo sapiens
gctgtaaaaggattca

SEQ ID NO: 8442651 - DNA, 22 bp, Homo sapiens
gctggtctccgccgctccctga

SEQ ID NO: 8442652 - DNA, 20 bp, Homo sapiens
gctggtgggggcttgacatg

SEQ ID NO: 8442653 - DNA, 22 bp, Homo sapiens
gctggtggcagagctccgcggc

SEQ ID NO: 8442654 - DNA, 20 bp, Homo sapiens
gctggtgggggcttgacatg

SEQ ID NO: 8442655 - DNA, 22 bp, Homo sapiens
gctggtggtaaggaggaaaaag

SEQ ID NO: 8442656 - DNA, 22 bp, Homo sapiens
gctggtggcagagacatcaggt

SEQ ID NO: 8442657 - DNA, 20 bp, Homo sapiens
caagtgttattgtgcattta

SEQ ID NO: 8442658 - DNA, 22 bp, Homo sapiens
caagtgggacctgtctgattcc

SEQ ID NO: 8442659 - DNA, 22 bp, Homo sapiens
caagtggggcagattctcttcc

SEQ ID NO: 8442660 - DNA, 22 bp, Homo sapiens
gctgggctcaccaggccactag

SEQ ID NO: 8442661 - DNA, 22 bp, Homo sapiens
caagtcaatgattataagagtc

SEQ ID NO: 8442662 - DNA, 22 bp, Homo sapiens
caagttattcctttacactata

SEQ ID NO: 8442663 - DNA, 17 bp, Homo sapiens
ggaacaaatactatgca

SEQ ID NO: 8442664 - DNA, 22 bp, Homo sapiens
gcttccagcaccagcagagggg

SEQ ID NO: 8442665 - DNA, 22 bp, Homo sapiens
gcttccagcaccagcagagggg

SEQ ID NO: 8442666 - DNA, 19 bp, Homo sapiens
gcttccagcactgcaggag

SEQ ID NO: 8442667 - DNA, 20 bp, Homo sapiens
gcttccaggagggctgatat

SEQ ID NO: 8442668 - DNA, 22 bp, Homo sapiens
caatgtatcaaccagaaagttc

SEQ ID NO: 8442669 - DNA, 22 bp, Homo sapiens
caatgtactacaaagattgtca

SEQ ID NO: 8442670 - DNA, 22 bp, Homo sapiens
caatgtactacaaagattgtca

SEQ ID NO: 8442671 - DNA, 22 bp, Homo sapiens
caatggttgaaccctgtcatga

SEQ ID NO: 8442672 - DNA, 22 bp, Homo sapiens
gcttccagaccccagtccctca

SEQ ID NO: 8442673 - DNA, 20 bp, Homo sapiens
gcttccagaggaggccccgt

SEQ ID NO: 8442674 - DNA, 22 bp, Homo sapiens
caatgcttctcattagccaatg

SEQ ID NO: 8442675 - DNA, 23 bp, Homo sapiens
cagaaatgacagtaagcaccctg

SEQ ID NO: 8442676 - DNA, 20 bp, Homo sapiens
ggctgctggtttggctctgt

SEQ ID NO: 8442677 - DNA, 20 bp, Homo sapiens
ggctgctggtttggctctgt

SEQ ID NO: 8442678 - DNA, 19 bp, Homo sapiens
ggctgctggttacagaggc

SEQ ID NO: 8442679 - DNA, 22 bp, Homo sapiens
ggctgctgtactgatgtcagtt

SEQ ID NO: 8442680 - DNA, 22 bp, Homo sapiens
ggctgctgggtcatgatgcaga

SEQ ID NO: 8442681 - DNA, 22 bp, Homo sapiens
ggctggctttctctccgcacct

SEQ ID NO: 8442682 - DNA, 22 bp, Homo sapiens
ggctgggagccccacagagtca

SEQ ID NO: 8442683 - DNA, 22 bp, Homo sapiens
ggctgggagccccacagagtca

SEQ ID NO: 8442684 - DNA, 23 bp, Homo sapiens
ggctgggagctccgggtgcacgt

SEQ ID NO: 8442685 - DNA, 23 bp, Homo sapiens
ggctgggagctccgggtgcacgt

SEQ ID NO: 8442686 - DNA, 23 bp, Homo sapiens
ggctgggagctccgggtgcacgt

SEQ ID NO: 8442687 - DNA, 22 bp, Homo sapiens
cagaacagaagtaaaatttacc

SEQ ID NO: 8442688 - DNA, 22 bp, Homo sapiens
cagaacagaagtaaaatttacc

SEQ ID NO: 8442689 - DNA, 22 bp, Homo sapiens
cagaacagaatcgtgtggtgag

SEQ ID NO: 8442690 - DNA, 22 bp, Homo sapiens
cagaacacaggctaaactgaga

SEQ ID NO: 8442691 - DNA, 22 bp, Homo sapiens
cagaaattcccatttcagattc

SEQ ID NO: 8442692 - DNA, 22 bp, Homo sapiens
cagaaattggaatagagaaata

SEQ ID NO: 8442693 - DNA, 22 bp, Homo sapiens
cagaagaggactgggtagctca

SEQ ID NO: 8442694 - DNA, 22 bp, Homo sapiens
cagaagagtagctgaacaagtt

SEQ ID NO: 8442695 - DNA, 22 bp, Homo sapiens
cagaacagtcgcctgcatggat

SEQ ID NO: 8442696 - DNA, 20 bp, Homo sapiens
cagaacatgagcatcgagcc

SEQ ID NO: 8442697 - DNA, 19 bp, Homo sapiens
cagaacagaggtcatggcc

SEQ ID NO: 8442698 - DNA, 22 bp, Homo sapiens
ggcttgcttcttgtccaggaat

SEQ ID NO: 8442699 - DNA, 22 bp, Homo sapiens
ggcttgcttcacctacccccag

SEQ ID NO: 8442700 - DNA, 22 bp, Homo sapiens
ggcttctttgtaacgtgccagc

SEQ ID NO: 8442701 - DNA, 22 bp, Homo sapiens
ggcttggcagaggtgggtgctt

SEQ ID NO: 8442702 - DNA, 22 bp, Homo sapiens
ggcttcttgtgtgtcaggctct

SEQ ID NO: 8442703 - DNA, 22 bp, Homo sapiens
ggcttcttcctgtgaacatgtt

SEQ ID NO: 8442704 - DNA, 20 bp, Homo sapiens
ggcttctttacatctgtgtt

SEQ ID NO: 8442705 - DNA, 20 bp, Homo sapiens
ggcttcttcaggtgtctatt

SEQ ID NO: 8442706 - DNA, 22 bp, Homo sapiens
ggctgggagctggacaggccgg

SEQ ID NO: 8442707 - DNA, 22 bp, Homo sapiens
cactgtctcctagggggacttc

SEQ ID NO: 8442708 - DNA, 22 bp, Homo sapiens
cactgtctgagctggtgattag

SEQ ID NO: 8442709 - DNA, 22 bp, Homo sapiens
cactgtctgtgtgtccttgggg

SEQ ID NO: 8442710 - DNA, 22 bp, Homo sapiens
cactgtctgcttcgactcttca

SEQ ID NO: 8442711 - DNA, 22 bp, Homo sapiens
cactgtctgggacatgtggtct

SEQ ID NO: 8442712 - DNA, 22 bp, Homo sapiens
cactgtcttgattactatgggt

SEQ ID NO: 8442713 - DNA, 22 bp, Homo sapiens
cactgtcttgattactatgggt

SEQ ID NO: 8442714 - DNA, 22 bp, Homo sapiens
cactgtcttttgtgaagacaat

SEQ ID NO: 8442715 - DNA, 22 bp, Homo sapiens
cactgtcttcagtttcactgca

SEQ ID NO: 8442716 - DNA, 22 bp, Homo sapiens
cactgtcttttgtgaagacaat

SEQ ID NO: 8442717 - DNA, 22 bp, Homo sapiens
cactgtgctcctaactagctgt

SEQ ID NO: 8442718 - DNA, 22 bp, Homo sapiens
ggctgccttgaccctggctccg

SEQ ID NO: 8442719 - DNA, 18 bp, Homo sapiens
ggctgctcctctccctac

SEQ ID NO: 8442720 - DNA, 21 bp, Homo sapiens
ggctgctcacctaggtcccaa

SEQ ID NO: 8442721 - DNA, 22 bp, Homo sapiens
ggctgctcctttaccctggcag

SEQ ID NO: 8442722 - DNA, 22 bp, Homo sapiens
ggctgctcctttaccctggcag

SEQ ID NO: 8442723 - DNA, 18 bp, Homo sapiens
ggctgctcgctctccccg

SEQ ID NO: 8442724 - DNA, 19 bp, Homo sapiens
ggctgcctttccttaccag

SEQ ID NO: 8442725 - DNA, 22 bp, Homo sapiens
ggctgcctttagaacggatgct

SEQ ID NO: 8442726 - DNA, 22 bp, Homo sapiens
ggctgccttgggggttgtcatt

SEQ ID NO: 8442727 - DNA, 22 bp, Homo sapiens
ggctgcggccgcgggtctgtgc

SEQ ID NO: 8442728 - DNA, 22 bp, Homo sapiens
ggctgctcaaggactctgatcg

SEQ ID NO: 8442729 - DNA, 22 bp, Homo sapiens
cactgtctattaatataactta

SEQ ID NO: 8442730 - DNA, 22 bp, Homo sapiens
ggctgcagcggattggggattg

SEQ ID NO: 8442731 - DNA, 22 bp, Homo sapiens
ggctgcagcagagggactcacg

SEQ ID NO: 8442732 - DNA, 22 bp, Homo sapiens
ggctgcagccctcgcctagcca

SEQ ID NO: 8442733 - DNA, 22 bp, Homo sapiens
ggctgcagccctcgcctagcca

SEQ ID NO: 8442734 - DNA, 22 bp, Homo sapiens
ggctgaggctcatgccatcttg

SEQ ID NO: 8442735 - DNA, 22 bp, Homo sapiens
cactgcctccccaggctccaca

SEQ ID NO: 8442736 - DNA, 22 bp, Homo sapiens
ggctgcagatagccagccacca

SEQ ID NO: 8442737 - DNA, 22 bp, Homo sapiens
ggctgcagatagccagccacca

SEQ ID NO: 8442738 - DNA, 22 bp, Homo sapiens
ggctgcagattgtagtctgtta

SEQ ID NO: 8442739 - DNA, 22 bp, Homo sapiens
cactgaggtatctgtctctcct

SEQ ID NO: 8442740 - DNA, 22 bp, Homo sapiens
ggcgctcagtgttgccccagag

SEQ ID NO: 8442741 - DNA, 22 bp, Homo sapiens
cactgattaagtctgctagagg

SEQ ID NO: 8442742 - DNA, 22 bp, Homo sapiens
ggctcctgggggtgctcctgcc

SEQ ID NO: 8442743 - DNA, 19 bp, Homo sapiens
ggctcctggggctcagccc

SEQ ID NO: 8442744 - DNA, 19 bp, Homo sapiens
ggctcctggggctcagccc

SEQ ID NO: 8442745 - DNA, 20 bp, Homo sapiens
cactgccctccagcctgagc

SEQ ID NO: 8442746 - DNA, 22 bp, Homo sapiens
cactgcccaggcacccatcttg

SEQ ID NO: 8442747 - DNA, 22 bp, Homo sapiens
cactgcccaggacctgccaccc

SEQ ID NO: 8442748 - DNA, 22 bp, Homo sapiens
cactgcccaggacctgccaccc

SEQ ID NO: 8442749 - DNA, 19 bp, Homo sapiens
ggctcctgtggctgcagcc

SEQ ID NO: 8442750 - DNA, 19 bp, Homo sapiens
ggctcctgtggctgcagcc

SEQ ID NO: 8442751 - DNA, 22 bp, Homo sapiens
ggctcctgggggtgctcctgcc

SEQ ID NO: 8442752 - DNA, 22 bp, Homo sapiens
ggctcctgtagatctctaaagc

SEQ ID NO: 8442753 - DNA, 22 bp, Homo sapiens
ggctcctgtcccctcagctgct

SEQ ID NO: 8442754 - DNA, 22 bp, Homo sapiens
ggctcctgtcctcctggagctc

SEQ ID NO: 8442755 - DNA, 22 bp, Homo sapiens
ggctcctgtcctcctggagctc

SEQ ID NO: 8442756 - DNA, 22 bp, Homo sapiens
ggctcctgtggcaagacagctt

SEQ ID NO: 8442757 - DNA, 22 bp, Homo sapiens
ggctcctgtggcaagacagctt

SEQ ID NO: 8442758 - DNA, 21 bp, Homo sapiens
cacatttgaacctcacagcaa

SEQ ID NO: 8442759 - DNA, 22 bp, Homo sapiens
caccaccaggcaggacaccgaa

SEQ ID NO: 8442760 - DNA, 20 bp, Homo sapiens
caccacagaattggggacag

SEQ ID NO: 8442761 - DNA, 22 bp, Homo sapiens
ggccagcctggggctcccagac

SEQ ID NO: 8442762 - DNA, 22 bp, Homo sapiens
ggccagcctggggctcccagac

SEQ ID NO: 8442763 - DNA, 22 bp, Homo sapiens
ggccagcctggggctcccagac

SEQ ID NO: 8442764 - DNA, 22 bp, Homo sapiens
ggccagcctggggctcccagac

SEQ ID NO: 8442765 - DNA, 18 bp, Homo sapiens
ggccagccccaggccagc

SEQ ID NO: 8442766 - DNA, 23 bp, Homo sapiens
ggccactttgtgtcagtatgtgc

SEQ ID NO: 8442767 - DNA, 22 bp, Homo sapiens
cacccaggacaggccagatgtg

SEQ ID NO: 8442768 - DNA, 22 bp, Homo sapiens
cacccagcttttgcatcctccg

SEQ ID NO: 8442769 - DNA, 22 bp, Homo sapiens
cacccaggcaggtggctgagaa

SEQ ID NO: 8442770 - DNA, 22 bp, Homo sapiens
ggccagggccaaggctttccca

SEQ ID NO: 8442771 - DNA, 22 bp, Homo sapiens
ggccagctccttggcagtgcct

SEQ ID NO: 8442772 - DNA, 21 bp, Homo sapiens
ggccagctcggaaggtcccat

SEQ ID NO: 8442773 - DNA, 18 bp, Homo sapiens
ggccagctcctgaggcag

SEQ ID NO: 8442774 - DNA, 22 bp, Homo sapiens
ggccagctccttggcagtgcct

SEQ ID NO: 8442775 - DNA, 22 bp, Homo sapiens
ggccagctcagggtccttgggc

SEQ ID NO: 8442776 - DNA, 22 bp, Homo sapiens
ggcgcacaatgtgcaggtttgt

SEQ ID NO: 8442777 - DNA, 17 bp, Homo sapiens
ggcctgtgtggctgcag

SEQ ID NO: 8442778 - DNA, 22 bp, Homo sapiens
ggcgccagcactgcagcgcctc

SEQ ID NO: 8442779 - DNA, 22 bp, Homo sapiens
ggcgccagcggtaagtaagaca

SEQ ID NO: 8442780 - DNA, 22 bp, Homo sapiens
ggcgcccatcggtgcagagggc

SEQ ID NO: 8442781 - DNA, 22 bp, Homo sapiens
ggccccaggcctttggtctggc

SEQ ID NO: 8442782 - DNA, 17 bp, Homo sapiens
ggcctgtgtggctgcag

SEQ ID NO: 8442783 - DNA, 22 bp, Homo sapiens
ggccccagggaagaaggtggtc

SEQ ID NO: 8442784 - DNA, 22 bp, Homo sapiens
ggccccaggcctttggtctggc

SEQ ID NO: 8442785 - DNA, 22 bp, Homo sapiens
ggccccagcagaccctcctctg

SEQ ID NO: 8442786 - DNA, 22 bp, Homo sapiens
ggcccagcccgagtcagccttc

SEQ ID NO: 8442787 - DNA, 22 bp, Homo sapiens
ggcccagcatcttgtgaagttt

SEQ ID NO: 8442788 - DNA, 21 bp, Homo sapiens
ggccccagcccatgggttctc

SEQ ID NO: 8442789 - DNA, 22 bp, Homo sapiens
ggcccagattagaagctgaatg

SEQ ID NO: 8442790 - DNA, 22 bp, Homo sapiens
ggcccagcacagtgcttggggg

SEQ ID NO: 8442791 - DNA, 22 bp, Homo sapiens
ggcccagcacagtgcttggggg

SEQ ID NO: 8442792 - DNA, 22 bp, Homo sapiens
ggcccagagtctgcaatggagt

SEQ ID NO: 8442793 - DNA, 22 bp, Homo sapiens
ggcccagagggtcaggagctga

SEQ ID NO: 8442794 - DNA, 22 bp, Homo sapiens
ggcccagagtctgcaatggagt

SEQ ID NO: 8442795 - DNA, 22 bp, Homo sapiens
ggcccagagctctgggggagct

SEQ ID NO: 8442796 - DNA, 22 bp, Homo sapiens
ggcccagaggggttgagcatct

SEQ ID NO: 8442797 - DNA, 22 bp, Homo sapiens
ggcccagagctccctggcacct

SEQ ID NO: 8442798 - DNA, 22 bp, Homo sapiens
ggcccagaatactttgtaaaat

SEQ ID NO: 8442799 - DNA, 22 bp, Homo sapiens
ggcccagagctccctggcacct

SEQ ID NO: 8442800 - DNA, 22 bp, Homo sapiens
ggcccagagacgtgcaatgtac

SEQ ID NO: 8442801 - DNA, 22 bp, Homo sapiens
ggcccagacccaagagtggtgg

SEQ ID NO: 8442802 - DNA, 22 bp, Homo sapiens
ggcccagaatacatgaagtata

SEQ ID NO: 8442803 - DNA, 22 bp, Homo sapiens
ggcccagaagccagaagcctcc

SEQ ID NO: 8442804 - DNA, 22 bp, Homo sapiens
ggaggtggaggttgcagtgagc

SEQ ID NO: 8442805 - DNA, 22 bp, Homo sapiens
ggagtctgcggcagacactgta

SEQ ID NO: 8442806 - DNA, 22 bp, Homo sapiens
ggaggtggaggttgcagtgagc

SEQ ID NO: 8442807 - DNA, 22 bp, Homo sapiens
ggagtctggagtggggcccaag

SEQ ID NO: 8442808 - DNA, 22 bp, Homo sapiens
ggagtctgctcccagacatgat

SEQ ID NO: 8442809 - DNA, 22 bp, Homo sapiens
ggagtctgtcacctgtttctct

SEQ ID NO: 8442810 - DNA, 21 bp, Homo sapiens
ggagtctgtggatgctgtttc

SEQ ID NO: 8442811 - DNA, 22 bp, Homo sapiens
ggagtctgttttacatgcagga

SEQ ID NO: 8442812 - DNA, 22 bp, Homo sapiens
ggagtgaaaggtaagttgagct

SEQ ID NO: 8442813 - DNA, 22 bp, Homo sapiens
ggagtcttggcctgctgagaaa

SEQ ID NO: 8442814 - DNA, 22 bp, Homo sapiens
ggagtcttggcctgctgagaaa

SEQ ID NO: 8442815 - DNA, 22 bp, Homo sapiens
ggagtcttcagatagagtattt

SEQ ID NO: 8442816 - DNA, 22 bp, Homo sapiens
ggagtcttaaaaatcaaatgga

SEQ ID NO: 8442817 - DNA, 22 bp, Homo sapiens
ggagtgactcacagctgggaca

SEQ ID NO: 8442818 - DNA, 22 bp, Homo sapiens
ggagtgaatcactagatgcaga

SEQ ID NO: 8442819 - DNA, 21 bp, Homo sapiens
ggagtttttctggaagggact

SEQ ID NO: 8442820 - DNA, 22 bp, Homo sapiens
ggcagctgcaaatctgctctgt

SEQ ID NO: 8442821 - DNA, 22 bp, Homo sapiens
ggcagctgcaaatctgctctgt

SEQ ID NO: 8442822 - DNA, 22 bp, Homo sapiens
ggcaggaaaacaatgagccagg

SEQ ID NO: 8442823 - DNA, 22 bp, Homo sapiens
ggcaggaagcattaaaacgatt

SEQ ID NO: 8442824 - DNA, 22 bp, Homo sapiens
ggcaggaagctcatgtggactg

SEQ ID NO: 8442825 - DNA, 22 bp, Homo sapiens
ggcaggaagctcatgtggactg

SEQ ID NO: 8442826 - DNA, 22 bp, Homo sapiens
ggcaggaataaattatggactt

SEQ ID NO: 8442827 - DNA, 22 bp, Homo sapiens
ggatcaggcgccatgggaagtg

SEQ ID NO: 8442828 - DNA, 22 bp, Homo sapiens
ggatcaaagggaacctgttagg

SEQ ID NO: 8442829 - DNA, 22 bp, Homo sapiens
ggatagtgggagaatgctatgt

SEQ ID NO: 8442830 - DNA, 22 bp, Homo sapiens
ggatagttctggatattttaag

SEQ ID NO: 8442831 - DNA, 18 bp, Homo sapiens
ggataggaccttaggcag

SEQ ID NO: 8442832 - DNA, 22 bp, Homo sapiens
cacatgctcattggcactgttc

SEQ ID NO: 8442833 - DNA, 22 bp, Homo sapiens
cacatgctagaataaatctcca

SEQ ID NO: 8442834 - DNA, 22 bp, Homo sapiens
cacatgctagaataaatctcca

SEQ ID NO: 8442835 - DNA, 22 bp, Homo sapiens
ggcaggtgccttctgtgctagc

SEQ ID NO: 8442836 - DNA, 22 bp, Homo sapiens
ggcaggtgtgagatcgaggcca

SEQ ID NO: 8442837 - DNA, 22 bp, Homo sapiens
ggcaggtgtgagctgtaaagga

SEQ ID NO: 8442838 - DNA, 22 bp, Homo sapiens
ggcaggtgtggagtgttatttt

SEQ ID NO: 8442839 - DNA, 22 bp, Homo sapiens
ggcagtagccagggactggcag

SEQ ID NO: 8442840 - DNA, 22 bp, Homo sapiens
ggcaggtgtggtgaccagagat

SEQ ID NO: 8442841 - DNA, 22 bp, Homo sapiens
ggcaggtgtttttatattaaag

SEQ ID NO: 8442842 - DNA, 22 bp, Homo sapiens
cacatttctggaattgacttgg

SEQ ID NO: 8442843 - DNA, 22 bp, Homo sapiens
cacatttctgtacttaggtaga

SEQ ID NO: 8442844 - DNA, 22 bp, Homo sapiens
ggcagtcacaggggagactggg

SEQ ID NO: 8442845 - DNA, 22 bp, Homo sapiens
cacatttcttatggatgttggc

SEQ ID NO: 8442846 - DNA, 22 bp, Homo sapiens
cacatttctgtgagtcaatatt

SEQ ID NO: 8442847 - DNA, 22 bp, Homo sapiens
cacatttctgtgagtcaatatt

SEQ ID NO: 8442848 - DNA, 22 bp, Homo sapiens
cacatttctgtgagtcaatatt

SEQ ID NO: 8442849 - DNA, 22 bp, Homo sapiens
cacatttctaggaaattaaatg

SEQ ID NO: 8442850 - DNA, 22 bp, Homo sapiens
cacatttctctacctcacacaa

SEQ ID NO: 8442851 - DNA, 22 bp, Homo sapiens
cacatgcatctgtcatgtttgg

SEQ ID NO: 8442852 - DNA, 22 bp, Homo sapiens
cacatgcaggagccaatgtaca

SEQ ID NO: 8442853 - DNA, 20 bp, Homo sapiens
ggcaggaccccagtggcatc

SEQ ID NO: 8442854 - DNA, 22 bp, Homo sapiens
gtgaattaaatatagccaggtc

SEQ ID NO: 8442855 - DNA, 22 bp, Homo sapiens
gtgaattaaatatagccaggtc

SEQ ID NO: 8442856 - DNA, 21 bp, Homo sapiens
gtgaattaattatatgcctta

SEQ ID NO: 8442857 - DNA, 21 bp, Homo sapiens
gtgaattaattatatgcctta

SEQ ID NO: 8442858 - DNA, 22 bp, Homo sapiens
gtgaatggggcaggaaggatgg

SEQ ID NO: 8442859 - DNA, 22 bp, Homo sapiens
gtgaagttgattgttatcgtca

SEQ ID NO: 8442860 - DNA, 22 bp, Homo sapiens
gtgaggtagcagagacagtgaa

SEQ ID NO: 8442861 - DNA, 22 bp, Homo sapiens
gtgcaaaagtaatggcagtttt

SEQ ID NO: 8442862 - DNA, 22 bp, Homo sapiens
gtgcaaaagtaattacagtttt

SEQ ID NO: 8442863 - DNA, 22 bp, Homo sapiens
gtgcaaaagtaattacagtttt

SEQ ID NO: 8442864 - DNA, 22 bp, Homo sapiens
gtgcaaaagtaattgaggtttt

SEQ ID NO: 8442865 - DNA, 22 bp, Homo sapiens
gtgcaaaagtaattgcagtact

SEQ ID NO: 8442866 - DNA, 22 bp, Homo sapiens
gtgcaaaagtaattgcagtttt

SEQ ID NO: 8442867 - DNA, 22 bp, Homo sapiens
gtgcaaaagtaattgctgtttt

SEQ ID NO: 8442868 - DNA, 22 bp, Homo sapiens
gtgcaaaagtaattgcggtttt

SEQ ID NO: 8442869 - DNA, 22 bp, Homo sapiens
gtgcaaaagtaattgtggtttt

SEQ ID NO: 8442870 - DNA, 22 bp, Homo sapiens
gtgcaaaagtcattgtggtttt

SEQ ID NO: 8442871 - DNA, 22 bp, Homo sapiens
gtgcaaaagtacttgcggattt

SEQ ID NO: 8442872 - DNA, 22 bp, Homo sapiens
gtgcagctgcccaagcctgagc

SEQ ID NO: 8442873 - DNA, 22 bp, Homo sapiens
gtgcagctgggcgctgaccttc

SEQ ID NO: 8442874 - DNA, 22 bp, Homo sapiens
gtgcagctggtggagtctgggg

SEQ ID NO: 8442875 - DNA, 22 bp, Homo sapiens
gtgcagctgagggcctcttcta

SEQ ID NO: 8442876 - DNA, 22 bp, Homo sapiens
gtgcagctgcaggagtcaggtc

SEQ ID NO: 8442877 - DNA, 22 bp, Homo sapiens
gtgcagcttcctggtctcagcc

SEQ ID NO: 8442878 - DNA, 22 bp, Homo sapiens
gtgcagctgtgtgagagctcca

SEQ ID NO: 8442879 - DNA, 22 bp, Homo sapiens
gtgcaggagcaggagccatgtc

SEQ ID NO: 8442880 - DNA, 22 bp, Homo sapiens
gtgcagctcagttgaaatgcag

SEQ ID NO: 8442881 - DNA, 22 bp, Homo sapiens
gtgcagcagggggaagacagtg

SEQ ID NO: 8442882 - DNA, 22 bp, Homo sapiens
gtgcaaaatttggccaataaca

SEQ ID NO: 8442883 - DNA, 22 bp, Homo sapiens
gtgcaaaatttggccaataaca

SEQ ID NO: 8442884 - DNA, 22 bp, Homo sapiens
gtgcaaaatttggccaataaca

SEQ ID NO: 8442885 - DNA, 23 bp, Homo sapiens
gtgcaaagatataccacatggct

SEQ ID NO: 8442886 - DNA, 22 bp, Homo sapiens
gtgcaaacatcatagagtgtac

SEQ ID NO: 8442887 - DNA, 22 bp, Homo sapiens
gtgcaaacatcatagagtgtac

SEQ ID NO: 8442888 - DNA, 22 bp, Homo sapiens
gtgcaaaatgatatcctgaagc

SEQ ID NO: 8442889 - DNA, 16 bp, Homo sapiens
gtgcaaaagtgaggag

SEQ ID NO: 8442890 - DNA, 22 bp, Homo sapiens
gtgcaaagcttaacattctgca

SEQ ID NO: 8442891 - DNA, 22 bp, Homo sapiens
gtgcaaagcttaacattctgca

SEQ ID NO: 8442892 - DNA, 20 bp, Homo sapiens
gtctccactgggggttaacc

SEQ ID NO: 8442893 - DNA, 22 bp, Homo sapiens
gtctccagaagcctagacagcc

SEQ ID NO: 8442894 - DNA, 22 bp, Homo sapiens
gtctcagttttccaaactgtca

SEQ ID NO: 8442895 - DNA, 22 bp, Homo sapiens
gtctccacagcccagctgccac

SEQ ID NO: 8442896 - DNA, 22 bp, Homo sapiens
gtctcattggttctgccagagt

SEQ ID NO: 8442897 - DNA, 22 bp, Homo sapiens
gtctcaggtattgaatgggaac

SEQ ID NO: 8442898 - DNA, 22 bp, Homo sapiens
gtctcagggcagctggaggagg

SEQ ID NO: 8442899 - DNA, 22 bp, Homo sapiens
gtctcagggctgagggcagtgg

SEQ ID NO: 8442900 - DNA, 22 bp, Homo sapiens
gtctcaggttcgagcctcctta

SEQ ID NO: 8442901 - DNA, 22 bp, Homo sapiens
gtctcaggttcgagcctcctta

SEQ ID NO: 8442902 - DNA, 22 bp, Homo sapiens
gtctcagtaagaaaggctcctg

SEQ ID NO: 8442903 - DNA, 22 bp, Homo sapiens
gtctcagataacatgtattcta

SEQ ID NO: 8442904 - DNA, 22 bp, Homo sapiens
gtctcagagtcctacttattcc

SEQ ID NO: 8442905 - DNA, 22 bp, Homo sapiens
gtctcagattcagacatctaca

SEQ ID NO: 8442906 - DNA, 22 bp, Homo sapiens
gtctcagattcagacatctaca

SEQ ID NO: 8442907 - DNA, 22 bp, Homo sapiens
gtctcagggactgcttctgggg

SEQ ID NO: 8442908 - DNA, 18 bp, Homo sapiens
gtctcaggagtggcacgt

SEQ ID NO: 8442909 - DNA, 22 bp, Homo sapiens
gtctctgtgtctgagagagccc

SEQ ID NO: 8442910 - DNA, 22 bp, Homo sapiens
gtctctgtggtacgtttcatcc

SEQ ID NO: 8442911 - DNA, 22 bp, Homo sapiens
gtctctgtggctggctccttcc

SEQ ID NO: 8442912 - DNA, 17 bp, Homo sapiens
gtctctgtcttgctttt

SEQ ID NO: 8442913 - DNA, 18 bp, Homo sapiens
gtctctgtgggaattggc

SEQ ID NO: 8442914 - DNA, 22 bp, Homo sapiens
gtctctgtcatttcaccttccc

SEQ ID NO: 8442915 - DNA, 22 bp, Homo sapiens
gtctctgtcttaggccaggcct

SEQ ID NO: 8442916 - DNA, 22 bp, Homo sapiens
gtctctgtgcccccatttccgt

SEQ ID NO: 8442917 - DNA, 22 bp, Homo sapiens
gtctctgtgccttctccccacc

SEQ ID NO: 8442918 - DNA, 22 bp, Homo sapiens
gtctctgggttaagcagtgcat

SEQ ID NO: 8442919 - DNA, 22 bp, Homo sapiens
gtctctgtcacaactactcatc

SEQ ID NO: 8442920 - DNA, 22 bp, Homo sapiens
gtctctggctttatgctggttt

SEQ ID NO: 8442921 - DNA, 22 bp, Homo sapiens
gtctctgggtgtgtgatgccaa

SEQ ID NO: 8442922 - DNA, 22 bp, Homo sapiens
gtctctggctttatgctggttt

SEQ ID NO: 8442923 - DNA, 22 bp, Homo sapiens
gtctttctgccatgtgaagaga

SEQ ID NO: 8442924 - DNA, 22 bp, Homo sapiens
gtctttctctggaacagtaaaa

SEQ ID NO: 8442925 - DNA, 22 bp, Homo sapiens
gtctttcttaaacaacagaaca

SEQ ID NO: 8442926 - DNA, 22 bp, Homo sapiens
gtcttacccacagcatctagaa

SEQ ID NO: 8442927 - DNA, 22 bp, Homo sapiens
gtctgttagtgataactgtttt

SEQ ID NO: 8442928 - DNA, 22 bp, Homo sapiens
gtctctgttatttccagggtca

SEQ ID NO: 8442929 - DNA, 22 bp, Homo sapiens
gtctttggatgtaagataaagt

SEQ ID NO: 8442930 - DNA, 18 bp, Homo sapiens
gtctttggagtggaggta

SEQ ID NO: 8442931 - DNA, 22 bp, Homo sapiens
gtctttggagaggtgccatttc

SEQ ID NO: 8442932 - DNA, 22 bp, Homo sapiens
gtctttggaggcactgttgagt

SEQ ID NO: 8442933 - DNA, 22 bp, Homo sapiens
gtctttggaaagacaaagttca

SEQ ID NO: 8442934 - DNA, 22 bp, Homo sapiens
gtctttgccacacttctgtaca

SEQ ID NO: 8442935 - DNA, 22 bp, Homo sapiens
gtcctgagggcccaggcattct

SEQ ID NO: 8442936 - DNA, 22 bp, Homo sapiens
gtcctgagtcaagtgtgggcag

SEQ ID NO: 8442937 - DNA, 19 bp, Homo sapiens
gtcctgcaactggctctcc

SEQ ID NO: 8442938 - DNA, 22 bp, Homo sapiens
cagcatctgtttttctgaccca

SEQ ID NO: 8442939 - DNA, 22 bp, Homo sapiens
gtcctgaggcaggatgggtttc

SEQ ID NO: 8442940 - DNA, 22 bp, Homo sapiens
gtcctgaggcaggatgggtttc

SEQ ID NO: 8442941 - DNA, 22 bp, Homo sapiens
gtcctgagccctcagcacagca

SEQ ID NO: 8442942 - DNA, 22 bp, Homo sapiens
gtcctgagaccatggccttagt

SEQ ID NO: 8442943 - DNA, 22 bp, Homo sapiens
gtcctgagatgtcacaaggttt

SEQ ID NO: 8442944 - DNA, 22 bp, Homo sapiens
gtcctgagatgtcacaaggttt

SEQ ID NO: 8442945 - DNA, 22 bp, Homo sapiens
gtcctgagatgtcacaaggttt

SEQ ID NO: 8442946 - DNA, 22 bp, Homo sapiens
gtcctgagcattaagcaattgt

SEQ ID NO: 8442947 - DNA, 22 bp, Homo sapiens
gtcctgagccacatactatcca

SEQ ID NO: 8442948 - DNA, 22 bp, Homo sapiens
gtcctgagattggaaccataaa

SEQ ID NO: 8442949 - DNA, 22 bp, Homo sapiens
gtcctgaatgcctttaggcaga

SEQ ID NO: 8442950 - DNA, 22 bp, Homo sapiens
cagcagtggctgcaggcagctg

SEQ ID NO: 8442951 - DNA, 22 bp, Homo sapiens
gtcctagagggtgagctaggct

SEQ ID NO: 8442952 - DNA, 22 bp, Homo sapiens
gtcctaatctcttcttataagg

SEQ ID NO: 8442953 - DNA, 20 bp, Homo sapiens
gtcctaggtttgaaggtaaa

SEQ ID NO: 8442954 - DNA, 22 bp, Homo sapiens
gtcctctgtgtaggctgcagac

SEQ ID NO: 8442955 - DNA, 20 bp, Homo sapiens
gtctcagaatggatttgcat

SEQ ID NO: 8442956 - DNA, 22 bp, Homo sapiens
gtctcagaccaccctctttggc

SEQ ID NO: 8442957 - DNA, 22 bp, Homo sapiens
gtctcagaccaccctctttggc

SEQ ID NO: 8442958 - DNA, 22 bp, Homo sapiens
gtctcagagagctactctctta

SEQ ID NO: 8442959 - DNA, 22 bp, Homo sapiens
gtctcagagagctactctctta

SEQ ID NO: 8442960 - DNA, 22 bp, Homo sapiens
gtctcagagagctactctctta

SEQ ID NO: 8442961 - DNA, 22 bp, Homo sapiens
gtctcaaactcctaggctaaag

SEQ ID NO: 8442962 - DNA, 22 bp, Homo sapiens
gtcctgtgtaagccaggacaat

SEQ ID NO: 8442963 - DNA, 22 bp, Homo sapiens
gtcctgtgggcccaccatgagc

SEQ ID NO: 8442964 - DNA, 22 bp, Homo sapiens
gtcctgtggaaagctagccgct

SEQ ID NO: 8442965 - DNA, 22 bp, Homo sapiens
cagcatctttctcttctggagt

SEQ ID NO: 8442966 - DNA, 22 bp, Homo sapiens
cagcatcttctagatccaggct

SEQ ID NO: 8442967 - DNA, 22 bp, Homo sapiens
cagcagagcatttggtaggagg

SEQ ID NO: 8442968 - DNA, 22 bp, Homo sapiens
cagcagagatgagattcctata

SEQ ID NO: 8442969 - DNA, 22 bp, Homo sapiens
cagcagagacggtaagcagaac

SEQ ID NO: 8442970 - DNA, 22 bp, Homo sapiens
cagcaggtcctgggcgtggcct

SEQ ID NO: 8442971 - DNA, 22 bp, Homo sapiens
cagcaggtcctgggcgtggcct

SEQ ID NO: 8442972 - DNA, 22 bp, Homo sapiens
cagcaggtctcagcagctcctt

SEQ ID NO: 8442973 - DNA, 22 bp, Homo sapiens
cagcaggtctcagcagctcctt

SEQ ID NO: 8442974 - DNA, 22 bp, Homo sapiens
cagcaggtctgcatttgaggtc

SEQ ID NO: 8442975 - DNA, 22 bp, Homo sapiens
cagcaggtcccactgagggccc

SEQ ID NO: 8442976 - DNA, 22 bp, Homo sapiens
cagcaggtatgtttgttcagca

SEQ ID NO: 8442977 - DNA, 22 bp, Homo sapiens
cagcaggtcatgaaagaaaacc

SEQ ID NO: 8442978 - DNA, 18 bp, Homo sapiens
cagcaggtagagtttggt

SEQ ID NO: 8442979 - DNA, 22 bp, Homo sapiens
cagcagggaagctgtgctgttt

SEQ ID NO: 8442980 - DNA, 22 bp, Homo sapiens
cagcagagctgtgtgggaaggg

SEQ ID NO: 8442981 - DNA, 22 bp, Homo sapiens
cagcagagctgtgtgggaaggg

SEQ ID NO: 8442982 - DNA, 22 bp, Homo sapiens
cagcagagctgtgtgggaaggg

SEQ ID NO: 8442983 - DNA, 22 bp, Homo sapiens
cagcaggttaacagaggctggt

SEQ ID NO: 8442984 - DNA, 22 bp, Homo sapiens
cagcaggttctacgggtgagat

SEQ ID NO: 8442985 - DNA, 22 bp, Homo sapiens
cagcaggtgtctagcaagggtc

SEQ ID NO: 8442986 - DNA, 22 bp, Homo sapiens
cagcaggtcctgggcgtggcct

SEQ ID NO: 8442987 - DNA, 22 bp, Homo sapiens
cagcaggttaacagaggctggt

SEQ ID NO: 8442988 - DNA, 22 bp, Homo sapiens
cagcaggttctacgggtgagat

SEQ ID NO: 8442989 - DNA, 22 bp, Homo sapiens
cagcaggtgtctagcaagggtc

SEQ ID NO: 8442990 - DNA, 22 bp, Homo sapiens
cagcaggtgtccttttggtgga

SEQ ID NO: 8442991 - DNA, 22 bp, Homo sapiens
cagcaggtgggctttgcggatg

SEQ ID NO: 8442992 - DNA, 22 bp, Homo sapiens
cagcaggtgtccttttggtgga

SEQ ID NO: 8442993 - DNA, 21 bp, Homo sapiens
cagcaggtggagcctcttgtc

SEQ ID NO: 8442994 - DNA, 22 bp, Homo sapiens
cagcaggtcttgttgctgctga

SEQ ID NO: 8442995 - DNA, 22 bp, Homo sapiens
cagcaggtctgcatttgaggtc

SEQ ID NO: 8442996 - DNA, 22 bp, Homo sapiens
cagcaggtgcaggtgcggccgc

SEQ ID NO: 8442997 - DNA, 22 bp, Homo sapiens
cagcaggtgctgcctgtcaccc

SEQ ID NO: 8442998 - DNA, 22 bp, Homo sapiens
cagcaggtggacacactcacct

SEQ ID NO: 8442999 - DNA, 22 bp, Homo sapiens
cagcagtcaggcctgtgggaga

SEQ ID NO: 8443000 - DNA, 22 bp, Homo sapiens
cagcagtgcttcagtgtgagat

SEQ ID NO: 8443001 - DNA, 22 bp, Homo sapiens
cagcagtgacaagactaagaag

SEQ ID NO: 8443002 - DNA, 22 bp, Homo sapiens
cagcagtggaactacccaggga

SEQ ID NO: 8443003 - DNA, 22 bp, Homo sapiens
cagctcctgcagctgctgccgt

SEQ ID NO: 8443004 - DNA, 22 bp, Homo sapiens
cagctcctgaggactgctggga

SEQ ID NO: 8443005 - DNA, 22 bp, Homo sapiens
cagctcctgaggactgctggga

SEQ ID NO: 8443006 - DNA, 22 bp, Homo sapiens
cagctcctgaggactgctggga

SEQ ID NO: 8443007 - DNA, 22 bp, Homo sapiens
cagctcctctgttagccctggg

SEQ ID NO: 8443008 - DNA, 22 bp, Homo sapiens
cagctcctgcagctgctgccgt

SEQ ID NO: 8443009 - DNA, 22 bp, Homo sapiens
cagctcctgcagctggctccca

SEQ ID NO: 8443010 - DNA, 22 bp, Homo sapiens
cagctcctgcagctggctccca

SEQ ID NO: 8443011 - DNA, 22 bp, Homo sapiens
cagctctgaggaacactccttt

SEQ ID NO: 8443012 - DNA, 22 bp, Homo sapiens
cagctcctcacgagtcttgaaa

SEQ ID NO: 8443013 - DNA, 22 bp, Homo sapiens
cagctcctattagacactgaat

SEQ ID NO: 8443014 - DNA, 22 bp, Homo sapiens
cagctcctattagacactgaat

SEQ ID NO: 8443015 - DNA, 22 bp, Homo sapiens
cagctcctcagccctgccttgg

SEQ ID NO: 8443016 - DNA, 22 bp, Homo sapiens
cagctcctcagccctgccttgg

SEQ ID NO: 8443017 - DNA, 22 bp, Homo sapiens
cagctcctcagccctgccttgg

SEQ ID NO: 8443018 - DNA, 22 bp, Homo sapiens
cagctcctctgttagccctggg

SEQ ID NO: 8443019 - DNA, 22 bp, Homo sapiens
cagctcctctgttagccctggg

SEQ ID NO: 8443020 - DNA, 22 bp, Homo sapiens
cagctcctctggccagccctgc

SEQ ID NO: 8443021 - DNA, 22 bp, Homo sapiens
cagctcctctggccagccctgc

SEQ ID NO: 8443022 - DNA, 22 bp, Homo sapiens
cagctcctctggccagccctgc

SEQ ID NO: 8443023 - DNA, 22 bp, Homo sapiens
cagctcctagatcggcgaagtg

SEQ ID NO: 8443024 - DNA, 22 bp, Homo sapiens
cagctcctatgagtatgattcc

SEQ ID NO: 8443025 - DNA, 22 bp, Homo sapiens
cagctccctatggtgaggcgac

SEQ ID NO: 8443026 - DNA, 21 bp, Homo sapiens
gtgcatgcgccgctgagatgc

SEQ ID NO: 8443027 - DNA, 22 bp, Homo sapiens
gtgcaggagcttctggcctgac

SEQ ID NO: 8443028 - DNA, 22 bp, Homo sapiens
gtgcatattttgcacacagatg

SEQ ID NO: 8443029 - DNA, 22 bp, Homo sapiens
cagccctgtgctaagcaccctc

SEQ ID NO: 8443030 - DNA, 22 bp, Homo sapiens
gtgcattattcttacctttctt

SEQ ID NO: 8443031 - DNA, 22 bp, Homo sapiens
gtgcattaggctggaatgttga

SEQ ID NO: 8443032 - DNA, 22 bp, Homo sapiens
gtgcattagtttcctattgctg

SEQ ID NO: 8443033 - DNA, 22 bp, Homo sapiens
gtgcattacatgtaataaaata

SEQ ID NO: 8443034 - DNA, 22 bp, Homo sapiens
gtgcattaacaacccagaactc

SEQ ID NO: 8443035 - DNA, 22 bp, Homo sapiens
gtgcatggtaagatgcttcaca

SEQ ID NO: 8443036 - DNA, 22 bp, Homo sapiens
gtgcctgggacttgctccggat

SEQ ID NO: 8443037 - DNA, 22 bp, Homo sapiens
gtgcctgggggtaatgtaggat

SEQ ID NO: 8443038 - DNA, 19 bp, Homo sapiens
cagcctcaatccctcgggc

SEQ ID NO: 8443039 - DNA, 19 bp, Homo sapiens
cagcctcaatccctcgggc

SEQ ID NO: 8443040 - DNA, 22 bp, Homo sapiens
cagccctgttgcgcttccggcg

SEQ ID NO: 8443041 - DNA, 22 bp, Homo sapiens
cagccctgttgcgcttccggcg

SEQ ID NO: 8443042 - DNA, 22 bp, Homo sapiens
cagcccttgatgataatttatc

SEQ ID NO: 8443043 - DNA, 22 bp, Homo sapiens
cagcccttaagagtcatccctc

SEQ ID NO: 8443044 - DNA, 23 bp, Homo sapiens
cagcccttcctgcatgtttttgt

SEQ ID NO: 8443045 - DNA, 22 bp, Homo sapiens
cagcccttccttctgtttatac

SEQ ID NO: 8443046 - DNA, 20 bp, Homo sapiens
cagccctttatcctcctatg

SEQ ID NO: 8443047 - DNA, 22 bp, Homo sapiens
cagccgtcagatgtgccgcagc

SEQ ID NO: 8443048 - DNA, 22 bp, Homo sapiens
cagccctttccttctcagcttt

SEQ ID NO: 8443049 - DNA, 22 bp, Homo sapiens
cagcccttggctggctccttgc

SEQ ID NO: 8443050 - DNA, 20 bp, Homo sapiens
cagccctttatcctcctatg

SEQ ID NO: 8443051 - DNA, 22 bp, Homo sapiens
gtgctgaggagagggggtggtc

SEQ ID NO: 8443052 - DNA, 22 bp, Homo sapiens
gtgctgagctgcagatgcgctc

SEQ ID NO: 8443053 - DNA, 22 bp, Homo sapiens
gtgctgagattggagtgagcag

SEQ ID NO: 8443054 - DNA, 22 bp, Homo sapiens
gtgcctggtatgtaggtagcgg

SEQ ID NO: 8443055 - DNA, 22 bp, Homo sapiens
gtgcctggggttgagctatgaa

SEQ ID NO: 8443056 - DNA, 22 bp, Homo sapiens
cagctcagcttcctgggtgtgt

SEQ ID NO: 8443057 - DNA, 22 bp, Homo sapiens
gtgctgaggtgggtgggcagcc

SEQ ID NO: 8443058 - DNA, 22 bp, Homo sapiens
cagctcagcttcctgggtgtgt

SEQ ID NO: 8443059 - DNA, 21 bp, Homo sapiens
cagctccactaaagcagctgt

SEQ ID NO: 8443060 - DNA, 22 bp, Homo sapiens
cagctccagcccaggcagctcc

SEQ ID NO: 8443061 - DNA, 22 bp, Homo sapiens
cagctccagcccaggcagctcc

SEQ ID NO: 8443062 - DNA, 22 bp, Homo sapiens
cagctccagccgactgtaagaa

SEQ ID NO: 8443063 - DNA, 22 bp, Homo sapiens
cagctccagctctgggcgcctc

SEQ ID NO: 8443064 - DNA, 23 bp, Homo sapiens
cagctccagtgcactcaggtagc

SEQ ID NO: 8443065 - DNA, 22 bp, Homo sapiens
cagataaatagacttggtcaga

SEQ ID NO: 8443066 - DNA, 22 bp, Homo sapiens
cagataataatatgacttcact

SEQ ID NO: 8443067 - DNA, 20 bp, Homo sapiens
cagataaacgggaaagaagc

SEQ ID NO: 8443068 - DNA, 22 bp, Homo sapiens
ggtgagaggcagaggacagctt

SEQ ID NO: 8443069 - DNA, 22 bp, Homo sapiens
cagatatattttatttggtcaa

SEQ ID NO: 8443070 - DNA, 22 bp, Homo sapiens
cagatagaatgcaagacctctc

SEQ ID NO: 8443071 - DNA, 22 bp, Homo sapiens
ggtgcagagcagtgtcagagca

SEQ ID NO: 8443072 - DNA, 22 bp, Homo sapiens
cagatgcttcgtgggtgagcac

SEQ ID NO: 8443073 - DNA, 22 bp, Homo sapiens
cagaggctgccagccatgtgca

SEQ ID NO: 8443074 - DNA, 22 bp, Homo sapiens
cagaggctgatgtgggatgggc

SEQ ID NO: 8443075 - DNA, 22 bp, Homo sapiens
cagaggctgatgtgggatgggc

SEQ ID NO: 8443076 - DNA, 22 bp, Homo sapiens
cagaggctgctctgggtggcat

SEQ ID NO: 8443077 - DNA, 22 bp, Homo sapiens
cagaggcctttctacagtgata

SEQ ID NO: 8443078 - DNA, 22 bp, Homo sapiens
cagaggctgaccctgctgttgt

SEQ ID NO: 8443079 - DNA, 22 bp, Homo sapiens
ggggtctgggcttagctggaat

SEQ ID NO: 8443080 - DNA, 22 bp, Homo sapiens
ggggtgagctgggcctgtgcct

SEQ ID NO: 8443081 - DNA, 22 bp, Homo sapiens
ggggtctgcgccactgtctgcg

SEQ ID NO: 8443082 - DNA, 22 bp, Homo sapiens
ggggtcctcggagcctgggtct

SEQ ID NO: 8443083 - DNA, 22 bp, Homo sapiens
ggggtcctggaggccagctgga

SEQ ID NO: 8443084 - DNA, 22 bp, Homo sapiens
cagagtgggctgtcagccacca

SEQ ID NO: 8443085 - DNA, 22 bp, Homo sapiens
cagagtgtggcatcttccaact

SEQ ID NO: 8443086 - DNA, 22 bp, Homo sapiens
cagagtggtgcaagggcagtgt

SEQ ID NO: 8443087 - DNA, 22 bp, Homo sapiens
cagagtggtgcaagggcagtgt

SEQ ID NO: 8443088 - DNA, 16 bp, Homo sapiens
cagagtgtaaacagga

SEQ ID NO: 8443089 - DNA, 22 bp, Homo sapiens
gtaacttaccattgtagcatca

SEQ ID NO: 8443090 - DNA, 22 bp, Homo sapiens
gtaagatttaaaatagcaattg

SEQ ID NO: 8443091 - DNA, 22 bp, Homo sapiens
gtaagcctgagaaacaccacct

SEQ ID NO: 8443092 - DNA, 22 bp, Homo sapiens
gtaagcctctgctctatctggt

SEQ ID NO: 8443093 - DNA, 22 bp, Homo sapiens
gtaagcctggaatttttgactt

SEQ ID NO: 8443094 - DNA, 22 bp, Homo sapiens
gtaactctttggaaaacatttt

SEQ ID NO: 8443095 - DNA, 22 bp, Homo sapiens
gtaactctgggtagaactcatg

SEQ ID NO: 8443096 - DNA, 20 bp, Homo sapiens
gtaactctggctaagtaaat

SEQ ID NO: 8443097 - DNA, 22 bp, Homo sapiens
gtaactggttttcttccctctc

SEQ ID NO: 8443098 - DNA, 23 bp, Homo sapiens
gtaactggggaatttgagctatg

SEQ ID NO: 8443099 - DNA, 22 bp, Homo sapiens
gtaacatttacagttcctagag

SEQ ID NO: 8443100 - DNA, 22 bp, Homo sapiens
gtaacattattcatgagataca

SEQ ID NO: 8443101 - DNA, 22 bp, Homo sapiens
gtaaacatcagccactctattt

SEQ ID NO: 8443102 - DNA, 22 bp, Homo sapiens
ggtgtgactcgccctcagggac

SEQ ID NO: 8443103 - DNA, 20 bp, Homo sapiens
cagcagagacccatggggag

SEQ ID NO: 8443104 - DNA, 22 bp, Homo sapiens
ggtgtctgcttccctccagctg

SEQ ID NO: 8443105 - DNA, 21 bp, Homo sapiens
cagcagaagcatctatggaag

SEQ ID NO: 8443106 - DNA, 22 bp, Homo sapiens
cagcagaagtccgactccagtc

SEQ ID NO: 8443107 - DNA, 22 bp, Homo sapiens
cagcagagaaattaaacttctg

SEQ ID NO: 8443108 - DNA, 22 bp, Homo sapiens
cagcactctggcttcgttaagt

SEQ ID NO: 8443109 - DNA, 22 bp, Homo sapiens
cagcagaagcaacattcaggct

SEQ ID NO: 8443110 - DNA, 22 bp, Homo sapiens
cagcagaacaggcagggaagct

SEQ ID NO: 8443111 - DNA, 22 bp, Homo sapiens
ggtgggacaggtaggagtggct

SEQ ID NO: 8443112 - DNA, 22 bp, Homo sapiens
ggtgggaaggggccagtgtgcg

SEQ ID NO: 8443113 - DNA, 18 bp, Homo sapiens
ggtggctggggacggaca

SEQ ID NO: 8443114 - DNA, 22 bp, Homo sapiens
ggtggcagtgcttgcgggtcta

SEQ ID NO: 8443115 - DNA, 22 bp, Homo sapiens
ggtggctgcttcctcaagagga

SEQ ID NO: 8443116 - DNA, 22 bp, Homo sapiens
ggtggctgcaccctggctaact

SEQ ID NO: 8443117 - DNA, 22 bp, Homo sapiens
ggtggctgcttcctcaagagga

SEQ ID NO: 8443118 - DNA, 22 bp, Homo sapiens
ggtggctgggattagtagccca

SEQ ID NO: 8443119 - DNA, 18 bp, Homo sapiens
ggtggctggggacggaca

SEQ ID NO: 8443120 - DNA, 22 bp, Homo sapiens
ggtggctgtgagcattatgtga

SEQ ID NO: 8443121 - DNA, 22 bp, Homo sapiens
ggtggctggttttataagaggt

SEQ ID NO: 8443122 - DNA, 22 bp, Homo sapiens
ggtggctggaggagctgatgga

SEQ ID NO: 8443123 - DNA, 22 bp, Homo sapiens
ggtggctggaggagctgatgga

SEQ ID NO: 8443124 - DNA, 22 bp, Homo sapiens
ggtggctgggattagtagccca

SEQ ID NO: 8443125 - DNA, 22 bp, Homo sapiens
ggtggctggaggagctgatgga

SEQ ID NO: 8443126 - DNA, 22 bp, Homo sapiens
cagatgcttgttggctggtctc

SEQ ID NO: 8443127 - DNA, 22 bp, Homo sapiens
cagatgctgcctgggaatgtct

SEQ ID NO: 8443128 - DNA, 22 bp, Homo sapiens
cagatgcttggaggacacttgg

SEQ ID NO: 8443129 - DNA, 22 bp, Homo sapiens
ggtggcagtcttaagagatctt

SEQ ID NO: 8443130 - DNA, 22 bp, Homo sapiens
ggtggcagtcttaagagatctt

SEQ ID NO: 8443131 - DNA, 22 bp, Homo sapiens
ggtggcagggagtgtccctggg

SEQ ID NO: 8443132 - DNA, 22 bp, Homo sapiens
ggtggcagggagtgtccctggg

SEQ ID NO: 8443133 - DNA, 22 bp, Homo sapiens
ggtggcagggagtgtccctggg

SEQ ID NO: 8443134 - DNA, 22 bp, Homo sapiens
cagaagagtagctgaacaagtt

SEQ ID NO: 8443135 - DNA, 22 bp, Homo sapiens
cagaagagtagctgaacaagtt

SEQ ID NO: 8443136 - DNA, 22 bp, Homo sapiens
cagaagcaaatgccttgctgag

SEQ ID NO: 8443137 - DNA, 22 bp, Homo sapiens
cagaagcaagtagtgattcttt

SEQ ID NO: 8443138 - DNA, 22 bp, Homo sapiens
cagaagcaagggccaaagtctt

SEQ ID NO: 8443139 - DNA, 22 bp, Homo sapiens
cagaagcaagtagtgattcttt

SEQ ID NO: 8443140 - DNA, 22 bp, Homo sapiens
cagaagcaagagccggagctag

SEQ ID NO: 8443141 - DNA, 22 bp, Homo sapiens
cagaagcaagagccggagctag

SEQ ID NO: 8443142 - DNA, 22 bp, Homo sapiens
cagaagcaagggccaaagtctt

SEQ ID NO: 8443143 - DNA, 23 bp, Homo sapiens
cagaagcacctgttgactgctgc

SEQ ID NO: 8443144 - DNA, 23 bp, Homo sapiens
cagaagcacctgttgactgctgc

SEQ ID NO: 8443145 - DNA, 22 bp, Homo sapiens
cagaagcagaacactagattta

SEQ ID NO: 8443146 - DNA, 22 bp, Homo sapiens
cagaagcagattctaaagcaag

SEQ ID NO: 8443147 - DNA, 22 bp, Homo sapiens
cagaagcagattctaaagcaag

SEQ ID NO: 8443148 - DNA, 22 bp, Homo sapiens
cagagactggagtgcagtggcg

SEQ ID NO: 8443149 - DNA, 22 bp, Homo sapiens
cagagacatccatgttagttgg

SEQ ID NO: 8443150 - DNA, 22 bp, Homo sapiens
cagagacagtttcacagggtct

SEQ ID NO: 8443151 - DNA, 22 bp, Homo sapiens
cagagagaatatgtagtatgga

SEQ ID NO: 8443152 - DNA, 20 bp, Homo sapiens
cagagacctgtcttcacaga

SEQ ID NO: 8443153 - DNA, 22 bp, Homo sapiens
cagagagaatcttggcagctga

SEQ ID NO: 8443154 - DNA, 22 bp, Homo sapiens
cagagagagtcaaatctttgct

SEQ ID NO: 8443155 - DNA, 22 bp, Homo sapiens
cagagagaggggctgcctggcc

SEQ ID NO: 8443156 - DNA, 19 bp, Homo sapiens
cagagagaccaaggcgcca

SEQ ID NO: 8443157 - DNA, 22 bp, Homo sapiens
cagagagaggccactgctatta

SEQ ID NO: 8443158 - DNA, 22 bp, Homo sapiens
gggccctggatttaagcatgga

SEQ ID NO: 8443159 - DNA, 22 bp, Homo sapiens
gggccctggacgtggcggcaga

SEQ ID NO: 8443160 - DNA, 22 bp, Homo sapiens
gggccctggacgtggcggcaga

SEQ ID NO: 8443161 - DNA, 22 bp, Homo sapiens
gggccctggccgaatccctctg

SEQ ID NO: 8443162 - DNA, 22 bp, Homo sapiens
gggccctggccgaatccctctg

SEQ ID NO: 8443163 - DNA, 22 bp, Homo sapiens
gggccctggacgtggcggcaga

SEQ ID NO: 8443164 - DNA, 22 bp, Homo sapiens
gggccagctctgtgatgtaggg

SEQ ID NO: 8443165 - DNA, 22 bp, Homo sapiens
cagagagcatgggaggcccgag

SEQ ID NO: 8443166 - DNA, 22 bp, Homo sapiens
cagagagcatgggaggcccgag

SEQ ID NO: 8443167 - DNA, 22 bp, Homo sapiens
cagagagcttagtgtgctgcat

SEQ ID NO: 8443168 - DNA, 18 bp, Homo sapiens
gggccctggcgtccgccc

SEQ ID NO: 8443169 - DNA, 22 bp, Homo sapiens
gggccctggctttcctgttctt

SEQ ID NO: 8443170 - DNA, 22 bp, Homo sapiens
cagagcagagtgattgttctgg

SEQ ID NO: 8443171 - DNA, 22 bp, Homo sapiens
cagagcaggaatagggtgttga

SEQ ID NO: 8443172 - DNA, 22 bp, Homo sapiens
cagagcaggcccactgccctcc

SEQ ID NO: 8443173 - DNA, 22 bp, Homo sapiens
cagagcagcctccagggggagc

SEQ ID NO: 8443174 - DNA, 22 bp, Homo sapiens
cagagcagcctccagggggagc

SEQ ID NO: 8443175 - DNA, 21 bp, Homo sapiens
cagagcagcgttctgctgtgg

SEQ ID NO: 8443176 - DNA, 22 bp, Homo sapiens
cagaggcagaccctccagggcg

SEQ ID NO: 8443177 - DNA, 22 bp, Homo sapiens
cagaggcagaggtcatctctgg

SEQ ID NO: 8443178 - DNA, 22 bp, Homo sapiens
cagaggcagaggtcatctctgg

SEQ ID NO: 8443179 - DNA, 22 bp, Homo sapiens
cagaggcagccgggggagaacg

SEQ ID NO: 8443180 - DNA, 22 bp, Homo sapiens
cagaggcaggaagatgggcagt

SEQ ID NO: 8443181 - DNA, 22 bp, Homo sapiens
cagaggcaggaagatgggcagt

SEQ ID NO: 8443182 - DNA, 19 bp, Homo sapiens
cagaggcactttctcttag

SEQ ID NO: 8443183 - DNA, 22 bp, Homo sapiens
gggggcagtaaggatatggaaa

SEQ ID NO: 8443184 - DNA, 22 bp, Homo sapiens
gggggcagtaacctcaaagtgt

SEQ ID NO: 8443185 - DNA, 22 bp, Homo sapiens
gggggcagtaacctcaaagtgt

SEQ ID NO: 8443186 - DNA, 22 bp, Homo sapiens
gggggcagtaacctcaaagtgt

SEQ ID NO: 8443187 - DNA, 22 bp, Homo sapiens
gggggcaggtctggaactttga

SEQ ID NO: 8443188 - DNA, 22 bp, Homo sapiens
gggggcaggtctggaactttga

SEQ ID NO: 8443189 - DNA, 22 bp, Homo sapiens
gggggcagaatgtactcttgtc

SEQ ID NO: 8443190 - DNA, 22 bp, Homo sapiens
gggggaggtgaatgcaataagg

SEQ ID NO: 8443191 - DNA, 22 bp, Homo sapiens
cagaggacttcccactcatctg

SEQ ID NO: 8443192 - DNA, 22 bp, Homo sapiens
cagaggacttcccactcatctg

SEQ ID NO: 8443193 - DNA, 22 bp, Homo sapiens
ggggcggggctctgagaagcat

SEQ ID NO: 8443194 - DNA, 22 bp, Homo sapiens
cagaggaagctgggtgtggagt

SEQ ID NO: 8443195 - DNA, 22 bp, Homo sapiens
cagaggaagttccttgatgaga

SEQ ID NO: 8443196 - DNA, 22 bp, Homo sapiens
cagaggaagttccttgatgaga

SEQ ID NO: 8443197 - DNA, 22 bp, Homo sapiens
cagaggaaggctctgggaatgt

SEQ ID NO: 8443198 - DNA, 22 bp, Homo sapiens
cagaggaaggctctgggaatgt

SEQ ID NO: 8443199 - DNA, 22 bp, Homo sapiens
cagaggaagggtgctgcgaaag

SEQ ID NO: 8443200 - DNA, 22 bp, Homo sapiens
cagaggaaatgggaaggagata

SEQ ID NO: 8443201 - DNA, 22 bp, Homo sapiens
cagaggaaatgggaaggagata

SEQ ID NO: 8443202 - DNA, 22 bp, Homo sapiens
cagaggaagagatacaagccct

SEQ ID NO: 8443203 - DNA, 22 bp, Homo sapiens
cagaggaagagatacaagccct

SEQ ID NO: 8443204 - DNA, 22 bp, Homo sapiens
cagaggaacgtttggattgatt

SEQ ID NO: 8443205 - DNA, 22 bp, Homo sapiens
cagaggaaagtatttctggaag

SEQ ID NO: 8443206 - DNA, 22 bp, Homo sapiens
cagagctttgtgtcagggctgt

SEQ ID NO: 8443207 - DNA, 22 bp, Homo sapiens
gggctctgcgctcagctccagc

SEQ ID NO: 8443208 - DNA, 22 bp, Homo sapiens
cagagcttctgacagctgctgc

SEQ ID NO: 8443209 - DNA, 22 bp, Homo sapiens
cagagcttctgacagctgctgc

SEQ ID NO: 8443210 - DNA, 22 bp, Homo sapiens
gggctctgcgctcagctccagc

SEQ ID NO: 8443211 - DNA, 22 bp, Homo sapiens
gggctctgcgctcagctccagc

SEQ ID NO: 8443212 - DNA, 22 bp, Homo sapiens
gggctctgcctggctgggagta

SEQ ID NO: 8443213 - DNA, 22 bp, Homo sapiens
gggctcaggcctggcctctcac

SEQ ID NO: 8443214 - DNA, 22 bp, Homo sapiens
catgctttgggtcagaaatgcc

SEQ ID NO: 8443215 - DNA, 22 bp, Homo sapiens
catgcttttttctagtataaat

SEQ ID NO: 8443216 - DNA, 22 bp, Homo sapiens
catgctttctgtccaaatgtta

SEQ ID NO: 8443217 - DNA, 22 bp, Homo sapiens
catgcttcacacactgaatgac

SEQ ID NO: 8443218 - DNA, 22 bp, Homo sapiens
catgctgttgaatatgacattg

SEQ ID NO: 8443219 - DNA, 22 bp, Homo sapiens
catgctgttgaatatgacattg

SEQ ID NO: 8443220 - DNA, 20 bp, Homo sapiens
tccagcaccctcacagagaa

SEQ ID NO: 8443221 - DNA, 22 bp, Homo sapiens
tccagcacccaatgtggctaag

SEQ ID NO: 8443222 - DNA, 22 bp, Homo sapiens
tccagcacccaatgtggctaag

SEQ ID NO: 8443223 - DNA, 22 bp, Homo sapiens
tccagcacagaatttcctagct

SEQ ID NO: 8443224 - DNA, 22 bp, Homo sapiens
tccagcactcgcccagggcttg

SEQ ID NO: 8443225 - DNA, 22 bp, Homo sapiens
tccagcagaaccagagacctgg

SEQ ID NO: 8443226 - DNA, 22 bp, Homo sapiens
catgtaaagcacttcataacag

SEQ ID NO: 8443227 - DNA, 22 bp, Homo sapiens
catgtaaagaatttcacacaag

SEQ ID NO: 8443228 - DNA, 22 bp, Homo sapiens
catgtaaaaagaagaatctgga

SEQ ID NO: 8443229 - DNA, 22 bp, Homo sapiens
catgtaaaaagaagaatctgga

SEQ ID NO: 8443230 - DNA, 22 bp, Homo sapiens
catgtaaaaaattaggtcatct

SEQ ID NO: 8443231 - DNA, 22 bp, Homo sapiens
catggtttgatgactggaagga

SEQ ID NO: 8443232 - DNA, 22 bp, Homo sapiens
catggtttttaccctacaccat

SEQ ID NO: 8443233 - DNA, 22 bp, Homo sapiens
catgtaaaccattgtgagcatc

SEQ ID NO: 8443234 - DNA, 22 bp, Homo sapiens
catggaaagcactcagcccagt

SEQ ID NO: 8443235 - DNA, 23 bp, Homo sapiens
catggaaaactgaaagctgacct

SEQ ID NO: 8443236 - DNA, 19 bp, Homo sapiens
catggtgaaaccccgtctc

SEQ ID NO: 8443237 - DNA, 19 bp, Homo sapiens
catggtgaaaccccgtctc

SEQ ID NO: 8443238 - DNA, 22 bp, Homo sapiens
catggtttggtctttgtagtgg

SEQ ID NO: 8443239 - DNA, 22 bp, Homo sapiens
catggtgaggggtgaagggcag

SEQ ID NO: 8443240 - DNA, 22 bp, Homo sapiens
catgccaacaacaagcaatgag

SEQ ID NO: 8443241 - DNA, 22 bp, Homo sapiens
catgccaacaacaagcaatgag

SEQ ID NO: 8443242 - DNA, 22 bp, Homo sapiens
catgccaagcatgttcagaagt

SEQ ID NO: 8443243 - DNA, 22 bp, Homo sapiens
catgctaaccagagacataaag

SEQ ID NO: 8443244 - DNA, 22 bp, Homo sapiens
catgctaagtcataaaagagta

SEQ ID NO: 8443245 - DNA, 20 bp, Homo sapiens
catgccagaatgtgaggtag

SEQ ID NO: 8443246 - DNA, 22 bp, Homo sapiens
tcatcagggatattggcctgaa

SEQ ID NO: 8443247 - DNA, 22 bp, Homo sapiens
catgctcacttttatactgtaa

SEQ ID NO: 8443248 - DNA, 22 bp, Homo sapiens
catgctcacaaaagatggcaaa

SEQ ID NO: 8443249 - DNA, 22 bp, Homo sapiens
catgctctgcagcagacctgtg

SEQ ID NO: 8443250 - DNA, 19 bp, Homo sapiens
catgctgacctgctgtggt

SEQ ID NO: 8443251 - DNA, 22 bp, Homo sapiens
catgctgatgaacttctacttg

SEQ ID NO: 8443252 - DNA, 22 bp, Homo sapiens
catgctgtggtaaatcactgaa

SEQ ID NO: 8443253 - DNA, 22 bp, Homo sapiens
catgctgtcctgccagggatgg

SEQ ID NO: 8443254 - DNA, 22 bp, Homo sapiens
tccaagagaatactggagagta

SEQ ID NO: 8443255 - DNA, 22 bp, Homo sapiens
tccaagaatacagatttgtgaa

SEQ ID NO: 8443256 - DNA, 22 bp, Homo sapiens
tccaagatctacagcagtttag

SEQ ID NO: 8443257 - DNA, 22 bp, Homo sapiens
tccaagagtaagaggactcttt

SEQ ID NO: 8443258 - DNA, 22 bp, Homo sapiens
tccagaggtgaacacccaggca

SEQ ID NO: 8443259 - DNA, 18 bp, Homo sapiens
tccagagagggagaagtg

SEQ ID NO: 8443260 - DNA, 18 bp, Homo sapiens
tccagagagggagaagtg

SEQ ID NO: 8443261 - DNA, 18 bp, Homo sapiens
tccagagagggagaagtg

SEQ ID NO: 8443262 - DNA, 22 bp, Homo sapiens
tccaagcatgtggtcaggagcc

SEQ ID NO: 8443263 - DNA, 22 bp, Homo sapiens
tccaggctgtgcatgagtttag

SEQ ID NO: 8443264 - DNA, 22 bp, Homo sapiens
tccaggctgggctgaagggtgc

SEQ ID NO: 8443265 - DNA, 22 bp, Homo sapiens
tccaggctcctgactttttggg

SEQ ID NO: 8443266 - DNA, 22 bp, Homo sapiens
tccaggcttcacgtctgccctc

SEQ ID NO: 8443267 - DNA, 22 bp, Homo sapiens
tccaggctgtgcgcaccgtgtg

SEQ ID NO: 8443268 - DNA, 22 bp, Homo sapiens
catgtacaaggatgctcagagt

SEQ ID NO: 8443269 - DNA, 23 bp, Homo sapiens
catgtacacacagctgtacagtg

SEQ ID NO: 8443270 - DNA, 23 bp, Homo sapiens
catgtacagagtttgataaagtg

SEQ ID NO: 8443271 - DNA, 22 bp, Homo sapiens
tccaggcttgagaccaggctct

SEQ ID NO: 8443272 - DNA, 22 bp, Homo sapiens
tccaggcttgagaccaggctct

SEQ ID NO: 8443273 - DNA, 22 bp, Homo sapiens
tccaggctttggggcaggagcg

SEQ ID NO: 8443274 - DNA, 22 bp, Homo sapiens
tccaggctttggggcaggagcg

SEQ ID NO: 8443275 - DNA, 22 bp, Homo sapiens
tccaggctttggggcaggagcg

SEQ ID NO: 8443276 - DNA, 22 bp, Homo sapiens
tccaggctttggggcaggagcg

SEQ ID NO: 8443277 - DNA, 22 bp, Homo sapiens
tccaggctttttcatgctgtct

SEQ ID NO: 8443278 - DNA, 22 bp, Homo sapiens
catgtgctgtagcagagaggaa

SEQ ID NO: 8443279 - DNA, 22 bp, Homo sapiens
tccaggctttttcatgctgtct

SEQ ID NO: 8443280 - DNA, 22 bp, Homo sapiens
cattaataaacatttcagaaga

SEQ ID NO: 8443281 - DNA, 22 bp, Homo sapiens
cattaagtatttcagttactgt

SEQ ID NO: 8443282 - DNA, 22 bp, Homo sapiens
catgtgggactcctgctgtttt

SEQ ID NO: 8443283 - DNA, 22 bp, Homo sapiens
cattacaaagttataaacagtt

SEQ ID NO: 8443284 - DNA, 22 bp, Homo sapiens
cattacaaagttataaacagtt

SEQ ID NO: 8443285 - DNA, 22 bp, Homo sapiens
cattacaaccccaaattacaaa

SEQ ID NO: 8443286 - DNA, 22 bp, Homo sapiens
cattacaaacatgttaagattt

SEQ ID NO: 8443287 - DNA, 22 bp, Homo sapiens
cattacaaacatgttaagattt

SEQ ID NO: 8443288 - DNA, 22 bp, Homo sapiens
cattaataaacatttcagaaga

SEQ ID NO: 8443289 - DNA, 22 bp, Homo sapiens
cattaataaacatttcagaaga

SEQ ID NO: 8443290 - DNA, 22 bp, Homo sapiens
cattaatattgttcttctttag

SEQ ID NO: 8443291 - DNA, 22 bp, Homo sapiens
cattaataaacatttcagaaga

SEQ ID NO: 8443292 - DNA, 22 bp, Homo sapiens
cattaatattgttcttctttag

SEQ ID NO: 8443293 - DNA, 22 bp, Homo sapiens
cattaattgtatttttcaaagt

SEQ ID NO: 8443294 - DNA, 22 bp, Homo sapiens
cattacagaatatgtaatgatc

SEQ ID NO: 8443295 - DNA, 22 bp, Homo sapiens
tccagggcaggtgctgggctct

SEQ ID NO: 8443296 - DNA, 22 bp, Homo sapiens
cattacaaccccaaattacaaa

SEQ ID NO: 8443297 - DNA, 22 bp, Homo sapiens
cattacaaccccaaattacaaa

SEQ ID NO: 8443298 - DNA, 22 bp, Homo sapiens
cattacaaccccaaattacaaa

SEQ ID NO: 8443299 - DNA, 22 bp, Homo sapiens
tccagggcagtgactacagcgg

SEQ ID NO: 8443300 - DNA, 22 bp, Homo sapiens
tccagggcagtgactacagcgg

SEQ ID NO: 8443301 - DNA, 22 bp, Homo sapiens
tccagggcaggtgctgggctct

SEQ ID NO: 8443302 - DNA, 22 bp, Homo sapiens
tccaggtcagacttctgtgccc

SEQ ID NO: 8443303 - DNA, 22 bp, Homo sapiens
tccaggtcagacttctgtgccc

SEQ ID NO: 8443304 - DNA, 22 bp, Homo sapiens
tccaggtaatttggatgctagt

SEQ ID NO: 8443305 - DNA, 20 bp, Homo sapiens
tccaggtaacatctctctgg

SEQ ID NO: 8443306 - DNA, 22 bp, Homo sapiens
tccaggtcatcttggagagctg

SEQ ID NO: 8443307 - DNA, 22 bp, Homo sapiens
tccaggtcccagactgggcagc

SEQ ID NO: 8443308 - DNA, 22 bp, Homo sapiens
tccaggtcccagactgggcagc

SEQ ID NO: 8443309 - DNA, 18 bp, Homo sapiens
tccaggtcccaggggaag

SEQ ID NO: 8443310 - DNA, 22 bp, Homo sapiens
tccagggttgtgggcttcagca

SEQ ID NO: 8443311 - DNA, 23 bp, Homo sapiens
tccagggcagtggctgggtctgc

SEQ ID NO: 8443312 - DNA, 22 bp, Homo sapiens
tccagggcatgctcagactcag

SEQ ID NO: 8443313 - DNA, 20 bp, Homo sapiens
tcatacacatgagcatgcag

SEQ ID NO: 8443314 - DNA, 22 bp, Homo sapiens
tcatacaactaagagtttcaga

SEQ ID NO: 8443315 - DNA, 22 bp, Homo sapiens
tcatcagagctcccccaaacgt

SEQ ID NO: 8443316 - DNA, 22 bp, Homo sapiens
tcatcacatatgtcatgatttg

SEQ ID NO: 8443317 - DNA, 18 bp, Homo sapiens
catctacaaatgccagaa

SEQ ID NO: 8443318 - DNA, 22 bp, Homo sapiens
catctaccagaattgctataaa

SEQ ID NO: 8443319 - DNA, 22 bp, Homo sapiens
catctacctccaccctatatat

SEQ ID NO: 8443320 - DNA, 22 bp, Homo sapiens
catctagaaaaaagacctgttg

SEQ ID NO: 8443321 - DNA, 22 bp, Homo sapiens
catcctgagaggtctctctacc

SEQ ID NO: 8443322 - DNA, 22 bp, Homo sapiens
catcctggttaccccatagtca

SEQ ID NO: 8443323 - DNA, 22 bp, Homo sapiens
catccgcatgcaagtgctgtcc

SEQ ID NO: 8443324 - DNA, 22 bp, Homo sapiens
catccctgtctgccactctgaa

SEQ ID NO: 8443325 - DNA, 22 bp, Homo sapiens
catcagtgaaagtgaatgttct

SEQ ID NO: 8443326 - DNA, 22 bp, Homo sapiens
catcagtgagccccttgatgag

SEQ ID NO: 8443327 - DNA, 22 bp, Homo sapiens
catcagtgcccttggggatgcc

SEQ ID NO: 8443328 - DNA, 22 bp, Homo sapiens
catcagtggatatagattagcg

SEQ ID NO: 8443329 - DNA, 22 bp, Homo sapiens
catcagtaaggcaacatagctt

SEQ ID NO: 8443330 - DNA, 22 bp, Homo sapiens
catcagagtggtggcctggtgt

SEQ ID NO: 8443331 - DNA, 22 bp, Homo sapiens
tcagtgtcttctctttcctacc

SEQ ID NO: 8443332 - DNA, 22 bp, Homo sapiens
tcagtgtgtacactgagcattt

SEQ ID NO: 8443333 - DNA, 22 bp, Homo sapiens
catcaaatctgacttttcttcc

SEQ ID NO: 8443334 - DNA, 22 bp, Homo sapiens
catcaaagttggtatatttgca

SEQ ID NO: 8443335 - DNA, 22 bp, Homo sapiens
catcaaagttgatatccaatta

SEQ ID NO: 8443336 - DNA, 17 bp, Homo sapiens
catcaaagaaatttcca

SEQ ID NO: 8443337 - DNA, 17 bp, Homo sapiens
catcaaagaaatttcca

SEQ ID NO: 8443338 - DNA, 22 bp, Homo sapiens
catcaaaattagacattgttga

SEQ ID NO: 8443339 - DNA, 22 bp, Homo sapiens
catcaaagggcctgtggtgcag

SEQ ID NO: 8443340 - DNA, 22 bp, Homo sapiens
catcaaagcttttttctgtgtt

SEQ ID NO: 8443341 - DNA, 22 bp, Homo sapiens
catcaaaattagacattgttga

SEQ ID NO: 8443342 - DNA, 21 bp, Homo sapiens
catattaaatcggtgccttta

SEQ ID NO: 8443343 - DNA, 22 bp, Homo sapiens
tcaggcagaggatggggagcgt

SEQ ID NO: 8443344 - DNA, 22 bp, Homo sapiens
tcaggcagagggagaagccaag

SEQ ID NO: 8443345 - DNA, 22 bp, Homo sapiens
tcaggcagagggagaagccaag

SEQ ID NO: 8443346 - DNA, 22 bp, Homo sapiens
tcaggcagaccaccgtgggcag

SEQ ID NO: 8443347 - DNA, 22 bp, Homo sapiens
tcaggcagagctgtggagctct

SEQ ID NO: 8443348 - DNA, 22 bp, Homo sapiens
catcaagagtcttactatcagt

SEQ ID NO: 8443349 - DNA, 22 bp, Homo sapiens
tcaggctgcagctgtcagcagc

SEQ ID NO: 8443350 - DNA, 22 bp, Homo sapiens
tcaggctgcagctgtcagcagc

SEQ ID NO: 8443351 - DNA, 22 bp, Homo sapiens
tcaggctgcagtggcaaaagac

SEQ ID NO: 8443352 - DNA, 22 bp, Homo sapiens
tcaggctgcagtggcaaaagac

SEQ ID NO: 8443353 - DNA, 22 bp, Homo sapiens
tcaggctgatttcttttgaggg

SEQ ID NO: 8443354 - DNA, 22 bp, Homo sapiens
tcaggctgatttcttttgaggg

SEQ ID NO: 8443355 - DNA, 21 bp, Homo sapiens
catcacattactcaaagtcct

SEQ ID NO: 8443356 - DNA, 22 bp, Homo sapiens
catcacattagtctcaagagaa

SEQ ID NO: 8443357 - DNA, 22 bp, Homo sapiens
tcaggctgcctatcagactgtg

SEQ ID NO: 8443358 - DNA, 18 bp, Homo sapiens
tcaggctgccctgtgtct

SEQ ID NO: 8443359 - DNA, 21 bp, Homo sapiens
catcacattactcaaagtcct

SEQ ID NO: 8443360 - DNA, 18 bp, Homo sapiens
tcaggctgccctgtgtct

SEQ ID NO: 8443361 - DNA, 22 bp, Homo sapiens
tcaggctgcctatcagactgtg

SEQ ID NO: 8443362 - DNA, 22 bp, Homo sapiens
tcaggctgcctatcagactgtg

SEQ ID NO: 8443363 - DNA, 22 bp, Homo sapiens
tcaggctgcccgttcagggctc

SEQ ID NO: 8443364 - DNA, 22 bp, Homo sapiens
tcaggctgcccgttcagggctc

SEQ ID NO: 8443365 - DNA, 22 bp, Homo sapiens
tcaggctgcatctgtaagggtg

SEQ ID NO: 8443366 - DNA, 22 bp, Homo sapiens
tcaggctgcatctgtaagggtg

SEQ ID NO: 8443367 - DNA, 22 bp, Homo sapiens
tcaggaggcctgagtagctcta

SEQ ID NO: 8443368 - DNA, 22 bp, Homo sapiens
tcaggaggcctgagtagctcta

SEQ ID NO: 8443369 - DNA, 22 bp, Homo sapiens
tcaggaggcggaggttgcagtg

SEQ ID NO: 8443370 - DNA, 22 bp, Homo sapiens
tcaggaggcctgagtagctcta

SEQ ID NO: 8443371 - DNA, 22 bp, Homo sapiens
tcaggaggcggtgctgcctttg

SEQ ID NO: 8443372 - DNA, 21 bp, Homo sapiens
tcaggaggctcagactcctgc

SEQ ID NO: 8443373 - DNA, 22 bp, Homo sapiens
tcaggcagaaaaatcactaatt

SEQ ID NO: 8443374 - DNA, 22 bp, Homo sapiens
tcaggcagaattatcaaaagat

SEQ ID NO: 8443375 - DNA, 22 bp, Homo sapiens
tcaggaagttttgaatcaactg

SEQ ID NO: 8443376 - DNA, 22 bp, Homo sapiens
tcacttattgctcatctcatgc

SEQ ID NO: 8443377 - DNA, 22 bp, Homo sapiens
tcacttagatggggatcatcac

SEQ ID NO: 8443378 - DNA, 22 bp, Homo sapiens
cagtggtttccaaacttgttcc

SEQ ID NO: 8443379 - DNA, 22 bp, Homo sapiens
cagtgtcctcagccagcagcta

SEQ ID NO: 8443380 - DNA, 22 bp, Homo sapiens
ccaaattaaatcatacagacag

SEQ ID NO: 8443381 - DNA, 22 bp, Homo sapiens
tcctgaggtggattgagcagag

SEQ ID NO: 8443382 - DNA, 22 bp, Homo sapiens
tcctgaggtggattgagcagag

SEQ ID NO: 8443383 - DNA, 22 bp, Homo sapiens
tcctgaggtggattgagcagag

SEQ ID NO: 8443384 - DNA, 22 bp, Homo sapiens
tcctgaggtgctcagccaggaa

SEQ ID NO: 8443385 - DNA, 22 bp, Homo sapiens
tcctgaggtatatgctttgcag

SEQ ID NO: 8443386 - DNA, 22 bp, Homo sapiens
tcctgaggtctgaaaaaggagc

SEQ ID NO: 8443387 - DNA, 22 bp, Homo sapiens
tcctgaggtgctcagccaggaa

SEQ ID NO: 8443388 - DNA, 22 bp, Homo sapiens
tcctgaggtgctcagccaggaa

SEQ ID NO: 8443389 - DNA, 22 bp, Homo sapiens
tcctgagggctgcagtcatagg

SEQ ID NO: 8443390 - DNA, 22 bp, Homo sapiens
ccaacacagatgtgttagtgtt

SEQ ID NO: 8443391 - DNA, 19 bp, Homo sapiens
ccaacagtactgaagcact

SEQ ID NO: 8443392 - DNA, 22 bp, Homo sapiens
ccaacagtccagatgagatggt

SEQ ID NO: 8443393 - DNA, 22 bp, Homo sapiens
ccaacctgaggcaggctgcagc

SEQ ID NO: 8443394 - DNA, 22 bp, Homo sapiens
ccaactctgaaaatccagatat

SEQ ID NO: 8443395 - DNA, 22 bp, Homo sapiens
ccaagaggcagaatgcagagaa

SEQ ID NO: 8443396 - DNA, 21 bp, Homo sapiens
ccaagagcaatgctaaggaga

SEQ ID NO: 8443397 - DNA, 20 bp, Homo sapiens
ccaagagcatgcatgaggaa

SEQ ID NO: 8443398 - DNA, 22 bp, Homo sapiens
tcctgcccagagctctccactc

SEQ ID NO: 8443399 - DNA, 22 bp, Homo sapiens
ccaagaggttgaggctgcagtg

SEQ ID NO: 8443400 - DNA, 22 bp, Homo sapiens
tcctgccttagagcaaggaaaa

SEQ ID NO: 8443401 - DNA, 21 bp, Homo sapiens
tcctgccttagtccagagcag

SEQ ID NO: 8443402 - DNA, 22 bp, Homo sapiens
tcctgccttgcctgggacatca

SEQ ID NO: 8443403 - DNA, 22 bp, Homo sapiens
tcctgccttcatactgctgtat

SEQ ID NO: 8443404 - DNA, 22 bp, Homo sapiens
tcctgctagagaataacagcac

SEQ ID NO: 8443405 - DNA, 22 bp, Homo sapiens
tcctgctccaccgtgggctgga

SEQ ID NO: 8443406 - DNA, 22 bp, Homo sapiens
tcctggccttagcgaggcggtc

SEQ ID NO: 8443407 - DNA, 22 bp, Homo sapiens
tcctggcctgtctggagtagct

SEQ ID NO: 8443408 - DNA, 22 bp, Homo sapiens
tcctggccttatccccaaactg

SEQ ID NO: 8443409 - DNA, 20 bp, Homo sapiens
tcctggccttctcgggcagt

SEQ ID NO: 8443410 - DNA, 20 bp, Homo sapiens
tcctggccttctcgggcagt

SEQ ID NO: 8443411 - DNA, 22 bp, Homo sapiens
tcctggccttatccccaaactg

SEQ ID NO: 8443412 - DNA, 22 bp, Homo sapiens
tcctggccttgctcctgatgcc

SEQ ID NO: 8443413 - DNA, 16 bp, Homo sapiens
tcctggcctttggaag

SEQ ID NO: 8443414 - DNA, 22 bp, Homo sapiens
tcctggccttgcgtcttgggag

SEQ ID NO: 8443415 - DNA, 22 bp, Homo sapiens
tcctggccttgcgtcttgggag

SEQ ID NO: 8443416 - DNA, 22 bp, Homo sapiens
tcctggccttgctcctgatgcc

SEQ ID NO: 8443417 - DNA, 22 bp, Homo sapiens
ccaccaggacagccctgagggg

SEQ ID NO: 8443418 - DNA, 22 bp, Homo sapiens
tcctggctaatgctgctgatgg

SEQ ID NO: 8443419 - DNA, 22 bp, Homo sapiens
tcctggctagttttgctgaaat

SEQ ID NO: 8443420 - DNA, 22 bp, Homo sapiens
tcctggctcaggcccctggtgc

SEQ ID NO: 8443421 - DNA, 22 bp, Homo sapiens
ccacaggctgctgcaggtcccg

SEQ ID NO: 8443422 - DNA, 22 bp, Homo sapiens
ccacaggcggagtggcgggcag

SEQ ID NO: 8443423 - DNA, 22 bp, Homo sapiens
tcctggagctggtgtctttccc

SEQ ID NO: 8443424 - DNA, 22 bp, Homo sapiens
tcctggagcttccttcatggta

SEQ ID NO: 8443425 - DNA, 22 bp, Homo sapiens
ccacaggcggagtggcgggcag

SEQ ID NO: 8443426 - DNA, 22 bp, Homo sapiens
ccacagctgaccgcaggtgagc

SEQ ID NO: 8443427 - DNA, 22 bp, Homo sapiens
catttcacgcacactcattact

SEQ ID NO: 8443428 - DNA, 22 bp, Homo sapiens
tccatataatgggattccttat

SEQ ID NO: 8443429 - DNA, 22 bp, Homo sapiens
tccatatacaacttaatcttta

SEQ ID NO: 8443430 - DNA, 22 bp, Homo sapiens
tccatatatattagtcttcctt

SEQ ID NO: 8443431 - DNA, 22 bp, Homo sapiens
tccatatacctgcagcctggtt

SEQ ID NO: 8443432 - DNA, 22 bp, Homo sapiens
tccatactggagtccacagttc

SEQ ID NO: 8443433 - DNA, 22 bp, Homo sapiens
tccatactcagaaagtattgca

SEQ ID NO: 8443434 - DNA, 23 bp, Homo sapiens
tccatactctaaacatgttattt

SEQ ID NO: 8443435 - DNA, 22 bp, Homo sapiens
tccatagaatgcagtgtaaatt

SEQ ID NO: 8443436 - DNA, 22 bp, Homo sapiens
tccatacattgaaataccattc

SEQ ID NO: 8443437 - DNA, 22 bp, Homo sapiens
tccatactaacagcatttatca

SEQ ID NO: 8443438 - DNA, 22 bp, Homo sapiens
tccatacatacagatatgcatt

SEQ ID NO: 8443439 - DNA, 22 bp, Homo sapiens
tccagtttgcactgtataatag

SEQ ID NO: 8443440 - DNA, 22 bp, Homo sapiens
tccagtttcctgtggctgccta

SEQ ID NO: 8443441 - DNA, 22 bp, Homo sapiens
tccaggtcctactggcccatag

SEQ ID NO: 8443442 - DNA, 22 bp, Homo sapiens
tccaggtcctactggcccatag

SEQ ID NO: 8443443 - DNA, 22 bp, Homo sapiens
tccaggtccctggggagatttt

SEQ ID NO: 8443444 - DNA, 16 bp, Homo sapiens
tccagttttcagcact

SEQ ID NO: 8443445 - DNA, 20 bp, Homo sapiens
tccagttttggagacattct

SEQ ID NO: 8443446 - DNA, 19 bp, Homo sapiens
tccagtttggcaggaagac

SEQ ID NO: 8443447 - DNA, 19 bp, Homo sapiens
tccataatgaagatagagg

SEQ ID NO: 8443448 - DNA, 22 bp, Homo sapiens
tccataaatgaaatagaacgct

SEQ ID NO: 8443449 - DNA, 22 bp, Homo sapiens
tccataaattttatgaacatat

SEQ ID NO: 8443450 - DNA, 19 bp, Homo sapiens
tccatacaaactgttgaaa

SEQ ID NO: 8443451 - DNA, 22 bp, Homo sapiens
tccatacacattgaattttagt

SEQ ID NO: 8443452 - DNA, 22 bp, Homo sapiens
tccatacataaaatgtttaatg

SEQ ID NO: 8443453 - DNA, 22 bp, Homo sapiens
tccatacagtccacacggtgca

SEQ ID NO: 8443454 - DNA, 22 bp, Homo sapiens
tccatacacatttatttggcct

SEQ ID NO: 8443455 - DNA, 21 bp, Homo sapiens
catttctaagcctggctatag

SEQ ID NO: 8443456 - DNA, 22 bp, Homo sapiens
catttcctgtctggaggtcaaa

SEQ ID NO: 8443457 - DNA, 22 bp, Homo sapiens
catttccttcctgctgctcctc

SEQ ID NO: 8443458 - DNA, 22 bp, Homo sapiens
catttcagtgtcttgtgatgaa

SEQ ID NO: 8443459 - DNA, 22 bp, Homo sapiens
catttcagtgttattctaattt

SEQ ID NO: 8443460 - DNA, 22 bp, Homo sapiens
catttcattcctttgaaagtgg

SEQ ID NO: 8443461 - DNA, 22 bp, Homo sapiens
cattttacgacatagggcaggc

SEQ ID NO: 8443462 - DNA, 22 bp, Homo sapiens
cattttactgactcttgaatta

SEQ ID NO: 8443463 - DNA, 22 bp, Homo sapiens
cattttacctagaagctgaaag

SEQ ID NO: 8443464 - DNA, 22 bp, Homo sapiens
cattttacctagaagctgaaag

SEQ ID NO: 8443465 - DNA, 22 bp, Homo sapiens
cattttactgactcttgaatta

SEQ ID NO: 8443466 - DNA, 22 bp, Homo sapiens
catttgtcatcactgagctgcc

SEQ ID NO: 8443467 - DNA, 22 bp, Homo sapiens
catttgtgcttttataaaatag

SEQ ID NO: 8443468 - DNA, 22 bp, Homo sapiens
catttgtgtgggaacccatcag

SEQ ID NO: 8443469 - DNA, 22 bp, Homo sapiens
cattttaagatgacctggtttc

SEQ ID NO: 8443470 - DNA, 22 bp, Homo sapiens
cattttaaatgatttaagccaa

SEQ ID NO: 8443471 - DNA, 22 bp, Homo sapiens
cattttcatgagtttctgttca

SEQ ID NO: 8443472 - DNA, 22 bp, Homo sapiens
cattttcctctgctggtgttca

SEQ ID NO: 8443473 - DNA, 22 bp, Homo sapiens
cattttgtagcaatgactgttg

SEQ ID NO: 8443474 - DNA, 19 bp, Homo sapiens
cattttctcattgtgcccc

SEQ ID NO: 8443475 - DNA, 22 bp, Homo sapiens
cattttgtaagtctctcttgtt

SEQ ID NO: 8443476 - DNA, 22 bp, Homo sapiens
cattttgtaagtctctcttgtt

SEQ ID NO: 8443477 - DNA, 20 bp, Homo sapiens
tcctgaggcttcgccagtgt

SEQ ID NO: 8443478 - DNA, 22 bp, Homo sapiens
tcctgagggcattttggtgact

SEQ ID NO: 8443479 - DNA, 22 bp, Homo sapiens
tcctgagggcgattcagcaggt

SEQ ID NO: 8443480 - DNA, 22 bp, Homo sapiens
tcctgagaaggcacagcttgca

SEQ ID NO: 8443481 - DNA, 22 bp, Homo sapiens
ccaaaaagctcagagatatgtt

SEQ ID NO: 8443482 - DNA, 22 bp, Homo sapiens
ccaaaaagtacatttaggtgtg

SEQ ID NO: 8443483 - DNA, 22 bp, Homo sapiens
tctagaatgacatgcaagagta

SEQ ID NO: 8443484 - DNA, 22 bp, Homo sapiens
tctagaatgacatgcaagagta

SEQ ID NO: 8443485 - DNA, 22 bp, Homo sapiens
tctagaatggctgggcacagct

SEQ ID NO: 8443486 - DNA, 22 bp, Homo sapiens
tctagaatgttccaccttgttt

SEQ ID NO: 8443487 - DNA, 22 bp, Homo sapiens
tctagaatctaaactatagttt

SEQ ID NO: 8443488 - DNA, 21 bp, Homo sapiens
tctagaatcctgtataagact

SEQ ID NO: 8443489 - DNA, 22 bp, Homo sapiens
tctagaattcccttttgacaat

SEQ ID NO: 8443490 - DNA, 22 bp, Homo sapiens
tctatacaagtttcactttgac

SEQ ID NO: 8443491 - DNA, 22 bp, Homo sapiens
tctcagctgcctgccctgctcc

SEQ ID NO: 8443492 - DNA, 22 bp, Homo sapiens
tctcagagacctgaactccctg

SEQ ID NO: 8443493 - DNA, 22 bp, Homo sapiens
tctcagagacctgaactccctg

SEQ ID NO: 8443494 - DNA, 22 bp, Homo sapiens
tctcaggaaaaatccctagctt

SEQ ID NO: 8443495 - DNA, 23 bp, Homo sapiens
tctatacatactgcagcctctgg

SEQ ID NO: 8443496 - DNA, 22 bp, Homo sapiens
tctatagacttggacatatagt

SEQ ID NO: 8443497 - DNA, 22 bp, Homo sapiens
tctatagatcagtaaatatctc

SEQ ID NO: 8443498 - DNA, 22 bp, Homo sapiens
tctcagagaagtgatgagcaat

SEQ ID NO: 8443499 - DNA, 22 bp, Homo sapiens
tctcagagaagtgatgagcaat

SEQ ID NO: 8443500 - DNA, 22 bp, Homo sapiens
tctcagagaagtgatgagcaat

SEQ ID NO: 8443501 - DNA, 17 bp, Homo sapiens
tctcaggcacgtgtggc

SEQ ID NO: 8443502 - DNA, 23 bp, Homo sapiens
tctcaggcaaaccaggacaagtt

SEQ ID NO: 8443503 - DNA, 22 bp, Homo sapiens
tctcaggactcctctggccata

SEQ ID NO: 8443504 - DNA, 22 bp, Homo sapiens
tctcaggactcctctggccata

SEQ ID NO: 8443505 - DNA, 22 bp, Homo sapiens
tctcaggcatggtttgttcatc

SEQ ID NO: 8443506 - DNA, 22 bp, Homo sapiens
tctcaggcatctgtgtggcaca

SEQ ID NO: 8443507 - DNA, 23 bp, Homo sapiens
tctcaggcaaaccaggacaagtt

SEQ ID NO: 8443508 - DNA, 22 bp, Homo sapiens
tctcaggcactgggtgccaact

SEQ ID NO: 8443509 - DNA, 20 bp, Homo sapiens
tctcaggccccagttttctt

SEQ ID NO: 8443510 - DNA, 22 bp, Homo sapiens
tctcaggcattcccacatagaa

SEQ ID NO: 8443511 - DNA, 22 bp, Homo sapiens
tctcaggcccactgtgttgaaa

SEQ ID NO: 8443512 - DNA, 22 bp, Homo sapiens
tctcagtgtttaaaaagatttc

SEQ ID NO: 8443513 - DNA, 22 bp, Homo sapiens
tctcagtgttgttctgcagatg

SEQ ID NO: 8443514 - DNA, 22 bp, Homo sapiens
tctcagtgttatctatctgcct

SEQ ID NO: 8443515 - DNA, 22 bp, Homo sapiens
tctcagtggcttcctcactttt

SEQ ID NO: 8443516 - DNA, 22 bp, Homo sapiens
tctcagtgggttaaaagagaag

SEQ ID NO: 8443517 - DNA, 22 bp, Homo sapiens
tctcagtgtgttttctctcaga

SEQ ID NO: 8443518 - DNA, 22 bp, Homo sapiens
tctcagtgtggtgcttaggata

SEQ ID NO: 8443519 - DNA, 22 bp, Homo sapiens
tctcagtggtgttttgagtcca

SEQ ID NO: 8443520 - DNA, 22 bp, Homo sapiens
tctagaaattttgccttgtatt

SEQ ID NO: 8443521 - DNA, 22 bp, Homo sapiens
tctagaaattttgccttgtatt

SEQ ID NO: 8443522 - DNA, 22 bp, Homo sapiens
tctagaactccagttaggcaat

SEQ ID NO: 8443523 - DNA, 21 bp, Homo sapiens
tctagaagaggttgagaatat

SEQ ID NO: 8443524 - DNA, 22 bp, Homo sapiens
tctagaagggtgccgatcttag

SEQ ID NO: 8443525 - DNA, 22 bp, Homo sapiens
tctagaacttctctaaaatgaa

SEQ ID NO: 8443526 - DNA, 22 bp, Homo sapiens
tctagaatcactgtttccatct

SEQ ID NO: 8443527 - DNA, 22 bp, Homo sapiens
tctagaatagattctgctgatc

SEQ ID NO: 8443528 - DNA, 22 bp, Homo sapiens
tctagaatactgtgacatgcca

SEQ ID NO: 8443529 - DNA, 22 bp, Homo sapiens
tctagaaagccaaattaggaat

SEQ ID NO: 8443530 - DNA, 22 bp, Homo sapiens
tctagaaagtttgtactgattt

SEQ ID NO: 8443531 - DNA, 22 bp, Homo sapiens
tctagaaagccaaattaggaat

SEQ ID NO: 8443532 - DNA, 22 bp, Homo sapiens
tctagaaagtactagagctggt

SEQ ID NO: 8443533 - DNA, 22 bp, Homo sapiens
tctagaaagtactagagctggt

SEQ ID NO: 8443534 - DNA, 22 bp, Homo sapiens
tcctgtttctcctgcaaaatcc

SEQ ID NO: 8443535 - DNA, 22 bp, Homo sapiens
tcctgtttcaacccttacactg

SEQ ID NO: 8443536 - DNA, 22 bp, Homo sapiens
tcctgtttatctgtgtgactcg

SEQ ID NO: 8443537 - DNA, 22 bp, Homo sapiens
tcctgtttccaatttgttgggt

SEQ ID NO: 8443538 - DNA, 23 bp, Homo sapiens
tctaatgcaattagaaattaggg

SEQ ID NO: 8443539 - DNA, 22 bp, Homo sapiens
tctagaaacatgacattgatct

SEQ ID NO: 8443540 - DNA, 22 bp, Homo sapiens
tcctgtttaggctgtggtctgg

SEQ ID NO: 8443541 - DNA, 17 bp, Homo sapiens
tcctgtttatcattgat

SEQ ID NO: 8443542 - DNA, 17 bp, Homo sapiens
tcctgtttatcattgat

SEQ ID NO: 8443543 - DNA, 22 bp, Homo sapiens
tcctgtttatctgtgtgactcg

SEQ ID NO: 8443544 - DNA, 22 bp, Homo sapiens
tcctgtgttactgcctggagcg

SEQ ID NO: 8443545 - DNA, 22 bp, Homo sapiens
tcctgtgttgatagagatggtt

SEQ ID NO: 8443546 - DNA, 19 bp, Homo sapiens
ccacccctttgctgggccc

SEQ ID NO: 8443547 - DNA, 22 bp, Homo sapiens
ccacccctgggtgcagggagcg

SEQ ID NO: 8443548 - DNA, 22 bp, Homo sapiens
ccacccatgtgactacctcatg

SEQ ID NO: 8443549 - DNA, 22 bp, Homo sapiens
ccaccaggcactcacagggaag

SEQ ID NO: 8443550 - DNA, 20 bp, Homo sapiens
tcctgtgtgtctcatcaacc

SEQ ID NO: 8443551 - DNA, 22 bp, Homo sapiens
tcctgtgttaaagggggtgcta

SEQ ID NO: 8443552 - DNA, 22 bp, Homo sapiens
tcctgtgtgtggcctttcccag

SEQ ID NO: 8443553 - DNA, 22 bp, Homo sapiens
tcctgtgtctcagcgtgaagca

SEQ ID NO: 8443554 - DNA, 20 bp, Homo sapiens
ccaccctgctaagaatacac

SEQ ID NO: 8443555 - DNA, 20 bp, Homo sapiens
ccaccctgctaagaatacac

SEQ ID NO: 8443556 - DNA, 22 bp, Homo sapiens
ccaccctggacaggcctctgag

SEQ ID NO: 8443557 - DNA, 22 bp, Homo sapiens
ccaccctgagccgcaagagcag

SEQ ID NO: 8443558 - DNA, 22 bp, Homo sapiens
ccagattcatagaaactcatag

SEQ ID NO: 8443559 - DNA, 22 bp, Homo sapiens
ccagatgttcccctggaggcct

SEQ ID NO: 8443560 - DNA, 22 bp, Homo sapiens
ccagatgtctgagccacactcc

SEQ ID NO: 8443561 - DNA, 22 bp, Homo sapiens
tctctgtattcttcgtaatgcc

SEQ ID NO: 8443562 - DNA, 20 bp, Homo sapiens
ccagcaccctctcagctgaa

SEQ ID NO: 8443563 - DNA, 20 bp, Homo sapiens
ccagcaccctctcagctgaa

SEQ ID NO: 8443564 - DNA, 22 bp, Homo sapiens
ccagcaccttgatcttggagtt

SEQ ID NO: 8443565 - DNA, 22 bp, Homo sapiens
tctctgtaatatcttttacaac

SEQ ID NO: 8443566 - DNA, 22 bp, Homo sapiens
tctctgtaatatcttttacaac

SEQ ID NO: 8443567 - DNA, 22 bp, Homo sapiens
tctctgtaagagaggctttcat

SEQ ID NO: 8443568 - DNA, 22 bp, Homo sapiens
tctctgtaagctgccttctcgt

SEQ ID NO: 8443569 - DNA, 23 bp, Homo sapiens
tctctgtacagatgaggacacac

SEQ ID NO: 8443570 - DNA, 22 bp, Homo sapiens
tctctgtaaaatgtggatgata

SEQ ID NO: 8443571 - DNA, 20 bp, Homo sapiens
tctctgtaaatcttctttta

SEQ ID NO: 8443572 - DNA, 22 bp, Homo sapiens
tctctgtagacctgaccagcac

SEQ ID NO: 8443573 - DNA, 22 bp, Homo sapiens
tctctgtagagacagcactgtg

SEQ ID NO: 8443574 - DNA, 22 bp, Homo sapiens
tctctgtaaggaagaattagat

SEQ ID NO: 8443575 - DNA, 22 bp, Homo sapiens
tctctgtacagtacatgccgtg

SEQ ID NO: 8443576 - DNA, 22 bp, Homo sapiens
tctctgtagcagcttccttcct

SEQ ID NO: 8443577 - DNA, 22 bp, Homo sapiens
tctctgtagggctgcttgagta

SEQ ID NO: 8443578 - DNA, 22 bp, Homo sapiens
tctctgtattctgatattcact

SEQ ID NO: 8443579 - DNA, 22 bp, Homo sapiens
tctctgtattctgatattcact

SEQ ID NO: 8443580 - DNA, 22 bp, Homo sapiens
tctctgtatcccagaaccaaaa

SEQ ID NO: 8443581 - DNA, 22 bp, Homo sapiens
ccagatgtccctctcaggtttg

SEQ ID NO: 8443582 - DNA, 22 bp, Homo sapiens
tctctgtatcagcacctgctgg

SEQ ID NO: 8443583 - DNA, 22 bp, Homo sapiens
tctctgtagttgggcagctgct

SEQ ID NO: 8443584 - DNA, 21 bp, Homo sapiens
tctctgtatccatgggttcca

SEQ ID NO: 8443585 - DNA, 20 bp, Homo sapiens
ccagagggtagggccgcccc

SEQ ID NO: 8443586 - DNA, 22 bp, Homo sapiens
ccagaggtcccctgccaggagg

SEQ ID NO: 8443587 - DNA, 22 bp, Homo sapiens
ccagaggtcctgctcactggtg

SEQ ID NO: 8443588 - DNA, 22 bp, Homo sapiens
ccagaggtctcctgcacgggat

SEQ ID NO: 8443589 - DNA, 22 bp, Homo sapiens
tctctgggataaactgggccag

SEQ ID NO: 8443590 - DNA, 22 bp, Homo sapiens
ccagaggtgaacaggaggctgt

SEQ ID NO: 8443591 - DNA, 22 bp, Homo sapiens
ccagagggcaaaatgaagctta

SEQ ID NO: 8443592 - DNA, 22 bp, Homo sapiens
ccagagggcctttggagttatc

SEQ ID NO: 8443593 - DNA, 22 bp, Homo sapiens
ccagagggcttggtttgggcca

SEQ ID NO: 8443594 - DNA, 22 bp, Homo sapiens
ccagaggggctgagcaggtcac

SEQ ID NO: 8443595 - DNA, 22 bp, Homo sapiens
ccagaggggtgggcctggttta

SEQ ID NO: 8443596 - DNA, 22 bp, Homo sapiens
ccagaggggcacaaaagtagaa

SEQ ID NO: 8443597 - DNA, 22 bp, Homo sapiens
ccagagcccagggtcatgcagg

SEQ ID NO: 8443598 - DNA, 22 bp, Homo sapiens
ccagagcccagcacacggtgct

SEQ ID NO: 8443599 - DNA, 22 bp, Homo sapiens
ccagagccagagaggtgcctgc

SEQ ID NO: 8443600 - DNA, 22 bp, Homo sapiens
ccagagcatgaagggcaatgac

SEQ ID NO: 8443601 - DNA, 22 bp, Homo sapiens
ccagagagggcgccacctggag

SEQ ID NO: 8443602 - DNA, 20 bp, Homo sapiens
ccagagcagccactgaagtt

SEQ ID NO: 8443603 - DNA, 22 bp, Homo sapiens
ccagagcagggcagcagggctc

SEQ ID NO: 8443604 - DNA, 19 bp, Homo sapiens
ccagagcccgccagatggg

SEQ ID NO: 8443605 - DNA, 22 bp, Homo sapiens
ccagagccggattgtgaagtgc

SEQ ID NO: 8443606 - DNA, 22 bp, Homo sapiens
ccagagcccgggacctggactt

SEQ ID NO: 8443607 - DNA, 22 bp, Homo sapiens
ccagagccggctccctcagctt

SEQ ID NO: 8443608 - DNA, 22 bp, Homo sapiens
ccagagcctcaacacaggtcct

SEQ ID NO: 8443609 - DNA, 22 bp, Homo sapiens
ccagagcctcaacacaggtcct

SEQ ID NO: 8443610 - DNA, 22 bp, Homo sapiens
ccagagcctaagatctgatcct

SEQ ID NO: 8443611 - DNA, 22 bp, Homo sapiens
ccagagcctcttatgaagatcg

SEQ ID NO: 8443612 - DNA, 22 bp, Homo sapiens
ccagaggctggcagccagctga

SEQ ID NO: 8443613 - DNA, 22 bp, Homo sapiens
ccagaggatcagtactggctgg

SEQ ID NO: 8443614 - DNA, 22 bp, Homo sapiens
ccagaggatcagtactggctgg

SEQ ID NO: 8443615 - DNA, 22 bp, Homo sapiens
ccagaggctgggttcacctcag

SEQ ID NO: 8443616 - DNA, 22 bp, Homo sapiens
ccagaggctggggaaggataca

SEQ ID NO: 8443617 - DNA, 22 bp, Homo sapiens
ccagagggagccaccagggtgt

SEQ ID NO: 8443618 - DNA, 22 bp, Homo sapiens
ccagagggaagaggaagcgctg

SEQ ID NO: 8443619 - DNA, 22 bp, Homo sapiens
ccagagggaactgggcctcatt

SEQ ID NO: 8443620 - DNA, 22 bp, Homo sapiens
tagaaagacagaggttttgtct

SEQ ID NO: 8443621 - DNA, 22 bp, Homo sapiens
tacctcaagttccaggaaagcg

SEQ ID NO: 8443622 - DNA, 22 bp, Homo sapiens
tacctagaccagttacaatgca

SEQ ID NO: 8443623 - DNA, 22 bp, Homo sapiens
tagaaagagctttgcttccttt

SEQ ID NO: 8443624 - DNA, 22 bp, Homo sapiens
tagaaagatctgtaggcaagag

SEQ ID NO: 8443625 - DNA, 22 bp, Homo sapiens
tagaaagatctgtaggcaagag

SEQ ID NO: 8443626 - DNA, 22 bp, Homo sapiens
tagaaagcaaaatcctaccaag

SEQ ID NO: 8443627 - DNA, 22 bp, Homo sapiens
tagaaagcagaaaccatcagag

SEQ ID NO: 8443628 - DNA, 22 bp, Homo sapiens
tagaaagcagaaaccatcagag

SEQ ID NO: 8443629 - DNA, 22 bp, Homo sapiens
tagaaagactgtccagatttca

SEQ ID NO: 8443630 - DNA, 22 bp, Homo sapiens
tagaaagagcatagtattataa

SEQ ID NO: 8443631 - DNA, 22 bp, Homo sapiens
tagaaagagcatagtattataa

SEQ ID NO: 8443632 - DNA, 22 bp, Homo sapiens
tagaaagacatgggccagcagc

SEQ ID NO: 8443633 - DNA, 22 bp, Homo sapiens
tacccaggaggaaactgaggct

SEQ ID NO: 8443634 - DNA, 22 bp, Homo sapiens
caggctgcagcagcagtggccc

SEQ ID NO: 8443635 - DNA, 22 bp, Homo sapiens
caggctgcagcagcagtggccc

SEQ ID NO: 8443636 - DNA, 22 bp, Homo sapiens
taccctcacgagacttcaagtc

SEQ ID NO: 8443637 - DNA, 22 bp, Homo sapiens
tacctagacatgaacacagatg

SEQ ID NO: 8443638 - DNA, 22 bp, Homo sapiens
taccctctcccggtccagcttt

SEQ ID NO: 8443639 - DNA, 22 bp, Homo sapiens
caggctgcagaggcctttcatg

SEQ ID NO: 8443640 - DNA, 22 bp, Homo sapiens
caggctgcagaggcctttcatg

SEQ ID NO: 8443641 - DNA, 22 bp, Homo sapiens
caggctgcaagaaaggcattca

SEQ ID NO: 8443642 - DNA, 22 bp, Homo sapiens
caggctgcaagaaaggcattca

SEQ ID NO: 8443643 - DNA, 22 bp, Homo sapiens
caggctgattaggcctcgtcca

SEQ ID NO: 8443644 - DNA, 22 bp, Homo sapiens
caggctgatcagggctgggatg

SEQ ID NO: 8443645 - DNA, 22 bp, Homo sapiens
caggctgattaggcctcgtcca

SEQ ID NO: 8443646 - DNA, 22 bp, Homo sapiens
caggctgattaggcctcgtcca

SEQ ID NO: 8443647 - DNA, 22 bp, Homo sapiens
caggctgagggttaggccttag

SEQ ID NO: 8443648 - DNA, 22 bp, Homo sapiens
caggctgaggcagtagggtttg

SEQ ID NO: 8443649 - DNA, 22 bp, Homo sapiens
caggctgatagggtccaaagtt

SEQ ID NO: 8443650 - DNA, 22 bp, Homo sapiens
caggctgatagggtccaaagtt

SEQ ID NO: 8443651 - DNA, 22 bp, Homo sapiens
caggctgatagggtccaaagtt

SEQ ID NO: 8443652 - DNA, 22 bp, Homo sapiens
tagaaatgtcgtctccacattt

SEQ ID NO: 8443653 - DNA, 22 bp, Homo sapiens
tagaaattcaatgctctgagta

SEQ ID NO: 8443654 - DNA, 22 bp, Homo sapiens
tagaacacttgaccactgctcc

SEQ ID NO: 8443655 - DNA, 22 bp, Homo sapiens
tagaacagagttccagtgatca

SEQ ID NO: 8443656 - DNA, 22 bp, Homo sapiens
tagaacagtataggctaaacat

SEQ ID NO: 8443657 - DNA, 22 bp, Homo sapiens
cagggagaaatctccaggaggt

SEQ ID NO: 8443658 - DNA, 22 bp, Homo sapiens
cagggacagcgggactctgaca

SEQ ID NO: 8443659 - DNA, 22 bp, Homo sapiens
cagggagaaatctccaggaggt

SEQ ID NO: 8443660 - DNA, 22 bp, Homo sapiens
cagggagaggcatcatagggaa

SEQ ID NO: 8443661 - DNA, 22 bp, Homo sapiens
cagggagaggcatcatagggaa

SEQ ID NO: 8443662 - DNA, 22 bp, Homo sapiens
cagggagaggcctctgttgccc

SEQ ID NO: 8443663 - DNA, 22 bp, Homo sapiens
cagggagatcttggctcctggt

SEQ ID NO: 8443664 - DNA, 22 bp, Homo sapiens
cagggagaggctggtggagtaa

SEQ ID NO: 8443665 - DNA, 22 bp, Homo sapiens
cagggagaggcctctgttgccc

SEQ ID NO: 8443666 - DNA, 22 bp, Homo sapiens
tagacatttctggttattgaca

SEQ ID NO: 8443667 - DNA, 22 bp, Homo sapiens
tagacaggagtcaggctagaat

SEQ ID NO: 8443668 - DNA, 22 bp, Homo sapiens
cagggatggcctggcgggccac

SEQ ID NO: 8443669 - DNA, 22 bp, Homo sapiens
tagcagcaatttcagaagtttg

SEQ ID NO: 8443670 - DNA, 22 bp, Homo sapiens
tagcagcaagaatgggatgtgt

SEQ ID NO: 8443671 - DNA, 22 bp, Homo sapiens
cagggatgagcagatggagcaa

SEQ ID NO: 8443672 - DNA, 22 bp, Homo sapiens
cagggatgagcagatggagcaa

SEQ ID NO: 8443673 - DNA, 22 bp, Homo sapiens
cagggatgagagatggcacaga

SEQ ID NO: 8443674 - DNA, 22 bp, Homo sapiens
cagggatgagaaagctctctaa

SEQ ID NO: 8443675 - DNA, 22 bp, Homo sapiens
cagggatggagagactactggc

SEQ ID NO: 8443676 - DNA, 22 bp, Homo sapiens
cagggatggagagactactggc

SEQ ID NO: 8443677 - DNA, 22 bp, Homo sapiens
cagggatgctgttaaacatcct

SEQ ID NO: 8443678 - DNA, 22 bp, Homo sapiens
cagggatgctgcttaggcagtt

SEQ ID NO: 8443679 - DNA, 22 bp, Homo sapiens
cagggatgctgcttaggcagtt

SEQ ID NO: 8443680 - DNA, 22 bp, Homo sapiens
cagggagctttgtcttctcatt

SEQ ID NO: 8443681 - DNA, 22 bp, Homo sapiens
cagggagcctgaatgttccagg

SEQ ID NO: 8443682 - DNA, 22 bp, Homo sapiens
cagggaggatgggctgttttgc

SEQ ID NO: 8443683 - DNA, 23 bp, Homo sapiens
cagggaggagatactgtgtatct

SEQ ID NO: 8443684 - DNA, 22 bp, Homo sapiens
cagggagggacaattgtcacct

SEQ ID NO: 8443685 - DNA, 22 bp, Homo sapiens
cagggaggctgtcttatgcctg

SEQ ID NO: 8443686 - DNA, 22 bp, Homo sapiens
cagggatgagaaagctctctaa

SEQ ID NO: 8443687 - DNA, 22 bp, Homo sapiens
cagggatgaccagagggatgtg

SEQ ID NO: 8443688 - DNA, 22 bp, Homo sapiens
cagggatgaccagagggatgtg

SEQ ID NO: 8443689 - DNA, 22 bp, Homo sapiens
cagggagggaggaaaatttgct

SEQ ID NO: 8443690 - DNA, 22 bp, Homo sapiens
tagcagtgtctaggtaggccat

SEQ ID NO: 8443691 - DNA, 22 bp, Homo sapiens
tagcataatttgtagaaaatca

SEQ ID NO: 8443692 - DNA, 22 bp, Homo sapiens
tagcataacaggtaagagtgag

SEQ ID NO: 8443693 - DNA, 22 bp, Homo sapiens
tagcagcacatggtggttttat

SEQ ID NO: 8443694 - DNA, 22 bp, Homo sapiens
tagcatctgttctttcattaaa

SEQ ID NO: 8443695 - DNA, 22 bp, Homo sapiens
tagcatcttgatttcagaccag

SEQ ID NO: 8443696 - DNA, 22 bp, Homo sapiens
tagcatctgtttctctttgtga

SEQ ID NO: 8443697 - DNA, 22 bp, Homo sapiens
tagcatctaacatcttaggact

SEQ ID NO: 8443698 - DNA, 22 bp, Homo sapiens
tagcatcagccacaccttgtac

SEQ ID NO: 8443699 - DNA, 22 bp, Homo sapiens
tagcatcatgatcagaactgtt

SEQ ID NO: 8443700 - DNA, 22 bp, Homo sapiens
tagcatgggtcgcgtctctgga

SEQ ID NO: 8443701 - DNA, 22 bp, Homo sapiens
cagggcatccgtgctccatgct

SEQ ID NO: 8443702 - DNA, 22 bp, Homo sapiens
cagggcagtaccgccctctggc

SEQ ID NO: 8443703 - DNA, 22 bp, Homo sapiens
cagggcagtttgtgcctatgag

SEQ ID NO: 8443704 - DNA, 22 bp, Homo sapiens
cagggcagtttgtgcctatgag

SEQ ID NO: 8443705 - DNA, 22 bp, Homo sapiens
tacactttcgtttgtggattag

SEQ ID NO: 8443706 - DNA, 22 bp, Homo sapiens
tacacttgttcaaacagcaaaa

SEQ ID NO: 8443707 - DNA, 22 bp, Homo sapiens
tacagagaataataggacaggt

SEQ ID NO: 8443708 - DNA, 22 bp, Homo sapiens
tacagagaactcatagaaagaa

SEQ ID NO: 8443709 - DNA, 22 bp, Homo sapiens
tacagaccagtagttctcagcg

SEQ ID NO: 8443710 - DNA, 22 bp, Homo sapiens
tacactgtgtaaaatgcacttt

SEQ ID NO: 8443711 - DNA, 22 bp, Homo sapiens
tacactgtgacaatcatgacag

SEQ ID NO: 8443712 - DNA, 22 bp, Homo sapiens
tacactggacaggagtaggaag

SEQ ID NO: 8443713 - DNA, 22 bp, Homo sapiens
caggccctgccttggcatgtgt

SEQ ID NO: 8443714 - DNA, 22 bp, Homo sapiens
caggccacgccccggcgtgtga

SEQ ID NO: 8443715 - DNA, 22 bp, Homo sapiens
caggccacgccccggcgtgtga

SEQ ID NO: 8443716 - DNA, 22 bp, Homo sapiens
caggccccattcctcttgggac

SEQ ID NO: 8443717 - DNA, 22 bp, Homo sapiens
caggccccattcctcttgggac

SEQ ID NO: 8443718 - DNA, 22 bp, Homo sapiens
caggccacacggcggctccctg

SEQ ID NO: 8443719 - DNA, 22 bp, Homo sapiens
caggccaccagatacatgcccc

SEQ ID NO: 8443720 - DNA, 22 bp, Homo sapiens
caggccaccagatacatgcccc

SEQ ID NO: 8443721 - DNA, 22 bp, Homo sapiens
caggccctgcactaggccctgg

SEQ ID NO: 8443722 - DNA, 22 bp, Homo sapiens
caggccctgcactaggccctgg

SEQ ID NO: 8443723 - DNA, 22 bp, Homo sapiens
caggccctgccttgagggacct

SEQ ID NO: 8443724 - DNA, 22 bp, Homo sapiens
caggccctgaggattcggcggg

SEQ ID NO: 8443725 - DNA, 22 bp, Homo sapiens
caggccctgcacagtggtcctg

SEQ ID NO: 8443726 - DNA, 22 bp, Homo sapiens
caggccctctgcaccctcgtct

SEQ ID NO: 8443727 - DNA, 22 bp, Homo sapiens
caggccctcgtggtgagctggg

SEQ ID NO: 8443728 - DNA, 22 bp, Homo sapiens
caggccctcgtggtgagctggg

SEQ ID NO: 8443729 - DNA, 22 bp, Homo sapiens
caggccctcgcccgcagcgacc

SEQ ID NO: 8443730 - DNA, 22 bp, Homo sapiens
caggccctcctgtgatctgcct

SEQ ID NO: 8443731 - DNA, 22 bp, Homo sapiens
caggccctcaggcaagggctct

SEQ ID NO: 8443732 - DNA, 22 bp, Homo sapiens
cagctctgccacttcctagcta

SEQ ID NO: 8443733 - DNA, 22 bp, Homo sapiens
cagctctgccacttcctagcta

SEQ ID NO: 8443734 - DNA, 22 bp, Homo sapiens
gtggagcaggactagctgagaa

SEQ ID NO: 8443735 - DNA, 22 bp, Homo sapiens
gtggagcaggactagctgagaa

SEQ ID NO: 8443736 - DNA, 21 bp, Homo sapiens
gtggagagtgattttgatgca

SEQ ID NO: 8443737 - DNA, 22 bp, Homo sapiens
tacacaggctgcctctttgcat

SEQ ID NO: 8443738 - DNA, 22 bp, Homo sapiens
tacacagggagagattggaaac

SEQ ID NO: 8443739 - DNA, 22 bp, Homo sapiens
tacacagggtatggcttgagga

SEQ ID NO: 8443740 - DNA, 22 bp, Homo sapiens
tacacagggtatggcttgagga

SEQ ID NO: 8443741 - DNA, 22 bp, Homo sapiens
tacacaggggagcatggttgac

SEQ ID NO: 8443742 - DNA, 22 bp, Homo sapiens
caggccaaagatcccattgaca

SEQ ID NO: 8443743 - DNA, 22 bp, Homo sapiens
tacacagactcttcaattcaga

SEQ ID NO: 8443744 - DNA, 22 bp, Homo sapiens
tacacagactcttcaattcaga

SEQ ID NO: 8443745 - DNA, 22 bp, Homo sapiens
tacagagaggtgacccttgggc

SEQ ID NO: 8443746 - DNA, 22 bp, Homo sapiens
tacagagagataagtgtaaaag

SEQ ID NO: 8443747 - DNA, 22 bp, Homo sapiens
tacagcctgatttggagccact

SEQ ID NO: 8443748 - DNA, 22 bp, Homo sapiens
caggcctgtgacaccgtgtctg

SEQ ID NO: 8443749 - DNA, 22 bp, Homo sapiens
caggcctgtgacaccgtgtctg

SEQ ID NO: 8443750 - DNA, 22 bp, Homo sapiens
caggcctgtgagttgaggcccc

SEQ ID NO: 8443751 - DNA, 22 bp, Homo sapiens
caggcctgtgagttgaggcccc

SEQ ID NO: 8443752 - DNA, 22 bp, Homo sapiens
caggcctgtgagttgaggcccc

SEQ ID NO: 8443753 - DNA, 22 bp, Homo sapiens
caggcctgtctgcacatgaggc

SEQ ID NO: 8443754 - DNA, 22 bp, Homo sapiens
caggcctgtctgcacatgaggc

SEQ ID NO: 8443755 - DNA, 22 bp, Homo sapiens
caggcctggagtgcaatggcac

SEQ ID NO: 8443756 - DNA, 22 bp, Homo sapiens
tacagctgcaagggtttctggg

SEQ ID NO: 8443757 - DNA, 22 bp, Homo sapiens
caggccttgcgtcccatggcct

SEQ ID NO: 8443758 - DNA, 22 bp, Homo sapiens
caggccttgggacccagactgg

SEQ ID NO: 8443759 - DNA, 22 bp, Homo sapiens
caggccttagtaggtgctccct

SEQ ID NO: 8443760 - DNA, 22 bp, Homo sapiens
tacagttcctctcgtggaggtg

SEQ ID NO: 8443761 - DNA, 22 bp, Homo sapiens
tacagttatatgtgataagtaa

SEQ ID NO: 8443762 - DNA, 22 bp, Homo sapiens
tacagtttcccagcagatgcaa

SEQ ID NO: 8443763 - DNA, 22 bp, Homo sapiens
tacagtttagaaccatagatgg

SEQ ID NO: 8443764 - DNA, 22 bp, Homo sapiens
caggctcccgaaatcacccatg

SEQ ID NO: 8443765 - DNA, 22 bp, Homo sapiens
caggctcccacttggcttaaag

SEQ ID NO: 8443766 - DNA, 22 bp, Homo sapiens
caggctcccacaagctcccagc

SEQ ID NO: 8443767 - DNA, 22 bp, Homo sapiens
caggctccattaatcatcctgc

SEQ ID NO: 8443768 - DNA, 22 bp, Homo sapiens
caggctcaaggctgacttccat

SEQ ID NO: 8443769 - DNA, 22 bp, Homo sapiens
caggctcccaccctcctgcagc

SEQ ID NO: 8443770 - DNA, 22 bp, Homo sapiens
caggctcccaccctcctgcagc

SEQ ID NO: 8443771 - DNA, 22 bp, Homo sapiens
caggctccagcttcctgctcag

SEQ ID NO: 8443772 - DNA, 22 bp, Homo sapiens
caggctcaaggctgacttccat

SEQ ID NO: 8443773 - DNA, 22 bp, Homo sapiens
caggctcaatggccacttgggc

SEQ ID NO: 8443774 - DNA, 22 bp, Homo sapiens
caggctccctgggcagtggcag

SEQ ID NO: 8443775 - DNA, 22 bp, Homo sapiens
caggctcccttctcggaattct

SEQ ID NO: 8443776 - DNA, 22 bp, Homo sapiens
caggctccctgccagggccggc

SEQ ID NO: 8443777 - DNA, 22 bp, Homo sapiens
caggctccctgcaggccagtga

SEQ ID NO: 8443778 - DNA, 22 bp, Homo sapiens
caggctcccgctccactgggca

SEQ ID NO: 8443779 - DNA, 22 bp, Homo sapiens
caggctcccgctccactgggca

SEQ ID NO: 8443780 - DNA, 23 bp, Homo sapiens
caggctcccggaccaggatccgc

SEQ ID NO: 8443781 - DNA, 22 bp, Homo sapiens
caggctccctaagtcagcagcc

SEQ ID NO: 8443782 - DNA, 22 bp, Homo sapiens
caggctccttatcttacaactt

SEQ ID NO: 8443783 - DNA, 17 bp, Homo sapiens
caggctccttccagatt

SEQ ID NO: 8443784 - DNA, 20 bp, Homo sapiens
caggctccgcaggactaggg

SEQ ID NO: 8443785 - DNA, 22 bp, Homo sapiens
caggctcctcactcatgctccc

SEQ ID NO: 8443786 - DNA, 22 bp, Homo sapiens
caggctcggtccagtggcaccc

SEQ ID NO: 8443787 - DNA, 22 bp, Homo sapiens
caggctctaggttagtaggaga

SEQ ID NO: 8443788 - DNA, 22 bp, Homo sapiens
caggctccttcccagggatggt

SEQ ID NO: 8443789 - DNA, 22 bp, Homo sapiens
caggctccttcccagggatggt

SEQ ID NO: 8443790 - DNA, 22 bp, Homo sapiens
caggctccttcccagggatggt

SEQ ID NO: 8443791 - DNA, 22 bp, Homo sapiens
cagggctgctggccgtgccctc

SEQ ID NO: 8443792 - DNA, 22 bp, Homo sapiens
cagggctgctggccgtgccctc

SEQ ID NO: 8443793 - DNA, 22 bp, Homo sapiens
cagggctgctggccgtgccctc

SEQ ID NO: 8443794 - DNA, 22 bp, Homo sapiens
cagggctggatcctccagactc

SEQ ID NO: 8443795 - DNA, 22 bp, Homo sapiens
cagggctggatcctccagactc

SEQ ID NO: 8443796 - DNA, 22 bp, Homo sapiens
cagggctgagtcatatagcctt

SEQ ID NO: 8443797 - DNA, 22 bp, Homo sapiens
cagggctgagaatttagagaca

SEQ ID NO: 8443798 - DNA, 22 bp, Homo sapiens
tagtacagttccatcaaagcag

SEQ ID NO: 8443799 - DNA, 22 bp, Homo sapiens
cagggctgaggacacaagtaaa

SEQ ID NO: 8443800 - DNA, 22 bp, Homo sapiens
tagtacagtggagagcaaagaa

SEQ ID NO: 8443801 - DNA, 22 bp, Homo sapiens
tagtacagtggcattcaaactt

SEQ ID NO: 8443802 - DNA, 22 bp, Homo sapiens
tagtaatcagaggtaaacttta

SEQ ID NO: 8443803 - DNA, 19 bp, Homo sapiens
tagtacaaaagcagccata

SEQ ID NO: 8443804 - DNA, 22 bp, Homo sapiens
tagtacaactcacttgatttta

SEQ ID NO: 8443805 - DNA, 22 bp, Homo sapiens
tagtacactctgtaagtttaaa

SEQ ID NO: 8443806 - DNA, 22 bp, Homo sapiens
tagtaactctacacacgacact

SEQ ID NO: 8443807 - DNA, 22 bp, Homo sapiens
tagtaacagcagcttccctgtg

SEQ ID NO: 8443808 - DNA, 22 bp, Homo sapiens
tagtaacaacaactagcatttt

SEQ ID NO: 8443809 - DNA, 22 bp, Homo sapiens
tagtaactggttgaacaactgt

SEQ ID NO: 8443810 - DNA, 22 bp, Homo sapiens
tagtaagcacatggacaagtgg

SEQ ID NO: 8443811 - DNA, 22 bp, Homo sapiens
tagtaagcctctccagagacag

SEQ ID NO: 8443812 - DNA, 22 bp, Homo sapiens
taggtataggattctaggttgg

SEQ ID NO: 8443813 - DNA, 22 bp, Homo sapiens
tagtaaattaaaatattgactt

SEQ ID NO: 8443814 - DNA, 22 bp, Homo sapiens
cagggccaccctctgctgggtg

SEQ ID NO: 8443815 - DNA, 20 bp, Homo sapiens
cagggccacgctccaaggca

SEQ ID NO: 8443816 - DNA, 22 bp, Homo sapiens
tagtgtggtaaataaatgtttt

SEQ ID NO: 8443817 - DNA, 22 bp, Homo sapiens
tagtgttctaagaacatccatg

SEQ ID NO: 8443818 - DNA, 22 bp, Homo sapiens
tagtgttccagaagcaaacaag

SEQ ID NO: 8443819 - DNA, 22 bp, Homo sapiens
tagtttgtcaaccactgtcaca

SEQ ID NO: 8443820 - DNA, 22 bp, Homo sapiens
tagttttacatcagccattgtt

SEQ ID NO: 8443821 - DNA, 22 bp, Homo sapiens
tagtttgcgaaattcctgcctc

SEQ ID NO: 8443822 - DNA, 22 bp, Homo sapiens
tagtttgagaattgaaatagaa

SEQ ID NO: 8443823 - DNA, 22 bp, Homo sapiens
tagttttacttgcgatgataat

SEQ ID NO: 8443824 - DNA, 22 bp, Homo sapiens
tagttttacttgcgatgataat

SEQ ID NO: 8443825 - DNA, 22 bp, Homo sapiens
tagttttacatcagccattgtt

SEQ ID NO: 8443826 - DNA, 22 bp, Homo sapiens
tatattcaatgattagtatcag

SEQ ID NO: 8443827 - DNA, 22 bp, Homo sapiens
tatatatatgcacacacaccta

SEQ ID NO: 8443828 - DNA, 22 bp, Homo sapiens
tatattcaacaggctaatgtca

SEQ ID NO: 8443829 - DNA, 22 bp, Homo sapiens
tatattcaatgattagtatcag

SEQ ID NO: 8443830 - DNA, 18 bp, Homo sapiens
tatatagagaaacccatt

SEQ ID NO: 8443831 - DNA, 22 bp, Homo sapiens
tatacagtttgagttcttgcat

SEQ ID NO: 8443832 - DNA, 21 bp, Homo sapiens
tatacatgtgcacacacatgc

SEQ ID NO: 8443833 - DNA, 22 bp, Homo sapiens
tagttttagcagcaatgggatg

SEQ ID NO: 8443834 - DNA, 21 bp, Homo sapiens
tatacatgtgtgcatacgtgt

SEQ ID NO: 8443835 - DNA, 21 bp, Homo sapiens
tatacatgtgcacacacatgc

SEQ ID NO: 8443836 - DNA, 22 bp, Homo sapiens
tatataactactattttgctca

SEQ ID NO: 8443837 - DNA, 22 bp, Homo sapiens
tatataatttgtaaaagcacct

SEQ ID NO: 8443838 - DNA, 22 bp, Homo sapiens
caggtggggagagtgtggagca

SEQ ID NO: 8443839 - DNA, 22 bp, Homo sapiens
caggtgggctgcctctccagct

SEQ ID NO: 8443840 - DNA, 22 bp, Homo sapiens
tatgtacatcgttgaattcaaa

SEQ ID NO: 8443841 - DNA, 22 bp, Homo sapiens
tatgtacatcgttgaattcaaa

SEQ ID NO: 8443842 - DNA, 22 bp, Homo sapiens
caggtggggcgccctcaggcag

SEQ ID NO: 8443843 - DNA, 22 bp, Homo sapiens
cagtacaagaggccacctgccc

SEQ ID NO: 8443844 - DNA, 22 bp, Homo sapiens
cagtaccagtcaccacattgat

SEQ ID NO: 8443845 - DNA, 22 bp, Homo sapiens
cagtacatttcatatgattcta

SEQ ID NO: 8443846 - DNA, 22 bp, Homo sapiens
cagtacatttcatatgattcta

SEQ ID NO: 8443847 - DNA, 22 bp, Homo sapiens
tatgtacatggagagcaattga

SEQ ID NO: 8443848 - DNA, 22 bp, Homo sapiens
tatgtacatggagagcaattga

SEQ ID NO: 8443849 - DNA, 22 bp, Homo sapiens
tatgtacatcttgagcaatgaa

SEQ ID NO: 8443850 - DNA, 22 bp, Homo sapiens
tatgtacatcttgagcaatgaa

SEQ ID NO: 8443851 - DNA, 22 bp, Homo sapiens
tatgtacatgatttcatttgct

SEQ ID NO: 8443852 - DNA, 22 bp, Homo sapiens
tatgtacatgatttcatttgct

SEQ ID NO: 8443853 - DNA, 22 bp, Homo sapiens
tatattgtagctgatgacaaat

SEQ ID NO: 8443854 - DNA, 22 bp, Homo sapiens
tatattgtaggtgctatttgaa

SEQ ID NO: 8443855 - DNA, 22 bp, Homo sapiens
tatattcattttaaagccatct

SEQ ID NO: 8443856 - DNA, 22 bp, Homo sapiens
tatgaacttttgatgtgacatg

SEQ ID NO: 8443857 - DNA, 22 bp, Homo sapiens
tatctgtatccccatctagcta

SEQ ID NO: 8443858 - DNA, 22 bp, Homo sapiens
tatctgtattctgacagtcact

SEQ ID NO: 8443859 - DNA, 22 bp, Homo sapiens
tatctgtagtcagaataatttt

SEQ ID NO: 8443860 - DNA, 22 bp, Homo sapiens
tatgcacacatcgcagcaggaa

SEQ ID NO: 8443861 - DNA, 22 bp, Homo sapiens
tatgcaacatctggtagaaatc

SEQ ID NO: 8443862 - DNA, 22 bp, Homo sapiens
tatgcaacagcattattacaat

SEQ ID NO: 8443863 - DNA, 22 bp, Homo sapiens
tatgcaaagtcctaagaaagaa

SEQ ID NO: 8443864 - DNA, 22 bp, Homo sapiens
tatgcaaatcattagatttcct

SEQ ID NO: 8443865 - DNA, 22 bp, Homo sapiens
tatgatttgtagacatttgatt

SEQ ID NO: 8443866 - DNA, 22 bp, Homo sapiens
tatgcaaagtcctaagaaagaa

SEQ ID NO: 8443867 - DNA, 22 bp, Homo sapiens
tatgatattctaaattgacacc

SEQ ID NO: 8443868 - DNA, 22 bp, Homo sapiens
tatgatctctgggtctggagct

SEQ ID NO: 8443869 - DNA, 22 bp, Homo sapiens
cagtgcaggtggcagaggacag

SEQ ID NO: 8443870 - DNA, 22 bp, Homo sapiens
cagtgcaggtttagggctgggg

SEQ ID NO: 8443871 - DNA, 22 bp, Homo sapiens
cagtgcagaggtgcaagcatgt

SEQ ID NO: 8443872 - DNA, 22 bp, Homo sapiens
cagtgcaggtggcagaggacag

SEQ ID NO: 8443873 - DNA, 22 bp, Homo sapiens
cagtgcagaggtgcaagcatgt

SEQ ID NO: 8443874 - DNA, 22 bp, Homo sapiens
cagtgcagttggtggcaggggt

SEQ ID NO: 8443875 - DNA, 22 bp, Homo sapiens
cagtgcagttggtggcaggggt

SEQ ID NO: 8443876 - DNA, 22 bp, Homo sapiens
cagtgcagtcaaggaagaacca

SEQ ID NO: 8443877 - DNA, 22 bp, Homo sapiens
cagtgcagtcaaggaagaacca

SEQ ID NO: 8443878 - DNA, 22 bp, Homo sapiens
cagtgcaggtttagggctgggg

SEQ ID NO: 8443879 - DNA, 22 bp, Homo sapiens
cagtgcagtttcccagatgctg

SEQ ID NO: 8443880 - DNA, 22 bp, Homo sapiens
cagtgcagtttcccagatgctg

SEQ ID NO: 8443881 - DNA, 22 bp, Homo sapiens
cagtgcagtttcccagatgctg

SEQ ID NO: 8443882 - DNA, 22 bp, Homo sapiens
cagtgcagtttcccagatgctg

SEQ ID NO: 8443883 - DNA, 22 bp, Homo sapiens
cagtgcagtttcccagatgctg

SEQ ID NO: 8443884 - DNA, 22 bp, Homo sapiens
tcacacatttctcaagtgtagg

SEQ ID NO: 8443885 - DNA, 22 bp, Homo sapiens
tcacacattgttgcttaagttg

SEQ ID NO: 8443886 - DNA, 22 bp, Homo sapiens
tcacacatgtaagggctttgga

SEQ ID NO: 8443887 - DNA, 22 bp, Homo sapiens
tcacacattctaggtatgttga

SEQ ID NO: 8443888 - DNA, 22 bp, Homo sapiens
tcacacatttgaaggcctgtca

SEQ ID NO: 8443889 - DNA, 16 bp, Homo sapiens
tcacacatttgttggt

SEQ ID NO: 8443890 - DNA, 22 bp, Homo sapiens
tcacactgtgaagagacaagca

SEQ ID NO: 8443891 - DNA, 23 bp, Homo sapiens
tcacactggatacacatgcaaga

SEQ ID NO: 8443892 - DNA, 22 bp, Homo sapiens
tcacactggcagtgctgaaggc

SEQ ID NO: 8443893 - DNA, 22 bp, Homo sapiens
tcacacgtgaggttctatcctg

SEQ ID NO: 8443894 - DNA, 22 bp, Homo sapiens
tcacacgtccttgctactcctc

SEQ ID NO: 8443895 - DNA, 22 bp, Homo sapiens
tcacaccttgctggctgagtgc

SEQ ID NO: 8443896 - DNA, 22 bp, Homo sapiens
cagtggcaagtccggtattgaa

SEQ ID NO: 8443897 - DNA, 22 bp, Homo sapiens
cagtggagtgggactggtctga

SEQ ID NO: 8443898 - DNA, 19 bp, Homo sapiens
tcacattcagccttgctga

SEQ ID NO: 8443899 - DNA, 19 bp, Homo sapiens
tcacattcagccttgctga

SEQ ID NO: 8443900 - DNA, 22 bp, Homo sapiens
tcacattctagaatgttatcgt

SEQ ID NO: 8443901 - DNA, 22 bp, Homo sapiens
tcacattcatggtgctaataaa

SEQ ID NO: 8443902 - DNA, 22 bp, Homo sapiens
tcacattctcagcatctataca

SEQ ID NO: 8443903 - DNA, 22 bp, Homo sapiens
tcacattctagaatgttatcgt

SEQ ID NO: 8443904 - DNA, 22 bp, Homo sapiens
tcacatgtgttttctcaccaac

SEQ ID NO: 8443905 - DNA, 22 bp, Homo sapiens
tcacatgtcagtcttaaacaga

SEQ ID NO: 8443906 - DNA, 22 bp, Homo sapiens
tcacatgtcaaaaactacataa

SEQ ID NO: 8443907 - DNA, 22 bp, Homo sapiens
tcacatgtcaagaagataattt

SEQ ID NO: 8443908 - DNA, 22 bp, Homo sapiens
tcacatgtcacaaaacactgcc

SEQ ID NO: 8443909 - DNA, 22 bp, Homo sapiens
tcacattcttccctgacttctt

SEQ ID NO: 8443910 - DNA, 22 bp, Homo sapiens
tcactcctcattgctgcccatt

SEQ ID NO: 8443911 - DNA, 17 bp, Homo sapiens
cagtggcagatcttctc

SEQ ID NO: 8443912 - DNA, 22 bp, Homo sapiens
cagtggcagatcaccaactgga

SEQ ID NO: 8443913 - DNA, 22 bp, Homo sapiens
cagtggcagatcaccaactgga

SEQ ID NO: 8443914 - DNA, 22 bp, Homo sapiens
cagtggcagagaacagagacct

SEQ ID NO: 8443915 - DNA, 22 bp, Homo sapiens
cagtggcagagccgttgccatc

SEQ ID NO: 8443916 - DNA, 22 bp, Homo sapiens
cagtggcagagaacagagacct

SEQ ID NO: 8443917 - DNA, 22 bp, Homo sapiens
cagtggcacccacgggctgggc

SEQ ID NO: 8443918 - DNA, 22 bp, Homo sapiens
cagtggcaatgggacagagcac

SEQ ID NO: 8443919 - DNA, 22 bp, Homo sapiens
tcactgcagagacctctagtca

SEQ ID NO: 8443920 - DNA, 22 bp, Homo sapiens
cagtctggaggtcagctggctt

SEQ ID NO: 8443921 - DNA, 22 bp, Homo sapiens
cagtctggaggtcagctggctt

SEQ ID NO: 8443922 - DNA, 23 bp, Homo sapiens
cagtctctccccggacagcaaaa

SEQ ID NO: 8443923 - DNA, 22 bp, Homo sapiens
cagtctggctcagcacaaaggg

SEQ ID NO: 8443924 - DNA, 22 bp, Homo sapiens
cagtctggcacagcacactgaa

SEQ ID NO: 8443925 - DNA, 22 bp, Homo sapiens
cagtctggctcagcacaaaggg

SEQ ID NO: 8443926 - DNA, 22 bp, Homo sapiens
cagtctggatctgtgctgctgt

SEQ ID NO: 8443927 - DNA, 22 bp, Homo sapiens
cagtcccagtttgagactctgg

SEQ ID NO: 8443928 - DNA, 22 bp, Homo sapiens
cagtcccagggttggttcagct

SEQ ID NO: 8443929 - DNA, 22 bp, Homo sapiens
cagtcccagggttggttcagct

SEQ ID NO: 8443930 - DNA, 22 bp, Homo sapiens
cagtcccagctgctcagaaggc

SEQ ID NO: 8443931 - DNA, 15 bp, Homo sapiens
cagtcccagggaccc

SEQ ID NO: 8443932 - DNA, 22 bp, Homo sapiens
cagtcccatctcccaggtggct

SEQ ID NO: 8443933 - DNA, 22 bp, Homo sapiens
cagtcccatgagcccagaacat

SEQ ID NO: 8443934 - DNA, 22 bp, Homo sapiens
cagtcccatctcccaggtggct

SEQ ID NO: 8443935 - DNA, 22 bp, Homo sapiens
cagtccctagtggagctcacag

SEQ ID NO: 8443936 - DNA, 22 bp, Homo sapiens
tcaaattagtggaataataatg

SEQ ID NO: 8443937 - DNA, 22 bp, Homo sapiens
tcaaattagtggaataataatg

SEQ ID NO: 8443938 - DNA, 22 bp, Homo sapiens
tcaaattagtggaataataatg

SEQ ID NO: 8443939 - DNA, 22 bp, Homo sapiens
tcaaatgggtatgctttataat

SEQ ID NO: 8443940 - DNA, 22 bp, Homo sapiens
tcaaattttaacatgcattaga

SEQ ID NO: 8443941 - DNA, 22 bp, Homo sapiens
tcaaattgtcatcttgataatg

SEQ ID NO: 8443942 - DNA, 22 bp, Homo sapiens
tcaacaaatacttaaagcagag

SEQ ID NO: 8443943 - DNA, 22 bp, Homo sapiens
tcaaattttaacatgcattaga

SEQ ID NO: 8443944 - DNA, 22 bp, Homo sapiens
cagtctttgttcccattactga

SEQ ID NO: 8443945 - DNA, 22 bp, Homo sapiens
cagtcttttgtatattagcaga

SEQ ID NO: 8443946 - DNA, 22 bp, Homo sapiens
cagtctttgacaagccctttca

SEQ ID NO: 8443947 - DNA, 22 bp, Homo sapiens
cagtctttgatgcatcctagcc

SEQ ID NO: 8443948 - DNA, 22 bp, Homo sapiens
cagtctttgatgcatcctagcc

SEQ ID NO: 8443949 - DNA, 22 bp, Homo sapiens
cagtcttatcctgaaaacaaca

SEQ ID NO: 8443950 - DNA, 22 bp, Homo sapiens
cagtcttctaacctagcagcct

SEQ ID NO: 8443951 - DNA, 22 bp, Homo sapiens
cagtgaaatcacaactttagtt

SEQ ID NO: 8443952 - DNA, 19 bp, Homo sapiens
tcaaatgccaatgtcacag

SEQ ID NO: 8443953 - DNA, 22 bp, Homo sapiens
tcaaatgccagtggtgtggatc

SEQ ID NO: 8443954 - DNA, 22 bp, Homo sapiens
tcaaatgctcagactcctgtgg

SEQ ID NO: 8443955 - DNA, 22 bp, Homo sapiens
tcaaatgctgcctttgtgtgcc

SEQ ID NO: 8443956 - DNA, 22 bp, Homo sapiens
cagtagcatgcttatcttttga

SEQ ID NO: 8443957 - DNA, 22 bp, Homo sapiens
cagtagcatgcttatcttttga

SEQ ID NO: 8443958 - DNA, 22 bp, Homo sapiens
cagtagcaggcactcagcacgt

SEQ ID NO: 8443959 - DNA, 22 bp, Homo sapiens
tattccaagtgcctagaagagt

SEQ ID NO: 8443960 - DNA, 22 bp, Homo sapiens
tattccaacttcactattgtct

SEQ ID NO: 8443961 - DNA, 20 bp, Homo sapiens
tattccaagggtagagaaaa

SEQ ID NO: 8443962 - DNA, 22 bp, Homo sapiens
tattccaccagagatgtgaatt

SEQ ID NO: 8443963 - DNA, 22 bp, Homo sapiens
tcaaagcaatttcaccagtgcc

SEQ ID NO: 8443964 - DNA, 22 bp, Homo sapiens
tcaaagcacacttagtggtaga

SEQ ID NO: 8443965 - DNA, 22 bp, Homo sapiens
tcaaagcacacttagtggtaga

SEQ ID NO: 8443966 - DNA, 20 bp, Homo sapiens
tcaaagcactgcctgtcatc

SEQ ID NO: 8443967 - DNA, 22 bp, Homo sapiens
tcaaagcagcacattcgcaagc

SEQ ID NO: 8443968 - DNA, 22 bp, Homo sapiens
tattcctatttctaaacatatg

SEQ ID NO: 8443969 - DNA, 22 bp, Homo sapiens
tattccctgatgtacactggca

SEQ ID NO: 8443970 - DNA, 22 bp, Homo sapiens
tattcctcccagtaagtacaac

SEQ ID NO: 8443971 - DNA, 22 bp, Homo sapiens
tcaaaagaaacaccatgttcct

SEQ ID NO: 8443972 - DNA, 22 bp, Homo sapiens
tcaaaagaaacaccatgttcct

SEQ ID NO: 8443973 - DNA, 19 bp, Homo sapiens
tcaaagcaagcatgttctg

SEQ ID NO: 8443974 - DNA, 22 bp, Homo sapiens
tcaaaggagacacaaggagaaa

SEQ ID NO: 8443975 - DNA, 22 bp, Homo sapiens
tcaaagcctgtggatagtttgg

SEQ ID NO: 8443976 - DNA, 22 bp, Homo sapiens
tcaaagcttagataatttcttt

SEQ ID NO: 8443977 - DNA, 22 bp, Homo sapiens
tcaaagcatcagtcaatttagg

SEQ ID NO: 8443978 - DNA, 22 bp, Homo sapiens
tcaaagcatggttttgaaagac

SEQ ID NO: 8443979 - DNA, 22 bp, Homo sapiens
tcaaaggaaacacaagcttctg

SEQ ID NO: 8443980 - DNA, 22 bp, Homo sapiens
tcaaaggaatttgattttgatg

SEQ ID NO: 8443981 - DNA, 22 bp, Homo sapiens
tgctagaatttgcagaagcata

SEQ ID NO: 8443982 - DNA, 22 bp, Homo sapiens
tgctagaatttgcagaagcata

SEQ ID NO: 8443983 - DNA, 22 bp, Homo sapiens
tgctagaagatagctagaagat

SEQ ID NO: 8443984 - DNA, 19 bp, Homo sapiens
tgctagaaattctgtgact

SEQ ID NO: 8443985 - DNA, 22 bp, Homo sapiens
tgctagggatatagtggcgagt

SEQ ID NO: 8443986 - DNA, 22 bp, Homo sapiens
tgctcagcttcagaggatcccc

SEQ ID NO: 8443987 - DNA, 22 bp, Homo sapiens
tgctcaggaaataatgtctgtg

SEQ ID NO: 8443988 - DNA, 22 bp, Homo sapiens
tgctcaggagcttagagcacag

SEQ ID NO: 8443989 - DNA, 22 bp, Homo sapiens
tgctcaggagcttagagcacag

SEQ ID NO: 8443990 - DNA, 22 bp, Homo sapiens
tgctcaggacagtggaacctaa

SEQ ID NO: 8443991 - DNA, 22 bp, Homo sapiens
tgctagtgtgtgagatgttcaa

SEQ ID NO: 8443992 - DNA, 22 bp, Homo sapiens
tgctcaggacagtggaacctaa

SEQ ID NO: 8443993 - DNA, 20 bp, Homo sapiens
tgctcaggatggagaggtgt

SEQ ID NO: 8443994 - DNA, 22 bp, Homo sapiens
tgctcaggaggaggctgtgagg

SEQ ID NO: 8443995 - DNA, 22 bp, Homo sapiens
tgctcagggagcttcctggtgg

SEQ ID NO: 8443996 - DNA, 22 bp, Homo sapiens
tgctcagggagcatagtgaatt

SEQ ID NO: 8443997 - DNA, 22 bp, Homo sapiens
tgctcagggagcatagtgaatt

SEQ ID NO: 8443998 - DNA, 22 bp, Homo sapiens
tgctcagggacaatggagaggg

SEQ ID NO: 8443999 - DNA, 22 bp, Homo sapiens
tgctcagggacaatggagaggg

SEQ ID NO: 8444000 - DNA, 22 bp, Homo sapiens
tgctcaggccctgggccatcct

SEQ ID NO: 8444001 - DNA, 22 bp, Homo sapiens
tgctcaggccctgggccatcct

SEQ ID NO: 8444002 - DNA, 22 bp, Homo sapiens
tgctcaggccagccggacagag

SEQ ID NO: 8444003 - DNA, 19 bp, Homo sapiens
tgctcaggccaaggagccc

SEQ ID NO: 8444004 - DNA, 19 bp, Homo sapiens
tgctcaggccaaggagccc

SEQ ID NO: 8444005 - DNA, 22 bp, Homo sapiens
tgctcaggccagccggacagag

SEQ ID NO: 8444006 - DNA, 22 bp, Homo sapiens
tgcagggctaagtcagagcctg

SEQ ID NO: 8444007 - DNA, 22 bp, Homo sapiens
tgcaggtgccatcgctgctcat

SEQ ID NO: 8444008 - DNA, 22 bp, Homo sapiens
tgcaggtgccatcgctgctcat

SEQ ID NO: 8444009 - DNA, 22 bp, Homo sapiens
tgcaggtgccatcgctgctcat

SEQ ID NO: 8444010 - DNA, 22 bp, Homo sapiens
tgcaggtgctccgggggtgccc

SEQ ID NO: 8444011 - DNA, 22 bp, Homo sapiens
tgcaggtgctacaagaactcac

SEQ ID NO: 8444012 - DNA, 22 bp, Homo sapiens
tgcaggtgcgttttcaagcctc

SEQ ID NO: 8444013 - DNA, 22 bp, Homo sapiens
tgctacataccacgatgcagta

SEQ ID NO: 8444014 - DNA, 22 bp, Homo sapiens
tgctacactcaatcagtgctat

SEQ ID NO: 8444015 - DNA, 22 bp, Homo sapiens
tgctacagagccaggaagagtg

SEQ ID NO: 8444016 - DNA, 22 bp, Homo sapiens
tgccttctcccttggaccctga

SEQ ID NO: 8444017 - DNA, 22 bp, Homo sapiens
tgcaggtgctgtgtcaagagag

SEQ ID NO: 8444018 - DNA, 22 bp, Homo sapiens
tgcaggtgctgtgtcaagagag

SEQ ID NO: 8444019 - DNA, 19 bp, Homo sapiens
cccagtccttgtcctgggc

SEQ ID NO: 8444020 - DNA, 22 bp, Homo sapiens
cccagtcctaaagcagacgcca

SEQ ID NO: 8444021 - DNA, 19 bp, Homo sapiens
cccagtctaggtcctagga

SEQ ID NO: 8444022 - DNA, 22 bp, Homo sapiens
cccaggtctgccagcctgtggg

SEQ ID NO: 8444023 - DNA, 22 bp, Homo sapiens
cccaggtctcctgcttcccagg

SEQ ID NO: 8444024 - DNA, 22 bp, Homo sapiens
cccaggtctcctgcttcccagg

SEQ ID NO: 8444025 - DNA, 22 bp, Homo sapiens
tgctcaggtgccttggctgctg

SEQ ID NO: 8444026 - DNA, 22 bp, Homo sapiens
tgctcaggtgccttggctgctg

SEQ ID NO: 8444027 - DNA, 22 bp, Homo sapiens
tgctcaggtgccttggctgctg

SEQ ID NO: 8444028 - DNA, 22 bp, Homo sapiens
tgctcaggtcgttctgcccctt

SEQ ID NO: 8444029 - DNA, 22 bp, Homo sapiens
tgctcaggtcgttctgcccctt

SEQ ID NO: 8444030 - DNA, 22 bp, Homo sapiens
tgctcaggtcgttctgcccctt

SEQ ID NO: 8444031 - DNA, 22 bp, Homo sapiens
cccagtggcccagcatgtggtg

SEQ ID NO: 8444032 - DNA, 22 bp, Homo sapiens
cccagtggaaggagtagaagac

SEQ ID NO: 8444033 - DNA, 22 bp, Homo sapiens
tgctctgcacatccctcacaaa

SEQ ID NO: 8444034 - DNA, 22 bp, Homo sapiens
tgctctgcaagcaggagcaaga

SEQ ID NO: 8444035 - DNA, 22 bp, Homo sapiens
tgctgcaggcagcccctctact

SEQ ID NO: 8444036 - DNA, 22 bp, Homo sapiens
tgctgcaggcaatagaaaacct

SEQ ID NO: 8444037 - DNA, 22 bp, Homo sapiens
tgctctggaaataaatgattta

SEQ ID NO: 8444038 - DNA, 22 bp, Homo sapiens
tgctctggaatagtcctaggca

SEQ ID NO: 8444039 - DNA, 22 bp, Homo sapiens
tgctctggacgctgagtggttt

SEQ ID NO: 8444040 - DNA, 22 bp, Homo sapiens
tgctctggacgctgagtggttt

SEQ ID NO: 8444041 - DNA, 19 bp, Homo sapiens
tgctctggagccagctctc

SEQ ID NO: 8444042 - DNA, 19 bp, Homo sapiens
tgctgcaggatgctgctgg

SEQ ID NO: 8444043 - DNA, 22 bp, Homo sapiens
tgcttggctagcttggcagctc

SEQ ID NO: 8444044 - DNA, 22 bp, Homo sapiens
tgcttggctttctgagcttctg

SEQ ID NO: 8444045 - DNA, 22 bp, Homo sapiens
tgcttggctttctgagcttctg

SEQ ID NO: 8444046 - DNA, 22 bp, Homo sapiens
tgcttgggcggccagcatggcg

SEQ ID NO: 8444047 - DNA, 22 bp, Homo sapiens
tgcttgggaatgtggagtcaga

SEQ ID NO: 8444048 - DNA, 21 bp, Homo sapiens
tgcttgggggcttcaggagct

SEQ ID NO: 8444049 - DNA, 22 bp, Homo sapiens
ccctccctatgtagatgatgtt

SEQ ID NO: 8444050 - DNA, 22 bp, Homo sapiens
ccctccccagggtcatattgaa

SEQ ID NO: 8444051 - DNA, 22 bp, Homo sapiens
ccctccccagggtcatattgaa

SEQ ID NO: 8444052 - DNA, 22 bp, Homo sapiens
ccctccccacaaagcttcacac

SEQ ID NO: 8444053 - DNA, 22 bp, Homo sapiens
ccctccccacaaagcttcacac

SEQ ID NO: 8444054 - DNA, 22 bp, Homo sapiens
tgcttgtccctctttatgatgg

SEQ ID NO: 8444055 - DNA, 22 bp, Homo sapiens
ccctccccacaaagcttcacac

SEQ ID NO: 8444056 - DNA, 22 bp, Homo sapiens
ccctccagtgtcccagtgggga

SEQ ID NO: 8444057 - DNA, 22 bp, Homo sapiens
ccctccagtgtcccagtgggga

SEQ ID NO: 8444058 - DNA, 22 bp, Homo sapiens
ccccaggcagggcctaacagag

SEQ ID NO: 8444059 - DNA, 22 bp, Homo sapiens
ccccaggagatttgggagcaca

SEQ ID NO: 8444060 - DNA, 22 bp, Homo sapiens
tgcttcctatccacacaatgcc

SEQ ID NO: 8444061 - DNA, 22 bp, Homo sapiens
tgcttccttgagctctccaatc

SEQ ID NO: 8444062 - DNA, 20 bp, Homo sapiens
tgcttcctggccactgcggg

SEQ ID NO: 8444063 - DNA, 20 bp, Homo sapiens
tgcttcctggccactgcggg

SEQ ID NO: 8444064 - DNA, 22 bp, Homo sapiens
tgcttcctgctaaggctgcctg

SEQ ID NO: 8444065 - DNA, 22 bp, Homo sapiens
cccagttgttgccggctctgga

SEQ ID NO: 8444066 - DNA, 22 bp, Homo sapiens
cccagtgtgcccctcctgcagc

SEQ ID NO: 8444067 - DNA, 22 bp, Homo sapiens
tgctgctcaatgagatgccatc

SEQ ID NO: 8444068 - DNA, 22 bp, Homo sapiens
tgctgctcacacacagtgaatg

SEQ ID NO: 8444069 - DNA, 22 bp, Homo sapiens
tgctgctcaagctgcagcaaaa

SEQ ID NO: 8444070 - DNA, 22 bp, Homo sapiens
cccagtggtttgcagaaccaag

SEQ ID NO: 8444071 - DNA, 22 bp, Homo sapiens
cccagtggtgctggcatctgtg

SEQ ID NO: 8444072 - DNA, 22 bp, Homo sapiens
cccagtggtgctggcatctgtg

SEQ ID NO: 8444073 - DNA, 22 bp, Homo sapiens
cccagtggggagctgaggttca

SEQ ID NO: 8444074 - DNA, 22 bp, Homo sapiens
cccagtggggaaatagctagct

SEQ ID NO: 8444075 - DNA, 22 bp, Homo sapiens
cccagtggcttttgcccaggtt

SEQ ID NO: 8444076 - DNA, 22 bp, Homo sapiens
cccagtgggtcactgcatctca

SEQ ID NO: 8444077 - DNA, 22 bp, Homo sapiens
cccagtgggtcactgcatctca

SEQ ID NO: 8444078 - DNA, 22 bp, Homo sapiens
cccagtggggagcttctgcctt

SEQ ID NO: 8444079 - DNA, 22 bp, Homo sapiens
ccccagctgcatacttgccaag

SEQ ID NO: 8444080 - DNA, 18 bp, Homo sapiens
tgctggggtagaatccac

SEQ ID NO: 8444081 - DNA, 23 bp, Homo sapiens
tgctggggtagtttgtggcacag

SEQ ID NO: 8444082 - DNA, 22 bp, Homo sapiens
tgctggggctctgaccactcca

SEQ ID NO: 8444083 - DNA, 22 bp, Homo sapiens
tgctgggggctttctggatacc

SEQ ID NO: 8444084 - DNA, 22 bp, Homo sapiens
tgctgggggctttctggatacc

SEQ ID NO: 8444085 - DNA, 22 bp, Homo sapiens
tgctgggggtgtctcaccaggc

SEQ ID NO: 8444086 - DNA, 22 bp, Homo sapiens
tgctgggggtgtctcaccaggc

SEQ ID NO: 8444087 - DNA, 22 bp, Homo sapiens
tggcagaaagaaccatgtgcaa

SEQ ID NO: 8444088 - DNA, 22 bp, Homo sapiens
tggcagaagtacacaagcatgc

SEQ ID NO: 8444089 - DNA, 22 bp, Homo sapiens
tggcagaatgaagactggggcc

SEQ ID NO: 8444090 - DNA, 22 bp, Homo sapiens
tggcactttacacccatttggc

SEQ ID NO: 8444091 - DNA, 22 bp, Homo sapiens
ccctggagtgtgacgaggcatt

SEQ ID NO: 8444092 - DNA, 22 bp, Homo sapiens
tggcacagtgctggatggtgct

SEQ ID NO: 8444093 - DNA, 22 bp, Homo sapiens
tggcagaatttctagcagattc

SEQ ID NO: 8444094 - DNA, 22 bp, Homo sapiens
tggcagaagttcactagtagct

SEQ ID NO: 8444095 - DNA, 22 bp, Homo sapiens
tggcagaattttaaagacagat

SEQ ID NO: 8444096 - DNA, 22 bp, Homo sapiens
tggcagaatttctagcagattc

SEQ ID NO: 8444097 - DNA, 22 bp, Homo sapiens
ccctggctgctaccaggtagct

SEQ ID NO: 8444098 - DNA, 22 bp, Homo sapiens
ccctggctgctaccaggtagct

SEQ ID NO: 8444099 - DNA, 22 bp, Homo sapiens
tggcagagaacacacatgattc

SEQ ID NO: 8444100 - DNA, 22 bp, Homo sapiens
ccctggaggttgaggctgcagt

SEQ ID NO: 8444101 - DNA, 22 bp, Homo sapiens
ccctgggagaagttgagggctg

SEQ ID NO: 8444102 - DNA, 22 bp, Homo sapiens
tggcaggaaaaacattggagat

SEQ ID NO: 8444103 - DNA, 22 bp, Homo sapiens
ccctgggagtccactgatgtca

SEQ ID NO: 8444104 - DNA, 22 bp, Homo sapiens
ccctgggaggcttccaggcaga

SEQ ID NO: 8444105 - DNA, 22 bp, Homo sapiens
tggcaggctgagttggcctggt

SEQ ID NO: 8444106 - DNA, 22 bp, Homo sapiens
tggcaggctgagttggcctggt

SEQ ID NO: 8444107 - DNA, 22 bp, Homo sapiens
ccctgggaagtattccagctat

SEQ ID NO: 8444108 - DNA, 22 bp, Homo sapiens
ccctgggaagtattccagctat

SEQ ID NO: 8444109 - DNA, 22 bp, Homo sapiens
ccctgggaagtattccagctat

SEQ ID NO: 8444110 - DNA, 22 bp, Homo sapiens
ccctggcttggcactctccact

SEQ ID NO: 8444111 - DNA, 22 bp, Homo sapiens
ccctgggaggcttccaggcaga

SEQ ID NO: 8444112 - DNA, 22 bp, Homo sapiens
ccctgggaggcttccaggcaga

SEQ ID NO: 8444113 - DNA, 22 bp, Homo sapiens
ccctgggagctgcctggctgac

SEQ ID NO: 8444114 - DNA, 22 bp, Homo sapiens
ccctgggagctgcctggctgac

SEQ ID NO: 8444115 - DNA, 22 bp, Homo sapiens
ccctgggagaagttgagggctg

SEQ ID NO: 8444116 - DNA, 22 bp, Homo sapiens
ccctgggagaagttgagggctg

SEQ ID NO: 8444117 - DNA, 22 bp, Homo sapiens
ccctgggacccgctgcagaggc

SEQ ID NO: 8444118 - DNA, 22 bp, Homo sapiens
ccctgggacccgctgcagaggc

SEQ ID NO: 8444119 - DNA, 22 bp, Homo sapiens
cccttggaaggtagctggcagt

SEQ ID NO: 8444120 - DNA, 22 bp, Homo sapiens
cccttggccactgcgccagtga

SEQ ID NO: 8444121 - DNA, 22 bp, Homo sapiens
cccttggcttctatgggttttc

SEQ ID NO: 8444122 - DNA, 22 bp, Homo sapiens
tggaggcagtttaagtctgaga

SEQ ID NO: 8444123 - DNA, 22 bp, Homo sapiens
tggaggcagtttaagtctgaga

SEQ ID NO: 8444124 - DNA, 22 bp, Homo sapiens
tggaggcatcagagtgcttggc

SEQ ID NO: 8444125 - DNA, 22 bp, Homo sapiens
tggaggcataggcctgggccct

SEQ ID NO: 8444126 - DNA, 22 bp, Homo sapiens
tggaggcatcagagtgcttggc

SEQ ID NO: 8444127 - DNA, 22 bp, Homo sapiens
tggaggcataggcctgggccct

SEQ ID NO: 8444128 - DNA, 22 bp, Homo sapiens
tggaggcatgacagtgtctgga

SEQ ID NO: 8444129 - DNA, 22 bp, Homo sapiens
tggaggcatgacagtgtctgga

SEQ ID NO: 8444130 - DNA, 22 bp, Homo sapiens
tggaggcatttctttttggtcg

SEQ ID NO: 8444131 - DNA, 22 bp, Homo sapiens
tggaggcattgtgactgctgaa

SEQ ID NO: 8444132 - DNA, 22 bp, Homo sapiens
tggaggcatttgatgttcataa

SEQ ID NO: 8444133 - DNA, 22 bp, Homo sapiens
tggaggaagtggctggccagaa

SEQ ID NO: 8444134 - DNA, 22 bp, Homo sapiens
tggaggaagttgctggaagtca

SEQ ID NO: 8444135 - DNA, 23 bp, Homo sapiens
tggaggaaacacatcagaagacc

SEQ ID NO: 8444136 - DNA, 23 bp, Homo sapiens
tggaggaaacacatcagaagacc

SEQ ID NO: 8444137 - DNA, 22 bp, Homo sapiens
tggaggaatcagggcttaggct

SEQ ID NO: 8444138 - DNA, 22 bp, Homo sapiens
tggaggacaggactggacagcc

SEQ ID NO: 8444139 - DNA, 21 bp, Homo sapiens
tggaggaataaagcacagaag

SEQ ID NO: 8444140 - DNA, 21 bp, Homo sapiens
tggaggaataaagcacagaag

SEQ ID NO: 8444141 - DNA, 22 bp, Homo sapiens
tggaggaataacagcaacctta

SEQ ID NO: 8444142 - DNA, 18 bp, Homo sapiens
tggaggaatcacaatggc

SEQ ID NO: 8444143 - DNA, 18 bp, Homo sapiens
tggaggaatcacaatggc

SEQ ID NO: 8444144 - DNA, 18 bp, Homo sapiens
tggaggaatcacaatggc

SEQ ID NO: 8444145 - DNA, 22 bp, Homo sapiens
tggagctgaggggaatgctgag

SEQ ID NO: 8444146 - DNA, 18 bp, Homo sapiens
tggagctgagggcaatgc

SEQ ID NO: 8444147 - DNA, 22 bp, Homo sapiens
tggagatgcctggagattaggg

SEQ ID NO: 8444148 - DNA, 22 bp, Homo sapiens
tggagatgcctggagattaggg

SEQ ID NO: 8444149 - DNA, 22 bp, Homo sapiens
tggagatgggaaaaaggaggta

SEQ ID NO: 8444150 - DNA, 22 bp, Homo sapiens
tggagatgaacatggtgatgtt

SEQ ID NO: 8444151 - DNA, 22 bp, Homo sapiens
tggagagaaaaaagacagttct

SEQ ID NO: 8444152 - DNA, 22 bp, Homo sapiens
tggagacagagatagccaattg

SEQ ID NO: 8444153 - DNA, 22 bp, Homo sapiens
tggagaattctatgttgagggg

SEQ ID NO: 8444154 - DNA, 22 bp, Homo sapiens
tggaaactctacctctctaaga

SEQ ID NO: 8444155 - DNA, 19 bp, Homo sapiens
tggaaactcctgatattag

SEQ ID NO: 8444156 - DNA, 22 bp, Homo sapiens
tggaaactgtggtatttcttta

SEQ ID NO: 8444157 - DNA, 22 bp, Homo sapiens
tggaaactgggagttaaatgta

SEQ ID NO: 8444158 - DNA, 22 bp, Homo sapiens
tggaaactgcagttcccgggga

SEQ ID NO: 8444159 - DNA, 22 bp, Homo sapiens
tggaaactgggagttaaatgta

SEQ ID NO: 8444160 - DNA, 22 bp, Homo sapiens
tggaaacttggaacgtcttcag

SEQ ID NO: 8444161 - DNA, 21 bp, Homo sapiens
tggaaacttctagcttacgta

SEQ ID NO: 8444162 - DNA, 22 bp, Homo sapiens
tggaaagaaaaacaggccatga

SEQ ID NO: 8444163 - DNA, 23 bp, Homo sapiens
tggaaacttaagggggagatgtc

SEQ ID NO: 8444164 - DNA, 22 bp, Homo sapiens
tggaaacttatctgacacgaac

SEQ ID NO: 8444165 - DNA, 22 bp, Homo sapiens
tggaaacttaccgtttggggaa

SEQ ID NO: 8444166 - DNA, 22 bp, Homo sapiens
tggaaactatcctcacaactag

SEQ ID NO: 8444167 - DNA, 22 bp, Homo sapiens
tggaaactcagggccagaagga

SEQ ID NO: 8444168 - DNA, 22 bp, Homo sapiens
tggaaactatagtcacaataga

SEQ ID NO: 8444169 - DNA, 22 bp, Homo sapiens
tggaaactataaaagcaccttc

SEQ ID NO: 8444170 - DNA, 22 bp, Homo sapiens
tggaaactaggatggaagaaat

SEQ ID NO: 8444171 - DNA, 22 bp, Homo sapiens
tggaaactagagtgtgggaagc

SEQ ID NO: 8444172 - DNA, 22 bp, Homo sapiens
tggaaactagccttttaggttg

SEQ ID NO: 8444173 - DNA, 22 bp, Homo sapiens
tggaaactagagagtttgtatt

SEQ ID NO: 8444174 - DNA, 22 bp, Homo sapiens
tggaaactaacaacagagcaga

SEQ ID NO: 8444175 - DNA, 22 bp, Homo sapiens
tggaaactaagactagagagac

SEQ ID NO: 8444176 - DNA, 22 bp, Homo sapiens
ccctcctcaactctggcttcca

SEQ ID NO: 8444177 - DNA, 23 bp, Homo sapiens
tggaaacattctgaatgtccatc

SEQ ID NO: 8444178 - DNA, 22 bp, Homo sapiens
ccctccctgtgtgcctcatttg

SEQ ID NO: 8444179 - DNA, 22 bp, Homo sapiens
tggcttctttgtagaaattgaa

SEQ ID NO: 8444180 - DNA, 22 bp, Homo sapiens
tggcttctttgtagaaattgaa

SEQ ID NO: 8444181 - DNA, 22 bp, Homo sapiens
tggcttctttgtgacagctctt

SEQ ID NO: 8444182 - DNA, 22 bp, Homo sapiens
tggcttctttctttccatgtgt

SEQ ID NO: 8444183 - DNA, 22 bp, Homo sapiens
tggcttctttccactgtcctgt

SEQ ID NO: 8444184 - DNA, 22 bp, Homo sapiens
tggcttgctactgaggtgtcag

SEQ ID NO: 8444185 - DNA, 22 bp, Homo sapiens
tggcttcttgtttggtttaaga

SEQ ID NO: 8444186 - DNA, 22 bp, Homo sapiens
tggcttccccggagtgacatgt

SEQ ID NO: 8444187 - DNA, 22 bp, Homo sapiens
tggcttcccctaccttccaatt

SEQ ID NO: 8444188 - DNA, 16 bp, Homo sapiens
tggcttcccagagata

SEQ ID NO: 8444189 - DNA, 22 bp, Homo sapiens
tggcttcccaggaaaggagaag

SEQ ID NO: 8444190 - DNA, 22 bp, Homo sapiens
tggcttcccatagcttgctagt

SEQ ID NO: 8444191 - DNA, 22 bp, Homo sapiens
cctcctggtccagcatctcttt

SEQ ID NO: 8444192 - DNA, 22 bp, Homo sapiens
cctcctggtccagcatctcttt

SEQ ID NO: 8444193 - DNA, 22 bp, Homo sapiens
cctcctgggttcaagcgattct

SEQ ID NO: 8444194 - DNA, 22 bp, Homo sapiens
cctcctgggttcaagcgattct

SEQ ID NO: 8444195 - DNA, 22 bp, Homo sapiens
cctcctggggtgaaggatggga

SEQ ID NO: 8444196 - DNA, 22 bp, Homo sapiens
cctcctggtaattagcgaaagg

SEQ ID NO: 8444197 - DNA, 22 bp, Homo sapiens
cctcctggtaattagcgaaagg

SEQ ID NO: 8444198 - DNA, 20 bp, Homo sapiens
cctcctggtcaggtgtgcag

SEQ ID NO: 8444199 - DNA, 20 bp, Homo sapiens
cctcctggtcaggtgtgcag

SEQ ID NO: 8444200 - DNA, 22 bp, Homo sapiens
cctcctggtaattagcgaaagg

SEQ ID NO: 8444201 - DNA, 22 bp, Homo sapiens
tggctttaggagctatatacct

SEQ ID NO: 8444202 - DNA, 22 bp, Homo sapiens
tggctttaggagctatatacct

SEQ ID NO: 8444203 - DNA, 22 bp, Homo sapiens
tggctttacttaaactgaatca

SEQ ID NO: 8444204 - DNA, 22 bp, Homo sapiens
cctctccagttttaacgtgacc

SEQ ID NO: 8444205 - DNA, 22 bp, Homo sapiens
cctctcccaggcgcggcggcag

SEQ ID NO: 8444206 - DNA, 22 bp, Homo sapiens
cctctcccctcccaaggcggga

SEQ ID NO: 8444207 - DNA, 19 bp, Homo sapiens
cctctcccatgcttacctc

SEQ ID NO: 8444208 - DNA, 22 bp, Homo sapiens
tgggataaggtatgtgaagtac

SEQ ID NO: 8444209 - DNA, 22 bp, Homo sapiens
tgggataataaatagaggcaga

SEQ ID NO: 8444210 - DNA, 21 bp, Homo sapiens
tgggatagaaatatggctgct

SEQ ID NO: 8444211 - DNA, 22 bp, Homo sapiens
tgggagagcagagaaccctctt

SEQ ID NO: 8444212 - DNA, 22 bp, Homo sapiens
tgggataataaatagaggcaga

SEQ ID NO: 8444213 - DNA, 22 bp, Homo sapiens
tgggcactggaagcctgctgtg

SEQ ID NO: 8444214 - DNA, 22 bp, Homo sapiens
tgggacagattataagtctgca

SEQ ID NO: 8444215 - DNA, 22 bp, Homo sapiens
tgggacaggaggcctctggaga

SEQ ID NO: 8444216 - DNA, 22 bp, Homo sapiens
tgggacagagtgagctttggcc

SEQ ID NO: 8444217 - DNA, 22 bp, Homo sapiens
tgggacagagtgagctttggcc

SEQ ID NO: 8444218 - DNA, 22 bp, Homo sapiens
tgggacaggaggcctctggaga

SEQ ID NO: 8444219 - DNA, 22 bp, Homo sapiens
tgggacaggaggcctctggaga

SEQ ID NO: 8444220 - DNA, 22 bp, Homo sapiens
tgggacagggaatctgatcccc

SEQ ID NO: 8444221 - DNA, 22 bp, Homo sapiens
tgggacagggaatctgatcccc

SEQ ID NO: 8444222 - DNA, 22 bp, Homo sapiens
tgggacagggaatctgatcccc

SEQ ID NO: 8444223 - DNA, 22 bp, Homo sapiens
tgggagagataggcttctggac

SEQ ID NO: 8444224 - DNA, 22 bp, Homo sapiens
tgggagagataggcttctggac

SEQ ID NO: 8444225 - DNA, 22 bp, Homo sapiens
tgggagagcactgcagccccgg

SEQ ID NO: 8444226 - DNA, 22 bp, Homo sapiens
tgggagagcactgcagccccgg

SEQ ID NO: 8444227 - DNA, 22 bp, Homo sapiens
tgggagagagaattcccagtgg

SEQ ID NO: 8444228 - DNA, 22 bp, Homo sapiens
cctcctggcttttcccattgaa

SEQ ID NO: 8444229 - DNA, 22 bp, Homo sapiens
cctcctggcttttcccattgaa

SEQ ID NO: 8444230 - DNA, 22 bp, Homo sapiens
cctcctgggacaggctggcaca

SEQ ID NO: 8444231 - DNA, 22 bp, Homo sapiens
cctcctgggacaggctggcaca

SEQ ID NO: 8444232 - DNA, 22 bp, Homo sapiens
cctcctgggacaggctggcaca

SEQ ID NO: 8444233 - DNA, 22 bp, Homo sapiens
cctcctgggacaggctggcaca

SEQ ID NO: 8444234 - DNA, 22 bp, Homo sapiens
cctcctgggactcattagcacc

SEQ ID NO: 8444235 - DNA, 22 bp, Homo sapiens
cctcctgggactcattagcacc

SEQ ID NO: 8444236 - DNA, 22 bp, Homo sapiens
cctcctggcctgtgcagagccc

SEQ ID NO: 8444237 - DNA, 22 bp, Homo sapiens
cctcctggcctgtgcagagccc

SEQ ID NO: 8444238 - DNA, 22 bp, Homo sapiens
cctcctggggtgaaggatggga

SEQ ID NO: 8444239 - DNA, 22 bp, Homo sapiens
cctcctgggctcctgtctgcac

SEQ ID NO: 8444240 - DNA, 22 bp, Homo sapiens
cctcctgggctcctgtctgcac

SEQ ID NO: 8444241 - DNA, 22 bp, Homo sapiens
cctcctgggctcctgtctgcac

SEQ ID NO: 8444242 - DNA, 22 bp, Homo sapiens
cctcctgggccttgctctgtga

SEQ ID NO: 8444243 - DNA, 22 bp, Homo sapiens
cctcctgggccttgctctgtga

SEQ ID NO: 8444244 - DNA, 22 bp, Homo sapiens
cctcctgggccttgctctgtga

SEQ ID NO: 8444245 - DNA, 22 bp, Homo sapiens
cctcctgggccttgctctgtga

SEQ ID NO: 8444246 - DNA, 22 bp, Homo sapiens
cctcctgggagagcacggaggg

SEQ ID NO: 8444247 - DNA, 22 bp, Homo sapiens
cctcctgggagagcacggaggg

SEQ ID NO: 8444248 - DNA, 22 bp, Homo sapiens
cctcctgggagagcacggaggg

SEQ ID NO: 8444249 - DNA, 23 bp, Homo sapiens
cctcctgggcacaggcctgatgg

SEQ ID NO: 8444250 - DNA, 23 bp, Homo sapiens
cctcctgggcacaggcctgatgg

SEQ ID NO: 8444251 - DNA, 23 bp, Homo sapiens
cctcctgggcacaggcctgatgg

SEQ ID NO: 8444252 - DNA, 22 bp, Homo sapiens
cctcccaccgtatctcagtggc

SEQ ID NO: 8444253 - DNA, 22 bp, Homo sapiens
cctcccacattgaggacatgct

SEQ ID NO: 8444254 - DNA, 19 bp, Homo sapiens
cctcccacggattccttcc

SEQ ID NO: 8444255 - DNA, 22 bp, Homo sapiens
cctcctctggtgctgccaaccc

SEQ ID NO: 8444256 - DNA, 23 bp, Homo sapiens
cctcccacctatttcactttctt

SEQ ID NO: 8444257 - DNA, 22 bp, Homo sapiens
cctcccaccgtatctcagtggc

SEQ ID NO: 8444258 - DNA, 23 bp, Homo sapiens
cctccatggtaagaagcttagag

SEQ ID NO: 8444259 - DNA, 22 bp, Homo sapiens
cctccaggtgttacatatgact

SEQ ID NO: 8444260 - DNA, 22 bp, Homo sapiens
cctccagtactccagtccagcg

SEQ ID NO: 8444261 - DNA, 22 bp, Homo sapiens
cctccatcaccatctgccctca

SEQ ID NO: 8444262 - DNA, 22 bp, Homo sapiens
cctccatcaccatctgccctca

SEQ ID NO: 8444263 - DNA, 22 bp, Homo sapiens
cctccagtcacctggatgagaa

SEQ ID NO: 8444264 - DNA, 22 bp, Homo sapiens
cctccatctccagcttctgcct

SEQ ID NO: 8444265 - DNA, 22 bp, Homo sapiens
tggcattttgttcagtatatgg

SEQ ID NO: 8444266 - DNA, 22 bp, Homo sapiens
tggcattttgttcagtatatgg

SEQ ID NO: 8444267 - DNA, 22 bp, Homo sapiens
tggcatttggcttacttatgtt

SEQ ID NO: 8444268 - DNA, 23 bp, Homo sapiens
tggcattttagttagcttcagtg

SEQ ID NO: 8444269 - DNA, 22 bp, Homo sapiens
tggcattttccaatgatatgtt

SEQ ID NO: 8444270 - DNA, 22 bp, Homo sapiens
cctccagctgcctcagtctctt

SEQ ID NO: 8444271 - DNA, 22 bp, Homo sapiens
cctccagcgcgatccactccgg

SEQ ID NO: 8444272 - DNA, 22 bp, Homo sapiens
cctccagggcccctctcactgg

SEQ ID NO: 8444273 - DNA, 22 bp, Homo sapiens
cctccagggcagacggggagca

SEQ ID NO: 8444274 - DNA, 21 bp, Homo sapiens
cctccaggtgattccgtgctc

SEQ ID NO: 8444275 - DNA, 22 bp, Homo sapiens
cctccagggcccctctcactgg

SEQ ID NO: 8444276 - DNA, 22 bp, Homo sapiens
tggcagtgtgggaggaaggtac

SEQ ID NO: 8444277 - DNA, 22 bp, Homo sapiens
tggcagtgtcttatcaggagtg

SEQ ID NO: 8444278 - DNA, 22 bp, Homo sapiens
tggcagtgggaagctggaagtc

SEQ ID NO: 8444279 - DNA, 22 bp, Homo sapiens
tggcagtgggaagctggaagtc

SEQ ID NO: 8444280 - DNA, 22 bp, Homo sapiens
tggcagtgggaagctggaagtc

SEQ ID NO: 8444281 - DNA, 22 bp, Homo sapiens
tggcagtgggaagctggaagtc

SEQ ID NO: 8444282 - DNA, 22 bp, Homo sapiens
tggcagtgggaagctggaagtc

SEQ ID NO: 8444283 - DNA, 22 bp, Homo sapiens
tggttacatatcctttggagcc

SEQ ID NO: 8444284 - DNA, 22 bp, Homo sapiens
tggttacagagatttttaagat

SEQ ID NO: 8444285 - DNA, 22 bp, Homo sapiens
tggttagacacatgcatgtcat

SEQ ID NO: 8444286 - DNA, 22 bp, Homo sapiens
tggtgggacatctgaggagagg

SEQ ID NO: 8444287 - DNA, 22 bp, Homo sapiens
cctgcctgcaaaatgggacaag

SEQ ID NO: 8444288 - DNA, 22 bp, Homo sapiens
cctgcctgattccaggatggct

SEQ ID NO: 8444289 - DNA, 17 bp, Homo sapiens
cctgcctgagccatagc

SEQ ID NO: 8444290 - DNA, 19 bp, Homo sapiens
cctgcctgagctgtccctc

SEQ ID NO: 8444291 - DNA, 19 bp, Homo sapiens
cctgcctgagctgtccctc

SEQ ID NO: 8444292 - DNA, 19 bp, Homo sapiens
cctgcctgagctgtccctc

SEQ ID NO: 8444293 - DNA, 22 bp, Homo sapiens
cctgcctgaaggtcagccaccc

SEQ ID NO: 8444294 - DNA, 22 bp, Homo sapiens
cctgcctgaaggtcagccaccc

SEQ ID NO: 8444295 - DNA, 22 bp, Homo sapiens
cctgcctgacagagaaggttca

SEQ ID NO: 8444296 - DNA, 22 bp, Homo sapiens
cctgcctcccagaggtcctcta

SEQ ID NO: 8444297 - DNA, 22 bp, Homo sapiens
tggtagcaacatctcagtggct

SEQ ID NO: 8444298 - DNA, 22 bp, Homo sapiens
cctgccctgtcactggctaggg

SEQ ID NO: 8444299 - DNA, 21 bp, Homo sapiens
tggtacagaggaggtgaagtg

SEQ ID NO: 8444300 - DNA, 22 bp, Homo sapiens
tggtaccagctgtgtgttcact

SEQ ID NO: 8444301 - DNA, 22 bp, Homo sapiens
tggtaccatttcccaggagtgt

SEQ ID NO: 8444302 - DNA, 22 bp, Homo sapiens
tggtacttggaggcagaaaaat

SEQ ID NO: 8444303 - DNA, 22 bp, Homo sapiens
tggtactgagaatagcgtctac

SEQ ID NO: 8444304 - DNA, 22 bp, Homo sapiens
tggtaccatgacaaatgtcagg

SEQ ID NO: 8444305 - DNA, 22 bp, Homo sapiens
cctgcctactgagttttatatt

SEQ ID NO: 8444306 - DNA, 22 bp, Homo sapiens
cctgcctatgagacgttttgcc

SEQ ID NO: 8444307 - DNA, 22 bp, Homo sapiens
cctgcctatgagacgttttgcc

SEQ ID NO: 8444308 - DNA, 22 bp, Homo sapiens
cctgccctgtgtttggggacta

SEQ ID NO: 8444309 - DNA, 22 bp, Homo sapiens
cctgccctgtgtttggggacta

SEQ ID NO: 8444310 - DNA, 22 bp, Homo sapiens
cctgccctgtgtttggggacta

SEQ ID NO: 8444311 - DNA, 22 bp, Homo sapiens
cctgccctgtcactggctaggg

SEQ ID NO: 8444312 - DNA, 22 bp, Homo sapiens
cctgcccttctttccccagcat

SEQ ID NO: 8444313 - DNA, 22 bp, Homo sapiens
cctgcccttctttccccagcat

SEQ ID NO: 8444314 - DNA, 22 bp, Homo sapiens
cctgcccttctttccccagcat

SEQ ID NO: 8444315 - DNA, 22 bp, Homo sapiens
cctgcccttctttccccagcat

SEQ ID NO: 8444316 - DNA, 22 bp, Homo sapiens
cctgcccttctttccccagcat

SEQ ID NO: 8444317 - DNA, 22 bp, Homo sapiens
cctgcaggggagagacttctag

SEQ ID NO: 8444318 - DNA, 19 bp, Homo sapiens
cctgcagggatgagaggtt

SEQ ID NO: 8444319 - DNA, 19 bp, Homo sapiens
cctgcagggatgagaggtt

SEQ ID NO: 8444320 - DNA, 22 bp, Homo sapiens
cctgcaggtaaggctaactgcc

SEQ ID NO: 8444321 - DNA, 22 bp, Homo sapiens
cctgcaggtccccggatgcgca

SEQ ID NO: 8444322 - DNA, 22 bp, Homo sapiens
cctgcaggtccccggatgcgca

SEQ ID NO: 8444323 - DNA, 22 bp, Homo sapiens
cctgcagggtgctgccacagat

SEQ ID NO: 8444324 - DNA, 22 bp, Homo sapiens
cctgcagggtgctgccacagat

SEQ ID NO: 8444325 - DNA, 22 bp, Homo sapiens
cctgcagggtgctgccacagat

SEQ ID NO: 8444326 - DNA, 22 bp, Homo sapiens
cctgcaggttgcagaggcggaa

SEQ ID NO: 8444327 - DNA, 22 bp, Homo sapiens
cctgcaggttgcagaggcggaa

SEQ ID NO: 8444328 - DNA, 22 bp, Homo sapiens
cctgcaggtttcccccggacgg

SEQ ID NO: 8444329 - DNA, 22 bp, Homo sapiens
cctgcaggtttcccccggacgg

SEQ ID NO: 8444330 - DNA, 22 bp, Homo sapiens
cctgccacttcttgctatggag

SEQ ID NO: 8444331 - DNA, 22 bp, Homo sapiens
cctgccagaaaagagggagttc

SEQ ID NO: 8444332 - DNA, 22 bp, Homo sapiens
tggtacaagcagactcagcaga

SEQ ID NO: 8444333 - DNA, 22 bp, Homo sapiens
tggtacaagatgttctaactga

SEQ ID NO: 8444334 - DNA, 22 bp, Homo sapiens
tggtacaactgtattaggcaaa

SEQ ID NO: 8444335 - DNA, 22 bp, Homo sapiens
tggtacaatggcatctatctat

SEQ ID NO: 8444336 - DNA, 22 bp, Homo sapiens
tggtacaatcacagctcactgt

SEQ ID NO: 8444337 - DNA, 23 bp, Homo sapiens
tggtaatagggagcagaaggtag

SEQ ID NO: 8444338 - DNA, 22 bp, Homo sapiens
tgggtgggagcaccctgtctgg

SEQ ID NO: 8444339 - DNA, 22 bp, Homo sapiens
tgggtgggagcaccctgtctgg

SEQ ID NO: 8444340 - DNA, 22 bp, Homo sapiens
tgggtggcacttctggggtcca

SEQ ID NO: 8444341 - DNA, 18 bp, Homo sapiens
tgggtggctagggagttt

SEQ ID NO: 8444342 - DNA, 22 bp, Homo sapiens
tgggtccacaaacatcagatat

SEQ ID NO: 8444343 - DNA, 22 bp, Homo sapiens
tgggtccacaaacatcagatat

SEQ ID NO: 8444344 - DNA, 19 bp, Homo sapiens
cctgagtgtttcagagaca

SEQ ID NO: 8444345 - DNA, 22 bp, Homo sapiens
cctgagttagttgctgtgtctc

SEQ ID NO: 8444346 - DNA, 22 bp, Homo sapiens
cctgagtgacctgaggtctagt

SEQ ID NO: 8444347 - DNA, 22 bp, Homo sapiens
cctgagtgacctgaggtctagt

SEQ ID NO: 8444348 - DNA, 22 bp, Homo sapiens
cctgagtgccatgagagcaccc

SEQ ID NO: 8444349 - DNA, 22 bp, Homo sapiens
cctgagtgccatgagagcaccc

SEQ ID NO: 8444350 - DNA, 22 bp, Homo sapiens
cctgagtcttggcttcttggct

SEQ ID NO: 8444351 - DNA, 22 bp, Homo sapiens
tgggctcctcgtcactcgctgt

SEQ ID NO: 8444352 - DNA, 22 bp, Homo sapiens
cctgagtctttcccattgcgct

SEQ ID NO: 8444353 - DNA, 22 bp, Homo sapiens
cctgaggtcatggtccagtgtt

SEQ ID NO: 8444354 - DNA, 17 bp, Homo sapiens
cctgagtgggagaggaa

SEQ ID NO: 8444355 - DNA, 17 bp, Homo sapiens
cctgagtgggagaggaa

SEQ ID NO: 8444356 - DNA, 22 bp, Homo sapiens
cctgagtgtaataatgaaggca

SEQ ID NO: 8444357 - DNA, 22 bp, Homo sapiens
cctgagtggtgctaagcagata

SEQ ID NO: 8444358 - DNA, 22 bp, Homo sapiens
cctgagtggccaggcagctgtg

SEQ ID NO: 8444359 - DNA, 22 bp, Homo sapiens
cctgagtgcttccagagtcatg

SEQ ID NO: 8444360 - DNA, 22 bp, Homo sapiens
cctgcaggctgcaggccagttc

SEQ ID NO: 8444361 - DNA, 22 bp, Homo sapiens
cctgcaggctgcaggccagttc

SEQ ID NO: 8444362 - DNA, 22 bp, Homo sapiens
cctgcagggaatcgaggcagaa

SEQ ID NO: 8444363 - DNA, 22 bp, Homo sapiens
cctgcagggaatcgaggcagaa

SEQ ID NO: 8444364 - DNA, 22 bp, Homo sapiens
cctgcagggaatcgaggcagaa

SEQ ID NO: 8444365 - DNA, 22 bp, Homo sapiens
cctgcaggctgcaggccagttc

SEQ ID NO: 8444366 - DNA, 22 bp, Homo sapiens
tggggagagattgaggagtttt

SEQ ID NO: 8444367 - DNA, 22 bp, Homo sapiens
tggggagaggtatcattgagat

SEQ ID NO: 8444368 - DNA, 23 bp, Homo sapiens
tggggagagttaccctggaagcg

SEQ ID NO: 8444369 - DNA, 22 bp, Homo sapiens
cctgcagacacttgtccagcaa

SEQ ID NO: 8444370 - DNA, 22 bp, Homo sapiens
tgggctcctcgtcactcgctgt

SEQ ID NO: 8444371 - DNA, 22 bp, Homo sapiens
tgggctccggcggcctcaggct

SEQ ID NO: 8444372 - DNA, 22 bp, Homo sapiens
tgggctccggcggcctcaggct

SEQ ID NO: 8444373 - DNA, 22 bp, Homo sapiens
tgggctcatggcccagcactgg

SEQ ID NO: 8444374 - DNA, 22 bp, Homo sapiens
tgggcctggccctgtggaggag

SEQ ID NO: 8444375 - DNA, 22 bp, Homo sapiens
tgggcctggagtttgtccagag

SEQ ID NO: 8444376 - DNA, 23 bp, Homo sapiens
tgggcctggcctcccagtccagc

SEQ ID NO: 8444377 - DNA, 23 bp, Homo sapiens
tgggcctggcctcccagtccagc

SEQ ID NO: 8444378 - DNA, 22 bp, Homo sapiens
tgggcctgggagggcagacgct

SEQ ID NO: 8444379 - DNA, 22 bp, Homo sapiens
tgggcaggcaagtgaatacctt

SEQ ID NO: 8444380 - DNA, 22 bp, Homo sapiens
tgggcaggcaagtgaatacctt

SEQ ID NO: 8444381 - DNA, 22 bp, Homo sapiens
tgggcaggcaagtgaatacctt

SEQ ID NO: 8444382 - DNA, 22 bp, Homo sapiens
tgggcaggataatatctcatgt

SEQ ID NO: 8444383 - DNA, 22 bp, Homo sapiens
tgggcaggataatatctcatgt

SEQ ID NO: 8444384 - DNA, 22 bp, Homo sapiens
tgggcaggagagaagctaaaga

SEQ ID NO: 8444385 - DNA, 22 bp, Homo sapiens
tgggcctggagtttgtccagag

SEQ ID NO: 8444386 - DNA, 22 bp, Homo sapiens
tgggcctggagtttgtccagag

SEQ ID NO: 8444387 - DNA, 22 bp, Homo sapiens
tgggcctggagccctggagagt

SEQ ID NO: 8444388 - DNA, 22 bp, Homo sapiens
tgggcctggagccctggagagt

SEQ ID NO: 8444389 - DNA, 22 bp, Homo sapiens
tgggcctggacaaggccactag

SEQ ID NO: 8444390 - DNA, 22 bp, Homo sapiens
tgggcctggacaaggccactag

SEQ ID NO: 8444391 - DNA, 22 bp, Homo sapiens
tgcacttcattgtaaattgtac

SEQ ID NO: 8444392 - DNA, 21 bp, Homo sapiens
tgcacttcagtggctaaattc

SEQ ID NO: 8444393 - DNA, 22 bp, Homo sapiens
tgcacttcaaaaatgtcactga

SEQ ID NO: 8444394 - DNA, 22 bp, Homo sapiens
tgcactgttgctttatatgatt

SEQ ID NO: 8444395 - DNA, 22 bp, Homo sapiens
tgcactgtatggtatctggaca

SEQ ID NO: 8444396 - DNA, 23 bp, Homo sapiens
tgcacttctccatagatgcatct

SEQ ID NO: 8444397 - DNA, 22 bp, Homo sapiens
tgcagagaccactgtgccttcc

SEQ ID NO: 8444398 - DNA, 22 bp, Homo sapiens
tgcagagaagaggacagttcta

SEQ ID NO: 8444399 - DNA, 22 bp, Homo sapiens
tgcagagaaagtgtagacaggc

SEQ ID NO: 8444400 - DNA, 22 bp, Homo sapiens
tgcagagagacccctgggccag

SEQ ID NO: 8444401 - DNA, 22 bp, Homo sapiens
tgcagagagacccctgggccag

SEQ ID NO: 8444402 - DNA, 19 bp, Homo sapiens
tgcagagagaggcaaagaa

SEQ ID NO: 8444403 - DNA, 22 bp, Homo sapiens
tgcagagagatatggcaagagg

SEQ ID NO: 8444404 - DNA, 22 bp, Homo sapiens
tgcagagagatcctcagggttt

SEQ ID NO: 8444405 - DNA, 19 bp, Homo sapiens
cccagaggaatgcctggaa

SEQ ID NO: 8444406 - DNA, 19 bp, Homo sapiens
cccagaggaatgcctggaa

SEQ ID NO: 8444407 - DNA, 23 bp, Homo sapiens
cccagaggagcagggcgtgagat

SEQ ID NO: 8444408 - DNA, 18 bp, Homo sapiens
cccagaggaatgcctgga

SEQ ID NO: 8444409 - DNA, 18 bp, Homo sapiens
cccagaggaatgcctgga

SEQ ID NO: 8444410 - DNA, 22 bp, Homo sapiens
cccagagctgattgttggagcc

SEQ ID NO: 8444411 - DNA, 22 bp, Homo sapiens
cccagagctgggtgggcagcgg

SEQ ID NO: 8444412 - DNA, 22 bp, Homo sapiens
cccagagctgagtctgatatat

SEQ ID NO: 8444413 - DNA, 22 bp, Homo sapiens
cccagagctgagggggcacgtt

SEQ ID NO: 8444414 - DNA, 22 bp, Homo sapiens
cccagagatgggaggtgatcgg

SEQ ID NO: 8444415 - DNA, 22 bp, Homo sapiens
cccagagcctcattctgttggg

SEQ ID NO: 8444416 - DNA, 22 bp, Homo sapiens
cccagagcctcattctgttggg

SEQ ID NO: 8444417 - DNA, 16 bp, Homo sapiens
tgcagagagcatggtg

SEQ ID NO: 8444418 - DNA, 22 bp, Homo sapiens
tgcagagagccagctctctcgg

SEQ ID NO: 8444419 - DNA, 22 bp, Homo sapiens
tgcagagagccctgccttcctc

SEQ ID NO: 8444420 - DNA, 22 bp, Homo sapiens
tgcagagagttagggcccgtat

SEQ ID NO: 8444421 - DNA, 22 bp, Homo sapiens
tgcaataagtattgcttacatg

SEQ ID NO: 8444422 - DNA, 22 bp, Homo sapiens
tgcaataagttgtgttatcact

SEQ ID NO: 8444423 - DNA, 22 bp, Homo sapiens
tgcaataaggagtaatagtaaa

SEQ ID NO: 8444424 - DNA, 22 bp, Homo sapiens
tgcaataactactttaatgttg

SEQ ID NO: 8444425 - DNA, 22 bp, Homo sapiens
tgcaataacccatgagatagaa

SEQ ID NO: 8444426 - DNA, 22 bp, Homo sapiens
tgcaataatgtatgtcactccc

SEQ ID NO: 8444427 - DNA, 21 bp, Homo sapiens
tgcaatatatatttgcctgaa

SEQ ID NO: 8444428 - DNA, 22 bp, Homo sapiens
tgcaatatgttgcattgtatgg

SEQ ID NO: 8444429 - DNA, 22 bp, Homo sapiens
tgcaaatattccatgctgttca

SEQ ID NO: 8444430 - DNA, 22 bp, Homo sapiens
tgcaataaagtgctataaatcc

SEQ ID NO: 8444431 - DNA, 22 bp, Homo sapiens
tgcaataacccagtatctgtga

SEQ ID NO: 8444432 - DNA, 22 bp, Homo sapiens
tgcaagtagtccagcctttggg

SEQ ID NO: 8444433 - DNA, 22 bp, Homo sapiens
cccaaggcagggattttctgct

SEQ ID NO: 8444434 - DNA, 22 bp, Homo sapiens
cccaaggctgcagtgagcatga

SEQ ID NO: 8444435 - DNA, 22 bp, Homo sapiens
cccaaggctgcagtgagcatga

SEQ ID NO: 8444436 - DNA, 22 bp, Homo sapiens
cccaaggacacgggcagggaca

SEQ ID NO: 8444437 - DNA, 22 bp, Homo sapiens
cccaaggaataggatcccagga

SEQ ID NO: 8444438 - DNA, 22 bp, Homo sapiens
cccaagcctttcaaaactcaga

SEQ ID NO: 8444439 - DNA, 23 bp, Homo sapiens
cccaagcctgtgccctctgactc

SEQ ID NO: 8444440 - DNA, 22 bp, Homo sapiens
tgcaatccactattctaaagcc

SEQ ID NO: 8444441 - DNA, 22 bp, Homo sapiens
cccaagccagaccctgaccctg

SEQ ID NO: 8444442 - DNA, 23 bp, Homo sapiens
cccaagcctgtgccctctgactc

SEQ ID NO: 8444443 - DNA, 22 bp, Homo sapiens
tgcactccaggctgggtgacag

SEQ ID NO: 8444444 - DNA, 22 bp, Homo sapiens
tgcactccaggctgggtgacag

SEQ ID NO: 8444445 - DNA, 22 bp, Homo sapiens
tgcactccaggctgggtgacag

SEQ ID NO: 8444446 - DNA, 22 bp, Homo sapiens
tgcacagatgggcttgttcata

SEQ ID NO: 8444447 - DNA, 22 bp, Homo sapiens
tgcacagatctggtggcaagga

SEQ ID NO: 8444448 - DNA, 22 bp, Homo sapiens
tgcacagatctggtggcaagga

SEQ ID NO: 8444449 - DNA, 22 bp, Homo sapiens
cccaagggagtgcctggtcaac

SEQ ID NO: 8444450 - DNA, 22 bp, Homo sapiens
tgcaggaatattgatgaactta

SEQ ID NO: 8444451 - DNA, 22 bp, Homo sapiens
tgcaggaatagctacagagctg

SEQ ID NO: 8444452 - DNA, 22 bp, Homo sapiens
tgcagctgcctagggctggctt

SEQ ID NO: 8444453 - DNA, 23 bp, Homo sapiens
tgcagctgcctctggcgggccgg

SEQ ID NO: 8444454 - DNA, 22 bp, Homo sapiens
tgcaggaccttgatcctggact

SEQ ID NO: 8444455 - DNA, 22 bp, Homo sapiens
tgcaggaccggaaccatgggat

SEQ ID NO: 8444456 - DNA, 22 bp, Homo sapiens
tgcaggaattttttgcagaaag

SEQ ID NO: 8444457 - DNA, 22 bp, Homo sapiens
tgcaggaattttttgcagaaag

SEQ ID NO: 8444458 - DNA, 20 bp, Homo sapiens
tgcaggaatttgcattcctt

SEQ ID NO: 8444459 - DNA, 22 bp, Homo sapiens
tgcaggaatcagaggggaagcg

SEQ ID NO: 8444460 - DNA, 22 bp, Homo sapiens
tgcagctgattaaagggcagac

SEQ ID NO: 8444461 - DNA, 22 bp, Homo sapiens
tgcagctgattaaagggcagac

SEQ ID NO: 8444462 - DNA, 22 bp, Homo sapiens
cccagaggaggcaaagctctgt

SEQ ID NO: 8444463 - DNA, 22 bp, Homo sapiens
cccagaggaggatctcggcccg

SEQ ID NO: 8444464 - DNA, 22 bp, Homo sapiens
cccagaggctgagttgggagca

SEQ ID NO: 8444465 - DNA, 22 bp, Homo sapiens
cccagagggaagggaatgaggt

SEQ ID NO: 8444466 - DNA, 22 bp, Homo sapiens
cccagagggaagggaatgaggt

SEQ ID NO: 8444467 - DNA, 22 bp, Homo sapiens
cccagagggctgaggatatgaa

SEQ ID NO: 8444468 - DNA, 22 bp, Homo sapiens
cccagagggctgaggatatgaa

SEQ ID NO: 8444469 - DNA, 22 bp, Homo sapiens
cccagagggctgaggatatgaa

SEQ ID NO: 8444470 - DNA, 22 bp, Homo sapiens
cccagaggggtcgtctgagggg

SEQ ID NO: 8444471 - DNA, 22 bp, Homo sapiens
tgcagggccttgggtctttctt

SEQ ID NO: 8444472 - DNA, 22 bp, Homo sapiens
cccagcagggtctctgtgtcta

SEQ ID NO: 8444473 - DNA, 22 bp, Homo sapiens
cccagcagggtctctgtgtcta

SEQ ID NO: 8444474 - DNA, 22 bp, Homo sapiens
cccagcagggtctctgtgtcta

SEQ ID NO: 8444475 - DNA, 22 bp, Homo sapiens
cccagcaggtcggtgctgcctg

SEQ ID NO: 8444476 - DNA, 22 bp, Homo sapiens
cccagcaggcatgttgggagga

SEQ ID NO: 8444477 - DNA, 22 bp, Homo sapiens
cccagcagcttgcacagtgctg

SEQ ID NO: 8444478 - DNA, 22 bp, Homo sapiens
cccagcagcttgcacagtgctg

SEQ ID NO: 8444479 - DNA, 22 bp, Homo sapiens
cccagcagcctggatgttcttt

SEQ ID NO: 8444480 - DNA, 22 bp, Homo sapiens
cccagcagccttgtcccttctc

SEQ ID NO: 8444481 - DNA, 22 bp, Homo sapiens
tgcaggccggccctaggcctca

SEQ ID NO: 8444482 - DNA, 22 bp, Homo sapiens
tgcaggcccagtgtagaggctc

SEQ ID NO: 8444483 - DNA, 22 bp, Homo sapiens
tgcaggcccagtgtagaggctc

SEQ ID NO: 8444484 - DNA, 22 bp, Homo sapiens
tgcaggcctcacacctggcacc

SEQ ID NO: 8444485 - DNA, 22 bp, Homo sapiens
tgcaggcctatggtggggcccc

SEQ ID NO: 8444486 - DNA, 22 bp, Homo sapiens
tgcaggcattggtgagagaagc

SEQ ID NO: 8444487 - DNA, 22 bp, Homo sapiens
tgcaggcattggtgagagaagc

SEQ ID NO: 8444488 - DNA, 22 bp, Homo sapiens
tgcaggcataaccgatgttgat

SEQ ID NO: 8444489 - DNA, 22 bp, Homo sapiens
tgcaggcaggggatgagcagcc

SEQ ID NO: 8444490 - DNA, 22 bp, Homo sapiens
tgcaggcaggggatgagcagcc

SEQ ID NO: 8444491 - DNA, 21 bp, Homo sapiens
tgcaggcaggcagagatgctg

SEQ ID NO: 8444492 - DNA, 21 bp, Homo sapiens
tgcaggcaggcagagatgctg

SEQ ID NO: 8444493 - DNA, 22 bp, Homo sapiens
tgcaggagaaagtacggagcgt

SEQ ID NO: 8444494 - DNA, 22 bp, Homo sapiens
tgagcagagacgggggcctcca

SEQ ID NO: 8444495 - DNA, 22 bp, Homo sapiens
tgagcagggagctgggctgagc

SEQ ID NO: 8444496 - DNA, 22 bp, Homo sapiens
tgagcaggggagagcgaatgtg

SEQ ID NO: 8444497 - DNA, 22 bp, Homo sapiens
tgagcagagacgggggcctcca

SEQ ID NO: 8444498 - DNA, 22 bp, Homo sapiens
ccagggctgagctgtgaccatg

SEQ ID NO: 8444499 - DNA, 22 bp, Homo sapiens
tgagcagtaacagctcacaggg

SEQ ID NO: 8444500 - DNA, 22 bp, Homo sapiens
tgagcagtaacagctcacaggg

SEQ ID NO: 8444501 - DNA, 22 bp, Homo sapiens
tgagcagtaacagctcacaggg

SEQ ID NO: 8444502 - DNA, 21 bp, Homo sapiens
tgagcaggtgctgcttttatg

SEQ ID NO: 8444503 - DNA, 17 bp, Homo sapiens
tgagcagtagaagatgc

SEQ ID NO: 8444504 - DNA, 22 bp, Homo sapiens
tgagcagtaggtctgaatagtg

SEQ ID NO: 8444505 - DNA, 21 bp, Homo sapiens
tgagcaggtgcagggaagtgg

SEQ ID NO: 8444506 - DNA, 22 bp, Homo sapiens
tgagcaggtgagtctagggcag

SEQ ID NO: 8444507 - DNA, 22 bp, Homo sapiens
tgagcaggtcaggaagtacatt

SEQ ID NO: 8444508 - DNA, 22 bp, Homo sapiens
tgagcaggtcaagactccagct

SEQ ID NO: 8444509 - DNA, 18 bp, Homo sapiens
tgagcaggggctgacctt

SEQ ID NO: 8444510 - DNA, 22 bp, Homo sapiens
ccagtcagccaagctgcagcgg

SEQ ID NO: 8444511 - DNA, 22 bp, Homo sapiens
ccagtcagggcaggagcctggt

SEQ ID NO: 8444512 - DNA, 22 bp, Homo sapiens
ccagtccacgtcaagaagaggt

SEQ ID NO: 8444513 - DNA, 20 bp, Homo sapiens
ccagtccacctgagacatgt

SEQ ID NO: 8444514 - DNA, 22 bp, Homo sapiens
ccagtccagtgccatgcatggc

SEQ ID NO: 8444515 - DNA, 22 bp, Homo sapiens
ccagtccatatttatactgccg

SEQ ID NO: 8444516 - DNA, 22 bp, Homo sapiens
ccagtccagtgccatgcatggc

SEQ ID NO: 8444517 - DNA, 22 bp, Homo sapiens
tgagcagtcatccatttctcct

SEQ ID NO: 8444518 - DNA, 22 bp, Homo sapiens
tgagcagtcagacaagcatcac

SEQ ID NO: 8444519 - DNA, 22 bp, Homo sapiens
tgagcagtcatccatttctcct

SEQ ID NO: 8444520 - DNA, 22 bp, Homo sapiens
ccagtgcataatcaatacagcc

SEQ ID NO: 8444521 - DNA, 22 bp, Homo sapiens
ccagtgcattgccgtgtctagg

SEQ ID NO: 8444522 - DNA, 22 bp, Homo sapiens
ccagtgcattgccgtgtctagg

SEQ ID NO: 8444523 - DNA, 18 bp, Homo sapiens
ccagtgccaagagtggca

SEQ ID NO: 8444524 - DNA, 22 bp, Homo sapiens
ccagtgcctgtgggcatggtgc

SEQ ID NO: 8444525 - DNA, 22 bp, Homo sapiens
ccagtgcctatctcctctggga

SEQ ID NO: 8444526 - DNA, 22 bp, Homo sapiens
ccagtgcctatccttctcctgt

SEQ ID NO: 8444527 - DNA, 22 bp, Homo sapiens
tgaggcagtgctgggaagcctg

SEQ ID NO: 8444528 - DNA, 22 bp, Homo sapiens
ccagtggaaatgtggtcaggat

SEQ ID NO: 8444529 - DNA, 21 bp, Homo sapiens
ccagtgctacagctgcctgac

SEQ ID NO: 8444530 - DNA, 22 bp, Homo sapiens
ccagtgccttttgtgggtttgt

SEQ ID NO: 8444531 - DNA, 22 bp, Homo sapiens
ccagtgcttctttgctagctgg

SEQ ID NO: 8444532 - DNA, 22 bp, Homo sapiens
ccagtgctgaatgaggaggtct

SEQ ID NO: 8444533 - DNA, 22 bp, Homo sapiens
ccagtgctcttaaaggtcataa

SEQ ID NO: 8444534 - DNA, 22 bp, Homo sapiens
ccagtgctcattcaagtcctta

SEQ ID NO: 8444535 - DNA, 22 bp, Homo sapiens
tgagcccagagcccttgtaggg

SEQ ID NO: 8444536 - DNA, 22 bp, Homo sapiens
tgagcccagagatctgagctat

SEQ ID NO: 8444537 - DNA, 22 bp, Homo sapiens
tgagcccagaagcccactcggc

SEQ ID NO: 8444538 - DNA, 23 bp, Homo sapiens
tgagcccaggaggtcaaggctgc

SEQ ID NO: 8444539 - DNA, 22 bp, Homo sapiens
tgagcccaggaggcagaggttg

SEQ ID NO: 8444540 - DNA, 22 bp, Homo sapiens
ccagtgcagtccccctgaactg

SEQ ID NO: 8444541 - DNA, 22 bp, Homo sapiens
ccagtgcaggtgagcaccaggt

SEQ ID NO: 8444542 - DNA, 22 bp, Homo sapiens
ccagtctgcagcccctggggac

SEQ ID NO: 8444543 - DNA, 22 bp, Homo sapiens
tgagcccaggagtatgaggctg

SEQ ID NO: 8444544 - DNA, 22 bp, Homo sapiens
tgagcccaggagttggagaccg

SEQ ID NO: 8444545 - DNA, 22 bp, Homo sapiens
tgagcccaggagtatgaggctg

SEQ ID NO: 8444546 - DNA, 22 bp, Homo sapiens
ccagtccatggattcccaaggt

SEQ ID NO: 8444547 - DNA, 22 bp, Homo sapiens
ccagtcccagctctgccatgct

SEQ ID NO: 8444548 - DNA, 22 bp, Homo sapiens
tgagccagttcttcagatccat

SEQ ID NO: 8444549 - DNA, 22 bp, Homo sapiens
tgagccatgggactccaaggga

SEQ ID NO: 8444550 - DNA, 22 bp, Homo sapiens
tgaggccatgcccgtgccggcc

SEQ ID NO: 8444551 - DNA, 22 bp, Homo sapiens
tgaggccaggcaaaggcgatct

SEQ ID NO: 8444552 - DNA, 22 bp, Homo sapiens
tgaggccagggattccatcatt

SEQ ID NO: 8444553 - DNA, 17 bp, Homo sapiens
tgaggccatggcaccat

SEQ ID NO: 8444554 - DNA, 22 bp, Homo sapiens
tgaggccatggaactagcttgg

SEQ ID NO: 8444555 - DNA, 22 bp, Homo sapiens
tgaggccccgaagctgaggttt

SEQ ID NO: 8444556 - DNA, 22 bp, Homo sapiens
tgaggcccatctgagattttga

SEQ ID NO: 8444557 - DNA, 22 bp, Homo sapiens
tgaggcccagccgccctgagag

SEQ ID NO: 8444558 - DNA, 22 bp, Homo sapiens
tgaggctgagatatcagggagg

SEQ ID NO: 8444559 - DNA, 22 bp, Homo sapiens
ccagttacaagtgattcttggt

SEQ ID NO: 8444560 - DNA, 22 bp, Homo sapiens
ccatacacacaccaaatttgta

SEQ ID NO: 8444561 - DNA, 22 bp, Homo sapiens
ccatagcaagaggagcagaaat

SEQ ID NO: 8444562 - DNA, 22 bp, Homo sapiens
ccatagatgagacaaagtagag

SEQ ID NO: 8444563 - DNA, 22 bp, Homo sapiens
ccatagtacataatacatttta

SEQ ID NO: 8444564 - DNA, 22 bp, Homo sapiens
ccatcagagggctgctctgcaa

SEQ ID NO: 8444565 - DNA, 22 bp, Homo sapiens
ccatcagacaattctttctctt

SEQ ID NO: 8444566 - DNA, 22 bp, Homo sapiens
ccatcacagtccccatcgtgat

SEQ ID NO: 8444567 - DNA, 22 bp, Homo sapiens
tgataaacagctgatgaagacc

SEQ ID NO: 8444568 - DNA, 22 bp, Homo sapiens
tgagttttggaagacaacacaa

SEQ ID NO: 8444569 - DNA, 22 bp, Homo sapiens
tgagtttggtatctagggggtc

SEQ ID NO: 8444570 - DNA, 22 bp, Homo sapiens
tgagttttgtcttgctagaagt

SEQ ID NO: 8444571 - DNA, 22 bp, Homo sapiens
tgataaacattttaggaactaa

SEQ ID NO: 8444572 - DNA, 22 bp, Homo sapiens
tgagttttttcaacatatgaag

SEQ ID NO: 8444573 - DNA, 22 bp, Homo sapiens
tgataaactggagaggtggagg

SEQ ID NO: 8444574 - DNA, 22 bp, Homo sapiens
tgataaacttagaaagaatgtt

SEQ ID NO: 8444575 - DNA, 22 bp, Homo sapiens
tgataaacttagaaagaatgtt

SEQ ID NO: 8444576 - DNA, 22 bp, Homo sapiens
tgagttcttcacattacctacg

SEQ ID NO: 8444577 - DNA, 22 bp, Homo sapiens
tgagttctttgcaaataacaag

SEQ ID NO: 8444578 - DNA, 22 bp, Homo sapiens
tgagttctttccgttaggtatg

SEQ ID NO: 8444579 - DNA, 22 bp, Homo sapiens
tgagttgctatctagatccaga

SEQ ID NO: 8444580 - DNA, 22 bp, Homo sapiens
tgagtctcccagcgttaaacct

SEQ ID NO: 8444581 - DNA, 22 bp, Homo sapiens
tgagtctcattaattatgaatg

SEQ ID NO: 8444582 - DNA, 22 bp, Homo sapiens
tgagtctaggtagagaaatgca

SEQ ID NO: 8444583 - DNA, 22 bp, Homo sapiens
tgagtctccagcgaagtaggat

SEQ ID NO: 8444584 - DNA, 22 bp, Homo sapiens
tgagtctgctcctggtagcaga

SEQ ID NO: 8444585 - DNA, 22 bp, Homo sapiens
tgagtctgatttttctagcatt

SEQ ID NO: 8444586 - DNA, 22 bp, Homo sapiens
tgagtctctgcactaaggagag

SEQ ID NO: 8444587 - DNA, 22 bp, Homo sapiens
tgagtcctgctgagcagagagg

SEQ ID NO: 8444588 - DNA, 23 bp, Homo sapiens
tgagtctactcaccacaactggg

SEQ ID NO: 8444589 - DNA, 22 bp, Homo sapiens
tgagtcctgctctgggcagggt

SEQ ID NO: 8444590 - DNA, 22 bp, Homo sapiens
tgagtccatagtggatccttca

SEQ ID NO: 8444591 - DNA, 22 bp, Homo sapiens
ccatccaggctgtgggtgagct

SEQ ID NO: 8444592 - DNA, 22 bp, Homo sapiens
ccatccagaccagtccatgggt

SEQ ID NO: 8444593 - DNA, 22 bp, Homo sapiens
ccatcctgcaggacctccatat

SEQ ID NO: 8444594 - DNA, 22 bp, Homo sapiens
ccatcctgcaggacctccatat

SEQ ID NO: 8444595 - DNA, 22 bp, Homo sapiens
ccatcctgaatggtctcagcca

SEQ ID NO: 8444596 - DNA, 22 bp, Homo sapiens
tcttctctgtggcctggtggtg

SEQ ID NO: 8444597 - DNA, 22 bp, Homo sapiens
tcttctctgtggcctggtggtg

SEQ ID NO: 8444598 - DNA, 22 bp, Homo sapiens
tcttctctcctgcttggcagaa

SEQ ID NO: 8444599 - DNA, 22 bp, Homo sapiens
tcttacccggcaacgtgtgtcg

SEQ ID NO: 8444600 - DNA, 22 bp, Homo sapiens
tcttagaaaaatggtatgtttt

SEQ ID NO: 8444601 - DNA, 22 bp, Homo sapiens
tcttagaaactgtatcgattag

SEQ ID NO: 8444602 - DNA, 22 bp, Homo sapiens
tcttagaaatgaagttctttct

SEQ ID NO: 8444603 - DNA, 22 bp, Homo sapiens
tcttagaaattccccagtggct

SEQ ID NO: 8444604 - DNA, 22 bp, Homo sapiens
tcttagaagtttatggcacgga

SEQ ID NO: 8444605 - DNA, 22 bp, Homo sapiens
tcttagaagttcatgttccagc

SEQ ID NO: 8444606 - DNA, 22 bp, Homo sapiens
tcttctggatcgatcacattgt

SEQ ID NO: 8444607 - DNA, 22 bp, Homo sapiens
tcttctggatgagagcggaggc

SEQ ID NO: 8444608 - DNA, 22 bp, Homo sapiens
tcttctggatcgatcacattgt

SEQ ID NO: 8444609 - DNA, 17 bp, Homo sapiens
tcttctcttccagtctt

SEQ ID NO: 8444610 - DNA, 22 bp, Homo sapiens
ccaggcaggcgatggtgcagtg

SEQ ID NO: 8444611 - DNA, 22 bp, Homo sapiens
ccaggcaggcgatggtgcagtg

SEQ ID NO: 8444612 - DNA, 22 bp, Homo sapiens
ccaggcaggcagcgttctcagg

SEQ ID NO: 8444613 - DNA, 22 bp, Homo sapiens
ccaggcagccaagtgtgtgtgt

SEQ ID NO: 8444614 - DNA, 22 bp, Homo sapiens
ccaggcagcctgctccattctg

SEQ ID NO: 8444615 - DNA, 22 bp, Homo sapiens
ccaggcagcctgctccattctg

SEQ ID NO: 8444616 - DNA, 22 bp, Homo sapiens
ccaggcagctctgatttatgtc

SEQ ID NO: 8444617 - DNA, 19 bp, Homo sapiens
ccaggcctcctgggaggtc

SEQ ID NO: 8444618 - DNA, 22 bp, Homo sapiens
ccaggcctcctgtgagtggacc

SEQ ID NO: 8444619 - DNA, 22 bp, Homo sapiens
ccaggcctcctgtgagtggacc

SEQ ID NO: 8444620 - DNA, 22 bp, Homo sapiens
ccaggcaggcgatggtgcagtg

SEQ ID NO: 8444621 - DNA, 22 bp, Homo sapiens
tcttacgaattcttagaggaca

SEQ ID NO: 8444622 - DNA, 22 bp, Homo sapiens
tcttacccggcaacgtgtgtcg

SEQ ID NO: 8444623 - DNA, 22 bp, Homo sapiens
tcttacatatacgtcatttagt

SEQ ID NO: 8444624 - DNA, 22 bp, Homo sapiens
tcttacaccattcaaatatttt

SEQ ID NO: 8444625 - DNA, 20 bp, Homo sapiens
tcttacaatcgttacatcca

SEQ ID NO: 8444626 - DNA, 22 bp, Homo sapiens
ccaggcagcaaattttctgaat

SEQ ID NO: 8444627 - DNA, 22 bp, Homo sapiens
ccaggcagagggaatagcaagt

SEQ ID NO: 8444628 - DNA, 22 bp, Homo sapiens
ccaggcagagggatccccatcc

SEQ ID NO: 8444629 - DNA, 22 bp, Homo sapiens
ccaggcagagtgctccagaaag

SEQ ID NO: 8444630 - DNA, 22 bp, Homo sapiens
ccaggcagagtgctccagaaag

SEQ ID NO: 8444631 - DNA, 22 bp, Homo sapiens
ccaggcagatgggccggcttca

SEQ ID NO: 8444632 - DNA, 22 bp, Homo sapiens
ccaggaggctcttgtccctggt

SEQ ID NO: 8444633 - DNA, 22 bp, Homo sapiens
ccaggaggctctgcccatccca

SEQ ID NO: 8444634 - DNA, 22 bp, Homo sapiens
ccaggaggctctgactggaccc

SEQ ID NO: 8444635 - DNA, 22 bp, Homo sapiens
ccaggaggctctgactggaccc

SEQ ID NO: 8444636 - DNA, 22 bp, Homo sapiens
ccaggaggcggaggttgcagtg

SEQ ID NO: 8444637 - DNA, 22 bp, Homo sapiens
ccaggaggcggaggttgcagcg

SEQ ID NO: 8444638 - DNA, 22 bp, Homo sapiens
ccaggaggcggaggttgcagtg

SEQ ID NO: 8444639 - DNA, 22 bp, Homo sapiens
ccaggaggcttcgtccgtggag

SEQ ID NO: 8444640 - DNA, 22 bp, Homo sapiens
ccaggcaagtagaagctgtggt

SEQ ID NO: 8444641 - DNA, 22 bp, Homo sapiens
ccaggcacttgtttgccaggca

SEQ ID NO: 8444642 - DNA, 22 bp, Homo sapiens
ccaggcacttgtttgccaggca

SEQ ID NO: 8444643 - DNA, 21 bp, Homo sapiens
ccaggcagagctgtgagttct

SEQ ID NO: 8444644 - DNA, 22 bp, Homo sapiens
ccaggcagaatgaaacccctgt

SEQ ID NO: 8444645 - DNA, 20 bp, Homo sapiens
tctgttattgcatgtacata

SEQ ID NO: 8444646 - DNA, 22 bp, Homo sapiens
ccaggagcctgggccaggctgg

SEQ ID NO: 8444647 - DNA, 22 bp, Homo sapiens
ccaggagcaccaggcctgtgcc

SEQ ID NO: 8444648 - DNA, 22 bp, Homo sapiens
ccaggagcaccaggcctgtgcc

SEQ ID NO: 8444649 - DNA, 22 bp, Homo sapiens
ccaggagcaccaggcctgtgcc

SEQ ID NO: 8444650 - DNA, 22 bp, Homo sapiens
ccaggagcagatatggacataa

SEQ ID NO: 8444651 - DNA, 22 bp, Homo sapiens
ccaggagcagatatggacataa

SEQ ID NO: 8444652 - DNA, 22 bp, Homo sapiens
ccaggagcagagtaggtgttca

SEQ ID NO: 8444653 - DNA, 22 bp, Homo sapiens
ccaggagcaggagctgcagctg

SEQ ID NO: 8444654 - DNA, 22 bp, Homo sapiens
ccaggagcaggagctgcagctg

SEQ ID NO: 8444655 - DNA, 22 bp, Homo sapiens
ccaggagcagccggcccacctg

SEQ ID NO: 8444656 - DNA, 19 bp, Homo sapiens
ccaggagcagtggtgagct

SEQ ID NO: 8444657 - DNA, 22 bp, Homo sapiens
ccaggagcattaagagaacata

SEQ ID NO: 8444658 - DNA, 22 bp, Homo sapiens
ccaggagccactcaggcccaca

SEQ ID NO: 8444659 - DNA, 22 bp, Homo sapiens
ccaggagcagggctggctgcac

SEQ ID NO: 8444660 - DNA, 22 bp, Homo sapiens
ccaggagcagggctggctgcac

SEQ ID NO: 8444661 - DNA, 22 bp, Homo sapiens
ccaggagcaggagctggacaga

SEQ ID NO: 8444662 - DNA, 22 bp, Homo sapiens
ccaggagcagggctggctgcac

SEQ ID NO: 8444663 - DNA, 22 bp, Homo sapiens
ccaggagcagggctggctgcac

SEQ ID NO: 8444664 - DNA, 22 bp, Homo sapiens
tctgggcctgtctcagagctgg

SEQ ID NO: 8444665 - DNA, 22 bp, Homo sapiens
tctgggctctgggaattaggga

SEQ ID NO: 8444666 - DNA, 22 bp, Homo sapiens
tctgggctctgcgaagcccttc

SEQ ID NO: 8444667 - DNA, 22 bp, Homo sapiens
tctgggctcacgagtctggaca

SEQ ID NO: 8444668 - DNA, 22 bp, Homo sapiens
tctgggccttggagtggggaga

SEQ ID NO: 8444669 - DNA, 22 bp, Homo sapiens
tctgggctatatggtctctgct

SEQ ID NO: 8444670 - DNA, 22 bp, Homo sapiens
tctgggccctgagatgttcttc

SEQ ID NO: 8444671 - DNA, 22 bp, Homo sapiens
ccagcactcgctgattttagga

SEQ ID NO: 8444672 - DNA, 22 bp, Homo sapiens
ccagcaccttgatcttggagtt

SEQ ID NO: 8444673 - DNA, 22 bp, Homo sapiens
ccagcactcctgtctcaagtct

SEQ ID NO: 8444674 - DNA, 22 bp, Homo sapiens
ccagcactctattgaatattct

SEQ ID NO: 8444675 - DNA, 22 bp, Homo sapiens
tctgggccctaaaccagctcta

SEQ ID NO: 8444676 - DNA, 20 bp, Homo sapiens
tctgggagggacaagtctcc

SEQ ID NO: 8444677 - DNA, 22 bp, Homo sapiens
tctgggctctgtcagcacctct

SEQ ID NO: 8444678 - DNA, 22 bp, Homo sapiens
tctgggcttttgcactggccat

SEQ ID NO: 8444679 - DNA, 22 bp, Homo sapiens
tctggggaatgttcatttctga

SEQ ID NO: 8444680 - DNA, 21 bp, Homo sapiens
tctggggaagacatctaggat

SEQ ID NO: 8444681 - DNA, 22 bp, Homo sapiens
tctgggcttttgcactggccat

SEQ ID NO: 8444682 - DNA, 21 bp, Homo sapiens
tctggggaagacatctaggat

SEQ ID NO: 8444683 - DNA, 22 bp, Homo sapiens
tctggggaccatggcatctaaa

SEQ ID NO: 8444684 - DNA, 22 bp, Homo sapiens
tctggggagggagccacaggtc

SEQ ID NO: 8444685 - DNA, 22 bp, Homo sapiens
tctggggagcagccctggtgag

SEQ ID NO: 8444686 - DNA, 22 bp, Homo sapiens
tctggggagtcaaagagacctg

SEQ ID NO: 8444687 - DNA, 22 bp, Homo sapiens
tctggggagtgcctaagtggaa

SEQ ID NO: 8444688 - DNA, 22 bp, Homo sapiens
ccaggagcaaagatcactggga

SEQ ID NO: 8444689 - DNA, 22 bp, Homo sapiens
ccaggagcaacttgaaggcaag

SEQ ID NO: 8444690 - DNA, 22 bp, Homo sapiens
ccagggaagattagaagccact

SEQ ID NO: 8444691 - DNA, 22 bp, Homo sapiens
ccagggagggtcctgtggcttc

SEQ ID NO: 8444692 - DNA, 22 bp, Homo sapiens
ccagggagggtcctgtggcttc

SEQ ID NO: 8444693 - DNA, 22 bp, Homo sapiens
ccagggagggtcctgtggcttc

SEQ ID NO: 8444694 - DNA, 17 bp, Homo sapiens
ccagggaggggccgcgc

SEQ ID NO: 8444695 - DNA, 17 bp, Homo sapiens
ccagggaggggccgcgc

SEQ ID NO: 8444696 - DNA, 23 bp, Homo sapiens
ccagggaggttgattggttaccc

SEQ ID NO: 8444697 - DNA, 22 bp, Homo sapiens
ccagggagggtcctgtggcttc

SEQ ID NO: 8444698 - DNA, 22 bp, Homo sapiens
ccagggagtttccaatctgaga

SEQ ID NO: 8444699 - DNA, 23 bp, Homo sapiens
ccagggagtgctactatcaagcc

SEQ ID NO: 8444700 - DNA, 22 bp, Homo sapiens
ccagggatgctttcccaggact

SEQ ID NO: 8444701 - DNA, 22 bp, Homo sapiens
ccagggatgccaagctttacca

SEQ ID NO: 8444702 - DNA, 22 bp, Homo sapiens
ccagggatgcagaggttgcagt

SEQ ID NO: 8444703 - DNA, 22 bp, Homo sapiens
ccagggcacgttgggacagtac

SEQ ID NO: 8444704 - DNA, 22 bp, Homo sapiens
ccagggcaggggctggagttca

SEQ ID NO: 8444705 - DNA, 22 bp, Homo sapiens
ccagggcaacgctgtctcagag

SEQ ID NO: 8444706 - DNA, 22 bp, Homo sapiens
ccagggcaacgctgtctcagag

SEQ ID NO: 8444707 - DNA, 22 bp, Homo sapiens
ccagggcagtgggagaaggtgc

SEQ ID NO: 8444708 - DNA, 22 bp, Homo sapiens
tgaagtctctgttttctcattt

SEQ ID NO: 8444709 - DNA, 22 bp, Homo sapiens
ccagggctgagctgtgaccatg

SEQ ID NO: 8444710 - DNA, 22 bp, Homo sapiens
ccagggctctgcttctgccatg

SEQ ID NO: 8444711 - DNA, 22 bp, Homo sapiens
ccagggctctatgagggtggag

SEQ ID NO: 8444712 - DNA, 22 bp, Homo sapiens
ccagggcctacagcttaagtcc

SEQ ID NO: 8444713 - DNA, 22 bp, Homo sapiens
ccagggctccattgctcatcct

SEQ ID NO: 8444714 - DNA, 22 bp, Homo sapiens
ccagggcctcgtgttctgagtg

SEQ ID NO: 8444715 - DNA, 22 bp, Homo sapiens
ccagggcctacagcttaagtcc

SEQ ID NO: 8444716 - DNA, 23 bp, Homo sapiens
ccaggcctctcagagggtgtgcc

SEQ ID NO: 8444717 - DNA, 23 bp, Homo sapiens
ccaggcctctcagagggtgtgcc

SEQ ID NO: 8444718 - DNA, 19 bp, Homo sapiens
ccaggcctctggggcctgt

SEQ ID NO: 8444719 - DNA, 22 bp, Homo sapiens
ccaggcctctggctgcttagtc

SEQ ID NO: 8444720 - DNA, 22 bp, Homo sapiens
ccaggcctctggctgcttagtc

SEQ ID NO: 8444721 - DNA, 22 bp, Homo sapiens
ccaggcctgattgggaatcttg

SEQ ID NO: 8444722 - DNA, 19 bp, Homo sapiens
tcttgcagccccagcaggc

SEQ ID NO: 8444723 - DNA, 22 bp, Homo sapiens
tcttgcagaggcactgtgtcag

SEQ ID NO: 8444724 - DNA, 22 bp, Homo sapiens
tcttttctgccacagcctgagc

SEQ ID NO: 8444725 - DNA, 22 bp, Homo sapiens
tctttgtaaatgcctagcataa

SEQ ID NO: 8444726 - DNA, 22 bp, Homo sapiens
tcttttctgtaactcagtgtct

SEQ ID NO: 8444727 - DNA, 22 bp, Homo sapiens
tcttgcatacactatatgtaca

SEQ ID NO: 8444728 - DNA, 22 bp, Homo sapiens
tctttggttgcactgcaggtgt

SEQ ID NO: 8444729 - DNA, 22 bp, Homo sapiens
tcttttcttgcattattgcact

SEQ ID NO: 8444730 - DNA, 22 bp, Homo sapiens
tcttttgagggccagaggaaga

SEQ ID NO: 8444731 - DNA, 22 bp, Homo sapiens
tcttttcttgcattattgcact

SEQ ID NO: 8444732 - DNA, 22 bp, Homo sapiens
tcttttggaaatgatgtgcagg

SEQ ID NO: 8444733 - DNA, 22 bp, Homo sapiens
ccaggcttctgattccaggcac

SEQ ID NO: 8444734 - DNA, 22 bp, Homo sapiens
ccaggcttgaagggaagaatgg

SEQ ID NO: 8444735 - DNA, 22 bp, Homo sapiens
ccaggcttcctaatgtgtgcag

SEQ ID NO: 8444736 - DNA, 22 bp, Homo sapiens
ccaggcttccctgagaggctgc

SEQ ID NO: 8444737 - DNA, 22 bp, Homo sapiens
ccaggcttcccccatcctagga

SEQ ID NO: 8444738 - DNA, 21 bp, Homo sapiens
ccaggctgggagggcagttcc

SEQ ID NO: 8444739 - DNA, 21 bp, Homo sapiens
ccaggctgggagggcagttcc

SEQ ID NO: 8444740 - DNA, 22 bp, Homo sapiens
ccaggctgtaagagtgatgttg

SEQ ID NO: 8444741 - DNA, 22 bp, Homo sapiens
ccaggctgtaagagtgatgttg

SEQ ID NO: 8444742 - DNA, 22 bp, Homo sapiens
ccaggctgtgcttttcataaat

SEQ ID NO: 8444743 - DNA, 22 bp, Homo sapiens
ccaggctgtgcttttcataaat

SEQ ID NO: 8444744 - DNA, 22 bp, Homo sapiens
ccaggctgtggtttagatagag

SEQ ID NO: 8444745 - DNA, 22 bp, Homo sapiens
ccaggctgttttcaaacttggg

SEQ ID NO: 8444746 - DNA, 22 bp, Homo sapiens
ccaggctgttttcaaacttggg

SEQ ID NO: 8444747 - DNA, 22 bp, Homo sapiens
ccaggctgtggtttagatagag

SEQ ID NO: 8444748 - DNA, 22 bp, Homo sapiens
tgaaacagagtggatacagtga

SEQ ID NO: 8444749 - DNA, 22 bp, Homo sapiens
tgaaacagagtggatacagtga

SEQ ID NO: 8444750 - DNA, 22 bp, Homo sapiens
tgaaacaattagaatgtaatga

SEQ ID NO: 8444751 - DNA, 22 bp, Homo sapiens
tcttttgtgattctttagttac

SEQ ID NO: 8444752 - DNA, 22 bp, Homo sapiens
tcttttgtgattcttcagttac

SEQ ID NO: 8444753 - DNA, 22 bp, Homo sapiens
tcttttgtgattctttagttac

SEQ ID NO: 8444754 - DNA, 19 bp, Homo sapiens
ctgtctgtgcagagatgtg

SEQ ID NO: 8444755 - DNA, 22 bp, Homo sapiens
ctgtctgtcaagttcatctcca

SEQ ID NO: 8444756 - DNA, 17 bp, Homo sapiens
ctgtctgctgcttcctc

SEQ ID NO: 8444757 - DNA, 22 bp, Homo sapiens
ctgtctggaatgcagtacatag

SEQ ID NO: 8444758 - DNA, 17 bp, Homo sapiens
ctgtctgcgcatgaggt

SEQ ID NO: 8444759 - DNA, 22 bp, Homo sapiens
ctgtgctgattcagcacaggcc

SEQ ID NO: 8444760 - DNA, 22 bp, Homo sapiens
ctgtgctctgagcgtggggttg

SEQ ID NO: 8444761 - DNA, 22 bp, Homo sapiens
ctgtgctgaacaattctgcatt

SEQ ID NO: 8444762 - DNA, 22 bp, Homo sapiens
ctgtgctctggcatcgctgcaa

SEQ ID NO: 8444763 - DNA, 22 bp, Homo sapiens
ctgtgccctctttgctggcctt

SEQ ID NO: 8444764 - DNA, 22 bp, Homo sapiens
ctgtgctggtgaaacccacaga

SEQ ID NO: 8444765 - DNA, 22 bp, Homo sapiens
ctgtgctgattcagcacaggcc

SEQ ID NO: 8444766 - DNA, 22 bp, Homo sapiens
ctgtatttgtcctctatttatt

SEQ ID NO: 8444767 - DNA, 22 bp, Homo sapiens
ctgtatttgaaagaaaagattt

SEQ ID NO: 8444768 - DNA, 22 bp, Homo sapiens
ctgtataaacatattttcaagt

SEQ ID NO: 8444769 - DNA, 22 bp, Homo sapiens
ctgtaggtttgctctgacctgg

SEQ ID NO: 8444770 - DNA, 22 bp, Homo sapiens
ctgtaggcttagctagaagtga

SEQ ID NO: 8444771 - DNA, 22 bp, Homo sapiens
ctgtaggtgattgctatgttat

SEQ ID NO: 8444772 - DNA, 22 bp, Homo sapiens
ctgtcaaattcataacacttat

SEQ ID NO: 8444773 - DNA, 22 bp, Homo sapiens
ctgtcaaagactaaggttctta

SEQ ID NO: 8444774 - DNA, 22 bp, Homo sapiens
ctgtcaaagactaaggttctta

SEQ ID NO: 8444775 - DNA, 22 bp, Homo sapiens
ctgtctctgttgcctgtaggtg

SEQ ID NO: 8444776 - DNA, 22 bp, Homo sapiens
ctgtctctgttgcctgtaggtg

SEQ ID NO: 8444777 - DNA, 22 bp, Homo sapiens
ctgtctgccctggccagagccc

SEQ ID NO: 8444778 - DNA, 22 bp, Homo sapiens
ctgtcaggtttcccggctcacg

SEQ ID NO: 8444779 - DNA, 22 bp, Homo sapiens
ctgtcaggtttcccatctgcaa

SEQ ID NO: 8444780 - DNA, 21 bp, Homo sapiens
ctgtcacctgctcagagaggg

SEQ ID NO: 8444781 - DNA, 22 bp, Homo sapiens
ctgtcagggggcctggccatca

SEQ ID NO: 8444782 - DNA, 22 bp, Homo sapiens
ctgtcaggaagctgggcatcca

SEQ ID NO: 8444783 - DNA, 22 bp, Homo sapiens
ctggtgagactcagggatgctt

SEQ ID NO: 8444784 - DNA, 22 bp, Homo sapiens
ctggtgagacggttgacaggag

SEQ ID NO: 8444785 - DNA, 22 bp, Homo sapiens
ctggtgcaagattccctgcttc

SEQ ID NO: 8444786 - DNA, 22 bp, Homo sapiens
ctggtgcaagattccctgcttc

SEQ ID NO: 8444787 - DNA, 19 bp, Homo sapiens
ctggtgagggttattgata

SEQ ID NO: 8444788 - DNA, 22 bp, Homo sapiens
ctggtgcatgtggccttgctct

SEQ ID NO: 8444789 - DNA, 22 bp, Homo sapiens
ctggtgcaggaaggagctggca

SEQ ID NO: 8444790 - DNA, 22 bp, Homo sapiens
ctggtgcactacagcctggaac

SEQ ID NO: 8444791 - DNA, 22 bp, Homo sapiens
ctggtgcacgtggctgcagtcg

SEQ ID NO: 8444792 - DNA, 22 bp, Homo sapiens
ctgtaaaactgcttaagtatgc

SEQ ID NO: 8444793 - DNA, 22 bp, Homo sapiens
ctgtaaaacactgtagtatctg

SEQ ID NO: 8444794 - DNA, 22 bp, Homo sapiens
ctgtaaaacactgtagtatctg

SEQ ID NO: 8444795 - DNA, 22 bp, Homo sapiens
ctggtgccctgtgtggcaggag

SEQ ID NO: 8444796 - DNA, 22 bp, Homo sapiens
ctggtgccattctgtggcctag

SEQ ID NO: 8444797 - DNA, 22 bp, Homo sapiens
ctgtacaaaagaaagttcctat

SEQ ID NO: 8444798 - DNA, 22 bp, Homo sapiens
ctgtaaaatgaacctagtcatc

SEQ ID NO: 8444799 - DNA, 22 bp, Homo sapiens
ctgtaaaatgaacctagtcatc

SEQ ID NO: 8444800 - DNA, 22 bp, Homo sapiens
ctgtaaaactgcttaagtatgc

SEQ ID NO: 8444801 - DNA, 22 bp, Homo sapiens
ctgtacaagtccttcatcaggg

SEQ ID NO: 8444802 - DNA, 22 bp, Homo sapiens
ctgtacagacctattagcccag

SEQ ID NO: 8444803 - DNA, 22 bp, Homo sapiens
ctgtacagaagctagagcaaat

SEQ ID NO: 8444804 - DNA, 22 bp, Homo sapiens
ctgtacaggagacgtctgtgca

SEQ ID NO: 8444805 - DNA, 22 bp, Homo sapiens
ctgtacaggtcaatgataagat

SEQ ID NO: 8444806 - DNA, 22 bp, Homo sapiens
ctgtacagagttctgagtgtac

SEQ ID NO: 8444807 - DNA, 22 bp, Homo sapiens
ctgtacagattgcacacgggga

SEQ ID NO: 8444808 - DNA, 22 bp, Homo sapiens
ctgtacagcaagttcaccttgg

SEQ ID NO: 8444809 - DNA, 19 bp, Homo sapiens
ctgtacaggttgcttctgg

SEQ ID NO: 8444810 - DNA, 22 bp, Homo sapiens
ctgtacaggtgaggagggggct

SEQ ID NO: 8444811 - DNA, 22 bp, Homo sapiens
ctgtacatatacatttttttcc

SEQ ID NO: 8444812 - DNA, 22 bp, Homo sapiens
ctgtacatcccgagagccagta

SEQ ID NO: 8444813 - DNA, 22 bp, Homo sapiens
ctgtagcagacagaccctaggt

SEQ ID NO: 8444814 - DNA, 22 bp, Homo sapiens
ctgtagcagtgttccagcattg

SEQ ID NO: 8444815 - DNA, 22 bp, Homo sapiens
ctgtagcaagttattcaataaa

SEQ ID NO: 8444816 - DNA, 22 bp, Homo sapiens
ctgtagaggaacaagagctctt

SEQ ID NO: 8444817 - DNA, 20 bp, Homo sapiens
ctgtagagcacaagtggagg

SEQ ID NO: 8444818 - DNA, 20 bp, Homo sapiens
ctggggagctgctcccacga

SEQ ID NO: 8444819 - DNA, 22 bp, Homo sapiens
ctggtcagagcaactgctcaca

SEQ ID NO: 8444820 - DNA, 22 bp, Homo sapiens
ctggtgacatttccggctgcca

SEQ ID NO: 8444821 - DNA, 22 bp, Homo sapiens
ctggtgaatggataaactgttg

SEQ ID NO: 8444822 - DNA, 22 bp, Homo sapiens
ctggtgaatattggaggcattg

SEQ ID NO: 8444823 - DNA, 22 bp, Homo sapiens
ctggtctgtccgcaggtcacct

SEQ ID NO: 8444824 - DNA, 19 bp, Homo sapiens
ctggtctgtcatgctcccc

SEQ ID NO: 8444825 - DNA, 22 bp, Homo sapiens
ctggtctggctacccagcgaat

SEQ ID NO: 8444826 - DNA, 19 bp, Homo sapiens
ctggtctgctgcttccagg

SEQ ID NO: 8444827 - DNA, 22 bp, Homo sapiens
ctggtctgcaaggccatataga

SEQ ID NO: 8444828 - DNA, 22 bp, Homo sapiens
ctggggaatagagctggagacc

SEQ ID NO: 8444829 - DNA, 22 bp, Homo sapiens
ctggggactcattcagagcata

SEQ ID NO: 8444830 - DNA, 22 bp, Homo sapiens
ctggggaccgagcaagctctgg

SEQ ID NO: 8444831 - DNA, 22 bp, Homo sapiens
ctggggaatagagctggagacc

SEQ ID NO: 8444832 - DNA, 22 bp, Homo sapiens
ctggggaaggcggtgactgcgc

SEQ ID NO: 8444833 - DNA, 22 bp, Homo sapiens
ctggggactttggttctccatg

SEQ ID NO: 8444834 - DNA, 22 bp, Homo sapiens
ctgggcttttgagtcacaaggg

SEQ ID NO: 8444835 - DNA, 22 bp, Homo sapiens
ctgggctttgaagccaggctgc

SEQ ID NO: 8444836 - DNA, 21 bp, Homo sapiens
ctgggctttctctcaaagaca

SEQ ID NO: 8444837 - DNA, 22 bp, Homo sapiens
ctggggaacgcagcgagcagcg

SEQ ID NO: 8444838 - DNA, 22 bp, Homo sapiens
ctggggaaggcggtgactgcgc

SEQ ID NO: 8444839 - DNA, 22 bp, Homo sapiens
ctggggaacaatttgccacact

SEQ ID NO: 8444840 - DNA, 22 bp, Homo sapiens
ctgggcttaggacctggtgcgg

SEQ ID NO: 8444841 - DNA, 22 bp, Homo sapiens
ctgggcttgtgttagctgacaa

SEQ ID NO: 8444842 - DNA, 22 bp, Homo sapiens
ctgggcttgtgttagctgacaa

SEQ ID NO: 8444843 - DNA, 22 bp, Homo sapiens
ctgggccttgcatcccagagcc

SEQ ID NO: 8444844 - DNA, 22 bp, Homo sapiens
ctgggccttgatcacacaggtg

SEQ ID NO: 8444845 - DNA, 22 bp, Homo sapiens
ctgggccttgccttgcccacag

SEQ ID NO: 8444846 - DNA, 22 bp, Homo sapiens
ctgggccttgccttgcccacag

SEQ ID NO: 8444847 - DNA, 22 bp, Homo sapiens
ctgggccttgcatcccagagcc

SEQ ID NO: 8444848 - DNA, 22 bp, Homo sapiens
ctgggccttgccaggggtgtct

SEQ ID NO: 8444849 - DNA, 22 bp, Homo sapiens
ctgggccttatgagtacctgga

SEQ ID NO: 8444850 - DNA, 22 bp, Homo sapiens
ctgggccttagggcactccctt

SEQ ID NO: 8444851 - DNA, 22 bp, Homo sapiens
ctgggccttgagaatcatgttt

SEQ ID NO: 8444852 - DNA, 22 bp, Homo sapiens
ctgggccttcattgctctccca

SEQ ID NO: 8444853 - DNA, 22 bp, Homo sapiens
ctgggccttcattgctctccca

SEQ ID NO: 8444854 - DNA, 17 bp, Homo sapiens
ctgggcctcccctgtcc

SEQ ID NO: 8444855 - DNA, 17 bp, Homo sapiens
ctgggcctcccctgtcc

SEQ ID NO: 8444856 - DNA, 22 bp, Homo sapiens
ctgggcctccagctctgccagc

SEQ ID NO: 8444857 - DNA, 22 bp, Homo sapiens
ctgggcctggtgtggcacctgc

SEQ ID NO: 8444858 - DNA, 22 bp, Homo sapiens
ctgggcctggtgtggcacctgc

SEQ ID NO: 8444859 - DNA, 22 bp, Homo sapiens
ctgggcctcctctgcccaagct

SEQ ID NO: 8444860 - DNA, 22 bp, Homo sapiens
ctgggcctcctctgcccaagct

SEQ ID NO: 8444861 - DNA, 22 bp, Homo sapiens
ctgggcctcctctgcccaagct

SEQ ID NO: 8444862 - DNA, 22 bp, Homo sapiens
ctgggcctgtgactcccatcct

SEQ ID NO: 8444863 - DNA, 22 bp, Homo sapiens
ctgggcctgtgggcacacggac

SEQ ID NO: 8444864 - DNA, 22 bp, Homo sapiens
ctgggcctgtgactcccatcct

SEQ ID NO: 8444865 - DNA, 22 bp, Homo sapiens
ctgggcctgtgactcccatcct

SEQ ID NO: 8444866 - DNA, 22 bp, Homo sapiens
ctgggcctgtcagggctttttg

SEQ ID NO: 8444867 - DNA, 22 bp, Homo sapiens
ctgggcctgtccctgattgagg

SEQ ID NO: 8444868 - DNA, 22 bp, Homo sapiens
ctgggcctgtccctgattgagg

SEQ ID NO: 8444869 - DNA, 22 bp, Homo sapiens
ctgggccttggattgacactgt

SEQ ID NO: 8444870 - DNA, 22 bp, Homo sapiens
ctgggcctttgggagttcggtg

SEQ ID NO: 8444871 - DNA, 18 bp, Homo sapiens
ctgggcctttgtattttt

SEQ ID NO: 8444872 - DNA, 22 bp, Homo sapiens
ctgggcctttgcttattaattt

SEQ ID NO: 8444873 - DNA, 22 bp, Homo sapiens
ctgggcctttacctacggagtt

SEQ ID NO: 8444874 - DNA, 22 bp, Homo sapiens
ctgggcgtgtcttccagctggc

SEQ ID NO: 8444875 - DNA, 22 bp, Homo sapiens
ctgggcttagcagctcctggtc

SEQ ID NO: 8444876 - DNA, 22 bp, Homo sapiens
ctgggctcaaatcctatctcca

SEQ ID NO: 8444877 - DNA, 22 bp, Homo sapiens
ctgggcactgcagcaggcatca

SEQ ID NO: 8444878 - DNA, 22 bp, Homo sapiens
ctgggcacttgctcacagctct

SEQ ID NO: 8444879 - DNA, 22 bp, Homo sapiens
ctgggcaaattgtgccagctat

SEQ ID NO: 8444880 - DNA, 22 bp, Homo sapiens
ctgggagcggctgtcactggtt

SEQ ID NO: 8444881 - DNA, 22 bp, Homo sapiens
ctgggagccctgactagcctgg

SEQ ID NO: 8444882 - DNA, 22 bp, Homo sapiens
ctgggagcccgcgtcctggtgg

SEQ ID NO: 8444883 - DNA, 22 bp, Homo sapiens
ctgggagcgcagcaggcacaac

SEQ ID NO: 8444884 - DNA, 22 bp, Homo sapiens
ctgggagcaagtcaggaaaggt

SEQ ID NO: 8444885 - DNA, 22 bp, Homo sapiens
ctgggagattgctagagatgca

SEQ ID NO: 8444886 - DNA, 22 bp, Homo sapiens
ctgggagattgctagagatgca

SEQ ID NO: 8444887 - DNA, 22 bp, Homo sapiens
ctgggagattgctagagatgca

SEQ ID NO: 8444888 - DNA, 22 bp, Homo sapiens
ctgggagattgctagagatgca

SEQ ID NO: 8444889 - DNA, 22 bp, Homo sapiens
ctgggcagctgtatcagggagt

SEQ ID NO: 8444890 - DNA, 22 bp, Homo sapiens
ctgggcagctgtatcagggagt

SEQ ID NO: 8444891 - DNA, 22 bp, Homo sapiens
ctgggcctccagctctgccagc

SEQ ID NO: 8444892 - DNA, 22 bp, Homo sapiens
ctgggcagcctcacacaatgtt

SEQ ID NO: 8444893 - DNA, 22 bp, Homo sapiens
ctgggcagctaccaccactgct

SEQ ID NO: 8444894 - DNA, 22 bp, Homo sapiens
ctgggcagagtccggaagatgg

SEQ ID NO: 8444895 - DNA, 22 bp, Homo sapiens
ctgggcagcacatcatcgtatc

SEQ ID NO: 8444896 - DNA, 22 bp, Homo sapiens
ctgggcagagctaacacctgag

SEQ ID NO: 8444897 - DNA, 22 bp, Homo sapiens
ctgggcactttggggagcctac

SEQ ID NO: 8444898 - DNA, 22 bp, Homo sapiens
ctgggcagaattttaggatggc

SEQ ID NO: 8444899 - DNA, 22 bp, Homo sapiens
ctgggcagaattttaggatggc

SEQ ID NO: 8444900 - DNA, 22 bp, Homo sapiens
ctgggacacccaaggaaagagc

SEQ ID NO: 8444901 - DNA, 22 bp, Homo sapiens
ctgggacagagcagcagtgggg

SEQ ID NO: 8444902 - DNA, 22 bp, Homo sapiens
ctgggaagaagtgggctacatt

SEQ ID NO: 8444903 - DNA, 22 bp, Homo sapiens
ctgggaagatggtgacagaatt

SEQ ID NO: 8444904 - DNA, 20 bp, Homo sapiens
ctgcttccaggctcaccccc

SEQ ID NO: 8444905 - DNA, 22 bp, Homo sapiens
ctgcttccatgcaatggcagtc

SEQ ID NO: 8444906 - DNA, 21 bp, Homo sapiens
ctgcttcctctcttcatggca

SEQ ID NO: 8444907 - DNA, 22 bp, Homo sapiens
ctgctgttccacctctgaatgc

SEQ ID NO: 8444908 - DNA, 23 bp, Homo sapiens
ctgctgtgttggtctcgatggga

SEQ ID NO: 8444909 - DNA, 22 bp, Homo sapiens
ctgctgtttggtgagtgagaaa

SEQ ID NO: 8444910 - DNA, 22 bp, Homo sapiens
ctgctgtttgccgtcattgcct

SEQ ID NO: 8444911 - DNA, 22 bp, Homo sapiens
ctgctgtgttcctcctgcatct

SEQ ID NO: 8444912 - DNA, 22 bp, Homo sapiens
ctgctgtgcacccaggaaggct

SEQ ID NO: 8444913 - DNA, 22 bp, Homo sapiens
ctgggagattgaggccatggtg

SEQ ID NO: 8444914 - DNA, 22 bp, Homo sapiens
ctgggagattgctagagatgca

SEQ ID NO: 8444915 - DNA, 22 bp, Homo sapiens
ctgggagatgactcagagcagg

SEQ ID NO: 8444916 - DNA, 22 bp, Homo sapiens
ctgggagatgactcagagcagg

SEQ ID NO: 8444917 - DNA, 22 bp, Homo sapiens
ctgggagatgactcagagcagg

SEQ ID NO: 8444918 - DNA, 22 bp, Homo sapiens
ctgggagatctgttgggactgg

SEQ ID NO: 8444919 - DNA, 22 bp, Homo sapiens
ctgggagatctcctgagggcag

SEQ ID NO: 8444920 - DNA, 22 bp, Homo sapiens
ctgggagaggtggtgggaagta

SEQ ID NO: 8444921 - DNA, 22 bp, Homo sapiens
ctgggagaggtggtgggaagta

SEQ ID NO: 8444922 - DNA, 22 bp, Homo sapiens
ctgggagaggtggtgggaagta

SEQ ID NO: 8444923 - DNA, 22 bp, Homo sapiens
ctgggagatatgaggatctgga

SEQ ID NO: 8444924 - DNA, 22 bp, Homo sapiens
ctgggacctcctcactgttcta

SEQ ID NO: 8444925 - DNA, 22 bp, Homo sapiens
ctgggacatgatagaaacagat

SEQ ID NO: 8444926 - DNA, 22 bp, Homo sapiens
ctgggacatggtgctgtcttta

SEQ ID NO: 8444927 - DNA, 22 bp, Homo sapiens
ctgggacattataagaaacatt

SEQ ID NO: 8444928 - DNA, 22 bp, Homo sapiens
ctgggacagttcaggtagggca

SEQ ID NO: 8444929 - DNA, 22 bp, Homo sapiens
ctgggacagctgagacaggaga

SEQ ID NO: 8444930 - DNA, 22 bp, Homo sapiens
cttctaattcttatgtaagctt

SEQ ID NO: 8444931 - DNA, 22 bp, Homo sapiens
cttctagagctggagcaaatgt

SEQ ID NO: 8444932 - DNA, 22 bp, Homo sapiens
cttctcagcattttgtcagtct

SEQ ID NO: 8444933 - DNA, 22 bp, Homo sapiens
cttctcagcttaggtatggttt

SEQ ID NO: 8444934 - DNA, 22 bp, Homo sapiens
cttctattcactggtcacagtt

SEQ ID NO: 8444935 - DNA, 23 bp, Homo sapiens
cttctcagaagtctgtgccagga

SEQ ID NO: 8444936 - DNA, 23 bp, Homo sapiens
cttctcagaagtctgtgccagga

SEQ ID NO: 8444937 - DNA, 20 bp, Homo sapiens
cttccaccagggccgctgat

SEQ ID NO: 8444938 - DNA, 22 bp, Homo sapiens
cttccagctgattacaggctat

SEQ ID NO: 8444939 - DNA, 22 bp, Homo sapiens
cttccagagttgcgttctcggt

SEQ ID NO: 8444940 - DNA, 22 bp, Homo sapiens
cttagccctgagagttctgagc

SEQ ID NO: 8444941 - DNA, 22 bp, Homo sapiens
cttagcagtgggtaccagggct

SEQ ID NO: 8444942 - DNA, 22 bp, Homo sapiens
cttagctagtgctcagctgtca

SEQ ID NO: 8444943 - DNA, 22 bp, Homo sapiens
cttagcttctctgcatctgtgt

SEQ ID NO: 8444944 - DNA, 22 bp, Homo sapiens
cttaggaacgctctgcctagtg

SEQ ID NO: 8444945 - DNA, 22 bp, Homo sapiens
cttaggaagcttttgaggacaa

SEQ ID NO: 8444946 - DNA, 22 bp, Homo sapiens
cttaggaagcgggacctgtgca

SEQ ID NO: 8444947 - DNA, 22 bp, Homo sapiens
cttaggaatatccacagcaggt

SEQ ID NO: 8444948 - DNA, 22 bp, Homo sapiens
cttaggaatatccacagcaggt

SEQ ID NO: 8444949 - DNA, 22 bp, Homo sapiens
cttaggaatgtcccttcccaca

SEQ ID NO: 8444950 - DNA, 22 bp, Homo sapiens
cttaggaatgcgtttcctgggt

SEQ ID NO: 8444951 - DNA, 22 bp, Homo sapiens
cttaggatttaatttcagactc

SEQ ID NO: 8444952 - DNA, 22 bp, Homo sapiens
cttaggagttcacttgaatagt

SEQ ID NO: 8444953 - DNA, 22 bp, Homo sapiens
cttatacacgaacacaaggtgt

SEQ ID NO: 8444954 - DNA, 22 bp, Homo sapiens
cttataaagtccatctgaacaa

SEQ ID NO: 8444955 - DNA, 22 bp, Homo sapiens
cttataaagtccatctgaacaa

SEQ ID NO: 8444956 - DNA, 22 bp, Homo sapiens
cttatagatggcgatcttcttg

SEQ ID NO: 8444957 - DNA, 22 bp, Homo sapiens
cttatagaatgtttttatatgt

SEQ ID NO: 8444958 - DNA, 22 bp, Homo sapiens
cttatagaattagagagatttt

SEQ ID NO: 8444959 - DNA, 22 bp, Homo sapiens
cttatatttgtcaactttacaa

SEQ ID NO: 8444960 - DNA, 22 bp, Homo sapiens
cttatagtatgatgttgagaat

SEQ ID NO: 8444961 - DNA, 22 bp, Homo sapiens
cttcagttagccaattcaggtc

SEQ ID NO: 8444962 - DNA, 22 bp, Homo sapiens
cttccaaaatttatatgttgaa

SEQ ID NO: 8444963 - DNA, 22 bp, Homo sapiens
cttccaaatgtaaataagtttc

SEQ ID NO: 8444964 - DNA, 22 bp, Homo sapiens
cttcatttcaggctgaagaata

SEQ ID NO: 8444965 - DNA, 19 bp, Homo sapiens
ctgtttctgagcttgcttt

SEQ ID NO: 8444966 - DNA, 19 bp, Homo sapiens
ctgtttctgagcttgcttt

SEQ ID NO: 8444967 - DNA, 22 bp, Homo sapiens
ctgtttatcatgtacatttcca

SEQ ID NO: 8444968 - DNA, 22 bp, Homo sapiens
ctgtttatcatgtacatttcca

SEQ ID NO: 8444969 - DNA, 22 bp, Homo sapiens
ctgtttatagcagagcaagcct

SEQ ID NO: 8444970 - DNA, 22 bp, Homo sapiens
ctgtttacttattggtaaagag

SEQ ID NO: 8444971 - DNA, 22 bp, Homo sapiens
ctgtttatactcaaaagataca

SEQ ID NO: 8444972 - DNA, 22 bp, Homo sapiens
ctgtttataaaccaccagttta

SEQ ID NO: 8444973 - DNA, 22 bp, Homo sapiens
ctgtggaaggcctgtcctgaaa

SEQ ID NO: 8444974 - DNA, 22 bp, Homo sapiens
ctgtggaaggacttagcgatac

SEQ ID NO: 8444975 - DNA, 20 bp, Homo sapiens
ctgtgctttggaacctggaa

SEQ ID NO: 8444976 - DNA, 22 bp, Homo sapiens
ctgtggaacttagtgggagaca

SEQ ID NO: 8444977 - DNA, 22 bp, Homo sapiens
ctgtggaacttagtgggagaca

SEQ ID NO: 8444978 - DNA, 22 bp, Homo sapiens
ctgtggaaataaacaatgctaa

SEQ ID NO: 8444979 - DNA, 22 bp, Homo sapiens
ctgtggaaagagcctttggagg

SEQ ID NO: 8444980 - DNA, 22 bp, Homo sapiens
ctgtggaaaatttgtatgtaat

SEQ ID NO: 8444981 - DNA, 22 bp, Homo sapiens
ctgtggaaagagcctttggagg

SEQ ID NO: 8444982 - DNA, 22 bp, Homo sapiens
cttaaaatctggcagttagcta

SEQ ID NO: 8444983 - DNA, 22 bp, Homo sapiens
cttaaaatctggcagttagcta

SEQ ID NO: 8444984 - DNA, 22 bp, Homo sapiens
cttaaaatctggcagttagcta

SEQ ID NO: 8444985 - DNA, 20 bp, Homo sapiens
cttaaacacagagatagatt

SEQ ID NO: 8444986 - DNA, 22 bp, Homo sapiens
cttaaactgggcattcagagaa

SEQ ID NO: 8444987 - DNA, 22 bp, Homo sapiens
ctgttttcaaagagagagaatg

SEQ ID NO: 8444988 - DNA, 22 bp, Homo sapiens
ctgtttgttggctattgacagt

SEQ ID NO: 8444989 - DNA, 20 bp, Homo sapiens
ctgtttgctatcatgagctg

SEQ ID NO: 8444990 - DNA, 22 bp, Homo sapiens
cttaattacccaatgtggtagg

SEQ ID NO: 8444991 - DNA, 22 bp, Homo sapiens
cttaattactgtccaatatgca

SEQ ID NO: 8444992 - DNA, 22 bp, Homo sapiens
cttaaattggatgagttaagtt

SEQ ID NO: 8444993 - DNA, 22 bp, Homo sapiens
cttaaattcttaatgccctcat

SEQ ID NO: 8444994 - DNA, 22 bp, Homo sapiens
cttaaaggtcattctgttgata

SEQ ID NO: 8444995 - DNA, 22 bp, Homo sapiens
cttacaaaggagaggagatagg

SEQ ID NO: 8444996 - DNA, 22 bp, Homo sapiens
cttacaaaggagaggagatagg

SEQ ID NO: 8444997 - DNA, 22 bp, Homo sapiens
cttacaaatacacttaggagag

SEQ ID NO: 8444998 - DNA, 22 bp, Homo sapiens
cttagaaatgcagattctcagg

SEQ ID NO: 8444999 - DNA, 22 bp, Homo sapiens
cttagaaatgcagattctcagg

SEQ ID NO: 8445000 - DNA, 22 bp, Homo sapiens
cttagaaatcgaactcaggtta

SEQ ID NO: 8445001 - DNA, 22 bp, Homo sapiens
cttagaaatcgaactcaggtta

SEQ ID NO: 8445002 - DNA, 22 bp, Homo sapiens
cttagaaatgcagattctcagg

SEQ ID NO: 8445003 - DNA, 22 bp, Homo sapiens
cttagcaaggctgcctggagaa

SEQ ID NO: 8445004 - DNA, 22 bp, Homo sapiens
cttagaaataatggtttcagtt

SEQ ID NO: 8445005 - DNA, 22 bp, Homo sapiens
cttagaaataatggtttcagtt

SEQ ID NO: 8445006 - DNA, 22 bp, Homo sapiens
cttagaaatcgaactcaggtta

SEQ ID NO: 8445007 - DNA, 22 bp, Homo sapiens
cttagaaagagttttctcccct

SEQ ID NO: 8445008 - DNA, 22 bp, Homo sapiens
cttagaaataatggtttcagtt

SEQ ID NO: 8445009 - DNA, 22 bp, Homo sapiens
cttagaaagagttttctcccct

SEQ ID NO: 8445010 - DNA, 22 bp, Homo sapiens
cttacattgtgtgcatgagggg

SEQ ID NO: 8445011 - DNA, 22 bp, Homo sapiens
cttacaggaaagaagaaagcat

SEQ ID NO: 8445012 - DNA, 22 bp, Homo sapiens
cttacagtgatcaacacaaaga

SEQ ID NO: 8445013 - DNA, 22 bp, Homo sapiens
cttacagtgatcaacacaaaga

SEQ ID NO: 8445014 - DNA, 22 bp, Homo sapiens
cttacagcattgttcagaggct

SEQ ID NO: 8445015 - DNA, 22 bp, Homo sapiens
cttacaagcaaaacaactgtag

SEQ ID NO: 8445016 - DNA, 22 bp, Homo sapiens
gaaaattattgaaaatggctct

SEQ ID NO: 8445017 - DNA, 22 bp, Homo sapiens
gaaaattattgaaaatggctct

SEQ ID NO: 8445018 - DNA, 22 bp, Homo sapiens
gaaaattattgaaaatggctct

SEQ ID NO: 8445019 - DNA, 22 bp, Homo sapiens
gaaaatacttcagtgttctggc

SEQ ID NO: 8445020 - DNA, 22 bp, Homo sapiens
cttttgcaccttttaagtaatg

SEQ ID NO: 8445021 - DNA, 22 bp, Homo sapiens
cttttgcagccattattgctgc

SEQ ID NO: 8445022 - DNA, 22 bp, Homo sapiens
gaaacaatacttgtcctcacta

SEQ ID NO: 8445023 - DNA, 22 bp, Homo sapiens
gaaaattattgaaaatggctct

SEQ ID NO: 8445024 - DNA, 18 bp, Homo sapiens
gaaagccatgcagcagtg

SEQ ID NO: 8445025 - DNA, 22 bp, Homo sapiens
gaaagatatttattggcaacag

SEQ ID NO: 8445026 - DNA, 22 bp, Homo sapiens
gaaagcatgtagcctgtatcca

SEQ ID NO: 8445027 - DNA, 22 bp, Homo sapiens
gaaagaggaaggagatgtatta

SEQ ID NO: 8445028 - DNA, 22 bp, Homo sapiens
gaaacacatatgaacagttgat

SEQ ID NO: 8445029 - DNA, 22 bp, Homo sapiens
gaaacacatatgaacagttgat

SEQ ID NO: 8445030 - DNA, 22 bp, Homo sapiens
gaaacagattaacagcatattt

SEQ ID NO: 8445031 - DNA, 22 bp, Homo sapiens
cttttctctgcgggtctttcat

SEQ ID NO: 8445032 - DNA, 22 bp, Homo sapiens
cttttcctattgattctgttac

SEQ ID NO: 8445033 - DNA, 22 bp, Homo sapiens
cttttcctcaggaggagacgcg

SEQ ID NO: 8445034 - DNA, 22 bp, Homo sapiens
cttttctggaatcatctctaac

SEQ ID NO: 8445035 - DNA, 22 bp, Homo sapiens
cttttctgagagggccaagatt

SEQ ID NO: 8445036 - DNA, 22 bp, Homo sapiens
cttttctgtcagtgcccaaatt

SEQ ID NO: 8445037 - DNA, 22 bp, Homo sapiens
cttttctgtgatgctgacagtc

SEQ ID NO: 8445038 - DNA, 22 bp, Homo sapiens
cttttctggccaggaacttgcc

SEQ ID NO: 8445039 - DNA, 22 bp, Homo sapiens
cttttctgtgatgctgacagtc

SEQ ID NO: 8445040 - DNA, 22 bp, Homo sapiens
cttttcttactcccgcaaggca

SEQ ID NO: 8445041 - DNA, 22 bp, Homo sapiens
cttttacatttgttgaagagta

SEQ ID NO: 8445042 - DNA, 22 bp, Homo sapiens
cttttacatttgttgaagagta

SEQ ID NO: 8445043 - DNA, 22 bp, Homo sapiens
cttttacagtggacctgccatt

SEQ ID NO: 8445044 - DNA, 22 bp, Homo sapiens
cttttacagtggacctgccatt

SEQ ID NO: 8445045 - DNA, 21 bp, Homo sapiens
cttttacattcagtcatgatg

SEQ ID NO: 8445046 - DNA, 21 bp, Homo sapiens
cttttacattcagtcatgatg

SEQ ID NO: 8445047 - DNA, 22 bp, Homo sapiens
cttctgaagaggttatcataga

SEQ ID NO: 8445048 - DNA, 22 bp, Homo sapiens
cttctcttggtagttcttgttg

SEQ ID NO: 8445049 - DNA, 22 bp, Homo sapiens
cttctgaagtgtttgatgattg

SEQ ID NO: 8445050 - DNA, 22 bp, Homo sapiens
cttctggaggacactggcccca

SEQ ID NO: 8445051 - DNA, 22 bp, Homo sapiens
cttctggagctcaccaacttcc

SEQ ID NO: 8445052 - DNA, 19 bp, Homo sapiens
cttctggccctgagccacc

SEQ ID NO: 8445053 - DNA, 22 bp, Homo sapiens
cttctggcgttggaggtctgag

SEQ ID NO: 8445054 - DNA, 22 bp, Homo sapiens
cttctggcaatcccagggtctt

SEQ ID NO: 8445055 - DNA, 22 bp, Homo sapiens
cttctggcaaaacaggcagaaa

SEQ ID NO: 8445056 - DNA, 22 bp, Homo sapiens
cttctgggagagcttttgcttc

SEQ ID NO: 8445057 - DNA, 23 bp, Homo sapiens
cttctggctctatatcagaattc

SEQ ID NO: 8445058 - DNA, 22 bp, Homo sapiens
cttctggggatggagcccagaa

SEQ ID NO: 8445059 - DNA, 22 bp, Homo sapiens
cttctgggccatggccttcctc

SEQ ID NO: 8445060 - DNA, 22 bp, Homo sapiens
cttctgggcagaagttttgaga

SEQ ID NO: 8445061 - DNA, 22 bp, Homo sapiens
cttctgggttgcaggtcttggc

SEQ ID NO: 8445062 - DNA, 22 bp, Homo sapiens
cttctgggttgcaggtcttggc

SEQ ID NO: 8445063 - DNA, 22 bp, Homo sapiens
cttgtgaaatgccagataatct

SEQ ID NO: 8445064 - DNA, 22 bp, Homo sapiens
ctttaaataatacaaggtccag

SEQ ID NO: 8445065 - DNA, 22 bp, Homo sapiens
cttgttttggctagtatgatgt

SEQ ID NO: 8445066 - DNA, 22 bp, Homo sapiens
cttgttttggctagtatgatgt

SEQ ID NO: 8445067 - DNA, 22 bp, Homo sapiens
cttgttttggaacagagtgaat

SEQ ID NO: 8445068 - DNA, 22 bp, Homo sapiens
cttgttttggaacagagtgaat

SEQ ID NO: 8445069 - DNA, 22 bp, Homo sapiens
cttgttttggctagtatgatgt

SEQ ID NO: 8445070 - DNA, 22 bp, Homo sapiens
cttgtggagatatccatgtctg

SEQ ID NO: 8445071 - DNA, 22 bp, Homo sapiens
ctttaattaggaagtataatga

SEQ ID NO: 8445072 - DNA, 22 bp, Homo sapiens
ctttaattaggaagtataatga

SEQ ID NO: 8445073 - DNA, 22 bp, Homo sapiens
ctttctcttcagcacccagccc

SEQ ID NO: 8445074 - DNA, 22 bp, Homo sapiens
ctttacaaagcaattttgtctc

SEQ ID NO: 8445075 - DNA, 22 bp, Homo sapiens
ctttacaaactataaagtgcgg

SEQ ID NO: 8445076 - DNA, 22 bp, Homo sapiens
ctttgaaaacttaaataacagc

SEQ ID NO: 8445077 - DNA, 22 bp, Homo sapiens
ctttgaaaacacacgaatagac

SEQ ID NO: 8445078 - DNA, 22 bp, Homo sapiens
ctttctttgtccaccaacaatg

SEQ ID NO: 8445079 - DNA, 22 bp, Homo sapiens
ctttgaaaaatggtttcctaga

SEQ ID NO: 8445080 - DNA, 22 bp, Homo sapiens
ctttctcttcgaaaacctgccc

SEQ ID NO: 8445081 - DNA, 22 bp, Homo sapiens
ctttctttgcagtgagccagag

SEQ ID NO: 8445082 - DNA, 22 bp, Homo sapiens
ctttctttgtccaccaacaatg

SEQ ID NO: 8445083 - DNA, 22 bp, Homo sapiens
ctttgaattaacgacacaagtg

SEQ ID NO: 8445084 - DNA, 22 bp, Homo sapiens
ctttgaattccagtacaataac

SEQ ID NO: 8445085 - DNA, 22 bp, Homo sapiens
ctttgaattccagtacaataac

SEQ ID NO: 8445086 - DNA, 22 bp, Homo sapiens
ctttgaaagctcccaggactta

SEQ ID NO: 8445087 - DNA, 22 bp, Homo sapiens
ctttgaaacctgctctgcagaa

SEQ ID NO: 8445088 - DNA, 22 bp, Homo sapiens
ctttgaaattcttcagctgaag

SEQ ID NO: 8445089 - DNA, 22 bp, Homo sapiens
gagcagtgtttgtggacctgga

SEQ ID NO: 8445090 - DNA, 22 bp, Homo sapiens
gagcagtgtttgtggacctgga

SEQ ID NO: 8445091 - DNA, 22 bp, Homo sapiens
gagcagtggtcacagggaggga

SEQ ID NO: 8445092 - DNA, 22 bp, Homo sapiens
gagcagtgggaaggaacagggt

SEQ ID NO: 8445093 - DNA, 22 bp, Homo sapiens
gagcagttatttttagacatga

SEQ ID NO: 8445094 - DNA, 22 bp, Homo sapiens
gagcagttctccttggtagggg

SEQ ID NO: 8445095 - DNA, 22 bp, Homo sapiens
gagcagttgggctctaggaagt

SEQ ID NO: 8445096 - DNA, 22 bp, Homo sapiens
gagcagttttatttcatgagac

SEQ ID NO: 8445097 - DNA, 22 bp, Homo sapiens
gagcagttgggctctaggaagt

SEQ ID NO: 8445098 - DNA, 22 bp, Homo sapiens
gagcatggatagaaggtgggat

SEQ ID NO: 8445099 - DNA, 22 bp, Homo sapiens
gagcatgagggaaggcagcaga

SEQ ID NO: 8445100 - DNA, 22 bp, Homo sapiens
gagcatctgtggtccatcagaa

SEQ ID NO: 8445101 - DNA, 22 bp, Homo sapiens
gagaggggcgcgcagctcgcga

SEQ ID NO: 8445102 - DNA, 22 bp, Homo sapiens
gagaggggcgcgcagctcgcga

SEQ ID NO: 8445103 - DNA, 22 bp, Homo sapiens
gagaggggcccaagccacatag

SEQ ID NO: 8445104 - DNA, 22 bp, Homo sapiens
gagaggggacctgtgtgtctag

SEQ ID NO: 8445105 - DNA, 22 bp, Homo sapiens
gagagggtgcctggaagccagg

SEQ ID NO: 8445106 - DNA, 22 bp, Homo sapiens
gagaggggtttgccatcctatg

SEQ ID NO: 8445107 - DNA, 22 bp, Homo sapiens
gagcaggctctgcctgtgtgtc

SEQ ID NO: 8445108 - DNA, 22 bp, Homo sapiens
gagcagtgactggagcatgaga

SEQ ID NO: 8445109 - DNA, 22 bp, Homo sapiens
gagcccagtctgctcctgcgcc

SEQ ID NO: 8445110 - DNA, 22 bp, Homo sapiens
gagcccaggttctgcttccagc

SEQ ID NO: 8445111 - DNA, 22 bp, Homo sapiens
gagcccaggttctgcttccagc

SEQ ID NO: 8445112 - DNA, 22 bp, Homo sapiens
gagcccaggttctgcttccagc

SEQ ID NO: 8445113 - DNA, 22 bp, Homo sapiens
gagccctgaacaacagcaggaa

SEQ ID NO: 8445114 - DNA, 22 bp, Homo sapiens
gagccctgaacaacagcaggaa

SEQ ID NO: 8445115 - DNA, 22 bp, Homo sapiens
gagccctgacactgagggagtt

SEQ ID NO: 8445116 - DNA, 21 bp, Homo sapiens
gagcccaggcatctcattaat

SEQ ID NO: 8445117 - DNA, 22 bp, Homo sapiens
gagcccaggcagaggttgcagt

SEQ ID NO: 8445118 - DNA, 22 bp, Homo sapiens
gagcccaggctggggttcagag

SEQ ID NO: 8445119 - DNA, 22 bp, Homo sapiens
gagcccaggctggggttcagag

SEQ ID NO: 8445120 - DNA, 22 bp, Homo sapiens
gagcccaggatggtgtatggct

SEQ ID NO: 8445121 - DNA, 22 bp, Homo sapiens
gagcccaggcagaggttgcagt

SEQ ID NO: 8445122 - DNA, 22 bp, Homo sapiens
gagcccaggatggtgtatggct

SEQ ID NO: 8445123 - DNA, 22 bp, Homo sapiens
gagcccagggcaggcaaggcag

SEQ ID NO: 8445124 - DNA, 22 bp, Homo sapiens
gagcccagctgtccttggcaaa

SEQ ID NO: 8445125 - DNA, 22 bp, Homo sapiens
gagcccagctgcggccctcagc

SEQ ID NO: 8445126 - DNA, 22 bp, Homo sapiens
gagcccagctgcggccctcagc

SEQ ID NO: 8445127 - DNA, 22 bp, Homo sapiens
gagcccagcttgcacatggagc

SEQ ID NO: 8445128 - DNA, 22 bp, Homo sapiens
gagcccaggaagtggaggctga

SEQ ID NO: 8445129 - DNA, 22 bp, Homo sapiens
gagcccaggaagtggaggctga

SEQ ID NO: 8445130 - DNA, 22 bp, Homo sapiens
gagcccaggaagtggaggctga

SEQ ID NO: 8445131 - DNA, 22 bp, Homo sapiens
gagcccagctaaatttatataa

SEQ ID NO: 8445132 - DNA, 22 bp, Homo sapiens
gagcccagctctacctcagact

SEQ ID NO: 8445133 - DNA, 22 bp, Homo sapiens
gagcccagctctacctcagact

SEQ ID NO: 8445134 - DNA, 22 bp, Homo sapiens
gagcccagctgcggccctcagc

SEQ ID NO: 8445135 - DNA, 22 bp, Homo sapiens
gagcccagctgcggccctcagc

SEQ ID NO: 8445136 - DNA, 22 bp, Homo sapiens
gagcccagctgcggccctcagc

SEQ ID NO: 8445137 - DNA, 22 bp, Homo sapiens
gagcccagctctacctcagact

SEQ ID NO: 8445138 - DNA, 22 bp, Homo sapiens
gagcccagctctacctcagact

SEQ ID NO: 8445139 - DNA, 22 bp, Homo sapiens
gagcccagctctacctcagact

SEQ ID NO: 8445140 - DNA, 20 bp, Homo sapiens
gagcccaagtagggagaaat

SEQ ID NO: 8445141 - DNA, 22 bp, Homo sapiens
gagccatgagatagttggttcg

SEQ ID NO: 8445142 - DNA, 22 bp, Homo sapiens
gaggaaatggttgttcaggtgg

SEQ ID NO: 8445143 - DNA, 22 bp, Homo sapiens
gaggaaatggttgttcaggtgg

SEQ ID NO: 8445144 - DNA, 21 bp, Homo sapiens
gaggaaatgctctggtgttca

SEQ ID NO: 8445145 - DNA, 22 bp, Homo sapiens
gaggaacagagggcaaggccag

SEQ ID NO: 8445146 - DNA, 22 bp, Homo sapiens
gaggaacaagctgctttatctt

SEQ ID NO: 8445147 - DNA, 22 bp, Homo sapiens
gaggaacagcagccacatgtcc

SEQ ID NO: 8445148 - DNA, 22 bp, Homo sapiens
gaggaagaaagcataggtgggg

SEQ ID NO: 8445149 - DNA, 22 bp, Homo sapiens
gaggaagaaagcataggtgggg

SEQ ID NO: 8445150 - DNA, 20 bp, Homo sapiens
gaggaaccactgggaggaga

SEQ ID NO: 8445151 - DNA, 22 bp, Homo sapiens
gaggaagaatcagggtggtgag

SEQ ID NO: 8445152 - DNA, 22 bp, Homo sapiens
gaggagagagggactgtctgca

SEQ ID NO: 8445153 - DNA, 22 bp, Homo sapiens
gaggaagaagcaaaccagctaa

SEQ ID NO: 8445154 - DNA, 22 bp, Homo sapiens
gaggaagaagggattagaactc

SEQ ID NO: 8445155 - DNA, 18 bp, Homo sapiens
gaggaaacaggctctgtg

SEQ ID NO: 8445156 - DNA, 22 bp, Homo sapiens
gaggaaacattgtagaagcagt

SEQ ID NO: 8445157 - DNA, 18 bp, Homo sapiens
gaggaaacaaggcagagg

SEQ ID NO: 8445158 - DNA, 18 bp, Homo sapiens
gaggaaacaaggcagagg

SEQ ID NO: 8445159 - DNA, 22 bp, Homo sapiens
gaggaaatcattccagaaaagg

SEQ ID NO: 8445160 - DNA, 22 bp, Homo sapiens
gaggaaaatgggacaggctgta

SEQ ID NO: 8445161 - DNA, 22 bp, Homo sapiens
gaggaaaatgggacaggctgta

SEQ ID NO: 8445162 - DNA, 22 bp, Homo sapiens
gagctgctggctcctcaggtta

SEQ ID NO: 8445163 - DNA, 22 bp, Homo sapiens
gagctgctggctcctcaggtta

SEQ ID NO: 8445164 - DNA, 22 bp, Homo sapiens
gagctgcctacattgccaagag

SEQ ID NO: 8445165 - DNA, 22 bp, Homo sapiens
gagctgagcttaactccttgaa

SEQ ID NO: 8445166 - DNA, 22 bp, Homo sapiens
gagctgagggtctaggagggtt

SEQ ID NO: 8445167 - DNA, 22 bp, Homo sapiens
gagccctggcagtctgggatgg

SEQ ID NO: 8445168 - DNA, 22 bp, Homo sapiens
gagccctgtagcaagtcatgtc

SEQ ID NO: 8445169 - DNA, 22 bp, Homo sapiens
gagccctgtagcaagtcatgtc

SEQ ID NO: 8445170 - DNA, 22 bp, Homo sapiens
gagccctgttcaggcctcctca

SEQ ID NO: 8445171 - DNA, 22 bp, Homo sapiens
gagccctgttcaggcctcctca

SEQ ID NO: 8445172 - DNA, 22 bp, Homo sapiens
gagccctgttcaggcctcctca

SEQ ID NO: 8445173 - DNA, 22 bp, Homo sapiens
gagccctgtgattctgttgtgt

SEQ ID NO: 8445174 - DNA, 22 bp, Homo sapiens
gagccctgtaggaatctctcaa

SEQ ID NO: 8445175 - DNA, 18 bp, Homo sapiens
gagccctgagtctgcaca

SEQ ID NO: 8445176 - DNA, 18 bp, Homo sapiens
gagccctgagtctgcaca

SEQ ID NO: 8445177 - DNA, 22 bp, Homo sapiens
gagccctgagagttgtgaggcc

SEQ ID NO: 8445178 - DNA, 22 bp, Homo sapiens
gagccctgcccacttgtctgag

SEQ ID NO: 8445179 - DNA, 22 bp, Homo sapiens
gagccctgcccacttgtctgag

SEQ ID NO: 8445180 - DNA, 22 bp, Homo sapiens
gagccctgatttgcagcatttg

SEQ ID NO: 8445181 - DNA, 22 bp, Homo sapiens
gagccctggcagtctgggatgg

SEQ ID NO: 8445182 - DNA, 22 bp, Homo sapiens
gagccctgcttccaagggggca

SEQ ID NO: 8445183 - DNA, 22 bp, Homo sapiens
gagccctgctgggccttgtctc

SEQ ID NO: 8445184 - DNA, 22 bp, Homo sapiens
gagccctgctgggccttgtctc

SEQ ID NO: 8445185 - DNA, 22 bp, Homo sapiens
gagccctgcgtgtctgggggca

SEQ ID NO: 8445186 - DNA, 22 bp, Homo sapiens
gagccctgcgtgtctgggggca

SEQ ID NO: 8445187 - DNA, 22 bp, Homo sapiens
gagccctgcgtgtctgggggca

SEQ ID NO: 8445188 - DNA, 22 bp, Homo sapiens
gagggctgtgaaggagcgggtt

SEQ ID NO: 8445189 - DNA, 22 bp, Homo sapiens
gagggctgtggggcatgaccag

SEQ ID NO: 8445190 - DNA, 22 bp, Homo sapiens
gagggctggggcttaggcttag

SEQ ID NO: 8445191 - DNA, 22 bp, Homo sapiens
gagggctgctggaaaaatgcag

SEQ ID NO: 8445192 - DNA, 22 bp, Homo sapiens
gaggggctggcacgatggctgc

SEQ ID NO: 8445193 - DNA, 22 bp, Homo sapiens
gaggggctctttaatagtaaca

SEQ ID NO: 8445194 - DNA, 22 bp, Homo sapiens
gagggctgccacgttgggcgag

SEQ ID NO: 8445195 - DNA, 22 bp, Homo sapiens
gagggctgctgccagatatgcc

SEQ ID NO: 8445196 - DNA, 22 bp, Homo sapiens
gagggctgcaatgagacagaga

SEQ ID NO: 8445197 - DNA, 22 bp, Homo sapiens
gagggctgatgttgccacctca

SEQ ID NO: 8445198 - DNA, 22 bp, Homo sapiens
gagggaggtgatactgaacgta

SEQ ID NO: 8445199 - DNA, 22 bp, Homo sapiens
gagggaggtgatactgaacgta

SEQ ID NO: 8445200 - DNA, 18 bp, Homo sapiens
gagggagtagctgaggtt

SEQ ID NO: 8445201 - DNA, 22 bp, Homo sapiens
gagggagtaacgtactacagtg

SEQ ID NO: 8445202 - DNA, 22 bp, Homo sapiens
gagggaggggagctccaccctc

SEQ ID NO: 8445203 - DNA, 22 bp, Homo sapiens
gagggagggccaggtcccaacc

SEQ ID NO: 8445204 - DNA, 22 bp, Homo sapiens
gagggagggactagcattctct

SEQ ID NO: 8445205 - DNA, 22 bp, Homo sapiens
gagggagggaaagtttaacact

SEQ ID NO: 8445206 - DNA, 22 bp, Homo sapiens
gagggaggcatcatgaatccag

SEQ ID NO: 8445207 - DNA, 22 bp, Homo sapiens
gagggagcttgatggatgtttg

SEQ ID NO: 8445208 - DNA, 22 bp, Homo sapiens
gagggagccgccacagactggg

SEQ ID NO: 8445209 - DNA, 22 bp, Homo sapiens
gagggagctatgaatagaagaa

SEQ ID NO: 8445210 - DNA, 22 bp, Homo sapiens
gagggagagtgatggaccattg

SEQ ID NO: 8445211 - DNA, 22 bp, Homo sapiens
gagggagagtgatggaccattg

SEQ ID NO: 8445212 - DNA, 22 bp, Homo sapiens
gaggctgattcggggaacagca

SEQ ID NO: 8445213 - DNA, 22 bp, Homo sapiens
gaggctgattcggggaacagca

SEQ ID NO: 8445214 - DNA, 22 bp, Homo sapiens
gaggctgatgctgcctcacaga

SEQ ID NO: 8445215 - DNA, 22 bp, Homo sapiens
gaggctgatgctgcctcacaga

SEQ ID NO: 8445216 - DNA, 22 bp, Homo sapiens
gaggctgagtagctttgtgctc

SEQ ID NO: 8445217 - DNA, 22 bp, Homo sapiens
gaggctgagactctgaattttt

SEQ ID NO: 8445218 - DNA, 22 bp, Homo sapiens
gaggctgaggcaggaggatcac

SEQ ID NO: 8445219 - DNA, 22 bp, Homo sapiens
gaggctgaggcaggaggatcac

SEQ ID NO: 8445220 - DNA, 22 bp, Homo sapiens
gaggctgaggcggatggatcac

SEQ ID NO: 8445221 - DNA, 22 bp, Homo sapiens
gaggctgagggttagagagtca

SEQ ID NO: 8445222 - DNA, 22 bp, Homo sapiens
gaggctgagggttagagagtca

SEQ ID NO: 8445223 - DNA, 22 bp, Homo sapiens
gaggctgaggttgcagtgagct

SEQ ID NO: 8445224 - DNA, 22 bp, Homo sapiens
gaggctgaggttgcagtgagct

SEQ ID NO: 8445225 - DNA, 22 bp, Homo sapiens
gaggctgaggttgcagtgagcc

SEQ ID NO: 8445226 - DNA, 22 bp, Homo sapiens
gaggctgaggttgcagtgagcc

SEQ ID NO: 8445227 - DNA, 22 bp, Homo sapiens
gaggagaggggctcccaagagc

SEQ ID NO: 8445228 - DNA, 22 bp, Homo sapiens
gaggagcatgggaaggctctgg

SEQ ID NO: 8445229 - DNA, 22 bp, Homo sapiens
gaggagaggctggacgcggtga

SEQ ID NO: 8445230 - DNA, 22 bp, Homo sapiens
gaggagagggctgcgggcccac

SEQ ID NO: 8445231 - DNA, 22 bp, Homo sapiens
gaggagagcctgcactttgacc

SEQ ID NO: 8445232 - DNA, 22 bp, Homo sapiens
gaggagagagggactgtctgca

SEQ ID NO: 8445233 - DNA, 22 bp, Homo sapiens
gaggagaggccatcgttgttat

SEQ ID NO: 8445234 - DNA, 22 bp, Homo sapiens
gaggagagatggtagattgggt

SEQ ID NO: 8445235 - DNA, 22 bp, Homo sapiens
gaggcagcttagggtactgact

SEQ ID NO: 8445236 - DNA, 22 bp, Homo sapiens
gaggagccatagatagtgctgc

SEQ ID NO: 8445237 - DNA, 22 bp, Homo sapiens
gaggagcccagcaccatcactt

SEQ ID NO: 8445238 - DNA, 22 bp, Homo sapiens
gaggcagcttggggctgtgggt

SEQ ID NO: 8445239 - DNA, 22 bp, Homo sapiens
gaggcagcttggggctgtgggt

SEQ ID NO: 8445240 - DNA, 22 bp, Homo sapiens
gaggcagcttggggctgtgggt

SEQ ID NO: 8445241 - DNA, 22 bp, Homo sapiens
gaggcaggaggattgcttgagc

SEQ ID NO: 8445242 - DNA, 22 bp, Homo sapiens
gaggcaggcagattgcttgagg

SEQ ID NO: 8445243 - DNA, 22 bp, Homo sapiens
gaggcataaatcacagtgttca

SEQ ID NO: 8445244 - DNA, 22 bp, Homo sapiens
gaggcagtttgccatgccagga

SEQ ID NO: 8445245 - DNA, 22 bp, Homo sapiens
gaggcagttcctgagtgacaag

SEQ ID NO: 8445246 - DNA, 22 bp, Homo sapiens
gaggcagtgtttactgccctgt

SEQ ID NO: 8445247 - DNA, 22 bp, Homo sapiens
gaggctcacctagggagcactg

SEQ ID NO: 8445248 - DNA, 22 bp, Homo sapiens
gaggctcaacccacaggggttg

SEQ ID NO: 8445249 - DNA, 22 bp, Homo sapiens
gaggctcagagaagtcatggta

SEQ ID NO: 8445250 - DNA, 22 bp, Homo sapiens
gaggctcactgggcaaagactc

SEQ ID NO: 8445251 - DNA, 22 bp, Homo sapiens
gaggctcactaggcatcctggg

SEQ ID NO: 8445252 - DNA, 22 bp, Homo sapiens
gaggctcacgacgggacgaact

SEQ ID NO: 8445253 - DNA, 19 bp, Homo sapiens
gaggcagtagtcaaagctt

SEQ ID NO: 8445254 - DNA, 22 bp, Homo sapiens
gaggcagtaattgtgggcaata

SEQ ID NO: 8445255 - DNA, 22 bp, Homo sapiens
gaggcagtgcattgtctagggg

SEQ ID NO: 8445256 - DNA, 22 bp, Homo sapiens
gaggcagtggtctgatgcaagg

SEQ ID NO: 8445257 - DNA, 22 bp, Homo sapiens
gaggcaggccctgaatgagtca

SEQ ID NO: 8445258 - DNA, 22 bp, Homo sapiens
gaggctgaagtgtacatgggtg

SEQ ID NO: 8445259 - DNA, 22 bp, Homo sapiens
gaggctgaagtgtacatgggtg

SEQ ID NO: 8445260 - DNA, 20 bp, Homo sapiens
gaggctgaagtgtttttgct

SEQ ID NO: 8445261 - DNA, 22 bp, Homo sapiens
gaggctgaatggccagaagcca

SEQ ID NO: 8445262 - DNA, 22 bp, Homo sapiens
gaggctgagagtttgttctact

SEQ ID NO: 8445263 - DNA, 22 bp, Homo sapiens
gaggctgacggcaccatcttct

SEQ ID NO: 8445264 - DNA, 22 bp, Homo sapiens
gaggctgagactctgaattttt

SEQ ID NO: 8445265 - DNA, 22 bp, Homo sapiens
gaggctgaatggccagaagcca

SEQ ID NO: 8445266 - DNA, 22 bp, Homo sapiens
gaggctcattgcattgtgcatt

SEQ ID NO: 8445267 - DNA, 22 bp, Homo sapiens
gaggctccagcgacacctaggc

SEQ ID NO: 8445268 - DNA, 22 bp, Homo sapiens
gaggctgaacaggttctcatga

SEQ ID NO: 8445269 - DNA, 22 bp, Homo sapiens
gaggctgaagtgtacatgggtg

SEQ ID NO: 8445270 - DNA, 22 bp, Homo sapiens
gaggctcagttatgtcatcagg

SEQ ID NO: 8445271 - DNA, 22 bp, Homo sapiens
gaggctcagggagtatatgaat

SEQ ID NO: 8445272 - DNA, 22 bp, Homo sapiens
gaggctcagggaaacagcgcag

SEQ ID NO: 8445273 - DNA, 22 bp, Homo sapiens
gaggctcagagaggtccacata

SEQ ID NO: 8445274 - DNA, 22 bp, Homo sapiens
gaggctcagagggagcatggtc

SEQ ID NO: 8445275 - DNA, 22 bp, Homo sapiens
gaatcttaaatcggaatcttaa

SEQ ID NO: 8445276 - DNA, 20 bp, Homo sapiens
gaatcttactacattctctc

SEQ ID NO: 8445277 - DNA, 20 bp, Homo sapiens
gaatctttccccatgcaatg

SEQ ID NO: 8445278 - DNA, 22 bp, Homo sapiens
gaatcttatttttaaatcttcc

SEQ ID NO: 8445279 - DNA, 22 bp, Homo sapiens
gaatcttatccccagtccttaa

SEQ ID NO: 8445280 - DNA, 22 bp, Homo sapiens
gaatcttaaatcggaatcttaa

SEQ ID NO: 8445281 - DNA, 22 bp, Homo sapiens
gaatctcagtggaagcaggaag

SEQ ID NO: 8445282 - DNA, 22 bp, Homo sapiens
gaatctcattctaactagtagg

SEQ ID NO: 8445283 - DNA, 17 bp, Homo sapiens
gaatccttctctgttct

SEQ ID NO: 8445284 - DNA, 22 bp, Homo sapiens
gaatctagggcctagatcacag

SEQ ID NO: 8445285 - DNA, 22 bp, Homo sapiens
gaatctaaaaacgggcttggtt

SEQ ID NO: 8445286 - DNA, 22 bp, Homo sapiens
gaatcccttgcaagttgttgta

SEQ ID NO: 8445287 - DNA, 22 bp, Homo sapiens
gaatctcaaattaagaatttta

SEQ ID NO: 8445288 - DNA, 22 bp, Homo sapiens
gaatctatgcctcatatagacc

SEQ ID NO: 8445289 - DNA, 22 bp, Homo sapiens
gaatctcaggaagatctctgca

SEQ ID NO: 8445290 - DNA, 22 bp, Homo sapiens
gaatctcaggaagatctctgca

SEQ ID NO: 8445291 - DNA, 22 bp, Homo sapiens
gaaggttctgtgtacactactt

SEQ ID NO: 8445292 - DNA, 17 bp, Homo sapiens
gaaggtttctcttaggt

SEQ ID NO: 8445293 - DNA, 22 bp, Homo sapiens
gaaggggaaagttgagcaaata

SEQ ID NO: 8445294 - DNA, 22 bp, Homo sapiens
gaaggggaaagttgagcaaata

SEQ ID NO: 8445295 - DNA, 19 bp, Homo sapiens
gaaggggaaggtgggtacc

SEQ ID NO: 8445296 - DNA, 22 bp, Homo sapiens
gaaggggactggcagctgcaga

SEQ ID NO: 8445297 - DNA, 22 bp, Homo sapiens
gaaggggactggcagctgcaga

SEQ ID NO: 8445298 - DNA, 22 bp, Homo sapiens
gaaggtccagcgtggccaagtc

SEQ ID NO: 8445299 - DNA, 22 bp, Homo sapiens
gaaggtgcagtggctggaggct

SEQ ID NO: 8445300 - DNA, 22 bp, Homo sapiens
gaagggtgcatggagggaagtc

SEQ ID NO: 8445301 - DNA, 22 bp, Homo sapiens
gaagggggttgcagtctagggt

SEQ ID NO: 8445302 - DNA, 22 bp, Homo sapiens
gacactttggtgctttgtggtt

SEQ ID NO: 8445303 - DNA, 22 bp, Homo sapiens
gacactttctcaggtaaagcat

SEQ ID NO: 8445304 - DNA, 22 bp, Homo sapiens
gacactttattaagctgttgtt

SEQ ID NO: 8445305 - DNA, 22 bp, Homo sapiens
gacagaaggcatctagggcacg

SEQ ID NO: 8445306 - DNA, 22 bp, Homo sapiens
gacagacaggtgtggtaggcac

SEQ ID NO: 8445307 - DNA, 22 bp, Homo sapiens
gaatgatattatttcgtgctgg

SEQ ID NO: 8445308 - DNA, 21 bp, Homo sapiens
gacacagtaatcttggggctt

SEQ ID NO: 8445309 - DNA, 22 bp, Homo sapiens
gacacagtcaagagtggaggaa

SEQ ID NO: 8445310 - DNA, 22 bp, Homo sapiens
gaatgacattgaaaagacattg

SEQ ID NO: 8445311 - DNA, 22 bp, Homo sapiens
gaatgatatattagcagatttt

SEQ ID NO: 8445312 - DNA, 22 bp, Homo sapiens
gaatgatagagctgccttcgga

SEQ ID NO: 8445313 - DNA, 22 bp, Homo sapiens
gaatgataaatggaagcagcat

SEQ ID NO: 8445314 - DNA, 22 bp, Homo sapiens
gaatgagtattctttataggat

SEQ ID NO: 8445315 - DNA, 22 bp, Homo sapiens
gaatgagtagagtataaacaaa

SEQ ID NO: 8445316 - DNA, 22 bp, Homo sapiens
gaatgaataggtgtccagatgg

SEQ ID NO: 8445317 - DNA, 22 bp, Homo sapiens
gaatgaattcagcacatggaat

SEQ ID NO: 8445318 - DNA, 21 bp, Homo sapiens
gaatctttgatttacatggga

SEQ ID NO: 8445319 - DNA, 22 bp, Homo sapiens
gaaggcattctattctacatat

SEQ ID NO: 8445320 - DNA, 22 bp, Homo sapiens
gaaggccaagaggctccaagat

SEQ ID NO: 8445321 - DNA, 22 bp, Homo sapiens
gaaggccaagaggctccaagat

SEQ ID NO: 8445322 - DNA, 22 bp, Homo sapiens
gaaggccacaaaaaatgtcata

SEQ ID NO: 8445323 - DNA, 22 bp, Homo sapiens
gaaggccacaagagaagttaag

SEQ ID NO: 8445324 - DNA, 22 bp, Homo sapiens
gaaggccacggaatggagctgg

SEQ ID NO: 8445325 - DNA, 22 bp, Homo sapiens
gaaggccactttgtgttgagaa

SEQ ID NO: 8445326 - DNA, 22 bp, Homo sapiens
gaaggccagttttgagataggt

SEQ ID NO: 8445327 - DNA, 22 bp, Homo sapiens
gaaggccatttttaggtagaat

SEQ ID NO: 8445328 - DNA, 22 bp, Homo sapiens
gaaggccattgcgtcctgggat

SEQ ID NO: 8445329 - DNA, 22 bp, Homo sapiens
gaaggccattagagcctgtgcc

SEQ ID NO: 8445330 - DNA, 22 bp, Homo sapiens
gaaggccagttttgagataggt

SEQ ID NO: 8445331 - DNA, 22 bp, Homo sapiens
gaaggccattagagcctgtgcc

SEQ ID NO: 8445332 - DNA, 22 bp, Homo sapiens
gaaggccagttttgagataggt

SEQ ID NO: 8445333 - DNA, 22 bp, Homo sapiens
gaagggagaaggttgggtgacg

SEQ ID NO: 8445334 - DNA, 22 bp, Homo sapiens
gaagggagaaggttgggtgacg

SEQ ID NO: 8445335 - DNA, 22 bp, Homo sapiens
gaaggagctaccaagactgaat

SEQ ID NO: 8445336 - DNA, 22 bp, Homo sapiens
gaaggagccgagctcttcccca

SEQ ID NO: 8445337 - DNA, 20 bp, Homo sapiens
gaagccagaggggaaaggag

SEQ ID NO: 8445338 - DNA, 22 bp, Homo sapiens
gaaggcagggaatgtggtgcta

SEQ ID NO: 8445339 - DNA, 22 bp, Homo sapiens
gaaggcagggaatgtggtgcta

SEQ ID NO: 8445340 - DNA, 22 bp, Homo sapiens
gaaggcagggaatgtggtgcta

SEQ ID NO: 8445341 - DNA, 22 bp, Homo sapiens
gaaaggagagggttaaggagct

SEQ ID NO: 8445342 - DNA, 17 bp, Homo sapiens
gaaaggaggcaacactg

SEQ ID NO: 8445343 - DNA, 22 bp, Homo sapiens
gaaaggagggaaacagagcggt

SEQ ID NO: 8445344 - DNA, 22 bp, Homo sapiens
gaaaggagtgctttccaggtct

SEQ ID NO: 8445345 - DNA, 22 bp, Homo sapiens
gaaagctgaaccaggaaccatg

SEQ ID NO: 8445346 - DNA, 22 bp, Homo sapiens
gaaagctgtgaaatagtgctct

SEQ ID NO: 8445347 - DNA, 22 bp, Homo sapiens
gaaagctgaaccaggaaccatg

SEQ ID NO: 8445348 - DNA, 22 bp, Homo sapiens
gaaagctgggaaataaatatta

SEQ ID NO: 8445349 - DNA, 22 bp, Homo sapiens
gaaagctgggaaataaatatta

SEQ ID NO: 8445350 - DNA, 22 bp, Homo sapiens
gaaaggaagaaaggtcatttta

SEQ ID NO: 8445351 - DNA, 22 bp, Homo sapiens
gaagcatgctaaggattctcag

SEQ ID NO: 8445352 - DNA, 22 bp, Homo sapiens
gaagccaagggctgcttttcct

SEQ ID NO: 8445353 - DNA, 22 bp, Homo sapiens
gaagcagtttctgtaatgaaat

SEQ ID NO: 8445354 - DNA, 22 bp, Homo sapiens
gaagcagttcgaaagcagttgg

SEQ ID NO: 8445355 - DNA, 22 bp, Homo sapiens
gaagcagtgtgaacccatgtaa

SEQ ID NO: 8445356 - DNA, 20 bp, Homo sapiens
gaagcagcttcatgtagaca

SEQ ID NO: 8445357 - DNA, 22 bp, Homo sapiens
gaagcagctttctggtgaggag

SEQ ID NO: 8445358 - DNA, 22 bp, Homo sapiens
gaagcagtatcctgacagcacc

SEQ ID NO: 8445359 - DNA, 22 bp, Homo sapiens
gaagcagtcagcagcacctttg

SEQ ID NO: 8445360 - DNA, 22 bp, Homo sapiens
gaagcagtatcctgacagcacc

SEQ ID NO: 8445361 - DNA, 22 bp, Homo sapiens
gaagcagtgtgaacccatgtaa

SEQ ID NO: 8445362 - DNA, 22 bp, Homo sapiens
gaagcagtagcaactgtgtctt

SEQ ID NO: 8445363 - DNA, 22 bp, Homo sapiens
gaagcagtagattcctactcat

SEQ ID NO: 8445364 - DNA, 22 bp, Homo sapiens
gaagcaagtggcctgattcaga

SEQ ID NO: 8445365 - DNA, 22 bp, Homo sapiens
gaagcaagtggcctgattcaga

SEQ ID NO: 8445366 - DNA, 22 bp, Homo sapiens
gaagcaagtgcaaggaagaggc

SEQ ID NO: 8445367 - DNA, 22 bp, Homo sapiens
gaagcaagtgcaaggaagaggc

SEQ ID NO: 8445368 - DNA, 22 bp, Homo sapiens
gaagcaagtgcaaggaagaggc

SEQ ID NO: 8445369 - DNA, 22 bp, Homo sapiens
gaagcaaaatgtctgcacatat

SEQ ID NO: 8445370 - DNA, 22 bp, Homo sapiens
gaagcaaagagctagtgccgct

SEQ ID NO: 8445371 - DNA, 22 bp, Homo sapiens
gaagcaaagagctagtgccgct

SEQ ID NO: 8445372 - DNA, 22 bp, Homo sapiens
gaagcagctagcccactagtca

SEQ ID NO: 8445373 - DNA, 22 bp, Homo sapiens
gaagcagctcagattgactgaa

SEQ ID NO: 8445374 - DNA, 22 bp, Homo sapiens
gaagcagccacggggagacaga

SEQ ID NO: 8445375 - DNA, 22 bp, Homo sapiens
gaagcagctagcccactagtca

SEQ ID NO: 8445376 - DNA, 22 bp, Homo sapiens
gaagcagcgaagtggaagggac

SEQ ID NO: 8445377 - DNA, 22 bp, Homo sapiens
gagaaaggcattcctatgcaaa

SEQ ID NO: 8445378 - DNA, 22 bp, Homo sapiens
gagacagatctcggctccatgc

SEQ ID NO: 8445379 - DNA, 22 bp, Homo sapiens
gagaaaggcattcctatgcaaa

SEQ ID NO: 8445380 - DNA, 22 bp, Homo sapiens
gagaccaggaagtacagcagcc

SEQ ID NO: 8445381 - DNA, 22 bp, Homo sapiens
gagacattcttaggaacaatgt

SEQ ID NO: 8445382 - DNA, 22 bp, Homo sapiens
gagacagatgctgctggagcat

SEQ ID NO: 8445383 - DNA, 22 bp, Homo sapiens
gagacagatgctgctggagcat

SEQ ID NO: 8445384 - DNA, 22 bp, Homo sapiens
gagaaagattgtccttcagggg

SEQ ID NO: 8445385 - DNA, 22 bp, Homo sapiens
gagaaacttggagttattctgg

SEQ ID NO: 8445386 - DNA, 22 bp, Homo sapiens
gagaaacttggagttattctgg

SEQ ID NO: 8445387 - DNA, 18 bp, Homo sapiens
gagaaacctgtgaatgct

SEQ ID NO: 8445388 - DNA, 22 bp, Homo sapiens
gagaaacctgtaaggaaggaag

SEQ ID NO: 8445389 - DNA, 18 bp, Homo sapiens
gagaaacctgtgaatgct

SEQ ID NO: 8445390 - DNA, 22 bp, Homo sapiens
gagaaacctgtaaggaaggaag

SEQ ID NO: 8445391 - DNA, 22 bp, Homo sapiens
gagaaagatgaagagtggcgtt

SEQ ID NO: 8445392 - DNA, 19 bp, Homo sapiens
gagaaaccccgtctttagg

SEQ ID NO: 8445393 - DNA, 22 bp, Homo sapiens
gagaaaccgattctgcatgtca

SEQ ID NO: 8445394 - DNA, 19 bp, Homo sapiens
gagaaaccccgtctttagg

SEQ ID NO: 8445395 - DNA, 23 bp, Homo sapiens
gagaaacctcggtaagcaggagg

SEQ ID NO: 8445396 - DNA, 22 bp, Homo sapiens
gagaaaccgattctgcatgtca

SEQ ID NO: 8445397 - DNA, 23 bp, Homo sapiens
gagaaacctcggtaagcaggagg

SEQ ID NO: 8445398 - DNA, 22 bp, Homo sapiens
gagagaaaggcttgcaggctgt

SEQ ID NO: 8445399 - DNA, 22 bp, Homo sapiens
gagagaaatgtgcagtttgggc

SEQ ID NO: 8445400 - DNA, 22 bp, Homo sapiens
gagagaagaaagccatggtcct

SEQ ID NO: 8445401 - DNA, 22 bp, Homo sapiens
gagagggcaaacttgtagctaa

SEQ ID NO: 8445402 - DNA, 22 bp, Homo sapiens
gagagggcaaacttgtagctaa

SEQ ID NO: 8445403 - DNA, 18 bp, Homo sapiens
gagagggatccctcagga

SEQ ID NO: 8445404 - DNA, 22 bp, Homo sapiens
gagagggccagggtgagaacta

SEQ ID NO: 8445405 - DNA, 22 bp, Homo sapiens
gagagggccgggggccagctcc

SEQ ID NO: 8445406 - DNA, 22 bp, Homo sapiens
gagagggccgggggccagctcc

SEQ ID NO: 8445407 - DNA, 22 bp, Homo sapiens
gagagggccgggggccagctcc

SEQ ID NO: 8445408 - DNA, 22 bp, Homo sapiens
gagagggcaaggtagatgctac

SEQ ID NO: 8445409 - DNA, 21 bp, Homo sapiens
gagagggcattataggaagtg

SEQ ID NO: 8445410 - DNA, 22 bp, Homo sapiens
gagactgggggcttggcctttt

SEQ ID NO: 8445411 - DNA, 22 bp, Homo sapiens
gagactcttgctttaatagccc

SEQ ID NO: 8445412 - DNA, 22 bp, Homo sapiens
gagacctggaggatgtggatgg

SEQ ID NO: 8445413 - DNA, 22 bp, Homo sapiens
gagaccttaagagatgtcagct

SEQ ID NO: 8445414 - DNA, 22 bp, Homo sapiens
gagaccccagctcagcctccag

SEQ ID NO: 8445415 - DNA, 22 bp, Homo sapiens
gagactggtgtttgctgggctg

SEQ ID NO: 8445416 - DNA, 22 bp, Homo sapiens
gactgaggaggtaaggtttgaa

SEQ ID NO: 8445417 - DNA, 22 bp, Homo sapiens
gactgagcttctgcaacactgg

SEQ ID NO: 8445418 - DNA, 22 bp, Homo sapiens
gactgagaatcatagaaggcaa

SEQ ID NO: 8445419 - DNA, 22 bp, Homo sapiens
gactctttcaaacagaaagcca

SEQ ID NO: 8445420 - DNA, 22 bp, Homo sapiens
gactctttccctgtgacagagt

SEQ ID NO: 8445421 - DNA, 22 bp, Homo sapiens
gactgagaaacagtacattacc

SEQ ID NO: 8445422 - DNA, 22 bp, Homo sapiens
gactgaggtattaagatggctt

SEQ ID NO: 8445423 - DNA, 22 bp, Homo sapiens
gactgaggtattaagatggctt

SEQ ID NO: 8445424 - DNA, 22 bp, Homo sapiens
gactcctggctttccctcttag

SEQ ID NO: 8445425 - DNA, 22 bp, Homo sapiens
gactcctgcctcctctgtttgc

SEQ ID NO: 8445426 - DNA, 22 bp, Homo sapiens
gaccagctggtcctgtcctggg

SEQ ID NO: 8445427 - DNA, 22 bp, Homo sapiens
gaccagctggtgaaaaccaatt

SEQ ID NO: 8445428 - DNA, 22 bp, Homo sapiens
gaccagctacttgtacagttca

SEQ ID NO: 8445429 - DNA, 22 bp, Homo sapiens
gaccagctctctgaagaaagag

SEQ ID NO: 8445430 - DNA, 22 bp, Homo sapiens
gaccagctgataaggcatataa

SEQ ID NO: 8445431 - DNA, 17 bp, Homo sapiens
gaccaggagaaaccagg

SEQ ID NO: 8445432 - DNA, 22 bp, Homo sapiens
gaccaggctagttcagagcttc

SEQ ID NO: 8445433 - DNA, 22 bp, Homo sapiens
gaccaggagatttgagctaggc

SEQ ID NO: 8445434 - DNA, 22 bp, Homo sapiens
gactccaggtgtccaggcctcc

SEQ ID NO: 8445435 - DNA, 22 bp, Homo sapiens
gactccaggtgtccaggcctcc

SEQ ID NO: 8445436 - DNA, 22 bp, Homo sapiens
gactccaggtgcaggaggagcc

SEQ ID NO: 8445437 - DNA, 22 bp, Homo sapiens
gactccaggtgcaggaggagcc

SEQ ID NO: 8445438 - DNA, 22 bp, Homo sapiens
gaccacagcagtgcaagaggag

SEQ ID NO: 8445439 - DNA, 22 bp, Homo sapiens
gaccacagctacaagggcaagg

SEQ ID NO: 8445440 - DNA, 22 bp, Homo sapiens
gaccacagctacaagggcaagg

SEQ ID NO: 8445441 - DNA, 22 bp, Homo sapiens
gacatttagctgttttgcattt

SEQ ID NO: 8445442 - DNA, 22 bp, Homo sapiens
gaccagaaatcaacacagaatg

SEQ ID NO: 8445443 - DNA, 22 bp, Homo sapiens
gaccacaggtatgggcttggca

SEQ ID NO: 8445444 - DNA, 22 bp, Homo sapiens
gaccactggggtgagggccatc

SEQ ID NO: 8445445 - DNA, 22 bp, Homo sapiens
gacagactaaatggctgtagga

SEQ ID NO: 8445446 - DNA, 22 bp, Homo sapiens
gacagagattgaatcaggaaat

SEQ ID NO: 8445447 - DNA, 22 bp, Homo sapiens
gacagagattgaatcaggaaat

SEQ ID NO: 8445448 - DNA, 22 bp, Homo sapiens
gacagcagaatccattcccagt

SEQ ID NO: 8445449 - DNA, 22 bp, Homo sapiens
gacagcagacagcctggcccct

SEQ ID NO: 8445450 - DNA, 22 bp, Homo sapiens
gacagaggcaagaccagaagcc

SEQ ID NO: 8445451 - DNA, 19 bp, Homo sapiens
gacattcctgacactggct

SEQ ID NO: 8445452 - DNA, 22 bp, Homo sapiens
gacagcagatactttcattgaa

SEQ ID NO: 8445453 - DNA, 22 bp, Homo sapiens
gacagcagataagacctcatca

SEQ ID NO: 8445454 - DNA, 22 bp, Homo sapiens
gacagcagcatgtttacaggcc

SEQ ID NO: 8445455 - DNA, 22 bp, Homo sapiens
gacagcagcataatacatgaac

SEQ ID NO: 8445456 - DNA, 22 bp, Homo sapiens
gacagcagatgaagcctgcaga

SEQ ID NO: 8445457 - DNA, 22 bp, Homo sapiens
gacatttactgaatactgatta

SEQ ID NO: 8445458 - DNA, 22 bp, Homo sapiens
gacatttagaagttagattcaa

SEQ ID NO: 8445459 - DNA, 22 bp, Homo sapiens
gacatttaaggcagtcacttaa

SEQ ID NO: 8445460 - DNA, 22 bp, Homo sapiens
ctaaattatttgcacattagag

SEQ ID NO: 8445461 - DNA, 22 bp, Homo sapiens
ctaaattatttgcacattagag

SEQ ID NO: 8445462 - DNA, 22 bp, Homo sapiens
ctaacatttattgagcacttag

SEQ ID NO: 8445463 - DNA, 20 bp, Homo sapiens
ctaactaaccactttctgat

SEQ ID NO: 8445464 - DNA, 22 bp, Homo sapiens
ctaaattatcatgagaattatg

SEQ ID NO: 8445465 - DNA, 22 bp, Homo sapiens
ctaaattatcatgagaattatg

SEQ ID NO: 8445466 - DNA, 22 bp, Homo sapiens
ctaaatgttttatcttcctggc

SEQ ID NO: 8445467 - DNA, 22 bp, Homo sapiens
ctaaatgtcagagtagcttgca

SEQ ID NO: 8445468 - DNA, 22 bp, Homo sapiens
ttctacagaataaatgtttaca

SEQ ID NO: 8445469 - DNA, 22 bp, Homo sapiens
ttctacacttttcattagctag

SEQ ID NO: 8445470 - DNA, 22 bp, Homo sapiens
ttctacaggtactgaagtacat

SEQ ID NO: 8445471 - DNA, 22 bp, Homo sapiens
ctacataaatatttatgtgtct

SEQ ID NO: 8445472 - DNA, 17 bp, Homo sapiens
ctacagtgtgtttcctg

SEQ ID NO: 8445473 - DNA, 17 bp, Homo sapiens
ctacagtgtgtttcctg

SEQ ID NO: 8445474 - DNA, 22 bp, Homo sapiens
ctacagtgtcgtgtggtttctg

SEQ ID NO: 8445475 - DNA, 22 bp, Homo sapiens
ctacatcagaacatttacccta

SEQ ID NO: 8445476 - DNA, 22 bp, Homo sapiens
ctacatcacttaattcttagaa

SEQ ID NO: 8445477 - DNA, 22 bp, Homo sapiens
ctacatgaactcttaagtcaca

SEQ ID NO: 8445478 - DNA, 22 bp, Homo sapiens
ctacatgaatgggtgtattact

SEQ ID NO: 8445479 - DNA, 20 bp, Homo sapiens
ctacatgttctgcttctctc

SEQ ID NO: 8445480 - DNA, 22 bp, Homo sapiens
ctacatgtaggtttccttaatt

SEQ ID NO: 8445481 - DNA, 22 bp, Homo sapiens
ctacatctcaccttccaggaca

SEQ ID NO: 8445482 - DNA, 22 bp, Homo sapiens
ctacatgaactcttaagtcaca

SEQ ID NO: 8445483 - DNA, 22 bp, Homo sapiens
ctacatgaaaataagtttgaaa

SEQ ID NO: 8445484 - DNA, 22 bp, Homo sapiens
ctacattatgtttattgggact

SEQ ID NO: 8445485 - DNA, 22 bp, Homo sapiens
ttctacatgagaaaatgtattt

SEQ ID NO: 8445486 - DNA, 22 bp, Homo sapiens
ttctacatcacttaacatgcta

SEQ ID NO: 8445487 - DNA, 22 bp, Homo sapiens
ttctcatgtaaatgccatcatc

SEQ ID NO: 8445488 - DNA, 22 bp, Homo sapiens
ttctcatgaaactcgcttcctc

SEQ ID NO: 8445489 - DNA, 22 bp, Homo sapiens
ttctcctgcccttggacttcca

SEQ ID NO: 8445490 - DNA, 22 bp, Homo sapiens
ttctcattctgactcagtgtag

SEQ ID NO: 8445491 - DNA, 22 bp, Homo sapiens
ttctcattctgactcagtgtag

SEQ ID NO: 8445492 - DNA, 22 bp, Homo sapiens
ttctcctgcgcaggcccaggga

SEQ ID NO: 8445493 - DNA, 22 bp, Homo sapiens
ttctcctgggaggggttgccca

SEQ ID NO: 8445494 - DNA, 22 bp, Homo sapiens
ttctcagtttcatagctgagca

SEQ ID NO: 8445495 - DNA, 22 bp, Homo sapiens
ttctcagtattacatgctaatg

SEQ ID NO: 8445496 - DNA, 22 bp, Homo sapiens
ttctcaggtgaggctgaggctg

SEQ ID NO: 8445497 - DNA, 22 bp, Homo sapiens
ttctcaggtgaggctgaggctg

SEQ ID NO: 8445498 - DNA, 22 bp, Homo sapiens
ttctcaggtgaggctgaggctg

SEQ ID NO: 8445499 - DNA, 22 bp, Homo sapiens
ctagtgtttggaagtcatagcc

SEQ ID NO: 8445500 - DNA, 21 bp, Homo sapiens
ttctcctgttttgcaccacag

SEQ ID NO: 8445501 - DNA, 21 bp, Homo sapiens
ttctcctgttttgcaccacag

SEQ ID NO: 8445502 - DNA, 21 bp, Homo sapiens
ttccagaaatctctttcttca

SEQ ID NO: 8445503 - DNA, 22 bp, Homo sapiens
ttccagaaagttctggaactgg

SEQ ID NO: 8445504 - DNA, 22 bp, Homo sapiens
ttccagaaaaaaatgtatatct

SEQ ID NO: 8445505 - DNA, 22 bp, Homo sapiens
ttccagaaaaaaatgtatatct

SEQ ID NO: 8445506 - DNA, 22 bp, Homo sapiens
ttccagaaaactctgcctggta

SEQ ID NO: 8445507 - DNA, 22 bp, Homo sapiens
ttccacttttctctctcatgcc

SEQ ID NO: 8445508 - DNA, 22 bp, Homo sapiens
ttccactggctttcagtgatct

SEQ ID NO: 8445509 - DNA, 22 bp, Homo sapiens
cgtcccagttccagccgcgctg

SEQ ID NO: 8445510 - DNA, 22 bp, Homo sapiens
cgtccaggaagatcggccgatg

SEQ ID NO: 8445511 - DNA, 19 bp, Homo sapiens
cgtccaggtgctggaagat

SEQ ID NO: 8445512 - DNA, 22 bp, Homo sapiens
cgtccagggcgggctcccctca

SEQ ID NO: 8445513 - DNA, 22 bp, Homo sapiens
ttcctaacaaacttcagtgaat

SEQ ID NO: 8445514 - DNA, 19 bp, Homo sapiens
cgtgaacatgactgcatgg

SEQ ID NO: 8445515 - DNA, 22 bp, Homo sapiens
cgtctggcttctccacggtaaa

SEQ ID NO: 8445516 - DNA, 17 bp, Homo sapiens
ttcctcctcaccatgtt

SEQ ID NO: 8445517 - DNA, 21 bp, Homo sapiens
ttcctcctctggagaagaaga

SEQ ID NO: 8445518 - DNA, 22 bp, Homo sapiens
ttcctctcaacatgcctgccgg

SEQ ID NO: 8445519 - DNA, 22 bp, Homo sapiens
ttcctccttcccattcctgggg

SEQ ID NO: 8445520 - DNA, 23 bp, Homo sapiens
ttcagggcctcagaggtgaagct

SEQ ID NO: 8445521 - DNA, 22 bp, Homo sapiens
ttcagtttccacttacatttaa

SEQ ID NO: 8445522 - DNA, 22 bp, Homo sapiens
ttcagtttccacttacatttaa

SEQ ID NO: 8445523 - DNA, 22 bp, Homo sapiens
ttcagtttcagtcttgcaaaaa

SEQ ID NO: 8445524 - DNA, 22 bp, Homo sapiens
cgcagctcttaccctcccctta

SEQ ID NO: 8445525 - DNA, 21 bp, Homo sapiens
ttcagtttcttcctcatctat

SEQ ID NO: 8445526 - DNA, 22 bp, Homo sapiens
ttcagtttctaaatgctcctct

SEQ ID NO: 8445527 - DNA, 22 bp, Homo sapiens
ttcagtttcgttatctatgaga

SEQ ID NO: 8445528 - DNA, 22 bp, Homo sapiens
ttcagtttccctaaagccaatt

SEQ ID NO: 8445529 - DNA, 22 bp, Homo sapiens
cgggagcctctgggtcacactg

SEQ ID NO: 8445530 - DNA, 18 bp, Homo sapiens
cggcttctgtcaccttgc

SEQ ID NO: 8445531 - DNA, 22 bp, Homo sapiens
cggcttcttcatcaggtcagca

SEQ ID NO: 8445532 - DNA, 22 bp, Homo sapiens
cggcttcttcgaggtgtctgcg

SEQ ID NO: 8445533 - DNA, 22 bp, Homo sapiens
cggcttcttttaaggttgctga

SEQ ID NO: 8445534 - DNA, 22 bp, Homo sapiens
ttccacggggctccccgctctt

SEQ ID NO: 8445535 - DNA, 22 bp, Homo sapiens
cggctgggttcggctgcaggcc

SEQ ID NO: 8445536 - DNA, 22 bp, Homo sapiens
cggcttctattaggtcggtgca

SEQ ID NO: 8445537 - DNA, 22 bp, Homo sapiens
cggcttccaacaagctttgctg

SEQ ID NO: 8445538 - DNA, 22 bp, Homo sapiens
cggcttccaacaagctttgctg

SEQ ID NO: 8445539 - DNA, 22 bp, Homo sapiens
cggcttctcgggtcggattccg

SEQ ID NO: 8445540 - DNA, 23 bp, Homo sapiens
cggcttctgaaatcccatctgtt

SEQ ID NO: 8445541 - DNA, 21 bp, Homo sapiens
cggcttctgcattccagagct

SEQ ID NO: 8445542 - DNA, 22 bp, Homo sapiens
cggcttctgcccattcagtcct

SEQ ID NO: 8445543 - DNA, 22 bp, Homo sapiens
cggctgtgtcttcacaggagcc

SEQ ID NO: 8445544 - DNA, 22 bp, Homo sapiens
ttgcactcaccacatttcaggt

SEQ ID NO: 8445545 - DNA, 22 bp, Homo sapiens
ttgcaccccttgattgagcctt

SEQ ID NO: 8445546 - DNA, 22 bp, Homo sapiens
ttgcacccagtagtttaaattc

SEQ ID NO: 8445547 - DNA, 23 bp, Homo sapiens
ttgcacagtttcggaaactgagg

SEQ ID NO: 8445548 - DNA, 22 bp, Homo sapiens
ttgcacagatgagggtgatgct

SEQ ID NO: 8445549 - DNA, 22 bp, Homo sapiens
ttgcacagtggtttagagcctg

SEQ ID NO: 8445550 - DNA, 22 bp, Homo sapiens
ctcaggccttgaagtcttttct

SEQ ID NO: 8445551 - DNA, 18 bp, Homo sapiens
ctcaggcctttccctgtg

SEQ ID NO: 8445552 - DNA, 22 bp, Homo sapiens
ttgctgctcccaagaggcagct

SEQ ID NO: 8445553 - DNA, 22 bp, Homo sapiens
ttgctgctcccaagaggcagct

SEQ ID NO: 8445554 - DNA, 23 bp, Homo sapiens
ttgctgcctgagccttcctctgg

SEQ ID NO: 8445555 - DNA, 22 bp, Homo sapiens
ttgctgtagctcatttcactct

SEQ ID NO: 8445556 - DNA, 22 bp, Homo sapiens
ctcaggctaagaaggccaagtg

SEQ ID NO: 8445557 - DNA, 22 bp, Homo sapiens
ctcaggctcatatcccatcagc

SEQ ID NO: 8445558 - DNA, 22 bp, Homo sapiens
ctcaggctaagaaggccaagtg

SEQ ID NO: 8445559 - DNA, 22 bp, Homo sapiens
ttgctgggtcagaagccaggag

SEQ ID NO: 8445560 - DNA, 22 bp, Homo sapiens
ttgctggcaatttagagatttc

SEQ ID NO: 8445561 - DNA, 22 bp, Homo sapiens
ttgcaaaagccgaggcactcca

SEQ ID NO: 8445562 - DNA, 22 bp, Homo sapiens
ttgcaaaatcatttctcaggat

SEQ ID NO: 8445563 - DNA, 22 bp, Homo sapiens
ttgcaaaagcaattgcagtttt

SEQ ID NO: 8445564 - DNA, 22 bp, Homo sapiens
ttgcaaaaccatcctaagtaaa

SEQ ID NO: 8445565 - DNA, 22 bp, Homo sapiens
ttgcaaaaccatcctaagtaaa

SEQ ID NO: 8445566 - DNA, 22 bp, Homo sapiens
ttgcaaaaactgcaattacttt

SEQ ID NO: 8445567 - DNA, 23 bp, Homo sapiens
ttgcaaaatgcaattgagttaga

SEQ ID NO: 8445568 - DNA, 22 bp, Homo sapiens
ttgcaaaatcatttctcaggat

SEQ ID NO: 8445569 - DNA, 23 bp, Homo sapiens
ttgcaaaatgagtcttgagtgaa

SEQ ID NO: 8445570 - DNA, 22 bp, Homo sapiens
ttgcaaagaattttacattcta

SEQ ID NO: 8445571 - DNA, 22 bp, Homo sapiens
ctcagcagtgacaagagagtat

SEQ ID NO: 8445572 - DNA, 22 bp, Homo sapiens
ctcagcagtgacaagagagtat

SEQ ID NO: 8445573 - DNA, 22 bp, Homo sapiens
ttgatttttccagcttctagag

SEQ ID NO: 8445574 - DNA, 22 bp, Homo sapiens
ttgatattctgagaagctgaag

SEQ ID NO: 8445575 - DNA, 22 bp, Homo sapiens
ttgatttttttctactatgcgc

SEQ ID NO: 8445576 - DNA, 22 bp, Homo sapiens
ttgcaaaaaccacaattacttt

SEQ ID NO: 8445577 - DNA, 22 bp, Homo sapiens
ttgcaaaaaccacaattacttt

SEQ ID NO: 8445578 - DNA, 22 bp, Homo sapiens
ttgcaaaaactgcaattacttt

SEQ ID NO: 8445579 - DNA, 22 bp, Homo sapiens
ctcagccatgcaacatgctggg

SEQ ID NO: 8445580 - DNA, 22 bp, Homo sapiens
ctcagcattcaatgtccagtcc

SEQ ID NO: 8445581 - DNA, 22 bp, Homo sapiens
ctcagcatcatggtatctgggg

SEQ ID NO: 8445582 - DNA, 22 bp, Homo sapiens
ctcagccatggggtggatcagc

SEQ ID NO: 8445583 - DNA, 22 bp, Homo sapiens
ctcagccatgtcatgcctacct

SEQ ID NO: 8445584 - DNA, 22 bp, Homo sapiens
ctcaggagtagttcagcagctg

SEQ ID NO: 8445585 - DNA, 22 bp, Homo sapiens
ctcaggccattcttccagctgc

SEQ ID NO: 8445586 - DNA, 22 bp, Homo sapiens
ctcaggccaggtttctcccaca

SEQ ID NO: 8445587 - DNA, 22 bp, Homo sapiens
ctcaggccattcttccagctgc

SEQ ID NO: 8445588 - DNA, 22 bp, Homo sapiens
ctcaggcccacagcagacccac

SEQ ID NO: 8445589 - DNA, 22 bp, Homo sapiens
ctcaggcccacagcagacccac

SEQ ID NO: 8445590 - DNA, 22 bp, Homo sapiens
ctcaggcctgagtggcagtccc

SEQ ID NO: 8445591 - DNA, 22 bp, Homo sapiens
ctcaggccaataagctccagcc

SEQ ID NO: 8445592 - DNA, 22 bp, Homo sapiens
ctcaggccaataagctccagcc

SEQ ID NO: 8445593 - DNA, 22 bp, Homo sapiens
ctcaggccaggtttctcccaca

SEQ ID NO: 8445594 - DNA, 22 bp, Homo sapiens
ctcaggccaggtttctcccaca

SEQ ID NO: 8445595 - DNA, 22 bp, Homo sapiens
ttctgaaagccaattcattgaa

SEQ ID NO: 8445596 - DNA, 22 bp, Homo sapiens
ttctgaaataggagatagctgt

SEQ ID NO: 8445597 - DNA, 22 bp, Homo sapiens
ttctgaaaattgggtcatactt

SEQ ID NO: 8445598 - DNA, 23 bp, Homo sapiens
ttctgaaaatagatagtggctcc

SEQ ID NO: 8445599 - DNA, 22 bp, Homo sapiens
ctataaatctacccagcattgg

SEQ ID NO: 8445600 - DNA, 22 bp, Homo sapiens
ttctgaaaacacactttgcagc

SEQ ID NO: 8445601 - DNA, 22 bp, Homo sapiens
ttctctttttgcatctcaacct

SEQ ID NO: 8445602 - DNA, 22 bp, Homo sapiens
ttcttacaagtattccaggtcc

SEQ ID NO: 8445603 - DNA, 22 bp, Homo sapiens
ttcttcagcttctacctgcgtc

SEQ ID NO: 8445604 - DNA, 21 bp, Homo sapiens
ttcttcaggccaatgctcatt

SEQ ID NO: 8445605 - DNA, 19 bp, Homo sapiens
ttcttacaacaccctggga

SEQ ID NO: 8445606 - DNA, 22 bp, Homo sapiens
ttcttaagtcagtaagatgcaa

SEQ ID NO: 8445607 - DNA, 22 bp, Homo sapiens
ttcttaaagaggcaaaacacag

SEQ ID NO: 8445608 - DNA, 21 bp, Homo sapiens
ttcttcatgatgattaatggc

SEQ ID NO: 8445609 - DNA, 21 bp, Homo sapiens
ttcttcatgatgattaatggc

SEQ ID NO: 8445610 - DNA, 21 bp, Homo sapiens
ttgaaggatcacttctgtacc

SEQ ID NO: 8445611 - DNA, 21 bp, Homo sapiens
ttgaaggatcacttctgtacc

SEQ ID NO: 8445612 - DNA, 22 bp, Homo sapiens
ctcactgccctgaagttgggtt

SEQ ID NO: 8445613 - DNA, 22 bp, Homo sapiens
ctcactggcaagactacaggtg

SEQ ID NO: 8445614 - DNA, 22 bp, Homo sapiens
ttgaatcattacaatagataag

SEQ ID NO: 8445615 - DNA, 22 bp, Homo sapiens
ttgaatctctctgagattcagt

SEQ ID NO: 8445616 - DNA, 22 bp, Homo sapiens
ttgaatctgggtacttgtaata

SEQ ID NO: 8445617 - DNA, 22 bp, Homo sapiens
ttgaatgaagtccctttttact

SEQ ID NO: 8445618 - DNA, 22 bp, Homo sapiens
ttgaatgaagggatgaccgaag

SEQ ID NO: 8445619 - DNA, 22 bp, Homo sapiens
ttgaatgaaattgctgtgttat

SEQ ID NO: 8445620 - DNA, 23 bp, Homo sapiens
ttgaatagggtggcaacaaactg

SEQ ID NO: 8445621 - DNA, 22 bp, Homo sapiens
ttacagaactgtcttgaaattt

SEQ ID NO: 8445622 - DNA, 22 bp, Homo sapiens
ttacagaactgtcttgaaattt

SEQ ID NO: 8445623 - DNA, 20 bp, Homo sapiens
ttacagaaatgatgttattt

SEQ ID NO: 8445624 - DNA, 20 bp, Homo sapiens
ttacagaaatgatgttattt

SEQ ID NO: 8445625 - DNA, 20 bp, Homo sapiens
ttacagaaatgatgttattt

SEQ ID NO: 8445626 - DNA, 22 bp, Homo sapiens
ttacaatgagacgttcttatct

SEQ ID NO: 8445627 - DNA, 20 bp, Homo sapiens
ccttctctggaattgcctcc

SEQ ID NO: 8445628 - DNA, 21 bp, Homo sapiens
ccttctcttgcttcagcttca

SEQ ID NO: 8445629 - DNA, 22 bp, Homo sapiens
ttacagaaggaacactactcag

SEQ ID NO: 8445630 - DNA, 22 bp, Homo sapiens
ttacagaagagaaagaattcag

SEQ ID NO: 8445631 - DNA, 21 bp, Homo sapiens
ttaccaatggcttctctttcc

SEQ ID NO: 8445632 - DNA, 22 bp, Homo sapiens
ttaccaagctctgcatgttaag

SEQ ID NO: 8445633 - DNA, 22 bp, Homo sapiens
ttaccacacttatttacattgg

SEQ ID NO: 8445634 - DNA, 22 bp, Homo sapiens
ttacccagtgaagccgaggcag

SEQ ID NO: 8445635 - DNA, 22 bp, Homo sapiens
ccttctgctccctggccagggc

SEQ ID NO: 8445636 - DNA, 22 bp, Homo sapiens
ccttctgatactgacatcattt

SEQ ID NO: 8445637 - DNA, 22 bp, Homo sapiens
ccttctgagcttcaatttcagt

SEQ ID NO: 8445638 - DNA, 17 bp, Homo sapiens
ttatctactgctactgt

SEQ ID NO: 8445639 - DNA, 22 bp, Homo sapiens
ccttgttttggaaccaaaggat

SEQ ID NO: 8445640 - DNA, 22 bp, Homo sapiens
ccttggggtgttggaggcagcc

SEQ ID NO: 8445641 - DNA, 22 bp, Homo sapiens
ccttggggaatatccattcttc

SEQ ID NO: 8445642 - DNA, 22 bp, Homo sapiens
ccttgcctcattgtgcttctcc

SEQ ID NO: 8445643 - DNA, 22 bp, Homo sapiens
ttaccttttaggcaagcatctt

SEQ ID NO: 8445644 - DNA, 22 bp, Homo sapiens
ttacctgtgtgtttgatacata

SEQ ID NO: 8445645 - DNA, 22 bp, Homo sapiens
ttacctgtgtcagtatatgaga

SEQ ID NO: 8445646 - DNA, 22 bp, Homo sapiens
ttacctgttttacatgcacaac

SEQ ID NO: 8445647 - DNA, 22 bp, Homo sapiens
ccttggctgtgttgcctgccct

SEQ ID NO: 8445648 - DNA, 22 bp, Homo sapiens
ccttggctgtgttgcctgccct

SEQ ID NO: 8445649 - DNA, 22 bp, Homo sapiens
ccttggctgtgctgccctttgc

SEQ ID NO: 8445650 - DNA, 21 bp, Homo sapiens
ccttggctggcatctagcacc

SEQ ID NO: 8445651 - DNA, 19 bp, Homo sapiens
ccttgcctgtccctgcagc

SEQ ID NO: 8445652 - DNA, 22 bp, Homo sapiens
ccttggcttgcacacggccacc

SEQ ID NO: 8445653 - DNA, 22 bp, Homo sapiens
ccttggcttgtgggctgcagcc

SEQ ID NO: 8445654 - DNA, 22 bp, Homo sapiens
ccttggcttgtgggctgcagcc

SEQ ID NO: 8445655 - DNA, 22 bp, Homo sapiens
ccttgggagaaattgcagagtc

SEQ ID NO: 8445656 - DNA, 22 bp, Homo sapiens
ccttgggagaaattgcagagtc

SEQ ID NO: 8445657 - DNA, 22 bp, Homo sapiens
ttatttcattgatttctaagac

SEQ ID NO: 8445658 - DNA, 22 bp, Homo sapiens
ttatttttaaaagttcacacag

SEQ ID NO: 8445659 - DNA, 22 bp, Homo sapiens
ttattcaccgcaggtgcttccc

SEQ ID NO: 8445660 - DNA, 22 bp, Homo sapiens
ttattcaccatttattatgtga

SEQ ID NO: 8445661 - DNA, 22 bp, Homo sapiens
ttattcacctctattagactca

SEQ ID NO: 8445662 - DNA, 22 bp, Homo sapiens
ttattcactcatttaacattat

SEQ ID NO: 8445663 - DNA, 22 bp, Homo sapiens
ttattcactcatttaacattat

SEQ ID NO: 8445664 - DNA, 22 bp, Homo sapiens
ttattcactctgaagccatcct

SEQ ID NO: 8445665 - DNA, 22 bp, Homo sapiens
ttattcacatgggctcattcta

SEQ ID NO: 8445666 - DNA, 22 bp, Homo sapiens
ttattattttgtgtacagcaaa

SEQ ID NO: 8445667 - DNA, 22 bp, Homo sapiens
ttattattttgtgtacagcaaa

SEQ ID NO: 8445668 - DNA, 22 bp, Homo sapiens
ttattattttgtgtacagcaaa

SEQ ID NO: 8445669 - DNA, 22 bp, Homo sapiens
cgcaccactgaattccagcctg

SEQ ID NO: 8445670 - DNA, 22 bp, Homo sapiens
cgcaccactgaattccagcctg

SEQ ID NO: 8445671 - DNA, 17 bp, Homo sapiens
ttattttttgggctgag

SEQ ID NO: 8445672 - DNA, 22 bp, Homo sapiens
ttatttttaaaagttcacacag

SEQ ID NO: 8445673 - DNA, 17 bp, Homo sapiens
ttattttttgggctgag

SEQ ID NO: 8445674 - DNA, 22 bp, Homo sapiens
ttcaaaaaggtatgttcaagtc

SEQ ID NO: 8445675 - DNA, 22 bp, Homo sapiens
cgcagagggcaggcagtgctgg

SEQ ID NO: 8445676 - DNA, 22 bp, Homo sapiens
cctttggagagtttgttagggg

SEQ ID NO: 8445677 - DNA, 22 bp, Homo sapiens
cctttcttgctaagagtttatg

SEQ ID NO: 8445678 - DNA, 22 bp, Homo sapiens
cctttctgacagtgatgggggg

SEQ ID NO: 8445679 - DNA, 22 bp, Homo sapiens
cctttctgtgttgccctatttg

SEQ ID NO: 8445680 - DNA, 22 bp, Homo sapiens
cctttctggtatttaaccaaag

SEQ ID NO: 8445681 - DNA, 22 bp, Homo sapiens
cctttctgatggcctcccagcc

SEQ ID NO: 8445682 - DNA, 20 bp, Homo sapiens
cctttctggagtgctgttca

SEQ ID NO: 8445683 - DNA, 22 bp, Homo sapiens
ttatgggagcaattggggaggt

SEQ ID NO: 8445684 - DNA, 22 bp, Homo sapiens
ttatgtactctgcaatgtttga

SEQ ID NO: 8445685 - DNA, 22 bp, Homo sapiens
cgcaacagcgtggcgcccagct

SEQ ID NO: 8445686 - DNA, 22 bp, Homo sapiens
cgcaacagagcaggtttgatga

SEQ ID NO: 8445687 - DNA, 22 bp, Homo sapiens
cgcaattaattcgggccacagt

SEQ ID NO: 8445688 - DNA, 22 bp, Homo sapiens
cgcaactcagcaacttaactgc

SEQ ID NO: 8445689 - DNA, 22 bp, Homo sapiens
cgatgggggcagtgttacattg

SEQ ID NO: 8445690 - DNA, 22 bp, Homo sapiens
cctttggagcaactgagagcta

SEQ ID NO: 8445691 - DNA, 19 bp, Homo sapiens
cctttggatttgtttagtc

SEQ ID NO: 8445692 - DNA, 22 bp, Homo sapiens
cctttggagcaactgagagcta

SEQ ID NO: 8445693 - DNA, 22 bp, Homo sapiens
cctgtatttgcttccttctgca

SEQ ID NO: 8445694 - DNA, 22 bp, Homo sapiens
ttaatatgctgcttcttgaaaa

SEQ ID NO: 8445695 - DNA, 22 bp, Homo sapiens
ttaatatacaattttacgggct

SEQ ID NO: 8445696 - DNA, 22 bp, Homo sapiens
ttaatagatttgattttaaagg

SEQ ID NO: 8445697 - DNA, 22 bp, Homo sapiens
ttaataggcttctaacatagct

SEQ ID NO: 8445698 - DNA, 22 bp, Homo sapiens
ttaatagtgctaaaccattgac

SEQ ID NO: 8445699 - DNA, 22 bp, Homo sapiens
ttaatagatatgcctctagagt

SEQ ID NO: 8445700 - DNA, 22 bp, Homo sapiens
cctgtacagtgaatgaatgtga

SEQ ID NO: 8445701 - DNA, 22 bp, Homo sapiens
cctgtacatctgctctcattgc

SEQ ID NO: 8445702 - DNA, 22 bp, Homo sapiens
cctgtacatggccatctttacc

SEQ ID NO: 8445703 - DNA, 22 bp, Homo sapiens
cctgtacattagctgtgaattg

SEQ ID NO: 8445704 - DNA, 22 bp, Homo sapiens
cctgtaggatattgtagaatac

SEQ ID NO: 8445705 - DNA, 22 bp, Homo sapiens
cctgtaggaacgccttcatttg

SEQ ID NO: 8445706 - DNA, 22 bp, Homo sapiens
cctgtaggcgagggatggacag

SEQ ID NO: 8445707 - DNA, 22 bp, Homo sapiens
cctgtaggatattgtagaatac

SEQ ID NO: 8445708 - DNA, 22 bp, Homo sapiens
cctgtatttgcaacttttctta

SEQ ID NO: 8445709 - DNA, 22 bp, Homo sapiens
cctgtattcaattttgtgtgat

SEQ ID NO: 8445710 - DNA, 22 bp, Homo sapiens
cctgtattatttgtatgtgctg

SEQ ID NO: 8445711 - DNA, 22 bp, Homo sapiens
cctggtttttcaaacatacaag

SEQ ID NO: 8445712 - DNA, 22 bp, Homo sapiens
cctggtttgtatttttaacacc

SEQ ID NO: 8445713 - DNA, 22 bp, Homo sapiens
cctgtaaatagtttcttctgac

SEQ ID NO: 8445714 - DNA, 22 bp, Homo sapiens
ttaaaatgaatattgattagca

SEQ ID NO: 8445715 - DNA, 22 bp, Homo sapiens
ttaaaatagccagtgcccctct

SEQ ID NO: 8445716 - DNA, 22 bp, Homo sapiens
ttaaaaggcatcataggtgaat

SEQ ID NO: 8445717 - DNA, 22 bp, Homo sapiens
ttaaaagggtaagcagcaactt

SEQ ID NO: 8445718 - DNA, 22 bp, Homo sapiens
ttaaaagggatgttatctgtaa

SEQ ID NO: 8445719 - DNA, 22 bp, Homo sapiens
ttaaaatagccagtgcccctct

SEQ ID NO: 8445720 - DNA, 22 bp, Homo sapiens
tgttttctcttgaaaagcagtc

SEQ ID NO: 8445721 - DNA, 22 bp, Homo sapiens
tgttttctattacctgagattg

SEQ ID NO: 8445722 - DNA, 22 bp, Homo sapiens
tgttttctattacctgagattg

SEQ ID NO: 8445723 - DNA, 22 bp, Homo sapiens
ttaatcacagctctgccatgag

SEQ ID NO: 8445724 - DNA, 22 bp, Homo sapiens
cctgtggccgcgtcgggcggcg

SEQ ID NO: 8445725 - DNA, 22 bp, Homo sapiens
cctgtggaggctgctcagctgg

SEQ ID NO: 8445726 - DNA, 22 bp, Homo sapiens
ttacaagttcagattttctcat

SEQ ID NO: 8445727 - DNA, 23 bp, Homo sapiens
ttacaagttctgaaatttccttc

SEQ ID NO: 8445728 - DNA, 23 bp, Homo sapiens
ttacaagttctgaaatttccttc

SEQ ID NO: 8445729 - DNA, 20 bp, Homo sapiens
ttacaagtttctaataacca

SEQ ID NO: 8445730 - DNA, 22 bp, Homo sapiens
ttacaagtttctggcttcatcc

SEQ ID NO: 8445731 - DNA, 22 bp, Homo sapiens
ttacaagtttctggcttcatcc

SEQ ID NO: 8445732 - DNA, 22 bp, Homo sapiens
ttacaagtttctggcttcatcc

SEQ ID NO: 8445733 - DNA, 22 bp, Homo sapiens
ttacaatagttccttcttttgt

SEQ ID NO: 8445734 - DNA, 22 bp, Homo sapiens
ttacaatagttccttcttttgt

SEQ ID NO: 8445735 - DNA, 22 bp, Homo sapiens
ttacaatcatctaggataaaga

SEQ ID NO: 8445736 - DNA, 22 bp, Homo sapiens
ttacaatgacaggtgtatcatt

SEQ ID NO: 8445737 - DNA, 22 bp, Homo sapiens
cctgtggctgccccgctgttgg

SEQ ID NO: 8445738 - DNA, 22 bp, Homo sapiens
cctgtggctggtcaggccagca

SEQ ID NO: 8445739 - DNA, 21 bp, Homo sapiens
ttacaaagctacagatgttgc

SEQ ID NO: 8445740 - DNA, 21 bp, Homo sapiens
ttacaaagctacagatgttgc

SEQ ID NO: 8445741 - DNA, 22 bp, Homo sapiens
ttacaagtactgaatatgattt

SEQ ID NO: 8445742 - DNA, 22 bp, Homo sapiens
ttacaagtactgaatatgattt

SEQ ID NO: 8445743 - DNA, 22 bp, Homo sapiens
ttacaagtatttaagatgctgt

SEQ ID NO: 8445744 - DNA, 22 bp, Homo sapiens
ttacaagtatttaagatgctgt

SEQ ID NO: 8445745 - DNA, 22 bp, Homo sapiens
cctgtggcgggggccagtgcct

SEQ ID NO: 8445746 - DNA, 18 bp, Homo sapiens
cctgtggctcagcccaca

SEQ ID NO: 8445747 - DNA, 22 bp, Homo sapiens
cctgtggctgccacttgggtga

SEQ ID NO: 8445748 - DNA, 22 bp, Homo sapiens
tggttcagttgcacaggctgtt

SEQ ID NO: 8445749 - DNA, 22 bp, Homo sapiens
tggttcagttgcacaggctgtt

SEQ ID NO: 8445750 - DNA, 22 bp, Homo sapiens
tggttcataatttgcactactg

SEQ ID NO: 8445751 - DNA, 22 bp, Homo sapiens
tggttcatagcctcacaggata

SEQ ID NO: 8445752 - DNA, 22 bp, Homo sapiens
tggttccaagatggctgccaca

SEQ ID NO: 8445753 - DNA, 17 bp, Homo sapiens
tggttccaaccatacgc

SEQ ID NO: 8445754 - DNA, 22 bp, Homo sapiens
tggttcagatatggagctggga

SEQ ID NO: 8445755 - DNA, 22 bp, Homo sapiens
tggttcagagagttgctgacca

SEQ ID NO: 8445756 - DNA, 22 bp, Homo sapiens
tggttataaattgctatgcaga

SEQ ID NO: 8445757 - DNA, 22 bp, Homo sapiens
tggttataaaagtcctctcatt

SEQ ID NO: 8445758 - DNA, 22 bp, Homo sapiens
tggttagactcaccttatagtt

SEQ ID NO: 8445759 - DNA, 22 bp, Homo sapiens
tggttagaggcttcttgcttgg

SEQ ID NO: 8445760 - DNA, 22 bp, Homo sapiens
tggttagatgaggctggtttca

SEQ ID NO: 8445761 - DNA, 22 bp, Homo sapiens
tggttcctcaagcgctggcggc

SEQ ID NO: 8445762 - DNA, 22 bp, Homo sapiens
cctgccttcccagcttggcttt

SEQ ID NO: 8445763 - DNA, 22 bp, Homo sapiens
tggttccactaacctgagagcc

SEQ ID NO: 8445764 - DNA, 22 bp, Homo sapiens
tggttccagttttcaatagagc

SEQ ID NO: 8445765 - DNA, 22 bp, Homo sapiens
tggttccactaacctgagagcc

SEQ ID NO: 8445766 - DNA, 22 bp, Homo sapiens
tggttccaatcgcactggctca

SEQ ID NO: 8445767 - DNA, 22 bp, Homo sapiens
cctgccttgacgtaacgcatga

SEQ ID NO: 8445768 - DNA, 22 bp, Homo sapiens
cctgccttctaaagcgcccgcc

SEQ ID NO: 8445769 - DNA, 22 bp, Homo sapiens
cctgcctttctcagtaatcttt

SEQ ID NO: 8445770 - DNA, 22 bp, Homo sapiens
cctgctcagccccagctcaccc

SEQ ID NO: 8445771 - DNA, 22 bp, Homo sapiens
tgttgcagtaaaaatggagagg

SEQ ID NO: 8445772 - DNA, 20 bp, Homo sapiens
tgttgattggtgtcatctca

SEQ ID NO: 8445773 - DNA, 22 bp, Homo sapiens
tgttgattagtgtttagactta

SEQ ID NO: 8445774 - DNA, 22 bp, Homo sapiens
tgttcccacaccagcctcagcc

SEQ ID NO: 8445775 - DNA, 22 bp, Homo sapiens
tgttgcccaggttctctcctgc

SEQ ID NO: 8445776 - DNA, 22 bp, Homo sapiens
tgttgcctgactttaaaatgtg

SEQ ID NO: 8445777 - DNA, 22 bp, Homo sapiens
tgttgcctgactttaaaatgtg

SEQ ID NO: 8445778 - DNA, 22 bp, Homo sapiens
tgtttcttacgtttttagaggc

SEQ ID NO: 8445779 - DNA, 22 bp, Homo sapiens
tgtttcttctcacacaaactca

SEQ ID NO: 8445780 - DNA, 22 bp, Homo sapiens
tgttttcagtcatatagcaggt

SEQ ID NO: 8445781 - DNA, 19 bp, Homo sapiens
tgtttcttcctccatctga

SEQ ID NO: 8445782 - DNA, 22 bp, Homo sapiens
tgttttctagaaacaatgccta

SEQ ID NO: 8445783 - DNA, 22 bp, Homo sapiens
tgttttcatcacagaatgtaac

SEQ ID NO: 8445784 - DNA, 22 bp, Homo sapiens
tgttttcatggagatggtggcg

SEQ ID NO: 8445785 - DNA, 22 bp, Homo sapiens
tgttttcatggagatggtggcg

SEQ ID NO: 8445786 - DNA, 22 bp, Homo sapiens
tgtttatacctgcaacctgtca

SEQ ID NO: 8445787 - DNA, 22 bp, Homo sapiens
cctggggctcaagatggcgccg

SEQ ID NO: 8445788 - DNA, 22 bp, Homo sapiens
cctggggctcaagatggcgccg

SEQ ID NO: 8445789 - DNA, 23 bp, Homo sapiens
cctggggcacttgagtcctcatc

SEQ ID NO: 8445790 - DNA, 22 bp, Homo sapiens
cctggggccccgagccagaagc

SEQ ID NO: 8445791 - DNA, 23 bp, Homo sapiens
cctggggagctgtatccagagtg

SEQ ID NO: 8445792 - DNA, 23 bp, Homo sapiens
cctggggagctgtatccagagtg

SEQ ID NO: 8445793 - DNA, 23 bp, Homo sapiens
cctggggcacttgagtcctcatc

SEQ ID NO: 8445794 - DNA, 23 bp, Homo sapiens
cctggggcacttgagtcctcatc

SEQ ID NO: 8445795 - DNA, 22 bp, Homo sapiens
cctggggagccgcctgagcccc

SEQ ID NO: 8445796 - DNA, 22 bp, Homo sapiens
cctggggagagaaagcccagcc

SEQ ID NO: 8445797 - DNA, 22 bp, Homo sapiens
cctggggagaagagcttccccc

SEQ ID NO: 8445798 - DNA, 22 bp, Homo sapiens
cctggggagaagagcttccccc

SEQ ID NO: 8445799 - DNA, 22 bp, Homo sapiens
cctggggagagaaagcccagcc

SEQ ID NO: 8445800 - DNA, 22 bp, Homo sapiens
ctccccagccctggtattctga

SEQ ID NO: 8445801 - DNA, 22 bp, Homo sapiens
ctccccagcattctgacttcct

SEQ ID NO: 8445802 - DNA, 18 bp, Homo sapiens
ctccccagctgcccccag

SEQ ID NO: 8445803 - DNA, 18 bp, Homo sapiens
ctccccagctgcccccag

SEQ ID NO: 8445804 - DNA, 22 bp, Homo sapiens
ctccccagctcgcgggtgacgg

SEQ ID NO: 8445805 - DNA, 22 bp, Homo sapiens
ttgtttaatatcgtgaagtact

SEQ ID NO: 8445806 - DNA, 22 bp, Homo sapiens
ttgtttattagcaattatcctg

SEQ ID NO: 8445807 - DNA, 20 bp, Homo sapiens
ttgtttattatgttctgatc

SEQ ID NO: 8445808 - DNA, 22 bp, Homo sapiens
ttgtttcagctgtatgctatgt

SEQ ID NO: 8445809 - DNA, 22 bp, Homo sapiens
ttgtttcagcccagatctttac

SEQ ID NO: 8445810 - DNA, 22 bp, Homo sapiens
ttgtttatgtaattggcacact

SEQ ID NO: 8445811 - DNA, 22 bp, Homo sapiens
ttgtttatgtgttgtctatggc

SEQ ID NO: 8445812 - DNA, 23 bp, Homo sapiens
ttgtttaccgtaggacttttaac

SEQ ID NO: 8445813 - DNA, 22 bp, Homo sapiens
ttgtttactaagaacctggtca

SEQ ID NO: 8445814 - DNA, 22 bp, Homo sapiens
ttgtttatcgcttgctcacata

SEQ ID NO: 8445815 - DNA, 22 bp, Homo sapiens
ttgtttacactgcagaattggg

SEQ ID NO: 8445816 - DNA, 22 bp, Homo sapiens
ttgtttacaagttactcagtct

SEQ ID NO: 8445817 - DNA, 22 bp, Homo sapiens
ctccccacatttctccctgtct

SEQ ID NO: 8445818 - DNA, 22 bp, Homo sapiens
ctccccacacactaggcctgat

SEQ ID NO: 8445819 - DNA, 22 bp, Homo sapiens
ctccccaccttcgcggtccctg

SEQ ID NO: 8445820 - DNA, 22 bp, Homo sapiens
ctccccacgcctggactaagag

SEQ ID NO: 8445821 - DNA, 22 bp, Homo sapiens
ctccccacgcctggactaagag

SEQ ID NO: 8445822 - DNA, 22 bp, Homo sapiens
ctcaggcttgggaggaggccca

SEQ ID NO: 8445823 - DNA, 22 bp, Homo sapiens
ctccccacacactaggcctgat

SEQ ID NO: 8445824 - DNA, 22 bp, Homo sapiens
ctccccaagccttggcttctcc

SEQ ID NO: 8445825 - DNA, 22 bp, Homo sapiens
ctccccaaagataacggcttct

SEQ ID NO: 8445826 - DNA, 22 bp, Homo sapiens
ctccccaactcagccgaggctt

SEQ ID NO: 8445827 - DNA, 22 bp, Homo sapiens
ctccccaagccttggcttctcc

SEQ ID NO: 8445828 - DNA, 22 bp, Homo sapiens
ctcaggctgtgatgtgatggca

SEQ ID NO: 8445829 - DNA, 22 bp, Homo sapiens
ctcaggctgtgatgtgatggca

SEQ ID NO: 8445830 - DNA, 22 bp, Homo sapiens
ctcaggctgtctaatggattag

SEQ ID NO: 8445831 - DNA, 22 bp, Homo sapiens
ctcaggctggtttgggttgttt

SEQ ID NO: 8445832 - DNA, 22 bp, Homo sapiens
ctcaggctggtttgggttgttt

SEQ ID NO: 8445833 - DNA, 22 bp, Homo sapiens
ctcaggcttgggaggaggccca

SEQ ID NO: 8445834 - DNA, 22 bp, Homo sapiens
ctcaggctgtgccacctgtgtg

SEQ ID NO: 8445835 - DNA, 22 bp, Homo sapiens
ctcaggctctggccatccaagg

SEQ ID NO: 8445836 - DNA, 22 bp, Homo sapiens
ctcaggctccagacttccgtcc

SEQ ID NO: 8445837 - DNA, 22 bp, Homo sapiens
ctcaggctccagacttccgtcc

SEQ ID NO: 8445838 - DNA, 21 bp, Homo sapiens
ctcaggctggcagcaggctag

SEQ ID NO: 8445839 - DNA, 21 bp, Homo sapiens
ctcaggctggcagcaggctag

SEQ ID NO: 8445840 - DNA, 21 bp, Homo sapiens
ctcaggctggcagcaggctag

SEQ ID NO: 8445841 - DNA, 22 bp, Homo sapiens
ctcaggctgccctgacagcccc

SEQ ID NO: 8445842 - DNA, 22 bp, Homo sapiens
ctcaggctgccctgacagcccc

SEQ ID NO: 8445843 - DNA, 22 bp, Homo sapiens
ctcctcagtcaggtctagggtc

SEQ ID NO: 8445844 - DNA, 19 bp, Homo sapiens
ctcctcagtcccagaggtc

SEQ ID NO: 8445845 - DNA, 21 bp, Homo sapiens
ctcctcaggaccagccacagg

SEQ ID NO: 8445846 - DNA, 22 bp, Homo sapiens
ctcctcagctgggaggagtccc

SEQ ID NO: 8445847 - DNA, 22 bp, Homo sapiens
ctcctcagctgggaggagtccc

SEQ ID NO: 8445848 - DNA, 22 bp, Homo sapiens
ctcccttgcttctggcattttg

SEQ ID NO: 8445849 - DNA, 22 bp, Homo sapiens
ctcccttcaggagaggctcaca

SEQ ID NO: 8445850 - DNA, 22 bp, Homo sapiens
ctccctggtgactcccaaagct

SEQ ID NO: 8445851 - DNA, 22 bp, Homo sapiens
ctccctggtgactcccaaagct

SEQ ID NO: 8445852 - DNA, 22 bp, Homo sapiens
ctccctggtctttcccatcatt

SEQ ID NO: 8445853 - DNA, 22 bp, Homo sapiens
ctccctggtgtcccctccagga

SEQ ID NO: 8445854 - DNA, 22 bp, Homo sapiens
ctccctggtgtcccctccagga

SEQ ID NO: 8445855 - DNA, 22 bp, Homo sapiens
ctccctggtgtcccctccagga

SEQ ID NO: 8445856 - DNA, 22 bp, Homo sapiens
ctccctgagtttgtggctaagt

SEQ ID NO: 8445857 - DNA, 22 bp, Homo sapiens
ctccctggaggcccagacctgg

SEQ ID NO: 8445858 - DNA, 22 bp, Homo sapiens
ctccctgcttgtttcccttcag

SEQ ID NO: 8445859 - DNA, 22 bp, Homo sapiens
ctccctgcttgtttcccttcag

SEQ ID NO: 8445860 - DNA, 22 bp, Homo sapiens
ctccctggaggcccagacctgg

SEQ ID NO: 8445861 - DNA, 22 bp, Homo sapiens
ctccctggaggcccagacctgg

SEQ ID NO: 8445862 - DNA, 22 bp, Homo sapiens
ctccctggaggtgagctggcac

SEQ ID NO: 8445863 - DNA, 22 bp, Homo sapiens
ctccctggaggtgagctggcac

SEQ ID NO: 8445864 - DNA, 22 bp, Homo sapiens
ctccctggaggtgagctggcac

SEQ ID NO: 8445865 - DNA, 23 bp, Homo sapiens
ctccctggcccttgggagacctg

SEQ ID NO: 8445866 - DNA, 23 bp, Homo sapiens
ctccctggcccttgggagacctg

SEQ ID NO: 8445867 - DNA, 22 bp, Homo sapiens
ctccctggctttgtcctgaggc

SEQ ID NO: 8445868 - DNA, 22 bp, Homo sapiens
ctccctggctttgtcctgaggc

SEQ ID NO: 8445869 - DNA, 22 bp, Homo sapiens
ctccctggctttgtcctgaggc

SEQ ID NO: 8445870 - DNA, 22 bp, Homo sapiens
ctccctgggcagatgtggctct

SEQ ID NO: 8445871 - DNA, 22 bp, Homo sapiens
ctccctgggcagatgtggctct

SEQ ID NO: 8445872 - DNA, 22 bp, Homo sapiens
ctccctgggcctcagtttctct

SEQ ID NO: 8445873 - DNA, 22 bp, Homo sapiens
ctccctggcagccgcactcctg

SEQ ID NO: 8445874 - DNA, 22 bp, Homo sapiens
ctccctggcacagcgagaggtt

SEQ ID NO: 8445875 - DNA, 22 bp, Homo sapiens
ctccctggcacagcgagaggtt

SEQ ID NO: 8445876 - DNA, 23 bp, Homo sapiens
ctccctggagtttctggaagatg

SEQ ID NO: 8445877 - DNA, 23 bp, Homo sapiens
ctccctggagtttctggaagatg

SEQ ID NO: 8445878 - DNA, 23 bp, Homo sapiens
ctccctggagtttctggaagatg

SEQ ID NO: 8445879 - DNA, 22 bp, Homo sapiens
tttacacatacctctttaaagt

SEQ ID NO: 8445880 - DNA, 22 bp, Homo sapiens
ctcctgcctgtgggactgagga

SEQ ID NO: 8445881 - DNA, 22 bp, Homo sapiens
ctcctgagctgcagccttgtgt

SEQ ID NO: 8445882 - DNA, 22 bp, Homo sapiens
ctcctgagctgcagccttgtgt

SEQ ID NO: 8445883 - DNA, 22 bp, Homo sapiens
ctcctgctgaatggccaggagc

SEQ ID NO: 8445884 - DNA, 22 bp, Homo sapiens
ctcctgcttcacgggcaccgcc

SEQ ID NO: 8445885 - DNA, 22 bp, Homo sapiens
ctcctggaagcccgccctgctg

SEQ ID NO: 8445886 - DNA, 22 bp, Homo sapiens
tttacacaaaagatagcacacc

SEQ ID NO: 8445887 - DNA, 22 bp, Homo sapiens
tttacacaaaagatagcacacc

SEQ ID NO: 8445888 - DNA, 22 bp, Homo sapiens
tttacaattggttttctctaat

SEQ ID NO: 8445889 - DNA, 22 bp, Homo sapiens
tttacaattggttttctctaat

SEQ ID NO: 8445890 - DNA, 22 bp, Homo sapiens
tttacaattggttttctctaat

SEQ ID NO: 8445891 - DNA, 20 bp, Homo sapiens
ctcctcagttccatgggagg

SEQ ID NO: 8445892 - DNA, 22 bp, Homo sapiens
tttacaattctctaccagtgtt

SEQ ID NO: 8445893 - DNA, 22 bp, Homo sapiens
ctcctggatcttagccagattc

SEQ ID NO: 8445894 - DNA, 22 bp, Homo sapiens
ctcctggatcttagccagattc

SEQ ID NO: 8445895 - DNA, 22 bp, Homo sapiens
ctcctggaggctccaagggaga

SEQ ID NO: 8445896 - DNA, 22 bp, Homo sapiens
ctcctggagggccaaagaaata

SEQ ID NO: 8445897 - DNA, 23 bp, Homo sapiens
ctcctggagggtccggccctgcc

SEQ ID NO: 8445898 - DNA, 22 bp, Homo sapiens
ctcctggaccagggctattggg

SEQ ID NO: 8445899 - DNA, 22 bp, Homo sapiens
ctcctggagcagcaggcgcagg

SEQ ID NO: 8445900 - DNA, 22 bp, Homo sapiens
ctcctggacatggagcggagga

SEQ ID NO: 8445901 - DNA, 22 bp, Homo sapiens
ctcctggaccaccttgtggcca

SEQ ID NO: 8445902 - DNA, 22 bp, Homo sapiens
tttatatctggagttgctagga

SEQ ID NO: 8445903 - DNA, 22 bp, Homo sapiens
tttatatccatctttgaagtaa

SEQ ID NO: 8445904 - DNA, 22 bp, Homo sapiens
tttatatcttatgtcatttcaa

SEQ ID NO: 8445905 - DNA, 22 bp, Homo sapiens
ctcctgtgaggcttaagcccag

SEQ ID NO: 8445906 - DNA, 22 bp, Homo sapiens
ctcctgtgaggcttaagcccag

SEQ ID NO: 8445907 - DNA, 22 bp, Homo sapiens
ctcctgtcccggggaccgccga

SEQ ID NO: 8445908 - DNA, 22 bp, Homo sapiens
ctcctgtgcacctccagcggca

SEQ ID NO: 8445909 - DNA, 22 bp, Homo sapiens
ctcctgtgcatgcatctcccta

SEQ ID NO: 8445910 - DNA, 22 bp, Homo sapiens
ctcctgtgcatgcatctcccta

SEQ ID NO: 8445911 - DNA, 22 bp, Homo sapiens
ctcctgtgggtcaccaataggc

SEQ ID NO: 8445912 - DNA, 22 bp, Homo sapiens
ctcctgtgggtcaccaataggc

SEQ ID NO: 8445913 - DNA, 20 bp, Homo sapiens
ctcctgtgcctctctgggcc

SEQ ID NO: 8445914 - DNA, 22 bp, Homo sapiens
ctcctgtggtactcccagggcc

SEQ ID NO: 8445915 - DNA, 22 bp, Homo sapiens
tttcaaagtcaatatcattacc

SEQ ID NO: 8445916 - DNA, 22 bp, Homo sapiens
tttcaaagtcaatatcattacc

SEQ ID NO: 8445917 - DNA, 22 bp, Homo sapiens
ctcctgtcaataggctcctggc

SEQ ID NO: 8445918 - DNA, 22 bp, Homo sapiens
tttatatgtttgtacaattaag

SEQ ID NO: 8445919 - DNA, 22 bp, Homo sapiens
tttatatgtttgtacaattaag

SEQ ID NO: 8445920 - DNA, 22 bp, Homo sapiens
ctcctgggcttcgaaggctccc

SEQ ID NO: 8445921 - DNA, 22 bp, Homo sapiens
ctcctgggcttcgaaggctccc

SEQ ID NO: 8445922 - DNA, 22 bp, Homo sapiens
ctcctggttcctgtcttaaata

SEQ ID NO: 8445923 - DNA, 22 bp, Homo sapiens
tttatattacctggaatagctt

SEQ ID NO: 8445924 - DNA, 22 bp, Homo sapiens
ctccttcctggttagcacctta

SEQ ID NO: 8445925 - DNA, 22 bp, Homo sapiens
ctcgggtaccatgctaggcact

SEQ ID NO: 8445926 - DNA, 22 bp, Homo sapiens
ctcgttgctgaagccaaagtca

SEQ ID NO: 8445927 - DNA, 22 bp, Homo sapiens
ctctaaaggcttgttattgcat

SEQ ID NO: 8445928 - DNA, 19 bp, Homo sapiens
ctcgtgcacccatcacctg

SEQ ID NO: 8445929 - DNA, 22 bp, Homo sapiens
tttcaaataccataaacctaat

SEQ ID NO: 8445930 - DNA, 22 bp, Homo sapiens
tttcaaataccataaacctaat

SEQ ID NO: 8445931 - DNA, 22 bp, Homo sapiens
tttcaaataccataaacctaat

SEQ ID NO: 8445932 - DNA, 22 bp, Homo sapiens
tttcaaagtggagaattagaca

SEQ ID NO: 8445933 - DNA, 22 bp, Homo sapiens
ctctatttatggcatctttatg

SEQ ID NO: 8445934 - DNA, 22 bp, Homo sapiens
ctctcaaatgtcattcctctat

SEQ ID NO: 8445935 - DNA, 20 bp, Homo sapiens
ctctcacagctccctcagcc

SEQ ID NO: 8445936 - DNA, 20 bp, Homo sapiens
tttctcagaacagtggctgc

SEQ ID NO: 8445937 - DNA, 22 bp, Homo sapiens
ctctagaaagattgttgaccaa

SEQ ID NO: 8445938 - DNA, 22 bp, Homo sapiens
ctctagaacagtgctgagcctt

SEQ ID NO: 8445939 - DNA, 21 bp, Homo sapiens
ctctagaaatcgaataacctt

SEQ ID NO: 8445940 - DNA, 22 bp, Homo sapiens
ctctagacaacttgctgtgggt

SEQ ID NO: 8445941 - DNA, 22 bp, Homo sapiens
ctctagaatgaattagcgcagg

SEQ ID NO: 8445942 - DNA, 18 bp, Homo sapiens
ctctagaatgggagattt

SEQ ID NO: 8445943 - DNA, 22 bp, Homo sapiens
ctctagaaggtctccctgccag

SEQ ID NO: 8445944 - DNA, 22 bp, Homo sapiens
ctctagaagctgaggggcccaa

SEQ ID NO: 8445945 - DNA, 22 bp, Homo sapiens
ctctagaactgattgggaagaa

SEQ ID NO: 8445946 - DNA, 22 bp, Homo sapiens
ctctaggccatccagggccatt

SEQ ID NO: 8445947 - DNA, 22 bp, Homo sapiens
ctctaggctgcccaggagctga

SEQ ID NO: 8445948 - DNA, 22 bp, Homo sapiens
ctctaggctgcccaggagctga

SEQ ID NO: 8445949 - DNA, 22 bp, Homo sapiens
ctctagagtacgggctggcatg

SEQ ID NO: 8445950 - DNA, 22 bp, Homo sapiens
ctctagaggcttgaatgggcga

SEQ ID NO: 8445951 - DNA, 22 bp, Homo sapiens
ctctagctgaggtcactgctat

SEQ ID NO: 8445952 - DNA, 22 bp, Homo sapiens
tttctctctgactgggagctga

SEQ ID NO: 8445953 - DNA, 22 bp, Homo sapiens
tttctctcttaaggagtttaaa

SEQ ID NO: 8445954 - DNA, 22 bp, Homo sapiens
tttctctctggccctgattgtc

SEQ ID NO: 8445955 - DNA, 22 bp, Homo sapiens
ctctctggaattaaagcccaat

SEQ ID NO: 8445956 - DNA, 22 bp, Homo sapiens
ctctctggaattaaagcccaat

SEQ ID NO: 8445957 - DNA, 22 bp, Homo sapiens
ctctctggaattaaagcccaat

SEQ ID NO: 8445958 - DNA, 20 bp, Homo sapiens
ctctctggaaggtgggagcc

SEQ ID NO: 8445959 - DNA, 22 bp, Homo sapiens
ctctctggacttgagtatcagc

SEQ ID NO: 8445960 - DNA, 22 bp, Homo sapiens
ctctctggacctcaactatttt

SEQ ID NO: 8445961 - DNA, 22 bp, Homo sapiens
tttctctgaggctggcctccct

SEQ ID NO: 8445962 - DNA, 23 bp, Homo sapiens
tttctctgagaagcagttctcta

SEQ ID NO: 8445963 - DNA, 22 bp, Homo sapiens
tttctctgagttgttacaaaac

SEQ ID NO: 8445964 - DNA, 22 bp, Homo sapiens
tttctctgctgcctgtgtcgat

SEQ ID NO: 8445965 - DNA, 22 bp, Homo sapiens
tttctctgctgtgttggcagct

SEQ ID NO: 8445966 - DNA, 22 bp, Homo sapiens
tttctctgcagagccccaagga

SEQ ID NO: 8445967 - DNA, 22 bp, Homo sapiens
tttctctgccagttattttcct

SEQ ID NO: 8445968 - DNA, 22 bp, Homo sapiens
tttctctggcctcagtttaaca

SEQ ID NO: 8445969 - DNA, 22 bp, Homo sapiens
tttctctggcctcagtttaaca

SEQ ID NO: 8445970 - DNA, 22 bp, Homo sapiens
tttctctggcattaggtataaa

SEQ ID NO: 8445971 - DNA, 22 bp, Homo sapiens
ctctctggatatttgtatgctg

SEQ ID NO: 8445972 - DNA, 22 bp, Homo sapiens
ctctctggcacttcattgctgt

SEQ ID NO: 8445973 - DNA, 22 bp, Homo sapiens
ctctctggcacttcattgctgt

SEQ ID NO: 8445974 - DNA, 22 bp, Homo sapiens
ctctctggcacttcattgctgt

SEQ ID NO: 8445975 - DNA, 22 bp, Homo sapiens
ctctctggcccatcctgttgcc

SEQ ID NO: 8445976 - DNA, 22 bp, Homo sapiens
ctctgagctgaaacatgagcat

SEQ ID NO: 8445977 - DNA, 22 bp, Homo sapiens
ctctgagctgaaacatgagcat

SEQ ID NO: 8445978 - DNA, 22 bp, Homo sapiens
ctctgaggcttgttctatgtat

SEQ ID NO: 8445979 - DNA, 20 bp, Homo sapiens
ctctgaggctgagaagggag

SEQ ID NO: 8445980 - DNA, 22 bp, Homo sapiens
ctctgaggctccatgcaggctt

SEQ ID NO: 8445981 - DNA, 22 bp, Homo sapiens
ctctgaggaagtcaagtagcca

SEQ ID NO: 8445982 - DNA, 22 bp, Homo sapiens
ctctgagctttgcagcccctgg

SEQ ID NO: 8445983 - DNA, 22 bp, Homo sapiens
ctctgaggagaaagagcttggt

SEQ ID NO: 8445984 - DNA, 22 bp, Homo sapiens
ctctgagggctcgagggacgcg

SEQ ID NO: 8445985 - DNA, 22 bp, Homo sapiens
ctctgagggctgtcaggaaagg

SEQ ID NO: 8445986 - DNA, 19 bp, Homo sapiens
tttctgtttgcttctggtt

SEQ ID NO: 8445987 - DNA, 19 bp, Homo sapiens
tttctgtttgcttctggtt

SEQ ID NO: 8445988 - DNA, 22 bp, Homo sapiens
tttctgtttagcataaagtggc

SEQ ID NO: 8445989 - DNA, 22 bp, Homo sapiens
tttctgttgttggtgtctggct

SEQ ID NO: 8445990 - DNA, 22 bp, Homo sapiens
tttctgttgtatggcttctgca

SEQ ID NO: 8445991 - DNA, 22 bp, Homo sapiens
tttctgttgtacttaaactagg

SEQ ID NO: 8445992 - DNA, 22 bp, Homo sapiens
ctctgagggtctaaggagtcac

SEQ ID NO: 8445993 - DNA, 22 bp, Homo sapiens
ctctgaggtcctacagtgaccc

SEQ ID NO: 8445994 - DNA, 22 bp, Homo sapiens
ctctgctgctttgccagtggaa

SEQ ID NO: 8445995 - DNA, 20 bp, Homo sapiens
ctctgctgcgcatcccactt

SEQ ID NO: 8445996 - DNA, 19 bp, Homo sapiens
ctctgcctctggctgtggc

SEQ ID NO: 8445997 - DNA, 22 bp, Homo sapiens
ctctgctggtgaccactgggcc

SEQ ID NO: 8445998 - DNA, 21 bp, Homo sapiens
ctctgctgtctaccagctgtt

SEQ ID NO: 8445999 - DNA, 22 bp, Homo sapiens
tttcttaatttgagttccacta

SEQ ID NO: 8446000 - DNA, 22 bp, Homo sapiens
tttcttaggctctaaaatgact

SEQ ID NO: 8446001 - DNA, 22 bp, Homo sapiens
tttcttatactatattgtcatc

SEQ ID NO: 8446002 - DNA, 22 bp, Homo sapiens
tttcttcttgatttaaacaggg

SEQ ID NO: 8446003 - DNA, 22 bp, Homo sapiens
tttcttcttgagtaaccagatt

SEQ ID NO: 8446004 - DNA, 19 bp, Homo sapiens
ctctggagcagacactgga

SEQ ID NO: 8446005 - DNA, 22 bp, Homo sapiens
ctctggaattgacctgggaggg

SEQ ID NO: 8446006 - DNA, 22 bp, Homo sapiens
tttgaagtgtatgaaaatacag

SEQ ID NO: 8446007 - DNA, 22 bp, Homo sapiens
tttgaagggcacgacaatagtt

SEQ ID NO: 8446008 - DNA, 22 bp, Homo sapiens
tttgaagggcacgacaatagtt

SEQ ID NO: 8446009 - DNA, 18 bp, Homo sapiens
tttgaaggatggcctgga

SEQ ID NO: 8446010 - DNA, 22 bp, Homo sapiens
tttgaagtgggcattagaacct

SEQ ID NO: 8446011 - DNA, 22 bp, Homo sapiens
ctctggaggccgttggccctta

SEQ ID NO: 8446012 - DNA, 22 bp, Homo sapiens
ctctggaggcctaaggaagtgg

SEQ ID NO: 8446013 - DNA, 22 bp, Homo sapiens
ctctggagggaggctgagctgg

SEQ ID NO: 8446014 - DNA, 22 bp, Homo sapiens
ctctggagggaggctgagctgg

SEQ ID NO: 8446015 - DNA, 21 bp, Homo sapiens
ctctggagtcaagagcttcca

SEQ ID NO: 8446016 - DNA, 22 bp, Homo sapiens
ctgaggaagacagcagctgtgt

SEQ ID NO: 8446017 - DNA, 22 bp, Homo sapiens
ctgaggaagacagcagctgtgt

SEQ ID NO: 8446018 - DNA, 22 bp, Homo sapiens
ctgaggaaagctgcagcggtac

SEQ ID NO: 8446019 - DNA, 22 bp, Homo sapiens
ctgaggaaggagttaggcagtt

SEQ ID NO: 8446020 - DNA, 22 bp, Homo sapiens
ctgaggaaggagttaggcagtt

SEQ ID NO: 8446021 - DNA, 22 bp, Homo sapiens
ctgaggaatgagtgaggagcca

SEQ ID NO: 8446022 - DNA, 22 bp, Homo sapiens
ctgaggaatgagtgaggagcca

SEQ ID NO: 8446023 - DNA, 22 bp, Homo sapiens
ctgagctgtttaatcccagata

SEQ ID NO: 8446024 - DNA, 21 bp, Homo sapiens
ctgagctggggtgaaggttgc

SEQ ID NO: 8446025 - DNA, 22 bp, Homo sapiens
ctgagctggtgtttcagggtca

SEQ ID NO: 8446026 - DNA, 22 bp, Homo sapiens
ctgagctggtggaagcatgcag

SEQ ID NO: 8446027 - DNA, 22 bp, Homo sapiens
ctgagctggttctcttgtgaaa

SEQ ID NO: 8446028 - DNA, 22 bp, Homo sapiens
ctgagctgtcaggaatggaaag

SEQ ID NO: 8446029 - DNA, 22 bp, Homo sapiens
ctgagctgtgctaagtgaaatg

SEQ ID NO: 8446030 - DNA, 22 bp, Homo sapiens
ctgagctgttactctgtcctcg

SEQ ID NO: 8446031 - DNA, 22 bp, Homo sapiens
ctgagctgtggaataaacactg

SEQ ID NO: 8446032 - DNA, 22 bp, Homo sapiens
ctgagggatgggctgggccgcc

SEQ ID NO: 8446033 - DNA, 22 bp, Homo sapiens
ctgagggatgggctgggccgcc

SEQ ID NO: 8446034 - DNA, 22 bp, Homo sapiens
ctgagggatgtggattttggtc

SEQ ID NO: 8446035 - DNA, 22 bp, Homo sapiens
ctgagggagttcctgagcccac

SEQ ID NO: 8446036 - DNA, 22 bp, Homo sapiens
ctgagggagggactttgagact

SEQ ID NO: 8446037 - DNA, 22 bp, Homo sapiens
ctgagggaggagaattgcttga

SEQ ID NO: 8446038 - DNA, 22 bp, Homo sapiens
ctgagggagctgctggccttgg

SEQ ID NO: 8446039 - DNA, 22 bp, Homo sapiens
ctgagggagacagtgcggacta

SEQ ID NO: 8446040 - DNA, 22 bp, Homo sapiens
ctgagggagagaatggggcaaa

SEQ ID NO: 8446041 - DNA, 22 bp, Homo sapiens
ctgagggaccctgtgagtacct

SEQ ID NO: 8446042 - DNA, 22 bp, Homo sapiens
ctgagggagaagtcacgggcag

SEQ ID NO: 8446043 - DNA, 22 bp, Homo sapiens
ctgagggagaagtgatctctac

SEQ ID NO: 8446044 - DNA, 22 bp, Homo sapiens
ctgaggacattgatgaggcaat

SEQ ID NO: 8446045 - DNA, 22 bp, Homo sapiens
ctgagggaacttgggcaagtct

SEQ ID NO: 8446046 - DNA, 22 bp, Homo sapiens
ctgagggaaggcagtcagttgg

SEQ ID NO: 8446047 - DNA, 22 bp, Homo sapiens
ctgagggaaggggtacatggct

SEQ ID NO: 8446048 - DNA, 22 bp, Homo sapiens
ctgagatctttatacgaggcac

SEQ ID NO: 8446049 - DNA, 22 bp, Homo sapiens
ctgagatctttatacgaggcac

SEQ ID NO: 8446050 - DNA, 22 bp, Homo sapiens
ctgagatctttatacgaggcac

SEQ ID NO: 8446051 - DNA, 22 bp, Homo sapiens
ctgagaggtgacagcgtgctgg

SEQ ID NO: 8446052 - DNA, 22 bp, Homo sapiens
ctgagctgggagtagagactct

SEQ ID NO: 8446053 - DNA, 22 bp, Homo sapiens
ctgagctgggagtagagactct

SEQ ID NO: 8446054 - DNA, 22 bp, Homo sapiens
ctgagctgggagtagagactct

SEQ ID NO: 8446055 - DNA, 22 bp, Homo sapiens
ctgagctgggagtagagactct

SEQ ID NO: 8446056 - DNA, 22 bp, Homo sapiens
ctgagctgggcaactcttagat

SEQ ID NO: 8446057 - DNA, 23 bp, Homo sapiens
ctgagcacagctctgtgggcctc

SEQ ID NO: 8446058 - DNA, 22 bp, Homo sapiens
ctgagcacagaaataagatatt

SEQ ID NO: 8446059 - DNA, 22 bp, Homo sapiens
ctgagcaccccaggacctgcgc

SEQ ID NO: 8446060 - DNA, 22 bp, Homo sapiens
ctgagcacctgctgtgtgccag

SEQ ID NO: 8446061 - DNA, 22 bp, Homo sapiens
ctgagccttgatgtcccttgtc

SEQ ID NO: 8446062 - DNA, 22 bp, Homo sapiens
ctgagccttgatgtcccttgtc

SEQ ID NO: 8446063 - DNA, 22 bp, Homo sapiens
ctgagccttattcaccagccct

SEQ ID NO: 8446064 - DNA, 22 bp, Homo sapiens
ctgagaggtaagcagcgcagtg

SEQ ID NO: 8446065 - DNA, 22 bp, Homo sapiens
ctgagaggggaccagggtgttt

SEQ ID NO: 8446066 - DNA, 22 bp, Homo sapiens
ctgagaggtaagcagcgcagtg

SEQ ID NO: 8446067 - DNA, 22 bp, Homo sapiens
ctgagaggtaagcagcgcagtg

SEQ ID NO: 8446068 - DNA, 22 bp, Homo sapiens
ctgagaggtaagcagcgcagtg

SEQ ID NO: 8446069 - DNA, 22 bp, Homo sapiens
ctgagaggggaccagggtgttt

SEQ ID NO: 8446070 - DNA, 22 bp, Homo sapiens
ctgagaggtgacagcgtgctgg

SEQ ID NO: 8446071 - DNA, 22 bp, Homo sapiens
ctgagaggtgctggtggctgca

SEQ ID NO: 8446072 - DNA, 22 bp, Homo sapiens
ctgagaggcggaggttgcagtg

SEQ ID NO: 8446073 - DNA, 22 bp, Homo sapiens
ctgagagatcaagccacaggat

SEQ ID NO: 8446074 - DNA, 22 bp, Homo sapiens
ctgaataattttctgttgtatg

SEQ ID NO: 8446075 - DNA, 22 bp, Homo sapiens
ctgaaggattagagagcactta

SEQ ID NO: 8446076 - DNA, 22 bp, Homo sapiens
ctgaaagcaaagtaattcttaa

SEQ ID NO: 8446077 - DNA, 22 bp, Homo sapiens
ctgaagggatgtgatttctaca

SEQ ID NO: 8446078 - DNA, 22 bp, Homo sapiens
ctgaaggctgaggctgtgttgt

SEQ ID NO: 8446079 - DNA, 22 bp, Homo sapiens
ctgaaggcttgttgttttctta

SEQ ID NO: 8446080 - DNA, 22 bp, Homo sapiens
ctgaagggtctggggctgtgcc

SEQ ID NO: 8446081 - DNA, 22 bp, Homo sapiens
ctgaaggatttagttctttgct

SEQ ID NO: 8446082 - DNA, 18 bp, Homo sapiens
ctgaaggcaccagggcag

SEQ ID NO: 8446083 - DNA, 18 bp, Homo sapiens
ctgaaggcaccagggcag

SEQ ID NO: 8446084 - DNA, 22 bp, Homo sapiens
ctgaaggcaccaggggtgccag

SEQ ID NO: 8446085 - DNA, 22 bp, Homo sapiens
ctgaaggcatttttgctgattt

SEQ ID NO: 8446086 - DNA, 22 bp, Homo sapiens
ctgaaggcatttttgctgattt

SEQ ID NO: 8446087 - DNA, 22 bp, Homo sapiens
ctgaaggctaaaatggactgaa

SEQ ID NO: 8446088 - DNA, 22 bp, Homo sapiens
ctgaaactggtcaattaatctg

SEQ ID NO: 8446089 - DNA, 22 bp, Homo sapiens
ctgaaactttagttctgcaaca

SEQ ID NO: 8446090 - DNA, 22 bp, Homo sapiens
ctgaaagaataagatgtttaca

SEQ ID NO: 8446091 - DNA, 22 bp, Homo sapiens
ctgaaactccatgagaaattgc

SEQ ID NO: 8446092 - DNA, 22 bp, Homo sapiens
tttttcttgtgctggatctaat

SEQ ID NO: 8446093 - DNA, 22 bp, Homo sapiens
tttttcttaaatgtgggttggc

SEQ ID NO: 8446094 - DNA, 22 bp, Homo sapiens
tttttcttaaatgtgggttggc

SEQ ID NO: 8446095 - DNA, 19 bp, Homo sapiens
tttttacaagtaggtgtga

SEQ ID NO: 8446096 - DNA, 22 bp, Homo sapiens
ttttctctccaggtggggtgat

SEQ ID NO: 8446097 - DNA, 19 bp, Homo sapiens
tttttaatgggctggagca

SEQ ID NO: 8446098 - DNA, 19 bp, Homo sapiens
tttttacaagtaggtgtga

SEQ ID NO: 8446099 - DNA, 22 bp, Homo sapiens
ttttctctacaaaataaccagc

SEQ ID NO: 8446100 - DNA, 22 bp, Homo sapiens
ttttctctatattgtctgtgaa

SEQ ID NO: 8446101 - DNA, 22 bp, Homo sapiens
ttttcctctgtatttgaaatgc

SEQ ID NO: 8446102 - DNA, 22 bp, Homo sapiens
ttttcctctgtatgcgtgagat

SEQ ID NO: 8446103 - DNA, 22 bp, Homo sapiens
ctctggagtgcagcctggtggc

SEQ ID NO: 8446104 - DNA, 22 bp, Homo sapiens
ttttctcaggtgcttatctaag

SEQ ID NO: 8446105 - DNA, 22 bp, Homo sapiens
ctgcctgcatcccacagtgggg

SEQ ID NO: 8446106 - DNA, 22 bp, Homo sapiens
ctgcgtgagcgtgcccgtcttg

SEQ ID NO: 8446107 - DNA, 22 bp, Homo sapiens
ctgcctctgttgggcatggtct

SEQ ID NO: 8446108 - DNA, 22 bp, Homo sapiens
ctgcctgaactgggtgagcaag

SEQ ID NO: 8446109 - DNA, 22 bp, Homo sapiens
ctgcctcttgacagatcgtggc

SEQ ID NO: 8446110 - DNA, 22 bp, Homo sapiens
ctgcctgcactgcctggctcca

SEQ ID NO: 8446111 - DNA, 22 bp, Homo sapiens
ctgcctgagtacaagtcccaga

SEQ ID NO: 8446112 - DNA, 22 bp, Homo sapiens
ctgctcctccccatcaggcagc

SEQ ID NO: 8446113 - DNA, 22 bp, Homo sapiens
ctgctccaggatttcaggccag

SEQ ID NO: 8446114 - DNA, 22 bp, Homo sapiens
ctgctcctgtccagcagggcca

SEQ ID NO: 8446115 - DNA, 22 bp, Homo sapiens
ctgctcctggtcatcctccact

SEQ ID NO: 8446116 - DNA, 22 bp, Homo sapiens
ctgctcctggtcatcctccact

SEQ ID NO: 8446117 - DNA, 22 bp, Homo sapiens
ctgctcctccccatcaggcagc

SEQ ID NO: 8446118 - DNA, 23 bp, Homo sapiens
ctgctccaggacagcatggaggt

SEQ ID NO: 8446119 - DNA, 22 bp, Homo sapiens
ctgctccagacacctgcagggg

SEQ ID NO: 8446120 - DNA, 19 bp, Homo sapiens
ctgctccaggagctgggga

SEQ ID NO: 8446121 - DNA, 22 bp, Homo sapiens
ctgctggcctcggccatgcctg

SEQ ID NO: 8446122 - DNA, 22 bp, Homo sapiens
ctgctggcctagcccatcctct

SEQ ID NO: 8446123 - DNA, 22 bp, Homo sapiens
ctgctggcccccatttcagggt

SEQ ID NO: 8446124 - DNA, 22 bp, Homo sapiens
ctgctggcccccatttcagggt

SEQ ID NO: 8446125 - DNA, 22 bp, Homo sapiens
ctgctggaggttggagcatgca

SEQ ID NO: 8446126 - DNA, 22 bp, Homo sapiens
ctgctgctgagagctcagcctg

SEQ ID NO: 8446127 - DNA, 22 bp, Homo sapiens
ctgctgctgagagctcagcctg

SEQ ID NO: 8446128 - DNA, 22 bp, Homo sapiens
ctgctgctgagaatgcctcagg

SEQ ID NO: 8446129 - DNA, 21 bp, Homo sapiens
ctgctgctggggtctgggcag

SEQ ID NO: 8446130 - DNA, 19 bp, Homo sapiens
ctgctctccttgacttgga

SEQ ID NO: 8446131 - DNA, 22 bp, Homo sapiens
ctgctgagccgcacccaggagc

SEQ ID NO: 8446132 - DNA, 22 bp, Homo sapiens
ctgctgcccctgagctcagcct

SEQ ID NO: 8446133 - DNA, 22 bp, Homo sapiens
ctgctgccggcgagcctccctt

SEQ ID NO: 8446134 - DNA, 20 bp, Homo sapiens
ctgctgccctgtcagcctct

SEQ ID NO: 8446135 - DNA, 20 bp, Homo sapiens
ctgctgccctgtcagcctct

SEQ ID NO: 8446136 - DNA, 22 bp, Homo sapiens
ctgcaggggctggagttggctt

SEQ ID NO: 8446137 - DNA, 22 bp, Homo sapiens
ctgcaggggctggagttggctt

SEQ ID NO: 8446138 - DNA, 23 bp, Homo sapiens
ctgaggggaaaagggcttcaggc

SEQ ID NO: 8446139 - DNA, 22 bp, Homo sapiens
ctgcaggggcctcgagcacagg

SEQ ID NO: 8446140 - DNA, 22 bp, Homo sapiens
ctgcaggggcctcgagcacagg

SEQ ID NO: 8446141 - DNA, 22 bp, Homo sapiens
ctgcaggggcctcgagcacagg

SEQ ID NO: 8446142 - DNA, 22 bp, Homo sapiens
ctgcagggtttttcaaggacaa

SEQ ID NO: 8446143 - DNA, 22 bp, Homo sapiens
ctgcaggttgagcagccaggtt

SEQ ID NO: 8446144 - DNA, 22 bp, Homo sapiens
ctgcaggttgagcagccaggtt

SEQ ID NO: 8446145 - DNA, 22 bp, Homo sapiens
ctgcaggttaggagcactcctt

SEQ ID NO: 8446146 - DNA, 22 bp, Homo sapiens
ctgcaggttgagcagccaggtt

SEQ ID NO: 8446147 - DNA, 22 bp, Homo sapiens
ctgagggctggagctgaggcct

SEQ ID NO: 8446148 - DNA, 22 bp, Homo sapiens
ctgagggcctgaggacctagat

SEQ ID NO: 8446149 - DNA, 22 bp, Homo sapiens
ctgagggcctgaggacctagat

SEQ ID NO: 8446150 - DNA, 22 bp, Homo sapiens
ctgcatatgatagatgccttgc

SEQ ID NO: 8446151 - DNA, 22 bp, Homo sapiens
ctgcatatgagaataggagaaa

SEQ ID NO: 8446152 - DNA, 22 bp, Homo sapiens
ctgcagtgaggattcttaggtg

SEQ ID NO: 8446153 - DNA, 22 bp, Homo sapiens
ctgcagtgaaatcaggaagcaa

SEQ ID NO: 8446154 - DNA, 20 bp, Homo sapiens
ctgccctgccctgggtcctg

SEQ ID NO: 8446155 - DNA, 20 bp, Homo sapiens
ctgccctgccctgggtcctg

SEQ ID NO: 8446156 - DNA, 22 bp, Homo sapiens
ctgccctgcctggccagtgtgg

SEQ ID NO: 8446157 - DNA, 22 bp, Homo sapiens
ctgccctgcccaggccttgggc

SEQ ID NO: 8446158 - DNA, 22 bp, Homo sapiens
ctgccctgcttgatgacagcga

SEQ ID NO: 8446159 - DNA, 22 bp, Homo sapiens
ctgccctgcttgatgacagcga

SEQ ID NO: 8446160 - DNA, 22 bp, Homo sapiens
ctgccctgcttctgagggaagc

SEQ ID NO: 8446161 - DNA, 22 bp, Homo sapiens
ctgccctgctggagatcacagt

SEQ ID NO: 8446162 - DNA, 22 bp, Homo sapiens
ctgccctgagggcctgtgtgtt

SEQ ID NO: 8446163 - DNA, 22 bp, Homo sapiens
ctgccctgcagctccacggact

SEQ ID NO: 8446164 - DNA, 22 bp, Homo sapiens
ctgccctgcagctccacggact

SEQ ID NO: 8446165 - DNA, 22 bp, Homo sapiens
ctgcccctggctggtgaagcag

SEQ ID NO: 8446166 - DNA, 22 bp, Homo sapiens
ctgcccctggtgatggacgcca

SEQ ID NO: 8446167 - DNA, 22 bp, Homo sapiens
ctgcctctggttttggtccctg

SEQ ID NO: 8446168 - DNA, 22 bp, Homo sapiens
ctgcctctggttttggtccctg

SEQ ID NO: 8446169 - DNA, 22 bp, Homo sapiens
ctgcctctggttttggtccctg

SEQ ID NO: 8446170 - DNA, 22 bp, Homo sapiens
ctgcctctggcctcaggcccag

SEQ ID NO: 8446171 - DNA, 22 bp, Homo sapiens
ctgcctctggcctcaggcccag

SEQ ID NO: 8446172 - DNA, 22 bp, Homo sapiens
ctgcctctattcactgaggcag

SEQ ID NO: 8446173 - DNA, 22 bp, Homo sapiens
ctgccctgggccaggaagcggc

SEQ ID NO: 8446174 - DNA, 22 bp, Homo sapiens
ctgccctgggatggtctgtgcg

SEQ ID NO: 8446175 - DNA, 22 bp, Homo sapiens
ctgccctgcttgatgacagcga

SEQ ID NO: 8446176 - DNA, 22 bp, Homo sapiens
ctgccctggcagcctaccatgg

SEQ ID NO: 8446177 - DNA, 22 bp, Homo sapiens
ctgccctggaaaacgtatctta

SEQ ID NO: 8446178 - DNA, 22 bp, Homo sapiens
ctgccctgggagtacctgtcct

SEQ ID NO: 8446179 - DNA, 22 bp, Homo sapiens
ctgccctggccactgtgcccag

SEQ ID NO: 8446180 - DNA, 22 bp, Homo sapiens
gtaagttatattaaaatttcag

SEQ ID NO: 8446181 - DNA, 19 bp, Homo sapiens
gtaacagtggacattttag

SEQ ID NO: 8446182 - DNA, 22 bp, Homo sapiens
gtaacacttggctgcaacctgg

SEQ ID NO: 8446183 - DNA, 22 bp, Homo sapiens
gtaacactggcaccgtctcaca

SEQ ID NO: 8446184 - DNA, 22 bp, Homo sapiens
gtaacacttggctgcaacctgg

SEQ ID NO: 8446185 - DNA, 22 bp, Homo sapiens
gtaacacagaaatgaaattcca

SEQ ID NO: 8446186 - DNA, 22 bp, Homo sapiens
gtaacactagctctgtcacttt

SEQ ID NO: 8446187 - DNA, 22 bp, Homo sapiens
gtaacactctaaagggatgcac

SEQ ID NO: 8446188 - DNA, 22 bp, Homo sapiens
gtaatagaacactcagcatgga

SEQ ID NO: 8446189 - DNA, 22 bp, Homo sapiens
gtaatagaacactcagcatgga

SEQ ID NO: 8446190 - DNA, 22 bp, Homo sapiens
gtaatagatgaaacaatgtgga

SEQ ID NO: 8446191 - DNA, 22 bp, Homo sapiens
gtaatagtctcaaactcctgga

SEQ ID NO: 8446192 - DNA, 22 bp, Homo sapiens
gtaataatggtccccaaacact

SEQ ID NO: 8446193 - DNA, 22 bp, Homo sapiens
gtaatcgtggtggttaattcca

SEQ ID NO: 8446194 - DNA, 22 bp, Homo sapiens
gtaatctcagctacttgggagg

SEQ ID NO: 8446195 - DNA, 22 bp, Homo sapiens
gtaatctcagctacttgggagg

SEQ ID NO: 8446196 - DNA, 20 bp, Homo sapiens
gtaatgaatgtaaacagtaa

SEQ ID NO: 8446197 - DNA, 22 bp, Homo sapiens
gtaaatcatggtcagaataaat

SEQ ID NO: 8446198 - DNA, 22 bp, Homo sapiens
gtaaatgtgaatgtcatttagc

SEQ ID NO: 8446199 - DNA, 22 bp, Homo sapiens
gtaaattatttcaagatcatct

SEQ ID NO: 8446200 - DNA, 22 bp, Homo sapiens
gtaaattatttcaagatcatct

SEQ ID NO: 8446201 - DNA, 22 bp, Homo sapiens
gtaaattatttcaagatcatct

SEQ ID NO: 8446202 - DNA, 22 bp, Homo sapiens
ggtgggcagctcttggcaggca

SEQ ID NO: 8446203 - DNA, 22 bp, Homo sapiens
gtagataaggattgatttttat

SEQ ID NO: 8446204 - DNA, 21 bp, Homo sapiens
gtagataaagcattttcatta

SEQ ID NO: 8446205 - DNA, 18 bp, Homo sapiens
gtagatccttgagctacc

SEQ ID NO: 8446206 - DNA, 22 bp, Homo sapiens
gtagacatctagatttatgtgt

SEQ ID NO: 8446207 - DNA, 22 bp, Homo sapiens
gtagacaggttataaatcagtg

SEQ ID NO: 8446208 - DNA, 23 bp, Homo sapiens
gtaatgatgggaatttacttaga

SEQ ID NO: 8446209 - DNA, 22 bp, Homo sapiens
gtagaccatttatctggggagt

SEQ ID NO: 8446210 - DNA, 22 bp, Homo sapiens
gtagcccacctggggagggcga

SEQ ID NO: 8446211 - DNA, 22 bp, Homo sapiens
gtagcaactgtagcccaaattc

SEQ ID NO: 8446212 - DNA, 22 bp, Homo sapiens
gtagcacatgattttgatatgt

SEQ ID NO: 8446213 - DNA, 22 bp, Homo sapiens
gtagattccagtggtctgtgtc

SEQ ID NO: 8446214 - DNA, 22 bp, Homo sapiens
gtagctacttagagccgttctt

SEQ ID NO: 8446215 - DNA, 22 bp, Homo sapiens
gtagctatttatgatactcatg

SEQ ID NO: 8446216 - DNA, 22 bp, Homo sapiens
gtagctctgtttaaagttcttt

SEQ ID NO: 8446217 - DNA, 22 bp, Homo sapiens
gtagctctgtttaaagttcttt

SEQ ID NO: 8446218 - DNA, 22 bp, Homo sapiens
gtagcctagaggtcacgtcttc

SEQ ID NO: 8446219 - DNA, 22 bp, Homo sapiens
gtagcttacatcagagttggtt

SEQ ID NO: 8446220 - DNA, 22 bp, Homo sapiens
gtagctgcctttctggcccagg

SEQ ID NO: 8446221 - DNA, 22 bp, Homo sapiens
gtagctgatcctgaggacaggg

SEQ ID NO: 8446222 - DNA, 22 bp, Homo sapiens
gtagcttcaagtactctccctg

SEQ ID NO: 8446223 - DNA, 22 bp, Homo sapiens
gtagcttccagaaagtgtcttt

SEQ ID NO: 8446224 - DNA, 22 bp, Homo sapiens
gtagcttccagaaagtgtcttt

SEQ ID NO: 8446225 - DNA, 22 bp, Homo sapiens
gtcaacagagacagagacactg

SEQ ID NO: 8446226 - DNA, 22 bp, Homo sapiens
gtcaacaattccagtttttact

SEQ ID NO: 8446227 - DNA, 22 bp, Homo sapiens
gtcaacaagtggttattgggat

SEQ ID NO: 8446228 - DNA, 22 bp, Homo sapiens
gtcaacaagtagttttcttcca

SEQ ID NO: 8446229 - DNA, 22 bp, Homo sapiens
gtaggaagctctgaggctagtt

SEQ ID NO: 8446230 - DNA, 17 bp, Homo sapiens
gtcaacaggatttcttt

SEQ ID NO: 8446231 - DNA, 22 bp, Homo sapiens
gtcaacatttactgccctggcc

SEQ ID NO: 8446232 - DNA, 22 bp, Homo sapiens
gtcaataattttatggagagaa

SEQ ID NO: 8446233 - DNA, 22 bp, Homo sapiens
gtcacaaaggtgagggacatga

SEQ ID NO: 8446234 - DNA, 22 bp, Homo sapiens
gtcaatataggtttcaaacatg

SEQ ID NO: 8446235 - DNA, 19 bp, Homo sapiens
gtcacatttgtctcccagg

SEQ ID NO: 8446236 - DNA, 22 bp, Homo sapiens
gtcacatgccagtgcacacagg

SEQ ID NO: 8446237 - DNA, 19 bp, Homo sapiens
gtcacatttgtctcccagg

SEQ ID NO: 8446238 - DNA, 22 bp, Homo sapiens
gtcaggctggggctgctgccag

SEQ ID NO: 8446239 - DNA, 22 bp, Homo sapiens
gtcagggcacagtgacagctcc

SEQ ID NO: 8446240 - DNA, 22 bp, Homo sapiens
gtcagttattttgagcaattgg

SEQ ID NO: 8446241 - DNA, 22 bp, Homo sapiens
gtcagttacagccacggcgggt

SEQ ID NO: 8446242 - DNA, 22 bp, Homo sapiens
gtcagttattcaattggtttaa

SEQ ID NO: 8446243 - DNA, 22 bp, Homo sapiens
gtcattcagagatgcaggtaga

SEQ ID NO: 8446244 - DNA, 22 bp, Homo sapiens
gtcattcaactgcacattaggt

SEQ ID NO: 8446245 - DNA, 22 bp, Homo sapiens
gtcagtcatattgtacagatat

SEQ ID NO: 8446246 - DNA, 22 bp, Homo sapiens
gtcagtgcttgaagggcagaga

SEQ ID NO: 8446247 - DNA, 22 bp, Homo sapiens
gtcaggggccatgggccaagga

SEQ ID NO: 8446248 - DNA, 22 bp, Homo sapiens
gtcaggggatgtgctggtggcc

SEQ ID NO: 8446249 - DNA, 22 bp, Homo sapiens
gtcagtaggaacctagggtcaa

SEQ ID NO: 8446250 - DNA, 22 bp, Homo sapiens
gtcagtaggaacctagggtcaa

SEQ ID NO: 8446251 - DNA, 22 bp, Homo sapiens
gtcattttatgggaacagattt

SEQ ID NO: 8446252 - DNA, 22 bp, Homo sapiens
gtccctggagctgagcagtgct

SEQ ID NO: 8446253 - DNA, 22 bp, Homo sapiens
gtccctggagctgagcagtgct

SEQ ID NO: 8446254 - DNA, 22 bp, Homo sapiens
gtcatttaggtctgtcagaaat

SEQ ID NO: 8446255 - DNA, 22 bp, Homo sapiens
gtcatttaaaagggaacacatg

SEQ ID NO: 8446256 - DNA, 22 bp, Homo sapiens
gtcatttatcatcagaagtcat

SEQ ID NO: 8446257 - DNA, 22 bp, Homo sapiens
gtcctcagaagcctgcttagct

SEQ ID NO: 8446258 - DNA, 22 bp, Homo sapiens
gtcctcagcaccagaactaggg

SEQ ID NO: 8446259 - DNA, 21 bp, Homo sapiens
gtcctcagctgatgggagctg

SEQ ID NO: 8446260 - DNA, 22 bp, Homo sapiens
gtcctcaggaaggctttctgac

SEQ ID NO: 8446261 - DNA, 22 bp, Homo sapiens
gtctcctaaaccatcctggtac

SEQ ID NO: 8446262 - DNA, 22 bp, Homo sapiens
gtctccccagggccctcttcat

SEQ ID NO: 8446263 - DNA, 22 bp, Homo sapiens
gtctcccatctctgtccttgtg

SEQ ID NO: 8446264 - DNA, 22 bp, Homo sapiens
gtcctctccaggaggctctgat

SEQ ID NO: 8446265 - DNA, 22 bp, Homo sapiens
gtcctctgagggggctgcacgc

SEQ ID NO: 8446266 - DNA, 22 bp, Homo sapiens
gtcctctgactcagccttggga

SEQ ID NO: 8446267 - DNA, 22 bp, Homo sapiens
gtcctctgatttctaggtatat

SEQ ID NO: 8446268 - DNA, 22 bp, Homo sapiens
gtgcaagcagtacactcaaagc

SEQ ID NO: 8446269 - DNA, 22 bp, Homo sapiens
gtgcaagacttcctaagcaata

SEQ ID NO: 8446270 - DNA, 22 bp, Homo sapiens
gtgcaatattgccatgttcttg

SEQ ID NO: 8446271 - DNA, 22 bp, Homo sapiens
gtgcaaccatcaccactgactc

SEQ ID NO: 8446272 - DNA, 22 bp, Homo sapiens
gtgcaacctcgtcagagcacct

SEQ ID NO: 8446273 - DNA, 22 bp, Homo sapiens
gtgcaatctggttaatacgact

SEQ ID NO: 8446274 - DNA, 22 bp, Homo sapiens
gtgcaatcctcatagaactcat

SEQ ID NO: 8446275 - DNA, 22 bp, Homo sapiens
gtgcccaggggccagctgccgg

SEQ ID NO: 8446276 - DNA, 22 bp, Homo sapiens
gtgcccaggggccagctgccgg

SEQ ID NO: 8446277 - DNA, 22 bp, Homo sapiens
gtgcacagaaacatacaatgtg

SEQ ID NO: 8446278 - DNA, 22 bp, Homo sapiens
gtgcacagaaacatacaatgtg

SEQ ID NO: 8446279 - DNA, 22 bp, Homo sapiens
gtgcacagaaattggtaagact

SEQ ID NO: 8446280 - DNA, 22 bp, Homo sapiens
gtgcacagaaacatacaatgtg

SEQ ID NO: 8446281 - DNA, 22 bp, Homo sapiens
gtgcccaggtgtccctgagaag

SEQ ID NO: 8446282 - DNA, 22 bp, Homo sapiens
gtgccctgacacacctggtgtg

SEQ ID NO: 8446283 - DNA, 22 bp, Homo sapiens
gtgccctgagcttatgcattct

SEQ ID NO: 8446284 - DNA, 22 bp, Homo sapiens
gtgccctgatgcaattgtctca

SEQ ID NO: 8446285 - DNA, 22 bp, Homo sapiens
gtgccctgcatgccccgggtat

SEQ ID NO: 8446286 - DNA, 22 bp, Homo sapiens
gtgccctgatcgctaggctccc

SEQ ID NO: 8446287 - DNA, 22 bp, Homo sapiens
gtgccctgatcgctaggctccc

SEQ ID NO: 8446288 - DNA, 22 bp, Homo sapiens
gtgattttgagacctatatagt

SEQ ID NO: 8446289 - DNA, 22 bp, Homo sapiens
gtgcaaaaataattgtggtttt

SEQ ID NO: 8446290 - DNA, 22 bp, Homo sapiens
gtgcaaaaatctatcaccagca

SEQ ID NO: 8446291 - DNA, 22 bp, Homo sapiens
gtgcaaaagcaattgcagtttt

SEQ ID NO: 8446292 - DNA, 22 bp, Homo sapiens
gtgcaaaagcagttggattttt

SEQ ID NO: 8446293 - DNA, 22 bp, Homo sapiens
gtgcaaaagtaactgtggtttt

SEQ ID NO: 8446294 - DNA, 22 bp, Homo sapiens
gtgcaaaagcagttgtggtttt

SEQ ID NO: 8446295 - DNA, 22 bp, Homo sapiens
gtgcaaaagtaaatgtggtttt

SEQ ID NO: 8446296 - DNA, 22 bp, Homo sapiens
gtgcaaaaggcattgtggtttt

SEQ ID NO: 8446297 - DNA, 22 bp, Homo sapiens
gtgctgggattacaggtgtgag

SEQ ID NO: 8446298 - DNA, 22 bp, Homo sapiens
gtgctgggattacaggtgtgag

SEQ ID NO: 8446299 - DNA, 22 bp, Homo sapiens
gtgctgggccctgagaccaggg

SEQ ID NO: 8446300 - DNA, 22 bp, Homo sapiens
gtgctggggagataggaagaga

SEQ ID NO: 8446301 - DNA, 22 bp, Homo sapiens
gtgctgggggtttctgtaggtc

SEQ ID NO: 8446302 - DNA, 22 bp, Homo sapiens
gtgctgggtgctgcagacaggt

SEQ ID NO: 8446303 - DNA, 22 bp, Homo sapiens
gtgctgggtgctgcagacaggt

SEQ ID NO: 8446304 - DNA, 22 bp, Homo sapiens
gtgcttctttctcctcaagcct

SEQ ID NO: 8446305 - DNA, 22 bp, Homo sapiens
gtgctgtcgtggaactgggctg

SEQ ID NO: 8446306 - DNA, 21 bp, Homo sapiens
gtgccctgttcccacatgccc

SEQ ID NO: 8446307 - DNA, 21 bp, Homo sapiens
gtgccctgttcccacatgccc

SEQ ID NO: 8446308 - DNA, 20 bp, Homo sapiens
gtgccctgtgggctattttc

SEQ ID NO: 8446309 - DNA, 22 bp, Homo sapiens
gtgccctggctcacagtgtctc

SEQ ID NO: 8446310 - DNA, 22 bp, Homo sapiens
gtgccctggtccccagcatata

SEQ ID NO: 8446311 - DNA, 22 bp, Homo sapiens
gtctcctggctgcagctaagac

SEQ ID NO: 8446312 - DNA, 22 bp, Homo sapiens
gtctcctgtcctgcaggatgga

SEQ ID NO: 8446313 - DNA, 22 bp, Homo sapiens
gtctctctgctaggcctccagt

SEQ ID NO: 8446314 - DNA, 22 bp, Homo sapiens
gtctggggtactttcatctgat

SEQ ID NO: 8446315 - DNA, 22 bp, Homo sapiens
gtctcctgagactgcagtcacc

SEQ ID NO: 8446316 - DNA, 22 bp, Homo sapiens
gtctcctgagactgcagtcacc

SEQ ID NO: 8446317 - DNA, 22 bp, Homo sapiens
gtctcctggaaatatgcccata

SEQ ID NO: 8446318 - DNA, 22 bp, Homo sapiens
gtctcctggctgcagctaagac

SEQ ID NO: 8446319 - DNA, 22 bp, Homo sapiens
gtctcctggaaatatgcccata

SEQ ID NO: 8446320 - DNA, 22 bp, Homo sapiens
gtctcctggaaatatgcccata

SEQ ID NO: 8446321 - DNA, 22 bp, Homo sapiens
gtcttagatttcaccgataatg

SEQ ID NO: 8446322 - DNA, 22 bp, Homo sapiens
gtcttagatttcaccgataatg

SEQ ID NO: 8446323 - DNA, 22 bp, Homo sapiens
gtcttatagtacaatttgaagt

SEQ ID NO: 8446324 - DNA, 22 bp, Homo sapiens
gtctggtcctcttcacagtggc

SEQ ID NO: 8446325 - DNA, 22 bp, Homo sapiens
gtctggtgggattccaagtggc

SEQ ID NO: 8446326 - DNA, 22 bp, Homo sapiens
gtctggggtactttcatctgat

SEQ ID NO: 8446327 - DNA, 22 bp, Homo sapiens
gtcttattaggttaaccctgct

SEQ ID NO: 8446328 - DNA, 22 bp, Homo sapiens
gtcttctaagtatcaaagcaga

SEQ ID NO: 8446329 - DNA, 20 bp, Homo sapiens
gtcttctattcccagaaagt

SEQ ID NO: 8446330 - DNA, 22 bp, Homo sapiens
gtcttctgatctggttagccat

SEQ ID NO: 8446331 - DNA, 22 bp, Homo sapiens
gtcttccacatttcaagaggct

SEQ ID NO: 8446332 - DNA, 22 bp, Homo sapiens
gtcttatttaaggacaagaaga

SEQ ID NO: 8446333 - DNA, 22 bp, Homo sapiens
gtgaggtctttgggaggtgatt

SEQ ID NO: 8446334 - DNA, 22 bp, Homo sapiens
gtgaggtgcctaataccgtgac

SEQ ID NO: 8446335 - DNA, 22 bp, Homo sapiens
gtgaggcattgaagaccggaat

SEQ ID NO: 8446336 - DNA, 22 bp, Homo sapiens
gtgaggcagggaaagaggataa

SEQ ID NO: 8446337 - DNA, 22 bp, Homo sapiens
gtgaggccgcacgccccggagt

SEQ ID NO: 8446338 - DNA, 22 bp, Homo sapiens
gtgaggctactcagctgtccga

SEQ ID NO: 8446339 - DNA, 22 bp, Homo sapiens
gtgagggaggtagatttcatca

SEQ ID NO: 8446340 - DNA, 16 bp, Homo sapiens
gtgagggacatagctt

SEQ ID NO: 8446341 - DNA, 22 bp, Homo sapiens
gtcttctgtttactttgaagtt

SEQ ID NO: 8446342 - DNA, 22 bp, Homo sapiens
gtcttcttgttttgaaggaaat

SEQ ID NO: 8446343 - DNA, 22 bp, Homo sapiens
gtcttctttaacctactaaagc

SEQ ID NO: 8446344 - DNA, 22 bp, Homo sapiens
gtcttctgttctgtgaggcttc

SEQ ID NO: 8446345 - DNA, 22 bp, Homo sapiens
gtcttctgtaagatgaggtccc

SEQ ID NO: 8446346 - DNA, 22 bp, Homo sapiens
gtcttctggaagagagccagct

SEQ ID NO: 8446347 - DNA, 22 bp, Homo sapiens
gtcttctggggccaggcccgct

SEQ ID NO: 8446348 - DNA, 22 bp, Homo sapiens
gtgataggcatttaactctaag

SEQ ID NO: 8446349 - DNA, 22 bp, Homo sapiens
gtgataactcaggcagagaata

SEQ ID NO: 8446350 - DNA, 22 bp, Homo sapiens
gtgataaaattcaaatagctct

SEQ ID NO: 8446351 - DNA, 22 bp, Homo sapiens
gtgagtctgcctagcacatcac

SEQ ID NO: 8446352 - DNA, 22 bp, Homo sapiens
gtgaggtggtacaatattaact

SEQ ID NO: 8446353 - DNA, 23 bp, Homo sapiens
gtgagtcttgcctttgctgtgga

SEQ ID NO: 8446354 - DNA, 22 bp, Homo sapiens
gtgagtctttggagacagttca

SEQ ID NO: 8446355 - DNA, 22 bp, Homo sapiens
gtgagtctgtggaccgggcact

SEQ ID NO: 8446356 - DNA, 22 bp, Homo sapiens
gtgagtctgtgggtgggaactg

SEQ ID NO: 8446357 - DNA, 22 bp, Homo sapiens
gtgagtcttaagcaccaccttt

SEQ ID NO: 8446358 - DNA, 19 bp, Homo sapiens
gggctctcgagcaaccaac

SEQ ID NO: 8446359 - DNA, 22 bp, Homo sapiens
gggctctcgattagaccctggg

SEQ ID NO: 8446360 - DNA, 22 bp, Homo sapiens
gggctcctgcctcctggcacct

SEQ ID NO: 8446361 - DNA, 22 bp, Homo sapiens
gggctcctggcagtcatgctca

SEQ ID NO: 8446362 - DNA, 20 bp, Homo sapiens
gggctggcgcatggggaaag

SEQ ID NO: 8446363 - DNA, 22 bp, Homo sapiens
gggctggcgggaaaggcaattc

SEQ ID NO: 8446364 - DNA, 22 bp, Homo sapiens
gggctctgaatcccaggtctgc

SEQ ID NO: 8446365 - DNA, 22 bp, Homo sapiens
gggctggcatcggttgctgaga

SEQ ID NO: 8446366 - DNA, 22 bp, Homo sapiens
gggctctctttttggcctgccc

SEQ ID NO: 8446367 - DNA, 22 bp, Homo sapiens
gggctggctaagacttttctgt

SEQ ID NO: 8446368 - DNA, 20 bp, Homo sapiens
gggctggctcaactggatcc

SEQ ID NO: 8446369 - DNA, 20 bp, Homo sapiens
gggctggctcaactggatcc

SEQ ID NO: 8446370 - DNA, 22 bp, Homo sapiens
gggctggctcccaggtgttgaa

SEQ ID NO: 8446371 - DNA, 22 bp, Homo sapiens
gggctggctcccaggtgttgaa

SEQ ID NO: 8446372 - DNA, 22 bp, Homo sapiens
gggctccacctagggacactgg

SEQ ID NO: 8446373 - DNA, 22 bp, Homo sapiens
gggctccagaggctcaccctgg

SEQ ID NO: 8446374 - DNA, 22 bp, Homo sapiens
gggctccagagtccatgttctt

SEQ ID NO: 8446375 - DNA, 22 bp, Homo sapiens
gggctccagcagaggcagccgg

SEQ ID NO: 8446376 - DNA, 22 bp, Homo sapiens
gggctccagcccgggaccaggt

SEQ ID NO: 8446377 - DNA, 22 bp, Homo sapiens
gggctccatcacaggctccatc

SEQ ID NO: 8446378 - DNA, 22 bp, Homo sapiens
gggctccatcacaggctccatc

SEQ ID NO: 8446379 - DNA, 22 bp, Homo sapiens
gggctccagtttggccaggaag

SEQ ID NO: 8446380 - DNA, 22 bp, Homo sapiens
gggcctcaggccttgctctgtg

SEQ ID NO: 8446381 - DNA, 22 bp, Homo sapiens
gggcctcatgatggctcaggaa

SEQ ID NO: 8446382 - DNA, 22 bp, Homo sapiens
gggcctcagctctgctctgcaa

SEQ ID NO: 8446383 - DNA, 22 bp, Homo sapiens
gggcctccggggtgagctgtgg

SEQ ID NO: 8446384 - DNA, 22 bp, Homo sapiens
gggcctccgtgtgctggtgctc

SEQ ID NO: 8446385 - DNA, 22 bp, Homo sapiens
gggcatgcaggactgtggcaga

SEQ ID NO: 8446386 - DNA, 21 bp, Homo sapiens
gggcctggctgcgcaggacgg

SEQ ID NO: 8446387 - DNA, 21 bp, Homo sapiens
gggcctggctgcgcaggacgg

SEQ ID NO: 8446388 - DNA, 21 bp, Homo sapiens
gggcctggctgcgcaggacgg

SEQ ID NO: 8446389 - DNA, 22 bp, Homo sapiens
gggcctgggaacttgcatttag

SEQ ID NO: 8446390 - DNA, 21 bp, Homo sapiens
gggcctggctgcgcaggacgg

SEQ ID NO: 8446391 - DNA, 22 bp, Homo sapiens
gggcctggggacaccaccatga

SEQ ID NO: 8446392 - DNA, 22 bp, Homo sapiens
gggcctggtgcttctgactcct

SEQ ID NO: 8446393 - DNA, 22 bp, Homo sapiens
gggcctggcatgcagccccgtt

SEQ ID NO: 8446394 - DNA, 22 bp, Homo sapiens
gggcctgctccccatcgctgct

SEQ ID NO: 8446395 - DNA, 22 bp, Homo sapiens
gggcctgattagcaggctagct

SEQ ID NO: 8446396 - DNA, 22 bp, Homo sapiens
gggcctgaggcccagacactgg

SEQ ID NO: 8446397 - DNA, 22 bp, Homo sapiens
gggcctgccaggctttcagcat

SEQ ID NO: 8446398 - DNA, 22 bp, Homo sapiens
gggcctgccaggctttcagcat

SEQ ID NO: 8446399 - DNA, 22 bp, Homo sapiens
gggcctgcaggttctgagaggc

SEQ ID NO: 8446400 - DNA, 22 bp, Homo sapiens
ggggcaggagcccttcttcagc

SEQ ID NO: 8446401 - DNA, 22 bp, Homo sapiens
ggggcagctcccgagggcagga

SEQ ID NO: 8446402 - DNA, 22 bp, Homo sapiens
ggggctgttgaagttagttgag

SEQ ID NO: 8446403 - DNA, 22 bp, Homo sapiens
gggggacaggatgaatatctgt

SEQ ID NO: 8446404 - DNA, 22 bp, Homo sapiens
gggggagaagattctgctgctt

SEQ ID NO: 8446405 - DNA, 21 bp, Homo sapiens
gggggaagaggagttgctagt

SEQ ID NO: 8446406 - DNA, 22 bp, Homo sapiens
gggggaagaggcatgaagtcct

SEQ ID NO: 8446407 - DNA, 22 bp, Homo sapiens
gggggaagactgggctagtgat

SEQ ID NO: 8446408 - DNA, 22 bp, Homo sapiens
gggggaagactgggctagtgat

SEQ ID NO: 8446409 - DNA, 22 bp, Homo sapiens
gggggaagactgggctagtgat

SEQ ID NO: 8446410 - DNA, 22 bp, Homo sapiens
gggggaagaaagaacatggcat

SEQ ID NO: 8446411 - DNA, 22 bp, Homo sapiens
gggtcagagtaagcaaggacaa

SEQ ID NO: 8446412 - DNA, 22 bp, Homo sapiens
gggtcagagccgtaacaggact

SEQ ID NO: 8446413 - DNA, 22 bp, Homo sapiens
gggggctaccgtctctggagct

SEQ ID NO: 8446414 - DNA, 22 bp, Homo sapiens
gggggcggagcacgtgaccacg

SEQ ID NO: 8446415 - DNA, 22 bp, Homo sapiens
gggctggctgattttcctctct

SEQ ID NO: 8446416 - DNA, 22 bp, Homo sapiens
gggctgggcatggtgttccctc

SEQ ID NO: 8446417 - DNA, 22 bp, Homo sapiens
gggctggggctcaataatttgt

SEQ ID NO: 8446418 - DNA, 22 bp, Homo sapiens
gggctgggattgcttgctgtga

SEQ ID NO: 8446419 - DNA, 22 bp, Homo sapiens
ggggcagaaagcccacagagtg

SEQ ID NO: 8446420 - DNA, 22 bp, Homo sapiens
ggggcaaagggagagtccctac

SEQ ID NO: 8446421 - DNA, 22 bp, Homo sapiens
ggggatggtgggaaggcaatct

SEQ ID NO: 8446422 - DNA, 22 bp, Homo sapiens
ggggatggaatgtagtagtgat

SEQ ID NO: 8446423 - DNA, 22 bp, Homo sapiens
ggtgccactgcactctggcctg

SEQ ID NO: 8446424 - DNA, 22 bp, Homo sapiens
ggtgccaggctgtagtcagggt

SEQ ID NO: 8446425 - DNA, 22 bp, Homo sapiens
ggtgcccagagccaggaatgag

SEQ ID NO: 8446426 - DNA, 22 bp, Homo sapiens
ggtgccctgtaaaagccatgca

SEQ ID NO: 8446427 - DNA, 22 bp, Homo sapiens
ggtggctgaagcagtcttcggg

SEQ ID NO: 8446428 - DNA, 22 bp, Homo sapiens
ggtgggagtggaacgtggaaga

SEQ ID NO: 8446429 - DNA, 16 bp, Homo sapiens
ggtgggaggtgaggtg

SEQ ID NO: 8446430 - DNA, 16 bp, Homo sapiens
ggtgggaggtgaggtg

SEQ ID NO: 8446431 - DNA, 22 bp, Homo sapiens
ggtgggagggctgcgttcctct

SEQ ID NO: 8446432 - DNA, 22 bp, Homo sapiens
ggtgggatgcctctggagaagt

SEQ ID NO: 8446433 - DNA, 22 bp, Homo sapiens
ggtgggcaacatttggcctgag

SEQ ID NO: 8446434 - DNA, 22 bp, Homo sapiens
ggtgggagccaacacccttctg

SEQ ID NO: 8446435 - DNA, 22 bp, Homo sapiens
ggtgggaggcaggctgctccca

SEQ ID NO: 8446436 - DNA, 22 bp, Homo sapiens
ggtgggaggcaggctgctccca

SEQ ID NO: 8446437 - DNA, 22 bp, Homo sapiens
ggtgggagagcttgctttgatg

SEQ ID NO: 8446438 - DNA, 22 bp, Homo sapiens
ggtgggagagcttgctttgatg

SEQ ID NO: 8446439 - DNA, 22 bp, Homo sapiens
ggtgggagagctctgtctccag

SEQ ID NO: 8446440 - DNA, 22 bp, Homo sapiens
ggtggctgcaccctggctaact

SEQ ID NO: 8446441 - DNA, 22 bp, Homo sapiens
ggtggctgaatcaaatcaggcc

SEQ ID NO: 8446442 - DNA, 22 bp, Homo sapiens
ggtggctgcaatggctaacttc

SEQ ID NO: 8446443 - DNA, 22 bp, Homo sapiens
ggtgcagtgcagggtaattata

SEQ ID NO: 8446444 - DNA, 22 bp, Homo sapiens
ggtgcagggagaggcaggcccc

SEQ ID NO: 8446445 - DNA, 22 bp, Homo sapiens
ggtgcagggagaggcaggcccc

SEQ ID NO: 8446446 - DNA, 22 bp, Homo sapiens
ggtccagtctttcccttctaga

SEQ ID NO: 8446447 - DNA, 22 bp, Homo sapiens
ggtccatgataggaagttccga

SEQ ID NO: 8446448 - DNA, 22 bp, Homo sapiens
ggtccatctcttgagcccacat

SEQ ID NO: 8446449 - DNA, 22 bp, Homo sapiens
ggtcccaaggaggatgaggcta

SEQ ID NO: 8446450 - DNA, 22 bp, Homo sapiens
ggtcccaagtgcttttcctgca

SEQ ID NO: 8446451 - DNA, 22 bp, Homo sapiens
ggtcccaatctaatcacatgag

SEQ ID NO: 8446452 - DNA, 22 bp, Homo sapiens
ggtcccagaattggttagcaca

SEQ ID NO: 8446453 - DNA, 22 bp, Homo sapiens
ggtctggcctcgggcaccccca

SEQ ID NO: 8446454 - DNA, 22 bp, Homo sapiens
ggtctggcctggcattctatgg

SEQ ID NO: 8446455 - DNA, 17 bp, Homo sapiens
ggtctggggccattggc

SEQ ID NO: 8446456 - DNA, 22 bp, Homo sapiens
ggtcttttcacagtggtttgag

SEQ ID NO: 8446457 - DNA, 22 bp, Homo sapiens
ggtcttttcacagtggtttgag

SEQ ID NO: 8446458 - DNA, 22 bp, Homo sapiens
ggtcttttctgctgcaggttgt

SEQ ID NO: 8446459 - DNA, 22 bp, Homo sapiens
ggtcttgtttatataaggtggt

SEQ ID NO: 8446460 - DNA, 22 bp, Homo sapiens
ggtcttctctatgagctggtct

SEQ ID NO: 8446461 - DNA, 22 bp, Homo sapiens
ggtaacacaggtgcagttttaa

SEQ ID NO: 8446462 - DNA, 22 bp, Homo sapiens
ggtaacagttacagtaacagta

SEQ ID NO: 8446463 - DNA, 22 bp, Homo sapiens
ggtaagcacttcatgtacatga

SEQ ID NO: 8446464 - DNA, 22 bp, Homo sapiens
ggtaactgcagaatgtgcctca

SEQ ID NO: 8446465 - DNA, 22 bp, Homo sapiens
gggtccagatggtgagagttaa

SEQ ID NO: 8446466 - DNA, 23 bp, Homo sapiens
gggtccagccaattccaaggaaa

SEQ ID NO: 8446467 - DNA, 23 bp, Homo sapiens
gggtccagccaattccaaggaaa

SEQ ID NO: 8446468 - DNA, 22 bp, Homo sapiens
gggtccagcgacagcaggctca

SEQ ID NO: 8446469 - DNA, 22 bp, Homo sapiens
ggtagaaagatggaacgttgaa

SEQ ID NO: 8446470 - DNA, 22 bp, Homo sapiens
ggtagaaataatcttcaggctg

SEQ ID NO: 8446471 - DNA, 22 bp, Homo sapiens
ggtaccaccaattcagctgcca

SEQ ID NO: 8446472 - DNA, 22 bp, Homo sapiens
ggtacagggcttcctggacaag

SEQ ID NO: 8446473 - DNA, 22 bp, Homo sapiens
ggtaataaaattgtgtcaaaca

SEQ ID NO: 8446474 - DNA, 22 bp, Homo sapiens
gggtcagggctggctgtcgtca

SEQ ID NO: 8446475 - DNA, 22 bp, Homo sapiens
gggtccagaatgagaatgggct

SEQ ID NO: 8446476 - DNA, 22 bp, Homo sapiens
gggtccacctgagcagcagcct

SEQ ID NO: 8446477 - DNA, 22 bp, Homo sapiens
gggtccacctgagcagcagcct

SEQ ID NO: 8446478 - DNA, 22 bp, Homo sapiens
gggtccagacactccagaggaa

SEQ ID NO: 8446479 - DNA, 23 bp, Homo sapiens
gggtccagagaagccattagggc

SEQ ID NO: 8446480 - DNA, 22 bp, Homo sapiens
gggtccagactatgaagaactt

SEQ ID NO: 8446481 - DNA, 23 bp, Homo sapiens
gggtccagagacaggcatgggtg

SEQ ID NO: 8446482 - DNA, 22 bp, Homo sapiens
gggtccagagcctcagcccaga

SEQ ID NO: 8446483 - DNA, 22 bp, Homo sapiens
gggtccagagttgaagaggtta

SEQ ID NO: 8446484 - DNA, 16 bp, Homo sapiens
gggtccagatctgctc

SEQ ID NO: 8446485 - DNA, 22 bp, Homo sapiens
gggtccagagttttcccgccct

SEQ ID NO: 8446486 - DNA, 22 bp, Homo sapiens
gggtcagggctgcctgggctca

SEQ ID NO: 8446487 - DNA, 22 bp, Homo sapiens
gggtcaggcctcaaggtgggct

SEQ ID NO: 8446488 - DNA, 22 bp, Homo sapiens
ggtaggagtattttgcagcagt

SEQ ID NO: 8446489 - DNA, 22 bp, Homo sapiens
ggtaggaagatagagcaaagtt

SEQ ID NO: 8446490 - DNA, 22 bp, Homo sapiens
ggtagctgcagcaggctggcaa

SEQ ID NO: 8446491 - DNA, 22 bp, Homo sapiens
ggtcaggaaaagactccccaga

SEQ ID NO: 8446492 - DNA, 22 bp, Homo sapiens
ggtcaggatccaagtctgtgct

SEQ ID NO: 8446493 - DNA, 22 bp, Homo sapiens
ggtcagccttggatttggtagc

SEQ ID NO: 8446494 - DNA, 22 bp, Homo sapiens
ggtcagcatctggttgagggca

SEQ ID NO: 8446495 - DNA, 18 bp, Homo sapiens
ggtcaggggcggagagaa

SEQ ID NO: 8446496 - DNA, 22 bp, Homo sapiens
ggtcagggctcttccagtggct

SEQ ID NO: 8446497 - DNA, 22 bp, Homo sapiens
ggtcagggggatctgtgaggta

SEQ ID NO: 8446498 - DNA, 23 bp, Homo sapiens
ggtccaggaaaggcagcagcacc

SEQ ID NO: 8446499 - DNA, 23 bp, Homo sapiens
ggtccaggaaaggcagcagcacc

SEQ ID NO: 8446500 - DNA, 23 bp, Homo sapiens
ggtccaggaaaggcagcagcacc

SEQ ID NO: 8446501 - DNA, 22 bp, Homo sapiens
ggtccagccaggtgctcatgcc

SEQ ID NO: 8446502 - DNA, 22 bp, Homo sapiens
ggtccagcacaacactggcatg

SEQ ID NO: 8446503 - DNA, 22 bp, Homo sapiens
ggtccagtcagatattcatgca

SEQ ID NO: 8446504 - DNA, 22 bp, Homo sapiens
ggtccaggtttgctctacttgt

SEQ ID NO: 8446505 - DNA, 22 bp, Homo sapiens
ggtccaggtttgctctacttgt

SEQ ID NO: 8446506 - DNA, 22 bp, Homo sapiens
ggtccaggtatgtggtgtgaat

SEQ ID NO: 8446507 - DNA, 22 bp, Homo sapiens
ggtccaggtcctgtgacagcag

SEQ ID NO: 8446508 - DNA, 22 bp, Homo sapiens
ggtccaggtcctgtgacagcag

SEQ ID NO: 8446509 - DNA, 22 bp, Homo sapiens
ggtccaggtcctgtgacagcag

SEQ ID NO: 8446510 - DNA, 22 bp, Homo sapiens
ggtccaggatcaaggcatcacc

SEQ ID NO: 8446511 - DNA, 22 bp, Homo sapiens
ggtccaggatcaaggcatcacc

SEQ ID NO: 8446512 - DNA, 22 bp, Homo sapiens
ggtccagggaactttgaaggat

SEQ ID NO: 8446513 - DNA, 22 bp, Homo sapiens
ggtccagggaactttgaaggat

SEQ ID NO: 8446514 - DNA, 22 bp, Homo sapiens
ggtccagggggtagatatgtga

SEQ ID NO: 8446515 - DNA, 22 bp, Homo sapiens
ggctgctgtttcagagactgtt

SEQ ID NO: 8446516 - DNA, 22 bp, Homo sapiens
ggctgctggggacgtgggagag

SEQ ID NO: 8446517 - DNA, 22 bp, Homo sapiens
ggctgagttgagaggattactt

SEQ ID NO: 8446518 - DNA, 22 bp, Homo sapiens
ggctgagggttaagatcagaca

SEQ ID NO: 8446519 - DNA, 22 bp, Homo sapiens
ggctgagggttaagatcagaca

SEQ ID NO: 8446520 - DNA, 22 bp, Homo sapiens
ggctgaggtgtggggaactata

SEQ ID NO: 8446521 - DNA, 18 bp, Homo sapiens
ggctgaggttgactagaa

SEQ ID NO: 8446522 - DNA, 22 bp, Homo sapiens
ggctgagggccagggctagtct

SEQ ID NO: 8446523 - DNA, 22 bp, Homo sapiens
ggctgagggccagggctagtct

SEQ ID NO: 8446524 - DNA, 22 bp, Homo sapiens
ggctgaggggcccagaggaaca

SEQ ID NO: 8446525 - DNA, 22 bp, Homo sapiens
ggctgaggggcccagaggaaca

SEQ ID NO: 8446526 - DNA, 22 bp, Homo sapiens
ggctgagggtcccagaccctaa

SEQ ID NO: 8446527 - DNA, 22 bp, Homo sapiens
ggctgagggtatagctgtccca

SEQ ID NO: 8446528 - DNA, 22 bp, Homo sapiens
ggctgagggtatagctgtccca

SEQ ID NO: 8446529 - DNA, 22 bp, Homo sapiens
ggctgagggtatagctgtccca

SEQ ID NO: 8446530 - DNA, 22 bp, Homo sapiens
ggctggtggggaaagaggacca

SEQ ID NO: 8446531 - DNA, 22 bp, Homo sapiens
ggctgtgagcaggcagaatgct

SEQ ID NO: 8446532 - DNA, 23 bp, Homo sapiens
ggctggtgcccttggccagtcgg

SEQ ID NO: 8446533 - DNA, 22 bp, Homo sapiens
ggctggtctcagtgctgggttc

SEQ ID NO: 8446534 - DNA, 21 bp, Homo sapiens
ggctggtcgcgtgcatgtctc

SEQ ID NO: 8446535 - DNA, 21 bp, Homo sapiens
ggctggtcgcgtgcatgtctc

SEQ ID NO: 8446536 - DNA, 22 bp, Homo sapiens
ggctggtgagttcagagaaccc

SEQ ID NO: 8446537 - DNA, 22 bp, Homo sapiens
ggctgggtttgactcctggctt

SEQ ID NO: 8446538 - DNA, 22 bp, Homo sapiens
ggctgggttatttatggccaag

SEQ ID NO: 8446539 - DNA, 22 bp, Homo sapiens
ggctggtcctttctctgtccta

SEQ ID NO: 8446540 - DNA, 22 bp, Homo sapiens
ggctgggtcccagctgggagga

SEQ ID NO: 8446541 - DNA, 19 bp, Homo sapiens
ggctgggtctggcaggttc

SEQ ID NO: 8446542 - DNA, 21 bp, Homo sapiens
ggctgggtcatgcagctggcc

SEQ ID NO: 8446543 - DNA, 22 bp, Homo sapiens
ggctgggtaccctgtttcccct

SEQ ID NO: 8446544 - DNA, 22 bp, Homo sapiens
ggctgggtacagggcagtgtgc

SEQ ID NO: 8446545 - DNA, 22 bp, Homo sapiens
ggctggagaagggtggttgaca

SEQ ID NO: 8446546 - DNA, 19 bp, Homo sapiens
ggctggagaaaggaatcag

SEQ ID NO: 8446547 - DNA, 22 bp, Homo sapiens
ggctggactgcctcccagagtc

SEQ ID NO: 8446548 - DNA, 22 bp, Homo sapiens
ggctggactttttgcaggtcat

SEQ ID NO: 8446549 - DNA, 22 bp, Homo sapiens
ggctggactttctgctgggctc

SEQ ID NO: 8446550 - DNA, 22 bp, Homo sapiens
ggctctggggaagctctcttca

SEQ ID NO: 8446551 - DNA, 22 bp, Homo sapiens
ggctctggggcctcctcccttg

SEQ ID NO: 8446552 - DNA, 22 bp, Homo sapiens
ggctctggggttggcccatctc

SEQ ID NO: 8446553 - DNA, 22 bp, Homo sapiens
ggctctggggggaagtctgttg

SEQ ID NO: 8446554 - DNA, 22 bp, Homo sapiens
ggctctgggtctgtggggagcg

SEQ ID NO: 8446555 - DNA, 22 bp, Homo sapiens
ggctcctgagaatgggccatca

SEQ ID NO: 8446556 - DNA, 22 bp, Homo sapiens
ggctcctctctggccgctcccg

SEQ ID NO: 8446557 - DNA, 22 bp, Homo sapiens
ggctccctgttctattccctgg

SEQ ID NO: 8446558 - DNA, 22 bp, Homo sapiens
ggctcctgaggaccaggcacag

SEQ ID NO: 8446559 - DNA, 22 bp, Homo sapiens
ggctcctgaggaccaggcacag

SEQ ID NO: 8446560 - DNA, 22 bp, Homo sapiens
ggctcctgaggaccaggcacag

SEQ ID NO: 8446561 - DNA, 22 bp, Homo sapiens
ggctctgggtctgtggggagcg

SEQ ID NO: 8446562 - DNA, 17 bp, Homo sapiens
ggctctgggtgtcacat

SEQ ID NO: 8446563 - DNA, 22 bp, Homo sapiens
ggctctgggtgtgaccttgggt

SEQ ID NO: 8446564 - DNA, 17 bp, Homo sapiens
ggctctgggtgtcacat

SEQ ID NO: 8446565 - DNA, 22 bp, Homo sapiens
ggctctggttgaccatgatggc

SEQ ID NO: 8446566 - DNA, 22 bp, Homo sapiens
ggctctgggttctgcaatgcgt

SEQ ID NO: 8446567 - DNA, 22 bp, Homo sapiens
ggctctggtgtgaagcagcctc

SEQ ID NO: 8446568 - DNA, 22 bp, Homo sapiens
ggctctggtgtgaagcagcctc

SEQ ID NO: 8446569 - DNA, 22 bp, Homo sapiens
ggctctgtggctggccatgatg

SEQ ID NO: 8446570 - DNA, 22 bp, Homo sapiens
ggctcttccgccaccagccaca

SEQ ID NO: 8446571 - DNA, 22 bp, Homo sapiens
ggctgagccatgggcactgcag

SEQ ID NO: 8446572 - DNA, 22 bp, Homo sapiens
ggctccctgcctgtcctcagtc

SEQ ID NO: 8446573 - DNA, 22 bp, Homo sapiens
ggctccctggaaatcccgaggc

SEQ ID NO: 8446574 - DNA, 22 bp, Homo sapiens
ggctccctggccctggggacac

SEQ ID NO: 8446575 - DNA, 22 bp, Homo sapiens
ggctccctagggagagtgggag

SEQ ID NO: 8446576 - DNA, 22 bp, Homo sapiens
ggctccctgcaacctccgcctc

SEQ ID NO: 8446577 - DNA, 22 bp, Homo sapiens
ggctccagtttgtgccttcagc

SEQ ID NO: 8446578 - DNA, 22 bp, Homo sapiens
ggctaggcgggcacatggtgga

SEQ ID NO: 8446579 - DNA, 22 bp, Homo sapiens
ggctaggcctcaggcctgcctg

SEQ ID NO: 8446580 - DNA, 22 bp, Homo sapiens
ggctactgtgatggtctgcaag

SEQ ID NO: 8446581 - DNA, 22 bp, Homo sapiens
ggctaccagataaattacagag

SEQ ID NO: 8446582 - DNA, 22 bp, Homo sapiens
ggctacagaggccgtgagcctg

SEQ ID NO: 8446583 - DNA, 22 bp, Homo sapiens
gggagggacacaaagagttccc

SEQ ID NO: 8446584 - DNA, 22 bp, Homo sapiens
gggagctggatgattgaggcaa

SEQ ID NO: 8446585 - DNA, 22 bp, Homo sapiens
gggagctggcctactattagat

SEQ ID NO: 8446586 - DNA, 22 bp, Homo sapiens
gggagctggagctggaagactc

SEQ ID NO: 8446587 - DNA, 22 bp, Homo sapiens
gggagggatctgctaggcaatg

SEQ ID NO: 8446588 - DNA, 22 bp, Homo sapiens
gggagggaggtgctggttcacg

SEQ ID NO: 8446589 - DNA, 22 bp, Homo sapiens
gggagggaggtgatgcttggct

SEQ ID NO: 8446590 - DNA, 22 bp, Homo sapiens
gggaggttctgttcgcacttga

SEQ ID NO: 8446591 - DNA, 22 bp, Homo sapiens
gggaggttgaggctgcagtgag

SEQ ID NO: 8446592 - DNA, 22 bp, Homo sapiens
gggaggttgaggctgcagtgag

SEQ ID NO: 8446593 - DNA, 22 bp, Homo sapiens
gggaggttgaggctgcagtgag

SEQ ID NO: 8446594 - DNA, 22 bp, Homo sapiens
gggaggttgaggctgcagtgag

SEQ ID NO: 8446595 - DNA, 22 bp, Homo sapiens
gggcacaggagaaggatctggc

SEQ ID NO: 8446596 - DNA, 22 bp, Homo sapiens
gggcacagtactccaatcaact

SEQ ID NO: 8446597 - DNA, 22 bp, Homo sapiens
gggcacagtactccaatcaact

SEQ ID NO: 8446598 - DNA, 22 bp, Homo sapiens
gggcacaggagaaggatctggc

SEQ ID NO: 8446599 - DNA, 22 bp, Homo sapiens
gggcacaggagaaggatctggc

SEQ ID NO: 8446600 - DNA, 21 bp, Homo sapiens
gggagggatggaaatgatgtt

SEQ ID NO: 8446601 - DNA, 22 bp, Homo sapiens
gggagggattagttctgcctgg

SEQ ID NO: 8446602 - DNA, 22 bp, Homo sapiens
gggaggtgattaggaccatgta

SEQ ID NO: 8446603 - DNA, 22 bp, Homo sapiens
gggaggtgattaggaccatgta

SEQ ID NO: 8446604 - DNA, 22 bp, Homo sapiens
gggagggccaggctcacccagg

SEQ ID NO: 8446605 - DNA, 22 bp, Homo sapiens
gggcacatgtaaagctggagaa

SEQ ID NO: 8446606 - DNA, 22 bp, Homo sapiens
gggcacatgcttagggaggaaa

SEQ ID NO: 8446607 - DNA, 22 bp, Homo sapiens
gggcacagtctgcagcccccca

SEQ ID NO: 8446608 - DNA, 22 bp, Homo sapiens
gggcacagtctaaagttgggcc

SEQ ID NO: 8446609 - DNA, 22 bp, Homo sapiens
gggcactgacagggtcccaact

SEQ ID NO: 8446610 - DNA, 22 bp, Homo sapiens
gggcactgctggaggctccctg

SEQ ID NO: 8446611 - DNA, 22 bp, Homo sapiens
gggcactggaaggctctcaggc

SEQ ID NO: 8446612 - DNA, 22 bp, Homo sapiens
gggcactggcagtcggggacgc

SEQ ID NO: 8446613 - DNA, 22 bp, Homo sapiens
gggcactgctggaggctccctg

SEQ ID NO: 8446614 - DNA, 23 bp, Homo sapiens
gggcaggtttttataggcttcag

SEQ ID NO: 8446615 - DNA, 22 bp, Homo sapiens
gggcaggttattggagtaggga

SEQ ID NO: 8446616 - DNA, 22 bp, Homo sapiens
gggcagtcacagtgctggagca

SEQ ID NO: 8446617 - DNA, 19 bp, Homo sapiens
gggcagtggcactagggag

SEQ ID NO: 8446618 - DNA, 22 bp, Homo sapiens
gggagctgagctggaagagaat

SEQ ID NO: 8446619 - DNA, 22 bp, Homo sapiens
gggagctgagctggaagagaat

SEQ ID NO: 8446620 - DNA, 22 bp, Homo sapiens
gggagctgagctctgagccacg

SEQ ID NO: 8446621 - DNA, 22 bp, Homo sapiens
gggagctgagctctgagccacg

SEQ ID NO: 8446622 - DNA, 21 bp, Homo sapiens
gggagctgacagcagcacggc

SEQ ID NO: 8446623 - DNA, 22 bp, Homo sapiens
gggagctggagctggaagactc

SEQ ID NO: 8446624 - DNA, 22 bp, Homo sapiens
gggagctggagctggaagactc

SEQ ID NO: 8446625 - DNA, 19 bp, Homo sapiens
gggagctgaggtctttggt

SEQ ID NO: 8446626 - DNA, 22 bp, Homo sapiens
gggagctgagctggaagagaat

SEQ ID NO: 8446627 - DNA, 22 bp, Homo sapiens
gggagctgagggacctctgtgg

SEQ ID NO: 8446628 - DNA, 22 bp, Homo sapiens
gggaagggtgttgtcttatctt

SEQ ID NO: 8446629 - DNA, 22 bp, Homo sapiens
gggaagggagggcctccagtca

SEQ ID NO: 8446630 - DNA, 22 bp, Homo sapiens
gggaagtttgtgggaggaatat

SEQ ID NO: 8446631 - DNA, 22 bp, Homo sapiens
ggctttgacatgctgaattaaa

SEQ ID NO: 8446632 - DNA, 22 bp, Homo sapiens
ggctttgcctggaatttccttg

SEQ ID NO: 8446633 - DNA, 22 bp, Homo sapiens
ggctttgcttaacgtgcttcta

SEQ ID NO: 8446634 - DNA, 22 bp, Homo sapiens
ggctttgccctggactgaggca

SEQ ID NO: 8446635 - DNA, 22 bp, Homo sapiens
ggctttgcattttgatggaggt

SEQ ID NO: 8446636 - DNA, 22 bp, Homo sapiens
ggctttctatgaactcaaaggc

SEQ ID NO: 8446637 - DNA, 22 bp, Homo sapiens
ggctttctccttgccttagtct

SEQ ID NO: 8446638 - DNA, 22 bp, Homo sapiens
ggctttctccttgccttagtct

SEQ ID NO: 8446639 - DNA, 20 bp, Homo sapiens
ggctttctgtgatcctcagt

SEQ ID NO: 8446640 - DNA, 22 bp, Homo sapiens
ggctttcttgttaaatgtccat

SEQ ID NO: 8446641 - DNA, 22 bp, Homo sapiens
ggctttctgtctgcgtctgtgt

SEQ ID NO: 8446642 - DNA, 22 bp, Homo sapiens
ggctttctgagtcaaacactga

SEQ ID NO: 8446643 - DNA, 22 bp, Homo sapiens
ggctttctgagtcaaacactga

SEQ ID NO: 8446644 - DNA, 22 bp, Homo sapiens
ggctttctagatctagctctgt

SEQ ID NO: 8446645 - DNA, 22 bp, Homo sapiens
ggctttctagatctagctctgt

SEQ ID NO: 8446646 - DNA, 22 bp, Homo sapiens
ggctttctagatctagctctgt

SEQ ID NO: 8446647 - DNA, 22 bp, Homo sapiens
gggaagggagggacctcagtct

SEQ ID NO: 8446648 - DNA, 22 bp, Homo sapiens
gggaagggacttgtttaaggtc

SEQ ID NO: 8446649 - DNA, 22 bp, Homo sapiens
ggcctggcatggggactaaggg

SEQ ID NO: 8446650 - DNA, 22 bp, Homo sapiens
ggcctggagtcagggaaagcaa

SEQ ID NO: 8446651 - DNA, 22 bp, Homo sapiens
ggcctcagaccggagctggcca

SEQ ID NO: 8446652 - DNA, 22 bp, Homo sapiens
ggcctggaagaggacagagaaa

SEQ ID NO: 8446653 - DNA, 22 bp, Homo sapiens
ggccctggtcctaggggtggaa

SEQ ID NO: 8446654 - DNA, 22 bp, Homo sapiens
ggccctgggcagaggagtgggc

SEQ ID NO: 8446655 - DNA, 22 bp, Homo sapiens
ggccctgggccctctagcttgt

SEQ ID NO: 8446656 - DNA, 22 bp, Homo sapiens
ggccctgggacacaacaccgaa

SEQ ID NO: 8446657 - DNA, 22 bp, Homo sapiens
ggccctgggatgctcagcagtg

SEQ ID NO: 8446658 - DNA, 21 bp, Homo sapiens
ggccctggttacgcctcctct

SEQ ID NO: 8446659 - DNA, 22 bp, Homo sapiens
ggcctagggagtggccatgcct

SEQ ID NO: 8446660 - DNA, 22 bp, Homo sapiens
ggcctaggaaggggatgtaact

SEQ ID NO: 8446661 - DNA, 22 bp, Homo sapiens
ggcctagttttttctggtaggt

SEQ ID NO: 8446662 - DNA, 21 bp, Homo sapiens
ggcctaggggcagatggtgct

SEQ ID NO: 8446663 - DNA, 21 bp, Homo sapiens
ggcctaggggcagatggtgct

SEQ ID NO: 8446664 - DNA, 22 bp, Homo sapiens
ggccaggaggcaggggctcaat

SEQ ID NO: 8446665 - DNA, 22 bp, Homo sapiens
ggccaggaggcaggggctcaat

SEQ ID NO: 8446666 - DNA, 22 bp, Homo sapiens
ggccaggagctgcacagggctc

SEQ ID NO: 8446667 - DNA, 22 bp, Homo sapiens
ggccaggaagggaagatcagca

SEQ ID NO: 8446668 - DNA, 22 bp, Homo sapiens
ggccaggaagggaagatcagca

SEQ ID NO: 8446669 - DNA, 22 bp, Homo sapiens
ggccaggagaggagggcactga

SEQ ID NO: 8446670 - DNA, 22 bp, Homo sapiens
ggccaggagcaagccaggctct

SEQ ID NO: 8446671 - DNA, 22 bp, Homo sapiens
ggccaggagcaagccaggctct

SEQ ID NO: 8446672 - DNA, 22 bp, Homo sapiens
ggccaggagatggacaccacat

SEQ ID NO: 8446673 - DNA, 22 bp, Homo sapiens
ggccaggccaagagggttggaa

SEQ ID NO: 8446674 - DNA, 22 bp, Homo sapiens
ggccaggcactgtgtgagatat

SEQ ID NO: 8446675 - DNA, 22 bp, Homo sapiens
ggccaggcactgtgtgagatat

SEQ ID NO: 8446676 - DNA, 22 bp, Homo sapiens
ggccctgctgaagccgggtcta

SEQ ID NO: 8446677 - DNA, 22 bp, Homo sapiens
ggccctgctcaggctgcgatga

SEQ ID NO: 8446678 - DNA, 22 bp, Homo sapiens
ggccaggcgatgacccctccac

SEQ ID NO: 8446679 - DNA, 22 bp, Homo sapiens
ggccctgctgagtggagtggag

SEQ ID NO: 8446680 - DNA, 22 bp, Homo sapiens
ggcatcagtatggccatagggt

SEQ ID NO: 8446681 - DNA, 22 bp, Homo sapiens
ggcatcagggtaggaaggtatc

SEQ ID NO: 8446682 - DNA, 22 bp, Homo sapiens
ggcatcagggtaggaaggtatc

SEQ ID NO: 8446683 - DNA, 20 bp, Homo sapiens
ggcatccttctgacccagag

SEQ ID NO: 8446684 - DNA, 20 bp, Homo sapiens
ggcatccttttggtcacagc

SEQ ID NO: 8446685 - DNA, 22 bp, Homo sapiens
ggcatcttcaaaattgccaaat

SEQ ID NO: 8446686 - DNA, 22 bp, Homo sapiens
ggcatctggatctgcttctccc

SEQ ID NO: 8446687 - DNA, 18 bp, Homo sapiens
ggcatctgcacagcagcc

SEQ ID NO: 8446688 - DNA, 21 bp, Homo sapiens
ggcatctcttagtatcaccat

SEQ ID NO: 8446689 - DNA, 22 bp, Homo sapiens
ggcatctgagctgtgtatggtt

SEQ ID NO: 8446690 - DNA, 22 bp, Homo sapiens
ggccagcttattagctcagagg

SEQ ID NO: 8446691 - DNA, 22 bp, Homo sapiens
ggccagcttctctgctgcctgt

SEQ ID NO: 8446692 - DNA, 22 bp, Homo sapiens
ggccagcttctctgctgcctgt

SEQ ID NO: 8446693 - DNA, 19 bp, Homo sapiens
ggccagctgtctcctgcta

SEQ ID NO: 8446694 - DNA, 22 bp, Homo sapiens
ggccagctttgagctgcaggaa

SEQ ID NO: 8446695 - DNA, 22 bp, Homo sapiens
ggccagctttgagctgcaggaa

SEQ ID NO: 8446696 - DNA, 23 bp, Homo sapiens
ggcatgcaatggacagagctgga

SEQ ID NO: 8446697 - DNA, 22 bp, Homo sapiens
ggcatgcttgccatgggccagt

SEQ ID NO: 8446698 - DNA, 22 bp, Homo sapiens
ggccagctgtaagctgctgaat

SEQ ID NO: 8446699 - DNA, 22 bp, Homo sapiens
ggcatgctctgggggtcctccg

SEQ ID NO: 8446700 - DNA, 22 bp, Homo sapiens
ggcatgctctttgtccacagta

SEQ ID NO: 8446701 - DNA, 22 bp, Homo sapiens
ggcatgcaaatgtgggtgacct

SEQ ID NO: 8446702 - DNA, 22 bp, Homo sapiens
ggcatgcatgcaaggtggtgta

SEQ ID NO: 8446703 - DNA, 22 bp, Homo sapiens
ggcaggtgagagctctttgaaa

SEQ ID NO: 8446704 - DNA, 22 bp, Homo sapiens
ggcagggtggccctccagtgag

SEQ ID NO: 8446705 - DNA, 22 bp, Homo sapiens
ggcagggtggcagaggctcaga

SEQ ID NO: 8446706 - DNA, 17 bp, Homo sapiens
ggcagggtgctgggtat

SEQ ID NO: 8446707 - DNA, 22 bp, Homo sapiens
ggcagggtatgattacctctga

SEQ ID NO: 8446708 - DNA, 22 bp, Homo sapiens
ggcaggggttcattttgtctta

SEQ ID NO: 8446709 - DNA, 22 bp, Homo sapiens
ggcaggggtggccttcctttgg

SEQ ID NO: 8446710 - DNA, 22 bp, Homo sapiens
ggcaggggtgaggccactctga

SEQ ID NO: 8446711 - DNA, 18 bp, Homo sapiens
ggcaggggtgaaccacag

SEQ ID NO: 8446712 - DNA, 22 bp, Homo sapiens
ggcactgggtgagggtcactgg

SEQ ID NO: 8446713 - DNA, 18 bp, Homo sapiens
ggcactggtgatgcagag

SEQ ID NO: 8446714 - DNA, 20 bp, Homo sapiens
ggcacttgatcccctggttc

SEQ ID NO: 8446715 - DNA, 22 bp, Homo sapiens
ggcactttgattttgagatgca

SEQ ID NO: 8446716 - DNA, 22 bp, Homo sapiens
ggcactgcccaccctcacaggg

SEQ ID NO: 8446717 - DNA, 21 bp, Homo sapiens
ggcactgctgggccatctgct

SEQ ID NO: 8446718 - DNA, 22 bp, Homo sapiens
ggatttcttccttcctcagaag

SEQ ID NO: 8446719 - DNA, 22 bp, Homo sapiens
ggatttactatcttgaaatata

SEQ ID NO: 8446720 - DNA, 22 bp, Homo sapiens
ggatttgggcttgcagcagagc

SEQ ID NO: 8446721 - DNA, 22 bp, Homo sapiens
ggattgagagcactggtagctg

SEQ ID NO: 8446722 - DNA, 20 bp, Homo sapiens
ggatttacaggggaaaagtg

SEQ ID NO: 8446723 - DNA, 22 bp, Homo sapiens
ggatttacccaatggatagatg

SEQ ID NO: 8446724 - DNA, 22 bp, Homo sapiens
ggatttacacacctgcctgtca

SEQ ID NO: 8446725 - DNA, 22 bp, Homo sapiens
ggatttacaagtttaactctca

SEQ ID NO: 8446726 - DNA, 22 bp, Homo sapiens
ggcagcagcaaggttggagctg

SEQ ID NO: 8446727 - DNA, 22 bp, Homo sapiens
ggcagaaggcaattagagactg

SEQ ID NO: 8446728 - DNA, 19 bp, Homo sapiens
ggcagaaggtgtaggggga

SEQ ID NO: 8446729 - DNA, 19 bp, Homo sapiens
ggcagaaggtgtaggggga

SEQ ID NO: 8446730 - DNA, 22 bp, Homo sapiens
ggcagaagataggacagggaat

SEQ ID NO: 8446731 - DNA, 22 bp, Homo sapiens
ggcagccatggacactggctag

SEQ ID NO: 8446732 - DNA, 22 bp, Homo sapiens
ggcagctgttggctctctagga

SEQ ID NO: 8446733 - DNA, 22 bp, Homo sapiens
ggcagctgttggctctctagga

SEQ ID NO: 8446734 - DNA, 22 bp, Homo sapiens
ggcagctgttggctctctagga

SEQ ID NO: 8446735 - DNA, 22 bp, Homo sapiens
ggcagctgtttgtcctcctgtt

SEQ ID NO: 8446736 - DNA, 22 bp, Homo sapiens
ggcagctgtttgtcctcctgtt

SEQ ID NO: 8446737 - DNA, 22 bp, Homo sapiens
ggcagcttacgttttgctagtg

SEQ ID NO: 8446738 - DNA, 22 bp, Homo sapiens
ggcagcagggtctagattgatg

SEQ ID NO: 8446739 - DNA, 22 bp, Homo sapiens
ggcagccatggacactggctag

SEQ ID NO: 8446740 - DNA, 22 bp, Homo sapiens
ggcagccatgctccaggtgcag

SEQ ID NO: 8446741 - DNA, 22 bp, Homo sapiens
ggcagccagtagggccagcctg

SEQ ID NO: 8446742 - DNA, 22 bp, Homo sapiens
ggcagccagcgggtggacgcgc

SEQ ID NO: 8446743 - DNA, 22 bp, Homo sapiens
ggcagcagtccatggcccaagg

SEQ ID NO: 8446744 - DNA, 22 bp, Homo sapiens
ggcagccagcaatgagaagttt

SEQ ID NO: 8446745 - DNA, 22 bp, Homo sapiens
ggcagccagagggcagctggat

SEQ ID NO: 8446746 - DNA, 22 bp, Homo sapiens
ggagatggtggaagctggtgca

SEQ ID NO: 8446747 - DNA, 22 bp, Homo sapiens
ggagatggtggaagctggtgca

SEQ ID NO: 8446748 - DNA, 22 bp, Homo sapiens
ggagatggctggcaggtagatg

SEQ ID NO: 8446749 - DNA, 22 bp, Homo sapiens
ggagatggctggcaggtagatg

SEQ ID NO: 8446750 - DNA, 22 bp, Homo sapiens
ggagatggctggcaggtagatg

SEQ ID NO: 8446751 - DNA, 22 bp, Homo sapiens
ggatctttaagttcttttccat

SEQ ID NO: 8446752 - DNA, 22 bp, Homo sapiens
ggatctgttttgcctctgaggg

SEQ ID NO: 8446753 - DNA, 22 bp, Homo sapiens
ggatgacaaggaaagcaaacca

SEQ ID NO: 8446754 - DNA, 22 bp, Homo sapiens
ggatctggggtagagcagtggg

SEQ ID NO: 8446755 - DNA, 22 bp, Homo sapiens
ggatctggggctctgctgctca

SEQ ID NO: 8446756 - DNA, 22 bp, Homo sapiens
ggatgaggaaaccacagtgtcc

SEQ ID NO: 8446757 - DNA, 19 bp, Homo sapiens
ggatgagggtcaggcatag

SEQ ID NO: 8446758 - DNA, 22 bp, Homo sapiens
ggatgaggaagattactgagaa

SEQ ID NO: 8446759 - DNA, 22 bp, Homo sapiens
ggagcagagctcttcatctgca

SEQ ID NO: 8446760 - DNA, 22 bp, Homo sapiens
ggagcagagctgggcttggctg

SEQ ID NO: 8446761 - DNA, 17 bp, Homo sapiens
ggagcagatccaccatt

SEQ ID NO: 8446762 - DNA, 22 bp, Homo sapiens
ggagcagatgtcttcatggcct

SEQ ID NO: 8446763 - DNA, 19 bp, Homo sapiens
ggatgagggtcaggcatag

SEQ ID NO: 8446764 - DNA, 22 bp, Homo sapiens
ggatgaggtagatgaacaaggg

SEQ ID NO: 8446765 - DNA, 21 bp, Homo sapiens
ggatgccacgaagcaccagga

SEQ ID NO: 8446766 - DNA, 22 bp, Homo sapiens
ggatgcccactatctgctggct

SEQ ID NO: 8446767 - DNA, 22 bp, Homo sapiens
ggatgctgactttggagcatgg

SEQ ID NO: 8446768 - DNA, 23 bp, Homo sapiens
ggatggacgtgatgccttagcca

SEQ ID NO: 8446769 - DNA, 23 bp, Homo sapiens
ggatggacgtgatgccttagcca

SEQ ID NO: 8446770 - DNA, 22 bp, Homo sapiens
ggatggagatgaccatggtgac

SEQ ID NO: 8446771 - DNA, 19 bp, Homo sapiens
ggattctgcagttttcaca

SEQ ID NO: 8446772 - DNA, 22 bp, Homo sapiens
ggattctgccttgttgcttcaa

SEQ ID NO: 8446773 - DNA, 22 bp, Homo sapiens
ggattcagtgtctgttaatagt

SEQ ID NO: 8446774 - DNA, 22 bp, Homo sapiens
ggatgtttggcgtttgaattgc

SEQ ID NO: 8446775 - DNA, 22 bp, Homo sapiens
ggatgggaacttggtagggcat

SEQ ID NO: 8446776 - DNA, 22 bp, Homo sapiens
gccagagccggcttcacaggat

SEQ ID NO: 8446777 - DNA, 22 bp, Homo sapiens
gccagagccacttttgggtgat

SEQ ID NO: 8446778 - DNA, 22 bp, Homo sapiens
gccagagcatgcactgcctgca

SEQ ID NO: 8446779 - DNA, 22 bp, Homo sapiens
gccaaggggttcaaaatgtata

SEQ ID NO: 8446780 - DNA, 22 bp, Homo sapiens
gccagagagagtccctgggcct

SEQ ID NO: 8446781 - DNA, 22 bp, Homo sapiens
gccaagcctgtagacacaagct

SEQ ID NO: 8446782 - DNA, 22 bp, Homo sapiens
gccaagcctgtagacacaagct

SEQ ID NO: 8446783 - DNA, 22 bp, Homo sapiens
gcattttaataagattcatagg

SEQ ID NO: 8446784 - DNA, 18 bp, Homo sapiens
gcattttaatctgaggca

SEQ ID NO: 8446785 - DNA, 22 bp, Homo sapiens
gcattttaatgaggtttatgag

SEQ ID NO: 8446786 - DNA, 22 bp, Homo sapiens
gcattttagaatattggagcaa

SEQ ID NO: 8446787 - DNA, 22 bp, Homo sapiens
gcattttataaagagttatttg

SEQ ID NO: 8446788 - DNA, 22 bp, Homo sapiens
gccagcagtcctgctgtgtgcc

SEQ ID NO: 8446789 - DNA, 22 bp, Homo sapiens
gccagcagtcctgctgtgtgcc

SEQ ID NO: 8446790 - DNA, 22 bp, Homo sapiens
gccagcagtatgtcctggcagt

SEQ ID NO: 8446791 - DNA, 22 bp, Homo sapiens
gccagcagtatgtcctggcagt

SEQ ID NO: 8446792 - DNA, 22 bp, Homo sapiens
gccagcagtggccaccaccagg

SEQ ID NO: 8446793 - DNA, 22 bp, Homo sapiens
gccagcatagtaagcagtcatc

SEQ ID NO: 8446794 - DNA, 22 bp, Homo sapiens
gccagccataggccagcactgg

SEQ ID NO: 8446795 - DNA, 22 bp, Homo sapiens
gccagccataggccagcactgg

SEQ ID NO: 8446796 - DNA, 21 bp, Homo sapiens
gccagccatgcttgcctaggc

SEQ ID NO: 8446797 - DNA, 21 bp, Homo sapiens
gccagccatgcttgcctaggc

SEQ ID NO: 8446798 - DNA, 22 bp, Homo sapiens
gccagccataggccagcactgg

SEQ ID NO: 8446799 - DNA, 22 bp, Homo sapiens
gccagcccagctccaggggaaa

SEQ ID NO: 8446800 - DNA, 22 bp, Homo sapiens
gccagcccattaacccctgtcc

SEQ ID NO: 8446801 - DNA, 22 bp, Homo sapiens
gccagcccattaacccctgtcc

SEQ ID NO: 8446802 - DNA, 22 bp, Homo sapiens
gccagccccttagggctctccc

SEQ ID NO: 8446803 - DNA, 22 bp, Homo sapiens
gccagccccttagggctctccc

SEQ ID NO: 8446804 - DNA, 22 bp, Homo sapiens
gccagccccagacatcctatcg

SEQ ID NO: 8446805 - DNA, 22 bp, Homo sapiens
gccagccccagacatcctatcg

SEQ ID NO: 8446806 - DNA, 22 bp, Homo sapiens
gccagcccctccatcctgttca

SEQ ID NO: 8446807 - DNA, 22 bp, Homo sapiens
gccagagcttcccccgagtgtg

SEQ ID NO: 8446808 - DNA, 22 bp, Homo sapiens
gccagagctgagtgaggttctt

SEQ ID NO: 8446809 - DNA, 22 bp, Homo sapiens
gccagagctgagacacgagtcc

SEQ ID NO: 8446810 - DNA, 22 bp, Homo sapiens
gccagaggaacgctgcgcgccc

SEQ ID NO: 8446811 - DNA, 22 bp, Homo sapiens
gccagcaggtggagagatcaag

SEQ ID NO: 8446812 - DNA, 22 bp, Homo sapiens
gccagcagggcggagccatcta

SEQ ID NO: 8446813 - DNA, 22 bp, Homo sapiens
gccagcagggcggagccatcta

SEQ ID NO: 8446814 - DNA, 22 bp, Homo sapiens
gccagcagggcggagccatcta

SEQ ID NO: 8446815 - DNA, 22 bp, Homo sapiens
gcatccaggactatatgatgat

SEQ ID NO: 8446816 - DNA, 22 bp, Homo sapiens
gcatccaggctgcccctctgcg

SEQ ID NO: 8446817 - DNA, 22 bp, Homo sapiens
gcatccagtcttggctcctgga

SEQ ID NO: 8446818 - DNA, 20 bp, Homo sapiens
gcatccagacacccagctgc

SEQ ID NO: 8446819 - DNA, 22 bp, Homo sapiens
gcatccagaggtagccactgtg

SEQ ID NO: 8446820 - DNA, 22 bp, Homo sapiens
gcatccaaatgtttcatttctt

SEQ ID NO: 8446821 - DNA, 22 bp, Homo sapiens
gcatctctacaacgaagacagt

SEQ ID NO: 8446822 - DNA, 22 bp, Homo sapiens
gcatcctggctctaggtgtcat

SEQ ID NO: 8446823 - DNA, 22 bp, Homo sapiens
gcatccctctgaggggccaggc

SEQ ID NO: 8446824 - DNA, 22 bp, Homo sapiens
gcatgcaactcccagttctgcc

SEQ ID NO: 8446825 - DNA, 22 bp, Homo sapiens
gcatgatgaaggaggaggagtc

SEQ ID NO: 8446826 - DNA, 19 bp, Homo sapiens
gcatttctctttacagcca

SEQ ID NO: 8446827 - DNA, 22 bp, Homo sapiens
gcatttggaacttggttgagat

SEQ ID NO: 8446828 - DNA, 22 bp, Homo sapiens
gcatctgatccaatagatatat

SEQ ID NO: 8446829 - DNA, 22 bp, Homo sapiens
gcatctctttagaatcagatgg

SEQ ID NO: 8446830 - DNA, 22 bp, Homo sapiens
gcatctcttacccacgagccag

SEQ ID NO: 8446831 - DNA, 22 bp, Homo sapiens
gcatctcttacccacgagccag

SEQ ID NO: 8446832 - DNA, 22 bp, Homo sapiens
gcatctttctgtccattcagca

SEQ ID NO: 8446833 - DNA, 22 bp, Homo sapiens
gcatctttagcctctccgtggc

SEQ ID NO: 8446834 - DNA, 22 bp, Homo sapiens
gcatctttctgtccattcagca

SEQ ID NO: 8446835 - DNA, 22 bp, Homo sapiens
gcagtcctagggtgctctgcag

SEQ ID NO: 8446836 - DNA, 22 bp, Homo sapiens
gcagtccattgacagaggtctt

SEQ ID NO: 8446837 - DNA, 22 bp, Homo sapiens
gcagtcctcatcctttagcagt

SEQ ID NO: 8446838 - DNA, 22 bp, Homo sapiens
gcagtcctcatcctttagcagt

SEQ ID NO: 8446839 - DNA, 22 bp, Homo sapiens
gcagtcctcctgcctcagcctc

SEQ ID NO: 8446840 - DNA, 22 bp, Homo sapiens
gcagtcctctcattggcctcct

SEQ ID NO: 8446841 - DNA, 22 bp, Homo sapiens
gcagtgaaaaagtgcaccctgt

SEQ ID NO: 8446842 - DNA, 22 bp, Homo sapiens
gcagtctttgaatgtgaaatag

SEQ ID NO: 8446843 - DNA, 22 bp, Homo sapiens
gcagtcagtaaggcagccagaa

SEQ ID NO: 8446844 - DNA, 22 bp, Homo sapiens
gcagtcagacaggaggagctcc

SEQ ID NO: 8446845 - DNA, 22 bp, Homo sapiens
gcagtatctatgtgatgggttg

SEQ ID NO: 8446846 - DNA, 19 bp, Homo sapiens
gcagggctctcccagatgc

SEQ ID NO: 8446847 - DNA, 22 bp, Homo sapiens
gcagggctctgctgtagtccta

SEQ ID NO: 8446848 - DNA, 22 bp, Homo sapiens
gcagggctccccaggcccgagg

SEQ ID NO: 8446849 - DNA, 22 bp, Homo sapiens
gcagggctcattgccaggcatt

SEQ ID NO: 8446850 - DNA, 22 bp, Homo sapiens
gcagggctccactgtggccaag

SEQ ID NO: 8446851 - DNA, 22 bp, Homo sapiens
gcagggctcaacaggacacccc

SEQ ID NO: 8446852 - DNA, 22 bp, Homo sapiens
gcagggctcagccgctcccacc

SEQ ID NO: 8446853 - DNA, 22 bp, Homo sapiens
gcagggctcattctagtacaat

SEQ ID NO: 8446854 - DNA, 22 bp, Homo sapiens
gccaggatgactatacaacagc

SEQ ID NO: 8446855 - DNA, 22 bp, Homo sapiens
gccaggagttcagatgcatgtt

SEQ ID NO: 8446856 - DNA, 22 bp, Homo sapiens
gccaggcaaattaaggaatgca

SEQ ID NO: 8446857 - DNA, 22 bp, Homo sapiens
gccaggagttcagatgcatgtt

SEQ ID NO: 8446858 - DNA, 23 bp, Homo sapiens
gccaggcacatggtggacacgca

SEQ ID NO: 8446859 - DNA, 22 bp, Homo sapiens
gccaggtcccctcatggctcct

SEQ ID NO: 8446860 - DNA, 22 bp, Homo sapiens
gccaggcacagttctaggtgct

SEQ ID NO: 8446861 - DNA, 22 bp, Homo sapiens
gccaggtctgggtagcagagga

SEQ ID NO: 8446862 - DNA, 22 bp, Homo sapiens
gccaggtgggagacagacagca

SEQ ID NO: 8446863 - DNA, 22 bp, Homo sapiens
gccaggtggtctggctccagag

SEQ ID NO: 8446864 - DNA, 22 bp, Homo sapiens
gccaggttctggggaggtacaa

SEQ ID NO: 8446865 - DNA, 22 bp, Homo sapiens
gccaggaggctgctgtgtaggc

SEQ ID NO: 8446866 - DNA, 22 bp, Homo sapiens
gccaggaggctgctgtgtaggc

SEQ ID NO: 8446867 - DNA, 22 bp, Homo sapiens
gccaggagccctgggcaagttc

SEQ ID NO: 8446868 - DNA, 22 bp, Homo sapiens
gccaggagccctgggcaagttc

SEQ ID NO: 8446869 - DNA, 22 bp, Homo sapiens
gccaggagaatgctagcagagg

SEQ ID NO: 8446870 - DNA, 22 bp, Homo sapiens
gccaggagagctccttcaggtt

SEQ ID NO: 8446871 - DNA, 22 bp, Homo sapiens
gccaggactgagaatgggagca

SEQ ID NO: 8446872 - DNA, 22 bp, Homo sapiens
gccaggactagagggaggtgag

SEQ ID NO: 8446873 - DNA, 22 bp, Homo sapiens
gccaggaatttcaagagccact

SEQ ID NO: 8446874 - DNA, 22 bp, Homo sapiens
gccaggacctcagatgcagggc

SEQ ID NO: 8446875 - DNA, 23 bp, Homo sapiens
gcccagagaggctcaccaggaat

SEQ ID NO: 8446876 - DNA, 22 bp, Homo sapiens
gcccagagggaagaggtgtcat

SEQ ID NO: 8446877 - DNA, 21 bp, Homo sapiens
gcccagagggagccaagccca

SEQ ID NO: 8446878 - DNA, 18 bp, Homo sapiens
gcccagaggtctgggccc

SEQ ID NO: 8446879 - DNA, 21 bp, Homo sapiens
gcccagagtcctcccactcca

SEQ ID NO: 8446880 - DNA, 22 bp, Homo sapiens
gcccagagtgagtcctgggccc

SEQ ID NO: 8446881 - DNA, 22 bp, Homo sapiens
gccagtgcctgctgctcagggc

SEQ ID NO: 8446882 - DNA, 18 bp, Homo sapiens
gccagtgccctggctcac

SEQ ID NO: 8446883 - DNA, 22 bp, Homo sapiens
gccagtcttcatattcatggtg

SEQ ID NO: 8446884 - DNA, 22 bp, Homo sapiens
gccagtctccctcagtcctctg

SEQ ID NO: 8446885 - DNA, 22 bp, Homo sapiens
gccagtcagctggccaggctgg

SEQ ID NO: 8446886 - DNA, 22 bp, Homo sapiens
gcccacagtacgaggctcaggc

SEQ ID NO: 8446887 - DNA, 22 bp, Homo sapiens
gcccacagtacgaggctcaggc

SEQ ID NO: 8446888 - DNA, 22 bp, Homo sapiens
gcctagagaaaaagcctctgca

SEQ ID NO: 8446889 - DNA, 22 bp, Homo sapiens
gcctcagaaagcttttattcat

SEQ ID NO: 8446890 - DNA, 22 bp, Homo sapiens
gcctcagaaagcttttattcat

SEQ ID NO: 8446891 - DNA, 23 bp, Homo sapiens
gcctcagagaaacagctgcacac

SEQ ID NO: 8446892 - DNA, 22 bp, Homo sapiens
gcctcagagggcagggtggtga

SEQ ID NO: 8446893 - DNA, 22 bp, Homo sapiens
gcctcagagctacacacacgca

SEQ ID NO: 8446894 - DNA, 22 bp, Homo sapiens
gcctcagaaagcttttattcat

SEQ ID NO: 8446895 - DNA, 22 bp, Homo sapiens
gcctcagaaagtggcaggtagg

SEQ ID NO: 8446896 - DNA, 22 bp, Homo sapiens
gcctcagaaagtggcaggtagg

SEQ ID NO: 8446897 - DNA, 23 bp, Homo sapiens
gcctcagagaaacagctgcacac

SEQ ID NO: 8446898 - DNA, 22 bp, Homo sapiens
gcctcagacactgcctgggtgt

SEQ ID NO: 8446899 - DNA, 22 bp, Homo sapiens
gcctcagaatcatttatcatct

SEQ ID NO: 8446900 - DNA, 22 bp, Homo sapiens
gccctgaggcaaaagaacagtc

SEQ ID NO: 8446901 - DNA, 22 bp, Homo sapiens
gccctgaggggtggtgtctgta

SEQ ID NO: 8446902 - DNA, 20 bp, Homo sapiens
gcctcagccaacccatgggg

SEQ ID NO: 8446903 - DNA, 20 bp, Homo sapiens
gcctcagagggtttgagttt

SEQ ID NO: 8446904 - DNA, 22 bp, Homo sapiens
gcctcagagggccctagggaca

SEQ ID NO: 8446905 - DNA, 22 bp, Homo sapiens
gcctcagccggcggacgccagg

SEQ ID NO: 8446906 - DNA, 22 bp, Homo sapiens
gcctcaggactggcatactcat

SEQ ID NO: 8446907 - DNA, 22 bp, Homo sapiens
gcctcagctgttgcaggggccc

SEQ ID NO: 8446908 - DNA, 22 bp, Homo sapiens
gcctcagctcccagcccaggct

SEQ ID NO: 8446909 - DNA, 22 bp, Homo sapiens
gcctcagctcccagcccaggct

SEQ ID NO: 8446910 - DNA, 22 bp, Homo sapiens
gccctgagcctatgagcctctc

SEQ ID NO: 8446911 - DNA, 22 bp, Homo sapiens
gccctgagcctatgagcctctc

SEQ ID NO: 8446912 - DNA, 22 bp, Homo sapiens
gccctgagccaccaatgccatt

SEQ ID NO: 8446913 - DNA, 22 bp, Homo sapiens
gccctgagctagtgtgggcagg

SEQ ID NO: 8446914 - DNA, 22 bp, Homo sapiens
gccctgagcacacagtagcaaa

SEQ ID NO: 8446915 - DNA, 22 bp, Homo sapiens
gccctgagcactgctgctgggg

SEQ ID NO: 8446916 - DNA, 22 bp, Homo sapiens
gccctgagcactgctgctgggg

SEQ ID NO: 8446917 - DNA, 22 bp, Homo sapiens
gccctgagcactgctgctgggg

SEQ ID NO: 8446918 - DNA, 22 bp, Homo sapiens
gccctctgttattgcatcctta

SEQ ID NO: 8446919 - DNA, 22 bp, Homo sapiens
gccctctgttattgcatcctta

SEQ ID NO: 8446920 - DNA, 22 bp, Homo sapiens
gccctctgttttgtaagcaacg

SEQ ID NO: 8446921 - DNA, 22 bp, Homo sapiens
gccctgagaagaagtcggaggg

SEQ ID NO: 8446922 - DNA, 22 bp, Homo sapiens
gccctgagactgagcatgggtt

SEQ ID NO: 8446923 - DNA, 22 bp, Homo sapiens
gccctgagactgagcatgggtt

SEQ ID NO: 8446924 - DNA, 22 bp, Homo sapiens
gcccagtggtaaaagcaggcct

SEQ ID NO: 8446925 - DNA, 22 bp, Homo sapiens
gcccagtggtaaaagcaggcct

SEQ ID NO: 8446926 - DNA, 22 bp, Homo sapiens
gcccagggcttcaaagagagaa

SEQ ID NO: 8446927 - DNA, 22 bp, Homo sapiens
gcccaggggagtagtcaattta

SEQ ID NO: 8446928 - DNA, 22 bp, Homo sapiens
gcccaggggcagcgcatagtgg

SEQ ID NO: 8446929 - DNA, 22 bp, Homo sapiens
gcccaggggcagcgcatagtgg

SEQ ID NO: 8446930 - DNA, 23 bp, Homo sapiens
gcccatgctgttgggcccgagca

SEQ ID NO: 8446931 - DNA, 22 bp, Homo sapiens
gcccatgcccctccttctggca

SEQ ID NO: 8446932 - DNA, 23 bp, Homo sapiens
gcccatgctgttgggcccgagca

SEQ ID NO: 8446933 - DNA, 22 bp, Homo sapiens
gccctctggtgggtgagccccg

SEQ ID NO: 8446934 - DNA, 22 bp, Homo sapiens
gccctctgtgtaacaatccaga

SEQ ID NO: 8446935 - DNA, 22 bp, Homo sapiens
gccctctggcagccttggctgg

SEQ ID NO: 8446936 - DNA, 22 bp, Homo sapiens
gcccaggctggagtgcagtggt

SEQ ID NO: 8446937 - DNA, 22 bp, Homo sapiens
gcccagcaaggaccaagggccg

SEQ ID NO: 8446938 - DNA, 22 bp, Homo sapiens
gcccagagttcaaggctgcagt

SEQ ID NO: 8446939 - DNA, 22 bp, Homo sapiens
gcccagagttcaaggctgcagt

SEQ ID NO: 8446940 - DNA, 22 bp, Homo sapiens
gcccagagtggccacttggctc

SEQ ID NO: 8446941 - DNA, 23 bp, Homo sapiens
gcccagggactgggaatcagtgg

SEQ ID NO: 8446942 - DNA, 22 bp, Homo sapiens
gcccaggctggagttcagtggt

SEQ ID NO: 8446943 - DNA, 22 bp, Homo sapiens
gcccagggcagggcaagagtga

SEQ ID NO: 8446944 - DNA, 22 bp, Homo sapiens
gcccagggcagggcaagagtga

SEQ ID NO: 8446945 - DNA, 22 bp, Homo sapiens
gcccagggcgatggtcggggcc

SEQ ID NO: 8446946 - DNA, 22 bp, Homo sapiens
gcccagggctgcaagtggacgc

SEQ ID NO: 8446947 - DNA, 22 bp, Homo sapiens
gcaagatggttataaaaaatgt

SEQ ID NO: 8446948 - DNA, 22 bp, Homo sapiens
gcaagatgttaacatagggaga

SEQ ID NO: 8446949 - DNA, 23 bp, Homo sapiens
gcaagcaaggcagggtaaagaga

SEQ ID NO: 8446950 - DNA, 22 bp, Homo sapiens
gcaagcaagcaggtagagctga

SEQ ID NO: 8446951 - DNA, 22 bp, Homo sapiens
gcaagcaatggacggtgacttt

SEQ ID NO: 8446952 - DNA, 22 bp, Homo sapiens
gcaagcaagtatctggcaggga

SEQ ID NO: 8446953 - DNA, 22 bp, Homo sapiens
gcaagcaaaatgggagattccc

SEQ ID NO: 8446954 - DNA, 22 bp, Homo sapiens
gcaagcaaattatttataggca

SEQ ID NO: 8446955 - DNA, 22 bp, Homo sapiens
gcaagcaaaatgggagattccc

SEQ ID NO: 8446956 - DNA, 22 bp, Homo sapiens
gcaagatggttataaaaaatgt

SEQ ID NO: 8446957 - DNA, 22 bp, Homo sapiens
gagggtccccatgcagagctca

SEQ ID NO: 8446958 - DNA, 22 bp, Homo sapiens
gagggtccccatgcagagctca

SEQ ID NO: 8446959 - DNA, 22 bp, Homo sapiens
gagggtcccgagccctgtcaga

SEQ ID NO: 8446960 - DNA, 19 bp, Homo sapiens
gcaaatctgaccaaatagt

SEQ ID NO: 8446961 - DNA, 22 bp, Homo sapiens
gagggtccctgctcagggccag

SEQ ID NO: 8446962 - DNA, 22 bp, Homo sapiens
gagggtccctgctcagggccag

SEQ ID NO: 8446963 - DNA, 22 bp, Homo sapiens
gcaagaacgaatcctacttgct

SEQ ID NO: 8446964 - DNA, 22 bp, Homo sapiens
gcaagacaatggagcataaacg

SEQ ID NO: 8446965 - DNA, 22 bp, Homo sapiens
gcaagaactgcaattacttttg

SEQ ID NO: 8446966 - DNA, 22 bp, Homo sapiens
gcaagacatgtctaaggtttaa

SEQ ID NO: 8446967 - DNA, 22 bp, Homo sapiens
gcaaatgctaaagtgtagagac

SEQ ID NO: 8446968 - DNA, 22 bp, Homo sapiens
gagggggagatgtgcacacact

SEQ ID NO: 8446969 - DNA, 22 bp, Homo sapiens
gagggggacgtatcctggtatg

SEQ ID NO: 8446970 - DNA, 22 bp, Homo sapiens
gagggggaaagtccctggagtc

SEQ ID NO: 8446971 - DNA, 22 bp, Homo sapiens
gagggggcgaacagaagcaagg

SEQ ID NO: 8446972 - DNA, 22 bp, Homo sapiens
gaggggtgtggagccatcagtt

SEQ ID NO: 8446973 - DNA, 22 bp, Homo sapiens
gcaagcagcccagaacagctct

SEQ ID NO: 8446974 - DNA, 22 bp, Homo sapiens
gcaagcagcccagaacagctct

SEQ ID NO: 8446975 - DNA, 22 bp, Homo sapiens
gcaagcagcccagaacagctct

SEQ ID NO: 8446976 - DNA, 22 bp, Homo sapiens
gcaagcagacattcaggtaggt

SEQ ID NO: 8446977 - DNA, 22 bp, Homo sapiens
gcaagcagttacccaggattcg

SEQ ID NO: 8446978 - DNA, 22 bp, Homo sapiens
gcaagcagttgtggcttctgag

SEQ ID NO: 8446979 - DNA, 22 bp, Homo sapiens
gcaagctgatgtgatagtgaaa

SEQ ID NO: 8446980 - DNA, 22 bp, Homo sapiens
gcaagcagttgtggcttctgag

SEQ ID NO: 8446981 - DNA, 22 bp, Homo sapiens
gcaagctgatgtgatagtgaaa

SEQ ID NO: 8446982 - DNA, 22 bp, Homo sapiens
gcaagctgctcttatgtggagg

SEQ ID NO: 8446983 - DNA, 22 bp, Homo sapiens
gcaagctgtgatttatgtgaat

SEQ ID NO: 8446984 - DNA, 22 bp, Homo sapiens
gcaagctgtgccttctcaggat

SEQ ID NO: 8446985 - DNA, 22 bp, Homo sapiens
gcaagctgtgccttctcaggat

SEQ ID NO: 8446986 - DNA, 22 bp, Homo sapiens
gcaagctgtccttttgcatggc

SEQ ID NO: 8446987 - DNA, 22 bp, Homo sapiens
gcaagctggctgttagaggatg

SEQ ID NO: 8446988 - DNA, 20 bp, Homo sapiens
gcaagcttattagtgatatt

SEQ ID NO: 8446989 - DNA, 22 bp, Homo sapiens
gcaaggaacaaatgctctgctt

SEQ ID NO: 8446990 - DNA, 22 bp, Homo sapiens
gcacagcagtggcataaacaat

SEQ ID NO: 8446991 - DNA, 22 bp, Homo sapiens
gcacagccactgagtgagaacc

SEQ ID NO: 8446992 - DNA, 22 bp, Homo sapiens
gcacagccacgtaatgtggtca

SEQ ID NO: 8446993 - DNA, 22 bp, Homo sapiens
gcacagctcgagctcaggaggg

SEQ ID NO: 8446994 - DNA, 22 bp, Homo sapiens
gcacagctctccccaagacgaa

SEQ ID NO: 8446995 - DNA, 22 bp, Homo sapiens
gcacagctctccccaagacgaa

SEQ ID NO: 8446996 - DNA, 22 bp, Homo sapiens
gcacagctggactctgcctggc

SEQ ID NO: 8446997 - DNA, 22 bp, Homo sapiens
gcacaggaaatgactcatgtta

SEQ ID NO: 8446998 - DNA, 22 bp, Homo sapiens
gcacaggatgatgggttgaggg

SEQ ID NO: 8446999 - DNA, 22 bp, Homo sapiens
gcacaggcaatagatacagcta

SEQ ID NO: 8447000 - DNA, 19 bp, Homo sapiens
gcacaggacatctgatgga

SEQ ID NO: 8447001 - DNA, 22 bp, Homo sapiens
gcacaggaggccgatgctcatg

SEQ ID NO: 8447002 - DNA, 18 bp, Homo sapiens
gcacagctaggagggtcc

SEQ ID NO: 8447003 - DNA, 22 bp, Homo sapiens
gcacagctcagcatgggaggac

SEQ ID NO: 8447004 - DNA, 22 bp, Homo sapiens
gcacagctcctggtaagctggg

SEQ ID NO: 8447005 - DNA, 22 bp, Homo sapiens
gcacagccctgagcgcatgtct

SEQ ID NO: 8447006 - DNA, 22 bp, Homo sapiens
gcacagccagcatctgagggat

SEQ ID NO: 8447007 - DNA, 22 bp, Homo sapiens
gcacagccctggtcggggcccc

SEQ ID NO: 8447008 - DNA, 22 bp, Homo sapiens
gcacagccggaccgaggaaaag

SEQ ID NO: 8447009 - DNA, 22 bp, Homo sapiens
gcacagcctgtccctgtcctgg

SEQ ID NO: 8447010 - DNA, 22 bp, Homo sapiens
gcacagccttgccctgtgccct

SEQ ID NO: 8447011 - DNA, 22 bp, Homo sapiens
gcacagccttgccctgtgccct

SEQ ID NO: 8447012 - DNA, 22 bp, Homo sapiens
gcactgtgctagaagccagggg

SEQ ID NO: 8447013 - DNA, 22 bp, Homo sapiens
gcactgtgctagaagccagggg

SEQ ID NO: 8447014 - DNA, 22 bp, Homo sapiens
gcacttagggtatgtactgggc

SEQ ID NO: 8447015 - DNA, 22 bp, Homo sapiens
gcacttctggcctggcctgtgt

SEQ ID NO: 8447016 - DNA, 21 bp, Homo sapiens
gcacttctgcagggctgctgg

SEQ ID NO: 8447017 - DNA, 22 bp, Homo sapiens
gcacttctcgggggcgctgtct

SEQ ID NO: 8447018 - DNA, 22 bp, Homo sapiens
gcacttgaagaattgaactgga

SEQ ID NO: 8447019 - DNA, 22 bp, Homo sapiens
gcactgggctccaggaaggagg

SEQ ID NO: 8447020 - DNA, 22 bp, Homo sapiens
gcactgggctccaggaaggagg

SEQ ID NO: 8447021 - DNA, 22 bp, Homo sapiens
gcagaggacacaggagggcaag

SEQ ID NO: 8447022 - DNA, 22 bp, Homo sapiens
gcagagctgcagcgaggcctgg

SEQ ID NO: 8447023 - DNA, 22 bp, Homo sapiens
gcagagctgcagcgaggcctgg

SEQ ID NO: 8447024 - DNA, 22 bp, Homo sapiens
gcagagctgcagcgaggcctgg

SEQ ID NO: 8447025 - DNA, 22 bp, Homo sapiens
gcagagctctgttcttatctcc

SEQ ID NO: 8447026 - DNA, 22 bp, Homo sapiens
gcagagctgagcggctgcccgg

SEQ ID NO: 8447027 - DNA, 22 bp, Homo sapiens
gcagaggacacaggagggcaag

SEQ ID NO: 8447028 - DNA, 22 bp, Homo sapiens
gcagaggagcaagctggacacc

SEQ ID NO: 8447029 - DNA, 22 bp, Homo sapiens
gcactgcatctactggcaagta

SEQ ID NO: 8447030 - DNA, 22 bp, Homo sapiens
gcactgccatcaatgcatgaca

SEQ ID NO: 8447031 - DNA, 22 bp, Homo sapiens
gcactgctccaggtgtggcttg

SEQ ID NO: 8447032 - DNA, 22 bp, Homo sapiens
gcactggagaatggctgtattc

SEQ ID NO: 8447033 - DNA, 22 bp, Homo sapiens
gcactgcttttacctaggtgag

SEQ ID NO: 8447034 - DNA, 22 bp, Homo sapiens
gcactggattttgatctgcaag

SEQ ID NO: 8447035 - DNA, 20 bp, Homo sapiens
gcactgaaattcaatgtttg

SEQ ID NO: 8447036 - DNA, 22 bp, Homo sapiens
gcactgaaattatatgcatttg

SEQ ID NO: 8447037 - DNA, 19 bp, Homo sapiens
gcactgaagagttggtcac

SEQ ID NO: 8447038 - DNA, 22 bp, Homo sapiens
gcactgaatgcttttactgtaa

SEQ ID NO: 8447039 - DNA, 22 bp, Homo sapiens
gcactgagcaccagccacagat

SEQ ID NO: 8447040 - DNA, 22 bp, Homo sapiens
gcacctgggcaaggattcagag

SEQ ID NO: 8447041 - DNA, 22 bp, Homo sapiens
gcactctcctggctgccacagt

SEQ ID NO: 8447042 - DNA, 22 bp, Homo sapiens
gcacaggcacagagggccactg

SEQ ID NO: 8447043 - DNA, 22 bp, Homo sapiens
gcacaggcacagagggccactg

SEQ ID NO: 8447044 - DNA, 22 bp, Homo sapiens
gcagggctattggaaggagatg

SEQ ID NO: 8447045 - DNA, 22 bp, Homo sapiens
gcaggctgccaccttctgagtt

SEQ ID NO: 8447046 - DNA, 22 bp, Homo sapiens
gcaggctgccaccttctgagtt

SEQ ID NO: 8447047 - DNA, 22 bp, Homo sapiens
gcagggccttagcagcggctgc

SEQ ID NO: 8447048 - DNA, 22 bp, Homo sapiens
gcaggctgatgactggagttgg

SEQ ID NO: 8447049 - DNA, 22 bp, Homo sapiens
gcaggctgatgactggagttgg

SEQ ID NO: 8447050 - DNA, 22 bp, Homo sapiens
gcaggctgatgactggagttgg

SEQ ID NO: 8447051 - DNA, 22 bp, Homo sapiens
gcaggctgatagaggattccat

SEQ ID NO: 8447052 - DNA, 22 bp, Homo sapiens
gcaggctgatagaggattccat

SEQ ID NO: 8447053 - DNA, 22 bp, Homo sapiens
gcaggctgatagaggattccat

SEQ ID NO: 8447054 - DNA, 22 bp, Homo sapiens
gcaggctcgttggaagtcccct

SEQ ID NO: 8447055 - DNA, 22 bp, Homo sapiens
gcaggctcttctttctgcccag

SEQ ID NO: 8447056 - DNA, 22 bp, Homo sapiens
gcaggctgaaactcggggtcta

SEQ ID NO: 8447057 - DNA, 22 bp, Homo sapiens
gcaggctgaaactcggggtcta

SEQ ID NO: 8447058 - DNA, 22 bp, Homo sapiens
gcaggctgaaactcggggtcta

SEQ ID NO: 8447059 - DNA, 22 bp, Homo sapiens
gcaggctgagagtccaagaagg

SEQ ID NO: 8447060 - DNA, 22 bp, Homo sapiens
gcaggctgagagtccaagaagg

SEQ ID NO: 8447061 - DNA, 22 bp, Homo sapiens
gcaggctgagagtccaagaagg

SEQ ID NO: 8447062 - DNA, 22 bp, Homo sapiens
gcaggctgagtattaccctagt

SEQ ID NO: 8447063 - DNA, 22 bp, Homo sapiens
gcaggctgagtattaccctagt

SEQ ID NO: 8447064 - DNA, 22 bp, Homo sapiens
gcaggctgagtattaccctagt

SEQ ID NO: 8447065 - DNA, 22 bp, Homo sapiens
gcaggctgagttgggaaaccaa

SEQ ID NO: 8447066 - DNA, 22 bp, Homo sapiens
gcaggctgagttgggaaaccaa

SEQ ID NO: 8447067 - DNA, 22 bp, Homo sapiens
gcaggctgagttgggaaaccaa

SEQ ID NO: 8447068 - DNA, 22 bp, Homo sapiens
gcaggctcactctgtttggctc

SEQ ID NO: 8447069 - DNA, 22 bp, Homo sapiens
gcaggctcagagcagattagca

SEQ ID NO: 8447070 - DNA, 22 bp, Homo sapiens
gcaggctccaactggaggagtt

SEQ ID NO: 8447071 - DNA, 22 bp, Homo sapiens
gcaggctccaactggaggagtt

SEQ ID NO: 8447072 - DNA, 19 bp, Homo sapiens
gcaggcctcttgggaatta

SEQ ID NO: 8447073 - DNA, 22 bp, Homo sapiens
gcaggctatgtcagggccgctc

SEQ ID NO: 8447074 - DNA, 22 bp, Homo sapiens
gcaggctcaaaagctggtagga

SEQ ID NO: 8447075 - DNA, 22 bp, Homo sapiens
gcaggctcaaaagctggtagga

SEQ ID NO: 8447076 - DNA, 22 bp, Homo sapiens
gcaggctcccttgcagagcagg

SEQ ID NO: 8447077 - DNA, 20 bp, Homo sapiens
gcaggctccgggcttgggag

SEQ ID NO: 8447078 - DNA, 22 bp, Homo sapiens
gcaggctccaaggcctgggaga

SEQ ID NO: 8447079 - DNA, 22 bp, Homo sapiens
gcaggctccaggccggcccctt

SEQ ID NO: 8447080 - DNA, 22 bp, Homo sapiens
gcaggaggagcattaactgagc

SEQ ID NO: 8447081 - DNA, 22 bp, Homo sapiens
gcaggagctggaaagtgatgtt

SEQ ID NO: 8447082 - DNA, 22 bp, Homo sapiens
gcaggagctggaaagtgatgtt

SEQ ID NO: 8447083 - DNA, 22 bp, Homo sapiens
gcaggagctggaaagtgatgtt

SEQ ID NO: 8447084 - DNA, 22 bp, Homo sapiens
gcagctggcccctttccttgtt

SEQ ID NO: 8447085 - DNA, 22 bp, Homo sapiens
gcagctggatttcaagagggag

SEQ ID NO: 8447086 - DNA, 22 bp, Homo sapiens
gcagctggagccagccagacac

SEQ ID NO: 8447087 - DNA, 22 bp, Homo sapiens
gcaggaggttgagccaggactg

SEQ ID NO: 8447088 - DNA, 22 bp, Homo sapiens
gcaggaggttgagccaggactg

SEQ ID NO: 8447089 - DNA, 22 bp, Homo sapiens
gcaggagtatgcagctatggtt

SEQ ID NO: 8447090 - DNA, 22 bp, Homo sapiens
gcaggagtgacatggatgtgga

SEQ ID NO: 8447091 - DNA, 22 bp, Homo sapiens
gcaggagtggagaccatgggga

SEQ ID NO: 8447092 - DNA, 22 bp, Homo sapiens
gcaggagtggagaccatgggga

SEQ ID NO: 8447093 - DNA, 22 bp, Homo sapiens
gcaggagtgtatttgcatgtaa

SEQ ID NO: 8447094 - DNA, 22 bp, Homo sapiens
gcaggagttaggcgtcgtggat

SEQ ID NO: 8447095 - DNA, 22 bp, Homo sapiens
gcaggcctctaattcaccgcag

SEQ ID NO: 8447096 - DNA, 22 bp, Homo sapiens
gcaggcctctgttgagggcctt

SEQ ID NO: 8447097 - DNA, 23 bp, Homo sapiens
gcagccaagagaccagggcaggc

SEQ ID NO: 8447098 - DNA, 22 bp, Homo sapiens
gcagccaagaccccaagaactg

SEQ ID NO: 8447099 - DNA, 22 bp, Homo sapiens
gcagctgcagaccctcagtgct

SEQ ID NO: 8447100 - DNA, 22 bp, Homo sapiens
gcagctgccccgactgtgagtc

SEQ ID NO: 8447101 - DNA, 21 bp, Homo sapiens
gcagcatgagaaagccccaaa

SEQ ID NO: 8447102 - DNA, 22 bp, Homo sapiens
gcagcatccccaggcagcaggg

SEQ ID NO: 8447103 - DNA, 22 bp, Homo sapiens
gcagcatcaatccatgcttctc

SEQ ID NO: 8447104 - DNA, 22 bp, Homo sapiens
gcagcatcaggttcactgcgtg

SEQ ID NO: 8447105 - DNA, 22 bp, Homo sapiens
gcagcatctagggcactggcct

SEQ ID NO: 8447106 - DNA, 22 bp, Homo sapiens
gcagcatctgtacatagacgct

SEQ ID NO: 8447107 - DNA, 22 bp, Homo sapiens
gcagcatcctgggccacagtcc

SEQ ID NO: 8447108 - DNA, 22 bp, Homo sapiens
gcagcatccttggcctccaccc

SEQ ID NO: 8447109 - DNA, 22 bp, Homo sapiens
gcagcagtgcgggcagctacag

SEQ ID NO: 8447110 - DNA, 22 bp, Homo sapiens
gcagcagtactcaatatcctgg

SEQ ID NO: 8447111 - DNA, 22 bp, Homo sapiens
gcagcaggtgtgcttttaatga

SEQ ID NO: 8447112 - DNA, 20 bp, Homo sapiens
gcagcagtgcaagtcctctt

SEQ ID NO: 8447113 - DNA, 22 bp, Homo sapiens
gcagcagtaggaaataacacag

SEQ ID NO: 8447114 - DNA, 22 bp, Homo sapiens
gcagcagtgtctcccatcttgc

SEQ ID NO: 8447115 - DNA, 22 bp, Homo sapiens
gcagcatattgtactggcctgc

SEQ ID NO: 8447116 - DNA, 22 bp, Homo sapiens
gcagcagctctgaatgggcccc

SEQ ID NO: 8447117 - DNA, 22 bp, Homo sapiens
gcagcagctctgaatgggcccc

SEQ ID NO: 8447118 - DNA, 22 bp, Homo sapiens
gcagcagctctcaaagtggtct

SEQ ID NO: 8447119 - DNA, 22 bp, Homo sapiens
gcagcagctcagttctgggagg

SEQ ID NO: 8447120 - DNA, 22 bp, Homo sapiens
gcagcagctccctatccaggct

SEQ ID NO: 8447121 - DNA, 22 bp, Homo sapiens
gcagcagcggggcccctgcgcg

SEQ ID NO: 8447122 - DNA, 22 bp, Homo sapiens
gcagaggaggacccaggaatta

SEQ ID NO: 8447123 - DNA, 23 bp, Homo sapiens
gcagaggagcaagctggacacca

SEQ ID NO: 8447124 - DNA, 22 bp, Homo sapiens
gcagaggagcaagttgctacag

SEQ ID NO: 8447125 - DNA, 22 bp, Homo sapiens
gcagaggagcaagttgctacag

SEQ ID NO: 8447126 - DNA, 22 bp, Homo sapiens
gcagcaggaataggataagcaa

SEQ ID NO: 8447127 - DNA, 22 bp, Homo sapiens
gcagcaggaataggataagcaa

SEQ ID NO: 8447128 - DNA, 22 bp, Homo sapiens
gcagcaggaatttaaatttata

SEQ ID NO: 8447129 - DNA, 22 bp, Homo sapiens
gcagcaggaataggataagcaa

SEQ ID NO: 8447130 - DNA, 22 bp, Homo sapiens
gcagcaggactgccgttaaagt

SEQ ID NO: 8447131 - DNA, 22 bp, Homo sapiens
gcagcaggagagtaatagcggt

SEQ ID NO: 8447132 - DNA, 22 bp, Homo sapiens
gcagcaggagagtaatagcggt

SEQ ID NO: 8447133 - DNA, 22 bp, Homo sapiens
gcagcaggagagtttgtcctgc

SEQ ID NO: 8447134 - DNA, 22 bp, Homo sapiens
gcagcaggagagtttgtcctgc

SEQ ID NO: 8447135 - DNA, 22 bp, Homo sapiens
gcagcaggcacggtctcgacat

SEQ ID NO: 8447136 - DNA, 22 bp, Homo sapiens
gcagcaggatggccaattgcca

SEQ ID NO: 8447137 - DNA, 22 bp, Homo sapiens
gcagcaggatggccaattgcca

SEQ ID NO: 8447138 - DNA, 22 bp, Homo sapiens
gcagcaggcacggtctcgacat

SEQ ID NO: 8447139 - DNA, 22 bp, Homo sapiens
gcagcaggtctgtcaatgtcat

SEQ ID NO: 8447140 - DNA, 22 bp, Homo sapiens
gcagcaggtctgtcaatgtcat

SEQ ID NO: 8447141 - DNA, 22 bp, Homo sapiens
gcctggctagttagtgtcaggt

SEQ ID NO: 8447142 - DNA, 22 bp, Homo sapiens
gcctggctagttagtgtcaggt

SEQ ID NO: 8447143 - DNA, 22 bp, Homo sapiens
gcctggctagttagtgtcaggt

SEQ ID NO: 8447144 - DNA, 18 bp, Homo sapiens
gcctggctgccaacccag

SEQ ID NO: 8447145 - DNA, 22 bp, Homo sapiens
gcctggctgctcagccactcac

SEQ ID NO: 8447146 - DNA, 22 bp, Homo sapiens
gcctggctgctggttctgagga

SEQ ID NO: 8447147 - DNA, 22 bp, Homo sapiens
gcctggctgcttagcctacttc

SEQ ID NO: 8447148 - DNA, 22 bp, Homo sapiens
gcctggctgctggttctgagga

SEQ ID NO: 8447149 - DNA, 22 bp, Homo sapiens
gcctggctgctagccagaggca

SEQ ID NO: 8447150 - DNA, 22 bp, Homo sapiens
gcctggctgctagccagaggca

SEQ ID NO: 8447151 - DNA, 21 bp, Homo sapiens
gcctggctagaagctcctagc

SEQ ID NO: 8447152 - DNA, 22 bp, Homo sapiens
gcctcagggataggatgagcat

SEQ ID NO: 8447153 - DNA, 22 bp, Homo sapiens
gcctcagggataggatgagcat

SEQ ID NO: 8447154 - DNA, 22 bp, Homo sapiens
gcctcaggcctatagctgctgt

SEQ ID NO: 8447155 - DNA, 22 bp, Homo sapiens
gcctcaggcctatagctgctgt

SEQ ID NO: 8447156 - DNA, 22 bp, Homo sapiens
gcctcaggcctatagctgctgt

SEQ ID NO: 8447157 - DNA, 22 bp, Homo sapiens
gcctcaggccgccctgctgctc

SEQ ID NO: 8447158 - DNA, 22 bp, Homo sapiens
gcctcaggccgccctgctgctc

SEQ ID NO: 8447159 - DNA, 22 bp, Homo sapiens
gcctggcttgccagccctggcg

SEQ ID NO: 8447160 - DNA, 22 bp, Homo sapiens
gcctggcttggggctcagtggt

SEQ ID NO: 8447161 - DNA, 22 bp, Homo sapiens
gcctggcttggggctcagtggt

SEQ ID NO: 8447162 - DNA, 21 bp, Homo sapiens
gcctggcttcacaggcactga

SEQ ID NO: 8447163 - DNA, 21 bp, Homo sapiens
gcctggcttcacaggcactga

SEQ ID NO: 8447164 - DNA, 22 bp, Homo sapiens
gcctggcttcccttggagcatt

SEQ ID NO: 8447165 - DNA, 19 bp, Homo sapiens
gcctggctgggatgagccc

SEQ ID NO: 8447166 - DNA, 19 bp, Homo sapiens
gcctggctgggatgagccc

SEQ ID NO: 8447167 - DNA, 22 bp, Homo sapiens
gcctggctgggcaccaggggag

SEQ ID NO: 8447168 - DNA, 22 bp, Homo sapiens
gcctggctgggcaccaggggag

SEQ ID NO: 8447169 - DNA, 22 bp, Homo sapiens
gcctggctgggctgaatgctta

SEQ ID NO: 8447170 - DNA, 22 bp, Homo sapiens
gcctggctgggcaccaggggag

SEQ ID NO: 8447171 - DNA, 22 bp, Homo sapiens
gcctggctggtagagggggctc

SEQ ID NO: 8447172 - DNA, 22 bp, Homo sapiens
gcctggctggtagagggggctc

SEQ ID NO: 8447173 - DNA, 22 bp, Homo sapiens
gcctggctggtcactgcctggc

SEQ ID NO: 8447174 - DNA, 22 bp, Homo sapiens
gcctggctggtcactgcctggc

SEQ ID NO: 8447175 - DNA, 22 bp, Homo sapiens
gcctggctgtctggcaaggttc

SEQ ID NO: 8447176 - DNA, 18 bp, Homo sapiens
gccttcagactgcatgct

SEQ ID NO: 8447177 - DNA, 22 bp, Homo sapiens
gcctggtgctatgagggccagc

SEQ ID NO: 8447178 - DNA, 22 bp, Homo sapiens
gcctggtggacactgggcatca

SEQ ID NO: 8447179 - DNA, 22 bp, Homo sapiens
gccttcaggaaatcagtccttg

SEQ ID NO: 8447180 - DNA, 22 bp, Homo sapiens
gccttcagcggccgctcgctgc

SEQ ID NO: 8447181 - DNA, 22 bp, Homo sapiens
gccttcagcggccgctcgctgc

SEQ ID NO: 8447182 - DNA, 23 bp, Homo sapiens
gccttcagctcgggaaggctccc

SEQ ID NO: 8447183 - DNA, 22 bp, Homo sapiens
gccttcagtagtgtcagctgta

SEQ ID NO: 8447184 - DNA, 22 bp, Homo sapiens
gccttcagtagtatcctcatga

SEQ ID NO: 8447185 - DNA, 22 bp, Homo sapiens
gcctggggaacttgatcctgtc

SEQ ID NO: 8447186 - DNA, 22 bp, Homo sapiens
gcctggggggcatgtcataata

SEQ ID NO: 8447187 - DNA, 23 bp, Homo sapiens
gcctgggttgtaactagtgcatc

SEQ ID NO: 8447188 - DNA, 22 bp, Homo sapiens
gcctggtgaaaggcagagagcg

SEQ ID NO: 8447189 - DNA, 22 bp, Homo sapiens
gcctggtgataagcagtgacct

SEQ ID NO: 8447190 - DNA, 22 bp, Homo sapiens
gcctgggtccactgatcatgct

SEQ ID NO: 8447191 - DNA, 19 bp, Homo sapiens
gctcaacagctcgggtcct

SEQ ID NO: 8447192 - DNA, 22 bp, Homo sapiens
gcggggcacagtgatggagcac

SEQ ID NO: 8447193 - DNA, 22 bp, Homo sapiens
gcggggggaggaacatcttgca

SEQ ID NO: 8447194 - DNA, 22 bp, Homo sapiens
gctatctttctgcaccataatt

SEQ ID NO: 8447195 - DNA, 22 bp, Homo sapiens
gctatcttcatggaaatacagg

SEQ ID NO: 8447196 - DNA, 22 bp, Homo sapiens
gctcagctgcacctggagagcc

SEQ ID NO: 8447197 - DNA, 21 bp, Homo sapiens
gctcagctgcttggttcctgt

SEQ ID NO: 8447198 - DNA, 22 bp, Homo sapiens
gctcacagtctggcatagtctc

SEQ ID NO: 8447199 - DNA, 18 bp, Homo sapiens
gctcaggccctagtcagt

SEQ ID NO: 8447200 - DNA, 22 bp, Homo sapiens
gctcaggcatgtatgtggttgc

SEQ ID NO: 8447201 - DNA, 22 bp, Homo sapiens
gctcaggcccagcggctggtgt

SEQ ID NO: 8447202 - DNA, 22 bp, Homo sapiens
gctcagctggaccatcgtgttt

SEQ ID NO: 8447203 - DNA, 21 bp, Homo sapiens
gctcagctgcttggttcctgt

SEQ ID NO: 8447204 - DNA, 22 bp, Homo sapiens
gctcagcttgggagcgcccggt

SEQ ID NO: 8447205 - DNA, 22 bp, Homo sapiens
gctcacagtctgctgagtgcag

SEQ ID NO: 8447206 - DNA, 22 bp, Homo sapiens
gctcacagccggctggcagggg

SEQ ID NO: 8447207 - DNA, 22 bp, Homo sapiens
gcgactgtacagaattgcccct

SEQ ID NO: 8447208 - DNA, 22 bp, Homo sapiens
gcgagaaactaagtgccctttg

SEQ ID NO: 8447209 - DNA, 22 bp, Homo sapiens
gcgccccatctacagtactttt

SEQ ID NO: 8447210 - DNA, 16 bp, Homo sapiens
gcgcctcctcggcctc

SEQ ID NO: 8447211 - DNA, 22 bp, Homo sapiens
gccttgccaaggggcagcagag

SEQ ID NO: 8447212 - DNA, 21 bp, Homo sapiens
gccttgccacatgtgccacag

SEQ ID NO: 8447213 - DNA, 22 bp, Homo sapiens
gcgacagtgcggccaccttcat

SEQ ID NO: 8447214 - DNA, 22 bp, Homo sapiens
gccttccacctaggcctctgct

SEQ ID NO: 8447215 - DNA, 22 bp, Homo sapiens
gccttctctgtgagctcctagg

SEQ ID NO: 8447216 - DNA, 22 bp, Homo sapiens
gccttctctgtgagctcctagg

SEQ ID NO: 8447217 - DNA, 22 bp, Homo sapiens
gcggctccgaagccaggccgcg

SEQ ID NO: 8447218 - DNA, 22 bp, Homo sapiens
gcgggccaccttggagagcgct

SEQ ID NO: 8447219 - DNA, 22 bp, Homo sapiens
gcgggccaccttggagagcgct

SEQ ID NO: 8447220 - DNA, 22 bp, Homo sapiens
gcggcaggagtaaaggaggaag

SEQ ID NO: 8447221 - DNA, 22 bp, Homo sapiens
gcgctcaggtgccaggcctgcg

SEQ ID NO: 8447222 - DNA, 22 bp, Homo sapiens
gctctgctctaacattcctgac

SEQ ID NO: 8447223 - DNA, 21 bp, Homo sapiens
gctctcagctgcctgctggtt

SEQ ID NO: 8447224 - DNA, 17 bp, Homo sapiens
gctctgccccagcctct

SEQ ID NO: 8447225 - DNA, 22 bp, Homo sapiens
gctctggctactccaccctgtt

SEQ ID NO: 8447226 - DNA, 22 bp, Homo sapiens
gctctggctactccaccctgtt

SEQ ID NO: 8447227 - DNA, 22 bp, Homo sapiens
gctctggccagaccctcagtgg

SEQ ID NO: 8447228 - DNA, 22 bp, Homo sapiens
gctctggccagaccctcagtgg

SEQ ID NO: 8447229 - DNA, 21 bp, Homo sapiens
gctctggcctactgttccctc

SEQ ID NO: 8447230 - DNA, 21 bp, Homo sapiens
gctctggcctactgttccctc

SEQ ID NO: 8447231 - DNA, 22 bp, Homo sapiens
gctctggcccaaaccctttcta

SEQ ID NO: 8447232 - DNA, 22 bp, Homo sapiens
gctgaagataagtgaagaggct

SEQ ID NO: 8447233 - DNA, 22 bp, Homo sapiens
gctctggctactgtggctaccg

SEQ ID NO: 8447234 - DNA, 22 bp, Homo sapiens
gctctggctactgtggctaccg

SEQ ID NO: 8447235 - DNA, 23 bp, Homo sapiens
gctctggcagcttgtgtcagcac

SEQ ID NO: 8447236 - DNA, 23 bp, Homo sapiens
gctctggcagcttgtgtcagcac

SEQ ID NO: 8447237 - DNA, 23 bp, Homo sapiens
gctctggcagcttgtgtcagcac

SEQ ID NO: 8447238 - DNA, 22 bp, Homo sapiens
gctctggcagctgatattagga

SEQ ID NO: 8447239 - DNA, 22 bp, Homo sapiens
gctctggcactggcgcgggatg

SEQ ID NO: 8447240 - DNA, 22 bp, Homo sapiens
gctctcagaagagccaggctac

SEQ ID NO: 8447241 - DNA, 22 bp, Homo sapiens
gctctcagaagagccaggctac

SEQ ID NO: 8447242 - DNA, 22 bp, Homo sapiens
gctctcagcccactgaggggaa

SEQ ID NO: 8447243 - DNA, 22 bp, Homo sapiens
gctctcagatgctccagcagcc

SEQ ID NO: 8447244 - DNA, 22 bp, Homo sapiens
gctctcagatgctccagcagcc

SEQ ID NO: 8447245 - DNA, 22 bp, Homo sapiens
gctcctgttttcttccagaaat

SEQ ID NO: 8447246 - DNA, 22 bp, Homo sapiens
gctccttcaggtggtagctgtt

SEQ ID NO: 8447247 - DNA, 22 bp, Homo sapiens
gctcctgtttgtttgttcctga

SEQ ID NO: 8447248 - DNA, 22 bp, Homo sapiens
gctcctgtgcaggtctcggttg

SEQ ID NO: 8447249 - DNA, 22 bp, Homo sapiens
gctctattactttcaataaaaa

SEQ ID NO: 8447250 - DNA, 22 bp, Homo sapiens
gctcctggtgctgtagagattt

SEQ ID NO: 8447251 - DNA, 22 bp, Homo sapiens
gctcctggtgctgtagagattt

SEQ ID NO: 8447252 - DNA, 18 bp, Homo sapiens
gctcctggttggaaagaa

SEQ ID NO: 8447253 - DNA, 21 bp, Homo sapiens
gctcctggtgctgcgtggcgc

SEQ ID NO: 8447254 - DNA, 21 bp, Homo sapiens
gctcctggtgctgcgtggcgc

SEQ ID NO: 8447255 - DNA, 21 bp, Homo sapiens
gctcctggtgctgcgtggcgc

SEQ ID NO: 8447256 - DNA, 21 bp, Homo sapiens
gctcctggtgctgcgtggcgc

SEQ ID NO: 8447257 - DNA, 21 bp, Homo sapiens
gctcctggtgctgcgtggcgc

SEQ ID NO: 8447258 - DNA, 22 bp, Homo sapiens
gctcctgtgaggacacagccgc

SEQ ID NO: 8447259 - DNA, 22 bp, Homo sapiens
gctcctgtgaaggcattaggtg

SEQ ID NO: 8447260 - DNA, 22 bp, Homo sapiens
gctcctgtccttagccccagag

SEQ ID NO: 8447261 - DNA, 22 bp, Homo sapiens
gctcctgtcttggggcactggc

SEQ ID NO: 8447262 - DNA, 22 bp, Homo sapiens
gctcctgtaatttttaaaagtc

SEQ ID NO: 8447263 - DNA, 18 bp, Homo sapiens
gctcctggttggaaagaa

SEQ ID NO: 8447264 - DNA, 22 bp, Homo sapiens
gctcctgtcatcaaacaatcct

SEQ ID NO: 8447265 - DNA, 22 bp, Homo sapiens
gctcctgtcagtcatcaggtgc

SEQ ID NO: 8447266 - DNA, 20 bp, Homo sapiens
gctcctgtcctggtggaggg

SEQ ID NO: 8447267 - DNA, 21 bp, Homo sapiens
gctcaggctcttgacagagca

SEQ ID NO: 8447268 - DNA, 22 bp, Homo sapiens
gctcaggcctggcccatgggac

SEQ ID NO: 8447269 - DNA, 21 bp, Homo sapiens
gctcaggctcttgacagagca

SEQ ID NO: 8447270 - DNA, 22 bp, Homo sapiens
gctcaggctctcccaggggaat

SEQ ID NO: 8447271 - DNA, 22 bp, Homo sapiens
gctcaggctctcccaggggaat

SEQ ID NO: 8447272 - DNA, 21 bp, Homo sapiens
gctcaggctcaggttcaggtt

SEQ ID NO: 8447273 - DNA, 22 bp, Homo sapiens
gctcaggcctggctatccattg

SEQ ID NO: 8447274 - DNA, 21 bp, Homo sapiens
gctcaggctcaggttcaggtt

SEQ ID NO: 8447275 - DNA, 22 bp, Homo sapiens
gctcaggcctggctatccattg

SEQ ID NO: 8447276 - DNA, 22 bp, Homo sapiens
gctcaggcctcggacacacaat

SEQ ID NO: 8447277 - DNA, 22 bp, Homo sapiens
gctcaggcctggcccatgggac

SEQ ID NO: 8447278 - DNA, 18 bp, Homo sapiens
gctcaggccctagtcagt

SEQ ID NO: 8447279 - DNA, 22 bp, Homo sapiens
gctcaggcctcactccatttgg

SEQ ID NO: 8447280 - DNA, 22 bp, Homo sapiens
gctcaggcccagcggctggtgt

SEQ ID NO: 8447281 - DNA, 22 bp, Homo sapiens
gctcaggcctccagaggggcaa

SEQ ID NO: 8447282 - DNA, 22 bp, Homo sapiens
gctcaggcctccagaggggcaa

SEQ ID NO: 8447283 - DNA, 22 bp, Homo sapiens
gctcctggtctggagcttcaag

SEQ ID NO: 8447284 - DNA, 22 bp, Homo sapiens
gctcctggtctggagcttcaag

SEQ ID NO: 8447285 - DNA, 22 bp, Homo sapiens
gctcagggaaagagctcctgtc

SEQ ID NO: 8447286 - DNA, 22 bp, Homo sapiens
gctcctggtgcaaagtttcttc

SEQ ID NO: 8447287 - DNA, 22 bp, Homo sapiens
gctcctggtgcaaagtttcttc

SEQ ID NO: 8447288 - DNA, 22 bp, Homo sapiens
gctcaggctggattgcagtggc

SEQ ID NO: 8447289 - DNA, 19 bp, Homo sapiens
gctcaggctgtgtgtgggg

SEQ ID NO: 8447290 - DNA, 22 bp, Homo sapiens
gctcaggctggattgcagtggc

SEQ ID NO: 8447291 - DNA, 19 bp, Homo sapiens
gctcaggctgtgtgtgggg

SEQ ID NO: 8447292 - DNA, 22 bp, Homo sapiens
gctcagggaaagagctcctgtc

SEQ ID NO: 8447293 - DNA, 22 bp, Homo sapiens
gctcaggcttcttctataaaga

SEQ ID NO: 8447294 - DNA, 22 bp, Homo sapiens
gctgccagtagttggagctcca

SEQ ID NO: 8447295 - DNA, 22 bp, Homo sapiens
gctgccagttccttcttactcc

SEQ ID NO: 8447296 - DNA, 22 bp, Homo sapiens
gctgccatctcctgaggacagg

SEQ ID NO: 8447297 - DNA, 22 bp, Homo sapiens
gctgccagtgtggcatgatgca

SEQ ID NO: 8447298 - DNA, 22 bp, Homo sapiens
gctgccagctcactctcctgag

SEQ ID NO: 8447299 - DNA, 22 bp, Homo sapiens
gctgccagcccagcaaggtgtg

SEQ ID NO: 8447300 - DNA, 22 bp, Homo sapiens
gctgccagggaggtggtggagg

SEQ ID NO: 8447301 - DNA, 22 bp, Homo sapiens
gctgccaggccctggggctatg

SEQ ID NO: 8447302 - DNA, 22 bp, Homo sapiens
gctgcagctcgccttccggcct

SEQ ID NO: 8447303 - DNA, 22 bp, Homo sapiens
gctgcagacctcatgcaggtgg

SEQ ID NO: 8447304 - DNA, 22 bp, Homo sapiens
gctgcaggagctggagctgtgg

SEQ ID NO: 8447305 - DNA, 22 bp, Homo sapiens
gctgcaggagctggagctgtgg

SEQ ID NO: 8447306 - DNA, 22 bp, Homo sapiens
gctgcaggagattttgagagtc

SEQ ID NO: 8447307 - DNA, 22 bp, Homo sapiens
gctgcaggagattttgagagtc

SEQ ID NO: 8447308 - DNA, 22 bp, Homo sapiens
gctgcaggagattttgagagtc

SEQ ID NO: 8447309 - DNA, 22 bp, Homo sapiens
gctgcaggatgaggctctgctc

SEQ ID NO: 8447310 - DNA, 22 bp, Homo sapiens
gctgcagggggtgggcgtctcc

SEQ ID NO: 8447311 - DNA, 22 bp, Homo sapiens
gctgcagggggtgggcgtctcc

SEQ ID NO: 8447312 - DNA, 22 bp, Homo sapiens
gctgcaggatgaggctctgctc

SEQ ID NO: 8447313 - DNA, 22 bp, Homo sapiens
gctgcaggatgaggctctgctc

SEQ ID NO: 8447314 - DNA, 22 bp, Homo sapiens
gctgcagggggtgggcgtctcc

SEQ ID NO: 8447315 - DNA, 22 bp, Homo sapiens
gctgcaggttgggcaacagagt

SEQ ID NO: 8447316 - DNA, 22 bp, Homo sapiens
gctgattttgtcacatagcaag

SEQ ID NO: 8447317 - DNA, 22 bp, Homo sapiens
gctgattttgtcacatagcaag

SEQ ID NO: 8447318 - DNA, 22 bp, Homo sapiens
gctgattttgagaagcacagtc

SEQ ID NO: 8447319 - DNA, 22 bp, Homo sapiens
gctgcaccagctccaccagggc

SEQ ID NO: 8447320 - DNA, 22 bp, Homo sapiens
gctgcaccagctgcacccagta

SEQ ID NO: 8447321 - DNA, 20 bp, Homo sapiens
gctgaagattcccatgcaag

SEQ ID NO: 8447322 - DNA, 22 bp, Homo sapiens
gctgaagataggcatttcagca

SEQ ID NO: 8447323 - DNA, 22 bp, Homo sapiens
gctgaagataagtgaagaggct

SEQ ID NO: 8447324 - DNA, 22 bp, Homo sapiens
gctgaagggagtgctgagtctg

SEQ ID NO: 8447325 - DNA, 22 bp, Homo sapiens
gctgaaggcccggaggacaggg

SEQ ID NO: 8447326 - DNA, 22 bp, Homo sapiens
gctgaagggagtgctgagtctg

SEQ ID NO: 8447327 - DNA, 22 bp, Homo sapiens
gctgaaggtgtgtggagagagg

SEQ ID NO: 8447328 - DNA, 22 bp, Homo sapiens
ggaccctgggctctgggcctat

SEQ ID NO: 8447329 - DNA, 22 bp, Homo sapiens
ggaccctgggcagctggctgct

SEQ ID NO: 8447330 - DNA, 22 bp, Homo sapiens
ggaccctgggcttgctcctggg

SEQ ID NO: 8447331 - DNA, 22 bp, Homo sapiens
ggaccctggagacccactggga

SEQ ID NO: 8447332 - DNA, 22 bp, Homo sapiens
ggaccctggagacccactggga

SEQ ID NO: 8447333 - DNA, 22 bp, Homo sapiens
ggaccctgcgtgtatccacact

SEQ ID NO: 8447334 - DNA, 23 bp, Homo sapiens
ggaccctgtggagggtgagagtc

SEQ ID NO: 8447335 - DNA, 22 bp, Homo sapiens
ggacccttggcttctgcagatt

SEQ ID NO: 8447336 - DNA, 23 bp, Homo sapiens
ggaccctgtggagggtgagagtc

SEQ ID NO: 8447337 - DNA, 22 bp, Homo sapiens
ggacctgaacataaaacgaggc

SEQ ID NO: 8447338 - DNA, 21 bp, Homo sapiens
ggacagaggagaaggcaccct

SEQ ID NO: 8447339 - DNA, 22 bp, Homo sapiens
ggacccagaggggagtctggca

SEQ ID NO: 8447340 - DNA, 22 bp, Homo sapiens
ggacagagggcaggagcccaga

SEQ ID NO: 8447341 - DNA, 22 bp, Homo sapiens
ggacagagggcaggagcccaga

SEQ ID NO: 8447342 - DNA, 22 bp, Homo sapiens
ggacagagggcaggagcccaga

SEQ ID NO: 8447343 - DNA, 18 bp, Homo sapiens
ggacccagggcctcaccc

SEQ ID NO: 8447344 - DNA, 18 bp, Homo sapiens
ggacccagggcctcaccc

SEQ ID NO: 8447345 - DNA, 18 bp, Homo sapiens
ggacccagggcctcaccc

SEQ ID NO: 8447346 - DNA, 22 bp, Homo sapiens
ggacccaggtagggaggaagat

SEQ ID NO: 8447347 - DNA, 22 bp, Homo sapiens
ggacccagaggggagtctggca

SEQ ID NO: 8447348 - DNA, 22 bp, Homo sapiens
ggacagagccctggtggcctaa

SEQ ID NO: 8447349 - DNA, 22 bp, Homo sapiens
ggacagaaattcttgttggaca

SEQ ID NO: 8447350 - DNA, 22 bp, Homo sapiens
ggacagagagtgaatatgacat

SEQ ID NO: 8447351 - DNA, 22 bp, Homo sapiens
ggacagagcagacgagcagcgg

SEQ ID NO: 8447352 - DNA, 22 bp, Homo sapiens
ggacagagcagacgagcagcgg

SEQ ID NO: 8447353 - DNA, 22 bp, Homo sapiens
ggagagagatgccgccttgctc

SEQ ID NO: 8447354 - DNA, 22 bp, Homo sapiens
ggagagagatgccgccttgctc

SEQ ID NO: 8447355 - DNA, 22 bp, Homo sapiens
ggagagagatgccgccttgctc

SEQ ID NO: 8447356 - DNA, 22 bp, Homo sapiens
ggactcagcagccaggagtggc

SEQ ID NO: 8447357 - DNA, 22 bp, Homo sapiens
ggacggggagctggaaagggga

SEQ ID NO: 8447358 - DNA, 22 bp, Homo sapiens
ggacggggagctggaaagggga

SEQ ID NO: 8447359 - DNA, 22 bp, Homo sapiens
ggacctggcaatttgcatctct

SEQ ID NO: 8447360 - DNA, 22 bp, Homo sapiens
ggaccttcctggctcctggggt

SEQ ID NO: 8447361 - DNA, 22 bp, Homo sapiens
ggacgcagccgagggagcaggg

SEQ ID NO: 8447362 - DNA, 22 bp, Homo sapiens
ggagagctggtatatgaagaca

SEQ ID NO: 8447363 - DNA, 22 bp, Homo sapiens
ggagaggaaatgccagcacttc

SEQ ID NO: 8447364 - DNA, 22 bp, Homo sapiens
ggagaggagattgtggcatttt

SEQ ID NO: 8447365 - DNA, 22 bp, Homo sapiens
ggagaggagattgtggcatttt

SEQ ID NO: 8447366 - DNA, 22 bp, Homo sapiens
ggagaggagctattgggggctc

SEQ ID NO: 8447367 - DNA, 22 bp, Homo sapiens
ggaaagctcagatcttgttgga

SEQ ID NO: 8447368 - DNA, 22 bp, Homo sapiens
ggaaagctttgttttcctcacc

SEQ ID NO: 8447369 - DNA, 22 bp, Homo sapiens
ggaaaggagatattggagagtg

SEQ ID NO: 8447370 - DNA, 22 bp, Homo sapiens
ggaaaggagatattggagagtg

SEQ ID NO: 8447371 - DNA, 22 bp, Homo sapiens
ggaaaggagatattggagagtg

SEQ ID NO: 8447372 - DNA, 22 bp, Homo sapiens
ggaaatcatgggagagttggaa

SEQ ID NO: 8447373 - DNA, 22 bp, Homo sapiens
ggaaagggcatggccttttcac

SEQ ID NO: 8447374 - DNA, 22 bp, Homo sapiens
ggaaatacaaagatacaccact

SEQ ID NO: 8447375 - DNA, 17 bp, Homo sapiens
gcttcctcatgcagttc

SEQ ID NO: 8447376 - DNA, 22 bp, Homo sapiens
gcttccggagccaaaaggcccc

SEQ ID NO: 8447377 - DNA, 22 bp, Homo sapiens
gcttcccatagtggaattcggg

SEQ ID NO: 8447378 - DNA, 22 bp, Homo sapiens
gcttcccattatggaaactctt

SEQ ID NO: 8447379 - DNA, 22 bp, Homo sapiens
gcttcccattatggaaactctt

SEQ ID NO: 8447380 - DNA, 23 bp, Homo sapiens
gcttcccagacaatactgcttcc

SEQ ID NO: 8447381 - DNA, 19 bp, Homo sapiens
gcttcccaccagccagccc

SEQ ID NO: 8447382 - DNA, 22 bp, Homo sapiens
gcttcccaggcgcctgaccttt

SEQ ID NO: 8447383 - DNA, 22 bp, Homo sapiens
gcttcccaggcgcctgaccttt

SEQ ID NO: 8447384 - DNA, 22 bp, Homo sapiens
gcttcccagcagaggaaagact

SEQ ID NO: 8447385 - DNA, 22 bp, Homo sapiens
gcttcccaatgtgctagtttct

SEQ ID NO: 8447386 - DNA, 20 bp, Homo sapiens
gcttcccaattcttgatctg

SEQ ID NO: 8447387 - DNA, 20 bp, Homo sapiens
gcttcccaattcttgatctg

SEQ ID NO: 8447388 - DNA, 22 bp, Homo sapiens
gcttcccacagctggactgggg

SEQ ID NO: 8447389 - DNA, 19 bp, Homo sapiens
gcttcccaccagccagccc

SEQ ID NO: 8447390 - DNA, 18 bp, Homo sapiens
gcttcctgaaagctgccc

SEQ ID NO: 8447391 - DNA, 18 bp, Homo sapiens
gcttcctgaaagctgccc

SEQ ID NO: 8447392 - DNA, 18 bp, Homo sapiens
gcttcctgaaagctgccc

SEQ ID NO: 8447393 - DNA, 22 bp, Homo sapiens
gcttcctgagtacaccctcatc

SEQ ID NO: 8447394 - DNA, 22 bp, Homo sapiens
gcttcctgagaaacaatctgat

SEQ ID NO: 8447395 - DNA, 22 bp, Homo sapiens
gcttcctccctgctgctcacta

SEQ ID NO: 8447396 - DNA, 22 bp, Homo sapiens
ggaagccaggccaatgagaaca

SEQ ID NO: 8447397 - DNA, 22 bp, Homo sapiens
ggaaccttgctagatgctgagg

SEQ ID NO: 8447398 - DNA, 21 bp, Homo sapiens
ggaagcagtggcggcaactcc

SEQ ID NO: 8447399 - DNA, 22 bp, Homo sapiens
ggaacagtagacgatctccttt

SEQ ID NO: 8447400 - DNA, 22 bp, Homo sapiens
ggaacattttttaaggcagaaa

SEQ ID NO: 8447401 - DNA, 22 bp, Homo sapiens
ggaacatttcctggcagagagg

SEQ ID NO: 8447402 - DNA, 19 bp, Homo sapiens
ggaaccttagagcttcagc

SEQ ID NO: 8447403 - DNA, 22 bp, Homo sapiens
ggaagccccagctgtgggatcc

SEQ ID NO: 8447404 - DNA, 19 bp, Homo sapiens
ggaagccctaaaggaccta

SEQ ID NO: 8447405 - DNA, 19 bp, Homo sapiens
ggaagccctgggtcagagc

SEQ ID NO: 8447406 - DNA, 22 bp, Homo sapiens
ggaagccccagcatggccttgg

SEQ ID NO: 8447407 - DNA, 22 bp, Homo sapiens
ggaagctgttatcatctgtatc

SEQ ID NO: 8447408 - DNA, 22 bp, Homo sapiens
ggacacagtggaagacagcttg

SEQ ID NO: 8447409 - DNA, 22 bp, Homo sapiens
ggaaggaaattggggcagttgt

SEQ ID NO: 8447410 - DNA, 18 bp, Homo sapiens
ggaaggaagaatgcattt

SEQ ID NO: 8447411 - DNA, 18 bp, Homo sapiens
ggaaggaagaatgcattt

SEQ ID NO: 8447412 - DNA, 22 bp, Homo sapiens
gctgtcttccttgctccaaggg

SEQ ID NO: 8447413 - DNA, 22 bp, Homo sapiens
gctgtcttgatgattggatgct

SEQ ID NO: 8447414 - DNA, 22 bp, Homo sapiens
gctgtcttcacttcctggtttc

SEQ ID NO: 8447415 - DNA, 22 bp, Homo sapiens
gctgggtttccagcaggcagga

SEQ ID NO: 8447416 - DNA, 22 bp, Homo sapiens
gctgggttttcttccgggccta

SEQ ID NO: 8447417 - DNA, 22 bp, Homo sapiens
gctgggttttcttccgggccta

SEQ ID NO: 8447418 - DNA, 22 bp, Homo sapiens
gctgggtggatcggaggctctg

SEQ ID NO: 8447419 - DNA, 22 bp, Homo sapiens
gctgggtctggatgctcaggtg

SEQ ID NO: 8447420 - DNA, 22 bp, Homo sapiens
gctgggtctggctgtgagccgg

SEQ ID NO: 8447421 - DNA, 22 bp, Homo sapiens
gctgggtctctccctggtcctg

SEQ ID NO: 8447422 - DNA, 22 bp, Homo sapiens
gctgggtcctatgctggtagag

SEQ ID NO: 8447423 - DNA, 22 bp, Homo sapiens
gctggggtgtggtggataagct

SEQ ID NO: 8447424 - DNA, 22 bp, Homo sapiens
gctggggtgtggtggataagct

SEQ ID NO: 8447425 - DNA, 22 bp, Homo sapiens
gctggggtctgtgaggagggct

SEQ ID NO: 8447426 - DNA, 22 bp, Homo sapiens
gctggggtctgtgaggagggct

SEQ ID NO: 8447427 - DNA, 22 bp, Homo sapiens
gctgggtcagaatctccctgtg

SEQ ID NO: 8447428 - DNA, 18 bp, Homo sapiens
gctggggttgagctctcc

SEQ ID NO: 8447429 - DNA, 21 bp, Homo sapiens
gctgggtcagcaggtcctctg

SEQ ID NO: 8447430 - DNA, 21 bp, Homo sapiens
gctgggtcagcaggtcctctg

SEQ ID NO: 8447431 - DNA, 21 bp, Homo sapiens
gctgggtcagcaggtcctctg

SEQ ID NO: 8447432 - DNA, 22 bp, Homo sapiens
gctgggtcccaagcctggggag

SEQ ID NO: 8447433 - DNA, 22 bp, Homo sapiens
gctgggtcccaagcctggggag

SEQ ID NO: 8447434 - DNA, 22 bp, Homo sapiens
gctgggtccatggtcctcgggt

SEQ ID NO: 8447435 - DNA, 22 bp, Homo sapiens
gctgggtccatggtcctcgggt

SEQ ID NO: 8447436 - DNA, 22 bp, Homo sapiens
gctgggagtcgcgtctgtggcc

SEQ ID NO: 8447437 - DNA, 22 bp, Homo sapiens
gctgggagtcgcgtctgtggcc

SEQ ID NO: 8447438 - DNA, 22 bp, Homo sapiens
gctgggagtcgcgtctgtggcc

SEQ ID NO: 8447439 - DNA, 22 bp, Homo sapiens
gctgggagtcgcgtctgtggcc

SEQ ID NO: 8447440 - DNA, 20 bp, Homo sapiens
gctgggggtgtgctgagtga

SEQ ID NO: 8447441 - DNA, 22 bp, Homo sapiens
gctgggaggcagcacctttagc

SEQ ID NO: 8447442 - DNA, 22 bp, Homo sapiens
gctgggagggaggctataccct

SEQ ID NO: 8447443 - DNA, 22 bp, Homo sapiens
gctgtcttgtatgttgtaggac

SEQ ID NO: 8447444 - DNA, 22 bp, Homo sapiens
gctgtctttcccctgctccaga

SEQ ID NO: 8447445 - DNA, 22 bp, Homo sapiens
gctgtcttttcctggcagtaaa

SEQ ID NO: 8447446 - DNA, 22 bp, Homo sapiens
gctgtcttgctcactcttgcag

SEQ ID NO: 8447447 - DNA, 22 bp, Homo sapiens
gctgtcttgggtagaaagaggt

SEQ ID NO: 8447448 - DNA, 22 bp, Homo sapiens
gctgtcttggaaaaggcaaaga

SEQ ID NO: 8447449 - DNA, 21 bp, Homo sapiens
gctgtgcacatagtagaagtg

SEQ ID NO: 8447450 - DNA, 23 bp, Homo sapiens
gctgtgcacgagccactgcctgt

SEQ ID NO: 8447451 - DNA, 22 bp, Homo sapiens
gctgtgcaaatcgatttgttgg

SEQ ID NO: 8447452 - DNA, 22 bp, Homo sapiens
gctgtgcagaggtgagaatcca

SEQ ID NO: 8447453 - DNA, 22 bp, Homo sapiens
gctgtgcagatgtagggagtgg

SEQ ID NO: 8447454 - DNA, 21 bp, Homo sapiens
gctgtgcagaggatggagtgg

SEQ ID NO: 8447455 - DNA, 22 bp, Homo sapiens
gctgtgcagagcacagggtccc

SEQ ID NO: 8447456 - DNA, 22 bp, Homo sapiens
gctgtgcactacctatacatcc

SEQ ID NO: 8447457 - DNA, 22 bp, Homo sapiens
gctgtgagtggaggaggctgag

SEQ ID NO: 8447458 - DNA, 22 bp, Homo sapiens
gctgtgagtgagctgcctaggc

SEQ ID NO: 8447459 - DNA, 22 bp, Homo sapiens
gctgtgcattgagcctgagagt

SEQ ID NO: 8447460 - DNA, 22 bp, Homo sapiens
gctgtgcatggagggccgttca

SEQ ID NO: 8447461 - DNA, 22 bp, Homo sapiens
gctgtgcatcttcattctggac

SEQ ID NO: 8447462 - DNA, 22 bp, Homo sapiens
gctgtgcataagtataataaac

SEQ ID NO: 8447463 - DNA, 22 bp, Homo sapiens
gctgtgcagtgggagttcggtg

SEQ ID NO: 8447464 - DNA, 22 bp, Homo sapiens
gctgtgcagtctttggtgtgcc

SEQ ID NO: 8447465 - DNA, 22 bp, Homo sapiens
gctgtgcaggtccccactgcct

SEQ ID NO: 8447466 - DNA, 22 bp, Homo sapiens
gctgtgcaggtccccactgcct

SEQ ID NO: 8447467 - DNA, 21 bp, Homo sapiens
gctgtgcaggtgcccctgctc

SEQ ID NO: 8447468 - DNA, 22 bp, Homo sapiens
gctgtgcagtagtaggtacagt

SEQ ID NO: 8447469 - DNA, 22 bp, Homo sapiens
gctgtgcagtagtaggtacagt

SEQ ID NO: 8447470 - DNA, 22 bp, Homo sapiens
gctgtgcagccaagtgcctctg

SEQ ID NO: 8447471 - DNA, 21 bp, Homo sapiens
gctgtgcaggattgaaagcag

SEQ ID NO: 8447472 - DNA, 22 bp, Homo sapiens
gctgtgcaggggatttggttat

SEQ ID NO: 8447473 - DNA, 22 bp, Homo sapiens
gcttccagtcctcagaggctgg

SEQ ID NO: 8447474 - DNA, 22 bp, Homo sapiens
gcttcccaaacttgtggataga

SEQ ID NO: 8447475 - DNA, 22 bp, Homo sapiens
gcttcattttgccctctggtgg

SEQ ID NO: 8447476 - DNA, 21 bp, Homo sapiens
gcttccaagatggcaccttga

SEQ ID NO: 8447477 - DNA, 22 bp, Homo sapiens
gctggcagctggaagttgggct

SEQ ID NO: 8447478 - DNA, 22 bp, Homo sapiens
gctggcagagacaagaagacta

SEQ ID NO: 8447479 - DNA, 22 bp, Homo sapiens
gctggcagagacaagaagacta

SEQ ID NO: 8447480 - DNA, 22 bp, Homo sapiens
gctggcaggatagaagtctaat

SEQ ID NO: 8447481 - DNA, 22 bp, Homo sapiens
gctggcaggataacttctaagc

SEQ ID NO: 8447482 - DNA, 22 bp, Homo sapiens
gctggcaggagcctttcccttt

SEQ ID NO: 8447483 - DNA, 22 bp, Homo sapiens
gctggcaggagaaacggggtgc

SEQ ID NO: 8447484 - DNA, 22 bp, Homo sapiens
gctggcaggagaccatacccta

SEQ ID NO: 8447485 - DNA, 22 bp, Homo sapiens
gctggcaggagaccatacccta

SEQ ID NO: 8447486 - DNA, 22 bp, Homo sapiens
gctggctcccagaggccccagc

SEQ ID NO: 8447487 - DNA, 22 bp, Homo sapiens
gctggctcccagaggccccagc

SEQ ID NO: 8447488 - DNA, 22 bp, Homo sapiens
gctggctcccagaggccccagc

SEQ ID NO: 8447489 - DNA, 22 bp, Homo sapiens
gctggctcaagtgtgcttccca

SEQ ID NO: 8447490 - DNA, 22 bp, Homo sapiens
gctggcagggacagctgcgtgt

SEQ ID NO: 8447491 - DNA, 22 bp, Homo sapiens
gctggctcaagtgtgcttccca

SEQ ID NO: 8447492 - DNA, 21 bp, Homo sapiens
gctggctcaaatgcttgtgtc

SEQ ID NO: 8447493 - DNA, 22 bp, Homo sapiens
gctggcagggacagctgcgtgt

SEQ ID NO: 8447494 - DNA, 22 bp, Homo sapiens
gctggcactgggaaggactgag

SEQ ID NO: 8447495 - DNA, 22 bp, Homo sapiens
gctggcacttgggacaaaatct

SEQ ID NO: 8447496 - DNA, 22 bp, Homo sapiens
gctgccatgttgtgaggacact

SEQ ID NO: 8447497 - DNA, 21 bp, Homo sapiens
gctgcccaaccctgcatctcc

SEQ ID NO: 8447498 - DNA, 22 bp, Homo sapiens
gctggcagaatttcttcttgct

SEQ ID NO: 8447499 - DNA, 19 bp, Homo sapiens
gctggcagaattttgaacc

SEQ ID NO: 8447500 - DNA, 22 bp, Homo sapiens
gctggcagaagagctggttcaa

SEQ ID NO: 8447501 - DNA, 22 bp, Homo sapiens
gctggcagaagagctggttcaa

SEQ ID NO: 8447502 - DNA, 22 bp, Homo sapiens
gctggcagacttcctctggaac

SEQ ID NO: 8447503 - DNA, 22 bp, Homo sapiens
gctggcagacttcctctggaac

SEQ ID NO: 8447504 - DNA, 22 bp, Homo sapiens
gctggcagacttcctctggaac

SEQ ID NO: 8447505 - DNA, 22 bp, Homo sapiens
gctggcagacttcctctggaac

SEQ ID NO: 8447506 - DNA, 22 bp, Homo sapiens
gctggcagactgggggcagaac

SEQ ID NO: 8447507 - DNA, 22 bp, Homo sapiens
gctggcagactgggggcagaac

SEQ ID NO: 8447508 - DNA, 22 bp, Homo sapiens
gctggcagactgggggcagaac

SEQ ID NO: 8447509 - DNA, 22 bp, Homo sapiens
gctgggactgagacagtgacct

SEQ ID NO: 8447510 - DNA, 22 bp, Homo sapiens
gctgggagaggcagctttcgga

SEQ ID NO: 8447511 - DNA, 22 bp, Homo sapiens
gctgggaagtggcagagctgga

SEQ ID NO: 8447512 - DNA, 22 bp, Homo sapiens
gctgggacggctcagtaagaag

SEQ ID NO: 8447513 - DNA, 22 bp, Homo sapiens
gctgggaagagatgcacatgat

SEQ ID NO: 8447514 - DNA, 22 bp, Homo sapiens
gctggctctgcacccaggcctc

SEQ ID NO: 8447515 - DNA, 22 bp, Homo sapiens
gctggctctgatgggctccagg

SEQ ID NO: 8447516 - DNA, 22 bp, Homo sapiens
gctggctctgatgggctccagg

SEQ ID NO: 8447517 - DNA, 22 bp, Homo sapiens
gctggctctgccccacctgttc

SEQ ID NO: 8447518 - DNA, 21 bp, Homo sapiens
gctggctctctgacgtgcttt

SEQ ID NO: 8447519 - DNA, 22 bp, Homo sapiens
gctggctctacatttgaggtca

SEQ ID NO: 8447520 - DNA, 22 bp, Homo sapiens
gctggctcctctgtcctcacgg

SEQ ID NO: 8447521 - DNA, 22 bp, Homo sapiens
gctggctcctctgtcctcacgg

SEQ ID NO: 8447522 - DNA, 22 bp, Homo sapiens
gctggctcccattggtccttcc

SEQ ID NO: 8447523 - DNA, 22 bp, Homo sapiens
gctggctcccattggtccttcc

SEQ ID NO: 8447524 - DNA, 18 bp, Homo sapiens
gctggctgcacttctgct

SEQ ID NO: 8447525 - DNA, 22 bp, Homo sapiens
gctggctgcctggttatgcctt

SEQ ID NO: 8447526 - DNA, 22 bp, Homo sapiens
gctggctgccttactttgtgga

SEQ ID NO: 8447527 - DNA, 22 bp, Homo sapiens
gctggctgccaatttcagagct

SEQ ID NO: 8447528 - DNA, 22 bp, Homo sapiens
gctggctgcagattttagaggt

SEQ ID NO: 8447529 - DNA, 22 bp, Homo sapiens
tatctataagtactaacatggt

SEQ ID NO: 8447530 - DNA, 22 bp, Homo sapiens
tatctagatggattttagtgaa

SEQ ID NO: 8447531 - DNA, 22 bp, Homo sapiens
tatctagatttctttctctgtg

SEQ ID NO: 8447532 - DNA, 22 bp, Homo sapiens
tatcaatacatgttatcagtgt

SEQ ID NO: 8447533 - DNA, 17 bp, Homo sapiens
tatcaagaagtctggcc

SEQ ID NO: 8447534 - DNA, 22 bp, Homo sapiens
tatcaacattaatattttctgg

SEQ ID NO: 8447535 - DNA, 22 bp, Homo sapiens
tatctagatatttggataaatg

SEQ ID NO: 8447536 - DNA, 22 bp, Homo sapiens
tatcaatatctcagtgtgcttc

SEQ ID NO: 8447537 - DNA, 19 bp, Homo sapiens
tatcaatcacggcatcttt

SEQ ID NO: 8447538 - DNA, 22 bp, Homo sapiens
tatcaatacatgttatcagtgt

SEQ ID NO: 8447539 - DNA, 18 bp, Homo sapiens
tatatttcacacatattc

SEQ ID NO: 8447540 - DNA, 22 bp, Homo sapiens
tatatttgtgtgtgatttatga

SEQ ID NO: 8447541 - DNA, 22 bp, Homo sapiens
tatattcaacaggctaatgtca

SEQ ID NO: 8447542 - DNA, 22 bp, Homo sapiens
tatatttaaatccaggttgaaa

SEQ ID NO: 8447543 - DNA, 22 bp, Homo sapiens
tatatttaatcctagagccatt

SEQ ID NO: 8447544 - DNA, 19 bp, Homo sapiens
tatatttgttgaataaaaa

SEQ ID NO: 8447545 - DNA, 19 bp, Homo sapiens
tatatttgttgaataaaaa

SEQ ID NO: 8447546 - DNA, 22 bp, Homo sapiens
tatcaaaaggagttgaaagggg

SEQ ID NO: 8447547 - DNA, 22 bp, Homo sapiens
tatcaaaaggagttgaaagggg

SEQ ID NO: 8447548 - DNA, 22 bp, Homo sapiens
tatcaaagttgtcctgtgaagt

SEQ ID NO: 8447549 - DNA, 22 bp, Homo sapiens
tatgatatgcactttatcagaa

SEQ ID NO: 8447550 - DNA, 22 bp, Homo sapiens
tatctttgtatcaatctccatt

SEQ ID NO: 8447551 - DNA, 22 bp, Homo sapiens
tatgagttgtggcttagtcaca

SEQ ID NO: 8447552 - DNA, 22 bp, Homo sapiens
tatgataacctgttgtagtttg

SEQ ID NO: 8447553 - DNA, 20 bp, Homo sapiens
tatgataattacaaaatagt

SEQ ID NO: 8447554 - DNA, 22 bp, Homo sapiens
tatctttagaggaagagaatct

SEQ ID NO: 8447555 - DNA, 22 bp, Homo sapiens
tatctttagaggaagagaatct

SEQ ID NO: 8447556 - DNA, 22 bp, Homo sapiens
tatctttattatgtctatctgc

SEQ ID NO: 8447557 - DNA, 22 bp, Homo sapiens
tatctttattatgtctatctgc

SEQ ID NO: 8447558 - DNA, 22 bp, Homo sapiens
tatctttattatgtctatctgc

SEQ ID NO: 8447559 - DNA, 19 bp, Homo sapiens
tatctttatgcagtggtgg

SEQ ID NO: 8447560 - DNA, 22 bp, Homo sapiens
tatcttgtgcagatgaaagaat

SEQ ID NO: 8447561 - DNA, 22 bp, Homo sapiens
tatctttaacttgcagtattta

SEQ ID NO: 8447562 - DNA, 20 bp, Homo sapiens
tatcttactttagtcatttg

SEQ ID NO: 8447563 - DNA, 22 bp, Homo sapiens
tagtgtcaaacagggattagaa

SEQ ID NO: 8447564 - DNA, 23 bp, Homo sapiens
tagtgtcaagagggagtgtaatt

SEQ ID NO: 8447565 - DNA, 22 bp, Homo sapiens
tagtgtcaggagggaaatgcaa

SEQ ID NO: 8447566 - DNA, 19 bp, Homo sapiens
tagtgtcaaggaggagggt

SEQ ID NO: 8447567 - DNA, 22 bp, Homo sapiens
tagtgtcatttcagtggagttt

SEQ ID NO: 8447568 - DNA, 22 bp, Homo sapiens
tagtgtcatgaaaagtacacta

SEQ ID NO: 8447569 - DNA, 22 bp, Homo sapiens
tagtgtcatcgttgcagctgag

SEQ ID NO: 8447570 - DNA, 22 bp, Homo sapiens
tagttaaaataatggagatgtt

SEQ ID NO: 8447571 - DNA, 22 bp, Homo sapiens
tagttaaagccctaaattgata

SEQ ID NO: 8447572 - DNA, 22 bp, Homo sapiens
tagttaaagccctaaattgata

SEQ ID NO: 8447573 - DNA, 22 bp, Homo sapiens
tagttaaagattctgttaagag

SEQ ID NO: 8447574 - DNA, 22 bp, Homo sapiens
tagttaaagattctgttaagag

SEQ ID NO: 8447575 - DNA, 22 bp, Homo sapiens
tagttaaagagatccacattcc

SEQ ID NO: 8447576 - DNA, 22 bp, Homo sapiens
tagttaaaccaccattctggta

SEQ ID NO: 8447577 - DNA, 22 bp, Homo sapiens
tagttaaaccaccattctggta

SEQ ID NO: 8447578 - DNA, 21 bp, Homo sapiens
tatacagaggggaacaggaga

SEQ ID NO: 8447579 - DNA, 22 bp, Homo sapiens
tataccaaaaaaattcttgtct

SEQ ID NO: 8447580 - DNA, 22 bp, Homo sapiens
tatacatgttttacataagtga

SEQ ID NO: 8447581 - DNA, 22 bp, Homo sapiens
tatacagatatctaagatgtaa

SEQ ID NO: 8447582 - DNA, 20 bp, Homo sapiens
tatactaacatatatctgtt

SEQ ID NO: 8447583 - DNA, 22 bp, Homo sapiens
tatacttatgctaaaaaatgtt

SEQ ID NO: 8447584 - DNA, 22 bp, Homo sapiens
tatacttccctgcagagtaaag

SEQ ID NO: 8447585 - DNA, 22 bp, Homo sapiens
tatacttatgctaaaaaatgtt

SEQ ID NO: 8447586 - DNA, 22 bp, Homo sapiens
tatagaagtaagcattgtgatg

SEQ ID NO: 8447587 - DNA, 22 bp, Homo sapiens
tatagaacaagttatttatgct

SEQ ID NO: 8447588 - DNA, 22 bp, Homo sapiens
tatagaacaagttatttatgct

SEQ ID NO: 8447589 - DNA, 22 bp, Homo sapiens
tatagaagagacatgtgcatag

SEQ ID NO: 8447590 - DNA, 22 bp, Homo sapiens
tatagaggccaccaacatgaaa

SEQ ID NO: 8447591 - DNA, 22 bp, Homo sapiens
tatagacaagcgtaacaagaag

SEQ ID NO: 8447592 - DNA, 20 bp, Homo sapiens
tatagatcacatcttctagc

SEQ ID NO: 8447593 - DNA, 22 bp, Homo sapiens
tatagatcttgctatttaagga

SEQ ID NO: 8447594 - DNA, 22 bp, Homo sapiens
tatagcaactccaaagagactt

SEQ ID NO: 8447595 - DNA, 22 bp, Homo sapiens
tatatgatgccaaataacctgt

SEQ ID NO: 8447596 - DNA, 22 bp, Homo sapiens
tatatgcaattttttagtgcaa

SEQ ID NO: 8447597 - DNA, 22 bp, Homo sapiens
tatatgtaagctatgtaagagt

SEQ ID NO: 8447598 - DNA, 22 bp, Homo sapiens
tatatggatagtgatcataaga

SEQ ID NO: 8447599 - DNA, 22 bp, Homo sapiens
tatatgtagattgtaccaatgt

SEQ ID NO: 8447600 - DNA, 22 bp, Homo sapiens
tatatgtagtcagtcagagtaa

SEQ ID NO: 8447601 - DNA, 22 bp, Homo sapiens
tatattatcataaaaccattca

SEQ ID NO: 8447602 - DNA, 22 bp, Homo sapiens
tatattataagccctttcagaa

SEQ ID NO: 8447603 - DNA, 22 bp, Homo sapiens
tatattacctgcctgatctata

SEQ ID NO: 8447604 - DNA, 22 bp, Homo sapiens
tatattacctgcctgatctata

SEQ ID NO: 8447605 - DNA, 22 bp, Homo sapiens
tatattacctgcctgatctata

SEQ ID NO: 8447606 - DNA, 22 bp, Homo sapiens
tatattaacacccacttgcctc

SEQ ID NO: 8447607 - DNA, 22 bp, Homo sapiens
tatattaaatgaccagttttaa

SEQ ID NO: 8447608 - DNA, 22 bp, Homo sapiens
tatatgtttcttacaaaatatt

SEQ ID NO: 8447609 - DNA, 22 bp, Homo sapiens
tatattaaaccctctctgtagg

SEQ ID NO: 8447610 - DNA, 22 bp, Homo sapiens
tatgtttacgctggtagaatta

SEQ ID NO: 8447611 - DNA, 22 bp, Homo sapiens
tatgtttacgctggtagaatta

SEQ ID NO: 8447612 - DNA, 22 bp, Homo sapiens
tatgttgagcattcagtgatct

SEQ ID NO: 8447613 - DNA, 22 bp, Homo sapiens
tatgttcatctggtgcatcagt

SEQ ID NO: 8447614 - DNA, 22 bp, Homo sapiens
tatgttcatgtcaaacaaatgc

SEQ ID NO: 8447615 - DNA, 22 bp, Homo sapiens
tatgttattttcatacaacaga

SEQ ID NO: 8447616 - DNA, 22 bp, Homo sapiens
tatgttactcacatgttcttgc

SEQ ID NO: 8447617 - DNA, 22 bp, Homo sapiens
tatgttacaaagtttttctaaa

SEQ ID NO: 8447618 - DNA, 22 bp, Homo sapiens
tatgttatattttgtcaattgt

SEQ ID NO: 8447619 - DNA, 22 bp, Homo sapiens
tatgttactcacatgttcttgc

SEQ ID NO: 8447620 - DNA, 22 bp, Homo sapiens
tatgttacttctgtatctgctt

SEQ ID NO: 8447621 - DNA, 22 bp, Homo sapiens
tatgctattcttcagagtgttc

SEQ ID NO: 8447622 - DNA, 22 bp, Homo sapiens
tatgctcctattggaatgatag

SEQ ID NO: 8447623 - DNA, 22 bp, Homo sapiens
tatgctaatgacactctagaaa

SEQ ID NO: 8447624 - DNA, 22 bp, Homo sapiens
tatgctaaatatgttcacattg

SEQ ID NO: 8447625 - DNA, 17 bp, Homo sapiens
tatgtgtgtgtttatac

SEQ ID NO: 8447626 - DNA, 20 bp, Homo sapiens
tattcaactttaaaaactta

SEQ ID NO: 8447627 - DNA, 22 bp, Homo sapiens
tattcaaagtgcgaggtcaggg

SEQ ID NO: 8447628 - DNA, 22 bp, Homo sapiens
tattcaagattgaactggcaga

SEQ ID NO: 8447629 - DNA, 22 bp, Homo sapiens
tattcacatgaaaacaaatttt

SEQ ID NO: 8447630 - DNA, 22 bp, Homo sapiens
tattcacatgaaaacaaatttt

SEQ ID NO: 8447631 - DNA, 22 bp, Homo sapiens
tattcacatgtacatatgctca

SEQ ID NO: 8447632 - DNA, 21 bp, Homo sapiens
tattgattcaatttcttgagt

SEQ ID NO: 8447633 - DNA, 22 bp, Homo sapiens
tattcatgacattgcatatgca

SEQ ID NO: 8447634 - DNA, 22 bp, Homo sapiens
tattcagagtgtagcaaataga

SEQ ID NO: 8447635 - DNA, 22 bp, Homo sapiens
tattcagagtgtagcaaataga

SEQ ID NO: 8447636 - DNA, 22 bp, Homo sapiens
tattcagagtattccatgaggt

SEQ ID NO: 8447637 - DNA, 22 bp, Homo sapiens
tattcagtgacagggtattatg

SEQ ID NO: 8447638 - DNA, 22 bp, Homo sapiens
tattcactttgggagagccatt

SEQ ID NO: 8447639 - DNA, 22 bp, Homo sapiens
tattcactgtaactcagcaata

SEQ ID NO: 8447640 - DNA, 22 bp, Homo sapiens
tattcagaaaataaattggatt

SEQ ID NO: 8447641 - DNA, 22 bp, Homo sapiens
tattcagaaaataaattggatt

SEQ ID NO: 8447642 - DNA, 22 bp, Homo sapiens
tattcagaataaagactacatt

SEQ ID NO: 8447643 - DNA, 22 bp, Homo sapiens
tatttcctgcatggtgatgtaa

SEQ ID NO: 8447644 - DNA, 22 bp, Homo sapiens
tatttcagggagaataaatttg

SEQ ID NO: 8447645 - DNA, 22 bp, Homo sapiens
tatttccagcagtaagaagaca

SEQ ID NO: 8447646 - DNA, 22 bp, Homo sapiens
tatttgtatgtgtgtacatata

SEQ ID NO: 8447647 - DNA, 22 bp, Homo sapiens
tatttgttgcgggaattgctat

SEQ ID NO: 8447648 - DNA, 22 bp, Homo sapiens
tattttcaccatgtatccctgt

SEQ ID NO: 8447649 - DNA, 22 bp, Homo sapiens
tatttgttgagttgttatgtct

SEQ ID NO: 8447650 - DNA, 22 bp, Homo sapiens
tatttcacagcagctcatttaa

SEQ ID NO: 8447651 - DNA, 22 bp, Homo sapiens
tatttcacataccacagagtgt

SEQ ID NO: 8447652 - DNA, 22 bp, Homo sapiens
tatttcacatgtgggaaacata

SEQ ID NO: 8447653 - DNA, 22 bp, Homo sapiens
tatttcacctaaaagtgtcaaa

SEQ ID NO: 8447654 - DNA, 22 bp, Homo sapiens
tatttcaacgtatgaaaagctg

SEQ ID NO: 8447655 - DNA, 22 bp, Homo sapiens
tatttcaacgtatgaaaagctg

SEQ ID NO: 8447656 - DNA, 22 bp, Homo sapiens
tatttcactcagtataccatag

SEQ ID NO: 8447657 - DNA, 22 bp, Homo sapiens
tatttcactattctctgtaact

SEQ ID NO: 8447658 - DNA, 22 bp, Homo sapiens
tattggtcttggaaggttttgt

SEQ ID NO: 8447659 - DNA, 22 bp, Homo sapiens
tattggtcaagttgaggaccct

SEQ ID NO: 8447660 - DNA, 22 bp, Homo sapiens
tattggtcaatttcaccttgat

SEQ ID NO: 8447661 - DNA, 22 bp, Homo sapiens
tattggtctgcttaagtggatt

SEQ ID NO: 8447662 - DNA, 22 bp, Homo sapiens
tattggtcttctgttccctatt

SEQ ID NO: 8447663 - DNA, 22 bp, Homo sapiens
tattgcacatgcgctagaacca

SEQ ID NO: 8447664 - DNA, 22 bp, Homo sapiens
tattgattctgtcccaagttga

SEQ ID NO: 8447665 - DNA, 22 bp, Homo sapiens
tattgattcctgctttctgctc

SEQ ID NO: 8447666 - DNA, 22 bp, Homo sapiens
tattgcataaaatcaggttaga

SEQ ID NO: 8447667 - DNA, 22 bp, Homo sapiens
tattgcatacttaaatttccgg

SEQ ID NO: 8447668 - DNA, 22 bp, Homo sapiens
taggaaatatttgaacatagga

SEQ ID NO: 8447669 - DNA, 22 bp, Homo sapiens
taggaaatatttgaacatagga

SEQ ID NO: 8447670 - DNA, 22 bp, Homo sapiens
taggaaatatttgaacatagga

SEQ ID NO: 8447671 - DNA, 22 bp, Homo sapiens
taggaaatgaatgcaggctccc

SEQ ID NO: 8447672 - DNA, 22 bp, Homo sapiens
taggaaatactgtaagtttggg

SEQ ID NO: 8447673 - DNA, 20 bp, Homo sapiens
taggaaatatgtttttaccc

SEQ ID NO: 8447674 - DNA, 22 bp, Homo sapiens
taggaaagcagtagagccagga

SEQ ID NO: 8447675 - DNA, 22 bp, Homo sapiens
taggaaagaaatgagtagtgat

SEQ ID NO: 8447676 - DNA, 22 bp, Homo sapiens
taggaaactctcagctggtcat

SEQ ID NO: 8447677 - DNA, 16 bp, Homo sapiens
taggaaactgcatgtg

SEQ ID NO: 8447678 - DNA, 22 bp, Homo sapiens
tagcccagatgattgaaccatg

SEQ ID NO: 8447679 - DNA, 22 bp, Homo sapiens
tagcccagagtcccaattccag

SEQ ID NO: 8447680 - DNA, 22 bp, Homo sapiens
tagccattgacttaaagcttat

SEQ ID NO: 8447681 - DNA, 22 bp, Homo sapiens
tagccatttttattaatgctgg

SEQ ID NO: 8447682 - DNA, 19 bp, Homo sapiens
tagcccagagcctggctac

SEQ ID NO: 8447683 - DNA, 19 bp, Homo sapiens
tagcccagagcctggctac

SEQ ID NO: 8447684 - DNA, 19 bp, Homo sapiens
tagcccagagcctggctac

SEQ ID NO: 8447685 - DNA, 22 bp, Homo sapiens
tagcccagaaagcaaatgtctc

SEQ ID NO: 8447686 - DNA, 22 bp, Homo sapiens
tagcccagagagccaggggctt

SEQ ID NO: 8447687 - DNA, 22 bp, Homo sapiens
taggaaatgctccattgcataa

SEQ ID NO: 8447688 - DNA, 22 bp, Homo sapiens
taggaaatgctgtcttattgta

SEQ ID NO: 8447689 - DNA, 22 bp, Homo sapiens
taggaaatggctcagttactgc

SEQ ID NO: 8447690 - DNA, 22 bp, Homo sapiens
taggaactagactcatgactca

SEQ ID NO: 8447691 - DNA, 21 bp, Homo sapiens
taggaactgttctgagtggtc

SEQ ID NO: 8447692 - DNA, 23 bp, Homo sapiens
taggaagacagcaaaagaatgga

SEQ ID NO: 8447693 - DNA, 22 bp, Homo sapiens
taggaactagactcatgactca

SEQ ID NO: 8447694 - DNA, 22 bp, Homo sapiens
taggaagatgagtatcaacttg

SEQ ID NO: 8447695 - DNA, 22 bp, Homo sapiens
taggaagatcaagtttatctca

SEQ ID NO: 8447696 - DNA, 22 bp, Homo sapiens
taggaagatcaagtttatctca

SEQ ID NO: 8447697 - DNA, 22 bp, Homo sapiens
taggaagataaacatttgtatg

SEQ ID NO: 8447698 - DNA, 22 bp, Homo sapiens
taggaagcttccagaacttaag

SEQ ID NO: 8447699 - DNA, 22 bp, Homo sapiens
taggctcctgagtccacagcac

SEQ ID NO: 8447700 - DNA, 22 bp, Homo sapiens
taggctgaaaggagaggtgaag

SEQ ID NO: 8447701 - DNA, 22 bp, Homo sapiens
taggctccaagagcgaactcag

SEQ ID NO: 8447702 - DNA, 22 bp, Homo sapiens
taggctcattaagtccccaggg

SEQ ID NO: 8447703 - DNA, 22 bp, Homo sapiens
taggctcagtgagtagggagtt

SEQ ID NO: 8447704 - DNA, 22 bp, Homo sapiens
taggctcctgaggactccatgc

SEQ ID NO: 8447705 - DNA, 22 bp, Homo sapiens
taggctcctctcacattctatt

SEQ ID NO: 8447706 - DNA, 22 bp, Homo sapiens
taggctcccagatcgtttgctg

SEQ ID NO: 8447707 - DNA, 22 bp, Homo sapiens
taggctccagtgtgtggcgagt

SEQ ID NO: 8447708 - DNA, 22 bp, Homo sapiens
taggctcagggctgggtgacgg

SEQ ID NO: 8447709 - DNA, 22 bp, Homo sapiens
taggcctatgcagaaggtggtt

SEQ ID NO: 8447710 - DNA, 22 bp, Homo sapiens
taggcccctagtgccacgtggc

SEQ ID NO: 8447711 - DNA, 22 bp, Homo sapiens
taggcccagttccgcctcccgg

SEQ ID NO: 8447712 - DNA, 21 bp, Homo sapiens
taggacagcccccctgccctc

SEQ ID NO: 8447713 - DNA, 22 bp, Homo sapiens
taggacagagttccctgatggc

SEQ ID NO: 8447714 - DNA, 22 bp, Homo sapiens
taggacaggatcatgatgctgg

SEQ ID NO: 8447715 - DNA, 22 bp, Homo sapiens
taggaatgattggaattccagg

SEQ ID NO: 8447716 - DNA, 22 bp, Homo sapiens
taggaatccagatctagactgt

SEQ ID NO: 8447717 - DNA, 22 bp, Homo sapiens
tagtccaggttaatccctgcct

SEQ ID NO: 8447718 - DNA, 22 bp, Homo sapiens
tagtccaggttaatccctgcct

SEQ ID NO: 8447719 - DNA, 22 bp, Homo sapiens
tagtccaggacaatcttcatat

SEQ ID NO: 8447720 - DNA, 22 bp, Homo sapiens
tagtccaggaaggtggggcaga

SEQ ID NO: 8447721 - DNA, 22 bp, Homo sapiens
tagtccagccttgggtgtagcc

SEQ ID NO: 8447722 - DNA, 20 bp, Homo sapiens
tagtccagtaggggggcttt

SEQ ID NO: 8447723 - DNA, 22 bp, Homo sapiens
tagtcctgaccttgccaccagc

SEQ ID NO: 8447724 - DNA, 22 bp, Homo sapiens
tagtggcaaaagcattttgggt

SEQ ID NO: 8447725 - DNA, 22 bp, Homo sapiens
tagtcagtcttacatatttgaa

SEQ ID NO: 8447726 - DNA, 22 bp, Homo sapiens
tagtcagtgatcagtggagttg

SEQ ID NO: 8447727 - DNA, 22 bp, Homo sapiens
tagtcagtgcacagacacttgt

SEQ ID NO: 8447728 - DNA, 22 bp, Homo sapiens
tagtcagttgggtctagtggca

SEQ ID NO: 8447729 - DNA, 22 bp, Homo sapiens
tagtcagtatgaaattgctcaa

SEQ ID NO: 8447730 - DNA, 23 bp, Homo sapiens
tagtcagtatgtaagtctaattg

SEQ ID NO: 8447731 - DNA, 22 bp, Homo sapiens
tagtcagtagcaaggtattttg

SEQ ID NO: 8447732 - DNA, 22 bp, Homo sapiens
tagtcagatatatgacttacgt

SEQ ID NO: 8447733 - DNA, 22 bp, Homo sapiens
tagtcagagtcttctctgttgt

SEQ ID NO: 8447734 - DNA, 22 bp, Homo sapiens
tagtcagacccaagagagccat

SEQ ID NO: 8447735 - DNA, 22 bp, Homo sapiens
tagtccacagactctacagcat

SEQ ID NO: 8447736 - DNA, 22 bp, Homo sapiens
tagtccagaaactgagcttata

SEQ ID NO: 8447737 - DNA, 22 bp, Homo sapiens
tagtattcagcttctcaggcaa

SEQ ID NO: 8447738 - DNA, 22 bp, Homo sapiens
tagtatttataatcatgcttaa

SEQ ID NO: 8447739 - DNA, 22 bp, Homo sapiens
tagtatttcctgtaagctatag

SEQ ID NO: 8447740 - DNA, 22 bp, Homo sapiens
tagtattttagaaaaccatgaa

SEQ ID NO: 8447741 - DNA, 22 bp, Homo sapiens
tagtcaaacctcagaatacccc

SEQ ID NO: 8447742 - DNA, 22 bp, Homo sapiens
taggtttactgaattagtggaa

SEQ ID NO: 8447743 - DNA, 22 bp, Homo sapiens
taggttctctattgcccccaaa

SEQ ID NO: 8447744 - DNA, 22 bp, Homo sapiens
taggttcagagaactgaaaata

SEQ ID NO: 8447745 - DNA, 22 bp, Homo sapiens
taggctgggagcctgaggctag

SEQ ID NO: 8447746 - DNA, 22 bp, Homo sapiens
taggctgggaagaaagattctc

SEQ ID NO: 8447747 - DNA, 22 bp, Homo sapiens
taggctgaggttgatgccaggg

SEQ ID NO: 8447748 - DNA, 22 bp, Homo sapiens
taggctgagcttgtagatcgta

SEQ ID NO: 8447749 - DNA, 22 bp, Homo sapiens
taggctgacttgtttcataaag

SEQ ID NO: 8447750 - DNA, 22 bp, Homo sapiens
taggctgagctaagagagctta

SEQ ID NO: 8447751 - DNA, 22 bp, Homo sapiens
taggctggaacttaggcagagg

SEQ ID NO: 8447752 - DNA, 22 bp, Homo sapiens
taggctggaggaagcagtgcct

SEQ ID NO: 8447753 - DNA, 22 bp, Homo sapiens
taggctggaggaagcagtgcct

SEQ ID NO: 8447754 - DNA, 22 bp, Homo sapiens
taggtttaggagtgaaggtgaa

SEQ ID NO: 8447755 - DNA, 22 bp, Homo sapiens
tagtaaagtgtcttaacacata

SEQ ID NO: 8447756 - DNA, 22 bp, Homo sapiens
tagtaaacccatgaggcttaaa

SEQ ID NO: 8447757 - DNA, 22 bp, Homo sapiens
tagtaaaagtttagttgaaagt

SEQ ID NO: 8447758 - DNA, 22 bp, Homo sapiens
tagtagaatccaaaccaacagt

SEQ ID NO: 8447759 - DNA, 22 bp, Homo sapiens
tagtataattgttctggaatca

SEQ ID NO: 8447760 - DNA, 23 bp, Homo sapiens
tagagcagggaaatctgtcagag

SEQ ID NO: 8447761 - DNA, 22 bp, Homo sapiens
tagagcacagtttcagggtgta

SEQ ID NO: 8447762 - DNA, 22 bp, Homo sapiens
tagagcagaacttgttaacacc

SEQ ID NO: 8447763 - DNA, 22 bp, Homo sapiens
tagaatctgtgttcaaacctac

SEQ ID NO: 8447764 - DNA, 18 bp, Homo sapiens
tagaatctgttattgcct

SEQ ID NO: 8447765 - DNA, 22 bp, Homo sapiens
tagagatgaattctgcagtctt

SEQ ID NO: 8447766 - DNA, 22 bp, Homo sapiens
tagaatctggatctgggcgcat

SEQ ID NO: 8447767 - DNA, 22 bp, Homo sapiens
tagaatctggaaggggctattc

SEQ ID NO: 8447768 - DNA, 22 bp, Homo sapiens
tagaatctccagcattggttgt

SEQ ID NO: 8447769 - DNA, 23 bp, Homo sapiens
tagaatctgtatttctgcagttc

SEQ ID NO: 8447770 - DNA, 20 bp, Homo sapiens
tagaatctggtgatgtatcg

SEQ ID NO: 8447771 - DNA, 23 bp, Homo sapiens
tagaatctgtatttctgcagttc

SEQ ID NO: 8447772 - DNA, 22 bp, Homo sapiens
tagaatctgcctgcagcaaaga

SEQ ID NO: 8447773 - DNA, 22 bp, Homo sapiens
tagaatctggaaggggctattc

SEQ ID NO: 8447774 - DNA, 22 bp, Homo sapiens
tagaatctgaatgtagagctga

SEQ ID NO: 8447775 - DNA, 22 bp, Homo sapiens
tagaatctgatggcccgtctgg

SEQ ID NO: 8447776 - DNA, 22 bp, Homo sapiens
tagaatctgattaccctatgaa

SEQ ID NO: 8447777 - DNA, 22 bp, Homo sapiens
tagagcagtgggtaccatggca

SEQ ID NO: 8447778 - DNA, 23 bp, Homo sapiens
tagagcagtagatcaccatggga

SEQ ID NO: 8447779 - DNA, 22 bp, Homo sapiens
tagagcagttggcagctgtatt

SEQ ID NO: 8447780 - DNA, 22 bp, Homo sapiens
tagagctgataatgaggccaag

SEQ ID NO: 8447781 - DNA, 22 bp, Homo sapiens
tagaggcacagtctatgtagag

SEQ ID NO: 8447782 - DNA, 22 bp, Homo sapiens
tagaggcaccctggaggagact

SEQ ID NO: 8447783 - DNA, 22 bp, Homo sapiens
tagaggcaaccagtgttgagaa

SEQ ID NO: 8447784 - DNA, 22 bp, Homo sapiens
tagaggagagttgctggatgga

SEQ ID NO: 8447785 - DNA, 22 bp, Homo sapiens
tagaggagcggcgagctgagct

SEQ ID NO: 8447786 - DNA, 22 bp, Homo sapiens
tagaggagcggcgagctgagct

SEQ ID NO: 8447787 - DNA, 23 bp, Homo sapiens
tagaggaggatgtgatgcatatt

SEQ ID NO: 8447788 - DNA, 22 bp, Homo sapiens
tagatggaggctagatgcaggg

SEQ ID NO: 8447789 - DNA, 22 bp, Homo sapiens
tagatgcttataaagagcatat

SEQ ID NO: 8447790 - DNA, 19 bp, Homo sapiens
tagaagcactaggcaaact

SEQ ID NO: 8447791 - DNA, 22 bp, Homo sapiens
tagaagcagcaggagtaaaggc

SEQ ID NO: 8447792 - DNA, 22 bp, Homo sapiens
tactttctgtccttctgttaaa

SEQ ID NO: 8447793 - DNA, 22 bp, Homo sapiens
tactttcttgttcctttcataa

SEQ ID NO: 8447794 - DNA, 22 bp, Homo sapiens
tactttctttcccaagaggtgg

SEQ ID NO: 8447795 - DNA, 22 bp, Homo sapiens
tactttctttctgatccttatg

SEQ ID NO: 8447796 - DNA, 22 bp, Homo sapiens
tactttctttctgatccttatg

SEQ ID NO: 8447797 - DNA, 22 bp, Homo sapiens
tactttctagctctccccagtt

SEQ ID NO: 8447798 - DNA, 22 bp, Homo sapiens
tactttcatgtctatacatatt

SEQ ID NO: 8447799 - DNA, 22 bp, Homo sapiens
tactttcagtttcagctgaagt

SEQ ID NO: 8447800 - DNA, 22 bp, Homo sapiens
tactttcatgggttttctttat

SEQ ID NO: 8447801 - DNA, 22 bp, Homo sapiens
tacttgtggcagtttgaattta

SEQ ID NO: 8447802 - DNA, 22 bp, Homo sapiens
tacttgtgttctactagagaaa

SEQ ID NO: 8447803 - DNA, 20 bp, Homo sapiens
tagaatctactatttggccc

SEQ ID NO: 8447804 - DNA, 21 bp, Homo sapiens
tagaatcctggactgggactc

SEQ ID NO: 8447805 - DNA, 22 bp, Homo sapiens
tagaatctagttcattcatttg

SEQ ID NO: 8447806 - DNA, 22 bp, Homo sapiens
tagaatctgaatattcttattt

SEQ ID NO: 8447807 - DNA, 22 bp, Homo sapiens
tagaatctccagcattggttgt

SEQ ID NO: 8447808 - DNA, 22 bp, Homo sapiens
tagaatctgaaagtggctgtga

SEQ ID NO: 8447809 - DNA, 22 bp, Homo sapiens
tagaatcattgagaataacagg

SEQ ID NO: 8447810 - DNA, 22 bp, Homo sapiens
tagaatcattgagaataacagg

SEQ ID NO: 8447811 - DNA, 22 bp, Homo sapiens
tagaatcattgagaataacagg

SEQ ID NO: 8447812 - DNA, 22 bp, Homo sapiens
tagaatccacctacacaagaga

SEQ ID NO: 8447813 - DNA, 23 bp, Homo sapiens
tagaatcctctgagatggaatag

SEQ ID NO: 8447814 - DNA, 22 bp, Homo sapiens
tagaagttgctcaataaatgtt

SEQ ID NO: 8447815 - DNA, 22 bp, Homo sapiens
tagaataagttgatgatatatg

SEQ ID NO: 8447816 - DNA, 22 bp, Homo sapiens
tagaagtctctcaagaaacata

SEQ ID NO: 8447817 - DNA, 22 bp, Homo sapiens
tagaagtctctcaagaaacata

SEQ ID NO: 8447818 - DNA, 22 bp, Homo sapiens
tagaaggctttgagagatactt

SEQ ID NO: 8447819 - DNA, 22 bp, Homo sapiens
tagaagctcaggaataggcata

SEQ ID NO: 8447820 - DNA, 22 bp, Homo sapiens
tagaagctcaggaataggcata

SEQ ID NO: 8447821 - DNA, 22 bp, Homo sapiens
tagaagttcatgcgaattattt

SEQ ID NO: 8447822 - DNA, 22 bp, Homo sapiens
tagaagttaggaaataggaata

SEQ ID NO: 8447823 - DNA, 22 bp, Homo sapiens
tagcaagaagtagctctggatt

SEQ ID NO: 8447824 - DNA, 22 bp, Homo sapiens
tagcaagaagggagatggggtt

SEQ ID NO: 8447825 - DNA, 22 bp, Homo sapiens
tagcaaaagccacgattacttt

SEQ ID NO: 8447826 - DNA, 22 bp, Homo sapiens
tagcaaaagccacgattacttt

SEQ ID NO: 8447827 - DNA, 22 bp, Homo sapiens
tagcaaaaactgcagttacttt

SEQ ID NO: 8447828 - DNA, 22 bp, Homo sapiens
tagcaaaaactgcagttacttt

SEQ ID NO: 8447829 - DNA, 22 bp, Homo sapiens
tagcaaaaaaactggcatctcc

SEQ ID NO: 8447830 - DNA, 22 bp, Homo sapiens
tagcaaaaactgcagttacttt

SEQ ID NO: 8447831 - DNA, 22 bp, Homo sapiens
tagcaagaggaaacaaggggcc

SEQ ID NO: 8447832 - DNA, 22 bp, Homo sapiens
tagcaagaccaatatgtagata

SEQ ID NO: 8447833 - DNA, 22 bp, Homo sapiens
tagcaagacaacttttctcagt

SEQ ID NO: 8447834 - DNA, 17 bp, Homo sapiens
tagcacaaagcaggatt

SEQ ID NO: 8447835 - DNA, 17 bp, Homo sapiens
tagattaaacacggcca

SEQ ID NO: 8447836 - DNA, 22 bp, Homo sapiens
tagattaagatgccagttttga

SEQ ID NO: 8447837 - DNA, 22 bp, Homo sapiens
tagattaacagttttgttgaag

SEQ ID NO: 8447838 - DNA, 22 bp, Homo sapiens
tagatttgtttccttctctcca

SEQ ID NO: 8447839 - DNA, 22 bp, Homo sapiens
tagattttacttctgtcattac

SEQ ID NO: 8447840 - DNA, 22 bp, Homo sapiens
tagatgttaagcttctagaagg

SEQ ID NO: 8447841 - DNA, 23 bp, Homo sapiens
tagatgtattaagtgcattttca

SEQ ID NO: 8447842 - DNA, 22 bp, Homo sapiens
tagcaccatgatggaagagctg

SEQ ID NO: 8447843 - DNA, 22 bp, Homo sapiens
tagcaccatgatggaagagctg

SEQ ID NO: 8447844 - DNA, 22 bp, Homo sapiens
tagcaccacttcatgctttcag

SEQ ID NO: 8447845 - DNA, 22 bp, Homo sapiens
tagcacccatggaatctgctgg

SEQ ID NO: 8447846 - DNA, 22 bp, Homo sapiens
tagcacctagagtattttatca

SEQ ID NO: 8447847 - DNA, 22 bp, Homo sapiens
tagcaccttagcatttctagtg

SEQ ID NO: 8447848 - DNA, 22 bp, Homo sapiens
tagcagaaactgttacagaagg

SEQ ID NO: 8447849 - DNA, 22 bp, Homo sapiens
tagcaggtgctcatttaactcc

SEQ ID NO: 8447850 - DNA, 22 bp, Homo sapiens
tagccagtgagacccagaaata

SEQ ID NO: 8447851 - DNA, 22 bp, Homo sapiens
tagccagtgaatgtttccagtg

SEQ ID NO: 8447852 - DNA, 22 bp, Homo sapiens
tagccagtttctttaacagcaa

SEQ ID NO: 8447853 - DNA, 22 bp, Homo sapiens
tagccatgagcagatcactata

SEQ ID NO: 8447854 - DNA, 22 bp, Homo sapiens
tagccatgtgtggaacacagcc

SEQ ID NO: 8447855 - DNA, 22 bp, Homo sapiens
tagcatttcactgatcttcact

SEQ ID NO: 8447856 - DNA, 22 bp, Homo sapiens
tagcattccttgtggcttctga

SEQ ID NO: 8447857 - DNA, 17 bp, Homo sapiens
tagcatttatcttcctt

SEQ ID NO: 8447858 - DNA, 22 bp, Homo sapiens
gttagagcacatactttgcatg

SEQ ID NO: 8447859 - DNA, 22 bp, Homo sapiens
gttagacatgagtgtgcttaca

SEQ ID NO: 8447860 - DNA, 22 bp, Homo sapiens
gttagacatgcagaatctcagg

SEQ ID NO: 8447861 - DNA, 22 bp, Homo sapiens
gttagaaacgcaggctctccgg

SEQ ID NO: 8447862 - DNA, 22 bp, Homo sapiens
gttagaaagtgtctgcttgggt

SEQ ID NO: 8447863 - DNA, 22 bp, Homo sapiens
gttagaaacgcaggctctccgg

SEQ ID NO: 8447864 - DNA, 22 bp, Homo sapiens
gttagaaagtgtctgcttgggt

SEQ ID NO: 8447865 - DNA, 22 bp, Homo sapiens
gttagaaatgcagaaacttgac

SEQ ID NO: 8447866 - DNA, 22 bp, Homo sapiens
gttagaaagtgtctgcttgggt

SEQ ID NO: 8447867 - DNA, 22 bp, Homo sapiens
gttagaaacacattcttattga

SEQ ID NO: 8447868 - DNA, 22 bp, Homo sapiens
gttagaaacacattcttattga

SEQ ID NO: 8447869 - DNA, 22 bp, Homo sapiens
gttactcttgagaggctgaggt

SEQ ID NO: 8447870 - DNA, 22 bp, Homo sapiens
gtgttacttaattagaatctgc

SEQ ID NO: 8447871 - DNA, 22 bp, Homo sapiens
gtgttacttacctgggacagca

SEQ ID NO: 8447872 - DNA, 22 bp, Homo sapiens
gtgttacttgccatacagaaaa

SEQ ID NO: 8447873 - DNA, 22 bp, Homo sapiens
gttactcttccccggggtctgg

SEQ ID NO: 8447874 - DNA, 22 bp, Homo sapiens
gttacaaaggtcataaaagtgt

SEQ ID NO: 8447875 - DNA, 22 bp, Homo sapiens
gttaggaatttgttactgtgta

SEQ ID NO: 8447876 - DNA, 20 bp, Homo sapiens
gttaggaggttggacatgga

SEQ ID NO: 8447877 - DNA, 20 bp, Homo sapiens
gttaggaggttggacatgga

SEQ ID NO: 8447878 - DNA, 22 bp, Homo sapiens
gttaggtagaagtttactttga

SEQ ID NO: 8447879 - DNA, 22 bp, Homo sapiens
gttagagggctgccttttgttt

SEQ ID NO: 8447880 - DNA, 22 bp, Homo sapiens
gttagagggaaaaatcatttgc

SEQ ID NO: 8447881 - DNA, 22 bp, Homo sapiens
gttccacaaaaggtctagttta

SEQ ID NO: 8447882 - DNA, 23 bp, Homo sapiens
gttcattttattgtctgattgct

SEQ ID NO: 8447883 - DNA, 22 bp, Homo sapiens
gttataaaatgcacagttgttt

SEQ ID NO: 8447884 - DNA, 22 bp, Homo sapiens
gttagtgtgactgaggaatgca

SEQ ID NO: 8447885 - DNA, 22 bp, Homo sapiens
gttagtgtatattgccttcaaa

SEQ ID NO: 8447886 - DNA, 22 bp, Homo sapiens
gttataaatacctaataggatt

SEQ ID NO: 8447887 - DNA, 22 bp, Homo sapiens
gttataaaggtgataatggtca

SEQ ID NO: 8447888 - DNA, 22 bp, Homo sapiens
gttataaatacctaataggatt

SEQ ID NO: 8447889 - DNA, 22 bp, Homo sapiens
gtgtgttcagcaagaggtaagg

SEQ ID NO: 8447890 - DNA, 22 bp, Homo sapiens
gtgttacatattctaaaatgct

SEQ ID NO: 8447891 - DNA, 22 bp, Homo sapiens
gtgttactgggaggacggaggt

SEQ ID NO: 8447892 - DNA, 22 bp, Homo sapiens
gtgttactgacacatttttgtc

SEQ ID NO: 8447893 - DNA, 22 bp, Homo sapiens
gtgttactgcttttatctacca

SEQ ID NO: 8447894 - DNA, 23 bp, Homo sapiens
gtgttactctgataggtgctttt

SEQ ID NO: 8447895 - DNA, 22 bp, Homo sapiens
gtgttactgacacatttttgtc

SEQ ID NO: 8447896 - DNA, 22 bp, Homo sapiens
gtgttactaaaatttgattctt

SEQ ID NO: 8447897 - DNA, 22 bp, Homo sapiens
gtgttactaaaatttgattctt

SEQ ID NO: 8447898 - DNA, 23 bp, Homo sapiens
gtgttactaaagatgaacattta

SEQ ID NO: 8447899 - DNA, 23 bp, Homo sapiens
gtgttactaaagatgaacattta

SEQ ID NO: 8447900 - DNA, 23 bp, Homo sapiens
gtgttactaaagatgaacattta

SEQ ID NO: 8447901 - DNA, 22 bp, Homo sapiens
gtgttactcaagagatagcttt

SEQ ID NO: 8447902 - DNA, 22 bp, Homo sapiens
gtgctttaaaccactgtgctgt

SEQ ID NO: 8447903 - DNA, 22 bp, Homo sapiens
gtgctttagttcttgcaactgg

SEQ ID NO: 8447904 - DNA, 22 bp, Homo sapiens
gtgcttttaacttttgaaagga

SEQ ID NO: 8447905 - DNA, 22 bp, Homo sapiens
gtgcttttaaaggcaattagta

SEQ ID NO: 8447906 - DNA, 22 bp, Homo sapiens
gtttctcacttaccaacacatg

SEQ ID NO: 8447907 - DNA, 22 bp, Homo sapiens
gtttatatgaacttcataccca

SEQ ID NO: 8447908 - DNA, 22 bp, Homo sapiens
gtttataaggtaaaggagagag

SEQ ID NO: 8447909 - DNA, 22 bp, Homo sapiens
gtttataatccaactctgctcc

SEQ ID NO: 8447910 - DNA, 22 bp, Homo sapiens
gtttataatgtctgtgccaaaa

SEQ ID NO: 8447911 - DNA, 22 bp, Homo sapiens
gtttcctacactgtagtattat

SEQ ID NO: 8447912 - DNA, 22 bp, Homo sapiens
gtttcctaccagtggttccaga

SEQ ID NO: 8447913 - DNA, 22 bp, Homo sapiens
gtttcctagatcagtgttctta

SEQ ID NO: 8447914 - DNA, 22 bp, Homo sapiens
gttttacaaggttaatcagcag

SEQ ID NO: 8447915 - DNA, 22 bp, Homo sapiens
gtttcttaaaagaggagttaga

SEQ ID NO: 8447916 - DNA, 23 bp, Homo sapiens
gttttacaggtgagaaaatggag

SEQ ID NO: 8447917 - DNA, 23 bp, Homo sapiens
gttttacaggtgagaaaatggag

SEQ ID NO: 8447918 - DNA, 22 bp, Homo sapiens
gttttacaaggttaatcagcag

SEQ ID NO: 8447919 - DNA, 22 bp, Homo sapiens
gttttacaaggttaatcagcag

SEQ ID NO: 8447920 - DNA, 22 bp, Homo sapiens
gttttacacacctatgaaagac

SEQ ID NO: 8447921 - DNA, 22 bp, Homo sapiens
gttttacacacctatgaaagac

SEQ ID NO: 8447922 - DNA, 22 bp, Homo sapiens
gtttctgtaagactgaattgac

SEQ ID NO: 8447923 - DNA, 22 bp, Homo sapiens
gtttctctgtctgttacattgg

SEQ ID NO: 8447924 - DNA, 22 bp, Homo sapiens
gttccacataacacatctacaa

SEQ ID NO: 8447925 - DNA, 22 bp, Homo sapiens
gttccacaaaatgtacccagtt

SEQ ID NO: 8447926 - DNA, 18 bp, Homo sapiens
gttcccagatggtgctga

SEQ ID NO: 8447927 - DNA, 22 bp, Homo sapiens
gttccaggtggtcacagagctc

SEQ ID NO: 8447928 - DNA, 22 bp, Homo sapiens
gttccaggtggtcacagagctc

SEQ ID NO: 8447929 - DNA, 22 bp, Homo sapiens
gtttacaaatattttaaatggt

SEQ ID NO: 8447930 - DNA, 22 bp, Homo sapiens
gtttaattcccacacctgccct

SEQ ID NO: 8447931 - DNA, 22 bp, Homo sapiens
gtttataaggcccaatatttct

SEQ ID NO: 8447932 - DNA, 22 bp, Homo sapiens
gtttataaattctgcttttgtt

SEQ ID NO: 8447933 - DNA, 22 bp, Homo sapiens
gtttagaatggcaaaattaagt

SEQ ID NO: 8447934 - DNA, 22 bp, Homo sapiens
gtttagaatggcaaaattaagt

SEQ ID NO: 8447935 - DNA, 22 bp, Homo sapiens
gtttagaatgaaacttttgagc

SEQ ID NO: 8447936 - DNA, 22 bp, Homo sapiens
gtttagaatggcaaaattaagt

SEQ ID NO: 8447937 - DNA, 22 bp, Homo sapiens
gtttagaatggcaaaattaagt

SEQ ID NO: 8447938 - DNA, 22 bp, Homo sapiens
gtttagaattctaactttaagg

SEQ ID NO: 8447939 - DNA, 22 bp, Homo sapiens
gtttagaattctaactttaagg

SEQ ID NO: 8447940 - DNA, 22 bp, Homo sapiens
gtttactggagaagatgacctg

SEQ ID NO: 8447941 - DNA, 22 bp, Homo sapiens
gtttacaaatattttaaatggt

SEQ ID NO: 8447942 - DNA, 22 bp, Homo sapiens
gtttacattgctgtttgtgtct

SEQ ID NO: 8447943 - DNA, 22 bp, Homo sapiens
gtttagaacacggaaatactga

SEQ ID NO: 8447944 - DNA, 22 bp, Homo sapiens
gtttagaagccaagatttgggt

SEQ ID NO: 8447945 - DNA, 22 bp, Homo sapiens
gtttagaagccaagatttgggt

SEQ ID NO: 8447946 - DNA, 21 bp, Homo sapiens
gtttagaagtagtctggctca

SEQ ID NO: 8447947 - DNA, 21 bp, Homo sapiens
gtttagaagtagtctggctca

SEQ ID NO: 8447948 - DNA, 22 bp, Homo sapiens
gtttagaatgaaacttttgagc

SEQ ID NO: 8447949 - DNA, 22 bp, Homo sapiens
gtttagaacacggaaatactga

SEQ ID NO: 8447950 - DNA, 22 bp, Homo sapiens
gtttagaacacggaaatactga

SEQ ID NO: 8447951 - DNA, 22 bp, Homo sapiens
gtttagaaaatagtgaagcaag

SEQ ID NO: 8447952 - DNA, 22 bp, Homo sapiens
gtttagaaaatagtgaagcaag

SEQ ID NO: 8447953 - DNA, 22 bp, Homo sapiens
taagatgactacttaccactga

SEQ ID NO: 8447954 - DNA, 20 bp, Homo sapiens
taagatgagctataagaagt

SEQ ID NO: 8447955 - DNA, 22 bp, Homo sapiens
taagatgaccttataaagagca

SEQ ID NO: 8447956 - DNA, 22 bp, Homo sapiens
taagatgatcaccaaatgctgg

SEQ ID NO: 8447957 - DNA, 22 bp, Homo sapiens
taagatgaggtaggtaagactt

SEQ ID NO: 8447958 - DNA, 22 bp, Homo sapiens
taagatgggggaaagaaatagt

SEQ ID NO: 8447959 - DNA, 22 bp, Homo sapiens
taagcaagatttattgaatttt

SEQ ID NO: 8447960 - DNA, 21 bp, Homo sapiens
taagcaaggaaagggcagccc

SEQ ID NO: 8447961 - DNA, 22 bp, Homo sapiens
taagcaagggtctctgtatcag

SEQ ID NO: 8447962 - DNA, 22 bp, Homo sapiens
taagcaagtggtagaaggacaa

SEQ ID NO: 8447963 - DNA, 22 bp, Homo sapiens
taagcaagggtctctgtatcag

SEQ ID NO: 8447964 - DNA, 22 bp, Homo sapiens
taagatggttgtagatggactg

SEQ ID NO: 8447965 - DNA, 22 bp, Homo sapiens
taagaaatttagttatagaatg

SEQ ID NO: 8447966 - DNA, 22 bp, Homo sapiens
taagaaatttagttatagaatg

SEQ ID NO: 8447967 - DNA, 22 bp, Homo sapiens
taagagttagggctagcaatat

SEQ ID NO: 8447968 - DNA, 22 bp, Homo sapiens
taagagttagggctagcaatat

SEQ ID NO: 8447969 - DNA, 22 bp, Homo sapiens
taagataaggaacattctgtga

SEQ ID NO: 8447970 - DNA, 22 bp, Homo sapiens
taactgtatttttctgagattc

SEQ ID NO: 8447971 - DNA, 22 bp, Homo sapiens
taactgtatattaaggtggccc

SEQ ID NO: 8447972 - DNA, 22 bp, Homo sapiens
taactgtatagcttggactaaa

SEQ ID NO: 8447973 - DNA, 22 bp, Homo sapiens
taactgtacctagataacgaac

SEQ ID NO: 8447974 - DNA, 22 bp, Homo sapiens
taactgtacaactggttagtca

SEQ ID NO: 8447975 - DNA, 22 bp, Homo sapiens
taactgtagctaaccgatgaga

SEQ ID NO: 8447976 - DNA, 22 bp, Homo sapiens
taactgtagttataaagctatc

SEQ ID NO: 8447977 - DNA, 22 bp, Homo sapiens
taactgtttttgaaatatatct

SEQ ID NO: 8447978 - DNA, 22 bp, Homo sapiens
taagaaatttagttatagaatg

SEQ ID NO: 8447979 - DNA, 22 bp, Homo sapiens
taagaaacttaactgggaacta

SEQ ID NO: 8447980 - DNA, 22 bp, Homo sapiens
taacttctggaaatgcatctgc

SEQ ID NO: 8447981 - DNA, 22 bp, Homo sapiens
taaatactgagttggagttggc

SEQ ID NO: 8447982 - DNA, 22 bp, Homo sapiens
taaatactgagttggagttggc

SEQ ID NO: 8447983 - DNA, 22 bp, Homo sapiens
taaatacttagttttgtgtcta

SEQ ID NO: 8447984 - DNA, 22 bp, Homo sapiens
taaatacttagttttgtgtcta

SEQ ID NO: 8447985 - DNA, 22 bp, Homo sapiens
taaatacttagttttgtgtcta

SEQ ID NO: 8447986 - DNA, 22 bp, Homo sapiens
taacaaactggaaattgacatt

SEQ ID NO: 8447987 - DNA, 22 bp, Homo sapiens
taacaaactggaaattgacatt

SEQ ID NO: 8447988 - DNA, 22 bp, Homo sapiens
taacaatagtgtttgctagtca

SEQ ID NO: 8447989 - DNA, 22 bp, Homo sapiens
taacacactgaaggtgagatgg

SEQ ID NO: 8447990 - DNA, 22 bp, Homo sapiens
taacacaaaagaatatgtgtgt

SEQ ID NO: 8447991 - DNA, 22 bp, Homo sapiens
taacacagacagccactagtaa

SEQ ID NO: 8447992 - DNA, 22 bp, Homo sapiens
taactggtcctgaacagcccag

SEQ ID NO: 8447993 - DNA, 22 bp, Homo sapiens
taactggtgagtaggatttata

SEQ ID NO: 8447994 - DNA, 22 bp, Homo sapiens
taactggtgagttggttgagtg

SEQ ID NO: 8447995 - DNA, 19 bp, Homo sapiens
taactggtgccttcagtca

SEQ ID NO: 8447996 - DNA, 22 bp, Homo sapiens
taactggtagattttaaatcgg

SEQ ID NO: 8447997 - DNA, 22 bp, Homo sapiens
taactggtatatcagtgtacac

SEQ ID NO: 8447998 - DNA, 22 bp, Homo sapiens
taactggtcctcggatgttgtg

SEQ ID NO: 8447999 - DNA, 19 bp, Homo sapiens
taactggttaaaaagcttg

SEQ ID NO: 8448000 - DNA, 22 bp, Homo sapiens
taactggttaagggtgaaatcc

SEQ ID NO: 8448001 - DNA, 22 bp, Homo sapiens
taactggtttcatatcatttcc

SEQ ID NO: 8448002 - DNA, 18 bp, Homo sapiens
taactggtttcttcccat

SEQ ID NO: 8448003 - DNA, 22 bp, Homo sapiens
taactggtttggctcagggtct

SEQ ID NO: 8448004 - DNA, 22 bp, Homo sapiens
taactgtaatataaatatgagt

SEQ ID NO: 8448005 - DNA, 22 bp, Homo sapiens
taacacatggttctgtcaggaa

SEQ ID NO: 8448006 - DNA, 22 bp, Homo sapiens
taacacatatctacaacatgtg

SEQ ID NO: 8448007 - DNA, 17 bp, Homo sapiens
taaatacacaagggtat

SEQ ID NO: 8448008 - DNA, 17 bp, Homo sapiens
taaatacacaagggtat

SEQ ID NO: 8448009 - DNA, 21 bp, Homo sapiens
taaataataagttgctgagat

SEQ ID NO: 8448010 - DNA, 22 bp, Homo sapiens
taaagtttgtagcaattgatat

SEQ ID NO: 8448011 - DNA, 22 bp, Homo sapiens
taaagtttgtagcaattgatat

SEQ ID NO: 8448012 - DNA, 22 bp, Homo sapiens
taaagtttggcagacaataaca

SEQ ID NO: 8448013 - DNA, 22 bp, Homo sapiens
taaagttataaattacctgtca

SEQ ID NO: 8448014 - DNA, 22 bp, Homo sapiens
taaagttcttagaacaaggcct

SEQ ID NO: 8448015 - DNA, 22 bp, Homo sapiens
taaagtttattggcaccaccat

SEQ ID NO: 8448016 - DNA, 22 bp, Homo sapiens
taaagtttattggcaccaccat

SEQ ID NO: 8448017 - DNA, 22 bp, Homo sapiens
taaagtttatttgaacatctct

SEQ ID NO: 8448018 - DNA, 22 bp, Homo sapiens
taaagtttatttgaacatctct

SEQ ID NO: 8448019 - DNA, 22 bp, Homo sapiens
taaagtttatttgaacatctct

SEQ ID NO: 8448020 - DNA, 22 bp, Homo sapiens
taaagtttggcagacaataaca

SEQ ID NO: 8448021 - DNA, 22 bp, Homo sapiens
taaagacaatttcgagctgtag

SEQ ID NO: 8448022 - DNA, 22 bp, Homo sapiens
taaagacacccagggagggact

SEQ ID NO: 8448023 - DNA, 22 bp, Homo sapiens
taaagtgtggacagtatctata

SEQ ID NO: 8448024 - DNA, 22 bp, Homo sapiens
taaagacactggttttaatcat

SEQ ID NO: 8448025 - DNA, 22 bp, Homo sapiens
taaagttataaattacctgtca

SEQ ID NO: 8448026 - DNA, 22 bp, Homo sapiens
taaagtgtttgtatgcagataa

SEQ ID NO: 8448027 - DNA, 22 bp, Homo sapiens
taaagtgtttgtatgcagataa

SEQ ID NO: 8448028 - DNA, 22 bp, Homo sapiens
taaagtgtgtatatacatatgg

SEQ ID NO: 8448029 - DNA, 22 bp, Homo sapiens
taaacatgttgacatcttacct

SEQ ID NO: 8448030 - DNA, 22 bp, Homo sapiens
taaactgcttctctcagtctgt

SEQ ID NO: 8448031 - DNA, 22 bp, Homo sapiens
taaagacaaatgacattacggc

SEQ ID NO: 8448032 - DNA, 22 bp, Homo sapiens
taaagacaataggaaagttgtt

SEQ ID NO: 8448033 - DNA, 22 bp, Homo sapiens
taaagacaataggaaagttgtt

SEQ ID NO: 8448034 - DNA, 22 bp, Homo sapiens
taaagaataatacccatggagc

SEQ ID NO: 8448035 - DNA, 22 bp, Homo sapiens
taaagacaaacccactagggtt

SEQ ID NO: 8448036 - DNA, 22 bp, Homo sapiens
taaacagctactgtgtcaaagg

SEQ ID NO: 8448037 - DNA, 22 bp, Homo sapiens
taaacagctactgtgtcaaagg

SEQ ID NO: 8448038 - DNA, 22 bp, Homo sapiens
taaacatggattctgatcacag

SEQ ID NO: 8448039 - DNA, 22 bp, Homo sapiens
taaacatggctgtttcagttat

SEQ ID NO: 8448040 - DNA, 22 bp, Homo sapiens
taaacagcctcccctttcactc

SEQ ID NO: 8448041 - DNA, 22 bp, Homo sapiens
taaacagcctaaaactttcttt

SEQ ID NO: 8448042 - DNA, 22 bp, Homo sapiens
taaacagagagtgcagttatag

SEQ ID NO: 8448043 - DNA, 22 bp, Homo sapiens
gttttataattgcttcataaga

SEQ ID NO: 8448044 - DNA, 22 bp, Homo sapiens
gttttataggtgaaatattact

SEQ ID NO: 8448045 - DNA, 22 bp, Homo sapiens
gttttataggtgaaatattact

SEQ ID NO: 8448046 - DNA, 22 bp, Homo sapiens
gttttatttccatgagagaccg

SEQ ID NO: 8448047 - DNA, 22 bp, Homo sapiens
gttttattggaacacagccatg

SEQ ID NO: 8448048 - DNA, 22 bp, Homo sapiens
tacatacagagatgctagttaa

SEQ ID NO: 8448049 - DNA, 22 bp, Homo sapiens
tacatacacaaatatactgttt

SEQ ID NO: 8448050 - DNA, 22 bp, Homo sapiens
tacatacacaaatatactgttt

SEQ ID NO: 8448051 - DNA, 22 bp, Homo sapiens
tacatgtatgtttatcttgaga

SEQ ID NO: 8448052 - DNA, 22 bp, Homo sapiens
tacattcagaagaatggacacg

SEQ ID NO: 8448053 - DNA, 22 bp, Homo sapiens
tacattcacttgttgaaggtgg

SEQ ID NO: 8448054 - DNA, 22 bp, Homo sapiens
tacattcacttgttgaaggtgg

SEQ ID NO: 8448055 - DNA, 22 bp, Homo sapiens
tacattcagcaaaagaatggtt

SEQ ID NO: 8448056 - DNA, 22 bp, Homo sapiens
tacattcagagaaagtttccat

SEQ ID NO: 8448057 - DNA, 22 bp, Homo sapiens
tacattcagaattgggaggcaa

SEQ ID NO: 8448058 - DNA, 22 bp, Homo sapiens
tacattcagagaaagtttccat

SEQ ID NO: 8448059 - DNA, 22 bp, Homo sapiens
tacattcatatgtgtgcataca

SEQ ID NO: 8448060 - DNA, 22 bp, Homo sapiens
tacattcagagaaagtttccat

SEQ ID NO: 8448061 - DNA, 22 bp, Homo sapiens
tacattcatggtgacttgtatg

SEQ ID NO: 8448062 - DNA, 15 bp, Homo sapiens
tacattcatttccac

SEQ ID NO: 8448063 - DNA, 22 bp, Homo sapiens
tacattcatggtgacttgtatg

SEQ ID NO: 8448064 - DNA, 23 bp, Homo sapiens
tacattcatttgcacagccagta

SEQ ID NO: 8448065 - DNA, 22 bp, Homo sapiens
tacattcaaacgatttattgat

SEQ ID NO: 8448066 - DNA, 20 bp, Homo sapiens
tacattcaaaacaaactctg

SEQ ID NO: 8448067 - DNA, 22 bp, Homo sapiens
tacattcaacatgtcactatgt

SEQ ID NO: 8448068 - DNA, 22 bp, Homo sapiens
tacattcacagttgttcatctc

SEQ ID NO: 8448069 - DNA, 22 bp, Homo sapiens
tacattcaaacgatttattgat

SEQ ID NO: 8448070 - DNA, 20 bp, Homo sapiens
tacattcaaaacaaactctg

SEQ ID NO: 8448071 - DNA, 22 bp, Homo sapiens
tacattatcttgttatctttca

SEQ ID NO: 8448072 - DNA, 22 bp, Homo sapiens
tacattatcttgttatctttca

SEQ ID NO: 8448073 - DNA, 22 bp, Homo sapiens
tacattacaggaaagataaaga

SEQ ID NO: 8448074 - DNA, 22 bp, Homo sapiens
tacattatcttgttatctttca

SEQ ID NO: 8448075 - DNA, 22 bp, Homo sapiens
tacattatcttgttatctttca

SEQ ID NO: 8448076 - DNA, 22 bp, Homo sapiens
tacattatcttgttatctttca

SEQ ID NO: 8448077 - DNA, 22 bp, Homo sapiens
tacataattaatctttaagttc

SEQ ID NO: 8448078 - DNA, 22 bp, Homo sapiens
tacaggaagttacagactatga

SEQ ID NO: 8448079 - DNA, 20 bp, Homo sapiens
tacaggaatcaagactgcat

SEQ ID NO: 8448080 - DNA, 22 bp, Homo sapiens
tacagttaccctggaaagaaat

SEQ ID NO: 8448081 - DNA, 22 bp, Homo sapiens
tacagttaccctggaaagaaat

SEQ ID NO: 8448082 - DNA, 17 bp, Homo sapiens
tacaggagagcaggaac

SEQ ID NO: 8448083 - DNA, 22 bp, Homo sapiens
tacagttacgctgagaaacgaa

SEQ ID NO: 8448084 - DNA, 22 bp, Homo sapiens
tacagttactgttatatgtgct

SEQ ID NO: 8448085 - DNA, 22 bp, Homo sapiens
tacaggaaggctctggaggtgc

SEQ ID NO: 8448086 - DNA, 22 bp, Homo sapiens
tacagctttagcaaattaccta

SEQ ID NO: 8448087 - DNA, 22 bp, Homo sapiens
tactgggtatacaaagatgaat

SEQ ID NO: 8448088 - DNA, 20 bp, Homo sapiens
tactgggtctgggtcctgga

SEQ ID NO: 8448089 - DNA, 22 bp, Homo sapiens
tacttagagcgataatttatac

SEQ ID NO: 8448090 - DNA, 22 bp, Homo sapiens
tacttagactctatctagagat

SEQ ID NO: 8448091 - DNA, 19 bp, Homo sapiens
tacttattagaaatatggg

SEQ ID NO: 8448092 - DNA, 22 bp, Homo sapiens
tacttcaaacaatggtacaaac

SEQ ID NO: 8448093 - DNA, 22 bp, Homo sapiens
tacttcattcctttgtaaaatg

SEQ ID NO: 8448094 - DNA, 22 bp, Homo sapiens
tacttcattcctttgtaaaatg

SEQ ID NO: 8448095 - DNA, 22 bp, Homo sapiens
tacttcattcaagttcgctata

SEQ ID NO: 8448096 - DNA, 22 bp, Homo sapiens
tacttcattattctagttttga

SEQ ID NO: 8448097 - DNA, 22 bp, Homo sapiens
tacttctgttagctctgagagt

SEQ ID NO: 8448098 - DNA, 22 bp, Homo sapiens
tacttctgttcttaaaccaaga

SEQ ID NO: 8448099 - DNA, 22 bp, Homo sapiens
tacttctgtaagtgcgccaagg

SEQ ID NO: 8448100 - DNA, 22 bp, Homo sapiens
tacttctgtaagtgcgccaagg

SEQ ID NO: 8448101 - DNA, 22 bp, Homo sapiens
tacttctggatattcagaactt

SEQ ID NO: 8448102 - DNA, 22 bp, Homo sapiens
tacttctgcaccaaccttaata

SEQ ID NO: 8448103 - DNA, 20 bp, Homo sapiens
tacttctgaggcactctgaa

SEQ ID NO: 8448104 - DNA, 22 bp, Homo sapiens
tacttctgaatgtgagtttgtt

SEQ ID NO: 8448105 - DNA, 22 bp, Homo sapiens
tacttctgccttagagaacact

SEQ ID NO: 8448106 - DNA, 22 bp, Homo sapiens
tacttcctgtttccatgtctgt

SEQ ID NO: 8448107 - DNA, 22 bp, Homo sapiens
tacttcctgtttccatgtctgt

SEQ ID NO: 8448108 - DNA, 22 bp, Homo sapiens
tactgagggcaaagagtgaagc

SEQ ID NO: 8448109 - DNA, 22 bp, Homo sapiens
tactgagctggtccactgaggt

SEQ ID NO: 8448110 - DNA, 22 bp, Homo sapiens
tacattcccccaattaccaatg

SEQ ID NO: 8448111 - DNA, 22 bp, Homo sapiens
tacattccatgtgtgtgtattc

SEQ ID NO: 8448112 - DNA, 22 bp, Homo sapiens
tacattcatggtgacttgtatg

SEQ ID NO: 8448113 - DNA, 22 bp, Homo sapiens
taccattttgaggatggagaga

SEQ ID NO: 8448114 - DNA, 22 bp, Homo sapiens
tacccagaagattgtcagcaaa

SEQ ID NO: 8448115 - DNA, 22 bp, Homo sapiens
tacctgaattaccaaaagcttt

SEQ ID NO: 8448116 - DNA, 22 bp, Homo sapiens
taccttcaccagcgaatgtttg

SEQ ID NO: 8448117 - DNA, 22 bp, Homo sapiens
taccttcaccagcgaatgtttg

SEQ ID NO: 8448118 - DNA, 22 bp, Homo sapiens
tacctgttttaaagctaaaagg

SEQ ID NO: 8448119 - DNA, 22 bp, Homo sapiens
tacctgttgtcacgataacact

SEQ ID NO: 8448120 - DNA, 22 bp, Homo sapiens
tacctggctggggaatagccag

SEQ ID NO: 8448121 - DNA, 22 bp, Homo sapiens
tacctggcagtcagtctttccg

SEQ ID NO: 8448122 - DNA, 22 bp, Homo sapiens
tacgcctgtaatcccagcactt

SEQ ID NO: 8448123 - DNA, 22 bp, Homo sapiens
tacgcctgtaatcccagcactt

SEQ ID NO: 8448124 - DNA, 23 bp, Homo sapiens
tacctttccctgggagactgctc

SEQ ID NO: 8448125 - DNA, 22 bp, Homo sapiens
tacgaatcctgtggatgaatgt

SEQ ID NO: 8448126 - DNA, 22 bp, Homo sapiens
tacgtgcaaggtccctgcccct

SEQ ID NO: 8448127 - DNA, 22 bp, Homo sapiens
tacgtgcactcatacctgaaat

SEQ ID NO: 8448128 - DNA, 22 bp, Homo sapiens
tactgaaagtggtcaacagtgg

SEQ ID NO: 8448129 - DNA, 22 bp, Homo sapiens
tactgaaagactgaatatttag

SEQ ID NO: 8448130 - DNA, 22 bp, Homo sapiens
tactgaaagactgaatatttag

SEQ ID NO: 8448131 - DNA, 22 bp, Homo sapiens
tactgaaagaatacataatttc

SEQ ID NO: 8448132 - DNA, 22 bp, Homo sapiens
tactgaaatactaagaagttaa

SEQ ID NO: 8448133 - DNA, 22 bp, Homo sapiens
tactgaaatactaagaagttaa

SEQ ID NO: 8448134 - DNA, 22 bp, Homo sapiens
tacactaatagccacactaatg

SEQ ID NO: 8448135 - DNA, 22 bp, Homo sapiens
tacactaatgtttttgcaaagc

SEQ ID NO: 8448136 - DNA, 22 bp, Homo sapiens
tacacgtgtgtgtatgtacata

SEQ ID NO: 8448137 - DNA, 22 bp, Homo sapiens
tacacgtgcaaattcaatgtat

SEQ ID NO: 8448138 - DNA, 21 bp, Homo sapiens
tacaccagtttacacttcctc

SEQ ID NO: 8448139 - DNA, 22 bp, Homo sapiens
tacaccattcccaggtggattt

SEQ ID NO: 8448140 - DNA, 22 bp, Homo sapiens
tacaccagtatcttaagcatga

SEQ ID NO: 8448141 - DNA, 22 bp, Homo sapiens
tacaccaggtgttatggtcaat

SEQ ID NO: 8448142 - DNA, 22 bp, Homo sapiens
tacaccaggttaccaatcactg

SEQ ID NO: 8448143 - DNA, 22 bp, Homo sapiens
tacaccagcttgcctgggctct

SEQ ID NO: 8448144 - DNA, 22 bp, Homo sapiens
tacaccagaatctctgtgggga

SEQ ID NO: 8448145 - DNA, 22 bp, Homo sapiens
tacaccagattatttataacat

SEQ ID NO: 8448146 - DNA, 22 bp, Homo sapiens
tacacatgcatgtactccagga

SEQ ID NO: 8448147 - DNA, 22 bp, Homo sapiens
tacacatgctcagattcctgtg

SEQ ID NO: 8448148 - DNA, 22 bp, Homo sapiens
tacacatgtatttatgtgtaca

SEQ ID NO: 8448149 - DNA, 22 bp, Homo sapiens
tacacatgtttggcaagtatgt

SEQ ID NO: 8448150 - DNA, 22 bp, Homo sapiens
tacacatgtccaaggtgtcacc

SEQ ID NO: 8448151 - DNA, 22 bp, Homo sapiens
tacacatgtgcacgcgtgtcct

SEQ ID NO: 8448152 - DNA, 22 bp, Homo sapiens
tacacattacataatactatct

SEQ ID NO: 8448153 - DNA, 22 bp, Homo sapiens
tacacattctagggcacagtta

SEQ ID NO: 8448154 - DNA, 22 bp, Homo sapiens
tacacatgacagtggactgaga

SEQ ID NO: 8448155 - DNA, 22 bp, Homo sapiens
tacacatctggtgtgactgcca

SEQ ID NO: 8448156 - DNA, 22 bp, Homo sapiens
tacacatgatcatttagtagca

SEQ ID NO: 8448157 - DNA, 22 bp, Homo sapiens
tacacatctggagaagccctgt

SEQ ID NO: 8448158 - DNA, 22 bp, Homo sapiens
tacacatctctgtcagtagtga

SEQ ID NO: 8448159 - DNA, 22 bp, Homo sapiens
tacacatccttctgaacaacct

SEQ ID NO: 8448160 - DNA, 22 bp, Homo sapiens
tacacatcccagactcccagga

SEQ ID NO: 8448161 - DNA, 22 bp, Homo sapiens
tacacatcatacactgggatta

SEQ ID NO: 8448162 - DNA, 22 bp, Homo sapiens
tacacatccatgttttgacttt

SEQ ID NO: 8448163 - DNA, 22 bp, Homo sapiens
tacacataggtctgaataaaaa

SEQ ID NO: 8448164 - DNA, 22 bp, Homo sapiens
tacacatcaacctggctttggc

SEQ ID NO: 8448165 - DNA, 22 bp, Homo sapiens
tacacatcactgtatctttcag

SEQ ID NO: 8448166 - DNA, 22 bp, Homo sapiens
tacaatgttggtaaagtatcat

SEQ ID NO: 8448167 - DNA, 22 bp, Homo sapiens
tacaattactcagctctgctgt

SEQ ID NO: 8448168 - DNA, 22 bp, Homo sapiens
tacaatgttaaggaaagagaga

SEQ ID NO: 8448169 - DNA, 22 bp, Homo sapiens
tacaatgttaaggaaagagaga

SEQ ID NO: 8448170 - DNA, 22 bp, Homo sapiens
tacaatgtgtgcttcttgtcac

SEQ ID NO: 8448171 - DNA, 17 bp, Homo sapiens
tacaatgtgattcaatc

SEQ ID NO: 8448172 - DNA, 22 bp, Homo sapiens
tacacaaaggcactctgttgtt

SEQ ID NO: 8448173 - DNA, 21 bp, Homo sapiens
tacacaaagcgtggtccagag

SEQ ID NO: 8448174 - DNA, 22 bp, Homo sapiens
taattttaatagtatgtggcat

SEQ ID NO: 8448175 - DNA, 22 bp, Homo sapiens
taatttcttcatctctgcagct

SEQ ID NO: 8448176 - DNA, 22 bp, Homo sapiens
taattttatgacagtgtatttt

SEQ ID NO: 8448177 - DNA, 22 bp, Homo sapiens
taattttccactctgtttatct

SEQ ID NO: 8448178 - DNA, 22 bp, Homo sapiens
taattttccactctgtttatct

SEQ ID NO: 8448179 - DNA, 22 bp, Homo sapiens
taattttgtccccctgcacata

SEQ ID NO: 8448180 - DNA, 22 bp, Homo sapiens
taattttgtcacagtgacatgc

SEQ ID NO: 8448181 - DNA, 22 bp, Homo sapiens
taattttgtcacagtgacatgc

SEQ ID NO: 8448182 - DNA, 22 bp, Homo sapiens
taattttgtattgccattgtag

SEQ ID NO: 8448183 - DNA, 22 bp, Homo sapiens
taattttgtattgccattgtag

SEQ ID NO: 8448184 - DNA, 22 bp, Homo sapiens
taattttgctgtgaccattgaa

SEQ ID NO: 8448185 - DNA, 22 bp, Homo sapiens
tacaatgtaattctgattatgt

SEQ ID NO: 8448186 - DNA, 22 bp, Homo sapiens
tacaatgtaattctgattatgt

SEQ ID NO: 8448187 - DNA, 22 bp, Homo sapiens
tacaatgattagctaacttgcc

SEQ ID NO: 8448188 - DNA, 22 bp, Homo sapiens
tacaatgcaaaatactgtctgc

SEQ ID NO: 8448189 - DNA, 22 bp, Homo sapiens
tacaatgctgtgcatgtaatgg

SEQ ID NO: 8448190 - DNA, 22 bp, Homo sapiens
tacaatgagctgtacatctcca

SEQ ID NO: 8448191 - DNA, 22 bp, Homo sapiens
taatttttccacgtacactggg

SEQ ID NO: 8448192 - DNA, 22 bp, Homo sapiens
tacaagctcacaaatttttaag

SEQ ID NO: 8448193 - DNA, 22 bp, Homo sapiens
tacaagctcgggcagctcatta

SEQ ID NO: 8448194 - DNA, 22 bp, Homo sapiens
taagttttaagcaatctgataa

SEQ ID NO: 8448195 - DNA, 22 bp, Homo sapiens
taataaatgaaagtgctggcat

SEQ ID NO: 8448196 - DNA, 22 bp, Homo sapiens
taataacaattgtaggacatga

SEQ ID NO: 8448197 - DNA, 22 bp, Homo sapiens
taagcactttatatgctttatc

SEQ ID NO: 8448198 - DNA, 22 bp, Homo sapiens
taagcagtttttcttgtattaa

SEQ ID NO: 8448199 - DNA, 20 bp, Homo sapiens
taagcacatgaacagtcctc

SEQ ID NO: 8448200 - DNA, 18 bp, Homo sapiens
taagcaatgacattgcaa

SEQ ID NO: 8448201 - DNA, 22 bp, Homo sapiens
taagcaatctaaaagccttacc

SEQ ID NO: 8448202 - DNA, 19 bp, Homo sapiens
taagtgttggtgaatttct

SEQ ID NO: 8448203 - DNA, 22 bp, Homo sapiens
taagtgttggtaattacaatga

SEQ ID NO: 8448204 - DNA, 22 bp, Homo sapiens
taagtgtttctccagtgtcttt

SEQ ID NO: 8448205 - DNA, 22 bp, Homo sapiens
taagtgttgttttcaagagata

SEQ ID NO: 8448206 - DNA, 22 bp, Homo sapiens
taatgatatttcccatttctct

SEQ ID NO: 8448207 - DNA, 22 bp, Homo sapiens
taatgatgcagttactgtctca

SEQ ID NO: 8448208 - DNA, 22 bp, Homo sapiens
taatgcaacgtgagataattaa

SEQ ID NO: 8448209 - DNA, 22 bp, Homo sapiens
taatgaatgagaatataacaga

SEQ ID NO: 8448210 - DNA, 22 bp, Homo sapiens
taatgaatgagaatataacaga

SEQ ID NO: 8448211 - DNA, 19 bp, Homo sapiens
taataagcaatatggaagt

SEQ ID NO: 8448212 - DNA, 22 bp, Homo sapiens
taatttcaccgttgctagaaat

SEQ ID NO: 8448213 - DNA, 22 bp, Homo sapiens
taatttctaattcattttcagt

SEQ ID NO: 8448214 - DNA, 22 bp, Homo sapiens
taatttcaatagcttgcataat

SEQ ID NO: 8448215 - DNA, 22 bp, Homo sapiens
taatgcttttccttcaaataag

SEQ ID NO: 8448216 - DNA, 22 bp, Homo sapiens
taatgctttgttttgatctaac

SEQ ID NO: 8448217 - DNA, 22 bp, Homo sapiens
taatgcttcaatttccttgatt

SEQ ID NO: 8448218 - DNA, 22 bp, Homo sapiens
taatgcttaattttcacaagcc

SEQ ID NO: 8448219 - DNA, 22 bp, Homo sapiens
taatgctaacatcatatcactg

SEQ ID NO: 8448220 - DNA, 22 bp, Homo sapiens
taatgctgccaagccatgcaga

SEQ ID NO: 8448221 - DNA, 22 bp, Homo sapiens
tcatgttatcttggctctggga

SEQ ID NO: 8448222 - DNA, 22 bp, Homo sapiens
tcatgttatcagacacagagta

SEQ ID NO: 8448223 - DNA, 22 bp, Homo sapiens
tcatgtgtgtttcatgtatgga

SEQ ID NO: 8448224 - DNA, 20 bp, Homo sapiens
tcatggctgctgagaggttc

SEQ ID NO: 8448225 - DNA, 20 bp, Homo sapiens
tcatggctgctgagaggttc

SEQ ID NO: 8448226 - DNA, 22 bp, Homo sapiens
tcatggctggaagctcagttag

SEQ ID NO: 8448227 - DNA, 18 bp, Homo sapiens
tcatggctttagtccctc

SEQ ID NO: 8448228 - DNA, 22 bp, Homo sapiens
tcatggctttttcactgttcgc

SEQ ID NO: 8448229 - DNA, 22 bp, Homo sapiens
tcatggcttttattatgttgag

SEQ ID NO: 8448230 - DNA, 22 bp, Homo sapiens
tcatgtttggagtttgctcact

SEQ ID NO: 8448231 - DNA, 22 bp, Homo sapiens
tcatgttttagctgcaaaatga

SEQ ID NO: 8448232 - DNA, 22 bp, Homo sapiens
tcatgttttagtaaagtgaagg

SEQ ID NO: 8448233 - DNA, 22 bp, Homo sapiens
tccacacacatttctatgtgca

SEQ ID NO: 8448234 - DNA, 22 bp, Homo sapiens
tccacagactattaagtgatct

SEQ ID NO: 8448235 - DNA, 22 bp, Homo sapiens
tccacagggatgcctgcggctt

SEQ ID NO: 8448236 - DNA, 22 bp, Homo sapiens
tccacaggctgaggcccttctg

SEQ ID NO: 8448237 - DNA, 22 bp, Homo sapiens
tccacagggatgcctgcggctt

SEQ ID NO: 8448238 - DNA, 22 bp, Homo sapiens
tccacaggaaagcacctcccat

SEQ ID NO: 8448239 - DNA, 22 bp, Homo sapiens
tccacaggctgaggcccttctg

SEQ ID NO: 8448240 - DNA, 22 bp, Homo sapiens
tccacaggcaagtctcttggca

SEQ ID NO: 8448241 - DNA, 22 bp, Homo sapiens
tccaccatgtaacaagctctgt

SEQ ID NO: 8448242 - DNA, 18 bp, Homo sapiens
tccaccagtcaatctgtc

SEQ ID NO: 8448243 - DNA, 22 bp, Homo sapiens
tccacccccagacagctggtga

SEQ ID NO: 8448244 - DNA, 22 bp, Homo sapiens
tccacccccagacagctggtga

SEQ ID NO: 8448245 - DNA, 22 bp, Homo sapiens
tccacccccagacagctggtga

SEQ ID NO: 8448246 - DNA, 22 bp, Homo sapiens
tccacccctgggaatgtcaata

SEQ ID NO: 8448247 - DNA, 22 bp, Homo sapiens
tccacccccagacagctggtga

SEQ ID NO: 8448248 - DNA, 19 bp, Homo sapiens
tccaccccagccagctctg

SEQ ID NO: 8448249 - DNA, 19 bp, Homo sapiens
tccaccccagccagctctg

SEQ ID NO: 8448250 - DNA, 19 bp, Homo sapiens
tccaccccagccagctctg

SEQ ID NO: 8448251 - DNA, 19 bp, Homo sapiens
tccaccccagccagctctg

SEQ ID NO: 8448252 - DNA, 22 bp, Homo sapiens
tccaccagcagcctgtcagcct

SEQ ID NO: 8448253 - DNA, 22 bp, Homo sapiens
tccacagggatgttgagttctt

SEQ ID NO: 8448254 - DNA, 22 bp, Homo sapiens
tccagaaaaagtaatttatttg

SEQ ID NO: 8448255 - DNA, 22 bp, Homo sapiens
tccagaaaaagtaatttatttg

SEQ ID NO: 8448256 - DNA, 22 bp, Homo sapiens
tccactccttatgccagacggt

SEQ ID NO: 8448257 - DNA, 22 bp, Homo sapiens
tccacgtgagcttcgtgtgcag

SEQ ID NO: 8448258 - DNA, 22 bp, Homo sapiens
tccaccctgctttcttatctcc

SEQ ID NO: 8448259 - DNA, 18 bp, Homo sapiens
tccaccgcgtgcacctct

SEQ ID NO: 8448260 - DNA, 20 bp, Homo sapiens
tccaggagaactgggagccg

SEQ ID NO: 8448261 - DNA, 22 bp, Homo sapiens
tccaggagcatccaggtgaagc

SEQ ID NO: 8448262 - DNA, 20 bp, Homo sapiens
tccaggagaactgggagccg

SEQ ID NO: 8448263 - DNA, 20 bp, Homo sapiens
tccaggagaactgggagccg

SEQ ID NO: 8448264 - DNA, 22 bp, Homo sapiens
tccaggagctcatccacgtcaa

SEQ ID NO: 8448265 - DNA, 23 bp, Homo sapiens
tccaggagcatgctggctggcga

SEQ ID NO: 8448266 - DNA, 22 bp, Homo sapiens
tccaggaggaggaaggctgcca

SEQ ID NO: 8448267 - DNA, 22 bp, Homo sapiens
tccaggaggaggaaggctgcca

SEQ ID NO: 8448268 - DNA, 22 bp, Homo sapiens
tccaggacagcggcaggcagat

SEQ ID NO: 8448269 - DNA, 22 bp, Homo sapiens
tccaggaccaaagacacatgta

SEQ ID NO: 8448270 - DNA, 22 bp, Homo sapiens
tccaggacagagtagaagcagc

SEQ ID NO: 8448271 - DNA, 22 bp, Homo sapiens
tccaggacagagtagaagcagc

SEQ ID NO: 8448272 - DNA, 22 bp, Homo sapiens
tccaggaatgtgtgtgggctag

SEQ ID NO: 8448273 - DNA, 22 bp, Homo sapiens
tccaggaatgtgtgtgggctag

SEQ ID NO: 8448274 - DNA, 22 bp, Homo sapiens
tccaggacctgactgggcctgc

SEQ ID NO: 8448275 - DNA, 22 bp, Homo sapiens
tccaggacctgactgggcctgc

SEQ ID NO: 8448276 - DNA, 22 bp, Homo sapiens
tccaggactataggaaagacac

SEQ ID NO: 8448277 - DNA, 22 bp, Homo sapiens
tccaggactagcatttctgata

SEQ ID NO: 8448278 - DNA, 22 bp, Homo sapiens
tccaggacctcccaggctagag

SEQ ID NO: 8448279 - DNA, 22 bp, Homo sapiens
tccaggacctcccaggctagag

SEQ ID NO: 8448280 - DNA, 22 bp, Homo sapiens
tccaggacctcccaggctagag

SEQ ID NO: 8448281 - DNA, 22 bp, Homo sapiens
tccaggacctcccaggctagag

SEQ ID NO: 8448282 - DNA, 23 bp, Homo sapiens
tccaggaccctggtagacacaca

SEQ ID NO: 8448283 - DNA, 21 bp, Homo sapiens
tccaggacttgagaattccag

SEQ ID NO: 8448284 - DNA, 21 bp, Homo sapiens
tccaggacttgagaattccag

SEQ ID NO: 8448285 - DNA, 22 bp, Homo sapiens
tccaggacttggcaggagatga

SEQ ID NO: 8448286 - DNA, 22 bp, Homo sapiens
tccaggagaaaactgacggtgg

SEQ ID NO: 8448287 - DNA, 22 bp, Homo sapiens
tccaggactttcttaaggcact

SEQ ID NO: 8448288 - DNA, 22 bp, Homo sapiens
tccaggactttcttaaggcact

SEQ ID NO: 8448289 - DNA, 22 bp, Homo sapiens
tccaggacttggcaggagatga

SEQ ID NO: 8448290 - DNA, 22 bp, Homo sapiens
tccaggactataggaaagacac

SEQ ID NO: 8448291 - DNA, 22 bp, Homo sapiens
tccaggacttagtgacctaaaa

SEQ ID NO: 8448292 - DNA, 22 bp, Homo sapiens
tccaggacttagtgacctaaaa

SEQ ID NO: 8448293 - DNA, 21 bp, Homo sapiens
tccagcctttccctcacttcc

SEQ ID NO: 8448294 - DNA, 22 bp, Homo sapiens
tccagccttgccacttttctgt

SEQ ID NO: 8448295 - DNA, 22 bp, Homo sapiens
tccaggaacgagaggctgggca

SEQ ID NO: 8448296 - DNA, 22 bp, Homo sapiens
tccaggaacgagaggctgggca

SEQ ID NO: 8448297 - DNA, 21 bp, Homo sapiens
tccagcctttccctcacttcc

SEQ ID NO: 8448298 - DNA, 22 bp, Homo sapiens
tccaggaactcttgatggtgat

SEQ ID NO: 8448299 - DNA, 22 bp, Homo sapiens
tccaggaactcttgatggtgat

SEQ ID NO: 8448300 - DNA, 22 bp, Homo sapiens
tccaggaatctgtgcctagccc

SEQ ID NO: 8448301 - DNA, 22 bp, Homo sapiens
tccaggaagccacactgggcct

SEQ ID NO: 8448302 - DNA, 20 bp, Homo sapiens
tccagccctgcttctctctt

SEQ ID NO: 8448303 - DNA, 20 bp, Homo sapiens
tccagccctgcttctctctt

SEQ ID NO: 8448304 - DNA, 22 bp, Homo sapiens
tccagccctgtggcttccaccc

SEQ ID NO: 8448305 - DNA, 22 bp, Homo sapiens
tccagccttctcaaggctggct

SEQ ID NO: 8448306 - DNA, 22 bp, Homo sapiens
tccagcctgaactttgtccaga

SEQ ID NO: 8448307 - DNA, 19 bp, Homo sapiens
tccagcctgctgtttctct

SEQ ID NO: 8448308 - DNA, 22 bp, Homo sapiens
tccagcctggttgcgggcatcc

SEQ ID NO: 8448309 - DNA, 22 bp, Homo sapiens
tccagcccgggggcaggtgacc

SEQ ID NO: 8448310 - DNA, 22 bp, Homo sapiens
tccagccctcagccaagtggaa

SEQ ID NO: 8448311 - DNA, 22 bp, Homo sapiens
tccagcccgagggcgctgatga

SEQ ID NO: 8448312 - DNA, 20 bp, Homo sapiens
tccagcccctgcatgttgct

SEQ ID NO: 8448313 - DNA, 22 bp, Homo sapiens
tccagccccttttactcattca

SEQ ID NO: 8448314 - DNA, 19 bp, Homo sapiens
tccagcccctctgtgtgtg

SEQ ID NO: 8448315 - DNA, 22 bp, Homo sapiens
tccagcccgactgggcctgccg

SEQ ID NO: 8448316 - DNA, 22 bp, Homo sapiens
tccagcccgactgggcctgccg

SEQ ID NO: 8448317 - DNA, 22 bp, Homo sapiens
tccagccccttttactcattca

SEQ ID NO: 8448318 - DNA, 22 bp, Homo sapiens
tccagccctctggcccgcggtg

SEQ ID NO: 8448319 - DNA, 22 bp, Homo sapiens
tccagccctgcccattctctcg

SEQ ID NO: 8448320 - DNA, 22 bp, Homo sapiens
tccagccctgcactgattagat

SEQ ID NO: 8448321 - DNA, 20 bp, Homo sapiens
tccagccctcatgtcgctca

SEQ ID NO: 8448322 - DNA, 20 bp, Homo sapiens
tccagccctcatgtcgctca

SEQ ID NO: 8448323 - DNA, 22 bp, Homo sapiens
tccagccctcctgggatcacag

SEQ ID NO: 8448324 - DNA, 22 bp, Homo sapiens
tccagccctgcccattctctcg

SEQ ID NO: 8448325 - DNA, 22 bp, Homo sapiens
tccagccctgcttcctgcctca

SEQ ID NO: 8448326 - DNA, 17 bp, Homo sapiens
tccagccctgcccgacg

SEQ ID NO: 8448327 - DNA, 17 bp, Homo sapiens
tccagccctgcccgacg

SEQ ID NO: 8448328 - DNA, 22 bp, Homo sapiens
tccagccccggcttccttacag

SEQ ID NO: 8448329 - DNA, 22 bp, Homo sapiens
tccagccccggcttccttacag

SEQ ID NO: 8448330 - DNA, 22 bp, Homo sapiens
tccagccccggcttccttacag

SEQ ID NO: 8448331 - DNA, 22 bp, Homo sapiens
tccagccccgggatgttcttca

SEQ ID NO: 8448332 - DNA, 19 bp, Homo sapiens
tccagcccctctgtgtgtg

SEQ ID NO: 8448333 - DNA, 22 bp, Homo sapiens
tccagcccctcctgagccaagc

SEQ ID NO: 8448334 - DNA, 22 bp, Homo sapiens
tccagcccctcctgagccaagc

SEQ ID NO: 8448335 - DNA, 22 bp, Homo sapiens
tccagccccgaggccggcgacg

SEQ ID NO: 8448336 - DNA, 22 bp, Homo sapiens
tccagcccatccctagcctggg

SEQ ID NO: 8448337 - DNA, 22 bp, Homo sapiens
tccagcccagtttggtgaattg

SEQ ID NO: 8448338 - DNA, 20 bp, Homo sapiens
tccagcccaggtcctgcctg

SEQ ID NO: 8448339 - DNA, 22 bp, Homo sapiens
tccagcccaggctggagtgtag

SEQ ID NO: 8448340 - DNA, 20 bp, Homo sapiens
tccagcccaggtcctgcctg

SEQ ID NO: 8448341 - DNA, 20 bp, Homo sapiens
tccagcccaggtcctgcctg

SEQ ID NO: 8448342 - DNA, 20 bp, Homo sapiens
tccagccacttccgctggtc

SEQ ID NO: 8448343 - DNA, 22 bp, Homo sapiens
tccagccactcagcagggattg

SEQ ID NO: 8448344 - DNA, 22 bp, Homo sapiens
tccagccactcagcagggattg

SEQ ID NO: 8448345 - DNA, 20 bp, Homo sapiens
tccagccacttccgctggtc

SEQ ID NO: 8448346 - DNA, 22 bp, Homo sapiens
tccagccacgtattatctcact

SEQ ID NO: 8448347 - DNA, 22 bp, Homo sapiens
tcccagattcttctgtgtgggc

SEQ ID NO: 8448348 - DNA, 22 bp, Homo sapiens
tcccagcagagccagcaagccg

SEQ ID NO: 8448349 - DNA, 22 bp, Homo sapiens
tcccagcactgtaattctttgg

SEQ ID NO: 8448350 - DNA, 22 bp, Homo sapiens
tcccagcaagaaagggggtggc

SEQ ID NO: 8448351 - DNA, 22 bp, Homo sapiens
tcccagcacagggcagatgtga

SEQ ID NO: 8448352 - DNA, 22 bp, Homo sapiens
tcccagcacgtctgctgtttct

SEQ ID NO: 8448353 - DNA, 22 bp, Homo sapiens
tcccagcagtcagagctatgtg

SEQ ID NO: 8448354 - DNA, 22 bp, Homo sapiens
tcccagcagggccgaccagcct

SEQ ID NO: 8448355 - DNA, 22 bp, Homo sapiens
tcccagcctttcttttctgctg

SEQ ID NO: 8448356 - DNA, 22 bp, Homo sapiens
tcccagcctttcttttctgctg

SEQ ID NO: 8448357 - DNA, 22 bp, Homo sapiens
tcccagcagatgagctgaccta

SEQ ID NO: 8448358 - DNA, 22 bp, Homo sapiens
tcccagcagcatagctcagaat

SEQ ID NO: 8448359 - DNA, 22 bp, Homo sapiens
tcccagcaggagtccagttccc

SEQ ID NO: 8448360 - DNA, 17 bp, Homo sapiens
tcccaggaacagggaat

SEQ ID NO: 8448361 - DNA, 22 bp, Homo sapiens
tcccaggaagatcccagggacc

SEQ ID NO: 8448362 - DNA, 17 bp, Homo sapiens
tcccaggaacagggaat

SEQ ID NO: 8448363 - DNA, 22 bp, Homo sapiens
tcccagctactctagaggctga

SEQ ID NO: 8448364 - DNA, 22 bp, Homo sapiens
tcccagagaaagtcaaggtctt

SEQ ID NO: 8448365 - DNA, 22 bp, Homo sapiens
tcccagaatctccagtgctaca

SEQ ID NO: 8448366 - DNA, 19 bp, Homo sapiens
tcccagagtctagaggttg

SEQ ID NO: 8448367 - DNA, 22 bp, Homo sapiens
tcccagagtcagaggtggggcc

SEQ ID NO: 8448368 - DNA, 22 bp, Homo sapiens
tcccagagaaagtcaaggtctt

SEQ ID NO: 8448369 - DNA, 22 bp, Homo sapiens
tcccagagtgagccaggggcag

SEQ ID NO: 8448370 - DNA, 22 bp, Homo sapiens
tcccagagttcaatgggaaggt

SEQ ID NO: 8448371 - DNA, 22 bp, Homo sapiens
tcccagagtgtgggcatcaagg

SEQ ID NO: 8448372 - DNA, 22 bp, Homo sapiens
tccagtgtgtgtccagctgctg

SEQ ID NO: 8448373 - DNA, 22 bp, Homo sapiens
tccagtgtgtgtccagctgctg

SEQ ID NO: 8448374 - DNA, 22 bp, Homo sapiens
tcccactgagcccctgctggtg

SEQ ID NO: 8448375 - DNA, 22 bp, Homo sapiens
tcccacatgtgaatcctcaggt

SEQ ID NO: 8448376 - DNA, 22 bp, Homo sapiens
tcccacatatgcaatcctgaat

SEQ ID NO: 8448377 - DNA, 22 bp, Homo sapiens
tcccacagtggtacagccctga

SEQ ID NO: 8448378 - DNA, 22 bp, Homo sapiens
tccagtggcaccttggccctca

SEQ ID NO: 8448379 - DNA, 22 bp, Homo sapiens
tccagtgctggaccagagcacc

SEQ ID NO: 8448380 - DNA, 22 bp, Homo sapiens
tccagtgcctcactgaggattc

SEQ ID NO: 8448381 - DNA, 22 bp, Homo sapiens
tccagtgctgtttccaatgtaa

SEQ ID NO: 8448382 - DNA, 22 bp, Homo sapiens
tccagtggtacatggagacact

SEQ ID NO: 8448383 - DNA, 22 bp, Homo sapiens
tccagtcctatctgcccttgga

SEQ ID NO: 8448384 - DNA, 22 bp, Homo sapiens
tccagtcctagaaactggagag

SEQ ID NO: 8448385 - DNA, 22 bp, Homo sapiens
tccagtgcaatggctcattcat

SEQ ID NO: 8448386 - DNA, 22 bp, Homo sapiens
tccagtccatggcctcagtctt

SEQ ID NO: 8448387 - DNA, 18 bp, Homo sapiens
tccagtcccaaggccagc

SEQ ID NO: 8448388 - DNA, 22 bp, Homo sapiens
tccagtccagggaatggctgat

SEQ ID NO: 8448389 - DNA, 20 bp, Homo sapiens
tccagggcaaactcatcacc

SEQ ID NO: 8448390 - DNA, 22 bp, Homo sapiens
tccagggatggtaatgagcagt

SEQ ID NO: 8448391 - DNA, 22 bp, Homo sapiens
tccagggatctttagagtcttt

SEQ ID NO: 8448392 - DNA, 22 bp, Homo sapiens
tccagggagatggcagaggctg

SEQ ID NO: 8448393 - DNA, 22 bp, Homo sapiens
tccagggagatggcagaggctg

SEQ ID NO: 8448394 - DNA, 22 bp, Homo sapiens
tccagggagatactggctgcca

SEQ ID NO: 8448395 - DNA, 22 bp, Homo sapiens
tccagggagatactggctgcca

SEQ ID NO: 8448396 - DNA, 22 bp, Homo sapiens
tccagggagagccgctgctcca

SEQ ID NO: 8448397 - DNA, 22 bp, Homo sapiens
tccagggacagcgctggagcta

SEQ ID NO: 8448398 - DNA, 22 bp, Homo sapiens
tccagggacagcgctggagcta

SEQ ID NO: 8448399 - DNA, 22 bp, Homo sapiens
tccagggacagcgctggagcta

SEQ ID NO: 8448400 - DNA, 21 bp, Homo sapiens
tccaggcctcaggaagggatg

SEQ ID NO: 8448401 - DNA, 22 bp, Homo sapiens
tccagggacagtatagaggatc

SEQ ID NO: 8448402 - DNA, 22 bp, Homo sapiens
tccagggacctccctgagagct

SEQ ID NO: 8448403 - DNA, 21 bp, Homo sapiens
tccaggcctcaggaagggatg

SEQ ID NO: 8448404 - DNA, 22 bp, Homo sapiens
tccaggcctaggccaagtgatt

SEQ ID NO: 8448405 - DNA, 22 bp, Homo sapiens
tccaggcctaggccaagtgatt

SEQ ID NO: 8448406 - DNA, 22 bp, Homo sapiens
tccaggcctaggccaagtgatt

SEQ ID NO: 8448407 - DNA, 22 bp, Homo sapiens
tccaggccgcatagttactctg

SEQ ID NO: 8448408 - DNA, 22 bp, Homo sapiens
tccaggccgcaggggcagcccc

SEQ ID NO: 8448409 - DNA, 22 bp, Homo sapiens
tccaggccctgggatgggagca

SEQ ID NO: 8448410 - DNA, 22 bp, Homo sapiens
tccaggccctgggatgggagca

SEQ ID NO: 8448411 - DNA, 22 bp, Homo sapiens
tccaggccctgggatgggagca

SEQ ID NO: 8448412 - DNA, 22 bp, Homo sapiens
tccaggcccatagacacttctc

SEQ ID NO: 8448413 - DNA, 22 bp, Homo sapiens
tccaggccgcaggggcagcccc

SEQ ID NO: 8448414 - DNA, 22 bp, Homo sapiens
tccaggccgcaggggcagcccc

SEQ ID NO: 8448415 - DNA, 22 bp, Homo sapiens
tccaggccgcaggggcagcccc

SEQ ID NO: 8448416 - DNA, 22 bp, Homo sapiens
tccaggccagggtaagaggaga

SEQ ID NO: 8448417 - DNA, 22 bp, Homo sapiens
tccaggccagggtaagaggaga

SEQ ID NO: 8448418 - DNA, 22 bp, Homo sapiens
tccaggccagggtaagaggaga

SEQ ID NO: 8448419 - DNA, 22 bp, Homo sapiens
tccaggccagggtaagaggaga

SEQ ID NO: 8448420 - DNA, 21 bp, Homo sapiens
tccaggccatggtggggaggc

SEQ ID NO: 8448421 - DNA, 21 bp, Homo sapiens
tccaggccatggtggggaggc

SEQ ID NO: 8448422 - DNA, 19 bp, Homo sapiens
tccaggccattcccagagc

SEQ ID NO: 8448423 - DNA, 19 bp, Homo sapiens
tccaggccattcccagagc

SEQ ID NO: 8448424 - DNA, 22 bp, Homo sapiens
tccaggccactgcagaggctct

SEQ ID NO: 8448425 - DNA, 22 bp, Homo sapiens
tccaggaggcagggctgtgccc

SEQ ID NO: 8448426 - DNA, 22 bp, Homo sapiens
tccaggaggaggaaggctgcca

SEQ ID NO: 8448427 - DNA, 22 bp, Homo sapiens
tccaggcccactcggtggggct

SEQ ID NO: 8448428 - DNA, 22 bp, Homo sapiens
tccaggcccactcagctgaaat

SEQ ID NO: 8448429 - DNA, 22 bp, Homo sapiens
tccaggcccactcagctgaaat

SEQ ID NO: 8448430 - DNA, 22 bp, Homo sapiens
tccaggcccagacggggtgagg

SEQ ID NO: 8448431 - DNA, 22 bp, Homo sapiens
tccaggcccagacggggtgagg

SEQ ID NO: 8448432 - DNA, 20 bp, Homo sapiens
tccaggcccactcagctgaa

SEQ ID NO: 8448433 - DNA, 22 bp, Homo sapiens
tccaggccattgactgcatcct

SEQ ID NO: 8448434 - DNA, 22 bp, Homo sapiens
tccaggccattgactgcatcct

SEQ ID NO: 8448435 - DNA, 22 bp, Homo sapiens
tccaggccattgactgcatcct

SEQ ID NO: 8448436 - DNA, 22 bp, Homo sapiens
tccaggccattgactgcatcct

SEQ ID NO: 8448437 - DNA, 22 bp, Homo sapiens
tccaggccattgactgcatcct

SEQ ID NO: 8448438 - DNA, 22 bp, Homo sapiens
tcccaggcaaaggcagctcatt

SEQ ID NO: 8448439 - DNA, 22 bp, Homo sapiens
tcccaggcaaaggcagctcatt

SEQ ID NO: 8448440 - DNA, 22 bp, Homo sapiens
tcccaggatgtttatggctggt

SEQ ID NO: 8448441 - DNA, 23 bp, Homo sapiens
tccctgagatgctgctctgtccc

SEQ ID NO: 8448442 - DNA, 21 bp, Homo sapiens
tccctgagcccaaggggctcc

SEQ ID NO: 8448443 - DNA, 22 bp, Homo sapiens
tcccaggcagcttctttcatca

SEQ ID NO: 8448444 - DNA, 19 bp, Homo sapiens
tcccaggcaaaggcttctc

SEQ ID NO: 8448445 - DNA, 22 bp, Homo sapiens
tccctgaggaaggggtgtggtg

SEQ ID NO: 8448446 - DNA, 22 bp, Homo sapiens
tccctgagcttcatcaggcttt

SEQ ID NO: 8448447 - DNA, 22 bp, Homo sapiens
tccctgagcttcatcaggcttt

SEQ ID NO: 8448448 - DNA, 23 bp, Homo sapiens
tccctgagctggagagactgcac

SEQ ID NO: 8448449 - DNA, 23 bp, Homo sapiens
tccctgagctggagagactgcac

SEQ ID NO: 8448450 - DNA, 22 bp, Homo sapiens
tccctgagctcacatggcagga

SEQ ID NO: 8448451 - DNA, 22 bp, Homo sapiens
tccctgagctgagctcaacagc

SEQ ID NO: 8448452 - DNA, 22 bp, Homo sapiens
tccctgagctgagctcaacagc

SEQ ID NO: 8448453 - DNA, 22 bp, Homo sapiens
tccctgagggcagctcaagtcc

SEQ ID NO: 8448454 - DNA, 22 bp, Homo sapiens
tccctgagggcagctcaagtcc

SEQ ID NO: 8448455 - DNA, 22 bp, Homo sapiens
tccctgagtgggctggtagtat

SEQ ID NO: 8448456 - DNA, 22 bp, Homo sapiens
tccctgagtgtatgtggtgaac

SEQ ID NO: 8448457 - DNA, 19 bp, Homo sapiens
tccctgagttccagcccag

SEQ ID NO: 8448458 - DNA, 22 bp, Homo sapiens
tccctgatgccttgatccgtgg

SEQ ID NO: 8448459 - DNA, 22 bp, Homo sapiens
tccctgagttttctttctgact

SEQ ID NO: 8448460 - DNA, 21 bp, Homo sapiens
tccctgagttctctgagcatc

SEQ ID NO: 8448461 - DNA, 22 bp, Homo sapiens
tccctgcacccttgctgggccc

SEQ ID NO: 8448462 - DNA, 22 bp, Homo sapiens
tccctgcagacgtcctgcgggt

SEQ ID NO: 8448463 - DNA, 22 bp, Homo sapiens
tccctgcaggtggggtggccag

SEQ ID NO: 8448464 - DNA, 22 bp, Homo sapiens
tccctgcatttgggagagtgtc

SEQ ID NO: 8448465 - DNA, 22 bp, Homo sapiens
tccctgcatttgggagagtgtc

SEQ ID NO: 8448466 - DNA, 22 bp, Homo sapiens
tccctgcagtagtggctaagat

SEQ ID NO: 8448467 - DNA, 22 bp, Homo sapiens
tccctgggccacagctgtgagc

SEQ ID NO: 8448468 - DNA, 23 bp, Homo sapiens
tccctgggcccgtgccagcggtg

SEQ ID NO: 8448469 - DNA, 22 bp, Homo sapiens
tccctgggccacagctgtgagc

SEQ ID NO: 8448470 - DNA, 22 bp, Homo sapiens
tccctgggcacaatctgctggc

SEQ ID NO: 8448471 - DNA, 22 bp, Homo sapiens
tccctgggcatcacgttgcttc

SEQ ID NO: 8448472 - DNA, 22 bp, Homo sapiens
tccctgccctcagtgcacccgg

SEQ ID NO: 8448473 - DNA, 22 bp, Homo sapiens
tccctgggcaagtttactcttc

SEQ ID NO: 8448474 - DNA, 22 bp, Homo sapiens
tccctgggcaagtttactcttc

SEQ ID NO: 8448475 - DNA, 22 bp, Homo sapiens
tccctgccaatgattggagcaa

SEQ ID NO: 8448476 - DNA, 22 bp, Homo sapiens
tccctgggcggacattctccca

SEQ ID NO: 8448477 - DNA, 22 bp, Homo sapiens
tccctgggcttctccagacttg

SEQ ID NO: 8448478 - DNA, 22 bp, Homo sapiens
tccctgggcctatcttagctcc

SEQ ID NO: 8448479 - DNA, 22 bp, Homo sapiens
tccctgggcctcctgctatgca

SEQ ID NO: 8448480 - DNA, 22 bp, Homo sapiens
tccctgggcctatcttagctcc

SEQ ID NO: 8448481 - DNA, 22 bp, Homo sapiens
tccctgggcctatcttagctcc

SEQ ID NO: 8448482 - DNA, 22 bp, Homo sapiens
tccctggggaagggcaagcaag

SEQ ID NO: 8448483 - DNA, 22 bp, Homo sapiens
tccctggggaagggcaagcaag

SEQ ID NO: 8448484 - DNA, 22 bp, Homo sapiens
tccctggggatgttggcctgcc

SEQ ID NO: 8448485 - DNA, 22 bp, Homo sapiens
tccctggggatgttggcctgcc

SEQ ID NO: 8448486 - DNA, 22 bp, Homo sapiens
tccctggggatgttggcctgcc

SEQ ID NO: 8448487 - DNA, 22 bp, Homo sapiens
tccctggggcagtggctcggag

SEQ ID NO: 8448488 - DNA, 20 bp, Homo sapiens
tccctggggccctacttcct

SEQ ID NO: 8448489 - DNA, 20 bp, Homo sapiens
tccctggggccctacttcct

SEQ ID NO: 8448490 - DNA, 22 bp, Homo sapiens
tccctgtaaacctcaagttgat

SEQ ID NO: 8448491 - DNA, 22 bp, Homo sapiens
tccctgtacttacacagcgtcc

SEQ ID NO: 8448492 - DNA, 22 bp, Homo sapiens
tccctgtatatcacaagggcta

SEQ ID NO: 8448493 - DNA, 22 bp, Homo sapiens
tccctgtccaaagtcttcctat

SEQ ID NO: 8448494 - DNA, 22 bp, Homo sapiens
tccctgtgaatcagaagcaggt

SEQ ID NO: 8448495 - DNA, 22 bp, Homo sapiens
tcccttggaaagtagcctcaca

SEQ ID NO: 8448496 - DNA, 22 bp, Homo sapiens
tcccttcacagatgcgatgttt

SEQ ID NO: 8448497 - DNA, 22 bp, Homo sapiens
tcccttcatcagtgagcaagcc

SEQ ID NO: 8448498 - DNA, 22 bp, Homo sapiens
tcccttcaagatttggggaaat

SEQ ID NO: 8448499 - DNA, 23 bp, Homo sapiens
tccctgtgtacagcctgcatgag

SEQ ID NO: 8448500 - DNA, 22 bp, Homo sapiens
tcctcagtgctagccaactgcc

SEQ ID NO: 8448501 - DNA, 22 bp, Homo sapiens
tcctcagtgctagccaactgcc

SEQ ID NO: 8448502 - DNA, 19 bp, Homo sapiens
tcctcagtgacaacctcag

SEQ ID NO: 8448503 - DNA, 22 bp, Homo sapiens
tcctcagtctctcaaatgaggc

SEQ ID NO: 8448504 - DNA, 22 bp, Homo sapiens
tcctcagttttctagtatggca

SEQ ID NO: 8448505 - DNA, 23 bp, Homo sapiens
tcctcagtatataaaggcagatg

SEQ ID NO: 8448506 - DNA, 22 bp, Homo sapiens
tcctcagtcgtttgagccaaaa

SEQ ID NO: 8448507 - DNA, 22 bp, Homo sapiens
tccctttcacttaactagccca

SEQ ID NO: 8448508 - DNA, 22 bp, Homo sapiens
tccggactcacctgacaatggc

SEQ ID NO: 8448509 - DNA, 22 bp, Homo sapiens
tccgggaggcagaggttgcagt

SEQ ID NO: 8448510 - DNA, 22 bp, Homo sapiens
tcctccaagcgtgggtgtttga

SEQ ID NO: 8448511 - DNA, 20 bp, Homo sapiens
tcctccagaagggcagggtg

SEQ ID NO: 8448512 - DNA, 20 bp, Homo sapiens
tcctccagaagggcagggtg

SEQ ID NO: 8448513 - DNA, 22 bp, Homo sapiens
tcctccagaaactgaggcagaa

SEQ ID NO: 8448514 - DNA, 20 bp, Homo sapiens
tcctccagaagggcagggtg

SEQ ID NO: 8448515 - DNA, 22 bp, Homo sapiens
tcctccaaggcagggggagaga

SEQ ID NO: 8448516 - DNA, 22 bp, Homo sapiens
tcctccacgatggcacacctgg

SEQ ID NO: 8448517 - DNA, 23 bp, Homo sapiens
tcctccaatctcatggcccttaa

SEQ ID NO: 8448518 - DNA, 22 bp, Homo sapiens
tcctccaagcctttgtgaagtg

SEQ ID NO: 8448519 - DNA, 22 bp, Homo sapiens
tcctccaagcagaggccctgaa

SEQ ID NO: 8448520 - DNA, 23 bp, Homo sapiens
tcctccaaccagcagctgcataa

SEQ ID NO: 8448521 - DNA, 20 bp, Homo sapiens
tcctccaaccagctgctaat

SEQ ID NO: 8448522 - DNA, 22 bp, Homo sapiens
tcctccagctgtatcctgcctg

SEQ ID NO: 8448523 - DNA, 22 bp, Homo sapiens
tcctccagctgtatcctgcctg

SEQ ID NO: 8448524 - DNA, 22 bp, Homo sapiens
tcctccaggataaaatgtgttg

SEQ ID NO: 8448525 - DNA, 22 bp, Homo sapiens
tcctccaggcacctcactggct

SEQ ID NO: 8448526 - DNA, 22 bp, Homo sapiens
tcctccaggataaaatgtgttg

SEQ ID NO: 8448527 - DNA, 22 bp, Homo sapiens
tcctccagccctctaggaaaat

SEQ ID NO: 8448528 - DNA, 22 bp, Homo sapiens
tcctccagctactaggcaaata

SEQ ID NO: 8448529 - DNA, 22 bp, Homo sapiens
tcctccagctactaggcaaata

SEQ ID NO: 8448530 - DNA, 22 bp, Homo sapiens
tcctccagctactaggcaaata

SEQ ID NO: 8448531 - DNA, 22 bp, Homo sapiens
tcctccagcaggactgaggccc

SEQ ID NO: 8448532 - DNA, 22 bp, Homo sapiens
tcctccagcaggactgaggccc

SEQ ID NO: 8448533 - DNA, 23 bp, Homo sapiens
tcctccagaggccctccttggcc

SEQ ID NO: 8448534 - DNA, 23 bp, Homo sapiens
tcctccagaggccctccttggcc

SEQ ID NO: 8448535 - DNA, 22 bp, Homo sapiens
tcctccagtggtactggccaat

SEQ ID NO: 8448536 - DNA, 22 bp, Homo sapiens
tcctccagtggtactggccaat

SEQ ID NO: 8448537 - DNA, 22 bp, Homo sapiens
tcctccaggtctagggtggctt

SEQ ID NO: 8448538 - DNA, 22 bp, Homo sapiens
tcctcccctgcccatgaggagg

SEQ ID NO: 8448539 - DNA, 22 bp, Homo sapiens
tcctcccctgcccatgaggagg

SEQ ID NO: 8448540 - DNA, 22 bp, Homo sapiens
tcctccctgggagcttctgagt

SEQ ID NO: 8448541 - DNA, 22 bp, Homo sapiens
tcctccctgtaccattcctctg

SEQ ID NO: 8448542 - DNA, 22 bp, Homo sapiens
tcctccctaaatcctagactgt

SEQ ID NO: 8448543 - DNA, 22 bp, Homo sapiens
tcctccctaaatcctagactgt

SEQ ID NO: 8448544 - DNA, 23 bp, Homo sapiens
tcctcctgacacagcctgagtga

SEQ ID NO: 8448545 - DNA, 23 bp, Homo sapiens
tcctcctgacacagcctgagtga

SEQ ID NO: 8448546 - DNA, 19 bp, Homo sapiens
tcctccctttggtgtcctg

SEQ ID NO: 8448547 - DNA, 21 bp, Homo sapiens
tcctcctggccaggcggcccc

SEQ ID NO: 8448548 - DNA, 22 bp, Homo sapiens
tcctcctgcctttgcttcttgt

SEQ ID NO: 8448549 - DNA, 23 bp, Homo sapiens
tcctcctgagtgagagtgccagc

SEQ ID NO: 8448550 - DNA, 22 bp, Homo sapiens
tcctcctgctgttagtcttgaa

SEQ ID NO: 8448551 - DNA, 23 bp, Homo sapiens
tcctcctggatacaaagggaaca

SEQ ID NO: 8448552 - DNA, 22 bp, Homo sapiens
tcaattatttgatatgaaaggg

SEQ ID NO: 8448553 - DNA, 22 bp, Homo sapiens
tcaattatttgatatgaaaggg

SEQ ID NO: 8448554 - DNA, 22 bp, Homo sapiens
tcaattcaattgaacagttact

SEQ ID NO: 8448555 - DNA, 22 bp, Homo sapiens
tcaattcagtccaacagtaatt

SEQ ID NO: 8448556 - DNA, 22 bp, Homo sapiens
tcaattctagagccttacattg

SEQ ID NO: 8448557 - DNA, 22 bp, Homo sapiens
tcaattctagtggagagagttt

SEQ ID NO: 8448558 - DNA, 22 bp, Homo sapiens
tcaatgttcaagtatgacaatg

SEQ ID NO: 8448559 - DNA, 22 bp, Homo sapiens
tcaatgtttgttcatgaaaata

SEQ ID NO: 8448560 - DNA, 22 bp, Homo sapiens
tcaatgtttgttcatgaaaata

SEQ ID NO: 8448561 - DNA, 20 bp, Homo sapiens
tcaatgtaatcatatcatca

SEQ ID NO: 8448562 - DNA, 22 bp, Homo sapiens
tcaatgtaataaaatactctat

SEQ ID NO: 8448563 - DNA, 23 bp, Homo sapiens
tcaattatcaatggaaagaagtt

SEQ ID NO: 8448564 - DNA, 22 bp, Homo sapiens
tcaattactaaccaaataatgt

SEQ ID NO: 8448565 - DNA, 23 bp, Homo sapiens
tcaattatcaatggaaagaagtt

SEQ ID NO: 8448566 - DNA, 22 bp, Homo sapiens
tcacacacatttgctgtctgat

SEQ ID NO: 8448567 - DNA, 22 bp, Homo sapiens
tcacacacataatctaagatta

SEQ ID NO: 8448568 - DNA, 22 bp, Homo sapiens
tcaattctggtcctcaggaact

SEQ ID NO: 8448569 - DNA, 22 bp, Homo sapiens
tcaatttaaggtactactttgg

SEQ ID NO: 8448570 - DNA, 22 bp, Homo sapiens
tcacacagggtcggaaagagtg

SEQ ID NO: 8448571 - DNA, 23 bp, Homo sapiens
tcacacagctggtcaggtacaga

SEQ ID NO: 8448572 - DNA, 23 bp, Homo sapiens
tcacacagctggtcaggtacaga

SEQ ID NO: 8448573 - DNA, 22 bp, Homo sapiens
tcacacagctcctttccttagt

SEQ ID NO: 8448574 - DNA, 22 bp, Homo sapiens
tcacacagctagtaagggccga

SEQ ID NO: 8448575 - DNA, 22 bp, Homo sapiens
tcacacagcagccccgggtgtt

SEQ ID NO: 8448576 - DNA, 22 bp, Homo sapiens
tcaaacagcaggtctttcatag

SEQ ID NO: 8448577 - DNA, 22 bp, Homo sapiens
tcaaacagcaggtctttcatag

SEQ ID NO: 8448578 - DNA, 23 bp, Homo sapiens
tcaaacaggtttcagagcatctt

SEQ ID NO: 8448579 - DNA, 22 bp, Homo sapiens
tcaaacagcaggtctttcatag

SEQ ID NO: 8448580 - DNA, 22 bp, Homo sapiens
tcaaacataggcacacattcag

SEQ ID NO: 8448581 - DNA, 22 bp, Homo sapiens
tcaatgatagtacaatcagcct

SEQ ID NO: 8448582 - DNA, 22 bp, Homo sapiens
tcaatgcaatcattggacaagt

SEQ ID NO: 8448583 - DNA, 22 bp, Homo sapiens
tcaatgcatgtgacaaagagta

SEQ ID NO: 8448584 - DNA, 19 bp, Homo sapiens
tcaatgcatgaaatcagcc

SEQ ID NO: 8448585 - DNA, 21 bp, Homo sapiens
tcaatacaggtgcatgtgtct

SEQ ID NO: 8448586 - DNA, 22 bp, Homo sapiens
tcaaacctgctgtcttgttcat

SEQ ID NO: 8448587 - DNA, 22 bp, Homo sapiens
tcaaaaatggtctttgagctgc

SEQ ID NO: 8448588 - DNA, 20 bp, Homo sapiens
tcaaaataggtgtgggcgga

SEQ ID NO: 8448589 - DNA, 20 bp, Homo sapiens
tcaaaataggtgtgggcgga

SEQ ID NO: 8448590 - DNA, 22 bp, Homo sapiens
tcaaaatttcagcactagccct

SEQ ID NO: 8448591 - DNA, 22 bp, Homo sapiens
tcaaaatttcagcactagccct

SEQ ID NO: 8448592 - DNA, 22 bp, Homo sapiens
tcaaaattttatttctcaagga

SEQ ID NO: 8448593 - DNA, 22 bp, Homo sapiens
tcaaacactgtaacatggaaaa

SEQ ID NO: 8448594 - DNA, 22 bp, Homo sapiens
tcaaacagaggaacaattgttt

SEQ ID NO: 8448595 - DNA, 22 bp, Homo sapiens
tcaaacagaggaacaattgttt

SEQ ID NO: 8448596 - DNA, 18 bp, Homo sapiens
tcaaaatatttctgtgga

SEQ ID NO: 8448597 - DNA, 18 bp, Homo sapiens
tcaaaatatttctgtgga

SEQ ID NO: 8448598 - DNA, 22 bp, Homo sapiens
tcaaaattaaaccaacgtccag

SEQ ID NO: 8448599 - DNA, 22 bp, Homo sapiens
tcaaaattaaaccaacgtccag

SEQ ID NO: 8448600 - DNA, 22 bp, Homo sapiens
tcaaaattagtgaccaaaggca

SEQ ID NO: 8448601 - DNA, 22 bp, Homo sapiens
tcacagaatgtctagcataatt

SEQ ID NO: 8448602 - DNA, 22 bp, Homo sapiens
tcacagaatgtcagagttgggg

SEQ ID NO: 8448603 - DNA, 22 bp, Homo sapiens
tcacagaatgtctagcataatt

SEQ ID NO: 8448604 - DNA, 22 bp, Homo sapiens
tcacagaatttttgcttccagt

SEQ ID NO: 8448605 - DNA, 22 bp, Homo sapiens
tcacagacacagggagaagcat

SEQ ID NO: 8448606 - DNA, 22 bp, Homo sapiens
tcacagaattgacatgggaatc

SEQ ID NO: 8448607 - DNA, 22 bp, Homo sapiens
tcacagaatagcactgtaagcg

SEQ ID NO: 8448608 - DNA, 22 bp, Homo sapiens
tcacagaataaattgagaagac

SEQ ID NO: 8448609 - DNA, 18 bp, Homo sapiens
tcacagaatattgagtgg

SEQ ID NO: 8448610 - DNA, 20 bp, Homo sapiens
tcacagaatgcctgaagaag

SEQ ID NO: 8448611 - DNA, 22 bp, Homo sapiens
tcacagaatctctgataagtct

SEQ ID NO: 8448612 - DNA, 22 bp, Homo sapiens
tcacacagggttctggtctcat

SEQ ID NO: 8448613 - DNA, 22 bp, Homo sapiens
tcacacagggtcggaaagagtg

SEQ ID NO: 8448614 - DNA, 22 bp, Homo sapiens
tcacacaggtttgcaatgattt

SEQ ID NO: 8448615 - DNA, 22 bp, Homo sapiens
tcacacagtgagaaagtgcgga

SEQ ID NO: 8448616 - DNA, 22 bp, Homo sapiens
tcacacataaaaagaagactag

SEQ ID NO: 8448617 - DNA, 22 bp, Homo sapiens
tcacacatactcatgtgtgagt

SEQ ID NO: 8448618 - DNA, 20 bp, Homo sapiens
tcacacataagtgaacgcac

SEQ ID NO: 8448619 - DNA, 22 bp, Homo sapiens
tcacacatctcaggtgtttaat

SEQ ID NO: 8448620 - DNA, 23 bp, Homo sapiens
tcacagagcatactgcattttgc

SEQ ID NO: 8448621 - DNA, 22 bp, Homo sapiens
tcacagagaggttaagcagttg

SEQ ID NO: 8448622 - DNA, 22 bp, Homo sapiens
tcacagagaggttaagcagttg

SEQ ID NO: 8448623 - DNA, 22 bp, Homo sapiens
tcacagagaactataatccatc

SEQ ID NO: 8448624 - DNA, 22 bp, Homo sapiens
tcacagacatggtgaggtaaca

SEQ ID NO: 8448625 - DNA, 22 bp, Homo sapiens
tcacagacaccttggccacagt

SEQ ID NO: 8448626 - DNA, 22 bp, Homo sapiens
tcacagacacattaaacatgtg

SEQ ID NO: 8448627 - DNA, 19 bp, Homo sapiens
tcacagacagagcaatcac

SEQ ID NO: 8448628 - DNA, 20 bp, Homo sapiens
tcacatcctctcccaacatg

SEQ ID NO: 8448629 - DNA, 22 bp, Homo sapiens
tcacatctaattccatttctgc

SEQ ID NO: 8448630 - DNA, 22 bp, Homo sapiens
tcacatctaattcggttaggtt

SEQ ID NO: 8448631 - DNA, 21 bp, Homo sapiens
tcacatctatgttaagcaaac

SEQ ID NO: 8448632 - DNA, 22 bp, Homo sapiens
tcacatctatacccaataattt

SEQ ID NO: 8448633 - DNA, 22 bp, Homo sapiens
tcacatctatacccaataattt

SEQ ID NO: 8448634 - DNA, 22 bp, Homo sapiens
tcacatctctcattgcctctgc

SEQ ID NO: 8448635 - DNA, 22 bp, Homo sapiens
tcacatctctgttttctaaatc

SEQ ID NO: 8448636 - DNA, 22 bp, Homo sapiens
tcacatctctgttttctaaatc

SEQ ID NO: 8448637 - DNA, 22 bp, Homo sapiens
tcacatctccatgtgttgttca

SEQ ID NO: 8448638 - DNA, 22 bp, Homo sapiens
tcacatctccctggaggacaca

SEQ ID NO: 8448639 - DNA, 23 bp, Homo sapiens
tcacatctgccgtagtgtattct

SEQ ID NO: 8448640 - DNA, 22 bp, Homo sapiens
tcacatctgattagtgactgat

SEQ ID NO: 8448641 - DNA, 22 bp, Homo sapiens
tcacatctgcaaaatccctttt

SEQ ID NO: 8448642 - DNA, 22 bp, Homo sapiens
tcacatctgaaaaaatattgag

SEQ ID NO: 8448643 - DNA, 22 bp, Homo sapiens
tcacagcctggacagttgcctg

SEQ ID NO: 8448644 - DNA, 22 bp, Homo sapiens
tcacagcctggtcactctgccc

SEQ ID NO: 8448645 - DNA, 22 bp, Homo sapiens
tcacagcctggacagttgcctg

SEQ ID NO: 8448646 - DNA, 22 bp, Homo sapiens
tcacatcaacattatagcatga

SEQ ID NO: 8448647 - DNA, 22 bp, Homo sapiens
tcacatcacatgagtgcaagga

SEQ ID NO: 8448648 - DNA, 17 bp, Homo sapiens
tcacatcacacaagcaa

SEQ ID NO: 8448649 - DNA, 22 bp, Homo sapiens
tcacatcacatgacagtaggcc

SEQ ID NO: 8448650 - DNA, 22 bp, Homo sapiens
tcacagcagggtaacaggaaga

SEQ ID NO: 8448651 - DNA, 22 bp, Homo sapiens
tcacagcattcgcaatggacag

SEQ ID NO: 8448652 - DNA, 22 bp, Homo sapiens
tcacagcattgagtgtactaga

SEQ ID NO: 8448653 - DNA, 22 bp, Homo sapiens
tcacagcattgtcacaaggctg

SEQ ID NO: 8448654 - DNA, 22 bp, Homo sapiens
tcactggggccatgtgagggac

SEQ ID NO: 8448655 - DNA, 22 bp, Homo sapiens
tcactggcaacttgtgctccct

SEQ ID NO: 8448656 - DNA, 22 bp, Homo sapiens
tcactgggagatgtgggaaggg

SEQ ID NO: 8448657 - DNA, 20 bp, Homo sapiens
tcactggccagagtagccct

SEQ ID NO: 8448658 - DNA, 22 bp, Homo sapiens
tcactgggagagctgacaagga

SEQ ID NO: 8448659 - DNA, 22 bp, Homo sapiens
tcactgggagagctgacaagga

SEQ ID NO: 8448660 - DNA, 22 bp, Homo sapiens
tcactgctttcaaaaattattg

SEQ ID NO: 8448661 - DNA, 22 bp, Homo sapiens
tcactaagttacatttagtatt

SEQ ID NO: 8448662 - DNA, 22 bp, Homo sapiens
tcactaagtgccgagtttagtt

SEQ ID NO: 8448663 - DNA, 22 bp, Homo sapiens
tcactaaagttggagaagagct

SEQ ID NO: 8448664 - DNA, 22 bp, Homo sapiens
tcactggggcctttggtcagga

SEQ ID NO: 8448665 - DNA, 22 bp, Homo sapiens
tcactggtgtgagaggagcaaa

SEQ ID NO: 8448666 - DNA, 22 bp, Homo sapiens
tcactggtgtgagaggagcaaa

SEQ ID NO: 8448667 - DNA, 20 bp, Homo sapiens
tcactgtaattgcctacatt

SEQ ID NO: 8448668 - DNA, 22 bp, Homo sapiens
tcactgtgaatgttatcatctt

SEQ ID NO: 8448669 - DNA, 22 bp, Homo sapiens
tcagaacatcctggtttaaaat

SEQ ID NO: 8448670 - DNA, 22 bp, Homo sapiens
tcagaacatcctggtttaaaat

SEQ ID NO: 8448671 - DNA, 22 bp, Homo sapiens
tcagaacatcccagatagtaga

SEQ ID NO: 8448672 - DNA, 22 bp, Homo sapiens
tcagaacagtgcctggcactaa

SEQ ID NO: 8448673 - DNA, 22 bp, Homo sapiens
tcagaacagttcttaatattgc

SEQ ID NO: 8448674 - DNA, 23 bp, Homo sapiens
tcagaacagttcttggtgcatag

SEQ ID NO: 8448675 - DNA, 22 bp, Homo sapiens
tcacatgagtattattttccaa

SEQ ID NO: 8448676 - DNA, 22 bp, Homo sapiens
tcacatcttggattacaatttt

SEQ ID NO: 8448677 - DNA, 22 bp, Homo sapiens
tcacatcttgtgatgttttcat

SEQ ID NO: 8448678 - DNA, 22 bp, Homo sapiens
tcacatctttaggcttacaggt

SEQ ID NO: 8448679 - DNA, 20 bp, Homo sapiens
tcacatctggcagctgatga

SEQ ID NO: 8448680 - DNA, 22 bp, Homo sapiens
tcacatctgtgtgattgtcatt

SEQ ID NO: 8448681 - DNA, 22 bp, Homo sapiens
tcacatctgcctccatagcacc

SEQ ID NO: 8448682 - DNA, 22 bp, Homo sapiens
tcacatctgcctccatagcacc

SEQ ID NO: 8448683 - DNA, 22 bp, Homo sapiens
tcacatctgttgatacagcatc

SEQ ID NO: 8448684 - DNA, 22 bp, Homo sapiens
tcacatctgtgtgattgtcatt

SEQ ID NO: 8448685 - DNA, 22 bp, Homo sapiens
tcacatcttattagagtatctc

SEQ ID NO: 8448686 - DNA, 22 bp, Homo sapiens
tcacatcttagtttgggactct

SEQ ID NO: 8448687 - DNA, 22 bp, Homo sapiens
tcacatgccctacctaatctta

SEQ ID NO: 8448688 - DNA, 22 bp, Homo sapiens
tcacatgagtcactatcttaat

SEQ ID NO: 8448689 - DNA, 22 bp, Homo sapiens
tcacgtgagggacctgtgtctg

SEQ ID NO: 8448690 - DNA, 22 bp, Homo sapiens
tcaccttgtgatctccctgcct

SEQ ID NO: 8448691 - DNA, 21 bp, Homo sapiens
tcacctggcttctgacctggc

SEQ ID NO: 8448692 - DNA, 22 bp, Homo sapiens
tcacctaattgaagtcaggagt

SEQ ID NO: 8448693 - DNA, 22 bp, Homo sapiens
tcacctgggagggctgtggtag

SEQ ID NO: 8448694 - DNA, 22 bp, Homo sapiens
tcaccgaggctggagtgcagtg

SEQ ID NO: 8448695 - DNA, 22 bp, Homo sapiens
tcacccttcccagctgtccgcc

SEQ ID NO: 8448696 - DNA, 22 bp, Homo sapiens
tcacccctccattctctcatgt

SEQ ID NO: 8448697 - DNA, 22 bp, Homo sapiens
tcagagaagtaaggtggggtgc

SEQ ID NO: 8448698 - DNA, 22 bp, Homo sapiens
tcagagaaggtaagtgacctgc

SEQ ID NO: 8448699 - DNA, 22 bp, Homo sapiens
tcagagaaggtaagtgacctgc

SEQ ID NO: 8448700 - DNA, 22 bp, Homo sapiens
tcagagaagtaggctaatggtg

SEQ ID NO: 8448701 - DNA, 23 bp, Homo sapiens
tcagagaagttgtaggctgggga

SEQ ID NO: 8448702 - DNA, 20 bp, Homo sapiens
tcagagaagggactgagatt

SEQ ID NO: 8448703 - DNA, 22 bp, Homo sapiens
tcagagacaccagagagctgtg

SEQ ID NO: 8448704 - DNA, 22 bp, Homo sapiens
tcagagaattctcagatgactc

SEQ ID NO: 8448705 - DNA, 22 bp, Homo sapiens
tcagagaattgtttaatggaat

SEQ ID NO: 8448706 - DNA, 22 bp, Homo sapiens
tcagagaattcgattaaatgca

SEQ ID NO: 8448707 - DNA, 22 bp, Homo sapiens
tcagagaatctctccttagttt

SEQ ID NO: 8448708 - DNA, 23 bp, Homo sapiens
tcagagaatggtatgcttttcct

SEQ ID NO: 8448709 - DNA, 22 bp, Homo sapiens
tcagaaccagcccagcagatga

SEQ ID NO: 8448710 - DNA, 22 bp, Homo sapiens
tcagaaccagcccagcagatga

SEQ ID NO: 8448711 - DNA, 22 bp, Homo sapiens
tcagaacctgcaagtctaacct

SEQ ID NO: 8448712 - DNA, 22 bp, Homo sapiens
tcagaacattctcattgactgc

SEQ ID NO: 8448713 - DNA, 22 bp, Homo sapiens
tcagaacatttaaaaagtggtt

SEQ ID NO: 8448714 - DNA, 22 bp, Homo sapiens
tcagaacattaaggatttgaag

SEQ ID NO: 8448715 - DNA, 22 bp, Homo sapiens
tcagaacatggcatgttccatc

SEQ ID NO: 8448716 - DNA, 22 bp, Homo sapiens
tcagaactggtatttatcaagg

SEQ ID NO: 8448717 - DNA, 22 bp, Homo sapiens
tcagaagcaagcttctacttct

SEQ ID NO: 8448718 - DNA, 22 bp, Homo sapiens
tcagaggctcatctgccttgca

SEQ ID NO: 8448719 - DNA, 22 bp, Homo sapiens
tcagaggccaaactgagcaggg

SEQ ID NO: 8448720 - DNA, 22 bp, Homo sapiens
tcagaggagaccaaggggaata

SEQ ID NO: 8448721 - DNA, 22 bp, Homo sapiens
tcagaggattgcctcagcgagc

SEQ ID NO: 8448722 - DNA, 19 bp, Homo sapiens
tcagaggatttggctatga

SEQ ID NO: 8448723 - DNA, 22 bp, Homo sapiens
tcagaggaccttactgagaacc

SEQ ID NO: 8448724 - DNA, 22 bp, Homo sapiens
tcagaggactaccttctccagt

SEQ ID NO: 8448725 - DNA, 22 bp, Homo sapiens
tcagaggactaccttctccagt

SEQ ID NO: 8448726 - DNA, 22 bp, Homo sapiens
tcagaggagaagttgggaaaat

SEQ ID NO: 8448727 - DNA, 22 bp, Homo sapiens
tcagaggaagccttggtgggag

SEQ ID NO: 8448728 - DNA, 22 bp, Homo sapiens
tcagaggaataatgctgcattt

SEQ ID NO: 8448729 - DNA, 22 bp, Homo sapiens
tcagaggacaagctccctggtg

SEQ ID NO: 8448730 - DNA, 22 bp, Homo sapiens
tcagaggacagcagctaaataa

SEQ ID NO: 8448731 - DNA, 22 bp, Homo sapiens
tcagaggacagcagctaaataa

SEQ ID NO: 8448732 - DNA, 22 bp, Homo sapiens
tcagagacagttctggggcagg

SEQ ID NO: 8448733 - DNA, 22 bp, Homo sapiens
tcagagactgtaggagcagcct

SEQ ID NO: 8448734 - DNA, 22 bp, Homo sapiens
tcagagactggtctgcagatgc

SEQ ID NO: 8448735 - DNA, 22 bp, Homo sapiens
tcagagacaccagagagctgtg

SEQ ID NO: 8448736 - DNA, 22 bp, Homo sapiens
tcagagactgtaggagcagcct

SEQ ID NO: 8448737 - DNA, 22 bp, Homo sapiens
tcagagagcctcaggcactgcc

SEQ ID NO: 8448738 - DNA, 22 bp, Homo sapiens
tcagagagcctcaggcactgcc

SEQ ID NO: 8448739 - DNA, 22 bp, Homo sapiens
tcagggagagcctgtctgacgt

SEQ ID NO: 8448740 - DNA, 22 bp, Homo sapiens
tcagggcaaaagggaaaccatt

SEQ ID NO: 8448741 - DNA, 22 bp, Homo sapiens
tcaggctgaggtcatctgcatc

SEQ ID NO: 8448742 - DNA, 22 bp, Homo sapiens
tcaggctgaggtcatctgcatc

SEQ ID NO: 8448743 - DNA, 22 bp, Homo sapiens
tcaggctgaggtcatctgcatc

SEQ ID NO: 8448744 - DNA, 22 bp, Homo sapiens
tcaggctgagaaaatctggacc

SEQ ID NO: 8448745 - DNA, 22 bp, Homo sapiens
tcaggctgagaaaatctggacc

SEQ ID NO: 8448746 - DNA, 22 bp, Homo sapiens
tcaggctgaccaggttttgctc

SEQ ID NO: 8448747 - DNA, 22 bp, Homo sapiens
tcaggctgaccaggttttgctc

SEQ ID NO: 8448748 - DNA, 22 bp, Homo sapiens
tcaggctgaaggaggcctatct

SEQ ID NO: 8448749 - DNA, 22 bp, Homo sapiens
tcaggctgaaggaggcctatct

SEQ ID NO: 8448750 - DNA, 22 bp, Homo sapiens
tcaggctgaatcatcctagctt

SEQ ID NO: 8448751 - DNA, 22 bp, Homo sapiens
tcaggctgaatcatcctagctt

SEQ ID NO: 8448752 - DNA, 22 bp, Homo sapiens
tcaggctctgagctgatgctaa

SEQ ID NO: 8448753 - DNA, 22 bp, Homo sapiens
tcaggctctgccacctagatta

SEQ ID NO: 8448754 - DNA, 22 bp, Homo sapiens
tcaggctctgggtacacctgac

SEQ ID NO: 8448755 - DNA, 22 bp, Homo sapiens
tcaggctgaaaggactccagtt

SEQ ID NO: 8448756 - DNA, 22 bp, Homo sapiens
tcaggctgaaaggactccagtt

SEQ ID NO: 8448757 - DNA, 22 bp, Homo sapiens
tcaggctcaggttaggggccaa

SEQ ID NO: 8448758 - DNA, 22 bp, Homo sapiens
tcaggctccctgctgggctctg

SEQ ID NO: 8448759 - DNA, 20 bp, Homo sapiens
tcaggctccgcattaactta

SEQ ID NO: 8448760 - DNA, 22 bp, Homo sapiens
tcaggctctacacttgacacac

SEQ ID NO: 8448761 - DNA, 22 bp, Homo sapiens
tcaggctctcagaccaacagca

SEQ ID NO: 8448762 - DNA, 18 bp, Homo sapiens
tcaggctctctggctaga

SEQ ID NO: 8448763 - DNA, 22 bp, Homo sapiens
tcaggcctttcttcagagcttc

SEQ ID NO: 8448764 - DNA, 22 bp, Homo sapiens
tcaggctcaaagggccggatga

SEQ ID NO: 8448765 - DNA, 22 bp, Homo sapiens
tcaggctcaggaatgtgtttat

SEQ ID NO: 8448766 - DNA, 22 bp, Homo sapiens
tcagggctggcttttgcagagc

SEQ ID NO: 8448767 - DNA, 22 bp, Homo sapiens
tcagggctgccgggcagaccgt

SEQ ID NO: 8448768 - DNA, 22 bp, Homo sapiens
tcagggctgccgggcagaccgt

SEQ ID NO: 8448769 - DNA, 22 bp, Homo sapiens
tcagggctgccgggcagaccgt

SEQ ID NO: 8448770 - DNA, 22 bp, Homo sapiens
tcagggctttggcttttactct

SEQ ID NO: 8448771 - DNA, 22 bp, Homo sapiens
tcaggggcttgaggtgcatgtc

SEQ ID NO: 8448772 - DNA, 22 bp, Homo sapiens
tcaggggcagccggggaagcca

SEQ ID NO: 8448773 - DNA, 22 bp, Homo sapiens
tcaggtcaggaaaataagattg

SEQ ID NO: 8448774 - DNA, 22 bp, Homo sapiens
tcagggggaggagactgccagt

SEQ ID NO: 8448775 - DNA, 22 bp, Homo sapiens
tcagggtaaaccttcactgtga

SEQ ID NO: 8448776 - DNA, 22 bp, Homo sapiens
tcagtgcatggacagatttaga

SEQ ID NO: 8448777 - DNA, 22 bp, Homo sapiens
tcagtgcatcacagaactttgt

SEQ ID NO: 8448778 - DNA, 22 bp, Homo sapiens
tcagtgcattcatgggtggctg

SEQ ID NO: 8448779 - DNA, 22 bp, Homo sapiens
tcagtgcattaataatatcagt

SEQ ID NO: 8448780 - DNA, 22 bp, Homo sapiens
tcagtgcagtgaaaggtttact

SEQ ID NO: 8448781 - DNA, 22 bp, Homo sapiens
tcaggtcttttgtctcctagaa

SEQ ID NO: 8448782 - DNA, 22 bp, Homo sapiens
tcaggtctatagaagaggaggg

SEQ ID NO: 8448783 - DNA, 22 bp, Homo sapiens
tcaggtctatactatgagaggc

SEQ ID NO: 8448784 - DNA, 22 bp, Homo sapiens
tcaggtcttgagccatcaggat

SEQ ID NO: 8448785 - DNA, 22 bp, Homo sapiens
tcaggtcttttgtctcctagaa

SEQ ID NO: 8448786 - DNA, 22 bp, Homo sapiens
tcaggtctatagaagaggaggg

SEQ ID NO: 8448787 - DNA, 22 bp, Homo sapiens
tcaggtctgtactattgtcttg

SEQ ID NO: 8448788 - DNA, 22 bp, Homo sapiens
tcaggtctgggcacatggtaca

SEQ ID NO: 8448789 - DNA, 22 bp, Homo sapiens
tcaggtctgatgcctcatccat

SEQ ID NO: 8448790 - DNA, 22 bp, Homo sapiens
tcataaacacactagtatgatt

SEQ ID NO: 8448791 - DNA, 22 bp, Homo sapiens
tcataaaatgctcctgatattg

SEQ ID NO: 8448792 - DNA, 22 bp, Homo sapiens
tcataaaatgctcctgatattg

SEQ ID NO: 8448793 - DNA, 22 bp, Homo sapiens
tcataaaatgctcctgatattg

SEQ ID NO: 8448794 - DNA, 22 bp, Homo sapiens
tcataaaagtactcatgttcat

SEQ ID NO: 8448795 - DNA, 20 bp, Homo sapiens
tcatccaggacaggagtggc

SEQ ID NO: 8448796 - DNA, 21 bp, Homo sapiens
tcatccaggtcctgcttcttc

SEQ ID NO: 8448797 - DNA, 20 bp, Homo sapiens
tcatccaggacaggagtggc

SEQ ID NO: 8448798 - DNA, 23 bp, Homo sapiens
tcatcaaacagctgctcaagaaa

SEQ ID NO: 8448799 - DNA, 22 bp, Homo sapiens
tcatctaagagtcttacattta

SEQ ID NO: 8448800 - DNA, 22 bp, Homo sapiens
tcatctcagagaggtatgttag

SEQ ID NO: 8448801 - DNA, 22 bp, Homo sapiens
tcatctctagacaggaggctgg

SEQ ID NO: 8448802 - DNA, 22 bp, Homo sapiens
tcatctctcaggataccagcag

SEQ ID NO: 8448803 - DNA, 22 bp, Homo sapiens
tcatctctccccagtgtcttta

SEQ ID NO: 8448804 - DNA, 22 bp, Homo sapiens
tcatctcttttgtattggggtt

SEQ ID NO: 8448805 - DNA, 22 bp, Homo sapiens
tcatccctctgccaggcccagg

SEQ ID NO: 8448806 - DNA, 20 bp, Homo sapiens
tcatccagttggtttatggt

SEQ ID NO: 8448807 - DNA, 22 bp, Homo sapiens
tcatccagttgtggagagggaa

SEQ ID NO: 8448808 - DNA, 22 bp, Homo sapiens
tcatccagttgtggagagggaa

SEQ ID NO: 8448809 - DNA, 22 bp, Homo sapiens
tcatccagtatgactggtgtct

SEQ ID NO: 8448810 - DNA, 22 bp, Homo sapiens
tcatccagttcacatggtgagt

SEQ ID NO: 8448811 - DNA, 22 bp, Homo sapiens
tcagttttctcatctgtaattt

SEQ ID NO: 8448812 - DNA, 22 bp, Homo sapiens
tcataaaaatagactctaaagt

SEQ ID NO: 8448813 - DNA, 22 bp, Homo sapiens
tcagtgcttgcctctggaggag

SEQ ID NO: 8448814 - DNA, 22 bp, Homo sapiens
tcagtgcttttgagaagctcct

SEQ ID NO: 8448815 - DNA, 19 bp, Homo sapiens
tcagtggagaaaggggaag

SEQ ID NO: 8448816 - DNA, 22 bp, Homo sapiens
tcagtggaactgtctgggtgag

SEQ ID NO: 8448817 - DNA, 22 bp, Homo sapiens
tcagttactctgatgtcctgtg

SEQ ID NO: 8448818 - DNA, 22 bp, Homo sapiens
tcagttactcaacagaggtgga

SEQ ID NO: 8448819 - DNA, 22 bp, Homo sapiens
tcagcctgcgtcatggtgacac

SEQ ID NO: 8448820 - DNA, 22 bp, Homo sapiens
tcagctgtaggtatggatgtcc

SEQ ID NO: 8448821 - DNA, 22 bp, Homo sapiens
tcagctgtgtatcccagggcct

SEQ ID NO: 8448822 - DNA, 22 bp, Homo sapiens
tcagcttatatttttagtgtaa

SEQ ID NO: 8448823 - DNA, 22 bp, Homo sapiens
tcagcttggacagcttggttga

SEQ ID NO: 8448824 - DNA, 22 bp, Homo sapiens
tcagcccttgatgtttgggggt

SEQ ID NO: 8448825 - DNA, 22 bp, Homo sapiens
tcagccagtttgtttattccgg

SEQ ID NO: 8448826 - DNA, 21 bp, Homo sapiens
tcagagggccctggaggctca

SEQ ID NO: 8448827 - DNA, 17 bp, Homo sapiens
tcagagggatgagcagg

SEQ ID NO: 8448828 - DNA, 17 bp, Homo sapiens
tcagagggatgagcagg

SEQ ID NO: 8448829 - DNA, 22 bp, Homo sapiens
tcagagggtggctgggagcatc

SEQ ID NO: 8448830 - DNA, 22 bp, Homo sapiens
tcagaggtcagcagcttgccca

SEQ ID NO: 8448831 - DNA, 22 bp, Homo sapiens
tcagaggtgcaagaagttctga

SEQ ID NO: 8448832 - DNA, 22 bp, Homo sapiens
tcagaggtggagatagttggga

SEQ ID NO: 8448833 - DNA, 22 bp, Homo sapiens
tcagagggtggctgggagcatc

SEQ ID NO: 8448834 - DNA, 22 bp, Homo sapiens
tcagaggtaaaaactcactgta

SEQ ID NO: 8448835 - DNA, 22 bp, Homo sapiens
tcagagtcattgcaagtagaag

SEQ ID NO: 8448836 - DNA, 22 bp, Homo sapiens
tcagagtcctcaccctgaggat

SEQ ID NO: 8448837 - DNA, 22 bp, Homo sapiens
tcagagtccatggtacttaatt

SEQ ID NO: 8448838 - DNA, 22 bp, Homo sapiens
tcagagtctaaatagaagaata

SEQ ID NO: 8448839 - DNA, 22 bp, Homo sapiens
tcagagtctatgcaacagaatt

SEQ ID NO: 8448840 - DNA, 22 bp, Homo sapiens
tcagagtctaaatagaagaata

SEQ ID NO: 8448841 - DNA, 22 bp, Homo sapiens
tcagagtctatgcaacagaatt

SEQ ID NO: 8448842 - DNA, 21 bp, Homo sapiens
tcagagtctcaggagcaaggg

SEQ ID NO: 8448843 - DNA, 22 bp, Homo sapiens
tcagagtcttaactattcagag

SEQ ID NO: 8448844 - DNA, 22 bp, Homo sapiens
tcagagtcttggcaataggtta

SEQ ID NO: 8448845 - DNA, 22 bp, Homo sapiens
tcagagtgaggcccagcaatct

SEQ ID NO: 8448846 - DNA, 22 bp, Homo sapiens
tcagagtgaggcgtcaacatga

SEQ ID NO: 8448847 - DNA, 23 bp, Homo sapiens
tcagagtagcaatttttctctcc

SEQ ID NO: 8448848 - DNA, 22 bp, Homo sapiens
tcagagtatttcattcttaggt

SEQ ID NO: 8448849 - DNA, 20 bp, Homo sapiens
tcagagtcatcaaagatggt

SEQ ID NO: 8448850 - DNA, 23 bp, Homo sapiens
tcagagtagcaatttttctctcc

SEQ ID NO: 8448851 - DNA, 22 bp, Homo sapiens
tcagagtatttcattcttaggt

SEQ ID NO: 8448852 - DNA, 22 bp, Homo sapiens
tcagaggtggtaaaggacagca

SEQ ID NO: 8448853 - DNA, 22 bp, Homo sapiens
tcagccagtatttgagtgctca

SEQ ID NO: 8448854 - DNA, 22 bp, Homo sapiens
tcaggaaagagtgtatccatca

SEQ ID NO: 8448855 - DNA, 22 bp, Homo sapiens
tcaggaaagagttagatgatta

SEQ ID NO: 8448856 - DNA, 22 bp, Homo sapiens
tcaggaaaggtttgttgaatgg

SEQ ID NO: 8448857 - DNA, 22 bp, Homo sapiens
tcaggaaagcctagaagagaac

SEQ ID NO: 8448858 - DNA, 22 bp, Homo sapiens
tcaggagcaacatctttgaatc

SEQ ID NO: 8448859 - DNA, 22 bp, Homo sapiens
tcaggagcaacatctttgaatc

SEQ ID NO: 8448860 - DNA, 22 bp, Homo sapiens
tcaggagcagccttggagagcg

SEQ ID NO: 8448861 - DNA, 22 bp, Homo sapiens
tcaggagcagccttggagagcg

SEQ ID NO: 8448862 - DNA, 22 bp, Homo sapiens
tcaggagcagccttggagagcg

SEQ ID NO: 8448863 - DNA, 22 bp, Homo sapiens
tcaggagcagctgtaggaaggg

SEQ ID NO: 8448864 - DNA, 22 bp, Homo sapiens
tcaggagatgtaaccttagctg

SEQ ID NO: 8448865 - DNA, 22 bp, Homo sapiens
tcaggaaatggacatctttgct

SEQ ID NO: 8448866 - DNA, 22 bp, Homo sapiens
tcaggaaatggtgatttggttg

SEQ ID NO: 8448867 - DNA, 22 bp, Homo sapiens
tcaggaaattaaacacttgaaa

SEQ ID NO: 8448868 - DNA, 22 bp, Homo sapiens
tcaggagagtgttcagtggagg

SEQ ID NO: 8448869 - DNA, 22 bp, Homo sapiens
tcaggagcttagatgctttgac

SEQ ID NO: 8448870 - DNA, 22 bp, Homo sapiens
tcaggagctgtgaatacaaagg

SEQ ID NO: 8448871 - DNA, 22 bp, Homo sapiens
tcaggagctgcattatcctgtg

SEQ ID NO: 8448872 - DNA, 22 bp, Homo sapiens
tcaggagctcaggctgatggaa

SEQ ID NO: 8448873 - DNA, 22 bp, Homo sapiens
tcaggagctcaggctgatggaa

SEQ ID NO: 8448874 - DNA, 22 bp, Homo sapiens
tcaggagctcttccctggtgtg

SEQ ID NO: 8448875 - DNA, 22 bp, Homo sapiens
tcaggagctatggactgtcaaa

SEQ ID NO: 8448876 - DNA, 22 bp, Homo sapiens
tcaggagctatggactgtcaaa

SEQ ID NO: 8448877 - DNA, 22 bp, Homo sapiens
tcaggagctcaggctgatggaa

SEQ ID NO: 8448878 - DNA, 20 bp, Homo sapiens
tcaggagcctaggacatgat

SEQ ID NO: 8448879 - DNA, 22 bp, Homo sapiens
tcaggagcatatattgatgtct

SEQ ID NO: 8448880 - DNA, 20 bp, Homo sapiens
tcaggagcctaggacatgat

SEQ ID NO: 8448881 - DNA, 22 bp, Homo sapiens
tcaggagctatggactgtcaaa

SEQ ID NO: 8448882 - DNA, 22 bp, Homo sapiens
tcaggagcctgaaagaggtcta

SEQ ID NO: 8448883 - DNA, 22 bp, Homo sapiens
tcaggagcctgaaagaggtcta

SEQ ID NO: 8448884 - DNA, 22 bp, Homo sapiens
tcaggagcagggggaagctctg

SEQ ID NO: 8448885 - DNA, 19 bp, Homo sapiens
tcaggagcagcttctgaac

SEQ ID NO: 8448886 - DNA, 22 bp, Homo sapiens
tcaggagcagctgtaggaaggg

SEQ ID NO: 8448887 - DNA, 22 bp, Homo sapiens
tcaggagcagggggaagctctg

SEQ ID NO: 8448888 - DNA, 22 bp, Homo sapiens
tcaggagcagggtctgttacca

SEQ ID NO: 8448889 - DNA, 22 bp, Homo sapiens
tcaggagcagggggaagctctg

SEQ ID NO: 8448890 - DNA, 22 bp, Homo sapiens
tcaggaggatgtcggcaaattt

SEQ ID NO: 8448891 - DNA, 22 bp, Homo sapiens
tcaggaggatgtcggcaaattt

SEQ ID NO: 8448892 - DNA, 22 bp, Homo sapiens
tcaggagggctaagactgtagc

SEQ ID NO: 8448893 - DNA, 22 bp, Homo sapiens
tcaggcaatctgacagctggag

SEQ ID NO: 8448894 - DNA, 22 bp, Homo sapiens
tcaggaggtaggacatactggt

SEQ ID NO: 8448895 - DNA, 22 bp, Homo sapiens
tcaggcagagttaatttgctcc

SEQ ID NO: 8448896 - DNA, 22 bp, Homo sapiens
tcaggcagagttaatttgctcc

SEQ ID NO: 8448897 - DNA, 22 bp, Homo sapiens
tcaggcactgctttctgatatg

SEQ ID NO: 8448898 - DNA, 22 bp, Homo sapiens
tcaggcagatgcagggatggat

SEQ ID NO: 8448899 - DNA, 22 bp, Homo sapiens
tcaggcagatgcagggatggat

SEQ ID NO: 8448900 - DNA, 22 bp, Homo sapiens
tcaggcagcattaaacttcagc

SEQ ID NO: 8448901 - DNA, 22 bp, Homo sapiens
tcaggcagctccaggaatggta

SEQ ID NO: 8448902 - DNA, 23 bp, Homo sapiens
tcaggcagctggggtagttggag

SEQ ID NO: 8448903 - DNA, 22 bp, Homo sapiens
tcaggcagctccaggaatggta

SEQ ID NO: 8448904 - DNA, 22 bp, Homo sapiens
tcaggcaggaagcccctgcaca

SEQ ID NO: 8448905 - DNA, 22 bp, Homo sapiens
tcaggcaggaagggaggacttg

SEQ ID NO: 8448906 - DNA, 22 bp, Homo sapiens
tcaggcaggatcccagggaagg

SEQ ID NO: 8448907 - DNA, 22 bp, Homo sapiens
tcaggcaggacaattatttagg

SEQ ID NO: 8448908 - DNA, 21 bp, Homo sapiens
tcaggcaggcgcagagggaag

SEQ ID NO: 8448909 - DNA, 22 bp, Homo sapiens
tcaggcaggcagagggcaaatg

SEQ ID NO: 8448910 - DNA, 21 bp, Homo sapiens
tcaggcaggtcccactgaaca

SEQ ID NO: 8448911 - DNA, 22 bp, Homo sapiens
tcaggcaggtggctggctatgg

SEQ ID NO: 8448912 - DNA, 21 bp, Homo sapiens
tcaggcaggcgcagagggaag

SEQ ID NO: 8448913 - DNA, 22 bp, Homo sapiens
tcaggcaggctcagaggaaaac

SEQ ID NO: 8448914 - DNA, 22 bp, Homo sapiens
tcaggcaggttggctgcaggtc

SEQ ID NO: 8448915 - DNA, 22 bp, Homo sapiens
tcaggcaggttggctgcaggtc

SEQ ID NO: 8448916 - DNA, 22 bp, Homo sapiens
tcaggcaggtggctggctatgg

SEQ ID NO: 8448917 - DNA, 22 bp, Homo sapiens
tcaggccttgtcctgacctcct

SEQ ID NO: 8448918 - DNA, 22 bp, Homo sapiens
tcaggcagtagaattgcttgaa

SEQ ID NO: 8448919 - DNA, 22 bp, Homo sapiens
ttctaaattttggaagatgcag

SEQ ID NO: 8448920 - DNA, 22 bp, Homo sapiens
ttctaaattttggaagatgcag

SEQ ID NO: 8448921 - DNA, 22 bp, Homo sapiens
ttctaaattttggaagatgcag

SEQ ID NO: 8448922 - DNA, 22 bp, Homo sapiens
ttctaactctgttatgtgtttc

SEQ ID NO: 8448923 - DNA, 22 bp, Homo sapiens
ttctaactctacactagctttg

SEQ ID NO: 8448924 - DNA, 22 bp, Homo sapiens
ttctaaatgtaaatagtatgat

SEQ ID NO: 8448925 - DNA, 20 bp, Homo sapiens
ttcgctgggagtggccaggc

SEQ ID NO: 8448926 - DNA, 22 bp, Homo sapiens
ttcggcatattaatggtgggtg

SEQ ID NO: 8448927 - DNA, 22 bp, Homo sapiens
ttcgtttagtccacaaatgcat

SEQ ID NO: 8448928 - DNA, 22 bp, Homo sapiens
ttctaaaaccaattctgcttct

SEQ ID NO: 8448929 - DNA, 22 bp, Homo sapiens
ttctaaacttcaattctaaatt

SEQ ID NO: 8448930 - DNA, 22 bp, Homo sapiens
ttctaaactgaagtattttaaa

SEQ ID NO: 8448931 - DNA, 20 bp, Homo sapiens
ttctaaactgttaggcttgc

SEQ ID NO: 8448932 - DNA, 22 bp, Homo sapiens
ttccttgttgaaaatgtctgca

SEQ ID NO: 8448933 - DNA, 22 bp, Homo sapiens
ttccttgttgaaaatgtctgca

SEQ ID NO: 8448934 - DNA, 22 bp, Homo sapiens
ttccctgcaacctttccctggg

SEQ ID NO: 8448935 - DNA, 22 bp, Homo sapiens
ttccctctttcactgtgatttt

SEQ ID NO: 8448936 - DNA, 22 bp, Homo sapiens
ttccctcttttccaacagttgt

SEQ ID NO: 8448937 - DNA, 22 bp, Homo sapiens
ttcctttagtgtcatatacttt

SEQ ID NO: 8448938 - DNA, 22 bp, Homo sapiens
ttcctttagtgtcatatacttt

SEQ ID NO: 8448939 - DNA, 22 bp, Homo sapiens
ttcgcagggagacaggctctct

SEQ ID NO: 8448940 - DNA, 22 bp, Homo sapiens
ttccctctcacttaaagcttgg

SEQ ID NO: 8448941 - DNA, 22 bp, Homo sapiens
ttccctcctatgcccactgaaa

SEQ ID NO: 8448942 - DNA, 22 bp, Homo sapiens
ttccctctccaggagccctgag

SEQ ID NO: 8448943 - DNA, 22 bp, Homo sapiens
ttccctctgcgcattgaatttc

SEQ ID NO: 8448944 - DNA, 22 bp, Homo sapiens
ttccctctctccagggctgcct

SEQ ID NO: 8448945 - DNA, 22 bp, Homo sapiens
ttccctctcctactcaggaaag

SEQ ID NO: 8448946 - DNA, 22 bp, Homo sapiens
ttccctctctagctttccccaa

SEQ ID NO: 8448947 - DNA, 22 bp, Homo sapiens
ttccctccctggctgccatttc

SEQ ID NO: 8448948 - DNA, 22 bp, Homo sapiens
ttccctcctatgcccactgaaa

SEQ ID NO: 8448949 - DNA, 22 bp, Homo sapiens
ttccctccgaacctcagtgctg

SEQ ID NO: 8448950 - DNA, 22 bp, Homo sapiens
ttccctcccccagcctggcagg

SEQ ID NO: 8448951 - DNA, 22 bp, Homo sapiens
ttccctcccccagcctggcagg

SEQ ID NO: 8448952 - DNA, 22 bp, Homo sapiens
ttctcaaagaaagctgtcatta

SEQ ID NO: 8448953 - DNA, 22 bp, Homo sapiens
ttctcaaagaaagctgtcatta

SEQ ID NO: 8448954 - DNA, 22 bp, Homo sapiens
ttctcaagaacatatgtagggt

SEQ ID NO: 8448955 - DNA, 22 bp, Homo sapiens
ttctaactttcaaggtcctttc

SEQ ID NO: 8448956 - DNA, 22 bp, Homo sapiens
ttctcagaaaatgtagagaaaa

SEQ ID NO: 8448957 - DNA, 22 bp, Homo sapiens
ttctcagaattgactgggagca

SEQ ID NO: 8448958 - DNA, 22 bp, Homo sapiens
ttctcagaattgactgggagca

SEQ ID NO: 8448959 - DNA, 22 bp, Homo sapiens
ttctcactatgtatgtagattg

SEQ ID NO: 8448960 - DNA, 22 bp, Homo sapiens
ttctcacagtacctaacatgta

SEQ ID NO: 8448961 - DNA, 22 bp, Homo sapiens
ttctcacaggctggaatgatga

SEQ ID NO: 8448962 - DNA, 22 bp, Homo sapiens
ttctcacaattcttgtatttgc

SEQ ID NO: 8448963 - DNA, 22 bp, Homo sapiens
ttctccaggggagggttctcca

SEQ ID NO: 8448964 - DNA, 21 bp, Homo sapiens
ttctccagggggagctctctc

SEQ ID NO: 8448965 - DNA, 19 bp, Homo sapiens
ttctccagggacttaggga

SEQ ID NO: 8448966 - DNA, 22 bp, Homo sapiens
ttctccaggcttgggccaggtc

SEQ ID NO: 8448967 - DNA, 22 bp, Homo sapiens
ttctccaggcttgggccaggtc

SEQ ID NO: 8448968 - DNA, 19 bp, Homo sapiens
ttctccaggctgcagaggg

SEQ ID NO: 8448969 - DNA, 19 bp, Homo sapiens
ttctccaggctgcagaggg

SEQ ID NO: 8448970 - DNA, 22 bp, Homo sapiens
ttctccagctcatcagggaggg

SEQ ID NO: 8448971 - DNA, 21 bp, Homo sapiens
ttctccaggcaaccatttcag

SEQ ID NO: 8448972 - DNA, 22 bp, Homo sapiens
ttctccaggccgcgcagggggc

SEQ ID NO: 8448973 - DNA, 19 bp, Homo sapiens
ttctccaggctgcagaggg

SEQ ID NO: 8448974 - DNA, 22 bp, Homo sapiens
ttctccagctcatcagggaggg

SEQ ID NO: 8448975 - DNA, 19 bp, Homo sapiens
ttctccagcctgacctgag

SEQ ID NO: 8448976 - DNA, 19 bp, Homo sapiens
ttctccagcctgacctgag

SEQ ID NO: 8448977 - DNA, 22 bp, Homo sapiens
ttctccagcctattggcctatc

SEQ ID NO: 8448978 - DNA, 22 bp, Homo sapiens
ttctccagcctattggcctatc

SEQ ID NO: 8448979 - DNA, 22 bp, Homo sapiens
ttctccagcacattttctttga

SEQ ID NO: 8448980 - DNA, 22 bp, Homo sapiens
ttctccagagtttctctcactg

SEQ ID NO: 8448981 - DNA, 22 bp, Homo sapiens
ttctcagacttccagcaccagc

SEQ ID NO: 8448982 - DNA, 22 bp, Homo sapiens
ttctcagacttccagcaccagc

SEQ ID NO: 8448983 - DNA, 22 bp, Homo sapiens
ttctcagagcactgctgacaaa

SEQ ID NO: 8448984 - DNA, 19 bp, Homo sapiens
ttctcagagcttgcagcac

SEQ ID NO: 8448985 - DNA, 22 bp, Homo sapiens
ttctcagatatttgtatggaac

SEQ ID NO: 8448986 - DNA, 22 bp, Homo sapiens
ttctccagaggtggctagagtt

SEQ ID NO: 8448987 - DNA, 22 bp, Homo sapiens
ttctccagaggtggctagagtt

SEQ ID NO: 8448988 - DNA, 22 bp, Homo sapiens
ttctcagatccatcagaagtcc

SEQ ID NO: 8448989 - DNA, 22 bp, Homo sapiens
ttctccagagtttctctcactg

SEQ ID NO: 8448990 - DNA, 22 bp, Homo sapiens
ttctcagatatttactgagcat

SEQ ID NO: 8448991 - DNA, 22 bp, Homo sapiens
ttctcagagtgaccaagtcttt

SEQ ID NO: 8448992 - DNA, 22 bp, Homo sapiens
ttctcagagtgaccaagtcttt

SEQ ID NO: 8448993 - DNA, 22 bp, Homo sapiens
ttctcagaggagtcgggagctg

SEQ ID NO: 8448994 - DNA, 21 bp, Homo sapiens
ttctcagagtctattacagtt

SEQ ID NO: 8448995 - DNA, 22 bp, Homo sapiens
ttctgataacaaacaccaattt

SEQ ID NO: 8448996 - DNA, 22 bp, Homo sapiens
ttctgataataccacatcgcag

SEQ ID NO: 8448997 - DNA, 22 bp, Homo sapiens
ttctgaggtccatgcagtactg

SEQ ID NO: 8448998 - DNA, 22 bp, Homo sapiens
ttctgagggaaccttgttcttg

SEQ ID NO: 8448999 - DNA, 22 bp, Homo sapiens
ttctgaggctttcccgtcccct

SEQ ID NO: 8449000 - DNA, 22 bp, Homo sapiens
ttctgattgctgatgaggccca

SEQ ID NO: 8449001 - DNA, 22 bp, Homo sapiens
ttctgattcatgatccagttct

SEQ ID NO: 8449002 - DNA, 22 bp, Homo sapiens
ttctgatataacactctagcta

SEQ ID NO: 8449003 - DNA, 22 bp, Homo sapiens
ttctgaggcactggctctccca

SEQ ID NO: 8449004 - DNA, 22 bp, Homo sapiens
ttctgaggcactggctctccca

SEQ ID NO: 8449005 - DNA, 23 bp, Homo sapiens
ttctctttagatttacattactc

SEQ ID NO: 8449006 - DNA, 22 bp, Homo sapiens
ttctctttatgtatttagtggg

SEQ ID NO: 8449007 - DNA, 20 bp, Homo sapiens
ttctggaggctacaagtctg

SEQ ID NO: 8449008 - DNA, 22 bp, Homo sapiens
ttctgccattgccatgagggct

SEQ ID NO: 8449009 - DNA, 22 bp, Homo sapiens
ttctgccatctgcagaagggga

SEQ ID NO: 8449010 - DNA, 22 bp, Homo sapiens
ttctgcagcatgaggctggagc

SEQ ID NO: 8449011 - DNA, 22 bp, Homo sapiens
ttctgcatttctaataagttcc

SEQ ID NO: 8449012 - DNA, 22 bp, Homo sapiens
ttctgcatttaaaatattacta

SEQ ID NO: 8449013 - DNA, 22 bp, Homo sapiens
ttctcttattctggatatgcag

SEQ ID NO: 8449014 - DNA, 22 bp, Homo sapiens
ttctcttagctgtaaagtcaat

SEQ ID NO: 8449015 - DNA, 19 bp, Homo sapiens
ttctctgtgctagactctg

SEQ ID NO: 8449016 - DNA, 22 bp, Homo sapiens
ttctctgttttcccctcgatgt

SEQ ID NO: 8449017 - DNA, 22 bp, Homo sapiens
ttctcttacattttctcagcct

SEQ ID NO: 8449018 - DNA, 22 bp, Homo sapiens
ttctctgtgagggtgctggatt

SEQ ID NO: 8449019 - DNA, 16 bp, Homo sapiens
ttctctgttccttgtg

SEQ ID NO: 8449020 - DNA, 22 bp, Homo sapiens
ttctctgtggattgggtgagag

SEQ ID NO: 8449021 - DNA, 22 bp, Homo sapiens
ttctctgtagttgcctggtgga

SEQ ID NO: 8449022 - DNA, 22 bp, Homo sapiens
ttctctggtttgctgtttctga

SEQ ID NO: 8449023 - DNA, 22 bp, Homo sapiens
ttctcttcccactttctgtatt

SEQ ID NO: 8449024 - DNA, 23 bp, Homo sapiens
ttctctttagatttacattactc

SEQ ID NO: 8449025 - DNA, 18 bp, Homo sapiens
ttctctggtggatgttat

SEQ ID NO: 8449026 - DNA, 21 bp, Homo sapiens
ttctcctccaagttgctcctg

SEQ ID NO: 8449027 - DNA, 20 bp, Homo sapiens
ttctccagtgcggtagccat

SEQ ID NO: 8449028 - DNA, 22 bp, Homo sapiens
ttctccagtcactgacttcgag

SEQ ID NO: 8449029 - DNA, 21 bp, Homo sapiens
ttctccagggggagctctctc

SEQ ID NO: 8449030 - DNA, 22 bp, Homo sapiens
ttctccatttaacttccttatg

SEQ ID NO: 8449031 - DNA, 22 bp, Homo sapiens
ttctccagttatattatgttaa

SEQ ID NO: 8449032 - DNA, 22 bp, Homo sapiens
ttctccagttatattatgttaa

SEQ ID NO: 8449033 - DNA, 22 bp, Homo sapiens
ttctccagtttctcccttcagt

SEQ ID NO: 8449034 - DNA, 22 bp, Homo sapiens
ttctcccatctcagtcttacat

SEQ ID NO: 8449035 - DNA, 22 bp, Homo sapiens
ttgagaaatgttttttaagctg

SEQ ID NO: 8449036 - DNA, 22 bp, Homo sapiens
ttgagaaataagcatgtctaga

SEQ ID NO: 8449037 - DNA, 22 bp, Homo sapiens
ttgagaaataagcatgtctaga

SEQ ID NO: 8449038 - DNA, 22 bp, Homo sapiens
ttgagaaaggggtcaatatctc

SEQ ID NO: 8449039 - DNA, 19 bp, Homo sapiens
ttgagaaagttgatttggg

SEQ ID NO: 8449040 - DNA, 22 bp, Homo sapiens
ttgagaataaattagcagacat

SEQ ID NO: 8449041 - DNA, 22 bp, Homo sapiens
ttgagaatgatgagattcttcc

SEQ ID NO: 8449042 - DNA, 22 bp, Homo sapiens
ttgagaacaggagtgttctttt

SEQ ID NO: 8449043 - DNA, 22 bp, Homo sapiens
ttgagaaatacttttgtagcct

SEQ ID NO: 8449044 - DNA, 23 bp, Homo sapiens
ttgagaacaggtgtgagaatggc

SEQ ID NO: 8449045 - DNA, 22 bp, Homo sapiens
ttgagaactactttattattct

SEQ ID NO: 8449046 - DNA, 22 bp, Homo sapiens
ttgagaactagcatggtctatc

SEQ ID NO: 8449047 - DNA, 22 bp, Homo sapiens
ttgagaactctgtatgtccagc

SEQ ID NO: 8449048 - DNA, 22 bp, Homo sapiens
ttgagactcctggtgtagaata

SEQ ID NO: 8449049 - DNA, 22 bp, Homo sapiens
ttgagacagtggggtgttgccg

SEQ ID NO: 8449050 - DNA, 22 bp, Homo sapiens
ttgagacactttgggcatcact

SEQ ID NO: 8449051 - DNA, 22 bp, Homo sapiens
ttgagacactttgggcatcact

SEQ ID NO: 8449052 - DNA, 22 bp, Homo sapiens
ttgagacacaaggcacagtaag

SEQ ID NO: 8449053 - DNA, 22 bp, Homo sapiens
ttgaggctgcacagtacaggct

SEQ ID NO: 8449054 - DNA, 22 bp, Homo sapiens
ttgagggaaataactgatgctt

SEQ ID NO: 8449055 - DNA, 22 bp, Homo sapiens
ttgagggaacatgagaatcatc

SEQ ID NO: 8449056 - DNA, 22 bp, Homo sapiens
ttgagggagaaagttggagtag

SEQ ID NO: 8449057 - DNA, 22 bp, Homo sapiens
ttgagggagaaagctgaggtgt

SEQ ID NO: 8449058 - DNA, 22 bp, Homo sapiens
ttgagggagaaagccgaggtgt

SEQ ID NO: 8449059 - DNA, 22 bp, Homo sapiens
ttgagggacagaggtgctgtct

SEQ ID NO: 8449060 - DNA, 22 bp, Homo sapiens
ttgagggactttctctattatt

SEQ ID NO: 8449061 - DNA, 22 bp, Homo sapiens
ttgagaggctgttgacattctg

SEQ ID NO: 8449062 - DNA, 22 bp, Homo sapiens
ttgagggatttacagaggtggg

SEQ ID NO: 8449063 - DNA, 22 bp, Homo sapiens
ttgagggattgcaccagaagag

SEQ ID NO: 8449064 - DNA, 22 bp, Homo sapiens
ttgagggagcctgggagccatg

SEQ ID NO: 8449065 - DNA, 22 bp, Homo sapiens
ttgagggagcacagattcttat

SEQ ID NO: 8449066 - DNA, 22 bp, Homo sapiens
ttgagggagatgttgacttcag

SEQ ID NO: 8449067 - DNA, 18 bp, Homo sapiens
ttgagggaggggcagagt

SEQ ID NO: 8449068 - DNA, 22 bp, Homo sapiens
ttgagggattttaaatgaacaa

SEQ ID NO: 8449069 - DNA, 22 bp, Homo sapiens
ttgaggtagtacttattattgg

SEQ ID NO: 8449070 - DNA, 22 bp, Homo sapiens
ttctttttaaagtgtgtatgca

SEQ ID NO: 8449071 - DNA, 22 bp, Homo sapiens
ttctttttatcttcccataaga

SEQ ID NO: 8449072 - DNA, 22 bp, Homo sapiens
ttgaaaaaattggtagaggatg

SEQ ID NO: 8449073 - DNA, 22 bp, Homo sapiens
ttgaaaaaattggtagaggatg

SEQ ID NO: 8449074 - DNA, 22 bp, Homo sapiens
ttgaaaagcaaatgatgggtag

SEQ ID NO: 8449075 - DNA, 22 bp, Homo sapiens
ttgaaaatatcacaggagcagc

SEQ ID NO: 8449076 - DNA, 22 bp, Homo sapiens
ttgaaaagttttgaaacactct

SEQ ID NO: 8449077 - DNA, 22 bp, Homo sapiens
ttgagaaacctggcagtagaga

SEQ ID NO: 8449078 - DNA, 22 bp, Homo sapiens
ttgacattttgtcatattgaca

SEQ ID NO: 8449079 - DNA, 22 bp, Homo sapiens
ttgaccactgaatggttctgaa

SEQ ID NO: 8449080 - DNA, 23 bp, Homo sapiens
ttgaaagattgctaagtaaaaat

SEQ ID NO: 8449081 - DNA, 22 bp, Homo sapiens
ttgaaagatatgttaatctttc

SEQ ID NO: 8449082 - DNA, 22 bp, Homo sapiens
ttgaaagatatgttaatctttc

SEQ ID NO: 8449083 - DNA, 22 bp, Homo sapiens
ttgaaagatagtgaagccagcc

SEQ ID NO: 8449084 - DNA, 22 bp, Homo sapiens
ttgaaactgcttattgaatttg

SEQ ID NO: 8449085 - DNA, 22 bp, Homo sapiens
ttgaaactatgaagacaaccat

SEQ ID NO: 8449086 - DNA, 22 bp, Homo sapiens
ttgaaacttttcttggagaaac

SEQ ID NO: 8449087 - DNA, 22 bp, Homo sapiens
ttgaaagaactcttcagagata

SEQ ID NO: 8449088 - DNA, 22 bp, Homo sapiens
ttcttctcctaaggagagtcct

SEQ ID NO: 8449089 - DNA, 22 bp, Homo sapiens
ttcttctaaatgtgcttattaa

SEQ ID NO: 8449090 - DNA, 22 bp, Homo sapiens
ttctgggagattcatatgaaaa

SEQ ID NO: 8449091 - DNA, 22 bp, Homo sapiens
ttctgggcacacaggccctggt

SEQ ID NO: 8449092 - DNA, 22 bp, Homo sapiens
ttctgggcacacaggccctggt

SEQ ID NO: 8449093 - DNA, 22 bp, Homo sapiens
ttcttcagagagtagaagcaag

SEQ ID NO: 8449094 - DNA, 22 bp, Homo sapiens
ttcttcagatggtgagacctcc

SEQ ID NO: 8449095 - DNA, 22 bp, Homo sapiens
ttctggagtattcctggcagcc

SEQ ID NO: 8449096 - DNA, 22 bp, Homo sapiens
ttcttcttcaagtgctgcattc

SEQ ID NO: 8449097 - DNA, 22 bp, Homo sapiens
ttcttctgattgccttctgcaa

SEQ ID NO: 8449098 - DNA, 22 bp, Homo sapiens
ttcttctgattgccttctgcaa

SEQ ID NO: 8449099 - DNA, 22 bp, Homo sapiens
ttcttctgcctcccacctgata

SEQ ID NO: 8449100 - DNA, 22 bp, Homo sapiens
ttcttctgcctcccacctgata

SEQ ID NO: 8449101 - DNA, 20 bp, Homo sapiens
ttcttctctagttatcttca

SEQ ID NO: 8449102 - DNA, 22 bp, Homo sapiens
ttcttctgacactgatgctgta

SEQ ID NO: 8449103 - DNA, 22 bp, Homo sapiens
ttctttggaataagtcaagctg

SEQ ID NO: 8449104 - DNA, 22 bp, Homo sapiens
ttctttgcccttaatgaaataa

SEQ ID NO: 8449105 - DNA, 22 bp, Homo sapiens
ttctttgcccatgtttcctaag

SEQ ID NO: 8449106 - DNA, 23 bp, Homo sapiens
ttctttggaattgggctgcaagg

SEQ ID NO: 8449107 - DNA, 22 bp, Homo sapiens
ttctttggaataagtcaagctg

SEQ ID NO: 8449108 - DNA, 22 bp, Homo sapiens
ttctttggcatttcctgtatgt

SEQ ID NO: 8449109 - DNA, 22 bp, Homo sapiens
ttctttctttgtagtcctgaac

SEQ ID NO: 8449110 - DNA, 22 bp, Homo sapiens
ttctttgggctcagagagggag

SEQ ID NO: 8449111 - DNA, 22 bp, Homo sapiens
ttctttggggaatattctggtt

SEQ ID NO: 8449112 - DNA, 22 bp, Homo sapiens
ttctttggtgggagattgaggt

SEQ ID NO: 8449113 - DNA, 22 bp, Homo sapiens
ttctttggggtctccagcatag

SEQ ID NO: 8449114 - DNA, 22 bp, Homo sapiens
ttctttgggattgtagctgtct

SEQ ID NO: 8449115 - DNA, 22 bp, Homo sapiens
ttctttgggcaattgctggccc

SEQ ID NO: 8449116 - DNA, 22 bp, Homo sapiens
ttctttgggcaattgctggccc

SEQ ID NO: 8449117 - DNA, 22 bp, Homo sapiens
ttctttggcttacgtctggcct

SEQ ID NO: 8449118 - DNA, 22 bp, Homo sapiens
ttctttggctgccagtctggag

SEQ ID NO: 8449119 - DNA, 22 bp, Homo sapiens
ttatacagcattgctagtgatg

SEQ ID NO: 8449120 - DNA, 22 bp, Homo sapiens
ttatacacgtttatggagctac

SEQ ID NO: 8449121 - DNA, 22 bp, Homo sapiens
ttatacaccatcactgccttgg

SEQ ID NO: 8449122 - DNA, 22 bp, Homo sapiens
ttatacactgcagaaccagcat

SEQ ID NO: 8449123 - DNA, 22 bp, Homo sapiens
ttatacacaattcttttactac

SEQ ID NO: 8449124 - DNA, 22 bp, Homo sapiens
ttataattctggcataggctgt

SEQ ID NO: 8449125 - DNA, 22 bp, Homo sapiens
ttataattctggcataggctgt

SEQ ID NO: 8449126 - DNA, 22 bp, Homo sapiens
ttatgcaaggacttattacagt

SEQ ID NO: 8449127 - DNA, 22 bp, Homo sapiens
ttatgcaaggacttattacagt

SEQ ID NO: 8449128 - DNA, 22 bp, Homo sapiens
ttagttaattgactatgttgca

SEQ ID NO: 8449129 - DNA, 22 bp, Homo sapiens
ttagttcatagaatgtaacagg

SEQ ID NO: 8449130 - DNA, 22 bp, Homo sapiens
ttagttcactgctatatcatca

SEQ ID NO: 8449131 - DNA, 22 bp, Homo sapiens
ttagttgacccccagtcctggc

SEQ ID NO: 8449132 - DNA, 22 bp, Homo sapiens
ttataagctctgaaatctccta

SEQ ID NO: 8449133 - DNA, 22 bp, Homo sapiens
ttatggaaaatacaattataag

SEQ ID NO: 8449134 - DNA, 21 bp, Homo sapiens
ttatgtctctttggtgactgg

SEQ ID NO: 8449135 - DNA, 22 bp, Homo sapiens
ttatgtgcttcaactgagccta

SEQ ID NO: 8449136 - DNA, 22 bp, Homo sapiens
ttatgtgtgtacatgcatatgt

SEQ ID NO: 8449137 - DNA, 22 bp, Homo sapiens
tcctctccagcaaactggctat

SEQ ID NO: 8449138 - DNA, 22 bp, Homo sapiens
tcctctgctccaggctggactt

SEQ ID NO: 8449139 - DNA, 22 bp, Homo sapiens
tcctcggctgggccccaggctt

SEQ ID NO: 8449140 - DNA, 23 bp, Homo sapiens
tcctccttttgcttgtgcttccc

SEQ ID NO: 8449141 - DNA, 21 bp, Homo sapiens
tcctcctgtagagggtcctgg

SEQ ID NO: 8449142 - DNA, 21 bp, Homo sapiens
tcctcctgtagagggtcctgg

SEQ ID NO: 8449143 - DNA, 22 bp, Homo sapiens
tcctcctgtctaccagttcctg

SEQ ID NO: 8449144 - DNA, 22 bp, Homo sapiens
tcctcctgtttctcaggcctgg

SEQ ID NO: 8449145 - DNA, 22 bp, Homo sapiens
ttagtgcttctgtccaaatata

SEQ ID NO: 8449146 - DNA, 22 bp, Homo sapiens
ttagtgcttggcacacaataca

SEQ ID NO: 8449147 - DNA, 22 bp, Homo sapiens
ttagtggtaaggatgaaatttc

SEQ ID NO: 8449148 - DNA, 22 bp, Homo sapiens
ttagttaataggtcttcagctt

SEQ ID NO: 8449149 - DNA, 22 bp, Homo sapiens
ttagttaaaattctgctgacat

SEQ ID NO: 8449150 - DNA, 22 bp, Homo sapiens
ttagttaaaagataattttgga

SEQ ID NO: 8449151 - DNA, 22 bp, Homo sapiens
ttagtgtgtccagttctgaaaa

SEQ ID NO: 8449152 - DNA, 22 bp, Homo sapiens
ttagtgtgtccagttctgaaaa

SEQ ID NO: 8449153 - DNA, 22 bp, Homo sapiens
ttagtgtgttatataccaagct

SEQ ID NO: 8449154 - DNA, 22 bp, Homo sapiens
ttagtgtgttaatgagtatatc

SEQ ID NO: 8449155 - DNA, 22 bp, Homo sapiens
tcctctggatataagcctcacc

SEQ ID NO: 8449156 - DNA, 22 bp, Homo sapiens
tcctctggaacctcacccttgc

SEQ ID NO: 8449157 - DNA, 22 bp, Homo sapiens
tcctctggctctttccctagga

SEQ ID NO: 8449158 - DNA, 22 bp, Homo sapiens
tcctctggcccagctgcctctg

SEQ ID NO: 8449159 - DNA, 22 bp, Homo sapiens
ttatttatatctctgcagttta

SEQ ID NO: 8449160 - DNA, 22 bp, Homo sapiens
ttatttgttttctgagaagtat

SEQ ID NO: 8449161 - DNA, 22 bp, Homo sapiens
ttatttaattttctcactcaga

SEQ ID NO: 8449162 - DNA, 22 bp, Homo sapiens
ttatttaatgtgatctgaagag

SEQ ID NO: 8449163 - DNA, 22 bp, Homo sapiens
ttatttaatgtgatctgaagag

SEQ ID NO: 8449164 - DNA, 22 bp, Homo sapiens
ttatttaggaggaaactgaggt

SEQ ID NO: 8449165 - DNA, 22 bp, Homo sapiens
ttatttagtctagatgaatttt

SEQ ID NO: 8449166 - DNA, 22 bp, Homo sapiens
ttatttaggagaaggaaccctg

SEQ ID NO: 8449167 - DNA, 22 bp, Homo sapiens
ttatttactggatggccttggg

SEQ ID NO: 8449168 - DNA, 22 bp, Homo sapiens
ttatttacaactcttctcttcc

SEQ ID NO: 8449169 - DNA, 22 bp, Homo sapiens
ttatttaaaagtggtaagattc

SEQ ID NO: 8449170 - DNA, 22 bp, Homo sapiens
ttattgtttgggtataatttga

SEQ ID NO: 8449171 - DNA, 22 bp, Homo sapiens
ttattgtttgggtataatttga

SEQ ID NO: 8449172 - DNA, 22 bp, Homo sapiens
ttatttaaaagtggtaagattc

SEQ ID NO: 8449173 - DNA, 22 bp, Homo sapiens
ttatttaatgtgatctgaagag

SEQ ID NO: 8449174 - DNA, 22 bp, Homo sapiens
ttatgtttgagtatatgactca

SEQ ID NO: 8449175 - DNA, 22 bp, Homo sapiens
ttatgtgtgtgtatacatacaa

SEQ ID NO: 8449176 - DNA, 22 bp, Homo sapiens
ttattgtttaaagccatgtaaa

SEQ ID NO: 8449177 - DNA, 22 bp, Homo sapiens
ttattgttagtgagactgtaga

SEQ ID NO: 8449178 - DNA, 22 bp, Homo sapiens
ttattgttagtgagactgtaga

SEQ ID NO: 8449179 - DNA, 22 bp, Homo sapiens
ttattgtttaaagccatgtaaa

SEQ ID NO: 8449180 - DNA, 22 bp, Homo sapiens
ttattgtttactagtttgcaga

SEQ ID NO: 8449181 - DNA, 22 bp, Homo sapiens
ttattgtttactagtttgcaga

SEQ ID NO: 8449182 - DNA, 22 bp, Homo sapiens
ttattgtttgggtataatttga

SEQ ID NO: 8449183 - DNA, 22 bp, Homo sapiens
ttcaaaattgttctaagctctg

SEQ ID NO: 8449184 - DNA, 22 bp, Homo sapiens
ttcaaaattgttctaagctctg

SEQ ID NO: 8449185 - DNA, 22 bp, Homo sapiens
ttcaagcagagatatttcaaga

SEQ ID NO: 8449186 - DNA, 22 bp, Homo sapiens
ttcaaggagattggagtctact

SEQ ID NO: 8449187 - DNA, 21 bp, Homo sapiens
ttcaaaatggtgtgtttgtct

SEQ ID NO: 8449188 - DNA, 22 bp, Homo sapiens
ttcaaaatgcacaaagggctag

SEQ ID NO: 8449189 - DNA, 21 bp, Homo sapiens
ttcaaaatggtgtgtttgtct

SEQ ID NO: 8449190 - DNA, 22 bp, Homo sapiens
ttcaaaatccgggaggcgcccc

SEQ ID NO: 8449191 - DNA, 22 bp, Homo sapiens
ttattttctcctcagaaagtgg

SEQ ID NO: 8449192 - DNA, 22 bp, Homo sapiens
ttattttctcctcagaaagtgg

SEQ ID NO: 8449193 - DNA, 22 bp, Homo sapiens
ttattttaccttcctctgagct

SEQ ID NO: 8449194 - DNA, 22 bp, Homo sapiens
ttcagaaatcgagtttcatgtc

SEQ ID NO: 8449195 - DNA, 22 bp, Homo sapiens
ttcagaaatcgagtttcatgtc

SEQ ID NO: 8449196 - DNA, 22 bp, Homo sapiens
ttcagaacaaccatggttagat

SEQ ID NO: 8449197 - DNA, 22 bp, Homo sapiens
ttcagaacaatatgaacagaac

SEQ ID NO: 8449198 - DNA, 22 bp, Homo sapiens
ttcagaaatgaatattggtatt

SEQ ID NO: 8449199 - DNA, 22 bp, Homo sapiens
ttcagaaataaaatatcccaac

SEQ ID NO: 8449200 - DNA, 22 bp, Homo sapiens
ttcactgttatgaagctctggg

SEQ ID NO: 8449201 - DNA, 22 bp, Homo sapiens
ttcactgtgatgtttaagagaa

SEQ ID NO: 8449202 - DNA, 20 bp, Homo sapiens
ttcagaaataaggaatgagg

SEQ ID NO: 8449203 - DNA, 20 bp, Homo sapiens
ttcagaaataaggaatgagg

SEQ ID NO: 8449204 - DNA, 22 bp, Homo sapiens
ttcactgtgaactcatattcag

SEQ ID NO: 8449205 - DNA, 22 bp, Homo sapiens
ttcagaatatttgttttacatg

SEQ ID NO: 8449206 - DNA, 21 bp, Homo sapiens
ttcaatgaaaacaaagtgagg

SEQ ID NO: 8449207 - DNA, 22 bp, Homo sapiens
ttcaatcatttttacatagtcc

SEQ ID NO: 8449208 - DNA, 22 bp, Homo sapiens
ttcaatcattgcaaagtaatgg

SEQ ID NO: 8449209 - DNA, 17 bp, Homo sapiens
ttcaatgattaatgcat

SEQ ID NO: 8449210 - DNA, 22 bp, Homo sapiens
ttcactgtactgactgtcttat

SEQ ID NO: 8449211 - DNA, 22 bp, Homo sapiens
ttcactgtatgagagggcttga

SEQ ID NO: 8449212 - DNA, 22 bp, Homo sapiens
ttcaatatctctaagaatgagg

SEQ ID NO: 8449213 - DNA, 22 bp, Homo sapiens
ttcaatatctctaagaatgagg

SEQ ID NO: 8449214 - DNA, 22 bp, Homo sapiens
ttcaatcattagaatctcaggc

SEQ ID NO: 8449215 - DNA, 22 bp, Homo sapiens
ttcaatatctctaagaatgagg

SEQ ID NO: 8449216 - DNA, 22 bp, Homo sapiens
ttcaagtatgagaaaggggact

SEQ ID NO: 8449217 - DNA, 22 bp, Homo sapiens
ttcaagtactgtagatttcagg

SEQ ID NO: 8449218 - DNA, 22 bp, Homo sapiens
ttcatacatttttactaacagc

SEQ ID NO: 8449219 - DNA, 22 bp, Homo sapiens
ttcatagagcagctcactgaat

SEQ ID NO: 8449220 - DNA, 22 bp, Homo sapiens
ttcatagacccagaactcatta

SEQ ID NO: 8449221 - DNA, 22 bp, Homo sapiens
ttcatagacccagaactcatta

SEQ ID NO: 8449222 - DNA, 22 bp, Homo sapiens
ttcagaatgctatttctgaaat

SEQ ID NO: 8449223 - DNA, 22 bp, Homo sapiens
ttcagaatgtactgatagaaca

SEQ ID NO: 8449224 - DNA, 22 bp, Homo sapiens
ttcagaatgtgaccttatttgg

SEQ ID NO: 8449225 - DNA, 22 bp, Homo sapiens
ttcagacagtaagaaagaggtt

SEQ ID NO: 8449226 - DNA, 22 bp, Homo sapiens
ttcatagtgattgttcagatag

SEQ ID NO: 8449227 - DNA, 22 bp, Homo sapiens
ttcatagtgcttaatttgataa

SEQ ID NO: 8449228 - DNA, 22 bp, Homo sapiens
ttcatagtgtttccttccagtg

SEQ ID NO: 8449229 - DNA, 22 bp, Homo sapiens
ttcatagtgtttccttccagtg

SEQ ID NO: 8449230 - DNA, 22 bp, Homo sapiens
ttcatatttgaaacagaagtta

SEQ ID NO: 8449231 - DNA, 22 bp, Homo sapiens
ttcatattatgatttgaaatgc

SEQ ID NO: 8449232 - DNA, 22 bp, Homo sapiens
ttcatattatgatttgaaatgc

SEQ ID NO: 8449233 - DNA, 22 bp, Homo sapiens
ttcatatatatgcactacgtac

SEQ ID NO: 8449234 - DNA, 22 bp, Homo sapiens
ttcatataccttgcgtttcaca

SEQ ID NO: 8449235 - DNA, 22 bp, Homo sapiens
ttccatctttcagctttgttgg

SEQ ID NO: 8449236 - DNA, 22 bp, Homo sapiens
ttccatctgctaggtaaatgaa

SEQ ID NO: 8449237 - DNA, 22 bp, Homo sapiens
ttccatattgtactctttggag

SEQ ID NO: 8449238 - DNA, 22 bp, Homo sapiens
ttccatattcccaattttgcca

SEQ ID NO: 8449239 - DNA, 22 bp, Homo sapiens
ttccatattggaaggcacaggc

SEQ ID NO: 8449240 - DNA, 22 bp, Homo sapiens
ttccatattagactatgtgggg

SEQ ID NO: 8449241 - DNA, 22 bp, Homo sapiens
ttccatatttgtgtggcaaaag

SEQ ID NO: 8449242 - DNA, 22 bp, Homo sapiens
ttccatatgtatatagctgtta

SEQ ID NO: 8449243 - DNA, 22 bp, Homo sapiens
ttccatgcctctatttagaatt

SEQ ID NO: 8449244 - DNA, 22 bp, Homo sapiens
ttcccagactccacactgaggc

SEQ ID NO: 8449245 - DNA, 22 bp, Homo sapiens
ttcccagacctgtaggatcaga

SEQ ID NO: 8449246 - DNA, 21 bp, Homo sapiens
ttcccagcacctagcacaggt

SEQ ID NO: 8449247 - DNA, 22 bp, Homo sapiens
ttcccagtgattgaacatccct

SEQ ID NO: 8449248 - DNA, 22 bp, Homo sapiens
ttcccagtgattaaggcagtgg

SEQ ID NO: 8449249 - DNA, 22 bp, Homo sapiens
ttcccagtattaccttcaggaa

SEQ ID NO: 8449250 - DNA, 22 bp, Homo sapiens
ttcccagtcccaagaaaagcca

SEQ ID NO: 8449251 - DNA, 22 bp, Homo sapiens
ttcccaggctgtgctaccagag

SEQ ID NO: 8449252 - DNA, 22 bp, Homo sapiens
ttcccagttagtcatttttaca

SEQ ID NO: 8449253 - DNA, 22 bp, Homo sapiens
ttccccaggcggctttttcagc

SEQ ID NO: 8449254 - DNA, 22 bp, Homo sapiens
ttcccatttgtggtagtgaatt

SEQ ID NO: 8449255 - DNA, 22 bp, Homo sapiens
ttccccaggctggagtgcagtg

SEQ ID NO: 8449256 - DNA, 22 bp, Homo sapiens
ttccccaggtgattctcatggc

SEQ ID NO: 8449257 - DNA, 22 bp, Homo sapiens
ttccccaggggctcctgccttt

SEQ ID NO: 8449258 - DNA, 22 bp, Homo sapiens
ttccccttgggctgtggaggag

SEQ ID NO: 8449259 - DNA, 20 bp, Homo sapiens
ttccaactcacatctctaca

SEQ ID NO: 8449260 - DNA, 22 bp, Homo sapiens
ttcatcaggcatcatgctcaag

SEQ ID NO: 8449261 - DNA, 19 bp, Homo sapiens
ttccaaaatcaggatttga

SEQ ID NO: 8449262 - DNA, 19 bp, Homo sapiens
ttccaaaatcaggatttga

SEQ ID NO: 8449263 - DNA, 17 bp, Homo sapiens
ttccaaggagcatttga

SEQ ID NO: 8449264 - DNA, 18 bp, Homo sapiens
ttccataatgtatgtaac

SEQ ID NO: 8449265 - DNA, 22 bp, Homo sapiens
ttccatatctgttgcatatcat

SEQ ID NO: 8449266 - DNA, 22 bp, Homo sapiens
ttccatatgaaaaagctgttgc

SEQ ID NO: 8449267 - DNA, 22 bp, Homo sapiens
ttccataatcaccttattcttt

SEQ ID NO: 8449268 - DNA, 22 bp, Homo sapiens
ttccataaaggtgatagtatac

SEQ ID NO: 8449269 - DNA, 22 bp, Homo sapiens
ttccaatggaatcatgtcttga

SEQ ID NO: 8449270 - DNA, 22 bp, Homo sapiens
ttccaatgactagtggcatcct

SEQ ID NO: 8449271 - DNA, 22 bp, Homo sapiens
ttccaagtccagccaggccaaa

SEQ ID NO: 8449272 - DNA, 22 bp, Homo sapiens
ttccaagtgaaagtagctttgt

SEQ ID NO: 8449273 - DNA, 22 bp, Homo sapiens
ttccaagtgcccatatttcatc

SEQ ID NO: 8449274 - DNA, 22 bp, Homo sapiens
ttccaagtgcccatatttcatc

SEQ ID NO: 8449275 - DNA, 22 bp, Homo sapiens
ttccaataaaatgttatttgca

SEQ ID NO: 8449276 - DNA, 20 bp, Homo sapiens
ttccaaggtctatgcttctt

SEQ ID NO: 8449277 - DNA, 22 bp, Homo sapiens
ttggaacaggattcaattaaag

SEQ ID NO: 8449278 - DNA, 20 bp, Homo sapiens
ttggaacagtggatcagcag

SEQ ID NO: 8449279 - DNA, 22 bp, Homo sapiens
ttggaacagaaacagacaaata

SEQ ID NO: 8449280 - DNA, 22 bp, Homo sapiens
ttggaacatgccggggtccagg

SEQ ID NO: 8449281 - DNA, 22 bp, Homo sapiens
ttggaacatgccggggtccagg

SEQ ID NO: 8449282 - DNA, 22 bp, Homo sapiens
ttggaacttaaccctgataggt

SEQ ID NO: 8449283 - DNA, 22 bp, Homo sapiens
ttggaactggatttcatgtagc

SEQ ID NO: 8449284 - DNA, 22 bp, Homo sapiens
ttgctttatgtgtatgacttga

SEQ ID NO: 8449285 - DNA, 22 bp, Homo sapiens
ttgctttattcacatctatatt

SEQ ID NO: 8449286 - DNA, 22 bp, Homo sapiens
ttggaacactagaatctgtact

SEQ ID NO: 8449287 - DNA, 22 bp, Homo sapiens
ttgctttagggcaaatatttca

SEQ ID NO: 8449288 - DNA, 22 bp, Homo sapiens
ttgctttatattcaagagagga

SEQ ID NO: 8449289 - DNA, 22 bp, Homo sapiens
ttgctttatattcaagagagga

SEQ ID NO: 8449290 - DNA, 20 bp, Homo sapiens
ttgctttatcagacatgata

SEQ ID NO: 8449291 - DNA, 22 bp, Homo sapiens
ttgctttaaaatggctaagtct

SEQ ID NO: 8449292 - DNA, 22 bp, Homo sapiens
ttgctttaactagtaaatgggg

SEQ ID NO: 8449293 - DNA, 22 bp, Homo sapiens
ttgctttaaggtatctggagaa

SEQ ID NO: 8449294 - DNA, 22 bp, Homo sapiens
ttgctttaggatttaagtggca

SEQ ID NO: 8449295 - DNA, 22 bp, Homo sapiens
ttgctttacaaaaattgatggt

SEQ ID NO: 8449296 - DNA, 22 bp, Homo sapiens
ttgctttacatgttctggtaaa

SEQ ID NO: 8449297 - DNA, 18 bp, Homo sapiens
ttggaggatgtccatgaa

SEQ ID NO: 8449298 - DNA, 18 bp, Homo sapiens
ttggaggatgtccatgaa

SEQ ID NO: 8449299 - DNA, 22 bp, Homo sapiens
ttggagggacagatggctaggc

SEQ ID NO: 8449300 - DNA, 22 bp, Homo sapiens
ttggatgggcattaggaaagtc

SEQ ID NO: 8449301 - DNA, 20 bp, Homo sapiens
ttggatgtgcatggccgtgc

SEQ ID NO: 8449302 - DNA, 22 bp, Homo sapiens
ttggaggatgcaatgagggagt

SEQ ID NO: 8449303 - DNA, 22 bp, Homo sapiens
ttggaattcagcttgcttataa

SEQ ID NO: 8449304 - DNA, 21 bp, Homo sapiens
ttggaatcttaggagtgtggg

SEQ ID NO: 8449305 - DNA, 21 bp, Homo sapiens
ttggaatctcttcatctctgc

SEQ ID NO: 8449306 - DNA, 22 bp, Homo sapiens
ttggaattaaaaggagaacttc

SEQ ID NO: 8449307 - DNA, 22 bp, Homo sapiens
ttggaagtaatgaagaggtggg

SEQ ID NO: 8449308 - DNA, 22 bp, Homo sapiens
ttggaatcctgcctctgctact

SEQ ID NO: 8449309 - DNA, 22 bp, Homo sapiens
ttggaatcctgagatgagaatt

SEQ ID NO: 8449310 - DNA, 23 bp, Homo sapiens
ttggaatatattgtttgacatag

SEQ ID NO: 8449311 - DNA, 22 bp, Homo sapiens
ttggaatatcatgcagaataaa

SEQ ID NO: 8449312 - DNA, 22 bp, Homo sapiens
ttggaatagatttgttagaaaa

SEQ ID NO: 8449313 - DNA, 22 bp, Homo sapiens
ttggaataaaaacaactcacag

SEQ ID NO: 8449314 - DNA, 20 bp, Homo sapiens
ttggaatcacctggagaggt

SEQ ID NO: 8449315 - DNA, 22 bp, Homo sapiens
ttggcacacagtaagccctaag

SEQ ID NO: 8449316 - DNA, 22 bp, Homo sapiens
ttggatgtttgaaatcacgtac

SEQ ID NO: 8449317 - DNA, 22 bp, Homo sapiens
ttggcagactgacaatctgttt

SEQ ID NO: 8449318 - DNA, 22 bp, Homo sapiens
ttggcagactgggtcctgggga

SEQ ID NO: 8449319 - DNA, 22 bp, Homo sapiens
ttggcagaatgggcagcttgag

SEQ ID NO: 8449320 - DNA, 22 bp, Homo sapiens
ttggcagaattaaccactgaag

SEQ ID NO: 8449321 - DNA, 22 bp, Homo sapiens
ttgctatttcctgaaataagca

SEQ ID NO: 8449322 - DNA, 22 bp, Homo sapiens
ttgcttcctctagtttcttgaa

SEQ ID NO: 8449323 - DNA, 19 bp, Homo sapiens
ttgcttcatgtcttttgct

SEQ ID NO: 8449324 - DNA, 22 bp, Homo sapiens
ttgctcatatttgcatgtgttt

SEQ ID NO: 8449325 - DNA, 22 bp, Homo sapiens
ttgctcatactcatgttgtgat

SEQ ID NO: 8449326 - DNA, 22 bp, Homo sapiens
ttgctcaggcttagagctacta

SEQ ID NO: 8449327 - DNA, 22 bp, Homo sapiens
ttgctattttgagagtcatagt

SEQ ID NO: 8449328 - DNA, 22 bp, Homo sapiens
ttgctattttgagagtcatagt

SEQ ID NO: 8449329 - DNA, 22 bp, Homo sapiens
ttgctcaggctggtgtgcagtg

SEQ ID NO: 8449330 - DNA, 22 bp, Homo sapiens
ttgcccagagtcacccagctca

SEQ ID NO: 8449331 - DNA, 22 bp, Homo sapiens
ttgcctcattttctggtgaaat

SEQ ID NO: 8449332 - DNA, 22 bp, Homo sapiens
ttgccatgcagccaggaaggag

SEQ ID NO: 8449333 - DNA, 22 bp, Homo sapiens
ttgccattaaaacatgttatct

SEQ ID NO: 8449334 - DNA, 22 bp, Homo sapiens
ttgccatttatactgcaagtca

SEQ ID NO: 8449335 - DNA, 22 bp, Homo sapiens
ttgccatgttgccaaggctggt

SEQ ID NO: 8449336 - DNA, 22 bp, Homo sapiens
ttgcctgggctagtaagccaga

SEQ ID NO: 8449337 - DNA, 22 bp, Homo sapiens
ttgcctggtcctgtgggtgctg

SEQ ID NO: 8449338 - DNA, 22 bp, Homo sapiens
ttgcctggcttgtagatggggg

SEQ ID NO: 8449339 - DNA, 22 bp, Homo sapiens
ttgcctggattctaccacagaa

SEQ ID NO: 8449340 - DNA, 22 bp, Homo sapiens
ttgcctggatggtccccagaga

SEQ ID NO: 8449341 - DNA, 22 bp, Homo sapiens
ttgcctggagggacatggagac

SEQ ID NO: 8449342 - DNA, 22 bp, Homo sapiens
ttgcctggactctgctggtatt

SEQ ID NO: 8449343 - DNA, 22 bp, Homo sapiens
ttgccttactgcattcagtaaa

SEQ ID NO: 8449344 - DNA, 22 bp, Homo sapiens
ttgaggtattgatattttatga

SEQ ID NO: 8449345 - DNA, 22 bp, Homo sapiens
ttgagtaccttggattacaggt

SEQ ID NO: 8449346 - DNA, 22 bp, Homo sapiens
ttgagtctcctcagcagggcta

SEQ ID NO: 8449347 - DNA, 18 bp, Homo sapiens
ttgagtctagccatggaa

SEQ ID NO: 8449348 - DNA, 22 bp, Homo sapiens
ttgcatttcactttcagtaggc

SEQ ID NO: 8449349 - DNA, 22 bp, Homo sapiens
ttgcatttcccattgagtaatg

SEQ ID NO: 8449350 - DNA, 22 bp, Homo sapiens
ttgcatttttgagcacgaagtt

SEQ ID NO: 8449351 - DNA, 22 bp, Homo sapiens
ttgcatttgtttgagtagaatg

SEQ ID NO: 8449352 - DNA, 22 bp, Homo sapiens
ttgcatttggttctgcctggta

SEQ ID NO: 8449353 - DNA, 22 bp, Homo sapiens
ttgcatttgctcatttgatatg

SEQ ID NO: 8449354 - DNA, 22 bp, Homo sapiens
ttgccaggggacatctggagcc

SEQ ID NO: 8449355 - DNA, 22 bp, Homo sapiens
ttgccagggtcaggatgagatc

SEQ ID NO: 8449356 - DNA, 22 bp, Homo sapiens
ttgccagggccagtgggggtgt

SEQ ID NO: 8449357 - DNA, 22 bp, Homo sapiens
ttgccagggctttggtggcatc

SEQ ID NO: 8449358 - DNA, 22 bp, Homo sapiens
ttgccagggaacagggagaggc

SEQ ID NO: 8449359 - DNA, 22 bp, Homo sapiens
ttgccaggagacatctggagcc

SEQ ID NO: 8449360 - DNA, 22 bp, Homo sapiens
ttgccaggagacaaagtgggcc

SEQ ID NO: 8449361 - DNA, 22 bp, Homo sapiens
ttgccaggcttgtttctaggct

SEQ ID NO: 8449362 - DNA, 22 bp, Homo sapiens
ttgccaggctctggttccagcc

SEQ ID NO: 8449363 - DNA, 22 bp, Homo sapiens
ttggcttcttgtgaaatctgag

SEQ ID NO: 8449364 - DNA, 22 bp, Homo sapiens
ttggcttcttgtgaaatctgag

SEQ ID NO: 8449365 - DNA, 22 bp, Homo sapiens
ttggcttcttataatgcaatag

SEQ ID NO: 8449366 - DNA, 22 bp, Homo sapiens
ttggcttcttcgcacagcagta

SEQ ID NO: 8449367 - DNA, 22 bp, Homo sapiens
ttggcttctgttttggctctgt

SEQ ID NO: 8449368 - DNA, 22 bp, Homo sapiens
ttggcttctggcagtctggacg

SEQ ID NO: 8449369 - DNA, 22 bp, Homo sapiens
ttggcttggagagttgaaatgt

SEQ ID NO: 8449370 - DNA, 18 bp, Homo sapiens
ttggcttctttccttcct

SEQ ID NO: 8449371 - DNA, 22 bp, Homo sapiens
ttggcttcttttctagacagaa

SEQ ID NO: 8449372 - DNA, 22 bp, Homo sapiens
ttggcttctttagtcagtttgg

SEQ ID NO: 8449373 - DNA, 22 bp, Homo sapiens
ttggcttctttagtcagtttgg

SEQ ID NO: 8449374 - DNA, 22 bp, Homo sapiens
ttggcttccaggggcttttaca

SEQ ID NO: 8449375 - DNA, 22 bp, Homo sapiens
ttggcttcccagagcttacgct

SEQ ID NO: 8449376 - DNA, 22 bp, Homo sapiens
ttggcttccaggggcttttaca

SEQ ID NO: 8449377 - DNA, 22 bp, Homo sapiens
ttggcttctgatgtattcctga

SEQ ID NO: 8449378 - DNA, 22 bp, Homo sapiens
ttggcttctgatgtattcctga

SEQ ID NO: 8449379 - DNA, 22 bp, Homo sapiens
ttggcttctcttaaccctaaag

SEQ ID NO: 8449380 - DNA, 22 bp, Homo sapiens
ttggcttcctgcacttgagttt

SEQ ID NO: 8449381 - DNA, 22 bp, Homo sapiens
ttggcttcctgcacttgagttt

SEQ ID NO: 8449382 - DNA, 22 bp, Homo sapiens
ttggcttccaggatctcagcag

SEQ ID NO: 8449383 - DNA, 22 bp, Homo sapiens
ttggcttcattgatctcacttt

SEQ ID NO: 8449384 - DNA, 22 bp, Homo sapiens
ttggcttcaatgtcagagacag

SEQ ID NO: 8449385 - DNA, 22 bp, Homo sapiens
ttggctggtttcaagaaggcat

SEQ ID NO: 8449386 - DNA, 22 bp, Homo sapiens
ttggcttcaatgtcagagacag

SEQ ID NO: 8449387 - DNA, 23 bp, Homo sapiens
ttgggaaatagttaagacatgag

SEQ ID NO: 8449388 - DNA, 22 bp, Homo sapiens
ttgggaaatatggattgttatt

SEQ ID NO: 8449389 - DNA, 22 bp, Homo sapiens
ttgggaaattactctgctagga

SEQ ID NO: 8449390 - DNA, 22 bp, Homo sapiens
ttgggaagaaacatgtccatca

SEQ ID NO: 8449391 - DNA, 22 bp, Homo sapiens
ttgggaaagccacaaattggag

SEQ ID NO: 8449392 - DNA, 22 bp, Homo sapiens
ttgggaaagggattatgagtag

SEQ ID NO: 8449393 - DNA, 22 bp, Homo sapiens
ttgggaaagaatgagaaggtga

SEQ ID NO: 8449394 - DNA, 22 bp, Homo sapiens
ttgggaaacagtatagctaaca

SEQ ID NO: 8449395 - DNA, 22 bp, Homo sapiens
ttgggaaagaatgagaaggtga

SEQ ID NO: 8449396 - DNA, 22 bp, Homo sapiens
ttgggaaagccacaaattggag

SEQ ID NO: 8449397 - DNA, 18 bp, Homo sapiens
ttggctttgagaactggt

SEQ ID NO: 8449398 - DNA, 22 bp, Homo sapiens
ttgggctcaggagtttgagacc

SEQ ID NO: 8449399 - DNA, 22 bp, Homo sapiens
ttgggctcaggagtttgagacc

SEQ ID NO: 8449400 - DNA, 22 bp, Homo sapiens
ttgggctcaggagtttgagacc

SEQ ID NO: 8449401 - DNA, 23 bp, Homo sapiens
ttgggctcagtggcaggaagagt

SEQ ID NO: 8449402 - DNA, 22 bp, Homo sapiens
ttgggctcaggagtttgagacc

SEQ ID NO: 8449403 - DNA, 22 bp, Homo sapiens
ttgggctgaagtagagggcaga

SEQ ID NO: 8449404 - DNA, 22 bp, Homo sapiens
ttgggctttaattccagagagg

SEQ ID NO: 8449405 - DNA, 22 bp, Homo sapiens
ttggggaagagttgactttgga

SEQ ID NO: 8449406 - DNA, 22 bp, Homo sapiens
ttggggaagctttgaaatactt

SEQ ID NO: 8449407 - DNA, 22 bp, Homo sapiens
ttggggaaggcttccctgtacc

SEQ ID NO: 8449408 - DNA, 22 bp, Homo sapiens
ttgggctggcagaggtggtctt

SEQ ID NO: 8449409 - DNA, 22 bp, Homo sapiens
ttgggctggcccttgtctctgg

SEQ ID NO: 8449410 - DNA, 22 bp, Homo sapiens
ttggccttgtctggtcttctcc

SEQ ID NO: 8449411 - DNA, 22 bp, Homo sapiens
ttggccttgtacatcatattaa

SEQ ID NO: 8449412 - DNA, 22 bp, Homo sapiens
ttggccttctggtgttcatttt

SEQ ID NO: 8449413 - DNA, 22 bp, Homo sapiens
ttggcctacctgggaatgctgg

SEQ ID NO: 8449414 - DNA, 22 bp, Homo sapiens
ttggccctttatgggatgggca

SEQ ID NO: 8449415 - DNA, 22 bp, Homo sapiens
ttggcccagggtcagcggcgct

SEQ ID NO: 8449416 - DNA, 22 bp, Homo sapiens
ttggcccagactcggggactga

SEQ ID NO: 8449417 - DNA, 22 bp, Homo sapiens
ttggcccagcatgcgggtctgt

SEQ ID NO: 8449418 - DNA, 22 bp, Homo sapiens
ttggcagatgaacacaactgga

SEQ ID NO: 8449419 - DNA, 22 bp, Homo sapiens
ttggcagaggggccacctgccc

SEQ ID NO: 8449420 - DNA, 22 bp, Homo sapiens
ttggcagagagtatgctgaaga

SEQ ID NO: 8449421 - DNA, 22 bp, Homo sapiens
ttggcagagccccagccttgga

SEQ ID NO: 8449422 - DNA, 22 bp, Homo sapiens
ttggcagagggaccagcctaca

SEQ ID NO: 8449423 - DNA, 22 bp, Homo sapiens
ttggctacatcgaggctccagc

SEQ ID NO: 8449424 - DNA, 22 bp, Homo sapiens
ttggctatgcttgtgttcagtt

SEQ ID NO: 8449425 - DNA, 22 bp, Homo sapiens
ttggcctttgctgggctgttga

SEQ ID NO: 8449426 - DNA, 19 bp, Homo sapiens
ttggccttgtttcatatct

SEQ ID NO: 8449427 - DNA, 22 bp, Homo sapiens
ttggcgcccaggacgccgccgc

SEQ ID NO: 8449428 - DNA, 21 bp, Homo sapiens
ttggcctttgtctcagacact

SEQ ID NO: 8449429 - DNA, 22 bp, Homo sapiens
ttggcctttgtcatcaagatca

SEQ ID NO: 8449430 - DNA, 20 bp, Homo sapiens
ttggctcagatttttatggg

SEQ ID NO: 8449431 - DNA, 22 bp, Homo sapiens
ttggctcagctgggactgttga

SEQ ID NO: 8449432 - DNA, 22 bp, Homo sapiens
ttggctgctggtctttggatat

SEQ ID NO: 8449433 - DNA, 22 bp, Homo sapiens
ttggctgctggtctttggatat

SEQ ID NO: 8449434 - DNA, 22 bp, Homo sapiens
ttggctgctttactctgacggg

SEQ ID NO: 8449435 - DNA, 22 bp, Homo sapiens
ttggctcccactaactccagca

SEQ ID NO: 8449436 - DNA, 22 bp, Homo sapiens
ttggctcattaaagatgataat

SEQ ID NO: 8449437 - DNA, 22 bp, Homo sapiens
ttggctcagtgtgagggagatg

SEQ ID NO: 8449438 - DNA, 22 bp, Homo sapiens
ttggctggcttctcgacttgtt

SEQ ID NO: 8449439 - DNA, 22 bp, Homo sapiens
ttggctggtaagccaaatgaaa

SEQ ID NO: 8449440 - DNA, 22 bp, Homo sapiens
ttggctggtttcaagaaggcat

SEQ ID NO: 8449441 - DNA, 22 bp, Homo sapiens
ttgtggcagaccatgagtctaa

SEQ ID NO: 8449442 - DNA, 22 bp, Homo sapiens
ttgttcagaaatttggactcct

SEQ ID NO: 8449443 - DNA, 22 bp, Homo sapiens
ttgttcaggcctgggacagttt

SEQ ID NO: 8449444 - DNA, 22 bp, Homo sapiens
ttgtgctcttattgtgcaggga

SEQ ID NO: 8449445 - DNA, 22 bp, Homo sapiens
ttgtgctgagcttctagctgtg

SEQ ID NO: 8449446 - DNA, 22 bp, Homo sapiens
ttgtgctctgtgttatttaagg

SEQ ID NO: 8449447 - DNA, 22 bp, Homo sapiens
ttgtgctcctatgagaatctaa

SEQ ID NO: 8449448 - DNA, 22 bp, Homo sapiens
ttgtgctcctgtgagaatctag

SEQ ID NO: 8449449 - DNA, 22 bp, Homo sapiens
ttgtggaagccctatgagagac

SEQ ID NO: 8449450 - DNA, 22 bp, Homo sapiens
ttgtggaagccctatgagagac

SEQ ID NO: 8449451 - DNA, 22 bp, Homo sapiens
ttgtggaagccctatgagagac

SEQ ID NO: 8449452 - DNA, 22 bp, Homo sapiens
ttgtgagtagtgccgcaataaa

SEQ ID NO: 8449453 - DNA, 22 bp, Homo sapiens
ttgtgagatgatttgaaagtgt

SEQ ID NO: 8449454 - DNA, 22 bp, Homo sapiens
ttgtgcaaagggggttaatcat

SEQ ID NO: 8449455 - DNA, 22 bp, Homo sapiens
ttgtgcaaggtctggactatag

SEQ ID NO: 8449456 - DNA, 22 bp, Homo sapiens
ttgtgcaaggctcttggaatgt

SEQ ID NO: 8449457 - DNA, 22 bp, Homo sapiens
ttgtgcaatagttttctcatga

SEQ ID NO: 8449458 - DNA, 22 bp, Homo sapiens
ttgtgcaatagttttctcatga

SEQ ID NO: 8449459 - DNA, 22 bp, Homo sapiens
ttgtgcattagggaaaggaact

SEQ ID NO: 8449460 - DNA, 22 bp, Homo sapiens
ttgtgcatgactgtgaatagct

SEQ ID NO: 8449461 - DNA, 22 bp, Homo sapiens
ttgtagaatcattatttctagt

SEQ ID NO: 8449462 - DNA, 22 bp, Homo sapiens
ttgtagaacatgcagcacaatg

SEQ ID NO: 8449463 - DNA, 22 bp, Homo sapiens
ttgtacttaaatatgcaaatag

SEQ ID NO: 8449464 - DNA, 22 bp, Homo sapiens
ttgtacttgccatagaacaaca

SEQ ID NO: 8449465 - DNA, 22 bp, Homo sapiens
ttgtacttttgtcaggtggaca

SEQ ID NO: 8449466 - DNA, 22 bp, Homo sapiens
ttgtagaaaattagatgcatgg

SEQ ID NO: 8449467 - DNA, 22 bp, Homo sapiens
ttgtagatggcttatttctgtg

SEQ ID NO: 8449468 - DNA, 22 bp, Homo sapiens
ttgtagctgaaagtaaagaagt

SEQ ID NO: 8449469 - DNA, 22 bp, Homo sapiens
ttgtagctaggtttttgtagaa

SEQ ID NO: 8449470 - DNA, 22 bp, Homo sapiens
ttgggggcatattgagtagtgg

SEQ ID NO: 8449471 - DNA, 22 bp, Homo sapiens
ttgggggcagagggagcatctg

SEQ ID NO: 8449472 - DNA, 22 bp, Homo sapiens
ttggggggttgaggagtagata

SEQ ID NO: 8449473 - DNA, 19 bp, Homo sapiens
ttggggtgaatgccagaca

SEQ ID NO: 8449474 - DNA, 18 bp, Homo sapiens
ttggggtgaggccaggaa

SEQ ID NO: 8449475 - DNA, 18 bp, Homo sapiens
ttggggtgaggccaggaa

SEQ ID NO: 8449476 - DNA, 22 bp, Homo sapiens
ttgtatttatattgaatagctt

SEQ ID NO: 8449477 - DNA, 22 bp, Homo sapiens
ttgtatttcctataacctttct

SEQ ID NO: 8449478 - DNA, 22 bp, Homo sapiens
ttgtattcttccttagcagtac

SEQ ID NO: 8449479 - DNA, 20 bp, Homo sapiens
ttgtattccttgaatcaggt

SEQ ID NO: 8449480 - DNA, 22 bp, Homo sapiens
ttgtattaaaatgtgtttctgt

SEQ ID NO: 8449481 - DNA, 22 bp, Homo sapiens
ttgtatgtttctgtgcacatga

SEQ ID NO: 8449482 - DNA, 22 bp, Homo sapiens
ttgtatatattcttaaagatgt

SEQ ID NO: 8449483 - DNA, 22 bp, Homo sapiens
ttgtatatattcttaaagatgt

SEQ ID NO: 8449484 - DNA, 22 bp, Homo sapiens
ttgtagctttttaatgtgctgc

SEQ ID NO: 8449485 - DNA, 22 bp, Homo sapiens
ttgtagcttatcaaggctgttt

SEQ ID NO: 8449486 - DNA, 22 bp, Homo sapiens
tttacagatgtggaaagtgagc

SEQ ID NO: 8449487 - DNA, 22 bp, Homo sapiens
tttacagatgtggaaagtgagc

SEQ ID NO: 8449488 - DNA, 22 bp, Homo sapiens
tttacagatgtggaaagtgagc

SEQ ID NO: 8449489 - DNA, 22 bp, Homo sapiens
tttacagcactgaagccagggg

SEQ ID NO: 8449490 - DNA, 22 bp, Homo sapiens
tttacagcactgaagccagggg

SEQ ID NO: 8449491 - DNA, 22 bp, Homo sapiens
tttacagatgaggatactgagg

SEQ ID NO: 8449492 - DNA, 22 bp, Homo sapiens
tttacagatgaggaaactgaga

SEQ ID NO: 8449493 - DNA, 22 bp, Homo sapiens
tttacagaatgtcaatttctat

SEQ ID NO: 8449494 - DNA, 22 bp, Homo sapiens
tttacagaagagaaggatgctt

SEQ ID NO: 8449495 - DNA, 22 bp, Homo sapiens
tttacagagaatgtacataaag

SEQ ID NO: 8449496 - DNA, 22 bp, Homo sapiens
tttacagacaacttaatagggg

SEQ ID NO: 8449497 - DNA, 22 bp, Homo sapiens
tttacagagagagaactggact

SEQ ID NO: 8449498 - DNA, 22 bp, Homo sapiens
tttaagacttagatttattggg

SEQ ID NO: 8449499 - DNA, 20 bp, Homo sapiens
tttaagaagtttctgaggaa

SEQ ID NO: 8449500 - DNA, 22 bp, Homo sapiens
tttaagatcatttgtattatcc

SEQ ID NO: 8449501 - DNA, 22 bp, Homo sapiens
tttaagatctatcccattttgt

SEQ ID NO: 8449502 - DNA, 22 bp, Homo sapiens
tttacaagtcagggactgttct

SEQ ID NO: 8449503 - DNA, 22 bp, Homo sapiens
tttaagagcctgtacaaatatt

SEQ ID NO: 8449504 - DNA, 19 bp, Homo sapiens
tttacaagttctttgtatg

SEQ ID NO: 8449505 - DNA, 22 bp, Homo sapiens
tttacaagtcagggactgttct

SEQ ID NO: 8449506 - DNA, 22 bp, Homo sapiens
tttaacttgatcagtagagcat

SEQ ID NO: 8449507 - DNA, 22 bp, Homo sapiens
tttaagaagttatgttataaat

SEQ ID NO: 8449508 - DNA, 22 bp, Homo sapiens
tttaaattatagttaatgtctg

SEQ ID NO: 8449509 - DNA, 22 bp, Homo sapiens
tttaaattatagttaatgtctg

SEQ ID NO: 8449510 - DNA, 22 bp, Homo sapiens
tttaaattatagttaatgtctg

SEQ ID NO: 8449511 - DNA, 22 bp, Homo sapiens
ttgttgccaaatgtaaaatatg

SEQ ID NO: 8449512 - DNA, 22 bp, Homo sapiens
tttatgaaccactctacacctt

SEQ ID NO: 8449513 - DNA, 22 bp, Homo sapiens
tttatgtcaaaactacagttgg

SEQ ID NO: 8449514 - DNA, 22 bp, Homo sapiens
tttatgtcccttcaaatgttta

SEQ ID NO: 8449515 - DNA, 22 bp, Homo sapiens
tttatgtttgcattttcaaaga

SEQ ID NO: 8449516 - DNA, 22 bp, Homo sapiens
tttatgtttgcattttcaaaga

SEQ ID NO: 8449517 - DNA, 16 bp, Homo sapiens
tttatttactagtgtt

SEQ ID NO: 8449518 - DNA, 22 bp, Homo sapiens
tttattgggtgcagtgcccaca

SEQ ID NO: 8449519 - DNA, 20 bp, Homo sapiens
tttattggcctttcaggaac

SEQ ID NO: 8449520 - DNA, 22 bp, Homo sapiens
tttattgggcctggaggatcta

SEQ ID NO: 8449521 - DNA, 22 bp, Homo sapiens
tttattggatatttacaagata

SEQ ID NO: 8449522 - DNA, 22 bp, Homo sapiens
tttattggatgggtcagctcta

SEQ ID NO: 8449523 - DNA, 22 bp, Homo sapiens
tttattggatggatggatggat

SEQ ID NO: 8449524 - DNA, 22 bp, Homo sapiens
tttattggaacacagccatgac

SEQ ID NO: 8449525 - DNA, 22 bp, Homo sapiens
tttatctgttgtacctgcattg

SEQ ID NO: 8449526 - DNA, 22 bp, Homo sapiens
tttatctgttgtacatttatgc

SEQ ID NO: 8449527 - DNA, 22 bp, Homo sapiens
tttatcttctgcagttctggct

SEQ ID NO: 8449528 - DNA, 22 bp, Homo sapiens
tttagtgtaagcataaagaaca

SEQ ID NO: 8449529 - DNA, 22 bp, Homo sapiens
tttagtgtaagcataaagaaca

SEQ ID NO: 8449530 - DNA, 22 bp, Homo sapiens
tttagtgtaattctgccttttg

SEQ ID NO: 8449531 - DNA, 22 bp, Homo sapiens
tttagtgtagcattcagagtca

SEQ ID NO: 8449532 - DNA, 22 bp, Homo sapiens
tttagtgtagcattcagagtca

SEQ ID NO: 8449533 - DNA, 22 bp, Homo sapiens
tttagtgtagcctaagcagaat

SEQ ID NO: 8449534 - DNA, 22 bp, Homo sapiens
tttagtgtggcactgatgttca

SEQ ID NO: 8449535 - DNA, 22 bp, Homo sapiens
tttagtgtagcctaagcagaat

SEQ ID NO: 8449536 - DNA, 22 bp, Homo sapiens
tttagtgtgacagtccccagta

SEQ ID NO: 8449537 - DNA, 22 bp, Homo sapiens
tttagtgtagcctaagcagaat

SEQ ID NO: 8449538 - DNA, 22 bp, Homo sapiens
tttagtgtggcactgatgttca

SEQ ID NO: 8449539 - DNA, 22 bp, Homo sapiens
tttagtgtttgcgtgtactcct

SEQ ID NO: 8449540 - DNA, 22 bp, Homo sapiens
tttatctgcattctgaccatct

SEQ ID NO: 8449541 - DNA, 22 bp, Homo sapiens
tttagttattgcacagaattag

SEQ ID NO: 8449542 - DNA, 22 bp, Homo sapiens
tttagctatggataacaaccac

SEQ ID NO: 8449543 - DNA, 19 bp, Homo sapiens
tttagcttacgtttcattg

SEQ ID NO: 8449544 - DNA, 22 bp, Homo sapiens
tttagcttcagttctagcttct

SEQ ID NO: 8449545 - DNA, 22 bp, Homo sapiens
tttagctttacctcatagattt

SEQ ID NO: 8449546 - DNA, 22 bp, Homo sapiens
tttagcttttgtgtcagataag

SEQ ID NO: 8449547 - DNA, 22 bp, Homo sapiens
tttaggaaatactgtcctatga

SEQ ID NO: 8449548 - DNA, 22 bp, Homo sapiens
tttaggaatattttctttcagg

SEQ ID NO: 8449549 - DNA, 22 bp, Homo sapiens
tttaggatgctctattctgact

SEQ ID NO: 8449550 - DNA, 22 bp, Homo sapiens
tttaggatcaatgagaaagtct

SEQ ID NO: 8449551 - DNA, 22 bp, Homo sapiens
tttaggatattaatgttcagag

SEQ ID NO: 8449552 - DNA, 22 bp, Homo sapiens
tttcctttgcccaatacatgtc

SEQ ID NO: 8449553 - DNA, 22 bp, Homo sapiens
tttcctttgcccaatacatgtc

SEQ ID NO: 8449554 - DNA, 22 bp, Homo sapiens
tttcctttgagggtcctacact

SEQ ID NO: 8449555 - DNA, 22 bp, Homo sapiens
tttcctttgggagcatgaattt

SEQ ID NO: 8449556 - DNA, 22 bp, Homo sapiens
tttccttgcacattggtttcca

SEQ ID NO: 8449557 - DNA, 23 bp, Homo sapiens
tttcccaccctctctcattgctg

SEQ ID NO: 8449558 - DNA, 22 bp, Homo sapiens
tttcccaagtgtaaacatggca

SEQ ID NO: 8449559 - DNA, 22 bp, Homo sapiens
tttcccacacagtccactgcag

SEQ ID NO: 8449560 - DNA, 22 bp, Homo sapiens
tttccatattctgcgtctgcca

SEQ ID NO: 8449561 - DNA, 22 bp, Homo sapiens
tttctaagatgtggtttcaagg

SEQ ID NO: 8449562 - DNA, 22 bp, Homo sapiens
tttctaaggaaagtacctggga

SEQ ID NO: 8449563 - DNA, 22 bp, Homo sapiens
tttcgagggccttaagtattcc

SEQ ID NO: 8449564 - DNA, 22 bp, Homo sapiens
tttctaaaatagattttatggt

SEQ ID NO: 8449565 - DNA, 22 bp, Homo sapiens
tttccaaataaggtcacattct

SEQ ID NO: 8449566 - DNA, 22 bp, Homo sapiens
tttcatcttccttggcataggt

SEQ ID NO: 8449567 - DNA, 17 bp, Homo sapiens
tttcatctgggaccacc

SEQ ID NO: 8449568 - DNA, 22 bp, Homo sapiens
tttccaggaagtaaggataatc

SEQ ID NO: 8449569 - DNA, 22 bp, Homo sapiens
tttccaggagaaagagagcctt

SEQ ID NO: 8449570 - DNA, 22 bp, Homo sapiens
tttccaggcagaggagttgtga

SEQ ID NO: 8449571 - DNA, 22 bp, Homo sapiens
tttccaaataaggtcacattct

SEQ ID NO: 8449572 - DNA, 22 bp, Homo sapiens
tttccaggtgcatagaaaacag

SEQ ID NO: 8449573 - DNA, 22 bp, Homo sapiens
tttccaggtattaatactgtat

SEQ ID NO: 8449574 - DNA, 22 bp, Homo sapiens
tttccaggtatcaagcttcagg

SEQ ID NO: 8449575 - DNA, 22 bp, Homo sapiens
tttccagtccctggatttaacc

SEQ ID NO: 8449576 - DNA, 22 bp, Homo sapiens
tttccagtgattgctgctctca

SEQ ID NO: 8449577 - DNA, 22 bp, Homo sapiens
tttccagtgattgctgctctca

SEQ ID NO: 8449578 - DNA, 22 bp, Homo sapiens
tttccagtgaattagtctgttt

SEQ ID NO: 8449579 - DNA, 22 bp, Homo sapiens
tttcataatagtgcagtttgtt

SEQ ID NO: 8449580 - DNA, 22 bp, Homo sapiens
tttcataatctgtcaagtgggg

SEQ ID NO: 8449581 - DNA, 22 bp, Homo sapiens
tttcataatgtcacagtcaaaa

SEQ ID NO: 8449582 - DNA, 22 bp, Homo sapiens
tttcatcatgttggcagattgg

SEQ ID NO: 8449583 - DNA, 22 bp, Homo sapiens
tttcatctctctaaaagacagt

SEQ ID NO: 8449584 - DNA, 23 bp, Homo sapiens
tttatttatttaggctgagggat

SEQ ID NO: 8449585 - DNA, 22 bp, Homo sapiens
tttatttatccttctggattgc

SEQ ID NO: 8449586 - DNA, 22 bp, Homo sapiens
tttatttatccttctggattgc

SEQ ID NO: 8449587 - DNA, 22 bp, Homo sapiens
tttatttatccttctggattgc

SEQ ID NO: 8449588 - DNA, 21 bp, Homo sapiens
tttatttatataggacacatg

SEQ ID NO: 8449589 - DNA, 22 bp, Homo sapiens
tttatttataagccacttgctg

SEQ ID NO: 8449590 - DNA, 22 bp, Homo sapiens
tttatttataagccacttgctg

SEQ ID NO: 8449591 - DNA, 21 bp, Homo sapiens
tttatttatataggacacatg

SEQ ID NO: 8449592 - DNA, 22 bp, Homo sapiens
tttcaagtcattctataatatc

SEQ ID NO: 8449593 - DNA, 22 bp, Homo sapiens
tttcaaggatgttatataaatg

SEQ ID NO: 8449594 - DNA, 22 bp, Homo sapiens
tttcaaggatgttatataaatg

SEQ ID NO: 8449595 - DNA, 23 bp, Homo sapiens
tttcaaggtgtctgtaccactga

SEQ ID NO: 8449596 - DNA, 17 bp, Homo sapiens
tttcaaggttacgttcc

SEQ ID NO: 8449597 - DNA, 17 bp, Homo sapiens
tttcaaggttacgttcc

SEQ ID NO: 8449598 - DNA, 22 bp, Homo sapiens
tttcaaggctagttttaattag

SEQ ID NO: 8449599 - DNA, 22 bp, Homo sapiens
tttcaaggtgcaggagggtttt

SEQ ID NO: 8449600 - DNA, 19 bp, Homo sapiens
tttcaatggcttagagaaa

SEQ ID NO: 8449601 - DNA, 19 bp, Homo sapiens
tttcaatggcttagagaaa

SEQ ID NO: 8449602 - DNA, 22 bp, Homo sapiens
tttcacaactgcttatttgaga

SEQ ID NO: 8449603 - DNA, 22 bp, Homo sapiens
tttcacaagtttcaggattctg

SEQ ID NO: 8449604 - DNA, 22 bp, Homo sapiens
tttcataaacagtagaagacta

SEQ ID NO: 8449605 - DNA, 22 bp, Homo sapiens
tttcagtttgaaggaaaggcca

SEQ ID NO: 8449606 - DNA, 22 bp, Homo sapiens
tttcacatttaggcgtgaattg

SEQ ID NO: 8449607 - DNA, 22 bp, Homo sapiens
tttcacatttgttttaagaagt

SEQ ID NO: 8449608 - DNA, 23 bp, Homo sapiens
tttcacattaatgtttagcagga

SEQ ID NO: 8449609 - DNA, 22 bp, Homo sapiens
tttcacattagatatgtcattt

SEQ ID NO: 8449610 - DNA, 22 bp, Homo sapiens
tttcacattcttctgaatctac

SEQ ID NO: 8449611 - DNA, 20 bp, Homo sapiens
tttcacatctgtccctttaa

SEQ ID NO: 8449612 - DNA, 22 bp, Homo sapiens
tttcacatggaagctctcgaga

SEQ ID NO: 8449613 - DNA, 22 bp, Homo sapiens
tttcacatgcagcagggaagtg

SEQ ID NO: 8449614 - DNA, 22 bp, Homo sapiens
tttcacatgtatataggcatta

SEQ ID NO: 8449615 - DNA, 22 bp, Homo sapiens
tttcacatcatgggatggaagc

SEQ ID NO: 8449616 - DNA, 22 bp, Homo sapiens
tttcacatatggttgttgattg

SEQ ID NO: 8449617 - DNA, 22 bp, Homo sapiens
tttgacatgcaaagcactttag

SEQ ID NO: 8449618 - DNA, 22 bp, Homo sapiens
tttgacattaaggaacatatat

SEQ ID NO: 8449619 - DNA, 22 bp, Homo sapiens
tttgagaaggtgacaaattcta

SEQ ID NO: 8449620 - DNA, 22 bp, Homo sapiens
tttgaacatgctgcatgataat

SEQ ID NO: 8449621 - DNA, 22 bp, Homo sapiens
tttgaacatgctgcatgataat

SEQ ID NO: 8449622 - DNA, 22 bp, Homo sapiens
tttgaactacctctccttagca

SEQ ID NO: 8449623 - DNA, 22 bp, Homo sapiens
tttgaacctgagcttctgcatg

SEQ ID NO: 8449624 - DNA, 22 bp, Homo sapiens
tttgaacaggagtatctatagt

SEQ ID NO: 8449625 - DNA, 22 bp, Homo sapiens
tttgaagacagatcaatataag

SEQ ID NO: 8449626 - DNA, 22 bp, Homo sapiens
tttgaagacatattgttacata

SEQ ID NO: 8449627 - DNA, 22 bp, Homo sapiens
tttgaagacatttgaatacttt

SEQ ID NO: 8449628 - DNA, 22 bp, Homo sapiens
tttgaaagtgtttacttgggaa

SEQ ID NO: 8449629 - DNA, 22 bp, Homo sapiens
tttgaaatatgtgatgagagag

SEQ ID NO: 8449630 - DNA, 22 bp, Homo sapiens
tttgaaatatgtgatgagagag

SEQ ID NO: 8449631 - DNA, 22 bp, Homo sapiens
tttgaaatatgtgatgagagag

SEQ ID NO: 8449632 - DNA, 22 bp, Homo sapiens
tttgaaatctaatcaaggaaca

SEQ ID NO: 8449633 - DNA, 22 bp, Homo sapiens
tttgaaatgtatcagtataggt

SEQ ID NO: 8449634 - DNA, 22 bp, Homo sapiens
tttgaaatgtatcagtataggt

SEQ ID NO: 8449635 - DNA, 22 bp, Homo sapiens
tttctattgatctaataaacat

SEQ ID NO: 8449636 - DNA, 22 bp, Homo sapiens
tttctattctggatctgtggca

SEQ ID NO: 8449637 - DNA, 22 bp, Homo sapiens
tttctataatctaccatgccag

SEQ ID NO: 8449638 - DNA, 22 bp, Homo sapiens
tttctatatgaggagctaaagt

SEQ ID NO: 8449639 - DNA, 19 bp, Homo sapiens
tttctagtttcagcttgtc

SEQ ID NO: 8449640 - DNA, 22 bp, Homo sapiens
tttctagttctaccacagtaat

SEQ ID NO: 8449641 - DNA, 22 bp, Homo sapiens
tttctagtcttccctacctccc

SEQ ID NO: 8449642 - DNA, 22 bp, Homo sapiens
tttctaggacatgataggatat

SEQ ID NO: 8449643 - DNA, 22 bp, Homo sapiens
tttctaggtcttccatactgcc

SEQ ID NO: 8449644 - DNA, 20 bp, Homo sapiens
tttgagaccagtctgcccaa

SEQ ID NO: 8449645 - DNA, 20 bp, Homo sapiens
tttgagaccagtctgcccaa

SEQ ID NO: 8449646 - DNA, 22 bp, Homo sapiens
tttgcattagtttagatttcaa

SEQ ID NO: 8449647 - DNA, 22 bp, Homo sapiens
tttgcagtttcattgctgaaat

SEQ ID NO: 8449648 - DNA, 22 bp, Homo sapiens
tttgctgtcagccgctattttc

SEQ ID NO: 8449649 - DNA, 20 bp, Homo sapiens
tttgctgtgggtgtaagaat

SEQ ID NO: 8449650 - DNA, 22 bp, Homo sapiens
tttgcttcctagttgggtaata

SEQ ID NO: 8449651 - DNA, 22 bp, Homo sapiens
tttgcatttgttcaagtattga

SEQ ID NO: 8449652 - DNA, 22 bp, Homo sapiens
tttgcatttctaatgagctccg

SEQ ID NO: 8449653 - DNA, 22 bp, Homo sapiens
tttgcattgcattaagtattct

SEQ ID NO: 8449654 - DNA, 22 bp, Homo sapiens
tttgcattgtaatatttagttc

SEQ ID NO: 8449655 - DNA, 22 bp, Homo sapiens
tttgtcatatagactattgtga

SEQ ID NO: 8449656 - DNA, 22 bp, Homo sapiens
tttggtaaatgcaggttcttct

SEQ ID NO: 8449657 - DNA, 22 bp, Homo sapiens
tttgggcatatagctgttccct

SEQ ID NO: 8449658 - DNA, 22 bp, Homo sapiens
tttgggctcactatgctgaaga

SEQ ID NO: 8449659 - DNA, 22 bp, Homo sapiens
tttggcgtctctcaggagctca

SEQ ID NO: 8449660 - DNA, 22 bp, Homo sapiens
tttggctaattaggtgctgatt

SEQ ID NO: 8449661 - DNA, 22 bp, Homo sapiens
tttggcctcatgaatttcttgc

SEQ ID NO: 8449662 - DNA, 22 bp, Homo sapiens
tttggcctcatgaatttcttgc

SEQ ID NO: 8449663 - DNA, 22 bp, Homo sapiens
tttggcctcgtttagaaatggc

SEQ ID NO: 8449664 - DNA, 22 bp, Homo sapiens
tttggccttagtccagaagaag

SEQ ID NO: 8449665 - DNA, 22 bp, Homo sapiens
tttggcatgggctatttgcttt

SEQ ID NO: 8449666 - DNA, 21 bp, Homo sapiens
tttggcagtttcccaggaaat

SEQ ID NO: 8449667 - DNA, 22 bp, Homo sapiens
tttggcatagctctttgttcct

SEQ ID NO: 8449668 - DNA, 23 bp, Homo sapiens
tttggcatgttaacttcacttac

SEQ ID NO: 8449669 - DNA, 22 bp, Homo sapiens
tttggctcatctcagtcctagg

SEQ ID NO: 8449670 - DNA, 22 bp, Homo sapiens
tttggctagccaagaaacaaaa

SEQ ID NO: 8449671 - DNA, 22 bp, Homo sapiens
tttggctcggctgctgatggtg

SEQ ID NO: 8449672 - DNA, 22 bp, Homo sapiens
tttggctctagtaaatataacc

SEQ ID NO: 8449673 - DNA, 23 bp, Homo sapiens
tttggctccatgggtggctcatt

SEQ ID NO: 8449674 - DNA, 22 bp, Homo sapiens
tttggctcgatggactttgaat

SEQ ID NO: 8449675 - DNA, 19 bp, Homo sapiens
tttggctctggtcagagag

SEQ ID NO: 8449676 - DNA, 22 bp, Homo sapiens
tttggcttaacttacatgatat

SEQ ID NO: 8449677 - DNA, 22 bp, Homo sapiens
tttggctcttcccgtaccataa

SEQ ID NO: 8449678 - DNA, 22 bp, Homo sapiens
ttttttatctatggtagtacca

SEQ ID NO: 8449679 - DNA, 22 bp, Homo sapiens
ttttttatagcaatgaacccac

SEQ ID NO: 8449680 - DNA, 22 bp, Homo sapiens
ttttttatatcaactgaagtct

SEQ ID NO: 8449681 - DNA, 22 bp, Homo sapiens
tttttgttcccagagaatttgt

SEQ ID NO: 8449682 - DNA, 22 bp, Homo sapiens
ttttgtctaagaactttgcaaa

SEQ ID NO: 8449683 - DNA, 22 bp, Homo sapiens
ttttgtctaagaactttgcaaa

SEQ ID NO: 8449684 - DNA, 19 bp, Homo sapiens
ttttgtgtagctgctggtt

SEQ ID NO: 8449685 - DNA, 23 bp, Homo sapiens
ttttgtgtgacttaatatctctt

SEQ ID NO: 8449686 - DNA, 22 bp, Homo sapiens
ttttgtgtccttcacatcatgt

SEQ ID NO: 8449687 - DNA, 22 bp, Homo sapiens
ttttgtgtccttcacatcatgt

SEQ ID NO: 8449688 - DNA, 22 bp, Homo sapiens
ttttgtgttgccatgttaagca

SEQ ID NO: 8449689 - DNA, 17 bp, Homo sapiens
ttttgttcatcttcaaa

SEQ ID NO: 8449690 - DNA, 22 bp, Homo sapiens
ttttgtgttgccatgttaagca

SEQ ID NO: 8449691 - DNA, 22 bp, Homo sapiens
ttttgtgttgtaatgtcagcta

SEQ ID NO: 8449692 - DNA, 17 bp, Homo sapiens
ttttgttcatcttcaaa

SEQ ID NO: 8449693 - DNA, 22 bp, Homo sapiens
ttttcctatatgcaaagaatgc

SEQ ID NO: 8449694 - DNA, 22 bp, Homo sapiens
ttttcctagtaggcctattaga

SEQ ID NO: 8449695 - DNA, 22 bp, Homo sapiens
ttttcctcacctaactcaaggt

SEQ ID NO: 8449696 - DNA, 22 bp, Homo sapiens
ttttcctcacctaactcaaggt

SEQ ID NO: 8449697 - DNA, 22 bp, Homo sapiens
ttttcccatctacaaagcaggg

SEQ ID NO: 8449698 - DNA, 22 bp, Homo sapiens
ttttcctactgataaacagtta

SEQ ID NO: 8449699 - DNA, 20 bp, Homo sapiens
ttttcctcgtgtttgttcta

SEQ ID NO: 8449700 - DNA, 22 bp, Homo sapiens
ttttcctcaggaatgctaagct

SEQ ID NO: 8449701 - DNA, 22 bp, Homo sapiens
ttttcctctgcagagcagttag

SEQ ID NO: 8449702 - DNA, 19 bp, Homo sapiens
ttttccttctatatgtttc

SEQ ID NO: 8449703 - DNA, 22 bp, Homo sapiens
ttttggctcttggtaggtcaga

SEQ ID NO: 8449704 - DNA, 19 bp, Homo sapiens
ttttggctggagtgatctg

SEQ ID NO: 8449705 - DNA, 22 bp, Homo sapiens
ttttggctgtagctggaaatct

SEQ ID NO: 8449706 - DNA, 22 bp, Homo sapiens
ttttggcttaaagagaatgtat

SEQ ID NO: 8449707 - DNA, 22 bp, Homo sapiens
ttttggcttttcctcagcaagc

SEQ ID NO: 8449708 - DNA, 17 bp, Homo sapiens
ttttggtgagttgtttc

SEQ ID NO: 8449709 - DNA, 22 bp, Homo sapiens
ttttaattttagcccttctggt

SEQ ID NO: 8449710 - DNA, 22 bp, Homo sapiens
ttttacaagctgagtcgttaaa

SEQ ID NO: 8449711 - DNA, 22 bp, Homo sapiens
ttttacaaatgaggagctggag

SEQ ID NO: 8449712 - DNA, 22 bp, Homo sapiens
ttttacacctcagatgagcaga

SEQ ID NO: 8449713 - DNA, 22 bp, Homo sapiens
ttttacaagctgagtcgttaaa

SEQ ID NO: 8449714 - DNA, 22 bp, Homo sapiens
ttttacaggtcataggtatagt

SEQ ID NO: 8449715 - DNA, 21 bp, Homo sapiens
ttttacagatgaggggaaggg

SEQ ID NO: 8449716 - DNA, 22 bp, Homo sapiens
ttttacaggtgaaaaatgaaga

SEQ ID NO: 8449717 - DNA, 22 bp, Homo sapiens
ttttacaggtgtgagccaccat

SEQ ID NO: 8449718 - DNA, 22 bp, Homo sapiens
ttttacagtcagtcaaactcag

SEQ ID NO: 8449719 - DNA, 22 bp, Homo sapiens
ttttacagttccatgcaaagcg

SEQ ID NO: 8449720 - DNA, 22 bp, Homo sapiens
tttgtgatctcctccctctaga

SEQ ID NO: 8449721 - DNA, 22 bp, Homo sapiens
tttgtgattaattttcaacctc

SEQ ID NO: 8449722 - DNA, 22 bp, Homo sapiens
tttgtggcaggagcggagaccg

SEQ ID NO: 8449723 - DNA, 19 bp, Homo sapiens
tttgtctctgaataatatt

SEQ ID NO: 8449724 - DNA, 22 bp, Homo sapiens
tttgtcttaaatcttgttactg

SEQ ID NO: 8449725 - DNA, 22 bp, Homo sapiens
tttgtcttccccctttaatcag

SEQ ID NO: 8449726 - DNA, 22 bp, Homo sapiens
ttttagaagtgcctatcctatg

SEQ ID NO: 8449727 - DNA, 22 bp, Homo sapiens
ttttagaagtgcctatcctatg

SEQ ID NO: 8449728 - DNA, 22 bp, Homo sapiens
ttttagaagtgcctatcctatg

SEQ ID NO: 8449729 - DNA, 22 bp, Homo sapiens
ttttattggtaatgataaaagt

SEQ ID NO: 8449730 - DNA, 22 bp, Homo sapiens
ttttacattgggaaatgcctct

SEQ ID NO: 8449731 - DNA, 18 bp, Homo sapiens
ttttactcatagcaggcc

SEQ ID NO: 8449732 - DNA, 22 bp, Homo sapiens
ttttagaaatactgatttagtg

SEQ ID NO: 8449733 - DNA, 22 bp, Homo sapiens
ttttagaaggaatgctatggtg

SEQ ID NO: 8449734 - DNA, 22 bp, Homo sapiens
ttttagaaatactgatttagtg

SEQ ID NO: 8449735 - DNA, 22 bp, Homo sapiens
ttttagaaagatccctggcagg

SEQ ID NO: 8449736 - DNA, 22 bp, Homo sapiens
ttttagaaagatccctggcagg

SEQ ID NO: 8449737 - DNA, 22 bp, Homo sapiens
ttttagaaagatccctggcagg

SEQ ID NO: 8449738 - DNA, 22 bp, Homo sapiens
ttttcaaagactggaggctgat

SEQ ID NO: 8449739 - DNA, 22 bp, Homo sapiens
ttttcaattttgaggcagtggt

SEQ ID NO: 8449740 - DNA, 22 bp, Homo sapiens
ttttcaagagagtgttctatgt

SEQ ID NO: 8449741 - DNA, 22 bp, Homo sapiens
ttttattgtcaatgaagacaga

SEQ ID NO: 8449742 - DNA, 21 bp, Homo sapiens
ttttttcttgcgtgaggcctg

SEQ ID NO: 8449743 - DNA, 22 bp, Homo sapiens
ttttttggataataaacgatct

SEQ ID NO: 8449744 - DNA, 22 bp, Homo sapiens
ttttttggtgctcctaggaagg

SEQ ID NO: 8449745 - DNA, 21 bp, Homo sapiens
aagaagtttggattttgtcct

SEQ ID NO: 8449746 - DNA, 20 bp, Homo sapiens
aagaagttggtaagcagtgc

SEQ ID NO: 8449747 - DNA, 20 bp, Homo sapiens
aagaagttggtaagcagtgc

SEQ ID NO: 8449748 - DNA, 18 bp, Homo sapiens
aagaagttggccaaagag

SEQ ID NO: 8449749 - DNA, 18 bp, Homo sapiens
aagaagttggccaaagag

SEQ ID NO: 8449750 - DNA, 23 bp, Homo sapiens
aagaataaatgacattaaaggtg

SEQ ID NO: 8449751 - DNA, 22 bp, Homo sapiens
aagaataaattaagatacttag

SEQ ID NO: 8449752 - DNA, 22 bp, Homo sapiens
aagaataaattaagatacttag

SEQ ID NO: 8449753 - DNA, 22 bp, Homo sapiens
aagaataaattaagatacttag

SEQ ID NO: 8449754 - DNA, 22 bp, Homo sapiens
aattggaaaatgctacatatca

SEQ ID NO: 8449755 - DNA, 22 bp, Homo sapiens
aagaataagaggatttagaaca

SEQ ID NO: 8449756 - DNA, 22 bp, Homo sapiens
aattgtcaaacacaaataagag

SEQ ID NO: 8449757 - DNA, 22 bp, Homo sapiens
aagacaccatttgacagtggca

SEQ ID NO: 8449758 - DNA, 22 bp, Homo sapiens
aagacactaagctttcaggata

SEQ ID NO: 8449759 - DNA, 20 bp, Homo sapiens
aagacaccagtggcagcccc

SEQ ID NO: 8449760 - DNA, 22 bp, Homo sapiens
aagacacagcgaaatgttcctg

SEQ ID NO: 8449761 - DNA, 22 bp, Homo sapiens
aagacagccagctccatgggat

SEQ ID NO: 8449762 - DNA, 22 bp, Homo sapiens
aagacagtgatctctgagagat

SEQ ID NO: 8449763 - DNA, 22 bp, Homo sapiens
aagacagtgtgtcaggcaggtg

SEQ ID NO: 8449764 - DNA, 22 bp, Homo sapiens
aagacaggaacatagcaaatcc

SEQ ID NO: 8449765 - DNA, 22 bp, Homo sapiens
aagacaggaaaagctccaggcc

SEQ ID NO: 8449766 - DNA, 22 bp, Homo sapiens
aagacaggaaaagctccaggcc

SEQ ID NO: 8449767 - DNA, 22 bp, Homo sapiens
aagaaatgcagaaatgtgctgg

SEQ ID NO: 8449768 - DNA, 22 bp, Homo sapiens
aagaaatgcagaaatgtgctgg

SEQ ID NO: 8449769 - DNA, 22 bp, Homo sapiens
aagaaatggaagatccatggtg

SEQ ID NO: 8449770 - DNA, 22 bp, Homo sapiens
aagaaatgctgatgttggatgg

SEQ ID NO: 8449771 - DNA, 22 bp, Homo sapiens
aagaaatggcttcatctgagta

SEQ ID NO: 8449772 - DNA, 22 bp, Homo sapiens
aagaaatgctgatgttggatgg

SEQ ID NO: 8449773 - DNA, 22 bp, Homo sapiens
aatgttttagattactgctggg

SEQ ID NO: 8449774 - DNA, 22 bp, Homo sapiens
aatgttttaaaagagattgaga

SEQ ID NO: 8449775 - DNA, 22 bp, Homo sapiens
aatgttttcattatcctaactg

SEQ ID NO: 8449776 - DNA, 22 bp, Homo sapiens
aatgttttctctgtgaacacat

SEQ ID NO: 8449777 - DNA, 22 bp, Homo sapiens
aagaagcactttcctacatgtt

SEQ ID NO: 8449778 - DNA, 22 bp, Homo sapiens
aatgttttgcattagttttcta

SEQ ID NO: 8449779 - DNA, 22 bp, Homo sapiens
aacttcatgtaatttaaaacag

SEQ ID NO: 8449780 - DNA, 22 bp, Homo sapiens
aacttcatgggttcaaagctgg

SEQ ID NO: 8449781 - DNA, 22 bp, Homo sapiens
aacttagttggggacaccatgg

SEQ ID NO: 8449782 - DNA, 22 bp, Homo sapiens
aacttattccataggctcactg

SEQ ID NO: 8449783 - DNA, 22 bp, Homo sapiens
aacttattgaacattctcgaat

SEQ ID NO: 8449784 - DNA, 22 bp, Homo sapiens
aagaaatgcacacaactgctgg

SEQ ID NO: 8449785 - DNA, 22 bp, Homo sapiens
aagaaatattgggccttataaa

SEQ ID NO: 8449786 - DNA, 22 bp, Homo sapiens
aagaaagcattagacaggcatt

SEQ ID NO: 8449787 - DNA, 22 bp, Homo sapiens
acaaggacgtcacttccacggt

SEQ ID NO: 8449788 - DNA, 22 bp, Homo sapiens
acaaggagagcacacatgggga

SEQ ID NO: 8449789 - DNA, 22 bp, Homo sapiens
acaaggacataggaaactacaa

SEQ ID NO: 8449790 - DNA, 22 bp, Homo sapiens
aagagatgtggaatcatttaca

SEQ ID NO: 8449791 - DNA, 17 bp, Homo sapiens
aagagaggctgagctgg

SEQ ID NO: 8449792 - DNA, 17 bp, Homo sapiens
aagagaggctgagctgg

SEQ ID NO: 8449793 - DNA, 22 bp, Homo sapiens
aagagaggggttgcatggaaat

SEQ ID NO: 8449794 - DNA, 22 bp, Homo sapiens
aagagaggggttgcatggaaat

SEQ ID NO: 8449795 - DNA, 22 bp, Homo sapiens
acaaagatcttgctttcctact

SEQ ID NO: 8449796 - DNA, 22 bp, Homo sapiens
acaaagattcatttgcattatt

SEQ ID NO: 8449797 - DNA, 20 bp, Homo sapiens
acaaagactggaaaagcaag

SEQ ID NO: 8449798 - DNA, 22 bp, Homo sapiens
aagacatcagtgatgacatttg

SEQ ID NO: 8449799 - DNA, 22 bp, Homo sapiens
aagacatgcagtttgttccatt

SEQ ID NO: 8449800 - DNA, 22 bp, Homo sapiens
aagacatgcagtttgttccatt

SEQ ID NO: 8449801 - DNA, 22 bp, Homo sapiens
aagagctggagtttgcagccct

SEQ ID NO: 8449802 - DNA, 22 bp, Homo sapiens
aagagctggcccaatctgagca

SEQ ID NO: 8449803 - DNA, 22 bp, Homo sapiens
aagagctggtcacaggtccatt

SEQ ID NO: 8449804 - DNA, 22 bp, Homo sapiens
aagaggaaatgattgactatat

SEQ ID NO: 8449805 - DNA, 18 bp, Homo sapiens
aagagcttcgcatataca

SEQ ID NO: 8449806 - DNA, 22 bp, Homo sapiens
aagagcttccctgttgtagagg

SEQ ID NO: 8449807 - DNA, 22 bp, Homo sapiens
aagagcttccctgttgtagagg

SEQ ID NO: 8449808 - DNA, 22 bp, Homo sapiens
acaaggctgttggtcacaaacc

SEQ ID NO: 8449809 - DNA, 19 bp, Homo sapiens
aagagcagggaaagaattg

SEQ ID NO: 8449810 - DNA, 20 bp, Homo sapiens
aagagctacttagcctttcc

SEQ ID NO: 8449811 - DNA, 22 bp, Homo sapiens
aagagctccaggcaatgcggtc

SEQ ID NO: 8449812 - DNA, 21 bp, Homo sapiens
aagagctcttttgttatggtc

SEQ ID NO: 8449813 - DNA, 22 bp, Homo sapiens
acaaggcaatggcaggatttca

SEQ ID NO: 8449814 - DNA, 22 bp, Homo sapiens
acaaggccaagcattctagcaa

SEQ ID NO: 8449815 - DNA, 22 bp, Homo sapiens
acaaggctctaatttcattgaa

SEQ ID NO: 8449816 - DNA, 22 bp, Homo sapiens
acaaggctggctgggaaaaact

SEQ ID NO: 8449817 - DNA, 22 bp, Homo sapiens
aagatgttctattttcactttt

SEQ ID NO: 8449818 - DNA, 22 bp, Homo sapiens
aagaggcgccgggtacgtggcg

SEQ ID NO: 8449819 - DNA, 22 bp, Homo sapiens
aagaggccttggtctgacctga

SEQ ID NO: 8449820 - DNA, 22 bp, Homo sapiens
aagaggccttggtctgacctga

SEQ ID NO: 8449821 - DNA, 22 bp, Homo sapiens
aagaggcctggaggcagaggtg

SEQ ID NO: 8449822 - DNA, 22 bp, Homo sapiens
aagaggcctcacctcactgccc

SEQ ID NO: 8449823 - DNA, 22 bp, Homo sapiens
aagatgttattgtcttccttgc

SEQ ID NO: 8449824 - DNA, 22 bp, Homo sapiens
acacagtaggccaccatgtcat

SEQ ID NO: 8449825 - DNA, 22 bp, Homo sapiens
aagaggccacagctgacagcac

SEQ ID NO: 8449826 - DNA, 22 bp, Homo sapiens
aagaggccacagctgacagcac

SEQ ID NO: 8449827 - DNA, 22 bp, Homo sapiens
acacagctttgtgttgctccac

SEQ ID NO: 8449828 - DNA, 22 bp, Homo sapiens
acacaggaactcaagctcgctt

SEQ ID NO: 8449829 - DNA, 22 bp, Homo sapiens
aagatttactttctttgtaata

SEQ ID NO: 8449830 - DNA, 18 bp, Homo sapiens
acactgcagcagtctgct

SEQ ID NO: 8449831 - DNA, 21 bp, Homo sapiens
acactgctgtagcatattggg

SEQ ID NO: 8449832 - DNA, 22 bp, Homo sapiens
acactgcttctctggcagagcc

SEQ ID NO: 8449833 - DNA, 22 bp, Homo sapiens
acactgctcacttcttcccttg

SEQ ID NO: 8449834 - DNA, 22 bp, Homo sapiens
aagcacagaaaaggagcatgga

SEQ ID NO: 8449835 - DNA, 22 bp, Homo sapiens
aagcacaggagacgcacagcca

SEQ ID NO: 8449836 - DNA, 22 bp, Homo sapiens
aagcacaggagacgcacagcca

SEQ ID NO: 8449837 - DNA, 22 bp, Homo sapiens
aagcacaggagacgcacagcca

SEQ ID NO: 8449838 - DNA, 22 bp, Homo sapiens
aagcacaggagacgcacagcca

SEQ ID NO: 8449839 - DNA, 22 bp, Homo sapiens
aagcacaggggaaataagttgt

SEQ ID NO: 8449840 - DNA, 22 bp, Homo sapiens
aagcacagggtgtctgcattca

SEQ ID NO: 8449841 - DNA, 22 bp, Homo sapiens
aagcacagggactcaggaccgg

SEQ ID NO: 8449842 - DNA, 22 bp, Homo sapiens
aagcacagtaaaagcagatttt

SEQ ID NO: 8449843 - DNA, 22 bp, Homo sapiens
aagcacagtgccaagttctatt

SEQ ID NO: 8449844 - DNA, 22 bp, Homo sapiens
aagcacagtaaaagcagatttt

SEQ ID NO: 8449845 - DNA, 22 bp, Homo sapiens
aagcacagtgggcagagcagcc

SEQ ID NO: 8449846 - DNA, 22 bp, Homo sapiens
aagcatgtgtataagctgggca

SEQ ID NO: 8449847 - DNA, 19 bp, Homo sapiens
aagcattagccaaagcatt

SEQ ID NO: 8449848 - DNA, 22 bp, Homo sapiens
aagcatgtcccttgtgattcaa

SEQ ID NO: 8449849 - DNA, 22 bp, Homo sapiens
aagcatgtacaatgagtgtctc

SEQ ID NO: 8449850 - DNA, 22 bp, Homo sapiens
aagcatgtactcaagcaaatgt

SEQ ID NO: 8449851 - DNA, 17 bp, Homo sapiens
aagcatttaatttgcta

SEQ ID NO: 8449852 - DNA, 22 bp, Homo sapiens
aagcatttatagataagaattt

SEQ ID NO: 8449853 - DNA, 22 bp, Homo sapiens
acagcagctaacccctgggcca

SEQ ID NO: 8449854 - DNA, 22 bp, Homo sapiens
aagcatttcaggtagagatatt

SEQ ID NO: 8449855 - DNA, 22 bp, Homo sapiens
aagcatttcaggtagagatatt

SEQ ID NO: 8449856 - DNA, 22 bp, Homo sapiens
aagcatttggcatgaaactctt

SEQ ID NO: 8449857 - DNA, 22 bp, Homo sapiens
acagcagcttcctgactgtact

SEQ ID NO: 8449858 - DNA, 22 bp, Homo sapiens
acagcagcttgtctgttcttta

SEQ ID NO: 8449859 - DNA, 22 bp, Homo sapiens
acagcagctgccttcaggctct

SEQ ID NO: 8449860 - DNA, 22 bp, Homo sapiens
aagccaagtgctggccatgggc

SEQ ID NO: 8449861 - DNA, 22 bp, Homo sapiens
aagccaagttggaagactgaat

SEQ ID NO: 8449862 - DNA, 22 bp, Homo sapiens
acagaggtttccattgaggttt

SEQ ID NO: 8449863 - DNA, 22 bp, Homo sapiens
aagcagccacctcatctccact

SEQ ID NO: 8449864 - DNA, 22 bp, Homo sapiens
aagcagccactggccagttata

SEQ ID NO: 8449865 - DNA, 22 bp, Homo sapiens
aagcagcattgtggtaggggag

SEQ ID NO: 8449866 - DNA, 22 bp, Homo sapiens
aagcagcctggcatgatgcttt

SEQ ID NO: 8449867 - DNA, 22 bp, Homo sapiens
acagaattgaagctgagtaaat

SEQ ID NO: 8449868 - DNA, 22 bp, Homo sapiens
acagaattatcaggaaatgtta

SEQ ID NO: 8449869 - DNA, 22 bp, Homo sapiens
acagaattggggttcttgggga

SEQ ID NO: 8449870 - DNA, 22 bp, Homo sapiens
acagaatttgcttgggcaatgg

SEQ ID NO: 8449871 - DNA, 18 bp, Homo sapiens
acagacaaaatggaaatg

SEQ ID NO: 8449872 - DNA, 22 bp, Homo sapiens
aagcagcattgtaaccaatgcc

SEQ ID NO: 8449873 - DNA, 22 bp, Homo sapiens
aagcagcatgctatgctggtgg

SEQ ID NO: 8449874 - DNA, 22 bp, Homo sapiens
aatagttaagcaactttttcca

SEQ ID NO: 8449875 - DNA, 21 bp, Homo sapiens
aaccagagccaggctctcagc

SEQ ID NO: 8449876 - DNA, 22 bp, Homo sapiens
aatataaattcctgggcccagc

SEQ ID NO: 8449877 - DNA, 22 bp, Homo sapiens
aatagtttgaatttatcagatg

SEQ ID NO: 8449878 - DNA, 22 bp, Homo sapiens
aaccaagcccattactttactt

SEQ ID NO: 8449879 - DNA, 22 bp, Homo sapiens
aaccaagtttattccaagttac

SEQ ID NO: 8449880 - DNA, 22 bp, Homo sapiens
aaccacagagccccctcagatg

SEQ ID NO: 8449881 - DNA, 22 bp, Homo sapiens
aaccacagagccccctcagatg

SEQ ID NO: 8449882 - DNA, 22 bp, Homo sapiens
aaccaccaccgtaatttaccca

SEQ ID NO: 8449883 - DNA, 22 bp, Homo sapiens
aaccaccaccatctagttccaa

SEQ ID NO: 8449884 - DNA, 22 bp, Homo sapiens
aaccaccattctctcctcttcc

SEQ ID NO: 8449885 - DNA, 22 bp, Homo sapiens
aacatttttaagaccaagtgct

SEQ ID NO: 8449886 - DNA, 22 bp, Homo sapiens
aaccaaagaaaactgtggtgag

SEQ ID NO: 8449887 - DNA, 20 bp, Homo sapiens
aaccaacagaatcatgtctc

SEQ ID NO: 8449888 - DNA, 22 bp, Homo sapiens
aataacttttaaaagaccctgg

SEQ ID NO: 8449889 - DNA, 22 bp, Homo sapiens
aataacttcatgtaacatttaa

SEQ ID NO: 8449890 - DNA, 22 bp, Homo sapiens
aataacttcatgtaacatttaa

SEQ ID NO: 8449891 - DNA, 22 bp, Homo sapiens
aataacttcatgtaacatttaa

SEQ ID NO: 8449892 - DNA, 22 bp, Homo sapiens
aataacttgaagatctcttcca

SEQ ID NO: 8449893 - DNA, 22 bp, Homo sapiens
aataacttgtatggttattcca

SEQ ID NO: 8449894 - DNA, 22 bp, Homo sapiens
aataacttttaaaagaccctgg

SEQ ID NO: 8449895 - DNA, 22 bp, Homo sapiens
aataacttcagttcttacatta

SEQ ID NO: 8449896 - DNA, 22 bp, Homo sapiens
aataacttcatcttcaggatag

SEQ ID NO: 8449897 - DNA, 22 bp, Homo sapiens
aacatggctcatgagagatttg

SEQ ID NO: 8449898 - DNA, 22 bp, Homo sapiens
aacatgcatataggtaaatgga

SEQ ID NO: 8449899 - DNA, 22 bp, Homo sapiens
aacatgcaggttttagggttgc

SEQ ID NO: 8449900 - DNA, 22 bp, Homo sapiens
aacatgcaggttttagggttgc

SEQ ID NO: 8449901 - DNA, 22 bp, Homo sapiens
aacagtaaaaatcatttagttg

SEQ ID NO: 8449902 - DNA, 22 bp, Homo sapiens
aacatgaaacccaaacagaata

SEQ ID NO: 8449903 - DNA, 20 bp, Homo sapiens
aacagggggctgcagagggc

SEQ ID NO: 8449904 - DNA, 22 bp, Homo sapiens
aacagtaaaaatcatttagttg

SEQ ID NO: 8449905 - DNA, 22 bp, Homo sapiens
aacaggtacagtttccctctgg

SEQ ID NO: 8449906 - DNA, 21 bp, Homo sapiens
aacaggtcccccacgggcttt

SEQ ID NO: 8449907 - DNA, 22 bp, Homo sapiens
aacaggtagggactctaacttg

SEQ ID NO: 8449908 - DNA, 18 bp, Homo sapiens
aacatgcattagaactgc

SEQ ID NO: 8449909 - DNA, 22 bp, Homo sapiens
aacatgcccgctgtatgccatt

SEQ ID NO: 8449910 - DNA, 22 bp, Homo sapiens
aacatgctcttcctggctagtc

SEQ ID NO: 8449911 - DNA, 22 bp, Homo sapiens
aacatgctgcctttctacgagt

SEQ ID NO: 8449912 - DNA, 22 bp, Homo sapiens
aacaggcaaactgtgggatccc

SEQ ID NO: 8449913 - DNA, 22 bp, Homo sapiens
aacaggcaacagttgactctga

SEQ ID NO: 8449914 - DNA, 22 bp, Homo sapiens
aacaggcaatttaggactcttt

SEQ ID NO: 8449915 - DNA, 22 bp, Homo sapiens
aacaggcactaagcatgtgggg

SEQ ID NO: 8449916 - DNA, 22 bp, Homo sapiens
aacaggacactgggatggctac

SEQ ID NO: 8449917 - DNA, 22 bp, Homo sapiens
aacaggaccttccaatccatca

SEQ ID NO: 8449918 - DNA, 22 bp, Homo sapiens
aacaggctcactctgacttcta

SEQ ID NO: 8449919 - DNA, 22 bp, Homo sapiens
aacaggctatttctttacaaac

SEQ ID NO: 8449920 - DNA, 22 bp, Homo sapiens
aacaggctagttttaaagcata

SEQ ID NO: 8449921 - DNA, 22 bp, Homo sapiens
aacaggctaaattgtccatttc

SEQ ID NO: 8449922 - DNA, 22 bp, Homo sapiens
aacaggctaagtatttggtagc

SEQ ID NO: 8449923 - DNA, 22 bp, Homo sapiens
aacaggcaggagaattctgcct

SEQ ID NO: 8449924 - DNA, 22 bp, Homo sapiens
aacaggcttttggaaagttaca

SEQ ID NO: 8449925 - DNA, 22 bp, Homo sapiens
aacaggcttcttctgggctcct

SEQ ID NO: 8449926 - DNA, 22 bp, Homo sapiens
aacaggcttttggaaagttaca

SEQ ID NO: 8449927 - DNA, 22 bp, Homo sapiens
aacaggctggccttgaagcagt

SEQ ID NO: 8449928 - DNA, 22 bp, Homo sapiens
aacaggcttcttctgggctcct

SEQ ID NO: 8449929 - DNA, 22 bp, Homo sapiens
aacaggcttccaggagggacga

SEQ ID NO: 8449930 - DNA, 22 bp, Homo sapiens
aacaggctccatgaacaacgtg

SEQ ID NO: 8449931 - DNA, 22 bp, Homo sapiens
aacaggctcttcatttccagag

SEQ ID NO: 8449932 - DNA, 22 bp, Homo sapiens
aacaggctccttgtgaatggat

SEQ ID NO: 8449933 - DNA, 20 bp, Homo sapiens
aactgcctgcccagaggtgg

SEQ ID NO: 8449934 - DNA, 22 bp, Homo sapiens
aactgcttagtgatggatgacc

SEQ ID NO: 8449935 - DNA, 22 bp, Homo sapiens
aatgataccgccaatattacca

SEQ ID NO: 8449936 - DNA, 22 bp, Homo sapiens
aatgatacatatgtatcgttag

SEQ ID NO: 8449937 - DNA, 22 bp, Homo sapiens
aatgatcactgcagttgatgag

SEQ ID NO: 8449938 - DNA, 22 bp, Homo sapiens
aatgatatgcaaattatcatca

SEQ ID NO: 8449939 - DNA, 22 bp, Homo sapiens
aatgatatagcagacatagcct

SEQ ID NO: 8449940 - DNA, 22 bp, Homo sapiens
aatgatatttattgaatagatg

SEQ ID NO: 8449941 - DNA, 22 bp, Homo sapiens
aacttacaaggatgatagctgc

SEQ ID NO: 8449942 - DNA, 22 bp, Homo sapiens
aacttacaaggatgatagctgc

SEQ ID NO: 8449943 - DNA, 22 bp, Homo sapiens
aacttagacttgtttcttggta

SEQ ID NO: 8449944 - DNA, 22 bp, Homo sapiens
aacttagagctctcctaaatga

SEQ ID NO: 8449945 - DNA, 22 bp, Homo sapiens
aactgtttggaactcttccaca

SEQ ID NO: 8449946 - DNA, 18 bp, Homo sapiens
aactgttgaaatagcttg

SEQ ID NO: 8449947 - DNA, 22 bp, Homo sapiens
aactgttggaggattattttgc

SEQ ID NO: 8449948 - DNA, 22 bp, Homo sapiens
aactgttgtcatatggtcttaa

SEQ ID NO: 8449949 - DNA, 22 bp, Homo sapiens
aactgttcacactgatgtgacg

SEQ ID NO: 8449950 - DNA, 22 bp, Homo sapiens
aactacattttacagaagatga

SEQ ID NO: 8449951 - DNA, 21 bp, Homo sapiens
aactacagttgttccttcatt

SEQ ID NO: 8449952 - DNA, 21 bp, Homo sapiens
aactacagttgttccttcatt

SEQ ID NO: 8449953 - DNA, 22 bp, Homo sapiens
aactacatagaaattagtattt

SEQ ID NO: 8449954 - DNA, 22 bp, Homo sapiens
aactacagtatgtccaaagaat

SEQ ID NO: 8449955 - DNA, 22 bp, Homo sapiens
aactacagcatctatacaaata

SEQ ID NO: 8449956 - DNA, 22 bp, Homo sapiens
aatataacacagatggcctgtt

SEQ ID NO: 8449957 - DNA, 20 bp, Homo sapiens
aatataattctctgaattta

SEQ ID NO: 8449958 - DNA, 22 bp, Homo sapiens
aactacagaatcatagaaaata

SEQ ID NO: 8449959 - DNA, 22 bp, Homo sapiens
aactacagaaaaggtaagctct

SEQ ID NO: 8449960 - DNA, 22 bp, Homo sapiens
aactacaatatgtatgtatgta

SEQ ID NO: 8449961 - DNA, 22 bp, Homo sapiens
aactacaatatgtatgtatgta

SEQ ID NO: 8449962 - DNA, 22 bp, Homo sapiens
aacgtgcaccaggaggtcatga

SEQ ID NO: 8449963 - DNA, 22 bp, Homo sapiens
aacgtgcattaggacctctcca

SEQ ID NO: 8449964 - DNA, 22 bp, Homo sapiens
aacgtcttctctccaagtaaat

SEQ ID NO: 8449965 - DNA, 22 bp, Homo sapiens
aactgcattcagaaagctcact

SEQ ID NO: 8449966 - DNA, 22 bp, Homo sapiens
aactgcaattacttttgcgcca

SEQ ID NO: 8449967 - DNA, 22 bp, Homo sapiens
aactgcaattacttttgcacta

SEQ ID NO: 8449968 - DNA, 22 bp, Homo sapiens
aactgcaattacttttgcacta

SEQ ID NO: 8449969 - DNA, 22 bp, Homo sapiens
aactgcaattacttttgcgcca

SEQ ID NO: 8449970 - DNA, 22 bp, Homo sapiens
aactgcaattacttttgcacca

SEQ ID NO: 8449971 - DNA, 22 bp, Homo sapiens
aactgcaattacttttgcacca

SEQ ID NO: 8449972 - DNA, 22 bp, Homo sapiens
aactgcaatcacttttgcacca

SEQ ID NO: 8449973 - DNA, 22 bp, Homo sapiens
aactgcaatcacttttgcacca

SEQ ID NO: 8449974 - DNA, 22 bp, Homo sapiens
aactgcaataacttgtgcacca

SEQ ID NO: 8449975 - DNA, 22 bp, Homo sapiens
aactgaaacgtatttttgagat

SEQ ID NO: 8449976 - DNA, 22 bp, Homo sapiens
aatccacacatctggcatgtga

SEQ ID NO: 8449977 - DNA, 22 bp, Homo sapiens
aactgcaagagtaaatgtctag

SEQ ID NO: 8449978 - DNA, 22 bp, Homo sapiens
aactgcaacttcgtaaagtgag

SEQ ID NO: 8449979 - DNA, 22 bp, Homo sapiens
aactgcaacttgtttgattctt

SEQ ID NO: 8449980 - DNA, 22 bp, Homo sapiens
aactgcaagctctttactgcta

SEQ ID NO: 8449981 - DNA, 22 bp, Homo sapiens
aactgcaagctctttactgcta

SEQ ID NO: 8449982 - DNA, 23 bp, Homo sapiens
aactgcaaggttgctgggaagta

SEQ ID NO: 8449983 - DNA, 22 bp, Homo sapiens
aactgcaagctctttactgcta

SEQ ID NO: 8449984 - DNA, 22 bp, Homo sapiens
aactgcaagtggggcttgtcat

SEQ ID NO: 8449985 - DNA, 22 bp, Homo sapiens
aactgcaataacttgtgcacca

SEQ ID NO: 8449986 - DNA, 22 bp, Homo sapiens
aatccaatcctactcagaaagt

SEQ ID NO: 8449987 - DNA, 22 bp, Homo sapiens
aacagcctcagtgagattagga

SEQ ID NO: 8449988 - DNA, 22 bp, Homo sapiens
aagtcatgagtcctcttctgtg

SEQ ID NO: 8449989 - DNA, 22 bp, Homo sapiens
aagtcattatctcttctaatct

SEQ ID NO: 8449990 - DNA, 22 bp, Homo sapiens
aagtcatgtggaagaataacct

SEQ ID NO: 8449991 - DNA, 22 bp, Homo sapiens
aacagaggctccctgcacttgt

SEQ ID NO: 8449992 - DNA, 22 bp, Homo sapiens
aaggtccttttgcagtgtgatc

SEQ ID NO: 8449993 - DNA, 22 bp, Homo sapiens
aaggtcctgtagccacagagcc

SEQ ID NO: 8449994 - DNA, 22 bp, Homo sapiens
aaggtctgagttttgccaggcc

SEQ ID NO: 8449995 - DNA, 22 bp, Homo sapiens
aacagcagctttcaggatcatc

SEQ ID NO: 8449996 - DNA, 22 bp, Homo sapiens
aacagcagctttcaggatcatc

SEQ ID NO: 8449997 - DNA, 23 bp, Homo sapiens
aacagcaggatgatagaggaggt

SEQ ID NO: 8449998 - DNA, 23 bp, Homo sapiens
aacagcaggatgatagaggaggt

SEQ ID NO: 8449999 - DNA, 22 bp, Homo sapiens
aacagcagggatgacatggcca

SEQ ID NO: 8450000 - DNA, 22 bp, Homo sapiens
aacagcaggtcctggcatgggt

SEQ ID NO: 8450001 - DNA, 22 bp, Homo sapiens
aacagcagggaaattccaagtc

SEQ ID NO: 8450002 - DNA, 22 bp, Homo sapiens
aacagcatatttcatatattga

SEQ ID NO: 8450003 - DNA, 22 bp, Homo sapiens
aacagcataccaatgtacatat

SEQ ID NO: 8450004 - DNA, 22 bp, Homo sapiens
aacagcagttacttttgcatca

SEQ ID NO: 8450005 - DNA, 22 bp, Homo sapiens
aacagcagtggcaggagaaggc

SEQ ID NO: 8450006 - DNA, 22 bp, Homo sapiens
aacagcataagtatttatttca

SEQ ID NO: 8450007 - DNA, 22 bp, Homo sapiens
aaggtcagagcaggaaggagtc

SEQ ID NO: 8450008 - DNA, 22 bp, Homo sapiens
aaggtcagagcaggaaggagtc

SEQ ID NO: 8450009 - DNA, 22 bp, Homo sapiens
aacactgacctctaccctcagt

SEQ ID NO: 8450010 - DNA, 22 bp, Homo sapiens
aacactgagaggggagtggcac

SEQ ID NO: 8450011 - DNA, 22 bp, Homo sapiens
aacactgagaacaatacagagt

SEQ ID NO: 8450012 - DNA, 22 bp, Homo sapiens
aacaaagtgtacttccatactg

SEQ ID NO: 8450013 - DNA, 22 bp, Homo sapiens
aacaaatgacctgatttcttcc

SEQ ID NO: 8450014 - DNA, 22 bp, Homo sapiens
aacaccagtcccaagagaggct

SEQ ID NO: 8450015 - DNA, 22 bp, Homo sapiens
aacaccttgcagggattatgac

SEQ ID NO: 8450016 - DNA, 19 bp, Homo sapiens
aacaccagagtcaggagtc

SEQ ID NO: 8450017 - DNA, 22 bp, Homo sapiens
aacactctctgttggtaaggct

SEQ ID NO: 8450018 - DNA, 22 bp, Homo sapiens
aacactcaatttacaaactctg

SEQ ID NO: 8450019 - DNA, 22 bp, Homo sapiens
aaattcacttgcctgcttagct

SEQ ID NO: 8450020 - DNA, 22 bp, Homo sapiens
aaattccattttgtgactattc

SEQ ID NO: 8450021 - DNA, 22 bp, Homo sapiens
aaattctaaggtcacaatgttg

SEQ ID NO: 8450022 - DNA, 22 bp, Homo sapiens
aaatgtttctacttgtgagcat

SEQ ID NO: 8450023 - DNA, 22 bp, Homo sapiens
aaatgtgtcatattcaaagtca

SEQ ID NO: 8450024 - DNA, 22 bp, Homo sapiens
aaatgtgtgtatgtacatatat

SEQ ID NO: 8450025 - DNA, 22 bp, Homo sapiens
aaatgtggggctggaggcagga

SEQ ID NO: 8450026 - DNA, 22 bp, Homo sapiens
aaatgtgcttcttactctcaat

SEQ ID NO: 8450027 - DNA, 22 bp, Homo sapiens
aaatgtgcttgtgatcagctgt

SEQ ID NO: 8450028 - DNA, 22 bp, Homo sapiens
aaatgtgagttatagcaataga

SEQ ID NO: 8450029 - DNA, 22 bp, Homo sapiens
aagctgaggatacatgaagcct

SEQ ID NO: 8450030 - DNA, 22 bp, Homo sapiens
aagctgaggcccatggcaaggt

SEQ ID NO: 8450031 - DNA, 19 bp, Homo sapiens
aagctgagggctgtccacc

SEQ ID NO: 8450032 - DNA, 22 bp, Homo sapiens
aagctgaggtcaagtagctagt

SEQ ID NO: 8450033 - DNA, 22 bp, Homo sapiens
aagctgaggctcccctgaggga

SEQ ID NO: 8450034 - DNA, 22 bp, Homo sapiens
aaattctttggcctactttgaa

SEQ ID NO: 8450035 - DNA, 22 bp, Homo sapiens
aaattctttggcctactttgaa

SEQ ID NO: 8450036 - DNA, 22 bp, Homo sapiens
aaattctttcatggctaataag

SEQ ID NO: 8450037 - DNA, 22 bp, Homo sapiens
aaattgaatttgggaaacattg

SEQ ID NO: 8450038 - DNA, 22 bp, Homo sapiens
aaattgaatttgggaaacattg

SEQ ID NO: 8450039 - DNA, 22 bp, Homo sapiens
aaattcttttgtgcggtgaagt

SEQ ID NO: 8450040 - DNA, 22 bp, Homo sapiens
aaattgcagatgctaaatgact

SEQ ID NO: 8450041 - DNA, 22 bp, Homo sapiens
aaattctgtcctgaatgccatt

SEQ ID NO: 8450042 - DNA, 22 bp, Homo sapiens
aaattctaaggtcacaatgttg

SEQ ID NO: 8450043 - DNA, 22 bp, Homo sapiens
aaattctatgtcaatgtttatt

SEQ ID NO: 8450044 - DNA, 22 bp, Homo sapiens
aacaaacagttaagtgtggatg

SEQ ID NO: 8450045 - DNA, 22 bp, Homo sapiens
aaattttagactcctgggtcta

SEQ ID NO: 8450046 - DNA, 22 bp, Homo sapiens
aaattttagaccaggcaaaact

SEQ ID NO: 8450047 - DNA, 22 bp, Homo sapiens
aaattttagaccaggcaaaact

SEQ ID NO: 8450048 - DNA, 22 bp, Homo sapiens
aaattgcattcaggatgcagga

SEQ ID NO: 8450049 - DNA, 22 bp, Homo sapiens
aaattgcaggtaggtgggtgat

SEQ ID NO: 8450050 - DNA, 22 bp, Homo sapiens
aacaaacagttaagtgtggatg

SEQ ID NO: 8450051 - DNA, 20 bp, Homo sapiens
aacaaactacaaaattatgt

SEQ ID NO: 8450052 - DNA, 22 bp, Homo sapiens
aacaaacattacctggtgctgg

SEQ ID NO: 8450053 - DNA, 22 bp, Homo sapiens
aacaaagatgggtgggaaagag

SEQ ID NO: 8450054 - DNA, 22 bp, Homo sapiens
aacaaagaagactggttatttt

SEQ ID NO: 8450055 - DNA, 20 bp, Homo sapiens
aacaaactacaaaattatgt

SEQ ID NO: 8450056 - DNA, 22 bp, Homo sapiens
aacaaactcaaatggaagagtg

SEQ ID NO: 8450057 - DNA, 20 bp, Homo sapiens
aacaaactacaaaattatgt

SEQ ID NO: 8450058 - DNA, 22 bp, Homo sapiens
aacaaagaagactggttatttt

SEQ ID NO: 8450059 - DNA, 22 bp, Homo sapiens
aacaaagtcgttgcctagaaga

SEQ ID NO: 8450060 - DNA, 22 bp, Homo sapiens
aacaaagtcgttgcctagaaga

SEQ ID NO: 8450061 - DNA, 22 bp, Homo sapiens
aacaaagtcgttgcctagaaga

SEQ ID NO: 8450062 - DNA, 22 bp, Homo sapiens
aacaaaggccgttaataaccac

SEQ ID NO: 8450063 - DNA, 22 bp, Homo sapiens
aaatagcagcctttagttaaca

SEQ ID NO: 8450064 - DNA, 22 bp, Homo sapiens
aaatagcaatgtgaaaagagga

SEQ ID NO: 8450065 - DNA, 22 bp, Homo sapiens
aaatagatttcctagcattgga

SEQ ID NO: 8450066 - DNA, 22 bp, Homo sapiens
aaatagatttcctagcattgga

SEQ ID NO: 8450067 - DNA, 22 bp, Homo sapiens
aaatagatttcctagcattgga

SEQ ID NO: 8450068 - DNA, 22 bp, Homo sapiens
aaatagattgctgaggcattac

SEQ ID NO: 8450069 - DNA, 22 bp, Homo sapiens
aaatagattgctgaggcattac

SEQ ID NO: 8450070 - DNA, 23 bp, Homo sapiens
aaatagagataggccagctttgc

SEQ ID NO: 8450071 - DNA, 22 bp, Homo sapiens
aaataattgagttggtcaatat

SEQ ID NO: 8450072 - DNA, 22 bp, Homo sapiens
aaataattgagttggtcaatat

SEQ ID NO: 8450073 - DNA, 22 bp, Homo sapiens
aaataattatagcgagtctatc

SEQ ID NO: 8450074 - DNA, 22 bp, Homo sapiens
aaataattatagcgagtctatc

SEQ ID NO: 8450075 - DNA, 22 bp, Homo sapiens
aaatagacaggcttaaatagga

SEQ ID NO: 8450076 - DNA, 22 bp, Homo sapiens
aaatcccaatgctagacccggt

SEQ ID NO: 8450077 - DNA, 22 bp, Homo sapiens
aaatcccactcacgagttttgc

SEQ ID NO: 8450078 - DNA, 22 bp, Homo sapiens
aaatccattctgttttaaaagt

SEQ ID NO: 8450079 - DNA, 22 bp, Homo sapiens
aaatcccactcagaaactgcca

SEQ ID NO: 8450080 - DNA, 22 bp, Homo sapiens
aaatcccagatagtaatgtatt

SEQ ID NO: 8450081 - DNA, 22 bp, Homo sapiens
aaatccatggtaatctgttaca

SEQ ID NO: 8450082 - DNA, 22 bp, Homo sapiens
aaatagcagctttgacagcaca

SEQ ID NO: 8450083 - DNA, 22 bp, Homo sapiens
aaatagcagctttgacagcaca

SEQ ID NO: 8450084 - DNA, 22 bp, Homo sapiens
aaatagcagctttgacagcaca

SEQ ID NO: 8450085 - DNA, 22 bp, Homo sapiens
aaatagcataaaataggaagct

SEQ ID NO: 8450086 - DNA, 22 bp, Homo sapiens
aaatagctacatgatctctagg

SEQ ID NO: 8450087 - DNA, 22 bp, Homo sapiens
aaatagctacatgatctctagg

SEQ ID NO: 8450088 - DNA, 22 bp, Homo sapiens
aaatagctgaaagttcctagat

SEQ ID NO: 8450089 - DNA, 22 bp, Homo sapiens
aaatagcttttcataattctca

SEQ ID NO: 8450090 - DNA, 22 bp, Homo sapiens
aaatagcttctaagccttttga

SEQ ID NO: 8450091 - DNA, 22 bp, Homo sapiens
aaagtgttgggaagaaagtgca

SEQ ID NO: 8450092 - DNA, 22 bp, Homo sapiens
aaagtgttgggattacaggcat

SEQ ID NO: 8450093 - DNA, 22 bp, Homo sapiens
aaagtgttgggattataggcgt

SEQ ID NO: 8450094 - DNA, 22 bp, Homo sapiens
aaagtgttgggattacaggtgt

SEQ ID NO: 8450095 - DNA, 22 bp, Homo sapiens
aaagtgtttacattgctataag

SEQ ID NO: 8450096 - DNA, 22 bp, Homo sapiens
aaagtgtttacattgctataag

SEQ ID NO: 8450097 - DNA, 22 bp, Homo sapiens
aaagtgttttccatgcaatgaa

SEQ ID NO: 8450098 - DNA, 22 bp, Homo sapiens
aaagtgtttttgagctgtagtt

SEQ ID NO: 8450099 - DNA, 22 bp, Homo sapiens
aaagttttatatgctgcagcga

SEQ ID NO: 8450100 - DNA, 22 bp, Homo sapiens
aaagttttatatgctgcagcga

SEQ ID NO: 8450101 - DNA, 22 bp, Homo sapiens
aaagtgttttgtgagcagtctg

SEQ ID NO: 8450102 - DNA, 22 bp, Homo sapiens
aaagtgttttgtgagcagtctg

SEQ ID NO: 8450103 - DNA, 19 bp, Homo sapiens
aaagtgttttcttttctgt

SEQ ID NO: 8450104 - DNA, 19 bp, Homo sapiens
aaagtgttttcttttctgt

SEQ ID NO: 8450105 - DNA, 22 bp, Homo sapiens
aaataacagtcagggacaacat

SEQ ID NO: 8450106 - DNA, 22 bp, Homo sapiens
aaagtgttaacactggctactt

SEQ ID NO: 8450107 - DNA, 21 bp, Homo sapiens
aaagtgttcagaccagttctg

SEQ ID NO: 8450108 - DNA, 22 bp, Homo sapiens
aaagtgttatgcaaaactctgt

SEQ ID NO: 8450109 - DNA, 22 bp, Homo sapiens
aaagtgttatgcaaaactctgt

SEQ ID NO: 8450110 - DNA, 22 bp, Homo sapiens
aaagtgttgaagaaaatgttca

SEQ ID NO: 8450111 - DNA, 22 bp, Homo sapiens
aaataagcacttaactgtatca

SEQ ID NO: 8450112 - DNA, 22 bp, Homo sapiens
aaataatcaatttttgtagata

SEQ ID NO: 8450113 - DNA, 22 bp, Homo sapiens
aaataatcaatttttgtagata

SEQ ID NO: 8450114 - DNA, 22 bp, Homo sapiens
aaataagttagcagattccagt

SEQ ID NO: 8450115 - DNA, 22 bp, Homo sapiens
aaataagtgtgggccagtcaaa

SEQ ID NO: 8450116 - DNA, 22 bp, Homo sapiens
aaatgcaggtagtatttatttt

SEQ ID NO: 8450117 - DNA, 22 bp, Homo sapiens
aaatgcaggaaattatgctttt

SEQ ID NO: 8450118 - DNA, 22 bp, Homo sapiens
aagcacagataaaacaggattc

SEQ ID NO: 8450119 - DNA, 22 bp, Homo sapiens
aagcacagcagagccttgcttg

SEQ ID NO: 8450120 - DNA, 22 bp, Homo sapiens
aaatcctaataatgcactagtg

SEQ ID NO: 8450121 - DNA, 22 bp, Homo sapiens
aaatcctaatgacaagtttagt

SEQ ID NO: 8450122 - DNA, 22 bp, Homo sapiens
aaatcctaatgacaagtttagt

SEQ ID NO: 8450123 - DNA, 22 bp, Homo sapiens
aaatcctaccaagaaattccct

SEQ ID NO: 8450124 - DNA, 22 bp, Homo sapiens
aaatcctaaaagtttgacttaa

SEQ ID NO: 8450125 - DNA, 22 bp, Homo sapiens
aaatcctaagcagaggaattta

SEQ ID NO: 8450126 - DNA, 22 bp, Homo sapiens
aaatcctaaggagaatatgatt

SEQ ID NO: 8450127 - DNA, 22 bp, Homo sapiens
aaatcctaaggagaatatgatt

SEQ ID NO: 8450128 - DNA, 23 bp, Homo sapiens
aaatcctgcctcttgtatttatc

SEQ ID NO: 8450129 - DNA, 22 bp, Homo sapiens
aaatcctggcctcaagtggtcc

SEQ ID NO: 8450130 - DNA, 22 bp, Homo sapiens
aaatccttttctatacagcata

SEQ ID NO: 8450131 - DNA, 22 bp, Homo sapiens
aaatctaggctcatcctggtcc

SEQ ID NO: 8450132 - DNA, 22 bp, Homo sapiens
aaatctagtacctttttgatta

SEQ ID NO: 8450133 - DNA, 22 bp, Homo sapiens
aaatctcaaaggcttagcatct

SEQ ID NO: 8450134 - DNA, 22 bp, Homo sapiens
aaatctaggccgggtgcggtgg

SEQ ID NO: 8450135 - DNA, 22 bp, Homo sapiens
aaatctagaagtttaaaaggat

SEQ ID NO: 8450136 - DNA, 22 bp, Homo sapiens
aagcacagagatgggcacgcct

SEQ ID NO: 8450137 - DNA, 22 bp, Homo sapiens
aagcacagactccctctgagtg

SEQ ID NO: 8450138 - DNA, 22 bp, Homo sapiens
aagcacagacacaaaaggcttt

SEQ ID NO: 8450139 - DNA, 23 bp, Homo sapiens
aagcacagaatggtttaggagtt

SEQ ID NO: 8450140 - DNA, 22 bp, Homo sapiens
aaatgtatcctacttcctgagt

SEQ ID NO: 8450141 - DNA, 22 bp, Homo sapiens
aaatgtattgcataggatattt

SEQ ID NO: 8450142 - DNA, 22 bp, Homo sapiens
aaatgtattgcataggatattt

SEQ ID NO: 8450143 - DNA, 22 bp, Homo sapiens
aaatgtactgatacttatttta

SEQ ID NO: 8450144 - DNA, 18 bp, Homo sapiens
aaatgtactgtccatggc

SEQ ID NO: 8450145 - DNA, 22 bp, Homo sapiens
aaatgtactgatacttatttta

SEQ ID NO: 8450146 - DNA, 22 bp, Homo sapiens
aaatgtagtatgttgcatgtat

SEQ ID NO: 8450147 - DNA, 22 bp, Homo sapiens
aaatgtaccttgatagtttggt

SEQ ID NO: 8450148 - DNA, 22 bp, Homo sapiens
aagctgaaacattagcctaaac

SEQ ID NO: 8450149 - DNA, 22 bp, Homo sapiens
aagctgaaaatgagactctaca

SEQ ID NO: 8450150 - DNA, 22 bp, Homo sapiens
aagctgaaattcctcctgaaat

SEQ ID NO: 8450151 - DNA, 22 bp, Homo sapiens
aagctgaagacacagctccagt

SEQ ID NO: 8450152 - DNA, 23 bp, Homo sapiens
aagctgaacttgtttgctgggag

SEQ ID NO: 8450153 - DNA, 22 bp, Homo sapiens
aagctgaaataatatctatgtt

SEQ ID NO: 8450154 - DNA, 22 bp, Homo sapiens
aagctgaagatgccagtgggag

SEQ ID NO: 8450155 - DNA, 22 bp, Homo sapiens
aagctgaatctgaaatagaatt

SEQ ID NO: 8450156 - DNA, 22 bp, Homo sapiens
aagctgaagccggatcaaaaag

SEQ ID NO: 8450157 - DNA, 22 bp, Homo sapiens
aagctgaattttctaaaagaat

SEQ ID NO: 8450158 - DNA, 22 bp, Homo sapiens
aaatgtcaaagacgtgtttttg

SEQ ID NO: 8450159 - DNA, 22 bp, Homo sapiens
aagctcttttcaccattaaagt

SEQ ID NO: 8450160 - DNA, 22 bp, Homo sapiens
aaatgtacaacatccatatata

SEQ ID NO: 8450161 - DNA, 22 bp, Homo sapiens
aaatggcaggctctttgctagt

SEQ ID NO: 8450162 - DNA, 22 bp, Homo sapiens
aagcatggctgagtgcaatggt

SEQ ID NO: 8450163 - DNA, 22 bp, Homo sapiens
aagcatggagcaatagaatgac

SEQ ID NO: 8450164 - DNA, 22 bp, Homo sapiens
aagcatgggaatcccacagggt

SEQ ID NO: 8450165 - DNA, 22 bp, Homo sapiens
aagcatggctgttctagctata

SEQ ID NO: 8450166 - DNA, 19 bp, Homo sapiens
aagcatggtgcctcacctc

SEQ ID NO: 8450167 - DNA, 22 bp, Homo sapiens
aagcatgggaggcctggaggag

SEQ ID NO: 8450168 - DNA, 22 bp, Homo sapiens
aagcatctaggtgactgacata

SEQ ID NO: 8450169 - DNA, 22 bp, Homo sapiens
aagcatctatattccactgtga

SEQ ID NO: 8450170 - DNA, 22 bp, Homo sapiens
aagcatctctatgtggagagtg

SEQ ID NO: 8450171 - DNA, 22 bp, Homo sapiens
aagcatctcctcatcatttggg

SEQ ID NO: 8450172 - DNA, 23 bp, Homo sapiens
aagcatcttttcctagctccatc

SEQ ID NO: 8450173 - DNA, 22 bp, Homo sapiens
aagcatcttctatcagttagac

SEQ ID NO: 8450174 - DNA, 22 bp, Homo sapiens
aagcatcttctatcagttagac

SEQ ID NO: 8450175 - DNA, 22 bp, Homo sapiens
aagcatcttagacctgagttcc

SEQ ID NO: 8450176 - DNA, 22 bp, Homo sapiens
aagcatcttaaaaagtatcaga

SEQ ID NO: 8450177 - DNA, 22 bp, Homo sapiens
aaagtatttttgacaggcatta

SEQ ID NO: 8450178 - DNA, 22 bp, Homo sapiens
aaagtatttgtgatttttacca

SEQ ID NO: 8450179 - DNA, 22 bp, Homo sapiens
aaagtatttgtgatttttacca

SEQ ID NO: 8450180 - DNA, 22 bp, Homo sapiens
aaagtatttgtgatttttacca

SEQ ID NO: 8450181 - DNA, 22 bp, Homo sapiens
aaagtatttgtgatttttacca

SEQ ID NO: 8450182 - DNA, 22 bp, Homo sapiens
aaagtcaaggtttagactagag

SEQ ID NO: 8450183 - DNA, 22 bp, Homo sapiens
aaagtcaaggtttagactagag

SEQ ID NO: 8450184 - DNA, 22 bp, Homo sapiens
aaagtatttttgacaggcatta

SEQ ID NO: 8450185 - DNA, 22 bp, Homo sapiens
aaagtattcttgactgtttttc

SEQ ID NO: 8450186 - DNA, 22 bp, Homo sapiens
aaagtattcttgactgtttttc

SEQ ID NO: 8450187 - DNA, 22 bp, Homo sapiens
aaagtattcttgactgtttttc

SEQ ID NO: 8450188 - DNA, 22 bp, Homo sapiens
aaagtattcaaaaatatttggt

SEQ ID NO: 8450189 - DNA, 22 bp, Homo sapiens
aaagtattcaaaaatatttggt

SEQ ID NO: 8450190 - DNA, 22 bp, Homo sapiens
aaagtattcaaaaatatttggt

SEQ ID NO: 8450191 - DNA, 22 bp, Homo sapiens
aaagtattcaaaaatatttggt

SEQ ID NO: 8450192 - DNA, 22 bp, Homo sapiens
aaagtatgttgtggcttttaaa

SEQ ID NO: 8450193 - DNA, 22 bp, Homo sapiens
aaagtatctgaccgattataaa

SEQ ID NO: 8450194 - DNA, 22 bp, Homo sapiens
aaagtatgattggggattattt

SEQ ID NO: 8450195 - DNA, 22 bp, Homo sapiens
aaagtatatttacttactgtga

SEQ ID NO: 8450196 - DNA, 22 bp, Homo sapiens
aaagtatatttacttactgtga

SEQ ID NO: 8450197 - DNA, 22 bp, Homo sapiens
aaagtagttagtcatgtgaaaa

SEQ ID NO: 8450198 - DNA, 22 bp, Homo sapiens
aaagtagaggcattgatcaggt

SEQ ID NO: 8450199 - DNA, 22 bp, Homo sapiens
aaagtagcttagttgatatttc

SEQ ID NO: 8450200 - DNA, 22 bp, Homo sapiens
aaagtagtccttggagcgaaat

SEQ ID NO: 8450201 - DNA, 22 bp, Homo sapiens
aaagtagtataaaattcatgtg

SEQ ID NO: 8450202 - DNA, 22 bp, Homo sapiens
aaagtgctttcccacatttgtt

SEQ ID NO: 8450203 - DNA, 22 bp, Homo sapiens
aaagtgctttaggatatttgga

SEQ ID NO: 8450204 - DNA, 22 bp, Homo sapiens
aaagtgcagtaacttgcccaag

SEQ ID NO: 8450205 - DNA, 22 bp, Homo sapiens
aaagtgcagggtgctctggtat

SEQ ID NO: 8450206 - DNA, 22 bp, Homo sapiens
aaagtgcagcttgtgatcccta

SEQ ID NO: 8450207 - DNA, 22 bp, Homo sapiens
aaagtcaaggtttagactagag

SEQ ID NO: 8450208 - DNA, 22 bp, Homo sapiens
aaagtggggtctagagggcctg

SEQ ID NO: 8450209 - DNA, 22 bp, Homo sapiens
aaagtgggaacaatggagagtg

SEQ ID NO: 8450210 - DNA, 22 bp, Homo sapiens
aaagtgggaacaatggagagtg

SEQ ID NO: 8450211 - DNA, 22 bp, Homo sapiens
aaagtgggaacaatggagagtg

SEQ ID NO: 8450212 - DNA, 22 bp, Homo sapiens
aactaaatctggcatttagagc

SEQ ID NO: 8450213 - DNA, 22 bp, Homo sapiens
aactaaatctggcatttagagc

SEQ ID NO: 8450214 - DNA, 22 bp, Homo sapiens
aactaaaagtgtgtctcttgta

SEQ ID NO: 8450215 - DNA, 22 bp, Homo sapiens
aactaaaactggtttgttctct

SEQ ID NO: 8450216 - DNA, 22 bp, Homo sapiens
aactaaaactggtttgttctct

SEQ ID NO: 8450217 - DNA, 22 bp, Homo sapiens
aaaggttttcatcacagcaaga

SEQ ID NO: 8450218 - DNA, 22 bp, Homo sapiens
aaagtactttgggctatgtttg

SEQ ID NO: 8450219 - DNA, 22 bp, Homo sapiens
aaagtactttgggctatgtttg

SEQ ID NO: 8450220 - DNA, 22 bp, Homo sapiens
aaagtacttacagtatgcttgg

SEQ ID NO: 8450221 - DNA, 22 bp, Homo sapiens
aaagtactaatgaatattttgc

SEQ ID NO: 8450222 - DNA, 22 bp, Homo sapiens
aaaggttattattactattgtc

SEQ ID NO: 8450223 - DNA, 22 bp, Homo sapiens
aaagggcctccgcctgggcagg

SEQ ID NO: 8450224 - DNA, 22 bp, Homo sapiens
aaaggtttatttaatcagggag

SEQ ID NO: 8450225 - DNA, 22 bp, Homo sapiens
aaagccaggggagggattccca

SEQ ID NO: 8450226 - DNA, 20 bp, Homo sapiens
aaagatactttttgtaatgg

SEQ ID NO: 8450227 - DNA, 22 bp, Homo sapiens
aaagccagggtccaggcctgcc

SEQ ID NO: 8450228 - DNA, 22 bp, Homo sapiens
aaagccaggttgtgtgcaggaa

SEQ ID NO: 8450229 - DNA, 22 bp, Homo sapiens
aaagccagtggtatgagagaaa

SEQ ID NO: 8450230 - DNA, 22 bp, Homo sapiens
aaagccagttcttagagaaagc

SEQ ID NO: 8450231 - DNA, 22 bp, Homo sapiens
aaagccagtttctggaagtacc

SEQ ID NO: 8450232 - DNA, 22 bp, Homo sapiens
aaagccagttcttttatattgg

SEQ ID NO: 8450233 - DNA, 22 bp, Homo sapiens
aaagccagtttgtctctttaaa

SEQ ID NO: 8450234 - DNA, 22 bp, Homo sapiens
aaagccatatctattctattct

SEQ ID NO: 8450235 - DNA, 22 bp, Homo sapiens
aaagccataagcctaatactaa

SEQ ID NO: 8450236 - DNA, 22 bp, Homo sapiens
aaagccatcagtaaaatgattt

SEQ ID NO: 8450237 - DNA, 22 bp, Homo sapiens
aaattttctctctaagacttaa

SEQ ID NO: 8450238 - DNA, 22 bp, Homo sapiens
aaattttagtaaggaagttgag

SEQ ID NO: 8450239 - DNA, 22 bp, Homo sapiens
aacaaaagccgaagtaggtgtc

SEQ ID NO: 8450240 - DNA, 22 bp, Homo sapiens
aacaaacaaacattttgtcatc

SEQ ID NO: 8450241 - DNA, 22 bp, Homo sapiens
aacaaaacatttgtcttgtttc

SEQ ID NO: 8450242 - DNA, 22 bp, Homo sapiens
aacaaaacatttgtcttgtttc

SEQ ID NO: 8450243 - DNA, 22 bp, Homo sapiens
aaagataatgtttccttattct

SEQ ID NO: 8450244 - DNA, 22 bp, Homo sapiens
aaagatacttaatagttgtctg

SEQ ID NO: 8450245 - DNA, 22 bp, Homo sapiens
aacaaacaaacattttgtcatc

SEQ ID NO: 8450246 - DNA, 22 bp, Homo sapiens
aaagcttagaggccagtggagg

SEQ ID NO: 8450247 - DNA, 22 bp, Homo sapiens
aaagcttaaggtaggtacagag

SEQ ID NO: 8450248 - DNA, 22 bp, Homo sapiens
aaagctgggctggccaacccag

SEQ ID NO: 8450249 - DNA, 22 bp, Homo sapiens
aaagctggttattctgaggcag

SEQ ID NO: 8450250 - DNA, 22 bp, Homo sapiens
aaagctgggggccctggtctag

SEQ ID NO: 8450251 - DNA, 22 bp, Homo sapiens
aaagctggcctctcaggcttta

SEQ ID NO: 8450252 - DNA, 22 bp, Homo sapiens
aaagctggcttttacaggggct

SEQ ID NO: 8450253 - DNA, 22 bp, Homo sapiens
aaagctgggctaggtttgtttc

SEQ ID NO: 8450254 - DNA, 22 bp, Homo sapiens
aaagctgcaagctcctgaggaa

SEQ ID NO: 8450255 - DNA, 22 bp, Homo sapiens
aaagctgcccttgtgaaacaag

SEQ ID NO: 8450256 - DNA, 22 bp, Homo sapiens
aacagatataggcagaactttg

SEQ ID NO: 8450257 - DNA, 22 bp, Homo sapiens
aacagataatttctaagttact

SEQ ID NO: 8450258 - DNA, 22 bp, Homo sapiens
aaagccatgggtctttggcata

SEQ ID NO: 8450259 - DNA, 22 bp, Homo sapiens
aacagataagtatatctatgta

SEQ ID NO: 8450260 - DNA, 22 bp, Homo sapiens
aaagccatgaatgttatagagg

SEQ ID NO: 8450261 - DNA, 22 bp, Homo sapiens
aaagccatctgctggttcgcat

SEQ ID NO: 8450262 - DNA, 22 bp, Homo sapiens
aaagccatctgtattaagtgaa

SEQ ID NO: 8450263 - DNA, 22 bp, Homo sapiens
aacagcagcaagtaagcaggtc

SEQ ID NO: 8450264 - DNA, 22 bp, Homo sapiens
aacagcaccgaagtcgtctaag

SEQ ID NO: 8450265 - DNA, 20 bp, Homo sapiens
aacagcacacattcgcatta

SEQ ID NO: 8450266 - DNA, 22 bp, Homo sapiens
aacagcaatagcactattcatt

SEQ ID NO: 8450267 - DNA, 22 bp, Homo sapiens
aaagcgctatataaatgttaac

SEQ ID NO: 8450268 - DNA, 22 bp, Homo sapiens
aacagcagcatgacagctgggt

SEQ ID NO: 8450269 - DNA, 22 bp, Homo sapiens
aaagctaaggtagcattggaga

SEQ ID NO: 8450270 - DNA, 22 bp, Homo sapiens
aaagagttggactttctcaggc

SEQ ID NO: 8450271 - DNA, 22 bp, Homo sapiens
aaagagttgaggcagttatcca

SEQ ID NO: 8450272 - DNA, 22 bp, Homo sapiens
aaagagttcttgtagctttgag

SEQ ID NO: 8450273 - DNA, 22 bp, Homo sapiens
aaagagttcacggaggccaaag

SEQ ID NO: 8450274 - DNA, 22 bp, Homo sapiens
aaattagaccagggctcctgga

SEQ ID NO: 8450275 - DNA, 22 bp, Homo sapiens
aaattagaccagggctcctgga

SEQ ID NO: 8450276 - DNA, 22 bp, Homo sapiens
aaattagaaatactttcaaagc

SEQ ID NO: 8450277 - DNA, 22 bp, Homo sapiens
aaattagaaatactttcaaagc

SEQ ID NO: 8450278 - DNA, 22 bp, Homo sapiens
aaattagaagtgctcaggaata

SEQ ID NO: 8450279 - DNA, 22 bp, Homo sapiens
aaattagaagtgctcaggaata

SEQ ID NO: 8450280 - DNA, 22 bp, Homo sapiens
aaattagaaatactttcaaagc

SEQ ID NO: 8450281 - DNA, 20 bp, Homo sapiens
aaattactgccacacatttc

SEQ ID NO: 8450282 - DNA, 20 bp, Homo sapiens
aaattactgccacacatttc

SEQ ID NO: 8450283 - DNA, 22 bp, Homo sapiens
aaattacagccttgggtagctt

SEQ ID NO: 8450284 - DNA, 22 bp, Homo sapiens
aaattacagccttgggtagctt

SEQ ID NO: 8450285 - DNA, 22 bp, Homo sapiens
aaattaccattgtaaagtattt

SEQ ID NO: 8450286 - DNA, 22 bp, Homo sapiens
aaattacagatcaccaatgcat

SEQ ID NO: 8450287 - DNA, 22 bp, Homo sapiens
aaattacagatcaccaatgcat

SEQ ID NO: 8450288 - DNA, 22 bp, Homo sapiens
aaattacagatcaccaatgcat

SEQ ID NO: 8450289 - DNA, 22 bp, Homo sapiens
aaatgcagattgtcattcagga

SEQ ID NO: 8450290 - DNA, 22 bp, Homo sapiens
aaagaggcaatcaatgtagcaa

SEQ ID NO: 8450291 - DNA, 22 bp, Homo sapiens
aaagaggctcaaggtgggccag

SEQ ID NO: 8450292 - DNA, 22 bp, Homo sapiens
aaagagcatggaaagttcagga

SEQ ID NO: 8450293 - DNA, 22 bp, Homo sapiens
aaagagcaccctcaatgtctga

SEQ ID NO: 8450294 - DNA, 22 bp, Homo sapiens
aaagaagtgttgaatttgcaag

SEQ ID NO: 8450295 - DNA, 22 bp, Homo sapiens
aaagaaggtagggctggtgact

SEQ ID NO: 8450296 - DNA, 22 bp, Homo sapiens
aaactgagtacctctgcattca

SEQ ID NO: 8450297 - DNA, 22 bp, Homo sapiens
aaactgcaatgacaggtaggag

SEQ ID NO: 8450298 - DNA, 21 bp, Homo sapiens
aaagaacaggcagatgttctt

SEQ ID NO: 8450299 - DNA, 21 bp, Homo sapiens
aaagaacaggcagatgttctt

SEQ ID NO: 8450300 - DNA, 22 bp, Homo sapiens
aaagacacaaatgtagaccaaa

SEQ ID NO: 8450301 - DNA, 22 bp, Homo sapiens
aaagacacaaatgtagaccaaa

SEQ ID NO: 8450302 - DNA, 22 bp, Homo sapiens
aaagaatactccttttgccttg

SEQ ID NO: 8450303 - DNA, 17 bp, Homo sapiens
aaactgaaaaattcact

SEQ ID NO: 8450304 - DNA, 21 bp, Homo sapiens
aaactgaagagacaggaactt

SEQ ID NO: 8450305 - DNA, 17 bp, Homo sapiens
aaactgaaaaattcact

SEQ ID NO: 8450306 - DNA, 17 bp, Homo sapiens
aaactgaaaaattcact

SEQ ID NO: 8450307 - DNA, 22 bp, Homo sapiens
aaactcttttgcatattagagg

SEQ ID NO: 8450308 - DNA, 17 bp, Homo sapiens
aaactgaaaaattcact

SEQ ID NO: 8450309 - DNA, 21 bp, Homo sapiens
aaactgaccttgcctgagaca

SEQ ID NO: 8450310 - DNA, 22 bp, Homo sapiens
aaactgaattcaagtatccagt

SEQ ID NO: 8450311 - DNA, 22 bp, Homo sapiens
aaactgaagtagattctgaaat

SEQ ID NO: 8450312 - DNA, 22 bp, Homo sapiens
aaactgaattcccaagggcatg

SEQ ID NO: 8450313 - DNA, 21 bp, Homo sapiens
aaactgaggcttcaagcagtg

SEQ ID NO: 8450314 - DNA, 22 bp, Homo sapiens
aaactgaggaatgacagcatta

SEQ ID NO: 8450315 - DNA, 22 bp, Homo sapiens
aaactgaggagttagactaggg

SEQ ID NO: 8450316 - DNA, 22 bp, Homo sapiens
aaactgaggaacaaggaaggat

SEQ ID NO: 8450317 - DNA, 22 bp, Homo sapiens
aaacaatgtagattaccattta

SEQ ID NO: 8450318 - DNA, 22 bp, Homo sapiens
aaacaatgttgtctccaagagg

SEQ ID NO: 8450319 - DNA, 22 bp, Homo sapiens
aaacagtgactggtacataata

SEQ ID NO: 8450320 - DNA, 22 bp, Homo sapiens
aaacagtgactggtacataata

SEQ ID NO: 8450321 - DNA, 22 bp, Homo sapiens
aaacaatgacaacacagctgcg

SEQ ID NO: 8450322 - DNA, 22 bp, Homo sapiens
aaaggtatcatgtccatacagt

SEQ ID NO: 8450323 - DNA, 22 bp, Homo sapiens
aaacagtttataacatgatact

SEQ ID NO: 8450324 - DNA, 22 bp, Homo sapiens
aaacagtttcattttcatgacc

SEQ ID NO: 8450325 - DNA, 22 bp, Homo sapiens
aaacagtttcattttcatgacc

SEQ ID NO: 8450326 - DNA, 22 bp, Homo sapiens
aaacagttctccaggaagccag

SEQ ID NO: 8450327 - DNA, 18 bp, Homo sapiens
aaacagtgcctaagtgtc

SEQ ID NO: 8450328 - DNA, 22 bp, Homo sapiens
aaactctatttctgttggctta

SEQ ID NO: 8450329 - DNA, 22 bp, Homo sapiens
aaactctataggcagaagcaat

SEQ ID NO: 8450330 - DNA, 22 bp, Homo sapiens
aaactctagtaaaatgtattca

SEQ ID NO: 8450331 - DNA, 22 bp, Homo sapiens
aaagttcattgatgactgaggt

SEQ ID NO: 8450332 - DNA, 22 bp, Homo sapiens
aaagttactatcacaatgaaat

SEQ ID NO: 8450333 - DNA, 22 bp, Homo sapiens
aaagttagtaaaatgggatata

SEQ ID NO: 8450334 - DNA, 22 bp, Homo sapiens
aaacctgtctgattatggagac

SEQ ID NO: 8450335 - DNA, 22 bp, Homo sapiens
aaacctgatagattttcagaat

SEQ ID NO: 8450336 - DNA, 22 bp, Homo sapiens
aaacctgatagattttcagaat

SEQ ID NO: 8450337 - DNA, 22 bp, Homo sapiens
aaacctgaatgtatgtcagaag

SEQ ID NO: 8450338 - DNA, 22 bp, Homo sapiens
aaacctgaagtacgttacataa

SEQ ID NO: 8450339 - DNA, 22 bp, Homo sapiens
aaacctgaaggatgatacaaca

SEQ ID NO: 8450340 - DNA, 22 bp, Homo sapiens
aaaggtgttgccttggagacct

SEQ ID NO: 8450341 - DNA, 22 bp, Homo sapiens
aaacattgtaattttagcatgg

SEQ ID NO: 8450342 - DNA, 22 bp, Homo sapiens
aaaggtcttctcaaacatccca

SEQ ID NO: 8450343 - DNA, 22 bp, Homo sapiens
aaacattgtacattctgtagct

SEQ ID NO: 8450344 - DNA, 22 bp, Homo sapiens
aaacctagaaggaagggtctct

SEQ ID NO: 8450345 - DNA, 22 bp, Homo sapiens
aaaccctgctcttatggaactt

SEQ ID NO: 8450346 - DNA, 22 bp, Homo sapiens
aaaccctgcccttcccaagatg

SEQ ID NO: 8450347 - DNA, 22 bp, Homo sapiens
aaaatgaataagttaacccagg

SEQ ID NO: 8450348 - DNA, 22 bp, Homo sapiens
aaaatgaataagttaacccagg

SEQ ID NO: 8450349 - DNA, 22 bp, Homo sapiens
aaaatgacattccagtgatatt

SEQ ID NO: 8450350 - DNA, 22 bp, Homo sapiens
aaaaatagcttctcttgtccct

SEQ ID NO: 8450351 - DNA, 22 bp, Homo sapiens
aaaaatcacttttataggcagc

SEQ ID NO: 8450352 - DNA, 22 bp, Homo sapiens
aaaaatcacttttataggcagc

SEQ ID NO: 8450353 - DNA, 22 bp, Homo sapiens
aaaaatcacttttataggcagc

SEQ ID NO: 8450354 - DNA, 22 bp, Homo sapiens
aaaaatcacttttataggcagc

SEQ ID NO: 8450355 - DNA, 22 bp, Homo sapiens
aaacactgtgggacatcttact

SEQ ID NO: 8450356 - DNA, 22 bp, Homo sapiens
aaaaatctatgactgcttctcc

SEQ ID NO: 8450357 - DNA, 22 bp, Homo sapiens
aaaaatcacttttataggcagc

SEQ ID NO: 8450358 - DNA, 22 bp, Homo sapiens
aaacagaaatttcctcatgctc

SEQ ID NO: 8450359 - DNA, 22 bp, Homo sapiens
aaacagaaatttcctcatgctc

SEQ ID NO: 8450360 - DNA, 22 bp, Homo sapiens
aaacagaaatttcctcatgctc

SEQ ID NO: 8450361 - DNA, 22 bp, Homo sapiens
aaaagacatctatttcaggcag

SEQ ID NO: 8450362 - DNA, 22 bp, Homo sapiens
aaaagacatatgtgggcattct

SEQ ID NO: 8450363 - DNA, 22 bp, Homo sapiens
aaaagacatctatttcaggcag

SEQ ID NO: 8450364 - DNA, 22 bp, Homo sapiens
aaaagacaggtgtctgcggccc

SEQ ID NO: 8450365 - DNA, 22 bp, Homo sapiens
aaacagagggccactgaggctc

SEQ ID NO: 8450366 - DNA, 22 bp, Homo sapiens
aaacagagagatgtatgtggag

SEQ ID NO: 8450367 - DNA, 21 bp, Homo sapiens
aaacagagctgagtaatagat

SEQ ID NO: 8450368 - DNA, 22 bp, Homo sapiens
aaacagactgaagagttgaagc

SEQ ID NO: 8450369 - DNA, 22 bp, Homo sapiens
aaacagaagggtaggtaaacat

SEQ ID NO: 8450370 - DNA, 22 bp, Homo sapiens
aaacagaagggtaggtaaacat

SEQ ID NO: 8450371 - DNA, 22 bp, Homo sapiens
aaacagagagatgtatgtggag

SEQ ID NO: 8450372 - DNA, 22 bp, Homo sapiens
aaaatgaacagaacaatgggga

SEQ ID NO: 8450373 - DNA, 22 bp, Homo sapiens
aaaatcttgtgacttaggaagg

SEQ ID NO: 8450374 - DNA, 22 bp, Homo sapiens
aaaatgaagcaaaggcattcag

SEQ ID NO: 8450375 - DNA, 22 bp, Homo sapiens
aaaatgaagcaaaggcattcag

SEQ ID NO: 8450376 - DNA, 22 bp, Homo sapiens
aaaaaccattgtcttcagtctc

SEQ ID NO: 8450377 - DNA, 22 bp, Homo sapiens
aaaaaccattgtcttcagtctc

SEQ ID NO: 8450378 - DNA, 20 bp, Homo sapiens
aaaaacagtaatgctgaaga

SEQ ID NO: 8450379 - DNA, 20 bp, Homo sapiens
aaaaacagtaatgctgaaga

SEQ ID NO: 8450380 - DNA, 22 bp, Homo sapiens
aaaaaccattgtcttcagtctc

SEQ ID NO: 8450381 - DNA, 22 bp, Homo sapiens
aaaaaccattgtcttcagtctc

SEQ ID NO: 8450382 - DNA, 22 bp, Homo sapiens
aaaaactgcaattacttttgtc

SEQ ID NO: 8450383 - DNA, 22 bp, Homo sapiens
aaaaacctttcccatactaaga

SEQ ID NO: 8450384 - DNA, 22 bp, Homo sapiens
aaaaacctttcccatactaaga

SEQ ID NO: 8450385 - DNA, 22 bp, Homo sapiens
aaaaacctttcattgcaaatgt

SEQ ID NO: 8450386 - DNA, 22 bp, Homo sapiens
aaaaaagattgatggtggatgc

SEQ ID NO: 8450387 - DNA, 22 bp, Homo sapiens
aaaaaatcagatctttggttaa

SEQ ID NO: 8450388 - DNA, 23 bp, Homo sapiens
aaaaaaccatgtaggcactcagt

SEQ ID NO: 8450389 - DNA, 23 bp, Homo sapiens
aaaaaaccatgtaggcactcagt

SEQ ID NO: 8450390 - DNA, 23 bp, Homo sapiens
aaaaaaccatgtaggcactcagt

SEQ ID NO: 8450391 - DNA, 22 bp, Homo sapiens
aaaaaattatcatagttcctga

SEQ ID NO: 8450392 - DNA, 22 bp, Homo sapiens
aaaaaatcagatctttggttaa

SEQ ID NO: 8450393 - DNA, 22 bp, Homo sapiens
aaaaaatcagatctttggttaa

SEQ ID NO: 8450394 - DNA, 22 bp, Homo sapiens
aaaaaattccattctgtgcctt

SEQ ID NO: 8450395 - DNA, 22 bp, Homo sapiens
aaaaaattatcatagttcctga

SEQ ID NO: 8450396 - DNA, 22 bp, Homo sapiens
aaaaacacaactgtctttctct

SEQ ID NO: 8450397 - DNA, 22 bp, Homo sapiens
aaaaacacaactgtctttctct

SEQ ID NO: 8450398 - DNA, 22 bp, Homo sapiens
aaaaaattccattctgtgcctt

SEQ ID NO: 8450399 - DNA, 22 bp, Homo sapiens
aaaaacacaactgtctttctct

SEQ ID NO: 8450400 - DNA, 22 bp, Homo sapiens
aaaaacacaagtggcttggtct

SEQ ID NO: 8450401 - DNA, 22 bp, Homo sapiens
aaaaacacaactgtctttctct

SEQ ID NO: 8450402 - DNA, 22 bp, Homo sapiens
aaaaacacaagtggcttggtct

SEQ ID NO: 8450403 - DNA, 22 bp, Homo sapiens
aaaaacagaatgtgtctaactc

SEQ ID NO: 8450404 - DNA, 20 bp, Homo sapiens
aaaaacagtaatgctgaaga

SEQ ID NO: 8450405 - DNA, 22 bp, Homo sapiens
aaacaagtttagaataatgaat

SEQ ID NO: 8450406 - DNA, 23 bp, Homo sapiens
aaacaagtctctcaatggcttgc

SEQ ID NO: 8450407 - DNA, 23 bp, Homo sapiens
aaacaagtctctcaatggcttgc

SEQ ID NO: 8450408 - DNA, 22 bp, Homo sapiens
aaacaagtgtaaactagtctgt

SEQ ID NO: 8450409 - DNA, 22 bp, Homo sapiens
aaacaagtcactttatcttgaa

SEQ ID NO: 8450410 - DNA, 22 bp, Homo sapiens
aaacaagtcactttatcttgaa

SEQ ID NO: 8450411 - DNA, 22 bp, Homo sapiens
aaacaagtttgtagactagcca

SEQ ID NO: 8450412 - DNA, 22 bp, Homo sapiens
aaaatccttagccgagtgaggt

SEQ ID NO: 8450413 - DNA, 22 bp, Homo sapiens
aaaatctaagtagcgagtaagg

SEQ ID NO: 8450414 - DNA, 22 bp, Homo sapiens
aaaatctaagtagcgagtaagg

SEQ ID NO: 8450415 - DNA, 23 bp, Homo sapiens
aaacaagccctaatgaagagtcc

SEQ ID NO: 8450416 - DNA, 22 bp, Homo sapiens
aaacaagctgcagacaagccat

SEQ ID NO: 8450417 - DNA, 20 bp, Homo sapiens
aaacaaggttgctctgagga

SEQ ID NO: 8450418 - DNA, 22 bp, Homo sapiens
aaaatcctctaattctagaata

SEQ ID NO: 8450419 - DNA, 22 bp, Homo sapiens
aaaatcctgctgactcgagatg

SEQ ID NO: 8450420 - DNA, 22 bp, Homo sapiens
aaaatccacaacgctcatttca

SEQ ID NO: 8450421 - DNA, 22 bp, Homo sapiens
aaagactaagaagagtattatt

SEQ ID NO: 8450422 - DNA, 22 bp, Homo sapiens
aaagactaaccagttgtcaaaa

SEQ ID NO: 8450423 - DNA, 22 bp, Homo sapiens
aaagacattgaagaaggactta

SEQ ID NO: 8450424 - DNA, 22 bp, Homo sapiens
aaagaccatgtttacagctagg

SEQ ID NO: 8450425 - DNA, 22 bp, Homo sapiens
aaagactaaacaaccaatatct

SEQ ID NO: 8450426 - DNA, 22 bp, Homo sapiens
aaagactaaacaaccaatatct

SEQ ID NO: 8450427 - DNA, 22 bp, Homo sapiens
aaagacctgtggtagctctaaa

SEQ ID NO: 8450428 - DNA, 22 bp, Homo sapiens
aaagacattagattaacgtaca

SEQ ID NO: 8450429 - DNA, 22 bp, Homo sapiens
aaagacatggcaagagatgggg

SEQ ID NO: 8450430 - DNA, 22 bp, Homo sapiens
aaagacattagcttagatgtca

SEQ ID NO: 8450431 - DNA, 22 bp, Homo sapiens
aaagacattagcttagatgtca

SEQ ID NO: 8450432 - DNA, 22 bp, Homo sapiens
aaactcagaaggtacagaaggg

SEQ ID NO: 8450433 - DNA, 22 bp, Homo sapiens
aaactcaagtctatgaacaagg

SEQ ID NO: 8450434 - DNA, 22 bp, Homo sapiens
aaactcaaagtcagatcagaga

SEQ ID NO: 8450435 - DNA, 21 bp, Homo sapiens
aaactagcagcaaccatgatc

SEQ ID NO: 8450436 - DNA, 22 bp, Homo sapiens
aaaagagaatcctgtacagaga

SEQ ID NO: 8450437 - DNA, 22 bp, Homo sapiens
aaaagagaatcctgtacagaga

SEQ ID NO: 8450438 - DNA, 22 bp, Homo sapiens
aaaagagaatcctgtacagaga

SEQ ID NO: 8450439 - DNA, 22 bp, Homo sapiens
aaaagagagctgaggagctcca

SEQ ID NO: 8450440 - DNA, 22 bp, Homo sapiens
aaaagagagttgccagtctgta

SEQ ID NO: 8450441 - DNA, 22 bp, Homo sapiens
aaaagagagctgaggagctcca

SEQ ID NO: 8450442 - DNA, 22 bp, Homo sapiens
aaacccagagactagaaagacc

SEQ ID NO: 8450443 - DNA, 22 bp, Homo sapiens
aaaagagcaaacatgtaatagt

SEQ ID NO: 8450444 - DNA, 22 bp, Homo sapiens
aaaagagcaaacatgtaatagt

SEQ ID NO: 8450445 - DNA, 22 bp, Homo sapiens
aaaagagagttgccagtctgta

SEQ ID NO: 8450446 - DNA, 22 bp, Homo sapiens
aaaagagagttgccagtctgta

SEQ ID NO: 8450447 - DNA, 22 bp, Homo sapiens
aaactctagggctccacattcc

SEQ ID NO: 8450448 - DNA, 22 bp, Homo sapiens
aaaagtatagggtttggagtca

SEQ ID NO: 8450449 - DNA, 22 bp, Homo sapiens
aaaagtatagggtttggagtca

SEQ ID NO: 8450450 - DNA, 22 bp, Homo sapiens
aaaagtatagggtttggagtca

SEQ ID NO: 8450451 - DNA, 22 bp, Homo sapiens
aaactctaagacactgtacaat

SEQ ID NO: 8450452 - DNA, 20 bp, Homo sapiens
aaactctacctcaatcgtca

SEQ ID NO: 8450453 - DNA, 22 bp, Homo sapiens
aaactctagctactaggataac

SEQ ID NO: 8450454 - DNA, 22 bp, Homo sapiens
aaaagtattggccaccatttct

SEQ ID NO: 8450455 - DNA, 22 bp, Homo sapiens
aaaagtattggccaccatttct

SEQ ID NO: 8450456 - DNA, 22 bp, Homo sapiens
aaaagtattggccaccatttct

SEQ ID NO: 8450457 - DNA, 22 bp, Homo sapiens
aaaagtatggtggtccttttta

SEQ ID NO: 8450458 - DNA, 22 bp, Homo sapiens
aaaagtatggtggtccttttta

SEQ ID NO: 8450459 - DNA, 22 bp, Homo sapiens
aaaagtatagggtttggagtca

SEQ ID NO: 8450460 - DNA, 22 bp, Homo sapiens
aaaagtatccacagctcaggag

SEQ ID NO: 8450461 - DNA, 22 bp, Homo sapiens
aaaagtatccacagctcaggag

SEQ ID NO: 8450462 - DNA, 22 bp, Homo sapiens
aaagacatggaactagagatgg

SEQ ID NO: 8450463 - DNA, 22 bp, Homo sapiens
aaagacatggaactagagatgg

SEQ ID NO: 8450464 - DNA, 22 bp, Homo sapiens
aaaagtatttatggctatgtaa

SEQ ID NO: 8450465 - DNA, 22 bp, Homo sapiens
acaagttaccaaaaaagattca

SEQ ID NO: 8450466 - DNA, 22 bp, Homo sapiens
acaagttaggttttaatccaaa

SEQ ID NO: 8450467 - DNA, 22 bp, Homo sapiens
acaagtttatttgattagaaca

SEQ ID NO: 8450468 - DNA, 22 bp, Homo sapiens
acaagtttatttgattagaaca

SEQ ID NO: 8450469 - DNA, 22 bp, Homo sapiens
acaagtttcattgtttagaacc

SEQ ID NO: 8450470 - DNA, 19 bp, Homo sapiens
agatggggaagagtgtgag

SEQ ID NO: 8450471 - DNA, 22 bp, Homo sapiens
agatggggcagaatggagccat

SEQ ID NO: 8450472 - DNA, 22 bp, Homo sapiens
agatggggcagaatggagccat

SEQ ID NO: 8450473 - DNA, 22 bp, Homo sapiens
agatggggcagaatggagccat

SEQ ID NO: 8450474 - DNA, 22 bp, Homo sapiens
agatggggctcagtgtggaggc

SEQ ID NO: 8450475 - DNA, 22 bp, Homo sapiens
acaagtctgttatgcacctgga

SEQ ID NO: 8450476 - DNA, 22 bp, Homo sapiens
acaagtctgttatgcacctgga

SEQ ID NO: 8450477 - DNA, 22 bp, Homo sapiens
acaagtctttttcatgtcttct

SEQ ID NO: 8450478 - DNA, 22 bp, Homo sapiens
acaagtctcaacagcagccagc

SEQ ID NO: 8450479 - DNA, 22 bp, Homo sapiens
acaagtctcaacagcagccagc

SEQ ID NO: 8450480 - DNA, 22 bp, Homo sapiens
acaagtgcatggaatcagctgt

SEQ ID NO: 8450481 - DNA, 22 bp, Homo sapiens
acaagttaccaaaaaagattca

SEQ ID NO: 8450482 - DNA, 23 bp, Homo sapiens
acaagtgtttccaatatggctgg

SEQ ID NO: 8450483 - DNA, 22 bp, Homo sapiens
acaaggtttggtcctatatttt

SEQ ID NO: 8450484 - DNA, 22 bp, Homo sapiens
acaagtatttaaggttagtata

SEQ ID NO: 8450485 - DNA, 22 bp, Homo sapiens
acaaggtacaaaacagagcaca

SEQ ID NO: 8450486 - DNA, 22 bp, Homo sapiens
acaaggttcttgtggaggaatt

SEQ ID NO: 8450487 - DNA, 22 bp, Homo sapiens
acaaggttgttctgaggattta

SEQ ID NO: 8450488 - DNA, 22 bp, Homo sapiens
acaaatggaacaatgaagactg

SEQ ID NO: 8450489 - DNA, 22 bp, Homo sapiens
acaaattgaccgcaagattcat

SEQ ID NO: 8450490 - DNA, 22 bp, Homo sapiens
acaaatgtgtctaattgtgcct

SEQ ID NO: 8450491 - DNA, 22 bp, Homo sapiens
acaaatgttggatttgtcttcc

SEQ ID NO: 8450492 - DNA, 22 bp, Homo sapiens
acaaattatagaaaattgagct

SEQ ID NO: 8450493 - DNA, 22 bp, Homo sapiens
agcaagattttccttgaatgtt

SEQ ID NO: 8450494 - DNA, 22 bp, Homo sapiens
agcaagatttttcaggttagta

SEQ ID NO: 8450495 - DNA, 22 bp, Homo sapiens
agcaagatttaaacccaggtca

SEQ ID NO: 8450496 - DNA, 22 bp, Homo sapiens
agcaagattgaggcttcctcag

SEQ ID NO: 8450497 - DNA, 22 bp, Homo sapiens
agcaagcagaattctgtcctct

SEQ ID NO: 8450498 - DNA, 21 bp, Homo sapiens
agcaagcagaatccatctaga

SEQ ID NO: 8450499 - DNA, 22 bp, Homo sapiens
agcaagcagaaatgccatggca

SEQ ID NO: 8450500 - DNA, 22 bp, Homo sapiens
agcaagcagaaatgccatggca

SEQ ID NO: 8450501 - DNA, 18 bp, Homo sapiens
agcaagcagttttcatgt

SEQ ID NO: 8450502 - DNA, 22 bp, Homo sapiens
agcaagcagtgaagttgaatgt

SEQ ID NO: 8450503 - DNA, 22 bp, Homo sapiens
agcaagcattgctggttaggtc

SEQ ID NO: 8450504 - DNA, 22 bp, Homo sapiens
agcaaggcagctttcactgctt

SEQ ID NO: 8450505 - DNA, 22 bp, Homo sapiens
agcaaggaaagtaggcacggaa

SEQ ID NO: 8450506 - DNA, 21 bp, Homo sapiens
agcaccagttttatgccaggc

SEQ ID NO: 8450507 - DNA, 22 bp, Homo sapiens
agcaccagtttcgtcgtgacaa

SEQ ID NO: 8450508 - DNA, 20 bp, Homo sapiens
agcaccagtgggggcagccc

SEQ ID NO: 8450509 - DNA, 22 bp, Homo sapiens
acaattccacatggcatgcagg

SEQ ID NO: 8450510 - DNA, 22 bp, Homo sapiens
acaattctctcatatcttatta

SEQ ID NO: 8450511 - DNA, 22 bp, Homo sapiens
acaattctgatggtttcccagt

SEQ ID NO: 8450512 - DNA, 22 bp, Homo sapiens
acaattctgatggtttcccagt

SEQ ID NO: 8450513 - DNA, 22 bp, Homo sapiens
acaattcaagaagagagatgaa

SEQ ID NO: 8450514 - DNA, 22 bp, Homo sapiens
acaattagtgatcagtgatgcc

SEQ ID NO: 8450515 - DNA, 22 bp, Homo sapiens
acaattagctgtgtgtctatct

SEQ ID NO: 8450516 - DNA, 22 bp, Homo sapiens
acaattactcaactttgctgct

SEQ ID NO: 8450517 - DNA, 22 bp, Homo sapiens
acaattaccctggcttgataaa

SEQ ID NO: 8450518 - DNA, 22 bp, Homo sapiens
acaattaccctggcttgataaa

SEQ ID NO: 8450519 - DNA, 22 bp, Homo sapiens
agatggggctcagtgtggaggc

SEQ ID NO: 8450520 - DNA, 22 bp, Homo sapiens
agatggggctcagtgtggaggc

SEQ ID NO: 8450521 - DNA, 22 bp, Homo sapiens
agatggggctgaaagttccaat

SEQ ID NO: 8450522 - DNA, 22 bp, Homo sapiens
agatggggctgaaagttccaat

SEQ ID NO: 8450523 - DNA, 22 bp, Homo sapiens
agatggggtttcatcatgttgg

SEQ ID NO: 8450524 - DNA, 19 bp, Homo sapiens
acaaatgatgttgcactga

SEQ ID NO: 8450525 - DNA, 22 bp, Homo sapiens
acaaatgagaatgtagacagag

SEQ ID NO: 8450526 - DNA, 19 bp, Homo sapiens
acaaatgatgttgcactga

SEQ ID NO: 8450527 - DNA, 22 bp, Homo sapiens
acaaacttcccagacaagctcc

SEQ ID NO: 8450528 - DNA, 19 bp, Homo sapiens
acaaatagttacatatcct

SEQ ID NO: 8450529 - DNA, 19 bp, Homo sapiens
acaaatagttacatatcct

SEQ ID NO: 8450530 - DNA, 22 bp, Homo sapiens
acaaaccagcttaagcaagatg

SEQ ID NO: 8450531 - DNA, 22 bp, Homo sapiens
acaaaccagcttaagcaagatg

SEQ ID NO: 8450532 - DNA, 22 bp, Homo sapiens
acaaacatcttgacctcagatt

SEQ ID NO: 8450533 - DNA, 22 bp, Homo sapiens
acaaacagagttgaaaaatagg

SEQ ID NO: 8450534 - DNA, 22 bp, Homo sapiens
acaaacagctaacatatgttaa

SEQ ID NO: 8450535 - DNA, 22 bp, Homo sapiens
acaaacagagttgaaaaatagg

SEQ ID NO: 8450536 - DNA, 22 bp, Homo sapiens
acaaacagagttgaaaaatagg

SEQ ID NO: 8450537 - DNA, 22 bp, Homo sapiens
acaaaatttttagacaaggctt

SEQ ID NO: 8450538 - DNA, 22 bp, Homo sapiens
acaaaatttttagacaaggctt

SEQ ID NO: 8450539 - DNA, 22 bp, Homo sapiens
acaaaattgtgttaaactttat

SEQ ID NO: 8450540 - DNA, 22 bp, Homo sapiens
acaaaattatgaagaggccttg

SEQ ID NO: 8450541 - DNA, 22 bp, Homo sapiens
acaaaattacctagttattttc

SEQ ID NO: 8450542 - DNA, 22 bp, Homo sapiens
acaaaattacctagttattttc

SEQ ID NO: 8450543 - DNA, 20 bp, Homo sapiens
acaaaataggtactgggtag

SEQ ID NO: 8450544 - DNA, 22 bp, Homo sapiens
agaggccatgctagaggcctgg

SEQ ID NO: 8450545 - DNA, 21 bp, Homo sapiens
agaggccctcggactgggcgt

SEQ ID NO: 8450546 - DNA, 22 bp, Homo sapiens
aattttctaaggtgatgatctg

SEQ ID NO: 8450547 - DNA, 22 bp, Homo sapiens
agaggccatctgctctgtgggg

SEQ ID NO: 8450548 - DNA, 22 bp, Homo sapiens
agaggccatctgctctgtgggg

SEQ ID NO: 8450549 - DNA, 20 bp, Homo sapiens
agaggccagttaggagtcta

SEQ ID NO: 8450550 - DNA, 20 bp, Homo sapiens
agaggccagttaggagtcta

SEQ ID NO: 8450551 - DNA, 22 bp, Homo sapiens
aatttgtgaatctgtctcttga

SEQ ID NO: 8450552 - DNA, 22 bp, Homo sapiens
agagctgggtggacttgtagtt

SEQ ID NO: 8450553 - DNA, 22 bp, Homo sapiens
agagctgggtgaagtgccatca

SEQ ID NO: 8450554 - DNA, 22 bp, Homo sapiens
agagctggggccagagtcaagg

SEQ ID NO: 8450555 - DNA, 22 bp, Homo sapiens
agagctggggccagagtcaagg

SEQ ID NO: 8450556 - DNA, 22 bp, Homo sapiens
agagctggggccagagtcaagg

SEQ ID NO: 8450557 - DNA, 22 bp, Homo sapiens
aattttattagaaggcaagggg

SEQ ID NO: 8450558 - DNA, 22 bp, Homo sapiens
aattttatgccttgcacgttgg

SEQ ID NO: 8450559 - DNA, 22 bp, Homo sapiens
aattttatgccttgcacgttgg

SEQ ID NO: 8450560 - DNA, 22 bp, Homo sapiens
aattttattaactggatgtagc

SEQ ID NO: 8450561 - DNA, 22 bp, Homo sapiens
aattatacaattgtcaagttct

SEQ ID NO: 8450562 - DNA, 22 bp, Homo sapiens
aattagttcaatggatgataga

SEQ ID NO: 8450563 - DNA, 22 bp, Homo sapiens
aattagttcacgtcctgtgctt

SEQ ID NO: 8450564 - DNA, 22 bp, Homo sapiens
aattatacatgaaggcattata

SEQ ID NO: 8450565 - DNA, 20 bp, Homo sapiens
aattatataactccaacatt

SEQ ID NO: 8450566 - DNA, 20 bp, Homo sapiens
aattatataactccaacatt

SEQ ID NO: 8450567 - DNA, 20 bp, Homo sapiens
aattatataactccaacatt

SEQ ID NO: 8450568 - DNA, 22 bp, Homo sapiens
aattatatgttaatcttcaatt

SEQ ID NO: 8450569 - DNA, 22 bp, Homo sapiens
aattatatgttaatcttcaatt

SEQ ID NO: 8450570 - DNA, 22 bp, Homo sapiens
aattatattgaagttgaatgtc

SEQ ID NO: 8450571 - DNA, 22 bp, Homo sapiens
aattatggtatgttcaacaact

SEQ ID NO: 8450572 - DNA, 22 bp, Homo sapiens
aattatgaggtagatatcacat

SEQ ID NO: 8450573 - DNA, 22 bp, Homo sapiens
aattatattgtggtgtgaatgt

SEQ ID NO: 8450574 - DNA, 22 bp, Homo sapiens
aattatattgtggtgtgaatgt

SEQ ID NO: 8450575 - DNA, 22 bp, Homo sapiens
aattatcagatataaaactgca

SEQ ID NO: 8450576 - DNA, 22 bp, Homo sapiens
aattatcagatataaaactgca

SEQ ID NO: 8450577 - DNA, 22 bp, Homo sapiens
aattatcagatataaaactgca

SEQ ID NO: 8450578 - DNA, 22 bp, Homo sapiens
aatttagattgataaacatgga

SEQ ID NO: 8450579 - DNA, 22 bp, Homo sapiens
aatttagattgataaacatgga

SEQ ID NO: 8450580 - DNA, 22 bp, Homo sapiens
aatttagattgataaacatgga

SEQ ID NO: 8450581 - DNA, 22 bp, Homo sapiens
agagctgggacttggactcaat

SEQ ID NO: 8450582 - DNA, 22 bp, Homo sapiens
agagctgggacttggactcaat

SEQ ID NO: 8450583 - DNA, 22 bp, Homo sapiens
agagctgggacttggactcaat

SEQ ID NO: 8450584 - DNA, 22 bp, Homo sapiens
agagctggggccagagtcaagg

SEQ ID NO: 8450585 - DNA, 22 bp, Homo sapiens
aatttacaggtgcactcgccat

SEQ ID NO: 8450586 - DNA, 22 bp, Homo sapiens
aatttacagttgctgatggtac

SEQ ID NO: 8450587 - DNA, 22 bp, Homo sapiens
aatttacaggtgcactcgccat

SEQ ID NO: 8450588 - DNA, 22 bp, Homo sapiens
aatttacagttgctgatggtac

SEQ ID NO: 8450589 - DNA, 22 bp, Homo sapiens
aatttacagttgctgatggtac

SEQ ID NO: 8450590 - DNA, 22 bp, Homo sapiens
aatttacagttgctgatggtac

SEQ ID NO: 8450591 - DNA, 20 bp, Homo sapiens
aatttactcacagaatgaat

SEQ ID NO: 8450592 - DNA, 19 bp, Homo sapiens
aatgtttaagagaaaaagg

SEQ ID NO: 8450593 - DNA, 19 bp, Homo sapiens
aatgtttaagagaaaaagg

SEQ ID NO: 8450594 - DNA, 22 bp, Homo sapiens
aatgtttcgtaaattgtctatg

SEQ ID NO: 8450595 - DNA, 22 bp, Homo sapiens
aattagggaaaatttacttgta

SEQ ID NO: 8450596 - DNA, 22 bp, Homo sapiens
aattaggaaatgagagtatttg

SEQ ID NO: 8450597 - DNA, 21 bp, Homo sapiens
aattagggtgcctcttataat

SEQ ID NO: 8450598 - DNA, 20 bp, Homo sapiens
aattagcttaagtcaatcag

SEQ ID NO: 8450599 - DNA, 22 bp, Homo sapiens
aatgttgagcttgaaagtaggt

SEQ ID NO: 8450600 - DNA, 22 bp, Homo sapiens
aatgttgaggatatcagaaaat

SEQ ID NO: 8450601 - DNA, 22 bp, Homo sapiens
aatgttgacagtggtgatctca

SEQ ID NO: 8450602 - DNA, 22 bp, Homo sapiens
aatgttgatgttttcagtgagc

SEQ ID NO: 8450603 - DNA, 22 bp, Homo sapiens
aatgttatttctgcatagtagt

SEQ ID NO: 8450604 - DNA, 22 bp, Homo sapiens
aatgttcagggcagccctgcta

SEQ ID NO: 8450605 - DNA, 23 bp, Homo sapiens
agacagaggctgaggctggccgc

SEQ ID NO: 8450606 - DNA, 23 bp, Homo sapiens
agacagaggctgaggctggccgc

SEQ ID NO: 8450607 - DNA, 23 bp, Homo sapiens
agacagaggctgaggctggccgc

SEQ ID NO: 8450608 - DNA, 22 bp, Homo sapiens
agacaggccactctggtctggt

SEQ ID NO: 8450609 - DNA, 22 bp, Homo sapiens
agacaggcttggaaaaaacctc

SEQ ID NO: 8450610 - DNA, 22 bp, Homo sapiens
agacaggccactctggtctggt

SEQ ID NO: 8450611 - DNA, 22 bp, Homo sapiens
aatgcaatgcagcacctccttg

SEQ ID NO: 8450612 - DNA, 21 bp, Homo sapiens
agacactggtttagcattcat

SEQ ID NO: 8450613 - DNA, 19 bp, Homo sapiens
agacagagctcagtgggtt

SEQ ID NO: 8450614 - DNA, 19 bp, Homo sapiens
agacagagctcagtgggtt

SEQ ID NO: 8450615 - DNA, 22 bp, Homo sapiens
agacagagatactatgttgtca

SEQ ID NO: 8450616 - DNA, 22 bp, Homo sapiens
agaaggggcccaaggatgtcag

SEQ ID NO: 8450617 - DNA, 22 bp, Homo sapiens
agaaggggagaagctaccagga

SEQ ID NO: 8450618 - DNA, 22 bp, Homo sapiens
agaagggctacacgggctctcc

SEQ ID NO: 8450619 - DNA, 22 bp, Homo sapiens
agaagtataaagaatgtttatg

SEQ ID NO: 8450620 - DNA, 22 bp, Homo sapiens
agaagtatgtgagaaattatcc

SEQ ID NO: 8450621 - DNA, 22 bp, Homo sapiens
agaagtataactatttgctttc

SEQ ID NO: 8450622 - DNA, 22 bp, Homo sapiens
agaagtatcaggaagattctca

SEQ ID NO: 8450623 - DNA, 22 bp, Homo sapiens
aatgcaaattatcaggcttctc

SEQ ID NO: 8450624 - DNA, 22 bp, Homo sapiens
aatgcaaattctagggccctat

SEQ ID NO: 8450625 - DNA, 22 bp, Homo sapiens
aatgcaaagctctttaatcctt

SEQ ID NO: 8450626 - DNA, 22 bp, Homo sapiens
aatgcaaacttcttgttacttg

SEQ ID NO: 8450627 - DNA, 22 bp, Homo sapiens
aatgcaaactccactggagcag

SEQ ID NO: 8450628 - DNA, 22 bp, Homo sapiens
aatgcaaacagcccagaatcca

SEQ ID NO: 8450629 - DNA, 22 bp, Homo sapiens
aatgcaaacagcccagaatcca

SEQ ID NO: 8450630 - DNA, 22 bp, Homo sapiens
aatgcaaacttcttgttacttg

SEQ ID NO: 8450631 - DNA, 22 bp, Homo sapiens
aatgcaaagcaagcagagattt

SEQ ID NO: 8450632 - DNA, 22 bp, Homo sapiens
aatgtctcaccgtaaatgtaac

SEQ ID NO: 8450633 - DNA, 22 bp, Homo sapiens
aatgtctgaaaatcagactgca

SEQ ID NO: 8450634 - DNA, 22 bp, Homo sapiens
aatgtctgaggctcatctgagg

SEQ ID NO: 8450635 - DNA, 22 bp, Homo sapiens
aatgtctgagtctctgtatccc

SEQ ID NO: 8450636 - DNA, 22 bp, Homo sapiens
aatgtctgccagaactgatcat

SEQ ID NO: 8450637 - DNA, 22 bp, Homo sapiens
aatgtctgcctgaactttatat

SEQ ID NO: 8450638 - DNA, 22 bp, Homo sapiens
aatgtgttcagttaaatgaact

SEQ ID NO: 8450639 - DNA, 22 bp, Homo sapiens
aatgtctacattctgaattcgt

SEQ ID NO: 8450640 - DNA, 22 bp, Homo sapiens
aatgtctatttgctacaaagcc

SEQ ID NO: 8450641 - DNA, 18 bp, Homo sapiens
aatgtccagtgttcatat

SEQ ID NO: 8450642 - DNA, 22 bp, Homo sapiens
aatgtctacaccgtatgttgtt

SEQ ID NO: 8450643 - DNA, 22 bp, Homo sapiens
agacagggtcttgatcagagct

SEQ ID NO: 8450644 - DNA, 22 bp, Homo sapiens
agacagggtcttgatcagagct

SEQ ID NO: 8450645 - DNA, 22 bp, Homo sapiens
agacagggtgatcgcttgagcc

SEQ ID NO: 8450646 - DNA, 22 bp, Homo sapiens
aatgtattctctttataagata

SEQ ID NO: 8450647 - DNA, 22 bp, Homo sapiens
agacagggtgatcgcttgagcc

SEQ ID NO: 8450648 - DNA, 22 bp, Homo sapiens
aatgtattctctttataagata

SEQ ID NO: 8450649 - DNA, 22 bp, Homo sapiens
aatgtcaattaccagaacagaa

SEQ ID NO: 8450650 - DNA, 22 bp, Homo sapiens
aatgtcaattaccagaacagaa

SEQ ID NO: 8450651 - DNA, 22 bp, Homo sapiens
aatgtcactctgtttcctctgc

SEQ ID NO: 8450652 - DNA, 22 bp, Homo sapiens
aatgtcagcctgaaagctattc

SEQ ID NO: 8450653 - DNA, 22 bp, Homo sapiens
agcacctgctatgtgtcaggga

SEQ ID NO: 8450654 - DNA, 22 bp, Homo sapiens
acaattctgatggtttcccagt

SEQ ID NO: 8450655 - DNA, 22 bp, Homo sapiens
acaattctgggtatttatatag

SEQ ID NO: 8450656 - DNA, 22 bp, Homo sapiens
acaatttatccattgtatagtt

SEQ ID NO: 8450657 - DNA, 23 bp, Homo sapiens
agcaccattacagtttgattggg

SEQ ID NO: 8450658 - DNA, 22 bp, Homo sapiens
agcaccatcgggttcttgcttt

SEQ ID NO: 8450659 - DNA, 22 bp, Homo sapiens
agcacctccagagcttgaagct

SEQ ID NO: 8450660 - DNA, 22 bp, Homo sapiens
agcacctccttagctatgacca

SEQ ID NO: 8450661 - DNA, 22 bp, Homo sapiens
agcacctgcacagtggaggaaa

SEQ ID NO: 8450662 - DNA, 22 bp, Homo sapiens
agcacctgcacagtggaggaaa

SEQ ID NO: 8450663 - DNA, 22 bp, Homo sapiens
acacaggaagagagataataat

SEQ ID NO: 8450664 - DNA, 22 bp, Homo sapiens
acacaggaagcaatttcagagc

SEQ ID NO: 8450665 - DNA, 22 bp, Homo sapiens
acacaggaactctgagaggtgg

SEQ ID NO: 8450666 - DNA, 22 bp, Homo sapiens
acaatttctaatatagatctta

SEQ ID NO: 8450667 - DNA, 22 bp, Homo sapiens
acaatttcttatagttcaattc

SEQ ID NO: 8450668 - DNA, 22 bp, Homo sapiens
acaatttgaggctactcaattg

SEQ ID NO: 8450669 - DNA, 22 bp, Homo sapiens
acaattttaagccagagtgggt

SEQ ID NO: 8450670 - DNA, 22 bp, Homo sapiens
acacaggacagggatgtgtttt

SEQ ID NO: 8450671 - DNA, 22 bp, Homo sapiens
acacaggaagtcagcactgatg

SEQ ID NO: 8450672 - DNA, 22 bp, Homo sapiens
agcagcttgggtctctcctgct

SEQ ID NO: 8450673 - DNA, 22 bp, Homo sapiens
acacatatctaagatagatgac

SEQ ID NO: 8450674 - DNA, 22 bp, Homo sapiens
acacatatgccattacagcaaa

SEQ ID NO: 8450675 - DNA, 22 bp, Homo sapiens
acacatatggttgctgcagtga

SEQ ID NO: 8450676 - DNA, 23 bp, Homo sapiens
acacatatattcagatacagatg

SEQ ID NO: 8450677 - DNA, 22 bp, Homo sapiens
acacatatatttgcatatacac

SEQ ID NO: 8450678 - DNA, 22 bp, Homo sapiens
agcagcagtgacagccgaaagc

SEQ ID NO: 8450679 - DNA, 22 bp, Homo sapiens
agcagcagtcctttgtgtaatt

SEQ ID NO: 8450680 - DNA, 22 bp, Homo sapiens
agcagcagtgtggtttggggaa

SEQ ID NO: 8450681 - DNA, 22 bp, Homo sapiens
agcagcagtgtggtttggggaa

SEQ ID NO: 8450682 - DNA, 22 bp, Homo sapiens
acacatatattatttgtggctc

SEQ ID NO: 8450683 - DNA, 22 bp, Homo sapiens
acacatatatgtcgaagtcctc

SEQ ID NO: 8450684 - DNA, 22 bp, Homo sapiens
agcagcagtgtgtggtcatgtt

SEQ ID NO: 8450685 - DNA, 22 bp, Homo sapiens
agcagcagtatccttccccggc

SEQ ID NO: 8450686 - DNA, 22 bp, Homo sapiens
acacaggcaatgtgagtgggag

SEQ ID NO: 8450687 - DNA, 21 bp, Homo sapiens
acacaggcagtgtcccgaggt

SEQ ID NO: 8450688 - DNA, 19 bp, Homo sapiens
acactgtagatatagctat

SEQ ID NO: 8450689 - DNA, 19 bp, Homo sapiens
acactgtagatatagctat

SEQ ID NO: 8450690 - DNA, 22 bp, Homo sapiens
acactgtagatatagagttagt

SEQ ID NO: 8450691 - DNA, 22 bp, Homo sapiens
acactgtagctgagggcatgcg

SEQ ID NO: 8450692 - DNA, 22 bp, Homo sapiens
acactgtaggagaaaggagttt

SEQ ID NO: 8450693 - DNA, 22 bp, Homo sapiens
acactgtatgaaaacaggaaat

SEQ ID NO: 8450694 - DNA, 22 bp, Homo sapiens
acactgtaggagaaaggagttt

SEQ ID NO: 8450695 - DNA, 22 bp, Homo sapiens
acactgtaaacatctcaagcac

SEQ ID NO: 8450696 - DNA, 22 bp, Homo sapiens
acactgtaaattgagtgcgtga

SEQ ID NO: 8450697 - DNA, 22 bp, Homo sapiens
acactgtagactgttgaagtac

SEQ ID NO: 8450698 - DNA, 22 bp, Homo sapiens
acactgtaaagtgatgcttaaa

SEQ ID NO: 8450699 - DNA, 22 bp, Homo sapiens
acactgtgacaagaaagagctg

SEQ ID NO: 8450700 - DNA, 22 bp, Homo sapiens
acactgtgacggaaataaagaa

SEQ ID NO: 8450701 - DNA, 23 bp, Homo sapiens
agcagggccagaatacttgctgt

SEQ ID NO: 8450702 - DNA, 22 bp, Homo sapiens
acacattttggctaggtggaga

SEQ ID NO: 8450703 - DNA, 22 bp, Homo sapiens
acacattttgttaaaccctgtg

SEQ ID NO: 8450704 - DNA, 22 bp, Homo sapiens
acacattttcaacactgtcaag

SEQ ID NO: 8450705 - DNA, 22 bp, Homo sapiens
acacattttctaacagggatca

SEQ ID NO: 8450706 - DNA, 22 bp, Homo sapiens
acacattttcaacactgtcaag

SEQ ID NO: 8450707 - DNA, 22 bp, Homo sapiens
acaccaaagtagaattaatgta

SEQ ID NO: 8450708 - DNA, 22 bp, Homo sapiens
acaccagggatatgaggaagga

SEQ ID NO: 8450709 - DNA, 22 bp, Homo sapiens
acaccagcctcgcccgtgtgtt

SEQ ID NO: 8450710 - DNA, 22 bp, Homo sapiens
acaccaccgtcccagcctcctg

SEQ ID NO: 8450711 - DNA, 22 bp, Homo sapiens
acaccagcctcgcccgtgtgtt

SEQ ID NO: 8450712 - DNA, 22 bp, Homo sapiens
acacattatctcattaaatact

SEQ ID NO: 8450713 - DNA, 23 bp, Homo sapiens
agcaggaaaccgagggtgatgtt

SEQ ID NO: 8450714 - DNA, 23 bp, Homo sapiens
agcaggaaaccgagggtgatgtt

SEQ ID NO: 8450715 - DNA, 19 bp, Homo sapiens
acacatttgcacaatccac

SEQ ID NO: 8450716 - DNA, 19 bp, Homo sapiens
acacatttgcacaatccac

SEQ ID NO: 8450717 - DNA, 22 bp, Homo sapiens
acacatttgctaaaatgagctc

SEQ ID NO: 8450718 - DNA, 22 bp, Homo sapiens
acagaaattgctaatagctcat

SEQ ID NO: 8450719 - DNA, 22 bp, Homo sapiens
acagaaattgctaatagctcat

SEQ ID NO: 8450720 - DNA, 22 bp, Homo sapiens
acagaaattctgggacagaaaa

SEQ ID NO: 8450721 - DNA, 22 bp, Homo sapiens
acagaaattagcagtgagttta

SEQ ID NO: 8450722 - DNA, 22 bp, Homo sapiens
acagaaattcaaactggaattt

SEQ ID NO: 8450723 - DNA, 22 bp, Homo sapiens
acagaaattcaaactggaattt

SEQ ID NO: 8450724 - DNA, 22 bp, Homo sapiens
agccacagggggtgagggacaa

SEQ ID NO: 8450725 - DNA, 22 bp, Homo sapiens
agccacaggaaacagagacagc

SEQ ID NO: 8450726 - DNA, 22 bp, Homo sapiens
agccacaggccatgagatacca

SEQ ID NO: 8450727 - DNA, 22 bp, Homo sapiens
agcagtgtggccttagacccgg

SEQ ID NO: 8450728 - DNA, 18 bp, Homo sapiens
agcagtgtggcaagcaga

SEQ ID NO: 8450729 - DNA, 22 bp, Homo sapiens
agcagtgtgggctgcacgctgg

SEQ ID NO: 8450730 - DNA, 20 bp, Homo sapiens
agcagtgtggggagactgtg

SEQ ID NO: 8450731 - DNA, 22 bp, Homo sapiens
agcagtgtgcttcgtttcatga

SEQ ID NO: 8450732 - DNA, 22 bp, Homo sapiens
agcagttacgggcctatctagg

SEQ ID NO: 8450733 - DNA, 22 bp, Homo sapiens
agcagtgtttaggcattcagta

SEQ ID NO: 8450734 - DNA, 22 bp, Homo sapiens
agcagtgttctaatctggctag

SEQ ID NO: 8450735 - DNA, 22 bp, Homo sapiens
agcagtgttttgattctgggag

SEQ ID NO: 8450736 - DNA, 22 bp, Homo sapiens
agcagttaccaaggaacctggt

SEQ ID NO: 8450737 - DNA, 22 bp, Homo sapiens
agcagtgggtgacagagctgag

SEQ ID NO: 8450738 - DNA, 22 bp, Homo sapiens
agcagtgggggagtgttagttt

SEQ ID NO: 8450739 - DNA, 22 bp, Homo sapiens
acactgtgcatgcatatacaca

SEQ ID NO: 8450740 - DNA, 22 bp, Homo sapiens
acactgtgcatgcatatacaca

SEQ ID NO: 8450741 - DNA, 22 bp, Homo sapiens
acactgtgtctagcattttaca

SEQ ID NO: 8450742 - DNA, 22 bp, Homo sapiens
acagcaactcctgcttctgagt

SEQ ID NO: 8450743 - DNA, 22 bp, Homo sapiens
acagcaaaggacgaacactctg

SEQ ID NO: 8450744 - DNA, 22 bp, Homo sapiens
acagcaaaagacaagaacttaa

SEQ ID NO: 8450745 - DNA, 22 bp, Homo sapiens
acagcaaaggacgaacactctg

SEQ ID NO: 8450746 - DNA, 22 bp, Homo sapiens
acagcaaaggacgaacactctg

SEQ ID NO: 8450747 - DNA, 22 bp, Homo sapiens
agcctgattttgataattatat

SEQ ID NO: 8450748 - DNA, 22 bp, Homo sapiens
agcctgcctcagactcaggata

SEQ ID NO: 8450749 - DNA, 17 bp, Homo sapiens
agcctgccccatgctgc

SEQ ID NO: 8450750 - DNA, 22 bp, Homo sapiens
acagcaatctgagagacatagt

SEQ ID NO: 8450751 - DNA, 21 bp, Homo sapiens
acagcaagccttcctttcagg

SEQ ID NO: 8450752 - DNA, 23 bp, Homo sapiens
acagcaagaggaccagatgtgag

SEQ ID NO: 8450753 - DNA, 22 bp, Homo sapiens
agctaggccatttgttcagtga

SEQ ID NO: 8450754 - DNA, 22 bp, Homo sapiens
agctagtgggctgggagaggaa

SEQ ID NO: 8450755 - DNA, 22 bp, Homo sapiens
agctagttcactgaagcctatg

SEQ ID NO: 8450756 - DNA, 22 bp, Homo sapiens
agctatggaacagagtggctgt

SEQ ID NO: 8450757 - DNA, 22 bp, Homo sapiens
agctatcagtaggaccatgttc

SEQ ID NO: 8450758 - DNA, 22 bp, Homo sapiens
agctatgtgatttaaacaaggt

SEQ ID NO: 8450759 - DNA, 22 bp, Homo sapiens
agctctagggaagaaaggcaca

SEQ ID NO: 8450760 - DNA, 22 bp, Homo sapiens
agctccttgaattaatgctgct

SEQ ID NO: 8450761 - DNA, 22 bp, Homo sapiens
agctcctgtgtgcccacctgct

SEQ ID NO: 8450762 - DNA, 22 bp, Homo sapiens
agctccttgaagggctctggga

SEQ ID NO: 8450763 - DNA, 19 bp, Homo sapiens
agctcctgttcagcagctc

SEQ ID NO: 8450764 - DNA, 19 bp, Homo sapiens
agctcctgttcagcagctc

SEQ ID NO: 8450765 - DNA, 19 bp, Homo sapiens
agctcctgttcagcagctc

SEQ ID NO: 8450766 - DNA, 19 bp, Homo sapiens
agctcctgttcagcagctc

SEQ ID NO: 8450767 - DNA, 19 bp, Homo sapiens
agctcctgttcagcagctc

SEQ ID NO: 8450768 - DNA, 22 bp, Homo sapiens
agctcctgttctgagagcagga

SEQ ID NO: 8450769 - DNA, 22 bp, Homo sapiens
agctcctgttctgagagcagga

SEQ ID NO: 8450770 - DNA, 22 bp, Homo sapiens
agctccttgaagggctctggga

SEQ ID NO: 8450771 - DNA, 22 bp, Homo sapiens
acagcaggagccttcatatgct

SEQ ID NO: 8450772 - DNA, 22 bp, Homo sapiens
acagcaggagccttcatatgct

SEQ ID NO: 8450773 - DNA, 22 bp, Homo sapiens
acagcaggaattaacatataag

SEQ ID NO: 8450774 - DNA, 22 bp, Homo sapiens
agctcaaagctgttacattgta

SEQ ID NO: 8450775 - DNA, 22 bp, Homo sapiens
acagcaggcacacaaggataga

SEQ ID NO: 8450776 - DNA, 22 bp, Homo sapiens
acagcaggcacacaaggataga

SEQ ID NO: 8450777 - DNA, 22 bp, Homo sapiens
acagcaggatttggcgatgttg

SEQ ID NO: 8450778 - DNA, 22 bp, Homo sapiens
acagcaggcatgaagaaatgtt

SEQ ID NO: 8450779 - DNA, 22 bp, Homo sapiens
acagcaggcatgaagaaatgtt

SEQ ID NO: 8450780 - DNA, 22 bp, Homo sapiens
agctcctgtgtgcccacctgct

SEQ ID NO: 8450781 - DNA, 22 bp, Homo sapiens
acagcaggcatgaatgacactg

SEQ ID NO: 8450782 - DNA, 22 bp, Homo sapiens
acagagtggagttcagtaaata

SEQ ID NO: 8450783 - DNA, 22 bp, Homo sapiens
agcccctctgtggctctgcctc

SEQ ID NO: 8450784 - DNA, 22 bp, Homo sapiens
agcccctgggagtagctgctgc

SEQ ID NO: 8450785 - DNA, 22 bp, Homo sapiens
agcccctgggagtagctgctgc

SEQ ID NO: 8450786 - DNA, 22 bp, Homo sapiens
acagataaagaaacaatcacag

SEQ ID NO: 8450787 - DNA, 23 bp, Homo sapiens
agcccctcatggtgtctagacag

SEQ ID NO: 8450788 - DNA, 22 bp, Homo sapiens
agccatgtgtctttattctgtt

SEQ ID NO: 8450789 - DNA, 22 bp, Homo sapiens
agccatgttaaatggacttgat

SEQ ID NO: 8450790 - DNA, 22 bp, Homo sapiens
agccatgttggggaaggtgggc

SEQ ID NO: 8450791 - DNA, 22 bp, Homo sapiens
agccatgtcacatatggtcatc

SEQ ID NO: 8450792 - DNA, 22 bp, Homo sapiens
agccatgtatgagggtttccag

SEQ ID NO: 8450793 - DNA, 22 bp, Homo sapiens
agccatgtatgagggtttccag

SEQ ID NO: 8450794 - DNA, 22 bp, Homo sapiens
agccatgggctcccagtccttt

SEQ ID NO: 8450795 - DNA, 22 bp, Homo sapiens
agccatggcgccactagaggga

SEQ ID NO: 8450796 - DNA, 22 bp, Homo sapiens
agccatgggagactgtgggaga

SEQ ID NO: 8450797 - DNA, 22 bp, Homo sapiens
agccatgggagactgtgggaga

SEQ ID NO: 8450798 - DNA, 22 bp, Homo sapiens
agccacagtcaacctgtccata

SEQ ID NO: 8450799 - DNA, 22 bp, Homo sapiens
agccacagtcaacctgtccata

SEQ ID NO: 8450800 - DNA, 21 bp, Homo sapiens
agccatcctgaatggtgccat

SEQ ID NO: 8450801 - DNA, 22 bp, Homo sapiens
agccacagtctgatgcctgaga

SEQ ID NO: 8450802 - DNA, 22 bp, Homo sapiens
agcccagctttcacccctctgg

SEQ ID NO: 8450803 - DNA, 19 bp, Homo sapiens
agcccagcttatttgtcag

SEQ ID NO: 8450804 - DNA, 22 bp, Homo sapiens
agcccagcttccttctgtctct

SEQ ID NO: 8450805 - DNA, 22 bp, Homo sapiens
agcccagcttccttctgtctct

SEQ ID NO: 8450806 - DNA, 22 bp, Homo sapiens
acagagcactgccctgtgccgc

SEQ ID NO: 8450807 - DNA, 22 bp, Homo sapiens
agcccagcggagcgggcccggg

SEQ ID NO: 8450808 - DNA, 22 bp, Homo sapiens
agcccaaacctgcgagcagagc

SEQ ID NO: 8450809 - DNA, 22 bp, Homo sapiens
agccattttcctgaaatataac

SEQ ID NO: 8450810 - DNA, 22 bp, Homo sapiens
agccatgttaaatggacttgat

SEQ ID NO: 8450811 - DNA, 22 bp, Homo sapiens
agccattttggtaatgataaca

SEQ ID NO: 8450812 - DNA, 22 bp, Homo sapiens
agcccagctgcctgcctgctgt

SEQ ID NO: 8450813 - DNA, 22 bp, Homo sapiens
agcccagctgctatgtacctgg

SEQ ID NO: 8450814 - DNA, 18 bp, Homo sapiens
agcccagcggagtgaatc

SEQ ID NO: 8450815 - DNA, 22 bp, Homo sapiens
agcccagctcctccacagaata

SEQ ID NO: 8450816 - DNA, 22 bp, Homo sapiens
aagggctgaaagaccttgggca

SEQ ID NO: 8450817 - DNA, 22 bp, Homo sapiens
aagggctgaatgaagggttgaa

SEQ ID NO: 8450818 - DNA, 22 bp, Homo sapiens
aagggctgaatgaagggttgaa

SEQ ID NO: 8450819 - DNA, 22 bp, Homo sapiens
aagggctgagaagtggggctgg

SEQ ID NO: 8450820 - DNA, 22 bp, Homo sapiens
aagggctgagcacagtgagcca

SEQ ID NO: 8450821 - DNA, 22 bp, Homo sapiens
aaggtctgtgaggctgtttgtc

SEQ ID NO: 8450822 - DNA, 18 bp, Homo sapiens
aaggtctgtctggtaggt

SEQ ID NO: 8450823 - DNA, 22 bp, Homo sapiens
aaggtctgtggccacctctggg

SEQ ID NO: 8450824 - DNA, 22 bp, Homo sapiens
accatgacgtcacagaggcttc

SEQ ID NO: 8450825 - DNA, 22 bp, Homo sapiens
accatgtgatcaaaacaaatcc

SEQ ID NO: 8450826 - DNA, 21 bp, Homo sapiens
accatcttccatgcattatat

SEQ ID NO: 8450827 - DNA, 22 bp, Homo sapiens
accatcttagcagactgcagtg

SEQ ID NO: 8450828 - DNA, 22 bp, Homo sapiens
accatctgagtagagagaagta

SEQ ID NO: 8450829 - DNA, 22 bp, Homo sapiens
accatcttttcctctgcctcct

SEQ ID NO: 8450830 - DNA, 22 bp, Homo sapiens
aaggtgggtggatcacgaggtc

SEQ ID NO: 8450831 - DNA, 22 bp, Homo sapiens
aaggtgggcagatcacaaggtc

SEQ ID NO: 8450832 - DNA, 23 bp, Homo sapiens
aagtacatatatttagatagtga

SEQ ID NO: 8450833 - DNA, 22 bp, Homo sapiens
aagtacatatatttatgattct

SEQ ID NO: 8450834 - DNA, 22 bp, Homo sapiens
aagtacatatatttatgattct

SEQ ID NO: 8450835 - DNA, 22 bp, Homo sapiens
aagtacatatatttatgattct

SEQ ID NO: 8450836 - DNA, 22 bp, Homo sapiens
aagtacataaaggaattagcca

SEQ ID NO: 8450837 - DNA, 22 bp, Homo sapiens
aagtacatgttgttcaaaagcc

SEQ ID NO: 8450838 - DNA, 22 bp, Homo sapiens
aagtacatgctttattcagagt

SEQ ID NO: 8450839 - DNA, 22 bp, Homo sapiens
aagtacatgctgtaatgattgg

SEQ ID NO: 8450840 - DNA, 22 bp, Homo sapiens
aagtacatcctagtctctttca

SEQ ID NO: 8450841 - DNA, 22 bp, Homo sapiens
aagtacatttttaacttacagc

SEQ ID NO: 8450842 - DNA, 22 bp, Homo sapiens
aagtaccaagtttgtttgacgc

SEQ ID NO: 8450843 - DNA, 22 bp, Homo sapiens
aagtacatttttaacttacagc

SEQ ID NO: 8450844 - DNA, 22 bp, Homo sapiens
aagtacctcatagggttatttt

SEQ ID NO: 8450845 - DNA, 22 bp, Homo sapiens
aagtacctagaaatatttttga

SEQ ID NO: 8450846 - DNA, 22 bp, Homo sapiens
aagtactgtatcacttactcct

SEQ ID NO: 8450847 - DNA, 22 bp, Homo sapiens
aagtacttctagatggataatc

SEQ ID NO: 8450848 - DNA, 22 bp, Homo sapiens
accccaggagctgtgcctagtc

SEQ ID NO: 8450849 - DNA, 23 bp, Homo sapiens
accccaggcatcgcattcctctt

SEQ ID NO: 8450850 - DNA, 22 bp, Homo sapiens
accccagggctgccagcctcct

SEQ ID NO: 8450851 - DNA, 22 bp, Homo sapiens
accccaggtcatctgagagtcc

SEQ ID NO: 8450852 - DNA, 22 bp, Homo sapiens
accccaggtccaggttacagag

SEQ ID NO: 8450853 - DNA, 22 bp, Homo sapiens
accccaggtcatctgagagtcc

SEQ ID NO: 8450854 - DNA, 22 bp, Homo sapiens
accccaggtctccaggctctgg

SEQ ID NO: 8450855 - DNA, 22 bp, Homo sapiens
aagtcacaagcatatatgcatt

SEQ ID NO: 8450856 - DNA, 21 bp, Homo sapiens
acccccacacctccttagttc

SEQ ID NO: 8450857 - DNA, 21 bp, Homo sapiens
acccccacacctccttagttc

SEQ ID NO: 8450858 - DNA, 22 bp, Homo sapiens
acccccacggaaggccgtacgc

SEQ ID NO: 8450859 - DNA, 22 bp, Homo sapiens
acccccacggaaggccgtacgc

SEQ ID NO: 8450860 - DNA, 22 bp, Homo sapiens
aagtatctgggagatttgcttt

SEQ ID NO: 8450861 - DNA, 22 bp, Homo sapiens
aagtatctgggagatttgcttt

SEQ ID NO: 8450862 - DNA, 22 bp, Homo sapiens
accccccagataatcccttgag

SEQ ID NO: 8450863 - DNA, 22 bp, Homo sapiens
accccccagataatcccttgag

SEQ ID NO: 8450864 - DNA, 22 bp, Homo sapiens
aaggcatagtctttaagttctg

SEQ ID NO: 8450865 - DNA, 22 bp, Homo sapiens
aaggcatatattctaaacagga

SEQ ID NO: 8450866 - DNA, 22 bp, Homo sapiens
aaggcatatattctaaacagga

SEQ ID NO: 8450867 - DNA, 22 bp, Homo sapiens
aaggcatatgctgtgtacagtt

SEQ ID NO: 8450868 - DNA, 22 bp, Homo sapiens
aaggctgaggctggagaattac

SEQ ID NO: 8450869 - DNA, 22 bp, Homo sapiens
aaggctgaggcagtgaggcaga

SEQ ID NO: 8450870 - DNA, 22 bp, Homo sapiens
aaggctgaggagggcctgcagg

SEQ ID NO: 8450871 - DNA, 22 bp, Homo sapiens
aaggctcttggagtgaatgcag

SEQ ID NO: 8450872 - DNA, 22 bp, Homo sapiens
aaggctgaaagaccttgaacct

SEQ ID NO: 8450873 - DNA, 16 bp, Homo sapiens
aaggctgattttccct

SEQ ID NO: 8450874 - DNA, 22 bp, Homo sapiens
acatgtgtacatatatatgtgc

SEQ ID NO: 8450875 - DNA, 22 bp, Homo sapiens
aaggctgaggtagggcctaaaa

SEQ ID NO: 8450876 - DNA, 22 bp, Homo sapiens
aaggctgagggctgtacctggc

SEQ ID NO: 8450877 - DNA, 22 bp, Homo sapiens
aaggctgagtaaaacagagaac

SEQ ID NO: 8450878 - DNA, 22 bp, Homo sapiens
aaggctgattagactgatagct

SEQ ID NO: 8450879 - DNA, 22 bp, Homo sapiens
aaggcttgttgtcacgctcttg

SEQ ID NO: 8450880 - DNA, 22 bp, Homo sapiens
aaggcttgttgagtatctactg

SEQ ID NO: 8450881 - DNA, 22 bp, Homo sapiens
aaggcttctttgcaggctttag

SEQ ID NO: 8450882 - DNA, 22 bp, Homo sapiens
aaggcttgatatttacagtctt

SEQ ID NO: 8450883 - DNA, 22 bp, Homo sapiens
aaggcttctttagtgtcctaat

SEQ ID NO: 8450884 - DNA, 22 bp, Homo sapiens
aaggcttcttatgcaattgttt

SEQ ID NO: 8450885 - DNA, 22 bp, Homo sapiens
aaggcttctggagcttgctggc

SEQ ID NO: 8450886 - DNA, 22 bp, Homo sapiens
aaggcttcctggaggaggtgtc

SEQ ID NO: 8450887 - DNA, 18 bp, Homo sapiens
aaggcttcaaagagtaga

SEQ ID NO: 8450888 - DNA, 22 bp, Homo sapiens
aaggcttccactttgttgggtc

SEQ ID NO: 8450889 - DNA, 22 bp, Homo sapiens
acatgtgtggccgctgtagaca

SEQ ID NO: 8450890 - DNA, 22 bp, Homo sapiens
acatgtgtgtatacgtatttat

SEQ ID NO: 8450891 - DNA, 22 bp, Homo sapiens
aaggctggtttccttgatgttt

SEQ ID NO: 8450892 - DNA, 22 bp, Homo sapiens
acatgtgtacttttaaggatgt

SEQ ID NO: 8450893 - DNA, 22 bp, Homo sapiens
aagggacatagactgtacatct

SEQ ID NO: 8450894 - DNA, 22 bp, Homo sapiens
aagggagaaaacttgtggctta

SEQ ID NO: 8450895 - DNA, 22 bp, Homo sapiens
aagggagaaagaatgagtttag

SEQ ID NO: 8450896 - DNA, 22 bp, Homo sapiens
aaggcttttaaactgtcaagga

SEQ ID NO: 8450897 - DNA, 22 bp, Homo sapiens
aaggcttttgacggttgcctct

SEQ ID NO: 8450898 - DNA, 22 bp, Homo sapiens
aagggaaaatagttgatgacca

SEQ ID NO: 8450899 - DNA, 22 bp, Homo sapiens
aagggagaaaacttgtggctta

SEQ ID NO: 8450900 - DNA, 22 bp, Homo sapiens
aagggccataacttgcagtgtt

SEQ ID NO: 8450901 - DNA, 22 bp, Homo sapiens
aagggctcacccaactcacttc

SEQ ID NO: 8450902 - DNA, 22 bp, Homo sapiens
aagggcccattctctcagaaaa

SEQ ID NO: 8450903 - DNA, 22 bp, Homo sapiens
acaggcaggtcctgtcccagct

SEQ ID NO: 8450904 - DNA, 18 bp, Homo sapiens
aagctgccctcaggcagg

SEQ ID NO: 8450905 - DNA, 22 bp, Homo sapiens
acaggcaggttgagaaacattt

SEQ ID NO: 8450906 - DNA, 22 bp, Homo sapiens
acaggcaggttgagaaacattt

SEQ ID NO: 8450907 - DNA, 22 bp, Homo sapiens
acaggcagtgggccagatttgt

SEQ ID NO: 8450908 - DNA, 22 bp, Homo sapiens
acaggcagtgatttcctctggt

SEQ ID NO: 8450909 - DNA, 22 bp, Homo sapiens
acaggcagtgatttcctctggt

SEQ ID NO: 8450910 - DNA, 22 bp, Homo sapiens
aagctgcagaccccctgtctca

SEQ ID NO: 8450911 - DNA, 22 bp, Homo sapiens
aagctgcactacttgagggacc

SEQ ID NO: 8450912 - DNA, 22 bp, Homo sapiens
aagctgccagctgagctgaggc

SEQ ID NO: 8450913 - DNA, 22 bp, Homo sapiens
aagccagggtcaggggcctcct

SEQ ID NO: 8450914 - DNA, 22 bp, Homo sapiens
aagctcttctgtggatttgagt

SEQ ID NO: 8450915 - DNA, 22 bp, Homo sapiens
aagccaggtgttgtggtaagag

SEQ ID NO: 8450916 - DNA, 18 bp, Homo sapiens
aagccaggtcaagataag

SEQ ID NO: 8450917 - DNA, 22 bp, Homo sapiens
acaggcagttgaggtttgtgtg

SEQ ID NO: 8450918 - DNA, 22 bp, Homo sapiens
acaggccacagtggagtctctg

SEQ ID NO: 8450919 - DNA, 22 bp, Homo sapiens
acaggcattgggatggaggttg

SEQ ID NO: 8450920 - DNA, 22 bp, Homo sapiens
acaggcatatttctagattaca

SEQ ID NO: 8450921 - DNA, 23 bp, Homo sapiens
aagcttgtcaccatttctttcag

SEQ ID NO: 8450922 - DNA, 22 bp, Homo sapiens
aaggaaagacatataaatgact

SEQ ID NO: 8450923 - DNA, 22 bp, Homo sapiens
aaggaaagattctctctctaga

SEQ ID NO: 8450924 - DNA, 22 bp, Homo sapiens
aaggaaatacaacatgtattca

SEQ ID NO: 8450925 - DNA, 22 bp, Homo sapiens
aaggaaaggatgagcatgcatt

SEQ ID NO: 8450926 - DNA, 22 bp, Homo sapiens
aaggaaaggatgagcatgcatt

SEQ ID NO: 8450927 - DNA, 22 bp, Homo sapiens
aaggaaatctttgtaacatctt

SEQ ID NO: 8450928 - DNA, 22 bp, Homo sapiens
acagggctctgacaccaaggta

SEQ ID NO: 8450929 - DNA, 23 bp, Homo sapiens
acagggctggcagctgcaagacc

SEQ ID NO: 8450930 - DNA, 22 bp, Homo sapiens
acagggctgaggctggcttctt

SEQ ID NO: 8450931 - DNA, 19 bp, Homo sapiens
acagggctctggacgccat

SEQ ID NO: 8450932 - DNA, 22 bp, Homo sapiens
acagtacagtgcagaggaagat

SEQ ID NO: 8450933 - DNA, 22 bp, Homo sapiens
acagtactctaatgaaaagtgc

SEQ ID NO: 8450934 - DNA, 22 bp, Homo sapiens
acagtaccaggccaaaccatga

SEQ ID NO: 8450935 - DNA, 22 bp, Homo sapiens
acagtacatagatctctaccct

SEQ ID NO: 8450936 - DNA, 22 bp, Homo sapiens
acagtacatagatctctaccct

SEQ ID NO: 8450937 - DNA, 22 bp, Homo sapiens
acaggtgtggggctgtggtact

SEQ ID NO: 8450938 - DNA, 20 bp, Homo sapiens
acagtagaagggatttcaaa

SEQ ID NO: 8450939 - DNA, 21 bp, Homo sapiens
acagtagctgacacacagttt

SEQ ID NO: 8450940 - DNA, 22 bp, Homo sapiens
acagtataaactcctaaaagcc

SEQ ID NO: 8450941 - DNA, 22 bp, Homo sapiens
acagtataccattgtgactttg

SEQ ID NO: 8450942 - DNA, 22 bp, Homo sapiens
aaggaaatctttgtaacatctt

SEQ ID NO: 8450943 - DNA, 22 bp, Homo sapiens
aaggaaatgtgcctgacactgc

SEQ ID NO: 8450944 - DNA, 22 bp, Homo sapiens
aaggaaatgaggttgatggatg

SEQ ID NO: 8450945 - DNA, 22 bp, Homo sapiens
aaggaaattaggttattttgct

SEQ ID NO: 8450946 - DNA, 22 bp, Homo sapiens
aaggaacactacaaggctggga

SEQ ID NO: 8450947 - DNA, 22 bp, Homo sapiens
aaggcagaaagggatgtgagtg

SEQ ID NO: 8450948 - DNA, 22 bp, Homo sapiens
aaggcagaaagggatgtgagtg

SEQ ID NO: 8450949 - DNA, 22 bp, Homo sapiens
aaggaacttgccacagaaaaga

SEQ ID NO: 8450950 - DNA, 22 bp, Homo sapiens
aaggaactttgcagaggtgatt

SEQ ID NO: 8450951 - DNA, 22 bp, Homo sapiens
aaggaactttgcagaggtgatt

SEQ ID NO: 8450952 - DNA, 22 bp, Homo sapiens
aaggaacttggtgcccgtgccc

SEQ ID NO: 8450953 - DNA, 22 bp, Homo sapiens
aaggaactgctgatgtggtgac

SEQ ID NO: 8450954 - DNA, 22 bp, Homo sapiens
aaggaactgatgctcaaagaat

SEQ ID NO: 8450955 - DNA, 22 bp, Homo sapiens
aaggaactctagagccttgaac

SEQ ID NO: 8450956 - DNA, 22 bp, Homo sapiens
aaggaactaactatgtagagat

SEQ ID NO: 8450957 - DNA, 22 bp, Homo sapiens
aaggaactaactatgtagagat

SEQ ID NO: 8450958 - DNA, 22 bp, Homo sapiens
aaggaactagcatgatgtgtag

SEQ ID NO: 8450959 - DNA, 22 bp, Homo sapiens
aaggaactaaatagttctggaa

SEQ ID NO: 8450960 - DNA, 20 bp, Homo sapiens
aaggaactcacccatgggct

SEQ ID NO: 8450961 - DNA, 22 bp, Homo sapiens
aaggaactcacagtctgttggg

SEQ ID NO: 8450962 - DNA, 22 bp, Homo sapiens
aaggcagtggttgggtggagga

SEQ ID NO: 8450963 - DNA, 22 bp, Homo sapiens
aaggcatacatattgttatagg

SEQ ID NO: 8450964 - DNA, 22 bp, Homo sapiens
aaggcagttaccgcaatggagg

SEQ ID NO: 8450965 - DNA, 22 bp, Homo sapiens
aaggcagttaatttggctagaa

SEQ ID NO: 8450966 - DNA, 22 bp, Homo sapiens
aaggcagcttcaccacagcatt

SEQ ID NO: 8450967 - DNA, 22 bp, Homo sapiens
aaggcagctcagctcatggcag

SEQ ID NO: 8450968 - DNA, 22 bp, Homo sapiens
acagttctttggatggaagaat

SEQ ID NO: 8450969 - DNA, 22 bp, Homo sapiens
aaggcagccgtgtgactgcatg

SEQ ID NO: 8450970 - DNA, 22 bp, Homo sapiens
aaggcagcctttgtttgattga

SEQ ID NO: 8450971 - DNA, 22 bp, Homo sapiens
agaaaaatcttggcgcttgtct

SEQ ID NO: 8450972 - DNA, 22 bp, Homo sapiens
agaaaaatcttggcgcttgtct

SEQ ID NO: 8450973 - DNA, 22 bp, Homo sapiens
agaaaaatcttggcgcttgtct

SEQ ID NO: 8450974 - DNA, 22 bp, Homo sapiens
agaaaacattacataggtgtgt

SEQ ID NO: 8450975 - DNA, 22 bp, Homo sapiens
agaaaacagaaagtcattggtg

SEQ ID NO: 8450976 - DNA, 22 bp, Homo sapiens
agaaaacataggagacaggaaa

SEQ ID NO: 8450977 - DNA, 22 bp, Homo sapiens
aatgaaactagtagaatctttg

SEQ ID NO: 8450978 - DNA, 22 bp, Homo sapiens
agaaaacattacataggtgtgt

SEQ ID NO: 8450979 - DNA, 22 bp, Homo sapiens
aatgaaactcgaaataatcaca

SEQ ID NO: 8450980 - DNA, 22 bp, Homo sapiens
aatgaaactcgaaataatcaca

SEQ ID NO: 8450981 - DNA, 22 bp, Homo sapiens
aatgaacatggacaagttaata

SEQ ID NO: 8450982 - DNA, 22 bp, Homo sapiens
aatgaacaggtgaatgtcagat

SEQ ID NO: 8450983 - DNA, 22 bp, Homo sapiens
agaaatacaaagtactaagata

SEQ ID NO: 8450984 - DNA, 20 bp, Homo sapiens
aatgagatgacttagaggaa

SEQ ID NO: 8450985 - DNA, 22 bp, Homo sapiens
aatgagatggcaatgacttaaa

SEQ ID NO: 8450986 - DNA, 22 bp, Homo sapiens
aatgagctgctgctgttccacc

SEQ ID NO: 8450987 - DNA, 22 bp, Homo sapiens
agaagggagagaaagttggtta

SEQ ID NO: 8450988 - DNA, 19 bp, Homo sapiens
aatgagttccatgaaaaga

SEQ ID NO: 8450989 - DNA, 20 bp, Homo sapiens
aatgagttattttgtatatg

SEQ ID NO: 8450990 - DNA, 20 bp, Homo sapiens
aatgagtcctgctggatcac

SEQ ID NO: 8450991 - DNA, 22 bp, Homo sapiens
aatgagtcaaaacagcatatag

SEQ ID NO: 8450992 - DNA, 22 bp, Homo sapiens
aatgagtcatgaagattagcaa

SEQ ID NO: 8450993 - DNA, 22 bp, Homo sapiens
aatgagttatttaatagaaagg

SEQ ID NO: 8450994 - DNA, 22 bp, Homo sapiens
aatgagttattaggtgtaagtg

SEQ ID NO: 8450995 - DNA, 19 bp, Homo sapiens
aatgactgagtacattgtc

SEQ ID NO: 8450996 - DNA, 22 bp, Homo sapiens
aatgagaaccttgaaaggaact

SEQ ID NO: 8450997 - DNA, 22 bp, Homo sapiens
aatgacatgctttttaattata

SEQ ID NO: 8450998 - DNA, 22 bp, Homo sapiens
aatacactattttgtgctcagt

SEQ ID NO: 8450999 - DNA, 22 bp, Homo sapiens
acttcttttcaaatcatgcaaa

SEQ ID NO: 8451000 - DNA, 22 bp, Homo sapiens
acttcctggattcccaagggct

SEQ ID NO: 8451001 - DNA, 19 bp, Homo sapiens
acttcttttcaacacagga

SEQ ID NO: 8451002 - DNA, 22 bp, Homo sapiens
acttgaataggaaagccacaaa

SEQ ID NO: 8451003 - DNA, 22 bp, Homo sapiens
acttgaataggtgtcaaggcca

SEQ ID NO: 8451004 - DNA, 22 bp, Homo sapiens
acttgaattaggccttgagaga

SEQ ID NO: 8451005 - DNA, 22 bp, Homo sapiens
acttgaattcaaagcgaaagca

SEQ ID NO: 8451006 - DNA, 22 bp, Homo sapiens
acttgaattatatttctagaga

SEQ ID NO: 8451007 - DNA, 22 bp, Homo sapiens
aatatcacaggaggagaccaag

SEQ ID NO: 8451008 - DNA, 22 bp, Homo sapiens
aatatcaacagtgtccttctaa

SEQ ID NO: 8451009 - DNA, 22 bp, Homo sapiens
aatatatttgaatcaggaacaa

SEQ ID NO: 8451010 - DNA, 22 bp, Homo sapiens
aatatatgtggtattgaccagc

SEQ ID NO: 8451011 - DNA, 22 bp, Homo sapiens
aatatatttgaatcaggaacaa

SEQ ID NO: 8451012 - DNA, 22 bp, Homo sapiens
aatatatagaagtacccgttgt

SEQ ID NO: 8451013 - DNA, 22 bp, Homo sapiens
acttgaatttagtttttcctaa

SEQ ID NO: 8451014 - DNA, 22 bp, Homo sapiens
acttgagagaatcggaggagtc

SEQ ID NO: 8451015 - DNA, 22 bp, Homo sapiens
aatatatgactccactgcatga

SEQ ID NO: 8451016 - DNA, 22 bp, Homo sapiens
aatcaacattgttttaagtcaa

SEQ ID NO: 8451017 - DNA, 22 bp, Homo sapiens
aatcaaagaatgggctagttgg

SEQ ID NO: 8451018 - DNA, 22 bp, Homo sapiens
aatcaaaacctacagaggtaat

SEQ ID NO: 8451019 - DNA, 22 bp, Homo sapiens
aatatttttgaggccctgttat

SEQ ID NO: 8451020 - DNA, 19 bp, Homo sapiens
aatattttagcctcttcct

SEQ ID NO: 8451021 - DNA, 22 bp, Homo sapiens
aatattttaggctttccaggct

SEQ ID NO: 8451022 - DNA, 22 bp, Homo sapiens
acttgtctggcagatcatgcaa

SEQ ID NO: 8451023 - DNA, 22 bp, Homo sapiens
acttgtatggagacttggaacc

SEQ ID NO: 8451024 - DNA, 22 bp, Homo sapiens
aatcaagagctgactatatttt

SEQ ID NO: 8451025 - DNA, 22 bp, Homo sapiens
aatcaagaggcgatggatggaa

SEQ ID NO: 8451026 - DNA, 21 bp, Homo sapiens
aatcaagagtactggtgtggc

SEQ ID NO: 8451027 - DNA, 22 bp, Homo sapiens
aatccatttactctttacaaga

SEQ ID NO: 8451028 - DNA, 20 bp, Homo sapiens
aatccattggtctatatgtc

SEQ ID NO: 8451029 - DNA, 22 bp, Homo sapiens
aatccatttacctttgcttgaa

SEQ ID NO: 8451030 - DNA, 22 bp, Homo sapiens
aatccatttactctttacaaga

SEQ ID NO: 8451031 - DNA, 22 bp, Homo sapiens
aatccattgctgtgctgccagg

SEQ ID NO: 8451032 - DNA, 22 bp, Homo sapiens
aatccattaaaaacaagcgcat

SEQ ID NO: 8451033 - DNA, 22 bp, Homo sapiens
aatccattcagaaattgggaat

SEQ ID NO: 8451034 - DNA, 22 bp, Homo sapiens
aatcctgacctgggcatgcttg

SEQ ID NO: 8451035 - DNA, 22 bp, Homo sapiens
aatcctgaggcaaagagatgag

SEQ ID NO: 8451036 - DNA, 22 bp, Homo sapiens
actttaaaaagagccttctaac

SEQ ID NO: 8451037 - DNA, 22 bp, Homo sapiens
acttgtttggtctcatgtttaa

SEQ ID NO: 8451038 - DNA, 22 bp, Homo sapiens
acttgtttgaatctctctagag

SEQ ID NO: 8451039 - DNA, 22 bp, Homo sapiens
acttgtttcaactgtactctca

SEQ ID NO: 8451040 - DNA, 22 bp, Homo sapiens
acttgtttcaactgtactctcc

SEQ ID NO: 8451041 - DNA, 22 bp, Homo sapiens
aatccagggtgtggcctttcca

SEQ ID NO: 8451042 - DNA, 22 bp, Homo sapiens
aatccatagaataaaattgcag

SEQ ID NO: 8451043 - DNA, 22 bp, Homo sapiens
actaacatttgtgtatgtcttg

SEQ ID NO: 8451044 - DNA, 22 bp, Homo sapiens
actaacttctgagaaccaattg

SEQ ID NO: 8451045 - DNA, 20 bp, Homo sapiens
actaacatttgcaaggggct

SEQ ID NO: 8451046 - DNA, 22 bp, Homo sapiens
aagtggactaatacaaggacta

SEQ ID NO: 8451047 - DNA, 22 bp, Homo sapiens
aagtgctttcatatagtcttaa

SEQ ID NO: 8451048 - DNA, 22 bp, Homo sapiens
aagtgcttggctaatggttatg

SEQ ID NO: 8451049 - DNA, 22 bp, Homo sapiens
aagtgcatagtaatggagtcaa

SEQ ID NO: 8451050 - DNA, 22 bp, Homo sapiens
aagtgcatacactagttaattg

SEQ ID NO: 8451051 - DNA, 22 bp, Homo sapiens
aagtgcataataactcccaagt

SEQ ID NO: 8451052 - DNA, 22 bp, Homo sapiens
aagtcaggacttatgctacctg

SEQ ID NO: 8451053 - DNA, 22 bp, Homo sapiens
aagtcacagaacccattgtaac

SEQ ID NO: 8451054 - DNA, 22 bp, Homo sapiens
aagtcactgtgaaaggtgaagc

SEQ ID NO: 8451055 - DNA, 19 bp, Homo sapiens
aagtcacttgagggcagga

SEQ ID NO: 8451056 - DNA, 20 bp, Homo sapiens
aagtcacttaagatgggcag

SEQ ID NO: 8451057 - DNA, 19 bp, Homo sapiens
aagtcacttgagggcagga

SEQ ID NO: 8451058 - DNA, 22 bp, Homo sapiens
aagtcacttgattgttgacaga

SEQ ID NO: 8451059 - DNA, 20 bp, Homo sapiens
aagtcacttaagatgggcag

SEQ ID NO: 8451060 - DNA, 22 bp, Homo sapiens
aagtcactgaaagggcagaaag

SEQ ID NO: 8451061 - DNA, 22 bp, Homo sapiens
aagtcagaaatatctgccatca

SEQ ID NO: 8451062 - DNA, 22 bp, Homo sapiens
aagtcagaaaacagagcaatta

SEQ ID NO: 8451063 - DNA, 22 bp, Homo sapiens
aagtcagacagctgagctgcct

SEQ ID NO: 8451064 - DNA, 22 bp, Homo sapiens
aagtcagaccttgttgatagct

SEQ ID NO: 8451065 - DNA, 22 bp, Homo sapiens
aagtcagaaattattcaggaat

SEQ ID NO: 8451066 - DNA, 22 bp, Homo sapiens
aagtcagaaatcatctagtgta

SEQ ID NO: 8451067 - DNA, 22 bp, Homo sapiens
aagtcagaataatgtttctttt

SEQ ID NO: 8451068 - DNA, 22 bp, Homo sapiens
aagtcagagcaactgagacatt

SEQ ID NO: 8451069 - DNA, 23 bp, Homo sapiens
aagtcagagccaagtcaatgaga

SEQ ID NO: 8451070 - DNA, 22 bp, Homo sapiens
aagtcagataggtgagtccaaa

SEQ ID NO: 8451071 - DNA, 22 bp, Homo sapiens
aagtcagagatgccaaagatta

SEQ ID NO: 8451072 - DNA, 22 bp, Homo sapiens
aagtcagagatcaaggtgtcta

SEQ ID NO: 8451073 - DNA, 22 bp, Homo sapiens
aagttatatcatctcattgacg

SEQ ID NO: 8451074 - DNA, 22 bp, Homo sapiens
aagttagtggataaacagcaaa

SEQ ID NO: 8451075 - DNA, 23 bp, Homo sapiens
aagttagtttcaataaagcaatt

SEQ ID NO: 8451076 - DNA, 22 bp, Homo sapiens
aagttacattttggtctaattg

SEQ ID NO: 8451077 - DNA, 22 bp, Homo sapiens
aagttacattttggtctaattg

SEQ ID NO: 8451078 - DNA, 22 bp, Homo sapiens
aagttacattttggtctaattg

SEQ ID NO: 8451079 - DNA, 22 bp, Homo sapiens
actaacttgctgagtgaccatg

SEQ ID NO: 8451080 - DNA, 20 bp, Homo sapiens
actaatcatccagtcacagt

SEQ ID NO: 8451081 - DNA, 22 bp, Homo sapiens
actacaatactcttagtaaaag

SEQ ID NO: 8451082 - DNA, 22 bp, Homo sapiens
actccccagactgccatgctgg

SEQ ID NO: 8451083 - DNA, 22 bp, Homo sapiens
actccccagactgccatgctgg

SEQ ID NO: 8451084 - DNA, 18 bp, Homo sapiens
actccccacaggctctgt

SEQ ID NO: 8451085 - DNA, 22 bp, Homo sapiens
actccaggttttttcactgaag

SEQ ID NO: 8451086 - DNA, 22 bp, Homo sapiens
actccaggttttttcactgaag

SEQ ID NO: 8451087 - DNA, 22 bp, Homo sapiens
actccaggttttttcactgaag

SEQ ID NO: 8451088 - DNA, 22 bp, Homo sapiens
actccagttaccttggctgagg

SEQ ID NO: 8451089 - DNA, 22 bp, Homo sapiens
actccagttctcttgtttataa

SEQ ID NO: 8451090 - DNA, 20 bp, Homo sapiens
actccaggtggcatgaggac

SEQ ID NO: 8451091 - DNA, 20 bp, Homo sapiens
actccaggtggcatgaggac

SEQ ID NO: 8451092 - DNA, 22 bp, Homo sapiens
actccaggttttctctcaagtt

SEQ ID NO: 8451093 - DNA, 22 bp, Homo sapiens
actgccttcaaacagcgccacc

SEQ ID NO: 8451094 - DNA, 22 bp, Homo sapiens
actgccttcaaacagcgccacc

SEQ ID NO: 8451095 - DNA, 22 bp, Homo sapiens
actgccttcatgcagacccctg

SEQ ID NO: 8451096 - DNA, 22 bp, Homo sapiens
actgccttccacctatggatga

SEQ ID NO: 8451097 - DNA, 22 bp, Homo sapiens
actgccttataatatgtcaaca

SEQ ID NO: 8451098 - DNA, 22 bp, Homo sapiens
actgccttatatgctgtgtgtg

SEQ ID NO: 8451099 - DNA, 22 bp, Homo sapiens
actgccttctttaatcctagtt

SEQ ID NO: 8451100 - DNA, 22 bp, Homo sapiens
actgccttcttggccttcaaaa

SEQ ID NO: 8451101 - DNA, 22 bp, Homo sapiens
actgccttctgctcagggttca

SEQ ID NO: 8451102 - DNA, 22 bp, Homo sapiens
actgccttgaaagattgttgag

SEQ ID NO: 8451103 - DNA, 22 bp, Homo sapiens
actgccttgattgccagtttcc

SEQ ID NO: 8451104 - DNA, 22 bp, Homo sapiens
actgccttgattcatgctgatg

SEQ ID NO: 8451105 - DNA, 22 bp, Homo sapiens
actgcgctccagcctgggtgac

SEQ ID NO: 8451106 - DNA, 22 bp, Homo sapiens
actgccttttccattacttaat

SEQ ID NO: 8451107 - DNA, 20 bp, Homo sapiens
actgcctttaggtatccttg

SEQ ID NO: 8451108 - DNA, 22 bp, Homo sapiens
actgccttgtctcttgcctgtt

SEQ ID NO: 8451109 - DNA, 20 bp, Homo sapiens
actgccttggttcagtaggt

SEQ ID NO: 8451110 - DNA, 22 bp, Homo sapiens
aataagattgacacaagtacct

SEQ ID NO: 8451111 - DNA, 22 bp, Homo sapiens
aataagattgacacaagtacct

SEQ ID NO: 8451112 - DNA, 22 bp, Homo sapiens
actgcctgtttggcatggcccc

SEQ ID NO: 8451113 - DNA, 22 bp, Homo sapiens
actgccttagaacaaagcagga

SEQ ID NO: 8451114 - DNA, 23 bp, Homo sapiens
actgcctgtgccgatctctctca

SEQ ID NO: 8451115 - DNA, 22 bp, Homo sapiens
aataagatgtgcttgagtttgg

SEQ ID NO: 8451116 - DNA, 22 bp, Homo sapiens
aataagatcttaaaggttatat

SEQ ID NO: 8451117 - DNA, 22 bp, Homo sapiens
aataagatcttaaaggttatat

SEQ ID NO: 8451118 - DNA, 22 bp, Homo sapiens
aataagattactggttgtctga

SEQ ID NO: 8451119 - DNA, 19 bp, Homo sapiens
aataatgttcatgagattg

SEQ ID NO: 8451120 - DNA, 22 bp, Homo sapiens
aataatgttgacgatagtctta

SEQ ID NO: 8451121 - DNA, 22 bp, Homo sapiens
aataattacccatctttttgta

SEQ ID NO: 8451122 - DNA, 22 bp, Homo sapiens
aataattacccatctttttgta

SEQ ID NO: 8451123 - DNA, 22 bp, Homo sapiens
aataattagtgggacagagaac

SEQ ID NO: 8451124 - DNA, 22 bp, Homo sapiens
aataattagtgggacagagaac

SEQ ID NO: 8451125 - DNA, 22 bp, Homo sapiens
aataattatttgagagcagacc

SEQ ID NO: 8451126 - DNA, 22 bp, Homo sapiens
aataattatttgagagcagacc

SEQ ID NO: 8451127 - DNA, 22 bp, Homo sapiens
aataattatttgagagcagacc

SEQ ID NO: 8451128 - DNA, 22 bp, Homo sapiens
aataatttccagccaactggaa

SEQ ID NO: 8451129 - DNA, 22 bp, Homo sapiens
aataattttgagagcctggaaa

SEQ ID NO: 8451130 - DNA, 22 bp, Homo sapiens
aataagatcctgaagatatgtt

SEQ ID NO: 8451131 - DNA, 22 bp, Homo sapiens
aataagactctgctagaaattc

SEQ ID NO: 8451132 - DNA, 22 bp, Homo sapiens
aataagataagatttctgctct

SEQ ID NO: 8451133 - DNA, 22 bp, Homo sapiens
aataagagcactggctttggag

SEQ ID NO: 8451134 - DNA, 22 bp, Homo sapiens
aataagaatttacttgtcaaga

SEQ ID NO: 8451135 - DNA, 22 bp, Homo sapiens
aataacttcagttcttacatta

SEQ ID NO: 8451136 - DNA, 22 bp, Homo sapiens
aataacttaagaaatttcccca

SEQ ID NO: 8451137 - DNA, 22 bp, Homo sapiens
aagtttatgttggtaagatatc

SEQ ID NO: 8451138 - DNA, 22 bp, Homo sapiens
aagtttatgttggtaagatatc

SEQ ID NO: 8451139 - DNA, 22 bp, Homo sapiens
aagtttcaaatataaaattaca

SEQ ID NO: 8451140 - DNA, 22 bp, Homo sapiens
aagtttaaggtggaagtggtgg

SEQ ID NO: 8451141 - DNA, 22 bp, Homo sapiens
aagttggaatctggaactgatc

SEQ ID NO: 8451142 - DNA, 22 bp, Homo sapiens
aagtttatgttctttgaaggca

SEQ ID NO: 8451143 - DNA, 22 bp, Homo sapiens
agagcctgtgggagatgcagct

SEQ ID NO: 8451144 - DNA, 22 bp, Homo sapiens
agagcctgtctgcctttctacc

SEQ ID NO: 8451145 - DNA, 22 bp, Homo sapiens
agagcctgtacttttctgtgaa

SEQ ID NO: 8451146 - DNA, 22 bp, Homo sapiens
agagcctgtaacatctttctta

SEQ ID NO: 8451147 - DNA, 22 bp, Homo sapiens
atgtggttttggattattcatg

SEQ ID NO: 8451148 - DNA, 20 bp, Homo sapiens
atgtggctttttgacctgct

SEQ ID NO: 8451149 - DNA, 22 bp, Homo sapiens
atgtgggagatttcaggaggtg

SEQ ID NO: 8451150 - DNA, 22 bp, Homo sapiens
atgtgggccgtgcgggtgtcct

SEQ ID NO: 8451151 - DNA, 22 bp, Homo sapiens
atgtggggacaaaatgatggcc

SEQ ID NO: 8451152 - DNA, 22 bp, Homo sapiens
atgtgggccgtgcgggtgtcct

SEQ ID NO: 8451153 - DNA, 22 bp, Homo sapiens
agagcctgcagtggagaccttg

SEQ ID NO: 8451154 - DNA, 22 bp, Homo sapiens
agagcctgcagtggagaccttg

SEQ ID NO: 8451155 - DNA, 22 bp, Homo sapiens
atgtcaaacacaacaccagtgg

SEQ ID NO: 8451156 - DNA, 22 bp, Homo sapiens
atgtatttgcgtatggacatac

SEQ ID NO: 8451157 - DNA, 22 bp, Homo sapiens
atgtatttgcgtatggacatac

SEQ ID NO: 8451158 - DNA, 23 bp, Homo sapiens
agagccaagcttctttctcacat

SEQ ID NO: 8451159 - DNA, 22 bp, Homo sapiens
agagccaaggcctcagtctcaa

SEQ ID NO: 8451160 - DNA, 22 bp, Homo sapiens
agagcagcctcagctccctgtg

SEQ ID NO: 8451161 - DNA, 22 bp, Homo sapiens
agagcagcctgtgatgatgcac

SEQ ID NO: 8451162 - DNA, 22 bp, Homo sapiens
agagccaaggctgagagctatt

SEQ ID NO: 8451163 - DNA, 22 bp, Homo sapiens
agagccacagtggataggagcc

SEQ ID NO: 8451164 - DNA, 22 bp, Homo sapiens
agagccacggcaggcctaggaa

SEQ ID NO: 8451165 - DNA, 22 bp, Homo sapiens
agagccactgggagacagagca

SEQ ID NO: 8451166 - DNA, 22 bp, Homo sapiens
agagccagaccattgccgtgca

SEQ ID NO: 8451167 - DNA, 22 bp, Homo sapiens
agagccagagacctgggttcac

SEQ ID NO: 8451168 - DNA, 22 bp, Homo sapiens
agagatgactgatggctgatta

SEQ ID NO: 8451169 - DNA, 22 bp, Homo sapiens
agagatgaagggcattccccag

SEQ ID NO: 8451170 - DNA, 22 bp, Homo sapiens
agagatgctgtgggtagaggca

SEQ ID NO: 8451171 - DNA, 22 bp, Homo sapiens
agagatggatgttattatgggt

SEQ ID NO: 8451172 - DNA, 19 bp, Homo sapiens
agagatgctaagagtcttt

SEQ ID NO: 8451173 - DNA, 22 bp, Homo sapiens
agagatgcggttccatggttat

SEQ ID NO: 8451174 - DNA, 22 bp, Homo sapiens
agagatggccttaggtgggaat

SEQ ID NO: 8451175 - DNA, 22 bp, Homo sapiens
agagatggccttaggtgggaat

SEQ ID NO: 8451176 - DNA, 22 bp, Homo sapiens
atgggggcctgaacaggcaaaa

SEQ ID NO: 8451177 - DNA, 22 bp, Homo sapiens
atgggggcctgaacaggcaaaa

SEQ ID NO: 8451178 - DNA, 22 bp, Homo sapiens
atggggggatgaaggagtccaa

SEQ ID NO: 8451179 - DNA, 22 bp, Homo sapiens
atgggggcggctgaagcccagg

SEQ ID NO: 8451180 - DNA, 22 bp, Homo sapiens
atgggggcggctgaagcccagg

SEQ ID NO: 8451181 - DNA, 22 bp, Homo sapiens
atggggtgcatgcagattggga

SEQ ID NO: 8451182 - DNA, 22 bp, Homo sapiens
atggggtgagactaggattaaa

SEQ ID NO: 8451183 - DNA, 22 bp, Homo sapiens
agagaagagcaatgataaattt

SEQ ID NO: 8451184 - DNA, 18 bp, Homo sapiens
agagaagaggtgttagtc

SEQ ID NO: 8451185 - DNA, 22 bp, Homo sapiens
atggccagctcagagcactcag

SEQ ID NO: 8451186 - DNA, 22 bp, Homo sapiens
atggccagcccttcccgcagct

SEQ ID NO: 8451187 - DNA, 22 bp, Homo sapiens
atggccagcccttcccgcagct

SEQ ID NO: 8451188 - DNA, 22 bp, Homo sapiens
atggcagcctgtggacagtcaa

SEQ ID NO: 8451189 - DNA, 22 bp, Homo sapiens
atggccagcaagttcagaattt

SEQ ID NO: 8451190 - DNA, 22 bp, Homo sapiens
agacccagagggctgctgggag

SEQ ID NO: 8451191 - DNA, 22 bp, Homo sapiens
agacccagaaagcagctgcatt

SEQ ID NO: 8451192 - DNA, 22 bp, Homo sapiens
agaccaggaaggcctacagata

SEQ ID NO: 8451193 - DNA, 22 bp, Homo sapiens
agaccacttggataagaaacag

SEQ ID NO: 8451194 - DNA, 18 bp, Homo sapiens
agaccagacaagaatggt

SEQ ID NO: 8451195 - DNA, 22 bp, Homo sapiens
agaccagggtcccacagagtct

SEQ ID NO: 8451196 - DNA, 22 bp, Homo sapiens
agaccagggtcccacagagtct

SEQ ID NO: 8451197 - DNA, 22 bp, Homo sapiens
agacccacactttgagtagcaa

SEQ ID NO: 8451198 - DNA, 22 bp, Homo sapiens
agacattttacattcttccatt

SEQ ID NO: 8451199 - DNA, 22 bp, Homo sapiens
agacattttgcattccctgaag

SEQ ID NO: 8451200 - DNA, 22 bp, Homo sapiens
agaccactaaaactttctctat

SEQ ID NO: 8451201 - DNA, 22 bp, Homo sapiens
agagaagagtcttgtcaaatta

SEQ ID NO: 8451202 - DNA, 22 bp, Homo sapiens
agagaagcagggagtcatctgt

SEQ ID NO: 8451203 - DNA, 21 bp, Homo sapiens
agagacagagaaagtaacatt

SEQ ID NO: 8451204 - DNA, 22 bp, Homo sapiens
agagaaggaaagctgacatggg

SEQ ID NO: 8451205 - DNA, 22 bp, Homo sapiens
agagaaggaaagctgacatggg

SEQ ID NO: 8451206 - DNA, 22 bp, Homo sapiens
agagacagaggcaatatagctt

SEQ ID NO: 8451207 - DNA, 22 bp, Homo sapiens
agagacagggttttgtcgtgtt

SEQ ID NO: 8451208 - DNA, 22 bp, Homo sapiens
agagacagggttttgtcgtgtt

SEQ ID NO: 8451209 - DNA, 22 bp, Homo sapiens
agagacagggttttgtcgtgtt

SEQ ID NO: 8451210 - DNA, 19 bp, Homo sapiens
agagaccacagagctgcct

SEQ ID NO: 8451211 - DNA, 19 bp, Homo sapiens
agagaccacagagctgcct

SEQ ID NO: 8451212 - DNA, 22 bp, Homo sapiens
atggccgcctgtccttcccgcc

SEQ ID NO: 8451213 - DNA, 22 bp, Homo sapiens
atggcctctagctgagaccaat

SEQ ID NO: 8451214 - DNA, 22 bp, Homo sapiens
agagacctttgttattctagga

SEQ ID NO: 8451215 - DNA, 22 bp, Homo sapiens
agagacctgaagagcttcctca

SEQ ID NO: 8451216 - DNA, 22 bp, Homo sapiens
atggcctggggattcctgagca

SEQ ID NO: 8451217 - DNA, 22 bp, Homo sapiens
atggcctggccagagctctgct

SEQ ID NO: 8451218 - DNA, 22 bp, Homo sapiens
atggctattttagagatcaagg

SEQ ID NO: 8451219 - DNA, 22 bp, Homo sapiens
agagagttgtaccacactcata

SEQ ID NO: 8451220 - DNA, 22 bp, Homo sapiens
agagagttgaggaagcaacact

SEQ ID NO: 8451221 - DNA, 22 bp, Homo sapiens
atgaaattgatcttgaactttt

SEQ ID NO: 8451222 - DNA, 22 bp, Homo sapiens
atgaaagatgatttaaagtact

SEQ ID NO: 8451223 - DNA, 22 bp, Homo sapiens
atgaaagatgatttaaagtact

SEQ ID NO: 8451224 - DNA, 22 bp, Homo sapiens
atgaaagatgatttaaagtact

SEQ ID NO: 8451225 - DNA, 22 bp, Homo sapiens
atgaaagcaagaagtgagttga

SEQ ID NO: 8451226 - DNA, 22 bp, Homo sapiens
atgaaagtacctgtaatatgtt

SEQ ID NO: 8451227 - DNA, 22 bp, Homo sapiens
agaattcttggtggttagaata

SEQ ID NO: 8451228 - DNA, 22 bp, Homo sapiens
atgaacaataatcatgtctatg

SEQ ID NO: 8451229 - DNA, 18 bp, Homo sapiens
agacaaacttcttctgcc

SEQ ID NO: 8451230 - DNA, 22 bp, Homo sapiens
agacaaaccttgttttatgatg

SEQ ID NO: 8451231 - DNA, 23 bp, Homo sapiens
agacaaacttccttcactgcacc

SEQ ID NO: 8451232 - DNA, 22 bp, Homo sapiens
agacaaatggagtatgagcaac

SEQ ID NO: 8451233 - DNA, 22 bp, Homo sapiens
agacaaatggtaattatgtcta

SEQ ID NO: 8451234 - DNA, 22 bp, Homo sapiens
agacaaataactttttatgtcc

SEQ ID NO: 8451235 - DNA, 22 bp, Homo sapiens
agacaaatgaacaaatatgtga

SEQ ID NO: 8451236 - DNA, 22 bp, Homo sapiens
agaagttaccacatacttctct

SEQ ID NO: 8451237 - DNA, 22 bp, Homo sapiens
agaagttaattcctgaaattct

SEQ ID NO: 8451238 - DNA, 22 bp, Homo sapiens
agaagtggtctgtcttccagat

SEQ ID NO: 8451239 - DNA, 22 bp, Homo sapiens
agaagtggtctgtcttccagat

SEQ ID NO: 8451240 - DNA, 22 bp, Homo sapiens
agaagttatccaccttagatgc

SEQ ID NO: 8451241 - DNA, 19 bp, Homo sapiens
agaagttagacattgcaat

SEQ ID NO: 8451242 - DNA, 22 bp, Homo sapiens
agaagtttggtcctataaactc

SEQ ID NO: 8451243 - DNA, 22 bp, Homo sapiens
atctttgtgctaatgtagttct

SEQ ID NO: 8451244 - DNA, 23 bp, Homo sapiens
atgaaactcaagccagatccaag

SEQ ID NO: 8451245 - DNA, 22 bp, Homo sapiens
atgaaacatgctttgtggatga

SEQ ID NO: 8451246 - DNA, 22 bp, Homo sapiens
atgaaactctaacttaacaagt

SEQ ID NO: 8451247 - DNA, 22 bp, Homo sapiens
atgaaactgaaggacaaccaga

SEQ ID NO: 8451248 - DNA, 22 bp, Homo sapiens
atctcagatctacagatctaca

SEQ ID NO: 8451249 - DNA, 22 bp, Homo sapiens
atctcagatctacagatctaca

SEQ ID NO: 8451250 - DNA, 22 bp, Homo sapiens
atctcagagaaatttgaatgca

SEQ ID NO: 8451251 - DNA, 22 bp, Homo sapiens
atctcagacatgttgtccatga

SEQ ID NO: 8451252 - DNA, 22 bp, Homo sapiens
atctcagagaaatttgaatgca

SEQ ID NO: 8451253 - DNA, 22 bp, Homo sapiens
atctcagaaacatatctaatcc

SEQ ID NO: 8451254 - DNA, 22 bp, Homo sapiens
atctcagaaggcatttccaaga

SEQ ID NO: 8451255 - DNA, 22 bp, Homo sapiens
atctcagaaggcatttccaaga

SEQ ID NO: 8451256 - DNA, 22 bp, Homo sapiens
atctcagaaagtttaatttttc

SEQ ID NO: 8451257 - DNA, 22 bp, Homo sapiens
atctcagaaacatatctaatcc

SEQ ID NO: 8451258 - DNA, 22 bp, Homo sapiens
agaaggctggccctgggtggcc

SEQ ID NO: 8451259 - DNA, 22 bp, Homo sapiens
agaaggcttaaaacatggaata

SEQ ID NO: 8451260 - DNA, 22 bp, Homo sapiens
agaagtattctgcatgtactga

SEQ ID NO: 8451261 - DNA, 22 bp, Homo sapiens
agaagtattctgcatgtactga

SEQ ID NO: 8451262 - DNA, 22 bp, Homo sapiens
agaaggctttaagtactggcat

SEQ ID NO: 8451263 - DNA, 22 bp, Homo sapiens
agaagtatttggctaaaagaca

SEQ ID NO: 8451264 - DNA, 23 bp, Homo sapiens
agaagtggaatggccgtggggtc

SEQ ID NO: 8451265 - DNA, 22 bp, Homo sapiens
agaagtcaatgatgagagtgct

SEQ ID NO: 8451266 - DNA, 22 bp, Homo sapiens
agaagtcagccacagtgggaga

SEQ ID NO: 8451267 - DNA, 22 bp, Homo sapiens
agaagtcagccacagtgggaga

SEQ ID NO: 8451268 - DNA, 20 bp, Homo sapiens
agaagtcagctcagaagtga

SEQ ID NO: 8451269 - DNA, 20 bp, Homo sapiens
agaagtcagctcagaagtga

SEQ ID NO: 8451270 - DNA, 22 bp, Homo sapiens
agaagtctggaattcctgcagg

SEQ ID NO: 8451271 - DNA, 22 bp, Homo sapiens
agaagtctggaattcctgcagg

SEQ ID NO: 8451272 - DNA, 22 bp, Homo sapiens
atgacaaattcagaccatagca

SEQ ID NO: 8451273 - DNA, 22 bp, Homo sapiens
atgacaagagtgttcagggaga

SEQ ID NO: 8451274 - DNA, 22 bp, Homo sapiens
atgacaacctgtgagctggtat

SEQ ID NO: 8451275 - DNA, 22 bp, Homo sapiens
atgacaaattcagaccatagca

SEQ ID NO: 8451276 - DNA, 22 bp, Homo sapiens
atgacaagggagggtcctgcta

SEQ ID NO: 8451277 - DNA, 22 bp, Homo sapiens
atgacaagggttgacacatgtc

SEQ ID NO: 8451278 - DNA, 22 bp, Homo sapiens
atgacaagggagggtcctgcta

SEQ ID NO: 8451279 - DNA, 22 bp, Homo sapiens
atgcaacatccaattccttttg

SEQ ID NO: 8451280 - DNA, 22 bp, Homo sapiens
atgcaacatacattctgaagct

SEQ ID NO: 8451281 - DNA, 22 bp, Homo sapiens
atgcaacatacattctgaagct

SEQ ID NO: 8451282 - DNA, 22 bp, Homo sapiens
atgacaagggttgacacatgtc

SEQ ID NO: 8451283 - DNA, 23 bp, Homo sapiens
atgcaacattgccagtatgggca

SEQ ID NO: 8451284 - DNA, 23 bp, Homo sapiens
atgcaacattgccagtatgggca

SEQ ID NO: 8451285 - DNA, 22 bp, Homo sapiens
atgcaacatccaattccttttg

SEQ ID NO: 8451286 - DNA, 20 bp, Homo sapiens
atgcaccctcagggtccctg

SEQ ID NO: 8451287 - DNA, 22 bp, Homo sapiens
atgcacccttatgaatatgatc

SEQ ID NO: 8451288 - DNA, 22 bp, Homo sapiens
atgcacctgaactccatcagct

SEQ ID NO: 8451289 - DNA, 22 bp, Homo sapiens
atgcacatgtatctatatacaa

SEQ ID NO: 8451290 - DNA, 22 bp, Homo sapiens
atgcaccacatcacttctgctc

SEQ ID NO: 8451291 - DNA, 22 bp, Homo sapiens
atgcacccagtgtctggactat

SEQ ID NO: 8451292 - DNA, 22 bp, Homo sapiens
atgcacccatgtacatacacat

SEQ ID NO: 8451293 - DNA, 22 bp, Homo sapiens
atgcaccccagaagctgcagtg

SEQ ID NO: 8451294 - DNA, 21 bp, Homo sapiens
agacagactgcctgacccacg

SEQ ID NO: 8451295 - DNA, 20 bp, Homo sapiens
agacaggagcccccattcag

SEQ ID NO: 8451296 - DNA, 22 bp, Homo sapiens
agacaggatgcatactcttggt

SEQ ID NO: 8451297 - DNA, 22 bp, Homo sapiens
agacaggcagaggctgcagagg

SEQ ID NO: 8451298 - DNA, 22 bp, Homo sapiens
agacaggcagaggctgcagagg

SEQ ID NO: 8451299 - DNA, 22 bp, Homo sapiens
agacagctgggagtgtccttct

SEQ ID NO: 8451300 - DNA, 22 bp, Homo sapiens
agacagctggtagcacttcctg

SEQ ID NO: 8451301 - DNA, 22 bp, Homo sapiens
agacagctgctcgcagagctat

SEQ ID NO: 8451302 - DNA, 23 bp, Homo sapiens
agacagcttagagtttgcctctc

SEQ ID NO: 8451303 - DNA, 22 bp, Homo sapiens
agacagctgttccttcatgttt

SEQ ID NO: 8451304 - DNA, 21 bp, Homo sapiens
agacagcagatagtcgaaagg

SEQ ID NO: 8451305 - DNA, 22 bp, Homo sapiens
agacagcagaaactagagcact

SEQ ID NO: 8451306 - DNA, 22 bp, Homo sapiens
agacagactgtgtttgaatcct

SEQ ID NO: 8451307 - DNA, 22 bp, Homo sapiens
agacagcatgagcctgctgatg

SEQ ID NO: 8451308 - DNA, 22 bp, Homo sapiens
agacagctagggctgcagggac

SEQ ID NO: 8451309 - DNA, 22 bp, Homo sapiens
agacagctccaagtgtctctgt

SEQ ID NO: 8451310 - DNA, 18 bp, Homo sapiens
agacagctgaaaggaaaa

SEQ ID NO: 8451311 - DNA, 22 bp, Homo sapiens
agacagctctgggttccacact

SEQ ID NO: 8451312 - DNA, 22 bp, Homo sapiens
atttggctaccatgaggatggg

SEQ ID NO: 8451313 - DNA, 22 bp, Homo sapiens
atttggctgtagtaactggatc

SEQ ID NO: 8451314 - DNA, 22 bp, Homo sapiens
atttgtgataatttgttacagc

SEQ ID NO: 8451315 - DNA, 22 bp, Homo sapiens
caaaagtaccttgtgtgctttg

SEQ ID NO: 8451316 - DNA, 22 bp, Homo sapiens
caaaagtaattgtggtttttgc

SEQ ID NO: 8451317 - DNA, 22 bp, Homo sapiens
caaaagtaattgcagtttttgc

SEQ ID NO: 8451318 - DNA, 22 bp, Homo sapiens
caaaagtaattgcggtttttgc

SEQ ID NO: 8451319 - DNA, 22 bp, Homo sapiens
caaaaggcaggggaaagagtgc

SEQ ID NO: 8451320 - DNA, 22 bp, Homo sapiens
caaaaggccagtactttgtttg

SEQ ID NO: 8451321 - DNA, 22 bp, Homo sapiens
caaaagtaatgtatgctcatcg

SEQ ID NO: 8451322 - DNA, 22 bp, Homo sapiens
caaaagtaatgtatgctcatcg

SEQ ID NO: 8451323 - DNA, 22 bp, Homo sapiens
caaaagtaattatggtttttgc

SEQ ID NO: 8451324 - DNA, 22 bp, Homo sapiens
caaaagtaatggcggtttttac

SEQ ID NO: 8451325 - DNA, 21 bp, Homo sapiens
caaaaggataggaaattaggg

SEQ ID NO: 8451326 - DNA, 22 bp, Homo sapiens
caaaagcagttctatctgagtt

SEQ ID NO: 8451327 - DNA, 21 bp, Homo sapiens
caaaaggataggaaattaggg

SEQ ID NO: 8451328 - DNA, 21 bp, Homo sapiens
caaaaggataggaaattaggg

SEQ ID NO: 8451329 - DNA, 22 bp, Homo sapiens
caaaaaacacagatgtctgtgt

SEQ ID NO: 8451330 - DNA, 22 bp, Homo sapiens
caaaaaacacagatgtctgtgt

SEQ ID NO: 8451331 - DNA, 22 bp, Homo sapiens
atttgtttcagggccttggtat

SEQ ID NO: 8451332 - DNA, 22 bp, Homo sapiens
atttctcattaagatcttccaa

SEQ ID NO: 8451333 - DNA, 22 bp, Homo sapiens
atttctcatgtacaaaaacact

SEQ ID NO: 8451334 - DNA, 22 bp, Homo sapiens
atttccttcagtgtttaatact

SEQ ID NO: 8451335 - DNA, 22 bp, Homo sapiens
atttctctcattgttagctagg

SEQ ID NO: 8451336 - DNA, 22 bp, Homo sapiens
atttctctcattgttagctagg

SEQ ID NO: 8451337 - DNA, 22 bp, Homo sapiens
atttctcattttgcttcaaagg

SEQ ID NO: 8451338 - DNA, 22 bp, Homo sapiens
atttgctttcccttccctgaca

SEQ ID NO: 8451339 - DNA, 22 bp, Homo sapiens
atttcctgtgtctctatttatg

SEQ ID NO: 8451340 - DNA, 22 bp, Homo sapiens
atttcctatttcttgtccccta

SEQ ID NO: 8451341 - DNA, 17 bp, Homo sapiens
atttcctcagggctgag

SEQ ID NO: 8451342 - DNA, 22 bp, Homo sapiens
atttcctgatctgtaaaatagc

SEQ ID NO: 8451343 - DNA, 17 bp, Homo sapiens
atttcctgcaagcccct

SEQ ID NO: 8451344 - DNA, 22 bp, Homo sapiens
agataggagccaggacttaaca

SEQ ID NO: 8451345 - DNA, 22 bp, Homo sapiens
atttcctatacagttgtccata

SEQ ID NO: 8451346 - DNA, 22 bp, Homo sapiens
atttcctatggatacaggcaga

SEQ ID NO: 8451347 - DNA, 22 bp, Homo sapiens
atttcctatcctggtcttaaaa

SEQ ID NO: 8451348 - DNA, 22 bp, Homo sapiens
atttcctatagatatggtgagt

SEQ ID NO: 8451349 - DNA, 22 bp, Homo sapiens
atttcctaggtgctcgagtgct

SEQ ID NO: 8451350 - DNA, 22 bp, Homo sapiens
atttccagcagcatatttgtct

SEQ ID NO: 8451351 - DNA, 21 bp, Homo sapiens
atttcacaccctcctttttct

SEQ ID NO: 8451352 - DNA, 22 bp, Homo sapiens
atttcacaaagaacagatgcag

SEQ ID NO: 8451353 - DNA, 22 bp, Homo sapiens
atttcacagctgctgttcaggt

SEQ ID NO: 8451354 - DNA, 22 bp, Homo sapiens
agataaacccaacttaatgaag

SEQ ID NO: 8451355 - DNA, 23 bp, Homo sapiens
agagtttgtttctaatgagtgag

SEQ ID NO: 8451356 - DNA, 23 bp, Homo sapiens
agagtttgtttctaatgagtgag

SEQ ID NO: 8451357 - DNA, 22 bp, Homo sapiens
agataaaatgattttctggatc

SEQ ID NO: 8451358 - DNA, 23 bp, Homo sapiens
agagttttctgttttctgtaggg

SEQ ID NO: 8451359 - DNA, 23 bp, Homo sapiens
agagttttctgttttctgtaggg

SEQ ID NO: 8451360 - DNA, 22 bp, Homo sapiens
agagtttgaattttgaaaagat

SEQ ID NO: 8451361 - DNA, 22 bp, Homo sapiens
agagtttggagagggtgaggca

SEQ ID NO: 8451362 - DNA, 22 bp, Homo sapiens
agagtttggaggtgttcctgga

SEQ ID NO: 8451363 - DNA, 22 bp, Homo sapiens
agagtttggagagggtgaggca

SEQ ID NO: 8451364 - DNA, 22 bp, Homo sapiens
agagtttggaggtgttcctgga

SEQ ID NO: 8451365 - DNA, 22 bp, Homo sapiens
agagtttgggtgggacagcttg

SEQ ID NO: 8451366 - DNA, 22 bp, Homo sapiens
agagtttggtgaagcaatttga

SEQ ID NO: 8451367 - DNA, 22 bp, Homo sapiens
agagtttgtatttttcagtgaa

SEQ ID NO: 8451368 - DNA, 22 bp, Homo sapiens
agagtttgtactttaccctgag

SEQ ID NO: 8451369 - DNA, 22 bp, Homo sapiens
agagtttgtagtggtgaatgta

SEQ ID NO: 8451370 - DNA, 22 bp, Homo sapiens
agagtttgtatttttcagtgaa

SEQ ID NO: 8451371 - DNA, 22 bp, Homo sapiens
atttcacatctatctcagattt

SEQ ID NO: 8451372 - DNA, 22 bp, Homo sapiens
atttcacagctgtcagtgttac

SEQ ID NO: 8451373 - DNA, 22 bp, Homo sapiens
atttcacagctgtcagtgttac

SEQ ID NO: 8451374 - DNA, 17 bp, Homo sapiens
atttcacttagcatgag

SEQ ID NO: 8451375 - DNA, 22 bp, Homo sapiens
agatacattagtagttacttgt

SEQ ID NO: 8451376 - DNA, 17 bp, Homo sapiens
atttcacttagcatgag

SEQ ID NO: 8451377 - DNA, 22 bp, Homo sapiens
agatacagtgttacatttttat

SEQ ID NO: 8451378 - DNA, 22 bp, Homo sapiens
agaggtcagaggtcgccaggtc

SEQ ID NO: 8451379 - DNA, 22 bp, Homo sapiens
agaggtcagaggtcgccaggtc

SEQ ID NO: 8451380 - DNA, 23 bp, Homo sapiens
attgccagacggcccctgctcgc

SEQ ID NO: 8451381 - DNA, 22 bp, Homo sapiens
agaggtgaaagaatttggctct

SEQ ID NO: 8451382 - DNA, 22 bp, Homo sapiens
agagttgctatagaaggatgga

SEQ ID NO: 8451383 - DNA, 22 bp, Homo sapiens
agagttgctaccaagatgctag

SEQ ID NO: 8451384 - DNA, 22 bp, Homo sapiens
agagttggcccacgtgtaggcg

SEQ ID NO: 8451385 - DNA, 22 bp, Homo sapiens
agagttgttgtacaaactaaat

SEQ ID NO: 8451386 - DNA, 22 bp, Homo sapiens
agagtttcttgtgagcactgac

SEQ ID NO: 8451387 - DNA, 22 bp, Homo sapiens
agagtttacagaaataagctgt

SEQ ID NO: 8451388 - DNA, 22 bp, Homo sapiens
attgataaattgcaatggggct

SEQ ID NO: 8451389 - DNA, 22 bp, Homo sapiens
attgcagctcagggtgatgact

SEQ ID NO: 8451390 - DNA, 19 bp, Homo sapiens
attgcagctatagactgcc

SEQ ID NO: 8451391 - DNA, 22 bp, Homo sapiens
attccattgtatgtgtagacta

SEQ ID NO: 8451392 - DNA, 22 bp, Homo sapiens
attccagttagtggcagcttat

SEQ ID NO: 8451393 - DNA, 22 bp, Homo sapiens
agagggaatgtgattgcaccat

SEQ ID NO: 8451394 - DNA, 23 bp, Homo sapiens
attccagagctagagtcaagtgg

SEQ ID NO: 8451395 - DNA, 22 bp, Homo sapiens
attccagatggcttcaagtaag

SEQ ID NO: 8451396 - DNA, 18 bp, Homo sapiens
agagggaaagcaggctga

SEQ ID NO: 8451397 - DNA, 22 bp, Homo sapiens
agagggaaatccaggagtgctt

SEQ ID NO: 8451398 - DNA, 22 bp, Homo sapiens
agagggaaaaactcatgtcatt

SEQ ID NO: 8451399 - DNA, 22 bp, Homo sapiens
agaggctgtctcatattttgta

SEQ ID NO: 8451400 - DNA, 22 bp, Homo sapiens
agaggcctttctgttgagtgaa

SEQ ID NO: 8451401 - DNA, 22 bp, Homo sapiens
agaggcggagcttgcagtgagc

SEQ ID NO: 8451402 - DNA, 22 bp, Homo sapiens
agaggcggaggttgcagtgagc

SEQ ID NO: 8451403 - DNA, 22 bp, Homo sapiens
agaggctccgtcatccctcttt

SEQ ID NO: 8451404 - DNA, 22 bp, Homo sapiens
attcattagccactaactagca

SEQ ID NO: 8451405 - DNA, 22 bp, Homo sapiens
attcatgttcggggccacgttg

SEQ ID NO: 8451406 - DNA, 22 bp, Homo sapiens
attcatgtgccactggtgaaca

SEQ ID NO: 8451407 - DNA, 22 bp, Homo sapiens
attcatgttagcccacatgtag

SEQ ID NO: 8451408 - DNA, 22 bp, Homo sapiens
attcatgtaaaattggatagac

SEQ ID NO: 8451409 - DNA, 22 bp, Homo sapiens
attcatgtagtgattgagtcac

SEQ ID NO: 8451410 - DNA, 22 bp, Homo sapiens
attcagtaggtctagaataaga

SEQ ID NO: 8451411 - DNA, 22 bp, Homo sapiens
attcagtaggtgtgaacttatt

SEQ ID NO: 8451412 - DNA, 22 bp, Homo sapiens
agaggcaggaggttgacttgag

SEQ ID NO: 8451413 - DNA, 17 bp, Homo sapiens
agaggcagatacttgga

SEQ ID NO: 8451414 - DNA, 17 bp, Homo sapiens
agaggcagatacttgga

SEQ ID NO: 8451415 - DNA, 21 bp, Homo sapiens
attattataaagaccacaggg

SEQ ID NO: 8451416 - DNA, 22 bp, Homo sapiens
agaggaggctgggtccagataa

SEQ ID NO: 8451417 - DNA, 22 bp, Homo sapiens
attattaaagcttaggtcttat

SEQ ID NO: 8451418 - DNA, 22 bp, Homo sapiens
agaggcagaagtgttcaaaccc

SEQ ID NO: 8451419 - DNA, 22 bp, Homo sapiens
agaggcagaagtgttcaaaccc

SEQ ID NO: 8451420 - DNA, 22 bp, Homo sapiens
agaggcactgttcttagcgact

SEQ ID NO: 8451421 - DNA, 22 bp, Homo sapiens
attattcaacacttgagaaatt

SEQ ID NO: 8451422 - DNA, 22 bp, Homo sapiens
attattcaaattcccactatac

SEQ ID NO: 8451423 - DNA, 22 bp, Homo sapiens
attattattgttgatgttaggg

SEQ ID NO: 8451424 - DNA, 22 bp, Homo sapiens
agaggaggcagcttaactcagt

SEQ ID NO: 8451425 - DNA, 22 bp, Homo sapiens
agaggacaggttttccatgggc

SEQ ID NO: 8451426 - DNA, 22 bp, Homo sapiens
agaggacaggttttccatgggc

SEQ ID NO: 8451427 - DNA, 22 bp, Homo sapiens
agaggagctgggaggccctcgt

SEQ ID NO: 8451428 - DNA, 20 bp, Homo sapiens
agaggaggattattttattc

SEQ ID NO: 8451429 - DNA, 22 bp, Homo sapiens
atgtgtacactggacttctgat

SEQ ID NO: 8451430 - DNA, 21 bp, Homo sapiens
agagctgggacttgcctgaga

SEQ ID NO: 8451431 - DNA, 22 bp, Homo sapiens
agagctggtttactcaggaatt

SEQ ID NO: 8451432 - DNA, 22 bp, Homo sapiens
agagctgtcacatagagccaga

SEQ ID NO: 8451433 - DNA, 22 bp, Homo sapiens
agagctgttcaacgtagcaatg

SEQ ID NO: 8451434 - DNA, 22 bp, Homo sapiens
agagctgtgttaagaacaggcc

SEQ ID NO: 8451435 - DNA, 22 bp, Homo sapiens
atgtttactggtttatagaata

SEQ ID NO: 8451436 - DNA, 22 bp, Homo sapiens
atgtttactgaaaagatttcaa

SEQ ID NO: 8451437 - DNA, 22 bp, Homo sapiens
atgtttatgcaaacatgtgagt

SEQ ID NO: 8451438 - DNA, 22 bp, Homo sapiens
atgtttacaattcagtattaca

SEQ ID NO: 8451439 - DNA, 22 bp, Homo sapiens
atgtttacaattcagtattaca

SEQ ID NO: 8451440 - DNA, 22 bp, Homo sapiens
atgtttacagaggaagtgcctc

SEQ ID NO: 8451441 - DNA, 21 bp, Homo sapiens
atgtttacactgactactgtg

SEQ ID NO: 8451442 - DNA, 22 bp, Homo sapiens
atgtttacaaaaaggaggcttg

SEQ ID NO: 8451443 - DNA, 19 bp, Homo sapiens
atgtttacactcaggggct

SEQ ID NO: 8451444 - DNA, 22 bp, Homo sapiens
agaggacacatctttcctcaaa

SEQ ID NO: 8451445 - DNA, 22 bp, Homo sapiens
atgtttatggagcaggtattag

SEQ ID NO: 8451446 - DNA, 22 bp, Homo sapiens
agaggaagccattgcttactga

SEQ ID NO: 8451447 - DNA, 22 bp, Homo sapiens
agaggaagctgagatgcctctt

SEQ ID NO: 8451448 - DNA, 22 bp, Homo sapiens
agcatacagttgaaagtggctt

SEQ ID NO: 8451449 - DNA, 20 bp, Homo sapiens
agcatacatcataagaaacc

SEQ ID NO: 8451450 - DNA, 22 bp, Homo sapiens
agcataattcctgacacacaag

SEQ ID NO: 8451451 - DNA, 22 bp, Homo sapiens
cactgctcgctgcagcatggcc

SEQ ID NO: 8451452 - DNA, 22 bp, Homo sapiens
cactgctcgctgcagcatggcc

SEQ ID NO: 8451453 - DNA, 22 bp, Homo sapiens
cacccaggctggagtgcattgg

SEQ ID NO: 8451454 - DNA, 22 bp, Homo sapiens
cacctagcattcctcttcctca

SEQ ID NO: 8451455 - DNA, 22 bp, Homo sapiens
cacctagcatgaaattcagcag

SEQ ID NO: 8451456 - DNA, 22 bp, Homo sapiens
cacctactttgtgcagatttta

SEQ ID NO: 8451457 - DNA, 19 bp, Homo sapiens
cacctacttttggatttgc

SEQ ID NO: 8451458 - DNA, 22 bp, Homo sapiens
cacctcatgtcatcagtaaaat

SEQ ID NO: 8451459 - DNA, 22 bp, Homo sapiens
cacctcatggataagataaact

SEQ ID NO: 8451460 - DNA, 22 bp, Homo sapiens
cacctctttgatttgaggcaag

SEQ ID NO: 8451461 - DNA, 22 bp, Homo sapiens
cacctgaagatttagagattga

SEQ ID NO: 8451462 - DNA, 22 bp, Homo sapiens
cacccaggctggagagcagtgg

SEQ ID NO: 8451463 - DNA, 22 bp, Homo sapiens
agcagggtcctgaggtgagtca

SEQ ID NO: 8451464 - DNA, 22 bp, Homo sapiens
agcaggggtggaaggtagcttt

SEQ ID NO: 8451465 - DNA, 22 bp, Homo sapiens
agcaggggtggaaggtagcttt

SEQ ID NO: 8451466 - DNA, 22 bp, Homo sapiens
agcaggggtctctgctaatgaa

SEQ ID NO: 8451467 - DNA, 22 bp, Homo sapiens
agcagggctggggcacgagcca

SEQ ID NO: 8451468 - DNA, 23 bp, Homo sapiens
agcaggctgcttctccacagctg

SEQ ID NO: 8451469 - DNA, 22 bp, Homo sapiens
agcaggctgccttccaaagcct

SEQ ID NO: 8451470 - DNA, 22 bp, Homo sapiens
agcaggggctcctccacagcca

SEQ ID NO: 8451471 - DNA, 22 bp, Homo sapiens
agcaggggcagggttttgtgct

SEQ ID NO: 8451472 - DNA, 22 bp, Homo sapiens
agcagggggcatccttgccctt

SEQ ID NO: 8451473 - DNA, 22 bp, Homo sapiens
agcagggggagttagactagat

SEQ ID NO: 8451474 - DNA, 22 bp, Homo sapiens
agcaggggtaacagaaggaaag

SEQ ID NO: 8451475 - DNA, 22 bp, Homo sapiens
agcagggggccacagtcacagc

SEQ ID NO: 8451476 - DNA, 22 bp, Homo sapiens
agcagctgatggggaaggagtt

SEQ ID NO: 8451477 - DNA, 22 bp, Homo sapiens
agcagctgatggggaaggagtt

SEQ ID NO: 8451478 - DNA, 22 bp, Homo sapiens
agcagctgatggggaaggagtt

SEQ ID NO: 8451479 - DNA, 22 bp, Homo sapiens
agcagctgcagggagggtctgc

SEQ ID NO: 8451480 - DNA, 22 bp, Homo sapiens
agcagctgcagggagggtctgc

SEQ ID NO: 8451481 - DNA, 22 bp, Homo sapiens
cacacaaatattctggaggcaa

SEQ ID NO: 8451482 - DNA, 22 bp, Homo sapiens
agcagctgccagagagagttcc

SEQ ID NO: 8451483 - DNA, 22 bp, Homo sapiens
agcagctgccactggaatagga

SEQ ID NO: 8451484 - DNA, 22 bp, Homo sapiens
agcagctgccactggaatagga

SEQ ID NO: 8451485 - DNA, 22 bp, Homo sapiens
cacacacagttttgtattctgt

SEQ ID NO: 8451486 - DNA, 22 bp, Homo sapiens
cacacacagttttgtattctgt

SEQ ID NO: 8451487 - DNA, 22 bp, Homo sapiens
cacacaccaatcaaatgtcaga

SEQ ID NO: 8451488 - DNA, 22 bp, Homo sapiens
agcaggagcccttatcaccagg

SEQ ID NO: 8451489 - DNA, 22 bp, Homo sapiens
agcaggcacaagaaagggaggt

SEQ ID NO: 8451490 - DNA, 22 bp, Homo sapiens
agcaggcacaagaaagggaggt

SEQ ID NO: 8451491 - DNA, 22 bp, Homo sapiens
agcaggcaccagggctcgtcct

SEQ ID NO: 8451492 - DNA, 22 bp, Homo sapiens
agcaggcacgctccctgcgcga

SEQ ID NO: 8451493 - DNA, 17 bp, Homo sapiens
agcaggcacgtcagcac

SEQ ID NO: 8451494 - DNA, 22 bp, Homo sapiens
agcaggattttgaagtgcaagt

SEQ ID NO: 8451495 - DNA, 22 bp, Homo sapiens
agcaggcaaggtccgtgcctcg

SEQ ID NO: 8451496 - DNA, 21 bp, Homo sapiens
agcaggcaaaggtgaagtctt

SEQ ID NO: 8451497 - DNA, 22 bp, Homo sapiens
agcaggcactatgccaggatct

SEQ ID NO: 8451498 - DNA, 22 bp, Homo sapiens
agcaggcagccatttggaaggc

SEQ ID NO: 8451499 - DNA, 22 bp, Homo sapiens
agcaggcagcatgggaccctcc

SEQ ID NO: 8451500 - DNA, 22 bp, Homo sapiens
agcaggcagcatgggaccctcc

SEQ ID NO: 8451501 - DNA, 22 bp, Homo sapiens
agcaggcaggaaggcagcactg

SEQ ID NO: 8451502 - DNA, 22 bp, Homo sapiens
agcaggcagcctaggaagtgaa

SEQ ID NO: 8451503 - DNA, 22 bp, Homo sapiens
agcaggcaggaaggcagcactg

SEQ ID NO: 8451504 - DNA, 22 bp, Homo sapiens
agcaggcaggaatggtggaaca

SEQ ID NO: 8451505 - DNA, 22 bp, Homo sapiens
cacagttagaggtagagtccag

SEQ ID NO: 8451506 - DNA, 17 bp, Homo sapiens
agcaggctgcagaggcc

SEQ ID NO: 8451507 - DNA, 17 bp, Homo sapiens
agcaggctgcagaggcc

SEQ ID NO: 8451508 - DNA, 17 bp, Homo sapiens
agcaggctgcagaggcc

SEQ ID NO: 8451509 - DNA, 22 bp, Homo sapiens
agcaggctgatgggcatgcttg

SEQ ID NO: 8451510 - DNA, 22 bp, Homo sapiens
agcaggctgatgggcatgcttg

SEQ ID NO: 8451511 - DNA, 22 bp, Homo sapiens
agcaggctgagcacccaggggg

SEQ ID NO: 8451512 - DNA, 22 bp, Homo sapiens
agcaggctccttccttctctgg

SEQ ID NO: 8451513 - DNA, 22 bp, Homo sapiens
agcaggctccaggctggccatc

SEQ ID NO: 8451514 - DNA, 22 bp, Homo sapiens
cacagttatatgttcacaagga

SEQ ID NO: 8451515 - DNA, 22 bp, Homo sapiens
cacagttatgggaaacgtagtt

SEQ ID NO: 8451516 - DNA, 22 bp, Homo sapiens
cacagtttggtatagaagtgat

SEQ ID NO: 8451517 - DNA, 22 bp, Homo sapiens
agcaccagctcaaggtgcacct

SEQ ID NO: 8451518 - DNA, 22 bp, Homo sapiens
agcaccaggaaagaaggggcca

SEQ ID NO: 8451519 - DNA, 23 bp, Homo sapiens
agcaccaggaacagtgtggtcct

SEQ ID NO: 8451520 - DNA, 22 bp, Homo sapiens
agcaccaggcaccaaagggcct

SEQ ID NO: 8451521 - DNA, 22 bp, Homo sapiens
agcaccaggatattgttggaga

SEQ ID NO: 8451522 - DNA, 22 bp, Homo sapiens
agcaccagcaactatgggctgc

SEQ ID NO: 8451523 - DNA, 22 bp, Homo sapiens
agcaccagagctatgggcctgc

SEQ ID NO: 8451524 - DNA, 16 bp, Homo sapiens
agcaccagatcatatc

SEQ ID NO: 8451525 - DNA, 22 bp, Homo sapiens
agcaccagcgtgggggccgttg

SEQ ID NO: 8451526 - DNA, 22 bp, Homo sapiens
agcaccagagctatgggcctgc

SEQ ID NO: 8451527 - DNA, 22 bp, Homo sapiens
agcacatttaagtatgaaatat

SEQ ID NO: 8451528 - DNA, 22 bp, Homo sapiens
agcacattctgccttgctttgc

SEQ ID NO: 8451529 - DNA, 22 bp, Homo sapiens
caagacttagagcatcttgaaa

SEQ ID NO: 8451530 - DNA, 22 bp, Homo sapiens
caagacttcaccgctctgtgct

SEQ ID NO: 8451531 - DNA, 22 bp, Homo sapiens
caagacattgattttgtacaga

SEQ ID NO: 8451532 - DNA, 22 bp, Homo sapiens
caagacattgattttgtacaga

SEQ ID NO: 8451533 - DNA, 21 bp, Homo sapiens
caagacatatgagtactctgg

SEQ ID NO: 8451534 - DNA, 22 bp, Homo sapiens
caagacatgcaattgccacttt

SEQ ID NO: 8451535 - DNA, 22 bp, Homo sapiens
caacttggctctctggctatcc

SEQ ID NO: 8451536 - DNA, 22 bp, Homo sapiens
agcaccaggccatggggtccct

SEQ ID NO: 8451537 - DNA, 22 bp, Homo sapiens
agcaccaggcagtatatcaaag

SEQ ID NO: 8451538 - DNA, 22 bp, Homo sapiens
agcaccaggctgttggaagccc

SEQ ID NO: 8451539 - DNA, 22 bp, Homo sapiens
agcacattaagtgagttcatgt

SEQ ID NO: 8451540 - DNA, 22 bp, Homo sapiens
caacagctttagaaacactttc

SEQ ID NO: 8451541 - DNA, 22 bp, Homo sapiens
agcacattaagtgagttcatgt

SEQ ID NO: 8451542 - DNA, 22 bp, Homo sapiens
caacagagggaatggatctcat

SEQ ID NO: 8451543 - DNA, 22 bp, Homo sapiens
caacagaggagtggcctgatcc

SEQ ID NO: 8451544 - DNA, 20 bp, Homo sapiens
caacagaggggtctggagta

SEQ ID NO: 8451545 - DNA, 20 bp, Homo sapiens
caacagaggggtctggagta

SEQ ID NO: 8451546 - DNA, 22 bp, Homo sapiens
caacagagcagttgatcaggaa

SEQ ID NO: 8451547 - DNA, 22 bp, Homo sapiens
caacagagagaccagaaacagg

SEQ ID NO: 8451548 - DNA, 22 bp, Homo sapiens
caacagagagaccagaaacagg

SEQ ID NO: 8451549 - DNA, 22 bp, Homo sapiens
caaatagtttttcatgtattat

SEQ ID NO: 8451550 - DNA, 22 bp, Homo sapiens
caaatagtgtcacattgtgagg

SEQ ID NO: 8451551 - DNA, 22 bp, Homo sapiens
caaatagtgtcacattgtgagg

SEQ ID NO: 8451552 - DNA, 22 bp, Homo sapiens
caacagaaatcaattttcccat

SEQ ID NO: 8451553 - DNA, 22 bp, Homo sapiens
agcaaagaaatggaggctcaga

SEQ ID NO: 8451554 - DNA, 22 bp, Homo sapiens
agcaaagaaatggaggctcaga

SEQ ID NO: 8451555 - DNA, 20 bp, Homo sapiens
agcaaactcttcccatcttc

SEQ ID NO: 8451556 - DNA, 22 bp, Homo sapiens
caaaagtcttcctattctctta

SEQ ID NO: 8451557 - DNA, 22 bp, Homo sapiens
agcaaactaattgcagttctgg

SEQ ID NO: 8451558 - DNA, 22 bp, Homo sapiens
agcaaagcactttgcatacata

SEQ ID NO: 8451559 - DNA, 22 bp, Homo sapiens
agcaaagatgtccggggcaagc

SEQ ID NO: 8451560 - DNA, 21 bp, Homo sapiens
agcacagctttaagccatgtg

SEQ ID NO: 8451561 - DNA, 21 bp, Homo sapiens
agcacagctttaagccatgtg

SEQ ID NO: 8451562 - DNA, 22 bp, Homo sapiens
caaatagattgttcaatcctga

SEQ ID NO: 8451563 - DNA, 18 bp, Homo sapiens
caaatagcatgatgtcct

SEQ ID NO: 8451564 - DNA, 18 bp, Homo sapiens
caaatagcatgatgtcct

SEQ ID NO: 8451565 - DNA, 20 bp, Homo sapiens
agcacattaaacatactcct

SEQ ID NO: 8451566 - DNA, 22 bp, Homo sapiens
agcacataccagaaccacaggt

SEQ ID NO: 8451567 - DNA, 22 bp, Homo sapiens
agcacagtggcttctatgtcta

SEQ ID NO: 8451568 - DNA, 22 bp, Homo sapiens
agcacagttttcattgcagggt

SEQ ID NO: 8451569 - DNA, 19 bp, Homo sapiens
agcacagtttccacatgca

SEQ ID NO: 8451570 - DNA, 22 bp, Homo sapiens
agcacagtttcttttccttgtc

SEQ ID NO: 8451571 - DNA, 22 bp, Homo sapiens
agcacaggtgaaacagtcaggt

SEQ ID NO: 8451572 - DNA, 22 bp, Homo sapiens
agcagcaggaggctgtccacca

SEQ ID NO: 8451573 - DNA, 22 bp, Homo sapiens
agcagcaggagccgtggggtga

SEQ ID NO: 8451574 - DNA, 22 bp, Homo sapiens
agcagcaggagccgtggggtga

SEQ ID NO: 8451575 - DNA, 20 bp, Homo sapiens
agcagcagatgttggaggtg

SEQ ID NO: 8451576 - DNA, 22 bp, Homo sapiens
agcagcagctctgttgccctac

SEQ ID NO: 8451577 - DNA, 20 bp, Homo sapiens
agcagcagatgttggaggtg

SEQ ID NO: 8451578 - DNA, 22 bp, Homo sapiens
caagcagagactagatagctgt

SEQ ID NO: 8451579 - DNA, 22 bp, Homo sapiens
agcagcaggattttcgttggga

SEQ ID NO: 8451580 - DNA, 22 bp, Homo sapiens
agcagcaggctagggaactgct

SEQ ID NO: 8451581 - DNA, 22 bp, Homo sapiens
caagatttggcaactttgtcat

SEQ ID NO: 8451582 - DNA, 22 bp, Homo sapiens
caagatttggcattctgaggag

SEQ ID NO: 8451583 - DNA, 22 bp, Homo sapiens
caagatttgacttcgtggtttg

SEQ ID NO: 8451584 - DNA, 22 bp, Homo sapiens
caagatttgccagtggccaact

SEQ ID NO: 8451585 - DNA, 22 bp, Homo sapiens
caagatttgggggcacggaatc

SEQ ID NO: 8451586 - DNA, 22 bp, Homo sapiens
caagatttgtattgggcctctg

SEQ ID NO: 8451587 - DNA, 19 bp, Homo sapiens
caagatttgttcacacatg

SEQ ID NO: 8451588 - DNA, 22 bp, Homo sapiens
caagattttatctccgtttctg

SEQ ID NO: 8451589 - DNA, 22 bp, Homo sapiens
caagatttagcctgctgcctgt

SEQ ID NO: 8451590 - DNA, 22 bp, Homo sapiens
caagagctagactttgtcagga

SEQ ID NO: 8451591 - DNA, 22 bp, Homo sapiens
caagatttagctcccttatctc

SEQ ID NO: 8451592 - DNA, 22 bp, Homo sapiens
caagatttatattttcacacaa

SEQ ID NO: 8451593 - DNA, 22 bp, Homo sapiens
caagatttccaaccctgggtaa

SEQ ID NO: 8451594 - DNA, 22 bp, Homo sapiens
caagagctaccctgtgccatat

SEQ ID NO: 8451595 - DNA, 22 bp, Homo sapiens
caagagcctttgggcagaagga

SEQ ID NO: 8451596 - DNA, 17 bp, Homo sapiens
caagagagatgactgga

SEQ ID NO: 8451597 - DNA, 22 bp, Homo sapiens
caagagacttatgtggaaacct

SEQ ID NO: 8451598 - DNA, 22 bp, Homo sapiens
caagagcacgtgccctccataa

SEQ ID NO: 8451599 - DNA, 22 bp, Homo sapiens
cacaaggactggatggagtggg

SEQ ID NO: 8451600 - DNA, 22 bp, Homo sapiens
cacaagctccttatgtggagaa

SEQ ID NO: 8451601 - DNA, 22 bp, Homo sapiens
cacaaggacctcagatggatga

SEQ ID NO: 8451602 - DNA, 22 bp, Homo sapiens
agcagccacccagctgctcatt

SEQ ID NO: 8451603 - DNA, 22 bp, Homo sapiens
agcagccacccagctgctcatt

SEQ ID NO: 8451604 - DNA, 22 bp, Homo sapiens
agcagccacccagctgctcatt

SEQ ID NO: 8451605 - DNA, 22 bp, Homo sapiens
agcagccagaaatccagaggtg

SEQ ID NO: 8451606 - DNA, 22 bp, Homo sapiens
agcagctccctcctcagccacc

SEQ ID NO: 8451607 - DNA, 22 bp, Homo sapiens
agcagccaaggtaacctgtgct

SEQ ID NO: 8451608 - DNA, 22 bp, Homo sapiens
agcagccaattggaggatgaag

SEQ ID NO: 8451609 - DNA, 22 bp, Homo sapiens
agcagcagggtgatagtgccca

SEQ ID NO: 8451610 - DNA, 22 bp, Homo sapiens
cacaagacttatttgtgtagaa

SEQ ID NO: 8451611 - DNA, 22 bp, Homo sapiens
cacaagaaataagctgcctttc

SEQ ID NO: 8451612 - DNA, 21 bp, Homo sapiens
cacaagacacatagggtgttt

SEQ ID NO: 8451613 - DNA, 22 bp, Homo sapiens
agcagcaggcttaaggaaaagt

SEQ ID NO: 8451614 - DNA, 21 bp, Homo sapiens
agcagcagggaagcctcatcc

SEQ ID NO: 8451615 - DNA, 22 bp, Homo sapiens
agcagcagggcatgtcttactc

SEQ ID NO: 8451616 - DNA, 22 bp, Homo sapiens
agcagcagggctctgcccgtgc

SEQ ID NO: 8451617 - DNA, 22 bp, Homo sapiens
agcagcagggtcattgctcttt

SEQ ID NO: 8451618 - DNA, 21 bp, Homo sapiens
agcctgaatcccaccagttca

SEQ ID NO: 8451619 - DNA, 22 bp, Homo sapiens
agcctcttattctccaggactt

SEQ ID NO: 8451620 - DNA, 22 bp, Homo sapiens
agcctgagagccaagctgtgca

SEQ ID NO: 8451621 - DNA, 22 bp, Homo sapiens
agcctgagagccaagctgtgca

SEQ ID NO: 8451622 - DNA, 22 bp, Homo sapiens
agcctgagctgcctgccgcctc

SEQ ID NO: 8451623 - DNA, 20 bp, Homo sapiens
cagcagccaaacttctattc

SEQ ID NO: 8451624 - DNA, 22 bp, Homo sapiens
agcctgagccccatccagctga

SEQ ID NO: 8451625 - DNA, 22 bp, Homo sapiens
cagcagctcactcaggtggctc

SEQ ID NO: 8451626 - DNA, 22 bp, Homo sapiens
cagcagctcctctgcggctatg

SEQ ID NO: 8451627 - DNA, 22 bp, Homo sapiens
cagcagctcccatccgctgagc

SEQ ID NO: 8451628 - DNA, 22 bp, Homo sapiens
cagcagctccaaagaatagcca

SEQ ID NO: 8451629 - DNA, 22 bp, Homo sapiens
cagcaggatatggtggagagag

SEQ ID NO: 8451630 - DNA, 22 bp, Homo sapiens
cagcaggatatggtggagagag

SEQ ID NO: 8451631 - DNA, 22 bp, Homo sapiens
cagcagggcccccgggtgcgcc

SEQ ID NO: 8451632 - DNA, 22 bp, Homo sapiens
cagcaggggaactgtgggccag

SEQ ID NO: 8451633 - DNA, 22 bp, Homo sapiens
agcctggagttcccaggagaag

SEQ ID NO: 8451634 - DNA, 20 bp, Homo sapiens
agcctggcaaacacccccag

SEQ ID NO: 8451635 - DNA, 22 bp, Homo sapiens
agcctggatcctaggctcagct

SEQ ID NO: 8451636 - DNA, 22 bp, Homo sapiens
agcctctgctggccctggcact

SEQ ID NO: 8451637 - DNA, 22 bp, Homo sapiens
agcctctgctggccctggcact

SEQ ID NO: 8451638 - DNA, 22 bp, Homo sapiens
agcctctgctggccctggcact

SEQ ID NO: 8451639 - DNA, 22 bp, Homo sapiens
agcctctgctggccctggcact

SEQ ID NO: 8451640 - DNA, 22 bp, Homo sapiens
agcctctgctggccctggcact

SEQ ID NO: 8451641 - DNA, 22 bp, Homo sapiens
agcctctgcttatgcaaaggta

SEQ ID NO: 8451642 - DNA, 18 bp, Homo sapiens
agcctctggcagagagaa

SEQ ID NO: 8451643 - DNA, 18 bp, Homo sapiens
agcctctggcagagagaa

SEQ ID NO: 8451644 - DNA, 22 bp, Homo sapiens
agcctctgatggctcccaagga

SEQ ID NO: 8451645 - DNA, 22 bp, Homo sapiens
agcctctgcacttcttacaggt

SEQ ID NO: 8451646 - DNA, 20 bp, Homo sapiens
agcctctgcccttcccactg

SEQ ID NO: 8451647 - DNA, 22 bp, Homo sapiens
agcctctggccctagactgctt

SEQ ID NO: 8451648 - DNA, 22 bp, Homo sapiens
agcctctggtcctccctcagct

SEQ ID NO: 8451649 - DNA, 22 bp, Homo sapiens
agcctctggtcctccctcagct

SEQ ID NO: 8451650 - DNA, 22 bp, Homo sapiens
agcctctgggggagctgggagc

SEQ ID NO: 8451651 - DNA, 22 bp, Homo sapiens
agcctctgtagaaagcagtgtg

SEQ ID NO: 8451652 - DNA, 22 bp, Homo sapiens
agcctctgtagaaagcagtgtg

SEQ ID NO: 8451653 - DNA, 22 bp, Homo sapiens
agcctctgtagaaagcagtgtg

SEQ ID NO: 8451654 - DNA, 22 bp, Homo sapiens
agcctccctatgcaccttcagg

SEQ ID NO: 8451655 - DNA, 22 bp, Homo sapiens
agcctcctggagtttctgggat

SEQ ID NO: 8451656 - DNA, 22 bp, Homo sapiens
cagaggtgctggagtgagtcct

SEQ ID NO: 8451657 - DNA, 22 bp, Homo sapiens
cagaggtgcatacaggtcatta

SEQ ID NO: 8451658 - DNA, 22 bp, Homo sapiens
cagagggagccctccaggagca

SEQ ID NO: 8451659 - DNA, 22 bp, Homo sapiens
cagagggagtttctgaggttgc

SEQ ID NO: 8451660 - DNA, 22 bp, Homo sapiens
cagagggagtttctgaggttgc

SEQ ID NO: 8451661 - DNA, 22 bp, Homo sapiens
cagagggcactcggagtgacat

SEQ ID NO: 8451662 - DNA, 22 bp, Homo sapiens
cagagggccccctggccacagt

SEQ ID NO: 8451663 - DNA, 22 bp, Homo sapiens
agctcaggcaactctgggcccc

SEQ ID NO: 8451664 - DNA, 22 bp, Homo sapiens
agctcaggcaactctgggcccc

SEQ ID NO: 8451665 - DNA, 19 bp, Homo sapiens
cagctcaggactcagcccc

SEQ ID NO: 8451666 - DNA, 22 bp, Homo sapiens
cagctcaggaaggaaggccggc

SEQ ID NO: 8451667 - DNA, 22 bp, Homo sapiens
cagctcaggctctccatgctcc

SEQ ID NO: 8451668 - DNA, 22 bp, Homo sapiens
cagctcaggctctccatgctcc

SEQ ID NO: 8451669 - DNA, 22 bp, Homo sapiens
cagctcagtctggagagatgca

SEQ ID NO: 8451670 - DNA, 22 bp, Homo sapiens
cagctcagtctggagagatgca

SEQ ID NO: 8451671 - DNA, 22 bp, Homo sapiens
cagctcaggcactggcgcggga

SEQ ID NO: 8451672 - DNA, 22 bp, Homo sapiens
agctcagcttcctctccatgct

SEQ ID NO: 8451673 - DNA, 22 bp, Homo sapiens
agctcagcttcctctccatgct

SEQ ID NO: 8451674 - DNA, 22 bp, Homo sapiens
agctcagcttcctctccatgct

SEQ ID NO: 8451675 - DNA, 21 bp, Homo sapiens
agctcagccgggcacagtggc

SEQ ID NO: 8451676 - DNA, 22 bp, Homo sapiens
agctcagccctcctgtgcagct

SEQ ID NO: 8451677 - DNA, 22 bp, Homo sapiens
agctcagccctcctgtgcagct

SEQ ID NO: 8451678 - DNA, 22 bp, Homo sapiens
agctcagcactgtcagcactcc

SEQ ID NO: 8451679 - DNA, 21 bp, Homo sapiens
agctcagcaagatggaggctc

SEQ ID NO: 8451680 - DNA, 22 bp, Homo sapiens
agctcctgaaaatccagactgg

SEQ ID NO: 8451681 - DNA, 22 bp, Homo sapiens
agctcctgaaaatccagactgg

SEQ ID NO: 8451682 - DNA, 22 bp, Homo sapiens
agctcctgaaaatccagactgg

SEQ ID NO: 8451683 - DNA, 18 bp, Homo sapiens
agctcctgaactctgtgg

SEQ ID NO: 8451684 - DNA, 22 bp, Homo sapiens
cagctccaaagccccactgtcc

SEQ ID NO: 8451685 - DNA, 22 bp, Homo sapiens
cagctcagtgatgccttcacag

SEQ ID NO: 8451686 - DNA, 22 bp, Homo sapiens
cagctcagtcttgaagcactgg

SEQ ID NO: 8451687 - DNA, 22 bp, Homo sapiens
cagctcagtttcaataccaggt

SEQ ID NO: 8451688 - DNA, 19 bp, Homo sapiens
cagctcagtttgattctct

SEQ ID NO: 8451689 - DNA, 22 bp, Homo sapiens
agctcctgatacatgcaggaat

SEQ ID NO: 8451690 - DNA, 22 bp, Homo sapiens
agctcctgatacatgcaggaat

SEQ ID NO: 8451691 - DNA, 22 bp, Homo sapiens
agctcctgattctcagagatag

SEQ ID NO: 8451692 - DNA, 23 bp, Homo sapiens
agctcctgaggccagcctctcct

SEQ ID NO: 8451693 - DNA, 23 bp, Homo sapiens
agctcctgaggccagcctctcct

SEQ ID NO: 8451694 - DNA, 23 bp, Homo sapiens
agctcctgaggccagcctctcct

SEQ ID NO: 8451695 - DNA, 22 bp, Homo sapiens
cagcagtgtctccagcatcaca

SEQ ID NO: 8451696 - DNA, 22 bp, Homo sapiens
cagcagtgtctccagcatcaca

SEQ ID NO: 8451697 - DNA, 22 bp, Homo sapiens
cagcagtgtctccagcatcaca

SEQ ID NO: 8451698 - DNA, 22 bp, Homo sapiens
cagcagtttcctatggttcagc

SEQ ID NO: 8451699 - DNA, 22 bp, Homo sapiens
cagccccagcacttagctgagt

SEQ ID NO: 8451700 - DNA, 22 bp, Homo sapiens
cagcatattactttaaaaaatc

SEQ ID NO: 8451701 - DNA, 22 bp, Homo sapiens
cagcatattactttaaaaaatc

SEQ ID NO: 8451702 - DNA, 22 bp, Homo sapiens
cagcatcaacattctcagctct

SEQ ID NO: 8451703 - DNA, 22 bp, Homo sapiens
cagccctgagagaaccatctat

SEQ ID NO: 8451704 - DNA, 22 bp, Homo sapiens
cagccctgagagaaccatctat

SEQ ID NO: 8451705 - DNA, 22 bp, Homo sapiens
cagccctgagagaaccatctat

SEQ ID NO: 8451706 - DNA, 22 bp, Homo sapiens
cagccctgcacgctgcctccgc

SEQ ID NO: 8451707 - DNA, 22 bp, Homo sapiens
cagccctgagttagcccacgga

SEQ ID NO: 8451708 - DNA, 22 bp, Homo sapiens
cagccctgagttagcccacgga

SEQ ID NO: 8451709 - DNA, 22 bp, Homo sapiens
cagccctgcagagggcgctcct

SEQ ID NO: 8451710 - DNA, 22 bp, Homo sapiens
cagccctgcagagggcgctcct

SEQ ID NO: 8451711 - DNA, 22 bp, Homo sapiens
cagccctgcacgctgcctccgc

SEQ ID NO: 8451712 - DNA, 22 bp, Homo sapiens
cagccctgcacgctgcctccgc

SEQ ID NO: 8451713 - DNA, 22 bp, Homo sapiens
cagacaggaagttcagaagaaa

SEQ ID NO: 8451714 - DNA, 22 bp, Homo sapiens
agccagagagccccaggttcta

SEQ ID NO: 8451715 - DNA, 22 bp, Homo sapiens
agccagagagccccaggttcta

SEQ ID NO: 8451716 - DNA, 22 bp, Homo sapiens
cagacagggtgggtttctgggc

SEQ ID NO: 8451717 - DNA, 22 bp, Homo sapiens
agccagactttaaaatagatga

SEQ ID NO: 8451718 - DNA, 22 bp, Homo sapiens
agccagactcatttggaagtat

SEQ ID NO: 8451719 - DNA, 22 bp, Homo sapiens
cagacatgatgtaagcagaggc

SEQ ID NO: 8451720 - DNA, 22 bp, Homo sapiens
cagacatctgtacccagcctgt

SEQ ID NO: 8451721 - DNA, 22 bp, Homo sapiens
cagacatcttttatcttcagga

SEQ ID NO: 8451722 - DNA, 22 bp, Homo sapiens
cagacaggtagggacagaacat

SEQ ID NO: 8451723 - DNA, 22 bp, Homo sapiens
cagacatatccctgctccctta

SEQ ID NO: 8451724 - DNA, 22 bp, Homo sapiens
agccactgtctgaacttctgtg

SEQ ID NO: 8451725 - DNA, 22 bp, Homo sapiens
cagaatgggaaggactgcagtt

SEQ ID NO: 8451726 - DNA, 22 bp, Homo sapiens
agccactgtgtgaccagctgtc

SEQ ID NO: 8451727 - DNA, 22 bp, Homo sapiens
agccagaaaaacaccaagagga

SEQ ID NO: 8451728 - DNA, 22 bp, Homo sapiens
cagaatctcgacttctggcccc

SEQ ID NO: 8451729 - DNA, 22 bp, Homo sapiens
cagaatctacaccctcagaaat

SEQ ID NO: 8451730 - DNA, 22 bp, Homo sapiens
cagaatccagaattgctgaggt

SEQ ID NO: 8451731 - DNA, 22 bp, Homo sapiens
cagaatgcagaatgttcatttt

SEQ ID NO: 8451732 - DNA, 22 bp, Homo sapiens
cagaatctgagtcgtgattgta

SEQ ID NO: 8451733 - DNA, 22 bp, Homo sapiens
cagaatctacaccctcagaaat

SEQ ID NO: 8451734 - DNA, 22 bp, Homo sapiens
cagaatctctgggagtggatca

SEQ ID NO: 8451735 - DNA, 22 bp, Homo sapiens
cagaatcttcttaattggcaca

SEQ ID NO: 8451736 - DNA, 22 bp, Homo sapiens
cagaatctgttggggttgcaga

SEQ ID NO: 8451737 - DNA, 22 bp, Homo sapiens
cagaaatctccatgtcagacat

SEQ ID NO: 8451738 - DNA, 22 bp, Homo sapiens
cagaaatatttattgagtgaca

SEQ ID NO: 8451739 - DNA, 22 bp, Homo sapiens
agccacagtgcaagagagaaaa

SEQ ID NO: 8451740 - DNA, 22 bp, Homo sapiens
agccacagtgcaagagagaaaa

SEQ ID NO: 8451741 - DNA, 22 bp, Homo sapiens
agccacccattcccgagcccta

SEQ ID NO: 8451742 - DNA, 22 bp, Homo sapiens
agccacccattcccgagcccta

SEQ ID NO: 8451743 - DNA, 22 bp, Homo sapiens
agccacagtctgtagccagctt

SEQ ID NO: 8451744 - DNA, 22 bp, Homo sapiens
agccacaggaaacagagacagc

SEQ ID NO: 8451745 - DNA, 21 bp, Homo sapiens
cagaggcaggctctgtgtgtg

SEQ ID NO: 8451746 - DNA, 21 bp, Homo sapiens
cagaggcaggctctgtgtgtg

SEQ ID NO: 8451747 - DNA, 21 bp, Homo sapiens
cagaggcaggctctgtgtgtg

SEQ ID NO: 8451748 - DNA, 22 bp, Homo sapiens
agcccagccggattcccagttc

SEQ ID NO: 8451749 - DNA, 22 bp, Homo sapiens
cagaggcagtggggttgctcct

SEQ ID NO: 8451750 - DNA, 22 bp, Homo sapiens
cagaggcagtggggttgctcct

SEQ ID NO: 8451751 - DNA, 21 bp, Homo sapiens
cagaggcaggtcctgggacgg

SEQ ID NO: 8451752 - DNA, 21 bp, Homo sapiens
cagaggcaggtcctgggacgg

SEQ ID NO: 8451753 - DNA, 21 bp, Homo sapiens
cagaggcaggtcctgggacgg

SEQ ID NO: 8451754 - DNA, 22 bp, Homo sapiens
cagaggcatataattgctgggg

SEQ ID NO: 8451755 - DNA, 22 bp, Homo sapiens
cagaggcatactcccagtcttg

SEQ ID NO: 8451756 - DNA, 22 bp, Homo sapiens
cagaggcatactcccagtcttg

SEQ ID NO: 8451757 - DNA, 22 bp, Homo sapiens
cagaggcatactcccagtcttg

SEQ ID NO: 8451758 - DNA, 22 bp, Homo sapiens
cagaggcatataattgctgggg

SEQ ID NO: 8451759 - DNA, 22 bp, Homo sapiens
agcccaggcagagggatgcttg

SEQ ID NO: 8451760 - DNA, 22 bp, Homo sapiens
agcccaggcagagggatgcttg

SEQ ID NO: 8451761 - DNA, 22 bp, Homo sapiens
cagaggcattactgaaaaggtg

SEQ ID NO: 8451762 - DNA, 18 bp, Homo sapiens
agcccaggcatcgtctgc

SEQ ID NO: 8451763 - DNA, 20 bp, Homo sapiens
agcccaggcctgtgtgagtc

SEQ ID NO: 8451764 - DNA, 22 bp, Homo sapiens
agcccagggaaccaggaagtgg

SEQ ID NO: 8451765 - DNA, 22 bp, Homo sapiens
agcccagggaaccaggaagtgg

SEQ ID NO: 8451766 - DNA, 22 bp, Homo sapiens
agcccaggctggagtgcagtgg

SEQ ID NO: 8451767 - DNA, 22 bp, Homo sapiens
cagagggacagtatgatgaaag

SEQ ID NO: 8451768 - DNA, 22 bp, Homo sapiens
cagagggacagtgtaatgcata

SEQ ID NO: 8451769 - DNA, 22 bp, Homo sapiens
agcccaagaagagctttcttgc

SEQ ID NO: 8451770 - DNA, 22 bp, Homo sapiens
agcccaagaagagctttcttgc

SEQ ID NO: 8451771 - DNA, 23 bp, Homo sapiens
agccatcatcctgctgctggggc

SEQ ID NO: 8451772 - DNA, 22 bp, Homo sapiens
cagagaaagaagcccattcatt

SEQ ID NO: 8451773 - DNA, 22 bp, Homo sapiens
cagactttctgactcccttgcc

SEQ ID NO: 8451774 - DNA, 22 bp, Homo sapiens
cagagaaagaagcccattcatt

SEQ ID NO: 8451775 - DNA, 22 bp, Homo sapiens
cagagaaagaagcccattcatt

SEQ ID NO: 8451776 - DNA, 22 bp, Homo sapiens
cagagaaactcagatagctgat

SEQ ID NO: 8451777 - DNA, 22 bp, Homo sapiens
agcccaaggcttccctgctggc

SEQ ID NO: 8451778 - DNA, 22 bp, Homo sapiens
agcccaaggcttccctgctggc

SEQ ID NO: 8451779 - DNA, 22 bp, Homo sapiens
agcccagagacaatgctcagta

SEQ ID NO: 8451780 - DNA, 22 bp, Homo sapiens
agcccagaaatgaaaggatgat

SEQ ID NO: 8451781 - DNA, 22 bp, Homo sapiens
agcccagagccccggccatgtt

SEQ ID NO: 8451782 - DNA, 22 bp, Homo sapiens
agcccagagccccggccatgtt

SEQ ID NO: 8451783 - DNA, 22 bp, Homo sapiens
agcccagagggtagcagaagaa

SEQ ID NO: 8451784 - DNA, 22 bp, Homo sapiens
agcccagataaagtacaaccat

SEQ ID NO: 8451785 - DNA, 22 bp, Homo sapiens
agcccagatggtagccctagaa

SEQ ID NO: 8451786 - DNA, 22 bp, Homo sapiens
agcccagatggtagccctagaa

SEQ ID NO: 8451787 - DNA, 22 bp, Homo sapiens
agcccagaggctgggcgtgcat

SEQ ID NO: 8451788 - DNA, 22 bp, Homo sapiens
agcccagagcctctcctaaagg

SEQ ID NO: 8451789 - DNA, 22 bp, Homo sapiens
agcccagagggtagcagaagaa

SEQ ID NO: 8451790 - DNA, 22 bp, Homo sapiens
agcccagaggctgggcgtgcat

SEQ ID NO: 8451791 - DNA, 22 bp, Homo sapiens
agcccagaggggtttgaggact

SEQ ID NO: 8451792 - DNA, 22 bp, Homo sapiens
agcccagcactgggggcccagc

SEQ ID NO: 8451793 - DNA, 22 bp, Homo sapiens
agcccagcactgggggcccagc

SEQ ID NO: 8451794 - DNA, 22 bp, Homo sapiens
agcccagcagaaagtccagcct

SEQ ID NO: 8451795 - DNA, 22 bp, Homo sapiens
agcccagcaaagggaggttcag

SEQ ID NO: 8451796 - DNA, 22 bp, Homo sapiens
agcccagcaaaggggtttgaga

SEQ ID NO: 8451797 - DNA, 22 bp, Homo sapiens
agcccagcccgggctgcgcttt

SEQ ID NO: 8451798 - DNA, 22 bp, Homo sapiens
agcccagcccgggctgcgcttt

SEQ ID NO: 8451799 - DNA, 22 bp, Homo sapiens
agcccagccactattaaatgtt

SEQ ID NO: 8451800 - DNA, 22 bp, Homo sapiens
agcccagcagtaagattagaga

SEQ ID NO: 8451801 - DNA, 23 bp, Homo sapiens
agcccagcagagaacctaggtcc

SEQ ID NO: 8451802 - DNA, 22 bp, Homo sapiens
agtaaacagaaagcaagatgat

SEQ ID NO: 8451803 - DNA, 22 bp, Homo sapiens
actagaacttctaactaaggtc

SEQ ID NO: 8451804 - DNA, 22 bp, Homo sapiens
actagaaccagaggaggcaggt

SEQ ID NO: 8451805 - DNA, 22 bp, Homo sapiens
agtaaacagaaagcaagatgat

SEQ ID NO: 8451806 - DNA, 22 bp, Homo sapiens
actagaatgcaagctccacaag

SEQ ID NO: 8451807 - DNA, 22 bp, Homo sapiens
agtaaacactaaaatgactgcg

SEQ ID NO: 8451808 - DNA, 22 bp, Homo sapiens
agtaaaacagagaaatcactca

SEQ ID NO: 8451809 - DNA, 22 bp, Homo sapiens
agtaaaatcttaagcacagtgg

SEQ ID NO: 8451810 - DNA, 22 bp, Homo sapiens
acgcctgtaatcccagcacttt

SEQ ID NO: 8451811 - DNA, 22 bp, Homo sapiens
acgcctgtaatcccagcacttt

SEQ ID NO: 8451812 - DNA, 22 bp, Homo sapiens
acgcctgtaatcccagcacttt

SEQ ID NO: 8451813 - DNA, 22 bp, Homo sapiens
acgcctgtaatcccagcacttt

SEQ ID NO: 8451814 - DNA, 22 bp, Homo sapiens
acggaaaaccctgagcaaactt

SEQ ID NO: 8451815 - DNA, 22 bp, Homo sapiens
acgcgcaaccaggcatgcacat

SEQ ID NO: 8451816 - DNA, 22 bp, Homo sapiens
aggttcttttggccaacctcat

SEQ ID NO: 8451817 - DNA, 22 bp, Homo sapiens
aggttcttggtgtccagatttc

SEQ ID NO: 8451818 - DNA, 22 bp, Homo sapiens
acggcttcttgactgtgggttg

SEQ ID NO: 8451819 - DNA, 22 bp, Homo sapiens
aggttgaaataggttatctaag

SEQ ID NO: 8451820 - DNA, 22 bp, Homo sapiens
acgcccagactcccatactttg

SEQ ID NO: 8451821 - DNA, 22 bp, Homo sapiens
acgcccagactcccatactttg

SEQ ID NO: 8451822 - DNA, 22 bp, Homo sapiens
acgatgctcaactatatgaatt

SEQ ID NO: 8451823 - DNA, 22 bp, Homo sapiens
acgatgctggattatctcaagg

SEQ ID NO: 8451824 - DNA, 20 bp, Homo sapiens
aggtggctcctgctgggggt

SEQ ID NO: 8451825 - DNA, 20 bp, Homo sapiens
aggtggctcctgctgggggt

SEQ ID NO: 8451826 - DNA, 22 bp, Homo sapiens
agtcaacacctggttctattac

SEQ ID NO: 8451827 - DNA, 22 bp, Homo sapiens
agtcaacatttgagatgcaatg

SEQ ID NO: 8451828 - DNA, 22 bp, Homo sapiens
agtcaaatatcttaaaaggcta

SEQ ID NO: 8451829 - DNA, 22 bp, Homo sapiens
agtcaaatgagtaaatatataa

SEQ ID NO: 8451830 - DNA, 22 bp, Homo sapiens
agtcaaatatcttaaaaggcta

SEQ ID NO: 8451831 - DNA, 22 bp, Homo sapiens
agtccaggcgggtatagaggct

SEQ ID NO: 8451832 - DNA, 22 bp, Homo sapiens
agtccaggcgggtatagaggct

SEQ ID NO: 8451833 - DNA, 19 bp, Homo sapiens
actcaggcttcctctgagg

SEQ ID NO: 8451834 - DNA, 22 bp, Homo sapiens
actcaggcttcaggcacagctg

SEQ ID NO: 8451835 - DNA, 22 bp, Homo sapiens
actcaggctagggaaaaagtgg

SEQ ID NO: 8451836 - DNA, 19 bp, Homo sapiens
actcaggcaatgagaaaca

SEQ ID NO: 8451837 - DNA, 19 bp, Homo sapiens
actcaggcaatgagaaaca

SEQ ID NO: 8451838 - DNA, 21 bp, Homo sapiens
actcaggcaccaggggatggc

SEQ ID NO: 8451839 - DNA, 22 bp, Homo sapiens
actcaggcactcagccctcgcc

SEQ ID NO: 8451840 - DNA, 22 bp, Homo sapiens
actcaggctacaacgcgtggct

SEQ ID NO: 8451841 - DNA, 22 bp, Homo sapiens
actcaggcctccttctgtcctt

SEQ ID NO: 8451842 - DNA, 22 bp, Homo sapiens
actcaggcctccttctgtcctt

SEQ ID NO: 8451843 - DNA, 22 bp, Homo sapiens
actcaggccccatcgcccatct

SEQ ID NO: 8451844 - DNA, 22 bp, Homo sapiens
actcaggctacaggggcagaag

SEQ ID NO: 8451845 - DNA, 22 bp, Homo sapiens
agtatttgatacagtcttctag

SEQ ID NO: 8451846 - DNA, 22 bp, Homo sapiens
agtatttgtggatttgtattgg

SEQ ID NO: 8451847 - DNA, 22 bp, Homo sapiens
agtcaaagatgaccgagttcct

SEQ ID NO: 8451848 - DNA, 22 bp, Homo sapiens
agtcaaagggtatttggattga

SEQ ID NO: 8451849 - DNA, 22 bp, Homo sapiens
agtatttcttcatatgattact

SEQ ID NO: 8451850 - DNA, 22 bp, Homo sapiens
aggtcctgtttcttccctgggg

SEQ ID NO: 8451851 - DNA, 22 bp, Homo sapiens
aggtcgagtttcggggctactt

SEQ ID NO: 8451852 - DNA, 20 bp, Homo sapiens
aggtcctgttccttgtctcc

SEQ ID NO: 8451853 - DNA, 20 bp, Homo sapiens
aggtcctgttccttgtctcc

SEQ ID NO: 8451854 - DNA, 22 bp, Homo sapiens
aggtcctgtgtccaggggcctg

SEQ ID NO: 8451855 - DNA, 22 bp, Homo sapiens
aggtcctgtggtttgggtaaaa

SEQ ID NO: 8451856 - DNA, 22 bp, Homo sapiens
aggtcctgtggtttgggtaaaa

SEQ ID NO: 8451857 - DNA, 22 bp, Homo sapiens
aggtccagttttcagttctcat

SEQ ID NO: 8451858 - DNA, 22 bp, Homo sapiens
aggtcctgtctatcaccctcgc

SEQ ID NO: 8451859 - DNA, 22 bp, Homo sapiens
aggtcctgtcttatctctgtaa

SEQ ID NO: 8451860 - DNA, 22 bp, Homo sapiens
aggtcctgtcttatctctgtaa

SEQ ID NO: 8451861 - DNA, 22 bp, Homo sapiens
acctggcacagagtatgctctc

SEQ ID NO: 8451862 - DNA, 22 bp, Homo sapiens
aggtctcttgctgtctctgggc

SEQ ID NO: 8451863 - DNA, 22 bp, Homo sapiens
aggtctctgcccacacaggctt

SEQ ID NO: 8451864 - DNA, 22 bp, Homo sapiens
aggtctctcacactcacagggc

SEQ ID NO: 8451865 - DNA, 22 bp, Homo sapiens
aggtctctgagtactgctggac

SEQ ID NO: 8451866 - DNA, 22 bp, Homo sapiens
aggtggcatgcctgagacataa

SEQ ID NO: 8451867 - DNA, 22 bp, Homo sapiens
aggtggccggtgccagccgggc

SEQ ID NO: 8451868 - DNA, 22 bp, Homo sapiens
aggtggctatgaggatgcagtc

SEQ ID NO: 8451869 - DNA, 22 bp, Homo sapiens
acctggcataagggcttgagtc

SEQ ID NO: 8451870 - DNA, 22 bp, Homo sapiens
accctccaggctgcagctcctg

SEQ ID NO: 8451871 - DNA, 22 bp, Homo sapiens
accctctgagaggcacactttg

SEQ ID NO: 8451872 - DNA, 19 bp, Homo sapiens
accctctgccacaagcctc

SEQ ID NO: 8451873 - DNA, 22 bp, Homo sapiens
accctctgagaggcacactttg

SEQ ID NO: 8451874 - DNA, 22 bp, Homo sapiens
acctgaattgatttgacctgta

SEQ ID NO: 8451875 - DNA, 22 bp, Homo sapiens
acctgagaatgggggcatgtgt

SEQ ID NO: 8451876 - DNA, 22 bp, Homo sapiens
acctgagaatgggggcatgtgt

SEQ ID NO: 8451877 - DNA, 22 bp, Homo sapiens
acctgaattttggatgagctgt

SEQ ID NO: 8451878 - DNA, 22 bp, Homo sapiens
acctcctgatgagagtaaagga

SEQ ID NO: 8451879 - DNA, 22 bp, Homo sapiens
acctctgtatagttgcctgtgg

SEQ ID NO: 8451880 - DNA, 22 bp, Homo sapiens
acctcttaatattgcaccttct

SEQ ID NO: 8451881 - DNA, 22 bp, Homo sapiens
acctgcacagccccagaatgcc

SEQ ID NO: 8451882 - DNA, 22 bp, Homo sapiens
acctgcaggcacaggtgtgcgc

SEQ ID NO: 8451883 - DNA, 22 bp, Homo sapiens
aggtccagttgccagaatggcc

SEQ ID NO: 8451884 - DNA, 19 bp, Homo sapiens
acctgccatgacagcctga

SEQ ID NO: 8451885 - DNA, 22 bp, Homo sapiens
acctgatgtatagattctagat

SEQ ID NO: 8451886 - DNA, 22 bp, Homo sapiens
acctgcaagcattacacttcta

SEQ ID NO: 8451887 - DNA, 22 bp, Homo sapiens
acctgaggctgttagtctaggt

SEQ ID NO: 8451888 - DNA, 22 bp, Homo sapiens
acctgaggctgttagtctaggt

SEQ ID NO: 8451889 - DNA, 22 bp, Homo sapiens
acctgaggcctccccagcagac

SEQ ID NO: 8451890 - DNA, 22 bp, Homo sapiens
acctgagacttgggatgggaat

SEQ ID NO: 8451891 - DNA, 22 bp, Homo sapiens
acctgagacttgggatgggaat

SEQ ID NO: 8451892 - DNA, 22 bp, Homo sapiens
acctgagacctaatctgactgt

SEQ ID NO: 8451893 - DNA, 22 bp, Homo sapiens
acctgaggaagggcgagaagct

SEQ ID NO: 8451894 - DNA, 22 bp, Homo sapiens
actgcacttcagcctgggtgac

SEQ ID NO: 8451895 - DNA, 22 bp, Homo sapiens
actgcacttcagcctgggtgac

SEQ ID NO: 8451896 - DNA, 22 bp, Homo sapiens
actgcacttcagcctgggtgac

SEQ ID NO: 8451897 - DNA, 22 bp, Homo sapiens
agtggcagtggctgggcagagc

SEQ ID NO: 8451898 - DNA, 22 bp, Homo sapiens
agtggcagtggaaagcacacgg

SEQ ID NO: 8451899 - DNA, 22 bp, Homo sapiens
agtggcagtagatgagctggtt

SEQ ID NO: 8451900 - DNA, 22 bp, Homo sapiens
agtggcagtagatgagctggtt

SEQ ID NO: 8451901 - DNA, 22 bp, Homo sapiens
agtggcagtaacattccacaat

SEQ ID NO: 8451902 - DNA, 22 bp, Homo sapiens
agtggcaggtgtttcgtggtgc

SEQ ID NO: 8451903 - DNA, 22 bp, Homo sapiens
agtggcagggctggctgctgca

SEQ ID NO: 8451904 - DNA, 22 bp, Homo sapiens
agtggcagagccagggttggga

SEQ ID NO: 8451905 - DNA, 22 bp, Homo sapiens
actgagggagagtcttaggttg

SEQ ID NO: 8451906 - DNA, 22 bp, Homo sapiens
actgcacttcagcctgggtgtc

SEQ ID NO: 8451907 - DNA, 22 bp, Homo sapiens
actgcacttcagcctgggtgtc

SEQ ID NO: 8451908 - DNA, 22 bp, Homo sapiens
actgcacttcagcctgggtgtc

SEQ ID NO: 8451909 - DNA, 22 bp, Homo sapiens
actgcagaggtggggtgcagag

SEQ ID NO: 8451910 - DNA, 22 bp, Homo sapiens
actgcagaggtggggtgcagag

SEQ ID NO: 8451911 - DNA, 22 bp, Homo sapiens
actgcagagcttttcagttgag

SEQ ID NO: 8451912 - DNA, 22 bp, Homo sapiens
agtgtacatagttaggaacatc

SEQ ID NO: 8451913 - DNA, 20 bp, Homo sapiens
agtgtacagacactagaaat

SEQ ID NO: 8451914 - DNA, 20 bp, Homo sapiens
agtgtacagacactagaaat

SEQ ID NO: 8451915 - DNA, 20 bp, Homo sapiens
agtgtacagacactagaaat

SEQ ID NO: 8451916 - DNA, 22 bp, Homo sapiens
agtgtacactaaatgaatacaa

SEQ ID NO: 8451917 - DNA, 22 bp, Homo sapiens
agtgtacatcagaacatatcaa

SEQ ID NO: 8451918 - DNA, 22 bp, Homo sapiens
agtgtacatcagaacatatcaa

SEQ ID NO: 8451919 - DNA, 22 bp, Homo sapiens
agtgtagaaggagaaatggatc

SEQ ID NO: 8451920 - DNA, 22 bp, Homo sapiens
agtgtacatgtttacagcatct

SEQ ID NO: 8451921 - DNA, 22 bp, Homo sapiens
agtgtagatgaaattaaaccca

SEQ ID NO: 8451922 - DNA, 22 bp, Homo sapiens
agtgtagacataggtctggtct

SEQ ID NO: 8451923 - DNA, 22 bp, Homo sapiens
agtgttcttgtttctaagcaaa

SEQ ID NO: 8451924 - DNA, 23 bp, Homo sapiens
agtgttgagcagatgcaaaggtt

SEQ ID NO: 8451925 - DNA, 22 bp, Homo sapiens
agtgttcttcctatctgctgtt

SEQ ID NO: 8451926 - DNA, 22 bp, Homo sapiens
actggctttgcctctgcctctc

SEQ ID NO: 8451927 - DNA, 22 bp, Homo sapiens
agtgtttaccccaatcagttta

SEQ ID NO: 8451928 - DNA, 22 bp, Homo sapiens
agtgtttaccccaatcagttta

SEQ ID NO: 8451929 - DNA, 20 bp, Homo sapiens
agtgtttagaatactattat

SEQ ID NO: 8451930 - DNA, 22 bp, Homo sapiens
actggaaagtattctttcactg

SEQ ID NO: 8451931 - DNA, 22 bp, Homo sapiens
agtgtattaagttatgaagtta

SEQ ID NO: 8451932 - DNA, 22 bp, Homo sapiens
agtgtattaatgctccaggagt

SEQ ID NO: 8451933 - DNA, 22 bp, Homo sapiens
agtgtattatcagaaactgtgg

SEQ ID NO: 8451934 - DNA, 22 bp, Homo sapiens
agtgtattacagaactgacatt

SEQ ID NO: 8451935 - DNA, 22 bp, Homo sapiens
agtgcagtgatgaataatggtt

SEQ ID NO: 8451936 - DNA, 22 bp, Homo sapiens
agtgcaggttaaggaactggcc

SEQ ID NO: 8451937 - DNA, 22 bp, Homo sapiens
agtgcagggggaaagggtgtct

SEQ ID NO: 8451938 - DNA, 22 bp, Homo sapiens
agtgcacaacatgcaggtttgt

SEQ ID NO: 8451939 - DNA, 22 bp, Homo sapiens
agtgcagggggaaagggtgtct

SEQ ID NO: 8451940 - DNA, 23 bp, Homo sapiens
actctgtaggctgtccatgtgca

SEQ ID NO: 8451941 - DNA, 20 bp, Homo sapiens
actctgtactgtcaatgttg

SEQ ID NO: 8451942 - DNA, 22 bp, Homo sapiens
actctgtagatgtggaaatgcg

SEQ ID NO: 8451943 - DNA, 22 bp, Homo sapiens
actctgtagagtataccaatgt

SEQ ID NO: 8451944 - DNA, 22 bp, Homo sapiens
actctgtagatctcccgggagc

SEQ ID NO: 8451945 - DNA, 22 bp, Homo sapiens
actctgtagcctgtaagagagc

SEQ ID NO: 8451946 - DNA, 22 bp, Homo sapiens
actctgtagggacggttctccc

SEQ ID NO: 8451947 - DNA, 20 bp, Homo sapiens
actctgtaggtaatgagact

SEQ ID NO: 8451948 - DNA, 21 bp, Homo sapiens
actctgtcttgagccatctgt

SEQ ID NO: 8451949 - DNA, 22 bp, Homo sapiens
actctgtatccctctcaaattg

SEQ ID NO: 8451950 - DNA, 22 bp, Homo sapiens
actctgtgaagatgcaggcttg

SEQ ID NO: 8451951 - DNA, 22 bp, Homo sapiens
actctgtgttttggtggcagca

SEQ ID NO: 8451952 - DNA, 22 bp, Homo sapiens
actctgtgtgagtagagcctgt

SEQ ID NO: 8451953 - DNA, 22 bp, Homo sapiens
actctgtgccaggcactttggg

SEQ ID NO: 8451954 - DNA, 23 bp, Homo sapiens
agtgcatgcttgacttagcaagc

SEQ ID NO: 8451955 - DNA, 20 bp, Homo sapiens
agtgcatggagggagagggc

SEQ ID NO: 8451956 - DNA, 22 bp, Homo sapiens
agtgcatgtccagtagtttatg

SEQ ID NO: 8451957 - DNA, 22 bp, Homo sapiens
agtgcatgcgcttgggaggggt

SEQ ID NO: 8451958 - DNA, 22 bp, Homo sapiens
actgaggacagtgaggagggct

SEQ ID NO: 8451959 - DNA, 22 bp, Homo sapiens
actgaggagaaatttgagtgaa

SEQ ID NO: 8451960 - DNA, 22 bp, Homo sapiens
actgaggatggataggtcatat

SEQ ID NO: 8451961 - DNA, 22 bp, Homo sapiens
actgaggatggataggtcatat

SEQ ID NO: 8451962 - DNA, 22 bp, Homo sapiens
actgaggattagcccaggctag

SEQ ID NO: 8451963 - DNA, 22 bp, Homo sapiens
actgagggcataaaagtactgt

SEQ ID NO: 8451964 - DNA, 23 bp, Homo sapiens
actgagggccacttccatcgtga

SEQ ID NO: 8451965 - DNA, 22 bp, Homo sapiens
actcaggctgttttttccttgt

SEQ ID NO: 8451966 - DNA, 22 bp, Homo sapiens
agtcccagcttcccccatgcag

SEQ ID NO: 8451967 - DNA, 19 bp, Homo sapiens
agtcccaggcccgaaagag

SEQ ID NO: 8451968 - DNA, 22 bp, Homo sapiens
actcctggtttgtgtcctggct

SEQ ID NO: 8451969 - DNA, 22 bp, Homo sapiens
actcctggtttgtgtcctggct

SEQ ID NO: 8451970 - DNA, 22 bp, Homo sapiens
actcctgtgaggtaggtggcaa

SEQ ID NO: 8451971 - DNA, 22 bp, Homo sapiens
actcctgtgggcatggcacccc

SEQ ID NO: 8451972 - DNA, 22 bp, Homo sapiens
actcctgtgtggctgggaggtt

SEQ ID NO: 8451973 - DNA, 22 bp, Homo sapiens
actcctggttcccagttgagat

SEQ ID NO: 8451974 - DNA, 22 bp, Homo sapiens
actcctggttcccagttgagat

SEQ ID NO: 8451975 - DNA, 22 bp, Homo sapiens
actcctggtgctgatgaagaga

SEQ ID NO: 8451976 - DNA, 22 bp, Homo sapiens
actcctggtgctgatgaagaga

SEQ ID NO: 8451977 - DNA, 22 bp, Homo sapiens
actcctgggttgcagtcctcaa

SEQ ID NO: 8451978 - DNA, 22 bp, Homo sapiens
actcctgggttgcagtcctcaa

SEQ ID NO: 8451979 - DNA, 20 bp, Homo sapiens
actcctggtaacttttgtga

SEQ ID NO: 8451980 - DNA, 20 bp, Homo sapiens
actcctggtaacttttgtga

SEQ ID NO: 8451981 - DNA, 20 bp, Homo sapiens
actcctggtaacttttgtga

SEQ ID NO: 8451982 - DNA, 17 bp, Homo sapiens
actcctggtctgaaggg

SEQ ID NO: 8451983 - DNA, 17 bp, Homo sapiens
actcctggtctgaaggg

SEQ ID NO: 8451984 - DNA, 22 bp, Homo sapiens
actcctgggttctaaatttgaa

SEQ ID NO: 8451985 - DNA, 22 bp, Homo sapiens
actcctgggttctaaatttgaa

SEQ ID NO: 8451986 - DNA, 22 bp, Homo sapiens
actcctgggttccggagattct

SEQ ID NO: 8451987 - DNA, 22 bp, Homo sapiens
actcctgggttccggagattct

SEQ ID NO: 8451988 - DNA, 22 bp, Homo sapiens
actctgtactctagaggaagtg

SEQ ID NO: 8451989 - DNA, 22 bp, Homo sapiens
actctgtactttcttgttgtgt

SEQ ID NO: 8451990 - DNA, 22 bp, Homo sapiens
actctgtaattctgaagcacct

SEQ ID NO: 8451991 - DNA, 22 bp, Homo sapiens
actctgtacgcaagagatggag

SEQ ID NO: 8451992 - DNA, 22 bp, Homo sapiens
agtctttacatgtgttatatat

SEQ ID NO: 8451993 - DNA, 18 bp, Homo sapiens
agtctttaaagatgttac

SEQ ID NO: 8451994 - DNA, 19 bp, Homo sapiens
agtcttgtatttttcaagc

SEQ ID NO: 8451995 - DNA, 22 bp, Homo sapiens
agtcttggctatgcatagagct

SEQ ID NO: 8451996 - DNA, 22 bp, Homo sapiens
agtcttcttgatcttttcagtg

SEQ ID NO: 8451997 - DNA, 22 bp, Homo sapiens
agtcttctgtttttcagcagct

SEQ ID NO: 8451998 - DNA, 22 bp, Homo sapiens
agtcttctgtttttcagcagct

SEQ ID NO: 8451999 - DNA, 22 bp, Homo sapiens
agtcttctttcatttactcagt

SEQ ID NO: 8452000 - DNA, 22 bp, Homo sapiens
agtcttgaaagcacattagagt

SEQ ID NO: 8452001 - DNA, 22 bp, Homo sapiens
agtctgtctaatattattcagg

SEQ ID NO: 8452002 - DNA, 22 bp, Homo sapiens
agtctgtcagtcattctaacaa

SEQ ID NO: 8452003 - DNA, 22 bp, Homo sapiens
agtctggttgattcctttgcac

SEQ ID NO: 8452004 - DNA, 20 bp, Homo sapiens
agtctgtcaatttacagtgg

SEQ ID NO: 8452005 - DNA, 23 bp, Homo sapiens
actcgtggaattctctgcgatcg

SEQ ID NO: 8452006 - DNA, 23 bp, Homo sapiens
actcgtggaattctctgcgatcg

SEQ ID NO: 8452007 - DNA, 23 bp, Homo sapiens
actcgtggaattctctgcgatcg

SEQ ID NO: 8452008 - DNA, 22 bp, Homo sapiens
atacagtaaccacattctatag

SEQ ID NO: 8452009 - DNA, 22 bp, Homo sapiens
atacagtaaccacattctatag

SEQ ID NO: 8452010 - DNA, 22 bp, Homo sapiens
acttctcttccccggaactcta

SEQ ID NO: 8452011 - DNA, 22 bp, Homo sapiens
acttctctttagtactaaatgt

SEQ ID NO: 8452012 - DNA, 22 bp, Homo sapiens
atacaggttctctagggaacag

SEQ ID NO: 8452013 - DNA, 22 bp, Homo sapiens
atacagtaaccacattctatag

SEQ ID NO: 8452014 - DNA, 22 bp, Homo sapiens
atacaggtgtacacacatgcaa

SEQ ID NO: 8452015 - DNA, 22 bp, Homo sapiens
atacaggtggacttcagttagt

SEQ ID NO: 8452016 - DNA, 22 bp, Homo sapiens
acttctgattaaggatgaatgc

SEQ ID NO: 8452017 - DNA, 22 bp, Homo sapiens
acttctgagaaatttaaggaca

SEQ ID NO: 8452018 - DNA, 22 bp, Homo sapiens
atacagcagtgaataagataaa

SEQ ID NO: 8452019 - DNA, 22 bp, Homo sapiens
atacagggacatccagtttttc

SEQ ID NO: 8452020 - DNA, 22 bp, Homo sapiens
atacaggtaatttgaataatag

SEQ ID NO: 8452021 - DNA, 22 bp, Homo sapiens
atacaggtaggggacatacatc

SEQ ID NO: 8452022 - DNA, 22 bp, Homo sapiens
atacacttgtacattttttaat

SEQ ID NO: 8452023 - DNA, 22 bp, Homo sapiens
atacagatgttaaagcaatttc

SEQ ID NO: 8452024 - DNA, 22 bp, Homo sapiens
atacagatgttgaatgttatat

SEQ ID NO: 8452025 - DNA, 22 bp, Homo sapiens
acttagaacaggcagaattcca

SEQ ID NO: 8452026 - DNA, 22 bp, Homo sapiens
acttagaagatgcagtaaagca

SEQ ID NO: 8452027 - DNA, 22 bp, Homo sapiens
acttagaaagggattctagatt

SEQ ID NO: 8452028 - DNA, 22 bp, Homo sapiens
acttagaaagggattctagatt

SEQ ID NO: 8452029 - DNA, 22 bp, Homo sapiens
acttagaaattcagttttgtca

SEQ ID NO: 8452030 - DNA, 22 bp, Homo sapiens
acttagaacaggcagaattcca

SEQ ID NO: 8452031 - DNA, 22 bp, Homo sapiens
ataatggattcagaaccgtcaa

SEQ ID NO: 8452032 - DNA, 22 bp, Homo sapiens
acttaacagacattatttacct

SEQ ID NO: 8452033 - DNA, 22 bp, Homo sapiens
atacattagaatctggtactca

SEQ ID NO: 8452034 - DNA, 22 bp, Homo sapiens
atacatgttgtaccatatgttt

SEQ ID NO: 8452035 - DNA, 22 bp, Homo sapiens
atacatgttgagaaaatatctg

SEQ ID NO: 8452036 - DNA, 22 bp, Homo sapiens
atacattagctcatatgattaa

SEQ ID NO: 8452037 - DNA, 22 bp, Homo sapiens
atacatctagagtcataaaaac

SEQ ID NO: 8452038 - DNA, 22 bp, Homo sapiens
acttcttgatgaaaatggtact

SEQ ID NO: 8452039 - DNA, 22 bp, Homo sapiens
atacatgttgagaaaatatctg

SEQ ID NO: 8452040 - DNA, 22 bp, Homo sapiens
actttatttcctattgcatcca

SEQ ID NO: 8452041 - DNA, 22 bp, Homo sapiens
atacattcaaaggaaggataga

SEQ ID NO: 8452042 - DNA, 22 bp, Homo sapiens
atactgatgatgtgaagaaaca

SEQ ID NO: 8452043 - DNA, 22 bp, Homo sapiens
atactgattagttgagaaagca

SEQ ID NO: 8452044 - DNA, 22 bp, Homo sapiens
ataatctttcttttccagatag

SEQ ID NO: 8452045 - DNA, 22 bp, Homo sapiens
ataatcttgtatttcctaaagt

SEQ ID NO: 8452046 - DNA, 22 bp, Homo sapiens
actgtgcatttgaagggatcat

SEQ ID NO: 8452047 - DNA, 22 bp, Homo sapiens
actgtgcagtgttgtaacccga

SEQ ID NO: 8452048 - DNA, 22 bp, Homo sapiens
actgtgcatttcatgtcttttc

SEQ ID NO: 8452049 - DNA, 22 bp, Homo sapiens
actgtgcattccccaacctgtg

SEQ ID NO: 8452050 - DNA, 22 bp, Homo sapiens
actgtgcatggtatccttgatg

SEQ ID NO: 8452051 - DNA, 22 bp, Homo sapiens
actgtgcatgaaccgaaacaaa

SEQ ID NO: 8452052 - DNA, 22 bp, Homo sapiens
actgtgcatttgtcatggggtt

SEQ ID NO: 8452053 - DNA, 22 bp, Homo sapiens
actgtgcaccctggacagtgtc

SEQ ID NO: 8452054 - DNA, 22 bp, Homo sapiens
actgtgcaccctggacagtgtc

SEQ ID NO: 8452055 - DNA, 22 bp, Homo sapiens
actgtgcacacaaaaatagatt

SEQ ID NO: 8452056 - DNA, 22 bp, Homo sapiens
actgtgcacacaaaaatagatt

SEQ ID NO: 8452057 - DNA, 22 bp, Homo sapiens
actgtgcaggggaagagagaaa

SEQ ID NO: 8452058 - DNA, 22 bp, Homo sapiens
actgtgcagctgagtgctaatt

SEQ ID NO: 8452059 - DNA, 21 bp, Homo sapiens
actgtgcagcctgaggatgtg

SEQ ID NO: 8452060 - DNA, 22 bp, Homo sapiens
actgtgcagtgttgtaacccga

SEQ ID NO: 8452061 - DNA, 22 bp, Homo sapiens
actgtgcaggtagatgcctggg

SEQ ID NO: 8452062 - DNA, 22 bp, Homo sapiens
actgtgcaggtgaactgtttgc

SEQ ID NO: 8452063 - DNA, 22 bp, Homo sapiens
actgtgcaggtagatgcctggg

SEQ ID NO: 8452064 - DNA, 22 bp, Homo sapiens
actgtgcatgaaccgaaacaaa

SEQ ID NO: 8452065 - DNA, 22 bp, Homo sapiens
actgtgcatgaaccgaaacaaa

SEQ ID NO: 8452066 - DNA, 22 bp, Homo sapiens
actgtgcatctattgccattta

SEQ ID NO: 8452067 - DNA, 22 bp, Homo sapiens
ataaacagcctgcccaaattgg

SEQ ID NO: 8452068 - DNA, 22 bp, Homo sapiens
actgtgcaatgagtaataaact

SEQ ID NO: 8452069 - DNA, 22 bp, Homo sapiens
actgtgcaatgagtaataaact

SEQ ID NO: 8452070 - DNA, 22 bp, Homo sapiens
actgtgcaatgagtaataaact

SEQ ID NO: 8452071 - DNA, 22 bp, Homo sapiens
actgtgcacaattctaagtcct

SEQ ID NO: 8452072 - DNA, 22 bp, Homo sapiens
actgtgatgtttgtgatcatct

SEQ ID NO: 8452073 - DNA, 22 bp, Homo sapiens
actgtgcaaatgacaggcacac

SEQ ID NO: 8452074 - DNA, 22 bp, Homo sapiens
actgtgcaaatgacaggcacac

SEQ ID NO: 8452075 - DNA, 22 bp, Homo sapiens
actgtgcaagtcaaagatgggc

SEQ ID NO: 8452076 - DNA, 22 bp, Homo sapiens
actgtgatgcagttgccatcca

SEQ ID NO: 8452077 - DNA, 22 bp, Homo sapiens
actgtgatgttctctatcttgg

SEQ ID NO: 8452078 - DNA, 22 bp, Homo sapiens
ataaacaagactggccaacttt

SEQ ID NO: 8452079 - DNA, 22 bp, Homo sapiens
ataaacaagactggccaacttt

SEQ ID NO: 8452080 - DNA, 22 bp, Homo sapiens
ataaacaagactggccaacttt

SEQ ID NO: 8452081 - DNA, 22 bp, Homo sapiens
ataaaatttgctactgttaaat

SEQ ID NO: 8452082 - DNA, 22 bp, Homo sapiens
actgtaacactcatactgaagt

SEQ ID NO: 8452083 - DNA, 22 bp, Homo sapiens
actgtaacacaatggtatctgt

SEQ ID NO: 8452084 - DNA, 22 bp, Homo sapiens
actgtaaattttggttgcaggt

SEQ ID NO: 8452085 - DNA, 22 bp, Homo sapiens
actgtactcttatagccatctg

SEQ ID NO: 8452086 - DNA, 22 bp, Homo sapiens
actgtactcttctagccatctg

SEQ ID NO: 8452087 - DNA, 22 bp, Homo sapiens
actgtagtctaaatatagtctt

SEQ ID NO: 8452088 - DNA, 22 bp, Homo sapiens
actgtagagaatctgagaaaaa

SEQ ID NO: 8452089 - DNA, 22 bp, Homo sapiens
actgggaagacaagaaagatag

SEQ ID NO: 8452090 - DNA, 22 bp, Homo sapiens
actgggaaggaaaggaatgtaa

SEQ ID NO: 8452091 - DNA, 22 bp, Homo sapiens
actgggaatctcaggaacatgg

SEQ ID NO: 8452092 - DNA, 22 bp, Homo sapiens
actgtattctagtcatgtttgt

SEQ ID NO: 8452093 - DNA, 22 bp, Homo sapiens
actgtattggttttctattgct

SEQ ID NO: 8452094 - DNA, 22 bp, Homo sapiens
actgtcaaaagagattatatta

SEQ ID NO: 8452095 - DNA, 22 bp, Homo sapiens
actgtattttgggtgtattttc

SEQ ID NO: 8452096 - DNA, 22 bp, Homo sapiens
actgtattttgtactttcgtgt

SEQ ID NO: 8452097 - DNA, 22 bp, Homo sapiens
actgtcactgacagaatcaaca

SEQ ID NO: 8452098 - DNA, 22 bp, Homo sapiens
actgtcactgtgatgttagaga

SEQ ID NO: 8452099 - DNA, 22 bp, Homo sapiens
actgtcaatgggttcattgagt

SEQ ID NO: 8452100 - DNA, 22 bp, Homo sapiens
actgtcactaactaagtctagt

SEQ ID NO: 8452101 - DNA, 22 bp, Homo sapiens
agaaagttagcagactcttggc

SEQ ID NO: 8452102 - DNA, 22 bp, Homo sapiens
agaaagttagcagactcttggc

SEQ ID NO: 8452103 - DNA, 22 bp, Homo sapiens
agaaagttaaacagtgataaga

SEQ ID NO: 8452104 - DNA, 22 bp, Homo sapiens
agaaagtgtgtcatactaagtg

SEQ ID NO: 8452105 - DNA, 22 bp, Homo sapiens
agaaagtgcttccctttggtga

SEQ ID NO: 8452106 - DNA, 22 bp, Homo sapiens
agaaagtgcttccctttggact

SEQ ID NO: 8452107 - DNA, 22 bp, Homo sapiens
agaaagtgaacgtgttcagttt

SEQ ID NO: 8452108 - DNA, 22 bp, Homo sapiens
agaaagtgaccttgaaaactgg

SEQ ID NO: 8452109 - DNA, 22 bp, Homo sapiens
agaaagtgcctcccttgggagc

SEQ ID NO: 8452110 - DNA, 22 bp, Homo sapiens
agaaagggttctctgaggtgct

SEQ ID NO: 8452111 - DNA, 22 bp, Homo sapiens
agaaagtacagatgagacactt

SEQ ID NO: 8452112 - DNA, 22 bp, Homo sapiens
agaaagggtcactgaaagagga

SEQ ID NO: 8452113 - DNA, 22 bp, Homo sapiens
agaaagggctattttgaggtag

SEQ ID NO: 8452114 - DNA, 22 bp, Homo sapiens
agaaagctggaagagctgggat

SEQ ID NO: 8452115 - DNA, 22 bp, Homo sapiens
agaaagtttgagaactgtagat

SEQ ID NO: 8452116 - DNA, 22 bp, Homo sapiens
agaaagtttggggctgggcacg

SEQ ID NO: 8452117 - DNA, 22 bp, Homo sapiens
agaaagttgttttagccaaacc

SEQ ID NO: 8452118 - DNA, 22 bp, Homo sapiens
agaacactctcctgaaaattaa

SEQ ID NO: 8452119 - DNA, 22 bp, Homo sapiens
agaacactgctagtataatcac

SEQ ID NO: 8452120 - DNA, 18 bp, Homo sapiens
agaacacttggttagatc

SEQ ID NO: 8452121 - DNA, 22 bp, Homo sapiens
agaacagaagggaggaaggcct

SEQ ID NO: 8452122 - DNA, 23 bp, Homo sapiens
atctaatttctccaaatctctac

SEQ ID NO: 8452123 - DNA, 22 bp, Homo sapiens
atctaagattttgctaagatca

SEQ ID NO: 8452124 - DNA, 22 bp, Homo sapiens
atctaagatgtattgagcactt

SEQ ID NO: 8452125 - DNA, 22 bp, Homo sapiens
atctcaaatgattacaccaagc

SEQ ID NO: 8452126 - DNA, 22 bp, Homo sapiens
atctcaaagcatggagcagaat

SEQ ID NO: 8452127 - DNA, 22 bp, Homo sapiens
atctcaaagcatggagcagaat

SEQ ID NO: 8452128 - DNA, 21 bp, Homo sapiens
atctcacagcccagagaagcc

SEQ ID NO: 8452129 - DNA, 22 bp, Homo sapiens
atctaaaaggagctctttatct

SEQ ID NO: 8452130 - DNA, 22 bp, Homo sapiens
atctaaaatgtggttagttggt

SEQ ID NO: 8452131 - DNA, 22 bp, Homo sapiens
atctaaacaggtgttctttaga

SEQ ID NO: 8452132 - DNA, 22 bp, Homo sapiens
atctaaacaggtgttctttaga

SEQ ID NO: 8452133 - DNA, 22 bp, Homo sapiens
atctaaaccctactttctttct

SEQ ID NO: 8452134 - DNA, 22 bp, Homo sapiens
atcgtgcatttttattaaccct

SEQ ID NO: 8452135 - DNA, 22 bp, Homo sapiens
atctaaaaggagctctttatct

SEQ ID NO: 8452136 - DNA, 22 bp, Homo sapiens
atctaagaggatggttggaaat

SEQ ID NO: 8452137 - DNA, 22 bp, Homo sapiens
atctaagagttaacatcaagaa

SEQ ID NO: 8452138 - DNA, 19 bp, Homo sapiens
atctaagagatgggggaaa

SEQ ID NO: 8452139 - DNA, 22 bp, Homo sapiens
atctaagagagagagcatgtct

SEQ ID NO: 8452140 - DNA, 22 bp, Homo sapiens
atctaagacaatgagtgagact

SEQ ID NO: 8452141 - DNA, 22 bp, Homo sapiens
atctaaagtgtttcatgaaaga

SEQ ID NO: 8452142 - DNA, 23 bp, Homo sapiens
atctaaagtgttaaatagctggg

SEQ ID NO: 8452143 - DNA, 22 bp, Homo sapiens
atctaaactatagtacctagtc

SEQ ID NO: 8452144 - DNA, 22 bp, Homo sapiens
atctaaagtgtcataagtagct

SEQ ID NO: 8452145 - DNA, 22 bp, Homo sapiens
atcgcctgttcacacctgtcca

SEQ ID NO: 8452146 - DNA, 18 bp, Homo sapiens
atcctgggagcagacagc

SEQ ID NO: 8452147 - DNA, 22 bp, Homo sapiens
atcctgggcaaagtatgctgtc

SEQ ID NO: 8452148 - DNA, 18 bp, Homo sapiens
atcctgggagcagacagc

SEQ ID NO: 8452149 - DNA, 22 bp, Homo sapiens
atcatcttatctgactcatttt

SEQ ID NO: 8452150 - DNA, 22 bp, Homo sapiens
atcatcttgaaagtctatgttt

SEQ ID NO: 8452151 - DNA, 22 bp, Homo sapiens
agaaaagttttctgagactgac

SEQ ID NO: 8452152 - DNA, 22 bp, Homo sapiens
agaaaagtttaaatcttggcac

SEQ ID NO: 8452153 - DNA, 22 bp, Homo sapiens
agaaaagtgctctagtgagagc

SEQ ID NO: 8452154 - DNA, 21 bp, Homo sapiens
agaaaagtatttgaatcaaga

SEQ ID NO: 8452155 - DNA, 21 bp, Homo sapiens
agaaaagtatttgaatcaaga

SEQ ID NO: 8452156 - DNA, 22 bp, Homo sapiens
atattctataagcagttggaag

SEQ ID NO: 8452157 - DNA, 22 bp, Homo sapiens
atattacataaacatgagtgaa

SEQ ID NO: 8452158 - DNA, 22 bp, Homo sapiens
atattacataaacatgagtgaa

SEQ ID NO: 8452159 - DNA, 22 bp, Homo sapiens
atattacacacggtatcacggg

SEQ ID NO: 8452160 - DNA, 22 bp, Homo sapiens
agaaaataaattgatggtggaa

SEQ ID NO: 8452161 - DNA, 22 bp, Homo sapiens
atatttcatggggttccatact

SEQ ID NO: 8452162 - DNA, 20 bp, Homo sapiens
atatttcaggtagtgtgccc

SEQ ID NO: 8452163 - DNA, 22 bp, Homo sapiens
atatttcaggttttgcaggccg

SEQ ID NO: 8452164 - DNA, 21 bp, Homo sapiens
atatttctcataaggttatgg

SEQ ID NO: 8452165 - DNA, 22 bp, Homo sapiens
agaaagctccccatgagatgat

SEQ ID NO: 8452166 - DNA, 22 bp, Homo sapiens
atatttcagctttacttaggaa

SEQ ID NO: 8452167 - DNA, 21 bp, Homo sapiens
atatttcagatttccgtaatc

SEQ ID NO: 8452168 - DNA, 22 bp, Homo sapiens
atatttcacgtaggttgttttc

SEQ ID NO: 8452169 - DNA, 22 bp, Homo sapiens
atattcttccaaaacatcattt

SEQ ID NO: 8452170 - DNA, 22 bp, Homo sapiens
atattcttccaaaacatcattt

SEQ ID NO: 8452171 - DNA, 22 bp, Homo sapiens
atattcttatccttttctctgt

SEQ ID NO: 8452172 - DNA, 22 bp, Homo sapiens
atatgctttgggattagatcat

SEQ ID NO: 8452173 - DNA, 22 bp, Homo sapiens
atatgcttgggactgatacagt

SEQ ID NO: 8452174 - DNA, 22 bp, Homo sapiens
atatgcttatgatggttaattt

SEQ ID NO: 8452175 - DNA, 22 bp, Homo sapiens
atatgcttatgatgtctcaagt

SEQ ID NO: 8452176 - DNA, 22 bp, Homo sapiens
atatgcttccccttctttttgg

SEQ ID NO: 8452177 - DNA, 22 bp, Homo sapiens
atatgaaagtaagcatgtgtgt

SEQ ID NO: 8452178 - DNA, 22 bp, Homo sapiens
actttctccagaaaaccaagga

SEQ ID NO: 8452179 - DNA, 22 bp, Homo sapiens
atatgaaagtaagcatgtgtgt

SEQ ID NO: 8452180 - DNA, 22 bp, Homo sapiens
actttcaagaacttctttaatg

SEQ ID NO: 8452181 - DNA, 22 bp, Homo sapiens
actttcaagcaagaacactttg

SEQ ID NO: 8452182 - DNA, 22 bp, Homo sapiens
actttccctctcagaactctta

SEQ ID NO: 8452183 - DNA, 22 bp, Homo sapiens
actttcctagacttcagtgaca

SEQ ID NO: 8452184 - DNA, 23 bp, Homo sapiens
actttcccatagcatggcttcct

SEQ ID NO: 8452185 - DNA, 22 bp, Homo sapiens
actttcccacttaatgtattta

SEQ ID NO: 8452186 - DNA, 22 bp, Homo sapiens
actttcctggccctgtcctctg

SEQ ID NO: 8452187 - DNA, 22 bp, Homo sapiens
acagtacaccactgtgtacagt

SEQ ID NO: 8452188 - DNA, 22 bp, Homo sapiens
aggagcagaccgtagtcctgca

SEQ ID NO: 8452189 - DNA, 22 bp, Homo sapiens
acagtatatatagtctaaaagc

SEQ ID NO: 8452190 - DNA, 22 bp, Homo sapiens
aggagcagaccgtagtcctgca

SEQ ID NO: 8452191 - DNA, 22 bp, Homo sapiens
aggagcaaatgatgagacagca

SEQ ID NO: 8452192 - DNA, 22 bp, Homo sapiens
acagtaaaacatttttattagg

SEQ ID NO: 8452193 - DNA, 22 bp, Homo sapiens
acagtaaacaatgcagcaaatt

SEQ ID NO: 8452194 - DNA, 22 bp, Homo sapiens
acagtaaaacatttttattagg

SEQ ID NO: 8452195 - DNA, 22 bp, Homo sapiens
acagtaaaattaagggcagtta

SEQ ID NO: 8452196 - DNA, 22 bp, Homo sapiens
acagtaaaaagccttagaattt

SEQ ID NO: 8452197 - DNA, 22 bp, Homo sapiens
acagtaaagccttctggttgac

SEQ ID NO: 8452198 - DNA, 16 bp, Homo sapiens
acagtaaagctggaca

SEQ ID NO: 8452199 - DNA, 22 bp, Homo sapiens
acagtaaataatgcatgttgat

SEQ ID NO: 8452200 - DNA, 22 bp, Homo sapiens
acagtaaataatgcatgttgat

SEQ ID NO: 8452201 - DNA, 22 bp, Homo sapiens
acagtaaatattaagcctgagt

SEQ ID NO: 8452202 - DNA, 18 bp, Homo sapiens
acagtaaagaaaggaatt

SEQ ID NO: 8452203 - DNA, 22 bp, Homo sapiens
aggacacaggcaggaggagatc

SEQ ID NO: 8452204 - DNA, 22 bp, Homo sapiens
aggacacagctcttcagtaaga

SEQ ID NO: 8452205 - DNA, 21 bp, Homo sapiens
aggacacagagacacctattg

SEQ ID NO: 8452206 - DNA, 22 bp, Homo sapiens
aggacacagactgattgcagca

SEQ ID NO: 8452207 - DNA, 22 bp, Homo sapiens
aggacacacttctgaggtcttt

SEQ ID NO: 8452208 - DNA, 22 bp, Homo sapiens
aggacacagctgctctgcagag

SEQ ID NO: 8452209 - DNA, 20 bp, Homo sapiens
acaggttcattctgtgtgac

SEQ ID NO: 8452210 - DNA, 22 bp, Homo sapiens
acagtgtggtttgagcactggg

SEQ ID NO: 8452211 - DNA, 22 bp, Homo sapiens
acagtgtggtttgagcactggg

SEQ ID NO: 8452212 - DNA, 22 bp, Homo sapiens
acagtgtggtttgagcactggg

SEQ ID NO: 8452213 - DNA, 22 bp, Homo sapiens
acagtgtgtgggaaatgtgact

SEQ ID NO: 8452214 - DNA, 22 bp, Homo sapiens
acagtgtggggtgagatggaac

SEQ ID NO: 8452215 - DNA, 22 bp, Homo sapiens
acagtgtggtgatggcacttgc

SEQ ID NO: 8452216 - DNA, 22 bp, Homo sapiens
acagtgtggaaagtcaacttga

SEQ ID NO: 8452217 - DNA, 23 bp, Homo sapiens
acagtgtctgctgcaagatatct

SEQ ID NO: 8452218 - DNA, 21 bp, Homo sapiens
acagtctccccagatctctcc

SEQ ID NO: 8452219 - DNA, 22 bp, Homo sapiens
acagtctctccacactgcaggg

SEQ ID NO: 8452220 - DNA, 22 bp, Homo sapiens
acagtctcttgcttgaatacta

SEQ ID NO: 8452221 - DNA, 22 bp, Homo sapiens
acagtctcttggaattttcaga

SEQ ID NO: 8452222 - DNA, 22 bp, Homo sapiens
acagtcctagctgcaaagaagt

SEQ ID NO: 8452223 - DNA, 22 bp, Homo sapiens
acagtcaatcagaacagcatgt

SEQ ID NO: 8452224 - DNA, 22 bp, Homo sapiens
acagtcagtatcccaggcaaat

SEQ ID NO: 8452225 - DNA, 19 bp, Homo sapiens
acagtccagctgtttgtac

SEQ ID NO: 8452226 - DNA, 22 bp, Homo sapiens
acagtccagcctagtatgtata

SEQ ID NO: 8452227 - DNA, 22 bp, Homo sapiens
acagtcatagcagcctttgtta

SEQ ID NO: 8452228 - DNA, 20 bp, Homo sapiens
acatagatcagtgattgaca

SEQ ID NO: 8452229 - DNA, 22 bp, Homo sapiens
acatagaagtgatgcttatcca

SEQ ID NO: 8452230 - DNA, 21 bp, Homo sapiens
acatacattatctttttaaaa

SEQ ID NO: 8452231 - DNA, 22 bp, Homo sapiens
acatagaacttcccagtgagca

SEQ ID NO: 8452232 - DNA, 22 bp, Homo sapiens
acatagaacttcccagtgagca

SEQ ID NO: 8452233 - DNA, 22 bp, Homo sapiens
acatagaacttcgatgtctttt

SEQ ID NO: 8452234 - DNA, 22 bp, Homo sapiens
acatagaacttcgatgtctttt

SEQ ID NO: 8452235 - DNA, 22 bp, Homo sapiens
acatagaacttcgatgtctttt

SEQ ID NO: 8452236 - DNA, 22 bp, Homo sapiens
aggcagctagagagtgaaactg

SEQ ID NO: 8452237 - DNA, 22 bp, Homo sapiens
aggcagctagagagtgaaactg

SEQ ID NO: 8452238 - DNA, 22 bp, Homo sapiens
acatagtgttttgagagacagc

SEQ ID NO: 8452239 - DNA, 21 bp, Homo sapiens
acataggcgaatgttcgggag

SEQ ID NO: 8452240 - DNA, 22 bp, Homo sapiens
aggcagctgaccacagtatgat

SEQ ID NO: 8452241 - DNA, 22 bp, Homo sapiens
aggcagctgaggtctggcgccc

SEQ ID NO: 8452242 - DNA, 21 bp, Homo sapiens
aggcagctcaggcccagagag

SEQ ID NO: 8452243 - DNA, 22 bp, Homo sapiens
aggcagctctgtggcctcccag

SEQ ID NO: 8452244 - DNA, 22 bp, Homo sapiens
aggcagctgccctctccttcct

SEQ ID NO: 8452245 - DNA, 22 bp, Homo sapiens
aggcagctgccctctccttcct

SEQ ID NO: 8452246 - DNA, 22 bp, Homo sapiens
aggcagctgaccacagtatgat

SEQ ID NO: 8452247 - DNA, 22 bp, Homo sapiens
aggcagctggaaaactccaggc

SEQ ID NO: 8452248 - DNA, 22 bp, Homo sapiens
acatatttccatgcagcatgtc

SEQ ID NO: 8452249 - DNA, 22 bp, Homo sapiens
acatattgagctctaaaagtac

SEQ ID NO: 8452250 - DNA, 22 bp, Homo sapiens
acatattaactgcactacacta

SEQ ID NO: 8452251 - DNA, 22 bp, Homo sapiens
aggcagctggaggcagagacta

SEQ ID NO: 8452252 - DNA, 22 bp, Homo sapiens
acatatattttcacacatggtt

SEQ ID NO: 8452253 - DNA, 21 bp, Homo sapiens
acagttcatgataactccatc

SEQ ID NO: 8452254 - DNA, 21 bp, Homo sapiens
aggatgccgcaggcggagaag

SEQ ID NO: 8452255 - DNA, 22 bp, Homo sapiens
acagtttatcgattcacctacc

SEQ ID NO: 8452256 - DNA, 22 bp, Homo sapiens
acagtgtgttctgggacctcca

SEQ ID NO: 8452257 - DNA, 22 bp, Homo sapiens
aggatgagagatacatggagca

SEQ ID NO: 8452258 - DNA, 22 bp, Homo sapiens
aggatgagattgctgtgttgta

SEQ ID NO: 8452259 - DNA, 22 bp, Homo sapiens
aggatgagattgctgtgttgta

SEQ ID NO: 8452260 - DNA, 22 bp, Homo sapiens
aggatgagattccagggtcaat

SEQ ID NO: 8452261 - DNA, 22 bp, Homo sapiens
aggatgccttcattgcatggcc

SEQ ID NO: 8452262 - DNA, 21 bp, Homo sapiens
aggatgccgcaggcggagaag

SEQ ID NO: 8452263 - DNA, 22 bp, Homo sapiens
aggatgccttcattgcatggcc

SEQ ID NO: 8452264 - DNA, 22 bp, Homo sapiens
aggatgaggctggacacttctt

SEQ ID NO: 8452265 - DNA, 22 bp, Homo sapiens
aggatgagccgcgcaagctgac

SEQ ID NO: 8452266 - DNA, 22 bp, Homo sapiens
aggatgaggctggcaggtcttg

SEQ ID NO: 8452267 - DNA, 22 bp, Homo sapiens
aggatgaggctggcaggtcttg

SEQ ID NO: 8452268 - DNA, 22 bp, Homo sapiens
acagtttgaataatttagatag

SEQ ID NO: 8452269 - DNA, 22 bp, Homo sapiens
aggcactgggaatatgctgagg

SEQ ID NO: 8452270 - DNA, 17 bp, Homo sapiens
acaggcagatcacctga

SEQ ID NO: 8452271 - DNA, 22 bp, Homo sapiens
acaggcagatgttttagttgta

SEQ ID NO: 8452272 - DNA, 22 bp, Homo sapiens
acaggcagattaagggtaggca

SEQ ID NO: 8452273 - DNA, 14 bp, Homo sapiens
acaggcagatttct

SEQ ID NO: 8452274 - DNA, 22 bp, Homo sapiens
acaggcagcaaaatcagcctca

SEQ ID NO: 8452275 - DNA, 22 bp, Homo sapiens
acaggcagcactaatctctggt

SEQ ID NO: 8452276 - DNA, 22 bp, Homo sapiens
acaggcagcactaatctctggt

SEQ ID NO: 8452277 - DNA, 23 bp, Homo sapiens
acaggcaggcatggccaaatgtg

SEQ ID NO: 8452278 - DNA, 23 bp, Homo sapiens
acaggcaggcatggccaaatgtg

SEQ ID NO: 8452279 - DNA, 22 bp, Homo sapiens
acaggcaggcgggacagcccga

SEQ ID NO: 8452280 - DNA, 22 bp, Homo sapiens
acaggcaggcgggacagcccga

SEQ ID NO: 8452281 - DNA, 22 bp, Homo sapiens
acaggcaggagctccccattcc

SEQ ID NO: 8452282 - DNA, 22 bp, Homo sapiens
acaggcagcgtcattgctgctc

SEQ ID NO: 8452283 - DNA, 22 bp, Homo sapiens
acaggcagcgtcattgctgctc

SEQ ID NO: 8452284 - DNA, 22 bp, Homo sapiens
acaggcagccctctccctggtt

SEQ ID NO: 8452285 - DNA, 22 bp, Homo sapiens
acaggcaggcttcggccagagc

SEQ ID NO: 8452286 - DNA, 22 bp, Homo sapiens
acaggcagggacctcttgagtt

SEQ ID NO: 8452287 - DNA, 22 bp, Homo sapiens
acaggcagggacctcttgagtt

SEQ ID NO: 8452288 - DNA, 22 bp, Homo sapiens
acaggctgttggggtccagggt

SEQ ID NO: 8452289 - DNA, 22 bp, Homo sapiens
acaggcagggaccttggctaag

SEQ ID NO: 8452290 - DNA, 22 bp, Homo sapiens
acaggctgttggggtccagggt

SEQ ID NO: 8452291 - DNA, 22 bp, Homo sapiens
acagggagatatcttcaatatc

SEQ ID NO: 8452292 - DNA, 22 bp, Homo sapiens
acagggagatatcttcaatatc

SEQ ID NO: 8452293 - DNA, 22 bp, Homo sapiens
acagggagatgggtgaaagcgg

SEQ ID NO: 8452294 - DNA, 22 bp, Homo sapiens
acagggagatgggtgaaagcgg

SEQ ID NO: 8452295 - DNA, 22 bp, Homo sapiens
acagggaaggatttagtgggaa

SEQ ID NO: 8452296 - DNA, 22 bp, Homo sapiens
acagggaatggagggatcagta

SEQ ID NO: 8452297 - DNA, 22 bp, Homo sapiens
aggacacacaaagagtgagaac

SEQ ID NO: 8452298 - DNA, 22 bp, Homo sapiens
aggacacacccagctcacgggg

SEQ ID NO: 8452299 - DNA, 22 bp, Homo sapiens
aggacacactgcaagagcctgg

SEQ ID NO: 8452300 - DNA, 22 bp, Homo sapiens
aggacacaccaggtccagctgt

SEQ ID NO: 8452301 - DNA, 22 bp, Homo sapiens
acagggcttttaatcagtagtt

SEQ ID NO: 8452302 - DNA, 22 bp, Homo sapiens
aggaagagcatctttgggtctg

SEQ ID NO: 8452303 - DNA, 22 bp, Homo sapiens
aggaagagcatctttgggtctg

SEQ ID NO: 8452304 - DNA, 23 bp, Homo sapiens
aggaagagagagtgcctctttct

SEQ ID NO: 8452305 - DNA, 22 bp, Homo sapiens
aggaagaatgtttacatatcaa

SEQ ID NO: 8452306 - DNA, 22 bp, Homo sapiens
aggaagaatgtttacatatcaa

SEQ ID NO: 8452307 - DNA, 22 bp, Homo sapiens
aggaagaaatgtgacttcaaac

SEQ ID NO: 8452308 - DNA, 21 bp, Homo sapiens
aggaagaaaggttggaggttg

SEQ ID NO: 8452309 - DNA, 22 bp, Homo sapiens
aggaagaacctaagaaagtctc

SEQ ID NO: 8452310 - DNA, 22 bp, Homo sapiens
aggaagaacctaagaaagtctc

SEQ ID NO: 8452311 - DNA, 22 bp, Homo sapiens
aggaagaacagataatggacgc

SEQ ID NO: 8452312 - DNA, 22 bp, Homo sapiens
aggaagaacagataatggacgc

SEQ ID NO: 8452313 - DNA, 22 bp, Homo sapiens
acagggagccccagcatttcca

SEQ ID NO: 8452314 - DNA, 22 bp, Homo sapiens
acagggagccccagcatttcca

SEQ ID NO: 8452315 - DNA, 22 bp, Homo sapiens
aggaagaaactgagctctgaca

SEQ ID NO: 8452316 - DNA, 22 bp, Homo sapiens
acaggatcgccctgttgcccag

SEQ ID NO: 8452317 - DNA, 22 bp, Homo sapiens
agctggtggagcctttctgttt

SEQ ID NO: 8452318 - DNA, 18 bp, Homo sapiens
agctggtggggagacagc

SEQ ID NO: 8452319 - DNA, 22 bp, Homo sapiens
agctggtgtgccagttccagtt

SEQ ID NO: 8452320 - DNA, 22 bp, Homo sapiens
acaggcacctgccaccacatct

SEQ ID NO: 8452321 - DNA, 21 bp, Homo sapiens
agctggtgtcagagctctggg

SEQ ID NO: 8452322 - DNA, 22 bp, Homo sapiens
agctggtgtcctcctggagctg

SEQ ID NO: 8452323 - DNA, 22 bp, Homo sapiens
agctggtgtcctcctggagctg

SEQ ID NO: 8452324 - DNA, 22 bp, Homo sapiens
agctggtgtcctcctggagctg

SEQ ID NO: 8452325 - DNA, 22 bp, Homo sapiens
agctggtgtgccactgttgggg

SEQ ID NO: 8452326 - DNA, 22 bp, Homo sapiens
agctggtgtgccactgttgggg

SEQ ID NO: 8452327 - DNA, 22 bp, Homo sapiens
acaggaggggcatgaaagacgg

SEQ ID NO: 8452328 - DNA, 22 bp, Homo sapiens
agctggcaatgtaagtccctgg

SEQ ID NO: 8452329 - DNA, 22 bp, Homo sapiens
agctggcacagaccaggagatc

SEQ ID NO: 8452330 - DNA, 19 bp, Homo sapiens
agctggcactagaatccag

SEQ ID NO: 8452331 - DNA, 22 bp, Homo sapiens
agctggcagctctcaggggtac

SEQ ID NO: 8452332 - DNA, 21 bp, Homo sapiens
agctggcagatatggtgtctg

SEQ ID NO: 8452333 - DNA, 22 bp, Homo sapiens
agctgacagtgcatggagggac

SEQ ID NO: 8452334 - DNA, 22 bp, Homo sapiens
agctgagagcccctgccctgtg

SEQ ID NO: 8452335 - DNA, 22 bp, Homo sapiens
agctgagagctgtgtcaagata

SEQ ID NO: 8452336 - DNA, 22 bp, Homo sapiens
agctgagacacttgagagacta

SEQ ID NO: 8452337 - DNA, 22 bp, Homo sapiens
agctgagacacttgagagacta

SEQ ID NO: 8452338 - DNA, 23 bp, Homo sapiens
agctgagaataaggagccgtttg

SEQ ID NO: 8452339 - DNA, 22 bp, Homo sapiens
agctgagaatcttccccagtgt

SEQ ID NO: 8452340 - DNA, 22 bp, Homo sapiens
agctgaagcaacaacaggatgg

SEQ ID NO: 8452341 - DNA, 22 bp, Homo sapiens
agctggaggggccagcaggtgt

SEQ ID NO: 8452342 - DNA, 22 bp, Homo sapiens
agctggaggggccagcaggtgt

SEQ ID NO: 8452343 - DNA, 22 bp, Homo sapiens
agctggaggggccagcaggtgt

SEQ ID NO: 8452344 - DNA, 22 bp, Homo sapiens
acagctgtatccccagagctca

SEQ ID NO: 8452345 - DNA, 22 bp, Homo sapiens
acagctgtattcaagttgcaag

SEQ ID NO: 8452346 - DNA, 22 bp, Homo sapiens
acagctgggtgctgctcagagc

SEQ ID NO: 8452347 - DNA, 22 bp, Homo sapiens
acagctgggtgtcccacttctg

SEQ ID NO: 8452348 - DNA, 22 bp, Homo sapiens
acagctgggtgtcccacttctg

SEQ ID NO: 8452349 - DNA, 22 bp, Homo sapiens
acagctggtgaatgttctctgt

SEQ ID NO: 8452350 - DNA, 21 bp, Homo sapiens
acagctggtgcagggcgggga

SEQ ID NO: 8452351 - DNA, 22 bp, Homo sapiens
acagctggtgaatgttctctgt

SEQ ID NO: 8452352 - DNA, 22 bp, Homo sapiens
acagctggcaggggggcatgaa

SEQ ID NO: 8452353 - DNA, 22 bp, Homo sapiens
acagctgctcacctgtgagccc

SEQ ID NO: 8452354 - DNA, 22 bp, Homo sapiens
acagctggcaggggggcatgaa

SEQ ID NO: 8452355 - DNA, 22 bp, Homo sapiens
acagctgggaactcacacagca

SEQ ID NO: 8452356 - DNA, 22 bp, Homo sapiens
acagctgggaactcacacagca

SEQ ID NO: 8452357 - DNA, 22 bp, Homo sapiens
acagctgggaactcacacagca

SEQ ID NO: 8452358 - DNA, 22 bp, Homo sapiens
acagctgggaatcagctgggga

SEQ ID NO: 8452359 - DNA, 22 bp, Homo sapiens
acatgtttaagtttgttatatg

SEQ ID NO: 8452360 - DNA, 22 bp, Homo sapiens
acatgtttaagtttaatgaaaa

SEQ ID NO: 8452361 - DNA, 22 bp, Homo sapiens
acatgtttaagtttaatgaaaa

SEQ ID NO: 8452362 - DNA, 22 bp, Homo sapiens
acatgtttggctctatgctata

SEQ ID NO: 8452363 - DNA, 19 bp, Homo sapiens
acatgttttgcagaacagc

SEQ ID NO: 8452364 - DNA, 22 bp, Homo sapiens
aggcctctgggtctcctctgac

SEQ ID NO: 8452365 - DNA, 22 bp, Homo sapiens
aggcctcttgtcttcctcacat

SEQ ID NO: 8452366 - DNA, 22 bp, Homo sapiens
aggcctctgggtctcctctgac

SEQ ID NO: 8452367 - DNA, 22 bp, Homo sapiens
aggcctctgtagggccctgaag

SEQ ID NO: 8452368 - DNA, 22 bp, Homo sapiens
aggcctctgttccccatgtttt

SEQ ID NO: 8452369 - DNA, 18 bp, Homo sapiens
aggcctctgtgtgcccag

SEQ ID NO: 8452370 - DNA, 18 bp, Homo sapiens
aggcctctgtgtgcccag

SEQ ID NO: 8452371 - DNA, 22 bp, Homo sapiens
aggcctcttcagggagcatgga

SEQ ID NO: 8452372 - DNA, 22 bp, Homo sapiens
aggcctcttcagggagcatgga

SEQ ID NO: 8452373 - DNA, 22 bp, Homo sapiens
aggcctcttcagggagcatgga

SEQ ID NO: 8452374 - DNA, 21 bp, Homo sapiens
aggcctcttcatggccatgat

SEQ ID NO: 8452375 - DNA, 21 bp, Homo sapiens
aggcctcttcatggccatgat

SEQ ID NO: 8452376 - DNA, 22 bp, Homo sapiens
aggccaggcgagacacccggct

SEQ ID NO: 8452377 - DNA, 22 bp, Homo sapiens
aggccaggcctttctccattcc

SEQ ID NO: 8452378 - DNA, 22 bp, Homo sapiens
aggccaggcctttctccattcc

SEQ ID NO: 8452379 - DNA, 22 bp, Homo sapiens
aggccaggcctttctccattcc

SEQ ID NO: 8452380 - DNA, 22 bp, Homo sapiens
aggccagggcactgctctttag

SEQ ID NO: 8452381 - DNA, 22 bp, Homo sapiens
aggccagggcactgctctttag

SEQ ID NO: 8452382 - DNA, 22 bp, Homo sapiens
aggccagggcactgctctttag

SEQ ID NO: 8452383 - DNA, 22 bp, Homo sapiens
aggccaggcgagacacccggct

SEQ ID NO: 8452384 - DNA, 22 bp, Homo sapiens
aggccaggcgagacacccggct

SEQ ID NO: 8452385 - DNA, 22 bp, Homo sapiens
aggccaggggtgagcacttctg

SEQ ID NO: 8452386 - DNA, 22 bp, Homo sapiens
aggccaggggtgagcacttctg

SEQ ID NO: 8452387 - DNA, 22 bp, Homo sapiens
aggccagggccagattagccac

SEQ ID NO: 8452388 - DNA, 22 bp, Homo sapiens
aggccagggccagattagccac

SEQ ID NO: 8452389 - DNA, 22 bp, Homo sapiens
aggccagggccagattagccac

SEQ ID NO: 8452390 - DNA, 22 bp, Homo sapiens
aggccagggtcccacactcgca

SEQ ID NO: 8452391 - DNA, 22 bp, Homo sapiens
aggccagggtagggcccattgt

SEQ ID NO: 8452392 - DNA, 22 bp, Homo sapiens
acatgtttaagtttaatgaaaa

SEQ ID NO: 8452393 - DNA, 22 bp, Homo sapiens
acatgttaaacatcatggaatg

SEQ ID NO: 8452394 - DNA, 22 bp, Homo sapiens
acatgttagaaatgcagaatct

SEQ ID NO: 8452395 - DNA, 23 bp, Homo sapiens
acatcatgatagccaacttggga

SEQ ID NO: 8452396 - DNA, 22 bp, Homo sapiens
acatccaccacatgccaggctc

SEQ ID NO: 8452397 - DNA, 22 bp, Homo sapiens
acatattttgaaagctttctaa

SEQ ID NO: 8452398 - DNA, 22 bp, Homo sapiens
acatcacagagcccagataaag

SEQ ID NO: 8452399 - DNA, 22 bp, Homo sapiens
acatgccagcactgcttttcag

SEQ ID NO: 8452400 - DNA, 22 bp, Homo sapiens
acatgccaatttggttagttca

SEQ ID NO: 8452401 - DNA, 22 bp, Homo sapiens
acatgccagcccatttaaatgg

SEQ ID NO: 8452402 - DNA, 22 bp, Homo sapiens
acatgccagcctcagcagcagt

SEQ ID NO: 8452403 - DNA, 22 bp, Homo sapiens
acatgcataagcctagccatca

SEQ ID NO: 8452404 - DNA, 22 bp, Homo sapiens
acatgctatgagagattacttc

SEQ ID NO: 8452405 - DNA, 22 bp, Homo sapiens
acatgctaatggagatgccaag

SEQ ID NO: 8452406 - DNA, 22 bp, Homo sapiens
acatgccatgaaggtatttttg

SEQ ID NO: 8452407 - DNA, 22 bp, Homo sapiens
acatgccatggttgtttgctgc

SEQ ID NO: 8452408 - DNA, 22 bp, Homo sapiens
acatgccagcctcagcagcagt

SEQ ID NO: 8452409 - DNA, 22 bp, Homo sapiens
acatgccatcactttcattcct

SEQ ID NO: 8452410 - DNA, 22 bp, Homo sapiens
acatgccatctttgtcaggagt

SEQ ID NO: 8452411 - DNA, 22 bp, Homo sapiens
acatgctgtcctgtctttgtca

SEQ ID NO: 8452412 - DNA, 22 bp, Homo sapiens
acatgctctccaaggacagagc

SEQ ID NO: 8452413 - DNA, 22 bp, Homo sapiens
acatgcttttcccacaattata

SEQ ID NO: 8452414 - DNA, 22 bp, Homo sapiens
acattgatgtgatgcagaagtg

SEQ ID NO: 8452415 - DNA, 22 bp, Homo sapiens
aggctgagaaagtgggaagatg

SEQ ID NO: 8452416 - DNA, 22 bp, Homo sapiens
aggctgagactgtgcattagtg

SEQ ID NO: 8452417 - DNA, 22 bp, Homo sapiens
aggctgagaaagtgggaagatg

SEQ ID NO: 8452418 - DNA, 22 bp, Homo sapiens
aggctgaaaacgagatggcaat

SEQ ID NO: 8452419 - DNA, 22 bp, Homo sapiens
aggctgaaaacgagatggcaat

SEQ ID NO: 8452420 - DNA, 22 bp, Homo sapiens
aggctctttgagactacctgga

SEQ ID NO: 8452421 - DNA, 22 bp, Homo sapiens
aggctctggctactacagagct

SEQ ID NO: 8452422 - DNA, 22 bp, Homo sapiens
aggctctggctactacagagct

SEQ ID NO: 8452423 - DNA, 18 bp, Homo sapiens
aggcctgcccagcactgt

SEQ ID NO: 8452424 - DNA, 22 bp, Homo sapiens
acattgtagacttttcatatgt

SEQ ID NO: 8452425 - DNA, 22 bp, Homo sapiens
acatttctagttgttcatctcc

SEQ ID NO: 8452426 - DNA, 22 bp, Homo sapiens
acatttcgtgctctgttttgtt

SEQ ID NO: 8452427 - DNA, 22 bp, Homo sapiens
acatttctaatttaatgtaaca

SEQ ID NO: 8452428 - DNA, 22 bp, Homo sapiens
acatttgagatgccttttaggt

SEQ ID NO: 8452429 - DNA, 22 bp, Homo sapiens
acatttgactgtagatacttgc

SEQ ID NO: 8452430 - DNA, 22 bp, Homo sapiens
acatttcttttcatctctatat

SEQ ID NO: 8452431 - DNA, 22 bp, Homo sapiens
aggctgagctggtagtgagtac

SEQ ID NO: 8452432 - DNA, 22 bp, Homo sapiens
aggctgaggagggatgttgctt

SEQ ID NO: 8452433 - DNA, 22 bp, Homo sapiens
aggctgaggagggatgttgctt

SEQ ID NO: 8452434 - DNA, 22 bp, Homo sapiens
aggctgagctggcccttgaaat

SEQ ID NO: 8452435 - DNA, 22 bp, Homo sapiens
aggctgagctggcccttgaaat

SEQ ID NO: 8452436 - DNA, 18 bp, Homo sapiens
acatttctatgcttctgg

SEQ ID NO: 8452437 - DNA, 22 bp, Homo sapiens
acatttctcttgatgtctctat

SEQ ID NO: 8452438 - DNA, 22 bp, Homo sapiens
acatttctttgctagacagcag

SEQ ID NO: 8452439 - DNA, 22 bp, Homo sapiens
acatttctttgctagacagcag

SEQ ID NO: 8452440 - DNA, 22 bp, Homo sapiens
acatttctttctattcagtagc

SEQ ID NO: 8452441 - DNA, 22 bp, Homo sapiens
acatttctttctattcagtagc

SEQ ID NO: 8452442 - DNA, 22 bp, Homo sapiens
acccagagcagagcttggcttc

SEQ ID NO: 8452443 - DNA, 22 bp, Homo sapiens
accaggctgtgaagtgagacta

SEQ ID NO: 8452444 - DNA, 22 bp, Homo sapiens
acccagagccagggtcaggagc

SEQ ID NO: 8452445 - DNA, 22 bp, Homo sapiens
accaggctggagtgcagtggcg

SEQ ID NO: 8452446 - DNA, 22 bp, Homo sapiens
accaggcctggctgggcagcca

SEQ ID NO: 8452447 - DNA, 22 bp, Homo sapiens
accaggctccccttggatcctg

SEQ ID NO: 8452448 - DNA, 22 bp, Homo sapiens
accaggctctgccagtgtttac

SEQ ID NO: 8452449 - DNA, 22 bp, Homo sapiens
acccagccacagcattgaggga

SEQ ID NO: 8452450 - DNA, 22 bp, Homo sapiens
acccagccatgttcagttctct

SEQ ID NO: 8452451 - DNA, 22 bp, Homo sapiens
acccagcatgacacctgcacat

SEQ ID NO: 8452452 - DNA, 22 bp, Homo sapiens
acccagcctacaaagctcacct

SEQ ID NO: 8452453 - DNA, 19 bp, Homo sapiens
acccagcccaggagtggca

SEQ ID NO: 8452454 - DNA, 19 bp, Homo sapiens
acccagcccaggagtggca

SEQ ID NO: 8452455 - DNA, 22 bp, Homo sapiens
acccagcccagaatctggggcc

SEQ ID NO: 8452456 - DNA, 22 bp, Homo sapiens
acccagcccagaatctggggcc

SEQ ID NO: 8452457 - DNA, 22 bp, Homo sapiens
acccaggctggcagaggctcct

SEQ ID NO: 8452458 - DNA, 22 bp, Homo sapiens
acccaggctggcagaggctcct

SEQ ID NO: 8452459 - DNA, 22 bp, Homo sapiens
acccaggctggagtgcagtgtc

SEQ ID NO: 8452460 - DNA, 22 bp, Homo sapiens
acccaggctggagtgcagtgtc

SEQ ID NO: 8452461 - DNA, 22 bp, Homo sapiens
acccaggctggagtgcagtgtc

SEQ ID NO: 8452462 - DNA, 22 bp, Homo sapiens
acccaggctggagtgcagtggt

SEQ ID NO: 8452463 - DNA, 22 bp, Homo sapiens
acccaggctggagtgcagtggt

SEQ ID NO: 8452464 - DNA, 22 bp, Homo sapiens
acccaggctggagtgcagtggt

SEQ ID NO: 8452465 - DNA, 22 bp, Homo sapiens
acccaggctggagtgcagtgat

SEQ ID NO: 8452466 - DNA, 22 bp, Homo sapiens
acccaggctggagtgcagtgat

SEQ ID NO: 8452467 - DNA, 22 bp, Homo sapiens
acccaggctggagtgcagtgat

SEQ ID NO: 8452468 - DNA, 22 bp, Homo sapiens
acccaggctggagtgcagtggc

SEQ ID NO: 8452469 - DNA, 22 bp, Homo sapiens
acccaggctggagtgcagtggc

SEQ ID NO: 8452470 - DNA, 22 bp, Homo sapiens
acccaggctggagtgcagtggg

SEQ ID NO: 8452471 - DNA, 22 bp, Homo sapiens
acccaggctggagtgcagtggg

SEQ ID NO: 8452472 - DNA, 22 bp, Homo sapiens
acccaggctggagtgcagtggg

SEQ ID NO: 8452473 - DNA, 22 bp, Homo sapiens
acccaggctggagtgcagtggc

SEQ ID NO: 8452474 - DNA, 22 bp, Homo sapiens
acccaggctggagtgcagtgac

SEQ ID NO: 8452475 - DNA, 22 bp, Homo sapiens
acccaggctggagtgcagtgac

SEQ ID NO: 8452476 - DNA, 22 bp, Homo sapiens
acccaggctggagtgcagtgac

SEQ ID NO: 8452477 - DNA, 22 bp, Homo sapiens
agggctgccccagtccagccgg

SEQ ID NO: 8452478 - DNA, 22 bp, Homo sapiens
agggctgcctgactccagagcc

SEQ ID NO: 8452479 - DNA, 22 bp, Homo sapiens
agggggctcagcatggatggag

SEQ ID NO: 8452480 - DNA, 22 bp, Homo sapiens
agggggcccttgcaggtgagcg

SEQ ID NO: 8452481 - DNA, 22 bp, Homo sapiens
agggggctcagcaggctctgga

SEQ ID NO: 8452482 - DNA, 22 bp, Homo sapiens
accctccacaccagtcttattt

SEQ ID NO: 8452483 - DNA, 22 bp, Homo sapiens
accctcagtaatcgtgcagttt

SEQ ID NO: 8452484 - DNA, 22 bp, Homo sapiens
agggggctcctccggtgcttcc

SEQ ID NO: 8452485 - DNA, 22 bp, Homo sapiens
acccaggctggcgtgcagtggc

SEQ ID NO: 8452486 - DNA, 22 bp, Homo sapiens
acccaggctggcgtgcagtggc

SEQ ID NO: 8452487 - DNA, 22 bp, Homo sapiens
agggggaggctgtgctgcgtct

SEQ ID NO: 8452488 - DNA, 22 bp, Homo sapiens
agggggcaggagagacctgctg

SEQ ID NO: 8452489 - DNA, 22 bp, Homo sapiens
agggggcaggagagacctgctg

SEQ ID NO: 8452490 - DNA, 22 bp, Homo sapiens
agggggcatcaggtcctggctc

SEQ ID NO: 8452491 - DNA, 22 bp, Homo sapiens
agggggcatcaggtcctggctc

SEQ ID NO: 8452492 - DNA, 18 bp, Homo sapiens
aggcttgggcccagcagc

SEQ ID NO: 8452493 - DNA, 18 bp, Homo sapiens
aggcttgggcccagcagc

SEQ ID NO: 8452494 - DNA, 22 bp, Homo sapiens
aggcttggtgccaaggagcctg

SEQ ID NO: 8452495 - DNA, 22 bp, Homo sapiens
aggcttggttaattctgtgtga

SEQ ID NO: 8452496 - DNA, 20 bp, Homo sapiens
aggcttgtgctttgtcactc

SEQ ID NO: 8452497 - DNA, 18 bp, Homo sapiens
aggcttgggcccagcagc

SEQ ID NO: 8452498 - DNA, 22 bp, Homo sapiens
accagccccaccgggactgcag

SEQ ID NO: 8452499 - DNA, 22 bp, Homo sapiens
accagccccaccgggactgcag

SEQ ID NO: 8452500 - DNA, 22 bp, Homo sapiens
aggcttgtggggaatctgtgtg

SEQ ID NO: 8452501 - DNA, 22 bp, Homo sapiens
accagccagccacagtggctcc

SEQ ID NO: 8452502 - DNA, 22 bp, Homo sapiens
accagccagccacagtggctcc

SEQ ID NO: 8452503 - DNA, 22 bp, Homo sapiens
accagccaccaccaggagatcg

SEQ ID NO: 8452504 - DNA, 19 bp, Homo sapiens
accagcccactcccagttt

SEQ ID NO: 8452505 - DNA, 19 bp, Homo sapiens
accagcccactcccagttt

SEQ ID NO: 8452506 - DNA, 22 bp, Homo sapiens
accagccaagactgcctggaat

SEQ ID NO: 8452507 - DNA, 22 bp, Homo sapiens
accagcatccttcctattaaca

SEQ ID NO: 8452508 - DNA, 22 bp, Homo sapiens
accagcagttatgaggccagga

SEQ ID NO: 8452509 - DNA, 22 bp, Homo sapiens
accagcaggtggcagtatgtat

SEQ ID NO: 8452510 - DNA, 19 bp, Homo sapiens
acatttgtcaagagaaggt

SEQ ID NO: 8452511 - DNA, 22 bp, Homo sapiens
accagcagagttgaggaggaca

SEQ ID NO: 8452512 - DNA, 22 bp, Homo sapiens
agggcagcaatgcagctgctgc

SEQ ID NO: 8452513 - DNA, 22 bp, Homo sapiens
agggcagcaatgcagctgctgc

SEQ ID NO: 8452514 - DNA, 22 bp, Homo sapiens
agggcagcaatgcagctgctgc

SEQ ID NO: 8452515 - DNA, 21 bp, Homo sapiens
agggcagattagctgtaagag

SEQ ID NO: 8452516 - DNA, 21 bp, Homo sapiens
agggcagattagctgtaagag

SEQ ID NO: 8452517 - DNA, 22 bp, Homo sapiens
agggcactttacccatagcttg

SEQ ID NO: 8452518 - DNA, 22 bp, Homo sapiens
accagctccaggcccctgctgg

SEQ ID NO: 8452519 - DNA, 22 bp, Homo sapiens
accagctctctagccctggtcc

SEQ ID NO: 8452520 - DNA, 22 bp, Homo sapiens
accagctcagagcaggctcctg

SEQ ID NO: 8452521 - DNA, 22 bp, Homo sapiens
accagctccaggcccctgctga

SEQ ID NO: 8452522 - DNA, 22 bp, Homo sapiens
agggcacttcagtcagactgag

SEQ ID NO: 8452523 - DNA, 22 bp, Homo sapiens
accagctctggacaggcatttc

SEQ ID NO: 8452524 - DNA, 22 bp, Homo sapiens
accagctcttctgctctagttg

SEQ ID NO: 8452525 - DNA, 19 bp, Homo sapiens
accaggcctcagaggccct

SEQ ID NO: 8452526 - DNA, 22 bp, Homo sapiens
agggcagcacaaggcatggact

SEQ ID NO: 8452527 - DNA, 22 bp, Homo sapiens
agggcagcaatttggttcctgg

SEQ ID NO: 8452528 - DNA, 22 bp, Homo sapiens
agggagagaagttatacaagat

SEQ ID NO: 8452529 - DNA, 22 bp, Homo sapiens
agggagagaagttatacaagat

SEQ ID NO: 8452530 - DNA, 22 bp, Homo sapiens
agggagagaagttatacaagat

SEQ ID NO: 8452531 - DNA, 17 bp, Homo sapiens
accagcctctcctgggg

SEQ ID NO: 8452532 - DNA, 17 bp, Homo sapiens
accagcctctcctgggg

SEQ ID NO: 8452533 - DNA, 17 bp, Homo sapiens
accagcctctcctgggg

SEQ ID NO: 8452534 - DNA, 22 bp, Homo sapiens
accagcctggccaacatggcaa

SEQ ID NO: 8452535 - DNA, 22 bp, Homo sapiens
accagcctcctagctgctcctg

SEQ ID NO: 8452536 - DNA, 22 bp, Homo sapiens
accagcctcctagctgctcctg

SEQ ID NO: 8452537 - DNA, 22 bp, Homo sapiens
accagccctcaggtcagatact

SEQ ID NO: 8452538 - DNA, 22 bp, Homo sapiens
accagccctcaggtcagatact

SEQ ID NO: 8452539 - DNA, 22 bp, Homo sapiens
accagctcagaagccagaaaga

SEQ ID NO: 8452540 - DNA, 22 bp, Homo sapiens
accagcctgtctgagtcgtggg

SEQ ID NO: 8452541 - DNA, 22 bp, Homo sapiens
accagcctggccaacatggtga

SEQ ID NO: 8452542 - DNA, 22 bp, Homo sapiens
accagcctggccaacatggcaa

SEQ ID NO: 8452543 - DNA, 22 bp, Homo sapiens
atagaaaacagatgtccttaaa

SEQ ID NO: 8452544 - DNA, 22 bp, Homo sapiens
atagaaaacagatgtccttaaa

SEQ ID NO: 8452545 - DNA, 22 bp, Homo sapiens
atagaaaacagatgtccttaaa

SEQ ID NO: 8452546 - DNA, 22 bp, Homo sapiens
atagaaaacagatgtccttaaa

SEQ ID NO: 8452547 - DNA, 22 bp, Homo sapiens
atagaaacagggaagcaaagca

SEQ ID NO: 8452548 - DNA, 22 bp, Homo sapiens
atagaatagcatagaaaattga

SEQ ID NO: 8452549 - DNA, 20 bp, Homo sapiens
atagaatcacaagtcctgaa

SEQ ID NO: 8452550 - DNA, 19 bp, Homo sapiens
atagaaagggttaaagaca

SEQ ID NO: 8452551 - DNA, 22 bp, Homo sapiens
ctggccaggctctcacgtggtc

SEQ ID NO: 8452552 - DNA, 22 bp, Homo sapiens
ctggccaggctctcacgtggtc

SEQ ID NO: 8452553 - DNA, 21 bp, Homo sapiens
ctggagcttggtgagaagtgt

SEQ ID NO: 8452554 - DNA, 21 bp, Homo sapiens
ctggagcttggtgagaagtgt

SEQ ID NO: 8452555 - DNA, 22 bp, Homo sapiens
ctggagcttattgggagcagaa

SEQ ID NO: 8452556 - DNA, 22 bp, Homo sapiens
ctggagcttattgggagcagaa

SEQ ID NO: 8452557 - DNA, 22 bp, Homo sapiens
ctggagcttattgggagcagaa

SEQ ID NO: 8452558 - DNA, 17 bp, Homo sapiens
ctggagctgtgtaacct

SEQ ID NO: 8452559 - DNA, 22 bp, Homo sapiens
ctggagctgtcttcacaggcct

SEQ ID NO: 8452560 - DNA, 22 bp, Homo sapiens
ctggccagtgactgctcacccg

SEQ ID NO: 8452561 - DNA, 22 bp, Homo sapiens
ctggccagtgcctgtgggcccc

SEQ ID NO: 8452562 - DNA, 22 bp, Homo sapiens
ctggccaggttttgaacagttg

SEQ ID NO: 8452563 - DNA, 22 bp, Homo sapiens
atagacaacacttattattcct

SEQ ID NO: 8452564 - DNA, 22 bp, Homo sapiens
atagacaatcccccatcctacc

SEQ ID NO: 8452565 - DNA, 22 bp, Homo sapiens
atagacaatggtttgccaagaa

SEQ ID NO: 8452566 - DNA, 22 bp, Homo sapiens
atagacattataacacagagct

SEQ ID NO: 8452567 - DNA, 22 bp, Homo sapiens
atagacatatggctttgtttct

SEQ ID NO: 8452568 - DNA, 22 bp, Homo sapiens
atagacatagccgtaatttatt

SEQ ID NO: 8452569 - DNA, 20 bp, Homo sapiens
atagacaaagacatgccaga

SEQ ID NO: 8452570 - DNA, 22 bp, Homo sapiens
atagacaaacacgaagatgaca

SEQ ID NO: 8452571 - DNA, 22 bp, Homo sapiens
atagaatcctgcagcaagcctt

SEQ ID NO: 8452572 - DNA, 22 bp, Homo sapiens
atagaatctttgtaaaacactt

SEQ ID NO: 8452573 - DNA, 22 bp, Homo sapiens
atagaatcatctgtgcactagt

SEQ ID NO: 8452574 - DNA, 22 bp, Homo sapiens
atagaattacagtgtgtttgga

SEQ ID NO: 8452575 - DNA, 22 bp, Homo sapiens
atagtacaagggaagagtgaag

SEQ ID NO: 8452576 - DNA, 22 bp, Homo sapiens
atagtacaatcagttaattagt

SEQ ID NO: 8452577 - DNA, 22 bp, Homo sapiens
atagtacaatcagttaattagt

SEQ ID NO: 8452578 - DNA, 22 bp, Homo sapiens
atagtacacatcctacaatgtt

SEQ ID NO: 8452579 - DNA, 22 bp, Homo sapiens
atagtacagagggctactggtt

SEQ ID NO: 8452580 - DNA, 22 bp, Homo sapiens
atagtacagatccattaattat

SEQ ID NO: 8452581 - DNA, 22 bp, Homo sapiens
atagtacagagggctactggtt

SEQ ID NO: 8452582 - DNA, 22 bp, Homo sapiens
ataggtgtgtggttcatggccc

SEQ ID NO: 8452583 - DNA, 22 bp, Homo sapiens
atagggctgttgtgaggattaa

SEQ ID NO: 8452584 - DNA, 22 bp, Homo sapiens
atagggctgccatcacagaaga

SEQ ID NO: 8452585 - DNA, 23 bp, Homo sapiens
atagacccaagagtaaaggcatc

SEQ ID NO: 8452586 - DNA, 22 bp, Homo sapiens
atagggcagtcaggccgccact

SEQ ID NO: 8452587 - DNA, 19 bp, Homo sapiens
atagggcaccctaaggagt

SEQ ID NO: 8452588 - DNA, 22 bp, Homo sapiens
atagggcagtggcatctcttaa

SEQ ID NO: 8452589 - DNA, 22 bp, Homo sapiens
atagggcccccgtgggtgctca

SEQ ID NO: 8452590 - DNA, 22 bp, Homo sapiens
atagggcatcctttattgagat

SEQ ID NO: 8452591 - DNA, 22 bp, Homo sapiens
ataggctttgtgttttgttatc

SEQ ID NO: 8452592 - DNA, 22 bp, Homo sapiens
ataggcgtgtttaggaggacgt

SEQ ID NO: 8452593 - DNA, 22 bp, Homo sapiens
ataggcagactctttttggagg

SEQ ID NO: 8452594 - DNA, 22 bp, Homo sapiens
atacatcttgtcagattcatgt

SEQ ID NO: 8452595 - DNA, 22 bp, Homo sapiens
atacatgactcacacattctgc

SEQ ID NO: 8452596 - DNA, 22 bp, Homo sapiens
atacatctctttgaagtgcttt

SEQ ID NO: 8452597 - DNA, 22 bp, Homo sapiens
atacatcttccttttaaaatgc

SEQ ID NO: 8452598 - DNA, 22 bp, Homo sapiens
ctggagctgctgtccttgggtg

SEQ ID NO: 8452599 - DNA, 22 bp, Homo sapiens
ctggagctggcttccttccact

SEQ ID NO: 8452600 - DNA, 22 bp, Homo sapiens
ctggagctggtatagggacaaa

SEQ ID NO: 8452601 - DNA, 22 bp, Homo sapiens
ctggagctggtatagggacaaa

SEQ ID NO: 8452602 - DNA, 22 bp, Homo sapiens
ctggagctgtcttcacaggcct

SEQ ID NO: 8452603 - DNA, 22 bp, Homo sapiens
ctggagctgtcttcacaggcct

SEQ ID NO: 8452604 - DNA, 22 bp, Homo sapiens
atacatgaggctcatttatgtc

SEQ ID NO: 8452605 - DNA, 22 bp, Homo sapiens
atacatgatcactgtattataa

SEQ ID NO: 8452606 - DNA, 22 bp, Homo sapiens
ctggagctgccagggctgccgc

SEQ ID NO: 8452607 - DNA, 22 bp, Homo sapiens
ctggagctgccagggctgccgc

SEQ ID NO: 8452608 - DNA, 22 bp, Homo sapiens
ctggagctggcccaggctggcc

SEQ ID NO: 8452609 - DNA, 22 bp, Homo sapiens
atacatctatgcctttctgaca

SEQ ID NO: 8452610 - DNA, 22 bp, Homo sapiens
atacatctatgcctttctgaca

SEQ ID NO: 8452611 - DNA, 22 bp, Homo sapiens
atacatatatggtacttcctgg

SEQ ID NO: 8452612 - DNA, 22 bp, Homo sapiens
ctggaagaccccccaggactca

SEQ ID NO: 8452613 - DNA, 22 bp, Homo sapiens
ctggaagacgtttgaagccatg

SEQ ID NO: 8452614 - DNA, 22 bp, Homo sapiens
ctggaagaactccagttctgtg

SEQ ID NO: 8452615 - DNA, 22 bp, Homo sapiens
ctggaactcctggggagctggt

SEQ ID NO: 8452616 - DNA, 22 bp, Homo sapiens
atacagaagaactatagccact

SEQ ID NO: 8452617 - DNA, 22 bp, Homo sapiens
atacactttagaaaaacgctgc

SEQ ID NO: 8452618 - DNA, 22 bp, Homo sapiens
ataatttaattttcacagtggt

SEQ ID NO: 8452619 - DNA, 22 bp, Homo sapiens
ataatttaattttcacagtggt

SEQ ID NO: 8452620 - DNA, 22 bp, Homo sapiens
atacagaaaagtggatagccag

SEQ ID NO: 8452621 - DNA, 22 bp, Homo sapiens
atacagaagaactatagccact

SEQ ID NO: 8452622 - DNA, 22 bp, Homo sapiens
ataatggtagatgtccacgcag

SEQ ID NO: 8452623 - DNA, 21 bp, Homo sapiens
ataatgtacaaaaactgtctt

SEQ ID NO: 8452624 - DNA, 22 bp, Homo sapiens
ataatgtaggtatgtgtattta

SEQ ID NO: 8452625 - DNA, 22 bp, Homo sapiens
ataatgtctgcagagccacaca

SEQ ID NO: 8452626 - DNA, 20 bp, Homo sapiens
ataattatttacttttgtgc

SEQ ID NO: 8452627 - DNA, 22 bp, Homo sapiens
ataattacattatactgttaga

SEQ ID NO: 8452628 - DNA, 22 bp, Homo sapiens
ataattaggtcttataacgtct

SEQ ID NO: 8452629 - DNA, 16 bp, Homo sapiens
ataattactgctactt

SEQ ID NO: 8452630 - DNA, 22 bp, Homo sapiens
ataattatctcagacacttgtt

SEQ ID NO: 8452631 - DNA, 20 bp, Homo sapiens
ataattacatagagattgcc

SEQ ID NO: 8452632 - DNA, 22 bp, Homo sapiens
ataagtgactgcagggaattca

SEQ ID NO: 8452633 - DNA, 22 bp, Homo sapiens
ataagcatttcacaggtgtgtt

SEQ ID NO: 8452634 - DNA, 22 bp, Homo sapiens
ataagcctgattcacttgtcat

SEQ ID NO: 8452635 - DNA, 23 bp, Homo sapiens
ataagccttttctttctgcccca

SEQ ID NO: 8452636 - DNA, 22 bp, Homo sapiens
ataagctctggacagccacatt

SEQ ID NO: 8452637 - DNA, 22 bp, Homo sapiens
ctgccctgtggctctgagtcat

SEQ ID NO: 8452638 - DNA, 22 bp, Homo sapiens
ataagtttgtctttgtaaagat

SEQ ID NO: 8452639 - DNA, 22 bp, Homo sapiens
ctgccctgtagctgttctagca

SEQ ID NO: 8452640 - DNA, 22 bp, Homo sapiens
ctgccctgtatcttctcccaat

SEQ ID NO: 8452641 - DNA, 22 bp, Homo sapiens
ctgccctgtatcttctcccaat

SEQ ID NO: 8452642 - DNA, 22 bp, Homo sapiens
ctgccctgtggctctgagtcat

SEQ ID NO: 8452643 - DNA, 22 bp, Homo sapiens
ctgccctgtggctctgagtcat

SEQ ID NO: 8452644 - DNA, 22 bp, Homo sapiens
ctgccctgtctttttctgatga

SEQ ID NO: 8452645 - DNA, 22 bp, Homo sapiens
ctgccctgtgagggtccttggg

SEQ ID NO: 8452646 - DNA, 22 bp, Homo sapiens
ctgccctgtgagggtccttggg

SEQ ID NO: 8452647 - DNA, 22 bp, Homo sapiens
ataataatgaaagccactgtgt

SEQ ID NO: 8452648 - DNA, 22 bp, Homo sapiens
ataataacaatgccagatgcct

SEQ ID NO: 8452649 - DNA, 22 bp, Homo sapiens
ataataacacctgaataggaaa

SEQ ID NO: 8452650 - DNA, 22 bp, Homo sapiens
ataataacacctgaataggaaa

SEQ ID NO: 8452651 - DNA, 22 bp, Homo sapiens
ataataactcctgttgaagaac

SEQ ID NO: 8452652 - DNA, 22 bp, Homo sapiens
ctgcctgcttttctgggagccg

SEQ ID NO: 8452653 - DNA, 22 bp, Homo sapiens
ctgcctgcttctgagccagagg

SEQ ID NO: 8452654 - DNA, 22 bp, Homo sapiens
ctgcctgctgcctgtggagggt

SEQ ID NO: 8452655 - DNA, 20 bp, Homo sapiens
agttttcagcagaacaccca

SEQ ID NO: 8452656 - DNA, 22 bp, Homo sapiens
ctgccctctagggatgcactgg

SEQ ID NO: 8452657 - DNA, 22 bp, Homo sapiens
ctgccctctagggatgcactgg

SEQ ID NO: 8452658 - DNA, 22 bp, Homo sapiens
ctgccctctagaggaggactga

SEQ ID NO: 8452659 - DNA, 22 bp, Homo sapiens
ctgccctgacctgcctcagagt

SEQ ID NO: 8452660 - DNA, 22 bp, Homo sapiens
ctgccctgactgaccttttgaa

SEQ ID NO: 8452661 - DNA, 18 bp, Homo sapiens
ctgcccagagcacttgtg

SEQ ID NO: 8452662 - DNA, 18 bp, Homo sapiens
ctgcccagagcatttcat

SEQ ID NO: 8452663 - DNA, 18 bp, Homo sapiens
ctgcccagagcatttcat

SEQ ID NO: 8452664 - DNA, 18 bp, Homo sapiens
ctgccccttctctgagat

SEQ ID NO: 8452665 - DNA, 22 bp, Homo sapiens
ctgccctcgggccctcccatag

SEQ ID NO: 8452666 - DNA, 22 bp, Homo sapiens
ctgagtctgtacgttagccata

SEQ ID NO: 8452667 - DNA, 22 bp, Homo sapiens
ctgagtctcctggggaggtgaa

SEQ ID NO: 8452668 - DNA, 22 bp, Homo sapiens
ctgagtctcccggcagtggagg

SEQ ID NO: 8452669 - DNA, 22 bp, Homo sapiens
agtttcttgaagactgatgttt

SEQ ID NO: 8452670 - DNA, 22 bp, Homo sapiens
agtttctctttgacaccaaaat

SEQ ID NO: 8452671 - DNA, 22 bp, Homo sapiens
agtttcagtgttgacagatggt

SEQ ID NO: 8452672 - DNA, 22 bp, Homo sapiens
agttttattccaatgtgcagca

SEQ ID NO: 8452673 - DNA, 22 bp, Homo sapiens
ctgataggttattttcagtgag

SEQ ID NO: 8452674 - DNA, 20 bp, Homo sapiens
agtttgtgtgtctatgcgct

SEQ ID NO: 8452675 - DNA, 22 bp, Homo sapiens
agttttatgttcacagaaggat

SEQ ID NO: 8452676 - DNA, 22 bp, Homo sapiens
ctgatacaatgctaataaattt

SEQ ID NO: 8452677 - DNA, 22 bp, Homo sapiens
ctgatacactccctaaaatata

SEQ ID NO: 8452678 - DNA, 22 bp, Homo sapiens
ctgatatggatgcctcattgtc

SEQ ID NO: 8452679 - DNA, 22 bp, Homo sapiens
ctgataggatttagtttctgtt

SEQ ID NO: 8452680 - DNA, 18 bp, Homo sapiens
ctgataggggtggcagct

SEQ ID NO: 8452681 - DNA, 22 bp, Homo sapiens
ctgagtggaacataggatgata

SEQ ID NO: 8452682 - DNA, 22 bp, Homo sapiens
agtttcaattcttttcacaaag

SEQ ID NO: 8452683 - DNA, 22 bp, Homo sapiens
agtgttctaacaactgctttca

SEQ ID NO: 8452684 - DNA, 22 bp, Homo sapiens
agtgttcatttattcattcact

SEQ ID NO: 8452685 - DNA, 22 bp, Homo sapiens
agtgttctcagctactagagag

SEQ ID NO: 8452686 - DNA, 22 bp, Homo sapiens
agtttatgtaaaattagtaatg

SEQ ID NO: 8452687 - DNA, 22 bp, Homo sapiens
agtgttagtggctgcagctggt

SEQ ID NO: 8452688 - DNA, 23 bp, Homo sapiens
agtgttcagcatgtagtaaatac

SEQ ID NO: 8452689 - DNA, 22 bp, Homo sapiens
agtgttcactctgtggagccca

SEQ ID NO: 8452690 - DNA, 22 bp, Homo sapiens
agtgttcactctgtggagccca

SEQ ID NO: 8452691 - DNA, 22 bp, Homo sapiens
agtgttcaggatctgaggccag

SEQ ID NO: 8452692 - DNA, 22 bp, Homo sapiens
agtgttcagtgattgtcaaccg

SEQ ID NO: 8452693 - DNA, 22 bp, Homo sapiens
agtgttcagtgattgtcaaccg

SEQ ID NO: 8452694 - DNA, 21 bp, Homo sapiens
agtgttaatggaaattatatt

SEQ ID NO: 8452695 - DNA, 22 bp, Homo sapiens
agtgttaatggtgtatattagg

SEQ ID NO: 8452696 - DNA, 22 bp, Homo sapiens
agtgttactacagactggttaa

SEQ ID NO: 8452697 - DNA, 22 bp, Homo sapiens
agtgttactggttcatgaatct

SEQ ID NO: 8452698 - DNA, 22 bp, Homo sapiens
agtgttaagagaaaattctgct

SEQ ID NO: 8452699 - DNA, 22 bp, Homo sapiens
ctgagaggcggaggttgcagtg

SEQ ID NO: 8452700 - DNA, 22 bp, Homo sapiens
ctgagaggcggaggttgcagtg

SEQ ID NO: 8452701 - DNA, 22 bp, Homo sapiens
ctggtggcatcttgagatggtt

SEQ ID NO: 8452702 - DNA, 22 bp, Homo sapiens
ctggtggcaatgaggcgtcact

SEQ ID NO: 8452703 - DNA, 22 bp, Homo sapiens
ctggggcatcatccattctttc

SEQ ID NO: 8452704 - DNA, 19 bp, Homo sapiens
ctggtcctgactgaggggt

SEQ ID NO: 8452705 - DNA, 22 bp, Homo sapiens
ctggtcctctccagcaggcatt

SEQ ID NO: 8452706 - DNA, 22 bp, Homo sapiens
ctggtccttgacgcgtgggagg

SEQ ID NO: 8452707 - DNA, 22 bp, Homo sapiens
ctggtgctgtagcctgattgag

SEQ ID NO: 8452708 - DNA, 23 bp, Homo sapiens
ctgggctgtcctgaggtcacctc

SEQ ID NO: 8452709 - DNA, 22 bp, Homo sapiens
ctggggaggcagggctgcccct

SEQ ID NO: 8452710 - DNA, 22 bp, Homo sapiens
ctgtatatgtgcatacacacac

SEQ ID NO: 8452711 - DNA, 22 bp, Homo sapiens
ctgtatctgtgttggatgagtt

SEQ ID NO: 8452712 - DNA, 22 bp, Homo sapiens
atattttcactgaaccaaagta

SEQ ID NO: 8452713 - DNA, 22 bp, Homo sapiens
atatttgttgagttcttatgat

SEQ ID NO: 8452714 - DNA, 22 bp, Homo sapiens
ctgtccacatggagaacctggt

SEQ ID NO: 8452715 - DNA, 22 bp, Homo sapiens
ctgtccagcttggctcctgggg

SEQ ID NO: 8452716 - DNA, 22 bp, Homo sapiens
ctgtccagctgaccagagcagc

SEQ ID NO: 8452717 - DNA, 22 bp, Homo sapiens
ctgtattagtccatttgagctg

SEQ ID NO: 8452718 - DNA, 22 bp, Homo sapiens
ctgtatttagttaaaatgctaa

SEQ ID NO: 8452719 - DNA, 22 bp, Homo sapiens
atagtacatgggtgtcctcaca

SEQ ID NO: 8452720 - DNA, 22 bp, Homo sapiens
atagtacagcatttttcctgag

SEQ ID NO: 8452721 - DNA, 22 bp, Homo sapiens
atagtatttccagaaatagtct

SEQ ID NO: 8452722 - DNA, 23 bp, Homo sapiens
atagtcatgtaaaatatttgaag

SEQ ID NO: 8452723 - DNA, 22 bp, Homo sapiens
atagtcagtgtctatatcgttg

SEQ ID NO: 8452724 - DNA, 22 bp, Homo sapiens
atagtcttagatcagataaagt

SEQ ID NO: 8452725 - DNA, 19 bp, Homo sapiens
atatatgtatacaatgtgg

SEQ ID NO: 8452726 - DNA, 22 bp, Homo sapiens
atatattacaaaagaggaagga

SEQ ID NO: 8452727 - DNA, 22 bp, Homo sapiens
atatattttttgagacagagtc

SEQ ID NO: 8452728 - DNA, 22 bp, Homo sapiens
atatattttgcggtcacgtggc

SEQ ID NO: 8452729 - DNA, 22 bp, Homo sapiens
atatattttgcggtcacgtggc

SEQ ID NO: 8452730 - DNA, 22 bp, Homo sapiens
atatcacaggtgtttacctgat

SEQ ID NO: 8452731 - DNA, 22 bp, Homo sapiens
atatcaaacgaagttattttaa

SEQ ID NO: 8452732 - DNA, 22 bp, Homo sapiens
atatcaaaataaacagcatgca

SEQ ID NO: 8452733 - DNA, 22 bp, Homo sapiens
atatattttttgagacagagtc

SEQ ID NO: 8452734 - DNA, 22 bp, Homo sapiens
atatcaaaataaacagcatgca

SEQ ID NO: 8452735 - DNA, 23 bp, Homo sapiens
atatcacacccagtacagtctcc

SEQ ID NO: 8452736 - DNA, 21 bp, Homo sapiens
atatcacaaacatatggtctg

SEQ ID NO: 8452737 - DNA, 23 bp, Homo sapiens
atatcacacccagtacagtctcc

SEQ ID NO: 8452738 - DNA, 22 bp, Homo sapiens
atatcaaagctagtggaaattt

SEQ ID NO: 8452739 - DNA, 22 bp, Homo sapiens
ctgggcctgggaggccaggtct

SEQ ID NO: 8452740 - DNA, 22 bp, Homo sapiens
ctgggcctgggaggccaggtct

SEQ ID NO: 8452741 - DNA, 22 bp, Homo sapiens
ctgggcctggggctgttgagag

SEQ ID NO: 8452742 - DNA, 19 bp, Homo sapiens
ctgggcctgcatggttgtt

SEQ ID NO: 8452743 - DNA, 22 bp, Homo sapiens
ctgggcctgagctctgaagagt

SEQ ID NO: 8452744 - DNA, 22 bp, Homo sapiens
ctgggcctgagctctgaagagt

SEQ ID NO: 8452745 - DNA, 22 bp, Homo sapiens
ctgggcctgccaccatcttagg

SEQ ID NO: 8452746 - DNA, 22 bp, Homo sapiens
ctgggcctgccaccatcttagg

SEQ ID NO: 8452747 - DNA, 22 bp, Homo sapiens
ctgggcctggacgggcagatct

SEQ ID NO: 8452748 - DNA, 22 bp, Homo sapiens
ctgggcctggcgttccaggctg

SEQ ID NO: 8452749 - DNA, 22 bp, Homo sapiens
ctgggcctggacgggcagatct

SEQ ID NO: 8452750 - DNA, 22 bp, Homo sapiens
ctgggcctggagcccacgagcc

SEQ ID NO: 8452751 - DNA, 22 bp, Homo sapiens
ctgggcctggcgttccaggctg

SEQ ID NO: 8452752 - DNA, 22 bp, Homo sapiens
ctgggcctggagcccacgagcc

SEQ ID NO: 8452753 - DNA, 22 bp, Homo sapiens
ctgggccatgggccagcgaggc

SEQ ID NO: 8452754 - DNA, 22 bp, Homo sapiens
ctgggccatctctctgcaagtg

SEQ ID NO: 8452755 - DNA, 22 bp, Homo sapiens
ctgggccatggaagtctctgcc

SEQ ID NO: 8452756 - DNA, 22 bp, Homo sapiens
ctgggcccacaagtggaatcgt

SEQ ID NO: 8452757 - DNA, 22 bp, Homo sapiens
ctgggcccacaagtggaatcgt

SEQ ID NO: 8452758 - DNA, 17 bp, Homo sapiens
ctgggcctctgcccttt

SEQ ID NO: 8452759 - DNA, 17 bp, Homo sapiens
ctgggcctctgcccttt

SEQ ID NO: 8452760 - DNA, 22 bp, Homo sapiens
ctgggcctctcagctcccgcgg

SEQ ID NO: 8452761 - DNA, 22 bp, Homo sapiens
ctgggcctctcagctcccgcgg

SEQ ID NO: 8452762 - DNA, 22 bp, Homo sapiens
ctgggcagttcgctttcgtttt

SEQ ID NO: 8452763 - DNA, 22 bp, Homo sapiens
ctgggccagttatgtctcatct

SEQ ID NO: 8452764 - DNA, 16 bp, Homo sapiens
ctgttacttgactgtt

SEQ ID NO: 8452765 - DNA, 22 bp, Homo sapiens
ctgttacttcaatcttctcccg

SEQ ID NO: 8452766 - DNA, 22 bp, Homo sapiens
ctgttagtgatcaaagggagag

SEQ ID NO: 8452767 - DNA, 22 bp, Homo sapiens
ctgttagtcttttgcaggagag

SEQ ID NO: 8452768 - DNA, 22 bp, Homo sapiens
ctgttactgtatttaatcatct

SEQ ID NO: 8452769 - DNA, 22 bp, Homo sapiens
ctgttactgttggcccagggtg

SEQ ID NO: 8452770 - DNA, 22 bp, Homo sapiens
ctgttactggacgcacgcagct

SEQ ID NO: 8452771 - DNA, 22 bp, Homo sapiens
ctgttactgctggagccattga

SEQ ID NO: 8452772 - DNA, 22 bp, Homo sapiens
ctgttatattggtatatttaca

SEQ ID NO: 8452773 - DNA, 22 bp, Homo sapiens
ctgtttattacgtaattaatat

SEQ ID NO: 8452774 - DNA, 22 bp, Homo sapiens
ctgtttatggaggtaaggcatc

SEQ ID NO: 8452775 - DNA, 20 bp, Homo sapiens
ctgtttattagaagtggatt

SEQ ID NO: 8452776 - DNA, 22 bp, Homo sapiens
ctgtttattctcatctaaaatg

SEQ ID NO: 8452777 - DNA, 22 bp, Homo sapiens
ctgtttattgagcaatctgcca

SEQ ID NO: 8452778 - DNA, 22 bp, Homo sapiens
ctgtttatctaggagttgcagg

SEQ ID NO: 8452779 - DNA, 22 bp, Homo sapiens
ctgtttatctctaacctgttta

SEQ ID NO: 8452780 - DNA, 22 bp, Homo sapiens
ctgttattttataattcaagaa

SEQ ID NO: 8452781 - DNA, 22 bp, Homo sapiens
ctgttatttgagagtgttgaat

SEQ ID NO: 8452782 - DNA, 22 bp, Homo sapiens
atcattactcctgtaaaattgt

SEQ ID NO: 8452783 - DNA, 22 bp, Homo sapiens
ctgtgtccccctcagccaggtg

SEQ ID NO: 8452784 - DNA, 22 bp, Homo sapiens
ctgtgtcccttgtcccagagcc

SEQ ID NO: 8452785 - DNA, 22 bp, Homo sapiens
atcattcagcctaagcaagtac

SEQ ID NO: 8452786 - DNA, 22 bp, Homo sapiens
atcattcagtctctgggacagt

SEQ ID NO: 8452787 - DNA, 22 bp, Homo sapiens
atcattagttgtggaattcttg

SEQ ID NO: 8452788 - DNA, 22 bp, Homo sapiens
atcattagaccaaactagagct

SEQ ID NO: 8452789 - DNA, 22 bp, Homo sapiens
atcattcaaatgatttggaggt

SEQ ID NO: 8452790 - DNA, 22 bp, Homo sapiens
ctgttactgaaatgcaccgtgc

SEQ ID NO: 8452791 - DNA, 22 bp, Homo sapiens
ctgttactcctttggcagatta

SEQ ID NO: 8452792 - DNA, 22 bp, Homo sapiens
ctgttactaatcttttctgcta

SEQ ID NO: 8452793 - DNA, 19 bp, Homo sapiens
ctgtgcaggccgggctgag

SEQ ID NO: 8452794 - DNA, 22 bp, Homo sapiens
ctgtgcctaagatgcatgtctc

SEQ ID NO: 8452795 - DNA, 22 bp, Homo sapiens
ctgtgcagtaggtcagggctgg

SEQ ID NO: 8452796 - DNA, 22 bp, Homo sapiens
ctgtgcctggggggcagagctg

SEQ ID NO: 8452797 - DNA, 20 bp, Homo sapiens
ctgtgcctcctgctagtcct

SEQ ID NO: 8452798 - DNA, 20 bp, Homo sapiens
ctgtgctccgggttcctgga

SEQ ID NO: 8452799 - DNA, 22 bp, Homo sapiens
ctgtgggagcacatgacagata

SEQ ID NO: 8452800 - DNA, 22 bp, Homo sapiens
ctgtgggagcacatgacagata

SEQ ID NO: 8452801 - DNA, 21 bp, Homo sapiens
atcaggctcaaatcatcccaa

SEQ ID NO: 8452802 - DNA, 22 bp, Homo sapiens
cttcattaaccaaaatgcaata

SEQ ID NO: 8452803 - DNA, 22 bp, Homo sapiens
cttcatgtacagttattggaga

SEQ ID NO: 8452804 - DNA, 22 bp, Homo sapiens
cttcatgttctgcctgtggaag

SEQ ID NO: 8452805 - DNA, 22 bp, Homo sapiens
cttcatgttctgcctgtggaag

SEQ ID NO: 8452806 - DNA, 17 bp, Homo sapiens
atctggaagctagctga

SEQ ID NO: 8452807 - DNA, 21 bp, Homo sapiens
atctggaagaactggtaagtg

SEQ ID NO: 8452808 - DNA, 22 bp, Homo sapiens
atctggaacaaagcttaggaat

SEQ ID NO: 8452809 - DNA, 22 bp, Homo sapiens
cttcatgctcccatttcctaca

SEQ ID NO: 8452810 - DNA, 22 bp, Homo sapiens
cttcatctttctgagcctcagt

SEQ ID NO: 8452811 - DNA, 22 bp, Homo sapiens
cttcatctttctgagcctcagt

SEQ ID NO: 8452812 - DNA, 22 bp, Homo sapiens
cttcatagggttgtaaggatta

SEQ ID NO: 8452813 - DNA, 23 bp, Homo sapiens
cttcatcaaaagttaacactagt

SEQ ID NO: 8452814 - DNA, 22 bp, Homo sapiens
cttcatagaacagaaatttaat

SEQ ID NO: 8452815 - DNA, 22 bp, Homo sapiens
atctcccaaattagcctcttga

SEQ ID NO: 8452816 - DNA, 22 bp, Homo sapiens
atctcccagccacagcattctt

SEQ ID NO: 8452817 - DNA, 22 bp, Homo sapiens
atctccagttagcagtactgat

SEQ ID NO: 8452818 - DNA, 22 bp, Homo sapiens
atctcccaaactcatttcttca

SEQ ID NO: 8452819 - DNA, 22 bp, Homo sapiens
atctccagtgaggcagattctg

SEQ ID NO: 8452820 - DNA, 22 bp, Homo sapiens
atctccagtcctggtttcctgg

SEQ ID NO: 8452821 - DNA, 22 bp, Homo sapiens
atctccagtgcccaaaggaaat

SEQ ID NO: 8452822 - DNA, 22 bp, Homo sapiens
atctccaggcatttcaagagac

SEQ ID NO: 8452823 - DNA, 22 bp, Homo sapiens
atctccaggcatttcaagagac

SEQ ID NO: 8452824 - DNA, 22 bp, Homo sapiens
atctccaggattttcacactca

SEQ ID NO: 8452825 - DNA, 22 bp, Homo sapiens
atctccagggtgcccttgttct

SEQ ID NO: 8452826 - DNA, 22 bp, Homo sapiens
atctccaggttgtgcctgcgtc

SEQ ID NO: 8452827 - DNA, 22 bp, Homo sapiens
atctccagtatcctagtattgt

SEQ ID NO: 8452828 - DNA, 22 bp, Homo sapiens
atctcagtcaggttgaatttgg

SEQ ID NO: 8452829 - DNA, 22 bp, Homo sapiens
atctcattttggtttctactta

SEQ ID NO: 8452830 - DNA, 22 bp, Homo sapiens
atctcaggggttccttctagag

SEQ ID NO: 8452831 - DNA, 22 bp, Homo sapiens
atctcaggtgaaacttctaggt

SEQ ID NO: 8452832 - DNA, 22 bp, Homo sapiens
atctatttctgctaataacaat

SEQ ID NO: 8452833 - DNA, 22 bp, Homo sapiens
atctatttctgctaataacaat

SEQ ID NO: 8452834 - DNA, 22 bp, Homo sapiens
atctccagctcgcagagctcct

SEQ ID NO: 8452835 - DNA, 22 bp, Homo sapiens
atctccagcagtgcttttgagc

SEQ ID NO: 8452836 - DNA, 22 bp, Homo sapiens
atctccagctggctgtgataaa

SEQ ID NO: 8452837 - DNA, 22 bp, Homo sapiens
atctccaggaagtgtcatttac

SEQ ID NO: 8452838 - DNA, 22 bp, Homo sapiens
atctccagatgcctggaaatga

SEQ ID NO: 8452839 - DNA, 22 bp, Homo sapiens
atctccagaggagtcatggtct

SEQ ID NO: 8452840 - DNA, 22 bp, Homo sapiens
atctccagattgtgatcatcag

SEQ ID NO: 8452841 - DNA, 22 bp, Homo sapiens
atctccagcaatggggagctct

SEQ ID NO: 8452842 - DNA, 22 bp, Homo sapiens
atctccagaatggcttgttaat

SEQ ID NO: 8452843 - DNA, 22 bp, Homo sapiens
atctccagaacatttataaacg

SEQ ID NO: 8452844 - DNA, 22 bp, Homo sapiens
atccttaggtggtgcatcaggg

SEQ ID NO: 8452845 - DNA, 22 bp, Homo sapiens
cttcagcaactttggaatgttt

SEQ ID NO: 8452846 - DNA, 22 bp, Homo sapiens
cttcagaatccagaatcagaat

SEQ ID NO: 8452847 - DNA, 22 bp, Homo sapiens
cttcagaagcctgcagcctttg

SEQ ID NO: 8452848 - DNA, 22 bp, Homo sapiens
cttcagagagtccagggactgc

SEQ ID NO: 8452849 - DNA, 22 bp, Homo sapiens
cttcagagcttgttaaaactgt

SEQ ID NO: 8452850 - DNA, 22 bp, Homo sapiens
cttcagagcatcacttcagctg

SEQ ID NO: 8452851 - DNA, 22 bp, Homo sapiens
cttcagaggggactcaaagtca

SEQ ID NO: 8452852 - DNA, 22 bp, Homo sapiens
cttcagagtgactcagcatctt

SEQ ID NO: 8452853 - DNA, 22 bp, Homo sapiens
ctgtttccccatgccctgactc

SEQ ID NO: 8452854 - DNA, 19 bp, Homo sapiens
agtctggagtaaaaggaat

SEQ ID NO: 8452855 - DNA, 22 bp, Homo sapiens
agtctgtgaacttggcagggaa

SEQ ID NO: 8452856 - DNA, 23 bp, Homo sapiens
agtctgtgcttggtgggagggcc

SEQ ID NO: 8452857 - DNA, 22 bp, Homo sapiens
agtctgtgctgttggtgaggat

SEQ ID NO: 8452858 - DNA, 22 bp, Homo sapiens
agtctgtgactcattggatctc

SEQ ID NO: 8452859 - DNA, 22 bp, Homo sapiens
agtctgtctctgctaatcacta

SEQ ID NO: 8452860 - DNA, 19 bp, Homo sapiens
agtctgtctgctttccctc

SEQ ID NO: 8452861 - DNA, 22 bp, Homo sapiens
agtctgtctttggcttcaccac

SEQ ID NO: 8452862 - DNA, 22 bp, Homo sapiens
agtctgtgaaaagataggaagt

SEQ ID NO: 8452863 - DNA, 22 bp, Homo sapiens
ctcaggagttggaggctacagt

SEQ ID NO: 8452864 - DNA, 22 bp, Homo sapiens
ctcaggagttggaggctacagt

SEQ ID NO: 8452865 - DNA, 22 bp, Homo sapiens
agtctgtgtgaatgtgggcttt

SEQ ID NO: 8452866 - DNA, 22 bp, Homo sapiens
agtctgtgtacctttggccttc

SEQ ID NO: 8452867 - DNA, 22 bp, Homo sapiens
agtctgtgtatattcactgccc

SEQ ID NO: 8452868 - DNA, 22 bp, Homo sapiens
agtctgtgtactgggtttctgt

SEQ ID NO: 8452869 - DNA, 22 bp, Homo sapiens
ctcaggcacgggtcagtgagcg

SEQ ID NO: 8452870 - DNA, 22 bp, Homo sapiens
ctcaggatgtcggtgactattg

SEQ ID NO: 8452871 - DNA, 22 bp, Homo sapiens
ctcaggcacttttgtcacagac

SEQ ID NO: 8452872 - DNA, 18 bp, Homo sapiens
ctcaggcagagaagcttt

SEQ ID NO: 8452873 - DNA, 22 bp, Homo sapiens
ctcaggcacttttgtcacagac

SEQ ID NO: 8452874 - DNA, 22 bp, Homo sapiens
ctcaggcagttctgtagcctcc

SEQ ID NO: 8452875 - DNA, 22 bp, Homo sapiens
ctcaggcagtgccctctggccg

SEQ ID NO: 8452876 - DNA, 22 bp, Homo sapiens
ctcaggcagtgccctctggccg

SEQ ID NO: 8452877 - DNA, 22 bp, Homo sapiens
ctcaggcagtgccctctggccg

SEQ ID NO: 8452878 - DNA, 22 bp, Homo sapiens
agtccaaagcagatgagggcca

SEQ ID NO: 8452879 - DNA, 22 bp, Homo sapiens
agtcattttgctaaatgagggt

SEQ ID NO: 8452880 - DNA, 22 bp, Homo sapiens
agtcatttcccattcttcatat

SEQ ID NO: 8452881 - DNA, 22 bp, Homo sapiens
agtcatttatcttagccattat

SEQ ID NO: 8452882 - DNA, 22 bp, Homo sapiens
agtcattgtatgaagtgtactc

SEQ ID NO: 8452883 - DNA, 22 bp, Homo sapiens
agtcattaattagtaggaaggt

SEQ ID NO: 8452884 - DNA, 22 bp, Homo sapiens
agtctctctcctcgtggtaacc

SEQ ID NO: 8452885 - DNA, 21 bp, Homo sapiens
agtctctctaataaatgcttg

SEQ ID NO: 8452886 - DNA, 20 bp, Homo sapiens
agtctctcccagaatgagca

SEQ ID NO: 8452887 - DNA, 22 bp, Homo sapiens
agtctcttggcattctgaaaca

SEQ ID NO: 8452888 - DNA, 22 bp, Homo sapiens
agtctctcacagaggattctcc

SEQ ID NO: 8452889 - DNA, 22 bp, Homo sapiens
agtctctccacattgttataaa

SEQ ID NO: 8452890 - DNA, 22 bp, Homo sapiens
agtctctttgtataaataggca

SEQ ID NO: 8452891 - DNA, 22 bp, Homo sapiens
agtctcttttggttccaaaaat

SEQ ID NO: 8452892 - DNA, 22 bp, Homo sapiens
agtctgaaccagatggcaaggt

SEQ ID NO: 8452893 - DNA, 22 bp, Homo sapiens
agtctgcaggaccgcgtcacat

SEQ ID NO: 8452894 - DNA, 22 bp, Homo sapiens
agtctgagttagtggaaatgta

SEQ ID NO: 8452895 - DNA, 22 bp, Homo sapiens
agtctgattcagagttggagaa

SEQ ID NO: 8452896 - DNA, 22 bp, Homo sapiens
agtctgaggtaatatttttctc

SEQ ID NO: 8452897 - DNA, 20 bp, Homo sapiens
ctccagtgttcaggggagtg

SEQ ID NO: 8452898 - DNA, 22 bp, Homo sapiens
ctccagtgtctcagagcagatg

SEQ ID NO: 8452899 - DNA, 22 bp, Homo sapiens
ctccagtggcaagtccgggcgg

SEQ ID NO: 8452900 - DNA, 22 bp, Homo sapiens
ctccagtggtgatggggaagaa

SEQ ID NO: 8452901 - DNA, 22 bp, Homo sapiens
ctccagtgcttctagaaaatac

SEQ ID NO: 8452902 - DNA, 22 bp, Homo sapiens
ctccagtgctgtcatcccttcc

SEQ ID NO: 8452903 - DNA, 22 bp, Homo sapiens
ctccagtggcacaaatgggtgc

SEQ ID NO: 8452904 - DNA, 22 bp, Homo sapiens
ctccatatggccctgggacctg

SEQ ID NO: 8452905 - DNA, 22 bp, Homo sapiens
ctccatatgttcagttatgcag

SEQ ID NO: 8452906 - DNA, 22 bp, Homo sapiens
ctccatacttccaacaaacttt

SEQ ID NO: 8452907 - DNA, 22 bp, Homo sapiens
ctccatggaaaaggctgttgtt

SEQ ID NO: 8452908 - DNA, 22 bp, Homo sapiens
agtgacattattttgtgtacta

SEQ ID NO: 8452909 - DNA, 22 bp, Homo sapiens
agtgatttgactcttttattgt

SEQ ID NO: 8452910 - DNA, 21 bp, Homo sapiens
agtgactctgaaccacttgaa

SEQ ID NO: 8452911 - DNA, 22 bp, Homo sapiens
agtgactcacacaaacatgtgt

SEQ ID NO: 8452912 - DNA, 21 bp, Homo sapiens
agtgactatgacattattacc

SEQ ID NO: 8452913 - DNA, 22 bp, Homo sapiens
agtgactaaaggttttaatggc

SEQ ID NO: 8452914 - DNA, 22 bp, Homo sapiens
agtgactactggatttgtttct

SEQ ID NO: 8452915 - DNA, 22 bp, Homo sapiens
agtgactactgatttttacttt

SEQ ID NO: 8452916 - DNA, 22 bp, Homo sapiens
agtgacatttgcaccagctgct

SEQ ID NO: 8452917 - DNA, 22 bp, Homo sapiens
agtgaccaatcactgaatgatt

SEQ ID NO: 8452918 - DNA, 22 bp, Homo sapiens
agtgcagagacctggtcaggca

SEQ ID NO: 8452919 - DNA, 22 bp, Homo sapiens
agtgcagatttttagtcagctt

SEQ ID NO: 8452920 - DNA, 22 bp, Homo sapiens
agtgcacaccttagtacaaagt

SEQ ID NO: 8452921 - DNA, 22 bp, Homo sapiens
agtgatttgaggattattgctc

SEQ ID NO: 8452922 - DNA, 22 bp, Homo sapiens
agtgactggttttgacaggaat

SEQ ID NO: 8452923 - DNA, 22 bp, Homo sapiens
ctcccaggttccgacgcctctt

SEQ ID NO: 8452924 - DNA, 21 bp, Homo sapiens
ctcccagggtgactgttcaac

SEQ ID NO: 8452925 - DNA, 22 bp, Homo sapiens
ctcccaggtgtcccttctgcca

SEQ ID NO: 8452926 - DNA, 22 bp, Homo sapiens
ctcccagggtctaggctgctgg

SEQ ID NO: 8452927 - DNA, 22 bp, Homo sapiens
ctcccagggtagggagagacta

SEQ ID NO: 8452928 - DNA, 22 bp, Homo sapiens
ctcccaggggaactatcaagta

SEQ ID NO: 8452929 - DNA, 22 bp, Homo sapiens
agtgcaggagcctggccagagc

SEQ ID NO: 8452930 - DNA, 22 bp, Homo sapiens
agtgcagctccctcacctgctt

SEQ ID NO: 8452931 - DNA, 22 bp, Homo sapiens
ctcctcctggacacaggctgtg

SEQ ID NO: 8452932 - DNA, 22 bp, Homo sapiens
ctcctcctggacacaggctgtg

SEQ ID NO: 8452933 - DNA, 22 bp, Homo sapiens
ctcctcgaagcaacctgcaggc

SEQ ID NO: 8452934 - DNA, 18 bp, Homo sapiens
ctcctccctaagggctca

SEQ ID NO: 8452935 - DNA, 22 bp, Homo sapiens
ctcctcccacggtctcaggaag

SEQ ID NO: 8452936 - DNA, 22 bp, Homo sapiens
ctcctccctctttgccacacat

SEQ ID NO: 8452937 - DNA, 22 bp, Homo sapiens
ctcctccctgcgattgctctgc

SEQ ID NO: 8452938 - DNA, 22 bp, Homo sapiens
ctctgaccattcccttgatttt

SEQ ID NO: 8452939 - DNA, 22 bp, Homo sapiens
agtggctgtcttccaaaatctg

SEQ ID NO: 8452940 - DNA, 22 bp, Homo sapiens
agtggctgtcctggctctaact

SEQ ID NO: 8452941 - DNA, 21 bp, Homo sapiens
agtggctgtcaagggggcctt

SEQ ID NO: 8452942 - DNA, 19 bp, Homo sapiens
agtggctgggcagaagcaa

SEQ ID NO: 8452943 - DNA, 22 bp, Homo sapiens
agtggctggtagttactgagca

SEQ ID NO: 8452944 - DNA, 22 bp, Homo sapiens
agtggctggtctaaggtcacag

SEQ ID NO: 8452945 - DNA, 22 bp, Homo sapiens
agtggctgtactattttttcat

SEQ ID NO: 8452946 - DNA, 22 bp, Homo sapiens
agtggctgtactattttttcat

SEQ ID NO: 8452947 - DNA, 22 bp, Homo sapiens
agtggctggtctaaggtcacag

SEQ ID NO: 8452948 - DNA, 22 bp, Homo sapiens
agtggctgtatcagtcaaccct

SEQ ID NO: 8452949 - DNA, 22 bp, Homo sapiens
agtggctgtaggctatgagaga

SEQ ID NO: 8452950 - DNA, 22 bp, Homo sapiens
ctctgagaggtgagaagcagca

SEQ ID NO: 8452951 - DNA, 22 bp, Homo sapiens
agtggggaagagcatgggccct

SEQ ID NO: 8452952 - DNA, 22 bp, Homo sapiens
agtgggcatatgaagtctcaag

SEQ ID NO: 8452953 - DNA, 22 bp, Homo sapiens
agtgggctgagcttgctgggtg

SEQ ID NO: 8452954 - DNA, 22 bp, Homo sapiens
agtgcaggccccaggccaggcc

SEQ ID NO: 8452955 - DNA, 22 bp, Homo sapiens
agtgcaggccccaggccaggcc

SEQ ID NO: 8452956 - DNA, 22 bp, Homo sapiens
agtgcaggctcgcttgtgaggc

SEQ ID NO: 8452957 - DNA, 22 bp, Homo sapiens
ctctctccttagctgcagacca

SEQ ID NO: 8452958 - DNA, 19 bp, Homo sapiens
agtgcagggagcaccctca

SEQ ID NO: 8452959 - DNA, 22 bp, Homo sapiens
ctctctggcttggcacggagat

SEQ ID NO: 8452960 - DNA, 22 bp, Homo sapiens
ctctctggcttggcacggagat

SEQ ID NO: 8452961 - DNA, 22 bp, Homo sapiens
ctctctgggaatattttattct

SEQ ID NO: 8452962 - DNA, 22 bp, Homo sapiens
ctctctgggaatattttattct

SEQ ID NO: 8452963 - DNA, 22 bp, Homo sapiens
ctctctgggggccatgccaaga

SEQ ID NO: 8452964 - DNA, 22 bp, Homo sapiens
ctctctggggttccagacgtgg

SEQ ID NO: 8452965 - DNA, 22 bp, Homo sapiens
ctctctgggcccagttggcacc

SEQ ID NO: 8452966 - DNA, 22 bp, Homo sapiens
ctctctggggttccagacgtgg

SEQ ID NO: 8452967 - DNA, 22 bp, Homo sapiens
ctctctgggtcctcttttatag

SEQ ID NO: 8452968 - DNA, 22 bp, Homo sapiens
ctctctgggtcctcttttatag

SEQ ID NO: 8452969 - DNA, 18 bp, Homo sapiens
ctctctgggtgaggacaa

SEQ ID NO: 8452970 - DNA, 22 bp, Homo sapiens
ctctctggtacatagagtttgg

SEQ ID NO: 8452971 - DNA, 22 bp, Homo sapiens
agtggcagccgagcaggagatg

SEQ ID NO: 8452972 - DNA, 22 bp, Homo sapiens
ctctctggtcccagattccaga

SEQ ID NO: 8452973 - DNA, 22 bp, Homo sapiens
agtggcaggatctcggttcact

SEQ ID NO: 8452974 - DNA, 22 bp, Homo sapiens
agtggcagctgtcatgccctag

SEQ ID NO: 8452975 - DNA, 22 bp, Homo sapiens
agtggcagctgtcatgccctag

SEQ ID NO: 8452976 - DNA, 22 bp, Homo sapiens
agtggctgaatatattttacta

SEQ ID NO: 8452977 - DNA, 22 bp, Homo sapiens
agtggctgaagcatcaaaggca

SEQ ID NO: 8452978 - DNA, 22 bp, Homo sapiens
agtggctggacgacaagggtga

SEQ ID NO: 8452979 - DNA, 22 bp, Homo sapiens
agtggctgacaactgggttaac

SEQ ID NO: 8452980 - DNA, 23 bp, Homo sapiens
agtggctggacagactttcctgg

SEQ ID NO: 8452981 - DNA, 22 bp, Homo sapiens
agtggctggagccccaggctgg

SEQ ID NO: 8452982 - DNA, 22 bp, Homo sapiens
agtggctggacgacaagggtga

SEQ ID NO: 8452983 - DNA, 22 bp, Homo sapiens
agtggctggagccccaggctgg

SEQ ID NO: 8452984 - DNA, 22 bp, Homo sapiens
agtggctggcataggaacagac

SEQ ID NO: 8452985 - DNA, 22 bp, Homo sapiens
agtggctggcataggaacagac

SEQ ID NO: 8452986 - DNA, 19 bp, Homo sapiens
agtggctgggcagaagcaa

SEQ ID NO: 8452987 - DNA, 22 bp, Homo sapiens
ctcttaaagaatgttccagctg

SEQ ID NO: 8452988 - DNA, 22 bp, Homo sapiens
agtgtctgccagctgccaggtg

SEQ ID NO: 8452989 - DNA, 22 bp, Homo sapiens
ctcttaaagcttccagtttcaa

SEQ ID NO: 8452990 - DNA, 22 bp, Homo sapiens
ctcttagaaagaaacacactgg

SEQ ID NO: 8452991 - DNA, 22 bp, Homo sapiens
ctcttagagagttgttgatcag

SEQ ID NO: 8452992 - DNA, 22 bp, Homo sapiens
ctcttagaaactatagagatta

SEQ ID NO: 8452993 - DNA, 22 bp, Homo sapiens
agtgtctgatgcacagttgtcc

SEQ ID NO: 8452994 - DNA, 22 bp, Homo sapiens
agtgtctgatgcacagttgtcc

SEQ ID NO: 8452995 - DNA, 22 bp, Homo sapiens
agtgtctgagccagaattagaa

SEQ ID NO: 8452996 - DNA, 22 bp, Homo sapiens
agtgtctgagctatcattaggg

SEQ ID NO: 8452997 - DNA, 20 bp, Homo sapiens
agtggggagtcaggagtgcc

SEQ ID NO: 8452998 - DNA, 20 bp, Homo sapiens
agtggggagtcaggagtgcc

SEQ ID NO: 8452999 - DNA, 20 bp, Homo sapiens
agtggggagtcaggagtgcc

SEQ ID NO: 8453000 - DNA, 22 bp, Homo sapiens
agtggggaagattttgcagtca

SEQ ID NO: 8453001 - DNA, 22 bp, Homo sapiens
agtggggaagagcatgggccct

SEQ ID NO: 8453002 - DNA, 22 bp, Homo sapiens
agtggggacaatgagagcaggt

SEQ ID NO: 8453003 - DNA, 22 bp, Homo sapiens
agtggggacaatgagagcaggt

SEQ ID NO: 8453004 - DNA, 22 bp, Homo sapiens
ctgaagccacgatagcttccta

SEQ ID NO: 8453005 - DNA, 22 bp, Homo sapiens
ctgaagcatgcgtttgtaaact

SEQ ID NO: 8453006 - DNA, 22 bp, Homo sapiens
ctgaagcagggagtgatgaagt

SEQ ID NO: 8453007 - DNA, 22 bp, Homo sapiens
ctgagaggcggagcttgcagtg

SEQ ID NO: 8453008 - DNA, 22 bp, Homo sapiens
ctgagaggcagccagagaaaat

SEQ ID NO: 8453009 - DNA, 22 bp, Homo sapiens
ctgagaggcggagcttgcagtg

SEQ ID NO: 8453010 - DNA, 22 bp, Homo sapiens
ctgagaggcggagcttgcagtg

SEQ ID NO: 8453011 - DNA, 22 bp, Homo sapiens
ctgagaggaacatcttatgctt

SEQ ID NO: 8453012 - DNA, 22 bp, Homo sapiens
ctgagaggaacatcttatgctt

SEQ ID NO: 8453013 - DNA, 22 bp, Homo sapiens
ctgagaggatgctgcagtggag

SEQ ID NO: 8453014 - DNA, 22 bp, Homo sapiens
ctgagaggatgctgcagtggag

SEQ ID NO: 8453015 - DNA, 22 bp, Homo sapiens
agtgtgggggctttggtgtcac

SEQ ID NO: 8453016 - DNA, 22 bp, Homo sapiens
agtgtgggggctttggtgtcac

SEQ ID NO: 8453017 - DNA, 21 bp, Homo sapiens
agtgtgtgataggcaggaaga

SEQ ID NO: 8453018 - DNA, 21 bp, Homo sapiens
agtgtgtgtggaatgagaata

SEQ ID NO: 8453019 - DNA, 22 bp, Homo sapiens
agtgtgtttggagcgagggagg

SEQ ID NO: 8453020 - DNA, 22 bp, Homo sapiens
agtgtgtttaggctgcgggttg

SEQ ID NO: 8453021 - DNA, 22 bp, Homo sapiens
agtgtgttctcaatgaaaagaa

SEQ ID NO: 8453022 - DNA, 22 bp, Homo sapiens
ctgaagcaaatgaaacagctct

SEQ ID NO: 8453023 - DNA, 22 bp, Homo sapiens
ctgaagcagatgtggctgagat

SEQ ID NO: 8453024 - DNA, 22 bp, Homo sapiens
ctgaagcaattgagagatgttt

SEQ ID NO: 8453025 - DNA, 22 bp, Homo sapiens
ctgaagcacagcatataaataa

SEQ ID NO: 8453026 - DNA, 20 bp, Homo sapiens
cctttattatttgtatgatg

SEQ ID NO: 8453027 - DNA, 22 bp, Homo sapiens
cctttatgagatcctggggtga

SEQ ID NO: 8453028 - DNA, 22 bp, Homo sapiens
cctttatactaaggcatacaat

SEQ ID NO: 8453029 - DNA, 22 bp, Homo sapiens
cctttagagcaaacgccaccta

SEQ ID NO: 8453030 - DNA, 22 bp, Homo sapiens
cctttagaattctgcccctcct

SEQ ID NO: 8453031 - DNA, 22 bp, Homo sapiens
cctttagatgatctcttggaca

SEQ ID NO: 8453032 - DNA, 21 bp, Homo sapiens
cctttagatttctatgcagtt

SEQ ID NO: 8453033 - DNA, 17 bp, Homo sapiens
aggtttatggtatttga

SEQ ID NO: 8453034 - DNA, 22 bp, Homo sapiens
cctttagaatacagactttcta

SEQ ID NO: 8453035 - DNA, 22 bp, Homo sapiens
aggtttctcctttaaagcatgg

SEQ ID NO: 8453036 - DNA, 22 bp, Homo sapiens
agtaatctgattttatagctat

SEQ ID NO: 8453037 - DNA, 22 bp, Homo sapiens
agtaatcaatttttcggtggat

SEQ ID NO: 8453038 - DNA, 21 bp, Homo sapiens
agtacaaaaattcctttctca

SEQ ID NO: 8453039 - DNA, 21 bp, Homo sapiens
agtacaaaaattcctttctca

SEQ ID NO: 8453040 - DNA, 22 bp, Homo sapiens
agtaatgattatgtacagaatg

SEQ ID NO: 8453041 - DNA, 22 bp, Homo sapiens
agtacaaattatagcgcttgga

SEQ ID NO: 8453042 - DNA, 22 bp, Homo sapiens
agtacaaatgcagccagagtag

SEQ ID NO: 8453043 - DNA, 22 bp, Homo sapiens
agtacaaatgcagccagagtag

SEQ ID NO: 8453044 - DNA, 22 bp, Homo sapiens
agtacaaagtgctcctggttct

SEQ ID NO: 8453045 - DNA, 22 bp, Homo sapiens
agtacaaaggcccttgattact

SEQ ID NO: 8453046 - DNA, 22 bp, Homo sapiens
cgcctgctctgtttccatgtgg

SEQ ID NO: 8453047 - DNA, 22 bp, Homo sapiens
cgcctgctctcactggacagct

SEQ ID NO: 8453048 - DNA, 22 bp, Homo sapiens
agtacaaaggcccttgattact

SEQ ID NO: 8453049 - DNA, 22 bp, Homo sapiens
agtacaaaggcccttgattact

SEQ ID NO: 8453050 - DNA, 22 bp, Homo sapiens
agtacaaactgtttcaaagtag

SEQ ID NO: 8453051 - DNA, 22 bp, Homo sapiens
agtacaaactgtttcaaagtag

SEQ ID NO: 8453052 - DNA, 22 bp, Homo sapiens
agtacaaaatgcagcatcatca

SEQ ID NO: 8453053 - DNA, 22 bp, Homo sapiens
agtacaaaatgcagcatcatca

SEQ ID NO: 8453054 - DNA, 22 bp, Homo sapiens
aggttattctctatctcatccc

SEQ ID NO: 8453055 - DNA, 22 bp, Homo sapiens
aggttacagtgattataggttt

SEQ ID NO: 8453056 - DNA, 19 bp, Homo sapiens
aggttacaggtgtcacaga

SEQ ID NO: 8453057 - DNA, 22 bp, Homo sapiens
aggttccaagaaatcatcagtg

SEQ ID NO: 8453058 - DNA, 22 bp, Homo sapiens
aggtggggttcagtctcagccg

SEQ ID NO: 8453059 - DNA, 22 bp, Homo sapiens
aggtgtctggatgggtgtcctt

SEQ ID NO: 8453060 - DNA, 22 bp, Homo sapiens
cctggtgcccccaagccagctg

SEQ ID NO: 8453061 - DNA, 22 bp, Homo sapiens
cctggtgcccccaagccagctg

SEQ ID NO: 8453062 - DNA, 22 bp, Homo sapiens
cctggtgcccccaagccagctg

SEQ ID NO: 8453063 - DNA, 22 bp, Homo sapiens
cctggtccttacgtcattgctt

SEQ ID NO: 8453064 - DNA, 22 bp, Homo sapiens
aggtgtggctggggcagaggcc

SEQ ID NO: 8453065 - DNA, 22 bp, Homo sapiens
aggtgtggctggggcagaggcc

SEQ ID NO: 8453066 - DNA, 22 bp, Homo sapiens
aggtgtggctggggcagaggcc

SEQ ID NO: 8453067 - DNA, 22 bp, Homo sapiens
aggtgtggcttgaagtctctat

SEQ ID NO: 8453068 - DNA, 19 bp, Homo sapiens
aggtgtgggggctgcagac

SEQ ID NO: 8453069 - DNA, 19 bp, Homo sapiens
aggtgtgggggctgcagac

SEQ ID NO: 8453070 - DNA, 22 bp, Homo sapiens
ctacactttggttgactttgtg

SEQ ID NO: 8453071 - DNA, 20 bp, Homo sapiens
ctacacttggcacctggcat

SEQ ID NO: 8453072 - DNA, 21 bp, Homo sapiens
ctacacagctttctataggaa

SEQ ID NO: 8453073 - DNA, 20 bp, Homo sapiens
ctacacagggttcgctgggc

SEQ ID NO: 8453074 - DNA, 22 bp, Homo sapiens
ctacagaaacactggacatgtg

SEQ ID NO: 8453075 - DNA, 22 bp, Homo sapiens
agtcagtttccctggaaagcag

SEQ ID NO: 8453076 - DNA, 22 bp, Homo sapiens
agtcagtttccctggaaagcag

SEQ ID NO: 8453077 - DNA, 22 bp, Homo sapiens
agtcagttttcttaaagggaag

SEQ ID NO: 8453078 - DNA, 22 bp, Homo sapiens
agtcagttttctccagggggct

SEQ ID NO: 8453079 - DNA, 22 bp, Homo sapiens
agtcagttttaccaatctcagt

SEQ ID NO: 8453080 - DNA, 22 bp, Homo sapiens
agtcagttttctccagggggct

SEQ ID NO: 8453081 - DNA, 22 bp, Homo sapiens
agtcagttcatggctctgtcct

SEQ ID NO: 8453082 - DNA, 22 bp, Homo sapiens
agtcagttaacctcacagcatc

SEQ ID NO: 8453083 - DNA, 18 bp, Homo sapiens
agtcagttgatggggacc

SEQ ID NO: 8453084 - DNA, 19 bp, Homo sapiens
agtcagttctgaggaggaa

SEQ ID NO: 8453085 - DNA, 22 bp, Homo sapiens
agtcagttgtggagatttaact

SEQ ID NO: 8453086 - DNA, 22 bp, Homo sapiens
agtcagttgcagtttatggatg

SEQ ID NO: 8453087 - DNA, 22 bp, Homo sapiens
agtcagttgcaaacatcaggca

SEQ ID NO: 8453088 - DNA, 22 bp, Homo sapiens
agtcagttgcaaacatcaggca

SEQ ID NO: 8453089 - DNA, 22 bp, Homo sapiens
agtcagttaaactttgtaaagt

SEQ ID NO: 8453090 - DNA, 22 bp, Homo sapiens
agtcagttaacctcacagcatc

SEQ ID NO: 8453091 - DNA, 22 bp, Homo sapiens
agtcagtgtagaaagcccaggc

SEQ ID NO: 8453092 - DNA, 22 bp, Homo sapiens
agtcagagttttgaggtgtgac

SEQ ID NO: 8453093 - DNA, 22 bp, Homo sapiens
agtcagagttcttggggagaca

SEQ ID NO: 8453094 - DNA, 22 bp, Homo sapiens
agtcagagaatgttttcatgga

SEQ ID NO: 8453095 - DNA, 22 bp, Homo sapiens
agtcagagcaaactggacagac

SEQ ID NO: 8453096 - DNA, 23 bp, Homo sapiens
agtcagagagtgtgagacaactg

SEQ ID NO: 8453097 - DNA, 22 bp, Homo sapiens
agtcagagcaaactggacagac

SEQ ID NO: 8453098 - DNA, 22 bp, Homo sapiens
agtcagagagctctcagcatag

SEQ ID NO: 8453099 - DNA, 22 bp, Homo sapiens
agtcactttgctactctgcctt

SEQ ID NO: 8453100 - DNA, 22 bp, Homo sapiens
agtcagaatctgcattttaacc

SEQ ID NO: 8453101 - DNA, 22 bp, Homo sapiens
agtcagaattcgatcccaggtc

SEQ ID NO: 8453102 - DNA, 22 bp, Homo sapiens
agtcagacataattctaacatt

SEQ ID NO: 8453103 - DNA, 22 bp, Homo sapiens
agtcagacataattctaacatt

SEQ ID NO: 8453104 - DNA, 22 bp, Homo sapiens
cgcggtggcggcctccagcgcc

SEQ ID NO: 8453105 - DNA, 22 bp, Homo sapiens
cgcctgggagtccacacctgct

SEQ ID NO: 8453106 - DNA, 22 bp, Homo sapiens
cgtgccctgcgcaagtgctgct

SEQ ID NO: 8453107 - DNA, 22 bp, Homo sapiens
cgtgccactgcactctagcctg

SEQ ID NO: 8453108 - DNA, 22 bp, Homo sapiens
cgtgccactgcactctagcctg

SEQ ID NO: 8453109 - DNA, 22 bp, Homo sapiens
cgtgatttctggctttctatat

SEQ ID NO: 8453110 - DNA, 22 bp, Homo sapiens
cgtgagggcatggcagtgagga

SEQ ID NO: 8453111 - DNA, 20 bp, Homo sapiens
ctaaactctgcagatttagt

SEQ ID NO: 8453112 - DNA, 22 bp, Homo sapiens
ctaaacaatgaacaaagcactg

SEQ ID NO: 8453113 - DNA, 22 bp, Homo sapiens
ctaaacaatgaacaaagcactg

SEQ ID NO: 8453114 - DNA, 22 bp, Homo sapiens
cgtggctggggaggtcagccag

SEQ ID NO: 8453115 - DNA, 17 bp, Homo sapiens
cgtggctgagccataga

SEQ ID NO: 8453116 - DNA, 22 bp, Homo sapiens
cgtggcagtggaaggctgggtg

SEQ ID NO: 8453117 - DNA, 20 bp, Homo sapiens
aggtctgattccagaatcag

SEQ ID NO: 8453118 - DNA, 22 bp, Homo sapiens
aggtctgcctcactcacttctg

SEQ ID NO: 8453119 - DNA, 23 bp, Homo sapiens
aggtctggacccttggcccctgc

SEQ ID NO: 8453120 - DNA, 22 bp, Homo sapiens
aggtctgagtatggcctgagaa

SEQ ID NO: 8453121 - DNA, 22 bp, Homo sapiens
aggtctgagtagagaaaaggca

SEQ ID NO: 8453122 - DNA, 22 bp, Homo sapiens
aggtctgagctcagggcctggc

SEQ ID NO: 8453123 - DNA, 22 bp, Homo sapiens
aggtctgagctccttcctctga

SEQ ID NO: 8453124 - DNA, 18 bp, Homo sapiens
aggtctgaggaagagcct

SEQ ID NO: 8453125 - DNA, 22 bp, Homo sapiens
aggtctgagctcagggcctggc

SEQ ID NO: 8453126 - DNA, 22 bp, Homo sapiens
aggtcctgtccttggtctctga

SEQ ID NO: 8453127 - DNA, 22 bp, Homo sapiens
aggtcctgtccttggtctctga

SEQ ID NO: 8453128 - DNA, 22 bp, Homo sapiens
aggtctcttgctgtctctgggc

SEQ ID NO: 8453129 - DNA, 22 bp, Homo sapiens
aggtcctgtctatcaccctcgc

SEQ ID NO: 8453130 - DNA, 20 bp, Homo sapiens
aggtctgaatgtcagggctg

SEQ ID NO: 8453131 - DNA, 22 bp, Homo sapiens
aggtctgactctttgccacata

SEQ ID NO: 8453132 - DNA, 19 bp, Homo sapiens
aggtgaggggcaccatgtc

SEQ ID NO: 8453133 - DNA, 22 bp, Homo sapiens
aggtctggtgttgggcctgaaa

SEQ ID NO: 8453134 - DNA, 22 bp, Homo sapiens
aggtctgtctggccccatgaat

SEQ ID NO: 8453135 - DNA, 22 bp, Homo sapiens
aggtctggtgttgatgaattcc

SEQ ID NO: 8453136 - DNA, 22 bp, Homo sapiens
aggtctggtgttgggcctgaaa

SEQ ID NO: 8453137 - DNA, 18 bp, Homo sapiens
aggtctgtggtcaccagg

SEQ ID NO: 8453138 - DNA, 22 bp, Homo sapiens
aggtctggagtgggatctgaga

SEQ ID NO: 8453139 - DNA, 22 bp, Homo sapiens
aggtctggctcttctccacaga

SEQ ID NO: 8453140 - DNA, 22 bp, Homo sapiens
aggtctggaggcggagtcagga

SEQ ID NO: 8453141 - DNA, 22 bp, Homo sapiens
aggtctggaggcggagtcagga

SEQ ID NO: 8453142 - DNA, 22 bp, Homo sapiens
aggtctgggcaccactggctgc

SEQ ID NO: 8453143 - DNA, 22 bp, Homo sapiens
aggtctggtatttttctatact

SEQ ID NO: 8453144 - DNA, 22 bp, Homo sapiens
aggtctgggcaccactggctgc

SEQ ID NO: 8453145 - DNA, 22 bp, Homo sapiens
aggtctggtgggctttagattg

SEQ ID NO: 8453146 - DNA, 22 bp, Homo sapiens
aggtgcacctgagggtgtcatc

SEQ ID NO: 8453147 - DNA, 22 bp, Homo sapiens
aggtgagtcctgggcacaggta

SEQ ID NO: 8453148 - DNA, 20 bp, Homo sapiens
aggtgcaaggcatggcatgt

SEQ ID NO: 8453149 - DNA, 22 bp, Homo sapiens
cctgggcagggagaccaggctc

SEQ ID NO: 8453150 - DNA, 22 bp, Homo sapiens
cctgggcagggctggactctca

SEQ ID NO: 8453151 - DNA, 22 bp, Homo sapiens
cctgggcagggctggactctca

SEQ ID NO: 8453152 - DNA, 22 bp, Homo sapiens
cctgggcaggccggacgctggg

SEQ ID NO: 8453153 - DNA, 22 bp, Homo sapiens
cctgggcaggccggacgctggg

SEQ ID NO: 8453154 - DNA, 22 bp, Homo sapiens
cctgggcaggtgtggcttcccc

SEQ ID NO: 8453155 - DNA, 22 bp, Homo sapiens
aggtgcttggctcgtgcacaca

SEQ ID NO: 8453156 - DNA, 22 bp, Homo sapiens
cctggtcacccctctctctgca

SEQ ID NO: 8453157 - DNA, 22 bp, Homo sapiens
cctggtcacccctctctctgca

SEQ ID NO: 8453158 - DNA, 22 bp, Homo sapiens
cctggtcagagcagtcaggatc

SEQ ID NO: 8453159 - DNA, 22 bp, Homo sapiens
cctggtcagagcagtcaggatc

SEQ ID NO: 8453160 - DNA, 22 bp, Homo sapiens
cctggtcaggtaactgggctga

SEQ ID NO: 8453161 - DNA, 22 bp, Homo sapiens
cctgcctggagctgagtgtgga

SEQ ID NO: 8453162 - DNA, 22 bp, Homo sapiens
cctgcctggctgtcagcagagc

SEQ ID NO: 8453163 - DNA, 22 bp, Homo sapiens
cctgcctggctgtcagcagagc

SEQ ID NO: 8453164 - DNA, 22 bp, Homo sapiens
cctgcctggctgtcagcagagc

SEQ ID NO: 8453165 - DNA, 22 bp, Homo sapiens
cctggagcaggagctgcagagg

SEQ ID NO: 8453166 - DNA, 22 bp, Homo sapiens
cctggagcaggagctgcagagg

SEQ ID NO: 8453167 - DNA, 22 bp, Homo sapiens
cctggagcaggagctgcagagg

SEQ ID NO: 8453168 - DNA, 18 bp, Homo sapiens
cctggacctgtctccttt

SEQ ID NO: 8453169 - DNA, 22 bp, Homo sapiens
cctggacctgcagcatcagcat

SEQ ID NO: 8453170 - DNA, 21 bp, Homo sapiens
cctggactaaaaccaggccac

SEQ ID NO: 8453171 - DNA, 21 bp, Homo sapiens
cctggactaaaaccaggccac

SEQ ID NO: 8453172 - DNA, 23 bp, Homo sapiens
agggtgagcaagctatggagacc

SEQ ID NO: 8453173 - DNA, 22 bp, Homo sapiens
agggtggcactggtggctctat

SEQ ID NO: 8453174 - DNA, 22 bp, Homo sapiens
cctgcctgcggcccgcggggag

SEQ ID NO: 8453175 - DNA, 19 bp, Homo sapiens
agggtggcaaaggagggtg

SEQ ID NO: 8453176 - DNA, 22 bp, Homo sapiens
aggtatatattctggtccttat

SEQ ID NO: 8453177 - DNA, 22 bp, Homo sapiens
cctggctcattatgtgccccca

SEQ ID NO: 8453178 - DNA, 22 bp, Homo sapiens
cctggctcagtgttgaaggggt

SEQ ID NO: 8453179 - DNA, 22 bp, Homo sapiens
cctggctcaggcacgcatggct

SEQ ID NO: 8453180 - DNA, 22 bp, Homo sapiens
cctggctcaggcacgcatggct

SEQ ID NO: 8453181 - DNA, 22 bp, Homo sapiens
cctggctcagaccccagttctg

SEQ ID NO: 8453182 - DNA, 22 bp, Homo sapiens
cctggctcagcagctctttctc

SEQ ID NO: 8453183 - DNA, 22 bp, Homo sapiens
cctggctcaggcacgcatggct

SEQ ID NO: 8453184 - DNA, 22 bp, Homo sapiens
cctggctcaaggcgaggactcc

SEQ ID NO: 8453185 - DNA, 22 bp, Homo sapiens
cctggctcaaggcgaggactcc

SEQ ID NO: 8453186 - DNA, 22 bp, Homo sapiens
cctggagcccctctggccagcc

SEQ ID NO: 8453187 - DNA, 22 bp, Homo sapiens
agggtggctgtgaagtgcttgg

SEQ ID NO: 8453188 - DNA, 22 bp, Homo sapiens
agggtggcttaattccaaaggg

SEQ ID NO: 8453189 - DNA, 23 bp, Homo sapiens
agggtggcttgctttgcttcctt

SEQ ID NO: 8453190 - DNA, 22 bp, Homo sapiens
cctggccttaagggcagggagc

SEQ ID NO: 8453191 - DNA, 22 bp, Homo sapiens
cctggccttaagggcagggagc

SEQ ID NO: 8453192 - DNA, 22 bp, Homo sapiens
cctggccagcagccccttcctc

SEQ ID NO: 8453193 - DNA, 22 bp, Homo sapiens
cctggccagcagccccttcctc

SEQ ID NO: 8453194 - DNA, 21 bp, Homo sapiens
agggtggctctgggtcagaac

SEQ ID NO: 8453195 - DNA, 22 bp, Homo sapiens
agggtggctgagtagatggaag

SEQ ID NO: 8453196 - DNA, 22 bp, Homo sapiens
agctgtgaccttcaagagctac

SEQ ID NO: 8453197 - DNA, 22 bp, Homo sapiens
caggctccacaggggaatccgg

SEQ ID NO: 8453198 - DNA, 22 bp, Homo sapiens
caggctccaagccctctgatgt

SEQ ID NO: 8453199 - DNA, 22 bp, Homo sapiens
caggctcagctctggccagtgc

SEQ ID NO: 8453200 - DNA, 22 bp, Homo sapiens
caggctccactgtaggcagctc

SEQ ID NO: 8453201 - DNA, 22 bp, Homo sapiens
caggctcagcaggagcctgacc

SEQ ID NO: 8453202 - DNA, 22 bp, Homo sapiens
caggctcagctctggccagtgc

SEQ ID NO: 8453203 - DNA, 22 bp, Homo sapiens
caggctcagctctggccagtgc

SEQ ID NO: 8453204 - DNA, 22 bp, Homo sapiens
caggctcagatgccctgcgctg

SEQ ID NO: 8453205 - DNA, 22 bp, Homo sapiens
caggctcagatgccctgcgctg

SEQ ID NO: 8453206 - DNA, 22 bp, Homo sapiens
agctggggcatttatccactaa

SEQ ID NO: 8453207 - DNA, 22 bp, Homo sapiens
agctggggcatttatccactaa

SEQ ID NO: 8453208 - DNA, 18 bp, Homo sapiens
agctggggcctctggtcc

SEQ ID NO: 8453209 - DNA, 22 bp, Homo sapiens
caggctcactgtaaggtcagct

SEQ ID NO: 8453210 - DNA, 22 bp, Homo sapiens
caggctcactgtaaggtcagct

SEQ ID NO: 8453211 - DNA, 22 bp, Homo sapiens
caggcctgtctgcacatgaggc

SEQ ID NO: 8453212 - DNA, 22 bp, Homo sapiens
caggctcactttctcagtcaca

SEQ ID NO: 8453213 - DNA, 22 bp, Homo sapiens
caggctcactttctcagtcaca

SEQ ID NO: 8453214 - DNA, 22 bp, Homo sapiens
caggctcactgtaaggtcagct

SEQ ID NO: 8453215 - DNA, 22 bp, Homo sapiens
caggctgcgtttgtgaaaggta

SEQ ID NO: 8453216 - DNA, 22 bp, Homo sapiens
caggctgctccagggtaggaaa

SEQ ID NO: 8453217 - DNA, 22 bp, Homo sapiens
caggctgcggtcggctctggtc

SEQ ID NO: 8453218 - DNA, 22 bp, Homo sapiens
caggctgcggtcggctctggtc

SEQ ID NO: 8453219 - DNA, 22 bp, Homo sapiens
caggctgagctctggcctgggc

SEQ ID NO: 8453220 - DNA, 22 bp, Homo sapiens
caggctgcggccgtgtgagcat

SEQ ID NO: 8453221 - DNA, 22 bp, Homo sapiens
agctgtggagtagggggttgga

SEQ ID NO: 8453222 - DNA, 22 bp, Homo sapiens
agctgtggaagactgtcagggt

SEQ ID NO: 8453223 - DNA, 22 bp, Homo sapiens
agctgtggaagactgtcagggt

SEQ ID NO: 8453224 - DNA, 22 bp, Homo sapiens
agctgtggaagactgtcagggt

SEQ ID NO: 8453225 - DNA, 22 bp, Homo sapiens
agctgtggcaaccttgtcagac

SEQ ID NO: 8453226 - DNA, 19 bp, Homo sapiens
agctgtggatgtgggattt

SEQ ID NO: 8453227 - DNA, 22 bp, Homo sapiens
agctgtgccttgctgcacggtg

SEQ ID NO: 8453228 - DNA, 22 bp, Homo sapiens
agctgtggaagactgtcagggt

SEQ ID NO: 8453229 - DNA, 22 bp, Homo sapiens
agctgtgctgtggtcatctggg

SEQ ID NO: 8453230 - DNA, 22 bp, Homo sapiens
cagggagctttcccaggaccct

SEQ ID NO: 8453231 - DNA, 22 bp, Homo sapiens
cagggatgggatggagtcagtt

SEQ ID NO: 8453232 - DNA, 22 bp, Homo sapiens
cagggatgggatggagtcagtt

SEQ ID NO: 8453233 - DNA, 19 bp, Homo sapiens
cagggatgggtagggactc

SEQ ID NO: 8453234 - DNA, 19 bp, Homo sapiens
cagggatgggtagggactc

SEQ ID NO: 8453235 - DNA, 19 bp, Homo sapiens
cagggatgggtagggactc

SEQ ID NO: 8453236 - DNA, 22 bp, Homo sapiens
cagggatggtaaatatgtaaag

SEQ ID NO: 8453237 - DNA, 22 bp, Homo sapiens
cagggagctggctggctgtgcc

SEQ ID NO: 8453238 - DNA, 22 bp, Homo sapiens
cagggagctggctggctgtgcc

SEQ ID NO: 8453239 - DNA, 22 bp, Homo sapiens
cagggagctggctggcgtgagt

SEQ ID NO: 8453240 - DNA, 22 bp, Homo sapiens
cagggagctggagttggagtac

SEQ ID NO: 8453241 - DNA, 22 bp, Homo sapiens
cagggagctggctggcgtgagt

SEQ ID NO: 8453242 - DNA, 22 bp, Homo sapiens
cagggagctgacaaccaaggag

SEQ ID NO: 8453243 - DNA, 22 bp, Homo sapiens
cagggagctctgggccggactc

SEQ ID NO: 8453244 - DNA, 22 bp, Homo sapiens
cagggagctggagttggagtac

SEQ ID NO: 8453245 - DNA, 22 bp, Homo sapiens
caggctggagtgcagtggtgcc

SEQ ID NO: 8453246 - DNA, 22 bp, Homo sapiens
caggctggagtgcagtggtgcc

SEQ ID NO: 8453247 - DNA, 22 bp, Homo sapiens
caggctggagtgcagtggtgcc

SEQ ID NO: 8453248 - DNA, 22 bp, Homo sapiens
caggctggagtgcagtgtcgcc

SEQ ID NO: 8453249 - DNA, 22 bp, Homo sapiens
caggctggagtgcagtgtcgcc

SEQ ID NO: 8453250 - DNA, 22 bp, Homo sapiens
caggctgctgacaggcttggag

SEQ ID NO: 8453251 - DNA, 22 bp, Homo sapiens
caggctggacattagatacata

SEQ ID NO: 8453252 - DNA, 22 bp, Homo sapiens
caggctggacattagatacata

SEQ ID NO: 8453253 - DNA, 22 bp, Homo sapiens
caggctggagtgcagttgtgca

SEQ ID NO: 8453254 - DNA, 22 bp, Homo sapiens
caggctggagtgcagttgtgca

SEQ ID NO: 8453255 - DNA, 22 bp, Homo sapiens
caggctggagtgcagttgtgca

SEQ ID NO: 8453256 - DNA, 22 bp, Homo sapiens
cagggagcggagtcccatgcct

SEQ ID NO: 8453257 - DNA, 22 bp, Homo sapiens
cagggagaaatctccaggaggt

SEQ ID NO: 8453258 - DNA, 22 bp, Homo sapiens
cagggctccctgcagcctctgt

SEQ ID NO: 8453259 - DNA, 22 bp, Homo sapiens
cagggctccctgcagcctctgt

SEQ ID NO: 8453260 - DNA, 22 bp, Homo sapiens
cagggcctgcctggttcctgga

SEQ ID NO: 8453261 - DNA, 22 bp, Homo sapiens
cagggctccccagagagcctct

SEQ ID NO: 8453262 - DNA, 22 bp, Homo sapiens
cagggctccccagagagcctct

SEQ ID NO: 8453263 - DNA, 22 bp, Homo sapiens
cagggctcgctgccagcttcag

SEQ ID NO: 8453264 - DNA, 22 bp, Homo sapiens
cagggctcgctcgctcgctcgc

SEQ ID NO: 8453265 - DNA, 23 bp, Homo sapiens
cagggccaggcagcagctgtcac

SEQ ID NO: 8453266 - DNA, 22 bp, Homo sapiens
cagggcctccccggcagtcttt

SEQ ID NO: 8453267 - DNA, 22 bp, Homo sapiens
cagggcctccccggcagtcttt

SEQ ID NO: 8453268 - DNA, 22 bp, Homo sapiens
cagggcctccccggcagtcttt

SEQ ID NO: 8453269 - DNA, 22 bp, Homo sapiens
cagggcctcctaaggcatctaa

SEQ ID NO: 8453270 - DNA, 22 bp, Homo sapiens
cagggatgtctctggaagggag

SEQ ID NO: 8453271 - DNA, 22 bp, Homo sapiens
cagggatgtctctggaagggag

SEQ ID NO: 8453272 - DNA, 22 bp, Homo sapiens
cagggatgtctctggaagggag

SEQ ID NO: 8453273 - DNA, 22 bp, Homo sapiens
cagggatggttgagaattggta

SEQ ID NO: 8453274 - DNA, 22 bp, Homo sapiens
cagggatgtctctggaagggag

SEQ ID NO: 8453275 - DNA, 22 bp, Homo sapiens
cagggatggttgagaattggta

SEQ ID NO: 8453276 - DNA, 22 bp, Homo sapiens
cagggatggttgagaattggta

SEQ ID NO: 8453277 - DNA, 22 bp, Homo sapiens
cagggcctgcaagagacctggg

SEQ ID NO: 8453278 - DNA, 22 bp, Homo sapiens
cagggcctctgtgggctctctc

SEQ ID NO: 8453279 - DNA, 22 bp, Homo sapiens
cagggcctgagggctgctctgc

SEQ ID NO: 8453280 - DNA, 22 bp, Homo sapiens
cagggcctcgaagcctctgggc

SEQ ID NO: 8453281 - DNA, 22 bp, Homo sapiens
cagggcctctcctccaggaact

SEQ ID NO: 8453282 - DNA, 22 bp, Homo sapiens
cagggcctctcatcccacgggc

SEQ ID NO: 8453283 - DNA, 22 bp, Homo sapiens
caggggctctaatgcatgatca

SEQ ID NO: 8453284 - DNA, 22 bp, Homo sapiens
caggggctccctgggtgccagt

SEQ ID NO: 8453285 - DNA, 22 bp, Homo sapiens
caggggctctgggtgatgtgag

SEQ ID NO: 8453286 - DNA, 22 bp, Homo sapiens
caggggctgagaaggaacgtcc

SEQ ID NO: 8453287 - DNA, 22 bp, Homo sapiens
caggggctgtggcacatggtgt

SEQ ID NO: 8453288 - DNA, 22 bp, Homo sapiens
caggtccttgtttgtaaagcag

SEQ ID NO: 8453289 - DNA, 22 bp, Homo sapiens
caggtcctttagtgtccagaac

SEQ ID NO: 8453290 - DNA, 22 bp, Homo sapiens
caggtcctttagtgtccagaac

SEQ ID NO: 8453291 - DNA, 22 bp, Homo sapiens
caggtgagaggcggtcctgcat

SEQ ID NO: 8453292 - DNA, 22 bp, Homo sapiens
caggtgagaggcggtcctgcat

SEQ ID NO: 8453293 - DNA, 20 bp, Homo sapiens
caggtgagcagatctgggtg

SEQ ID NO: 8453294 - DNA, 22 bp, Homo sapiens
caggtgagctctatctagggag

SEQ ID NO: 8453295 - DNA, 22 bp, Homo sapiens
caggtgagttttcctccttggt

SEQ ID NO: 8453296 - DNA, 22 bp, Homo sapiens
caggtgagttttcctccttggt

SEQ ID NO: 8453297 - DNA, 22 bp, Homo sapiens
caggtgcaatgagacagctctg

SEQ ID NO: 8453298 - DNA, 22 bp, Homo sapiens
caggtgaggctgaacagatgaa

SEQ ID NO: 8453299 - DNA, 22 bp, Homo sapiens
caggtgaggctgaacagatgaa

SEQ ID NO: 8453300 - DNA, 22 bp, Homo sapiens
caggtgaggctgaacagatgaa

SEQ ID NO: 8453301 - DNA, 22 bp, Homo sapiens
caggtgagtaacaatgggtgat

SEQ ID NO: 8453302 - DNA, 22 bp, Homo sapiens
caggccagaggctgttgttgcg

SEQ ID NO: 8453303 - DNA, 22 bp, Homo sapiens
caggccagaggctgttgttgcg

SEQ ID NO: 8453304 - DNA, 22 bp, Homo sapiens
agctggcctccgggtgcctggg

SEQ ID NO: 8453305 - DNA, 20 bp, Homo sapiens
caggcagtttgtggttaggg

SEQ ID NO: 8453306 - DNA, 22 bp, Homo sapiens
agctggccggcctccaggtgga

SEQ ID NO: 8453307 - DNA, 22 bp, Homo sapiens
agctggccggcctccaggtgga

SEQ ID NO: 8453308 - DNA, 22 bp, Homo sapiens
agctggcccactgtgtggtcca

SEQ ID NO: 8453309 - DNA, 22 bp, Homo sapiens
agctggccattgtgagtggcct

SEQ ID NO: 8453310 - DNA, 22 bp, Homo sapiens
caggcactgtgttaggcactgt

SEQ ID NO: 8453311 - DNA, 22 bp, Homo sapiens
caggccagcgtccagaacaagc

SEQ ID NO: 8453312 - DNA, 22 bp, Homo sapiens
caggccagcgtccagaacaagc

SEQ ID NO: 8453313 - DNA, 22 bp, Homo sapiens
caggccagcttcctgacatcct

SEQ ID NO: 8453314 - DNA, 22 bp, Homo sapiens
caggccaggctgcatttgcccc

SEQ ID NO: 8453315 - DNA, 22 bp, Homo sapiens
caggccagcagggcctccgtgg

SEQ ID NO: 8453316 - DNA, 22 bp, Homo sapiens
caggccagcggcccgcgcgttc

SEQ ID NO: 8453317 - DNA, 20 bp, Homo sapiens
caggccagaggtttgatggc

SEQ ID NO: 8453318 - DNA, 22 bp, Homo sapiens
caggccagagtccaactccaga

SEQ ID NO: 8453319 - DNA, 22 bp, Homo sapiens
agctgggctgggctgagctgag

SEQ ID NO: 8453320 - DNA, 22 bp, Homo sapiens
agctgggctgggctgagctgag

SEQ ID NO: 8453321 - DNA, 22 bp, Homo sapiens
agctgggctggagctccaagcg

SEQ ID NO: 8453322 - DNA, 22 bp, Homo sapiens
caggccagggagaatatgaagc

SEQ ID NO: 8453323 - DNA, 22 bp, Homo sapiens
caggccagggagaatatgaagc

SEQ ID NO: 8453324 - DNA, 22 bp, Homo sapiens
caggcacactgtctacactgag

SEQ ID NO: 8453325 - DNA, 22 bp, Homo sapiens
caggcactggccagtcagcaca

SEQ ID NO: 8453326 - DNA, 22 bp, Homo sapiens
agctgctgcccataggtgacat

SEQ ID NO: 8453327 - DNA, 22 bp, Homo sapiens
agctgctgcaagtggtgctaac

SEQ ID NO: 8453328 - DNA, 22 bp, Homo sapiens
agctgctgccggtggccaccct

SEQ ID NO: 8453329 - DNA, 22 bp, Homo sapiens
agctgctgcctcactggtctgt

SEQ ID NO: 8453330 - DNA, 19 bp, Homo sapiens
agctgctggcccagggacc

SEQ ID NO: 8453331 - DNA, 22 bp, Homo sapiens
agctgctgcggaaagatgccac

SEQ ID NO: 8453332 - DNA, 22 bp, Homo sapiens
caggcacactgtctacactgag

SEQ ID NO: 8453333 - DNA, 19 bp, Homo sapiens
agctgctggcccagggacc

SEQ ID NO: 8453334 - DNA, 22 bp, Homo sapiens
caggaggacatactggctcaca

SEQ ID NO: 8453335 - DNA, 22 bp, Homo sapiens
caggaggacatactggctcaca

SEQ ID NO: 8453336 - DNA, 22 bp, Homo sapiens
caggaggacatactggctcaca

SEQ ID NO: 8453337 - DNA, 22 bp, Homo sapiens
caggaggagcattagcgtctca

SEQ ID NO: 8453338 - DNA, 22 bp, Homo sapiens
caggaggagcattagcgtctca

SEQ ID NO: 8453339 - DNA, 22 bp, Homo sapiens
agctgccacctctgcctttggg

SEQ ID NO: 8453340 - DNA, 22 bp, Homo sapiens
agctgccaagtttctcagttta

SEQ ID NO: 8453341 - DNA, 21 bp, Homo sapiens
agctgccaccctagcttctga

SEQ ID NO: 8453342 - DNA, 22 bp, Homo sapiens
agctgccacctctgcctttggg

SEQ ID NO: 8453343 - DNA, 22 bp, Homo sapiens
agctgccacatggtgtcactgt

SEQ ID NO: 8453344 - DNA, 22 bp, Homo sapiens
caggagccccaggctgacaata

SEQ ID NO: 8453345 - DNA, 22 bp, Homo sapiens
agctgccactgagggtgcacag

SEQ ID NO: 8453346 - DNA, 22 bp, Homo sapiens
caggagccccaggctgacaata

SEQ ID NO: 8453347 - DNA, 22 bp, Homo sapiens
agctgctgagccatgtcctgct

SEQ ID NO: 8453348 - DNA, 22 bp, Homo sapiens
caggaggattgcttgaggccag

SEQ ID NO: 8453349 - DNA, 22 bp, Homo sapiens
agctgctgagccatgtcctgct

SEQ ID NO: 8453350 - DNA, 22 bp, Homo sapiens
caggaggagggtacaccatcag

SEQ ID NO: 8453351 - DNA, 22 bp, Homo sapiens
caggaggagggcagccgcctcc

SEQ ID NO: 8453352 - DNA, 22 bp, Homo sapiens
caggaaggcgcggctgtgcctg

SEQ ID NO: 8453353 - DNA, 22 bp, Homo sapiens
caggaaggcgcggctgtgcctg

SEQ ID NO: 8453354 - DNA, 22 bp, Homo sapiens
caggaaggcgcggctgtgcctg

SEQ ID NO: 8453355 - DNA, 22 bp, Homo sapiens
caggaaggcgcggctgtgcctg

SEQ ID NO: 8453356 - DNA, 22 bp, Homo sapiens
caggaaggggctcactctggcc

SEQ ID NO: 8453357 - DNA, 22 bp, Homo sapiens
caggaaggcccacctgtcctgt

SEQ ID NO: 8453358 - DNA, 22 bp, Homo sapiens
caggaaggcccacctgtcctgt

SEQ ID NO: 8453359 - DNA, 22 bp, Homo sapiens
caggaaggcccacctgtcctgt

SEQ ID NO: 8453360 - DNA, 22 bp, Homo sapiens
caggaaggcccacctgtcctgt

SEQ ID NO: 8453361 - DNA, 22 bp, Homo sapiens
caggaaggcccacctgtcctgt

SEQ ID NO: 8453362 - DNA, 22 bp, Homo sapiens
agctgccaagttggagtagcaa

SEQ ID NO: 8453363 - DNA, 22 bp, Homo sapiens
agctgccacagagcctggccag

SEQ ID NO: 8453364 - DNA, 22 bp, Homo sapiens
caggaaggggctcactctggcc

SEQ ID NO: 8453365 - DNA, 22 bp, Homo sapiens
agctgcagttcgttccagctct

SEQ ID NO: 8453366 - DNA, 22 bp, Homo sapiens
agctgcagttagccccagatga

SEQ ID NO: 8453367 - DNA, 22 bp, Homo sapiens
caggaagagaacatggaggctg

SEQ ID NO: 8453368 - DNA, 23 bp, Homo sapiens
agctgcagatgctcagcgggcag

SEQ ID NO: 8453369 - DNA, 22 bp, Homo sapiens
agctgcagattctctacttcat

SEQ ID NO: 8453370 - DNA, 22 bp, Homo sapiens
agctgcagagaaaagaggctgg

SEQ ID NO: 8453371 - DNA, 22 bp, Homo sapiens
agctgcagagaaaagaggctgg

SEQ ID NO: 8453372 - DNA, 22 bp, Homo sapiens
agctgcagagaaaagaggctgg

SEQ ID NO: 8453373 - DNA, 22 bp, Homo sapiens
agctgcagatcaataggctcac

SEQ ID NO: 8453374 - DNA, 22 bp, Homo sapiens
agctgcagatcaataggctcac

SEQ ID NO: 8453375 - DNA, 19 bp, Homo sapiens
agctgcagaccagaagtgc

SEQ ID NO: 8453376 - DNA, 19 bp, Homo sapiens
agctgcagaccagaagtgc

SEQ ID NO: 8453377 - DNA, 18 bp, Homo sapiens
agctgcagaccaggaggt

SEQ ID NO: 8453378 - DNA, 20 bp, Homo sapiens
agctgcagaacccactggac

SEQ ID NO: 8453379 - DNA, 22 bp, Homo sapiens
agctgcagaaaggacaactaat

SEQ ID NO: 8453380 - DNA, 22 bp, Homo sapiens
cagctgagaagtgatagctgca

SEQ ID NO: 8453381 - DNA, 22 bp, Homo sapiens
cagctgagaagtgatagctgca

SEQ ID NO: 8453382 - DNA, 22 bp, Homo sapiens
cagctgagaccagaatgcaggt

SEQ ID NO: 8453383 - DNA, 22 bp, Homo sapiens
cagctgagaaaggcaggctcac

SEQ ID NO: 8453384 - DNA, 22 bp, Homo sapiens
cagctgagaaatggggaaaggg

SEQ ID NO: 8453385 - DNA, 22 bp, Homo sapiens
cagctgagaaaggcaggctcac

SEQ ID NO: 8453386 - DNA, 22 bp, Homo sapiens
cagctgagaaggtctgatcagg

SEQ ID NO: 8453387 - DNA, 22 bp, Homo sapiens
agctgagggcaggatggggtga

SEQ ID NO: 8453388 - DNA, 22 bp, Homo sapiens
cagctgagagacaatgagtcat

SEQ ID NO: 8453389 - DNA, 22 bp, Homo sapiens
cagctgagagtagaaatggagg

SEQ ID NO: 8453390 - DNA, 22 bp, Homo sapiens
cagctgagagtagaaatggagg

SEQ ID NO: 8453391 - DNA, 22 bp, Homo sapiens
agctgcaattaaagactgtgaa

SEQ ID NO: 8453392 - DNA, 22 bp, Homo sapiens
agctgcactgtgaagttcatag

SEQ ID NO: 8453393 - DNA, 21 bp, Homo sapiens
agctgcaagagcaacatcttt

SEQ ID NO: 8453394 - DNA, 22 bp, Homo sapiens
agctgcaactgtccttgccttg

SEQ ID NO: 8453395 - DNA, 23 bp, Homo sapiens
agctgcaagactccctgtctgag

SEQ ID NO: 8453396 - DNA, 22 bp, Homo sapiens
agctgcaacatctgcttgtccc

SEQ ID NO: 8453397 - DNA, 20 bp, Homo sapiens
agctgcaacagactgtatgg

SEQ ID NO: 8453398 - DNA, 22 bp, Homo sapiens
agctgcaacatctgcttgtccc

SEQ ID NO: 8453399 - DNA, 22 bp, Homo sapiens
agctgcaaagatctgtcagtca

SEQ ID NO: 8453400 - DNA, 22 bp, Homo sapiens
agctgcaaagatctgtcagtca

SEQ ID NO: 8453401 - DNA, 22 bp, Homo sapiens
cagctgaatcagtgagtggaaa

SEQ ID NO: 8453402 - DNA, 22 bp, Homo sapiens
cagctgaatggctccctgctaa

SEQ ID NO: 8453403 - DNA, 22 bp, Homo sapiens
cagctgaattcttcagactcca

SEQ ID NO: 8453404 - DNA, 23 bp, Homo sapiens
cagctgaagcagcctgggctgga

SEQ ID NO: 8453405 - DNA, 22 bp, Homo sapiens
cagctgaagcccaggcagaacc

SEQ ID NO: 8453406 - DNA, 22 bp, Homo sapiens
cagctgaagctcttgtcaaagg

SEQ ID NO: 8453407 - DNA, 22 bp, Homo sapiens
cagctgaaggtaggaaccagga

SEQ ID NO: 8453408 - DNA, 22 bp, Homo sapiens
cagctctggttcctgggcccag

SEQ ID NO: 8453409 - DNA, 22 bp, Homo sapiens
cagctctggttcctgggcccag

SEQ ID NO: 8453410 - DNA, 18 bp, Homo sapiens
cagtggtgctgggatgtg

SEQ ID NO: 8453411 - DNA, 22 bp, Homo sapiens
cagtggttatacttactgtttc

SEQ ID NO: 8453412 - DNA, 22 bp, Homo sapiens
cagttctgactttcataatgtc

SEQ ID NO: 8453413 - DNA, 22 bp, Homo sapiens
cagttctgagctttcccagaag

SEQ ID NO: 8453414 - DNA, 22 bp, Homo sapiens
cagttctggaggctccacatct

SEQ ID NO: 8453415 - DNA, 22 bp, Homo sapiens
cagtggctcatgcctataatcc

SEQ ID NO: 8453416 - DNA, 22 bp, Homo sapiens
cagtttctccaaacgcaggctg

SEQ ID NO: 8453417 - DNA, 22 bp, Homo sapiens
cagtttctacgaaggtcaaccc

SEQ ID NO: 8453418 - DNA, 22 bp, Homo sapiens
cagtttccctgcttgaaaacgt

SEQ ID NO: 8453419 - DNA, 22 bp, Homo sapiens
cagtttcctgaagagaaagaat

SEQ ID NO: 8453420 - DNA, 22 bp, Homo sapiens
cagttttaaattttgaatgtct

SEQ ID NO: 8453421 - DNA, 22 bp, Homo sapiens
cagttttaaattgttagataat

SEQ ID NO: 8453422 - DNA, 22 bp, Homo sapiens
cagttttagctagagcaaacca

SEQ ID NO: 8453423 - DNA, 22 bp, Homo sapiens
cagttttaggacatgtggatgt

SEQ ID NO: 8453424 - DNA, 22 bp, Homo sapiens
cataggaagccatctcagtcac

SEQ ID NO: 8453425 - DNA, 22 bp, Homo sapiens
cataggccacggtcagcccaca

SEQ ID NO: 8453426 - DNA, 22 bp, Homo sapiens
catataaatacaacatgtgtta

SEQ ID NO: 8453427 - DNA, 22 bp, Homo sapiens
catataaatacaacatgtgtta

SEQ ID NO: 8453428 - DNA, 22 bp, Homo sapiens
catagtgactcatgcctataat

SEQ ID NO: 8453429 - DNA, 22 bp, Homo sapiens
catagttttaggtagaaactgg

SEQ ID NO: 8453430 - DNA, 22 bp, Homo sapiens
catacattacctaacttaatgc

SEQ ID NO: 8453431 - DNA, 22 bp, Homo sapiens
cagttttatacactgcagctcc

SEQ ID NO: 8453432 - DNA, 22 bp, Homo sapiens
cagttttatgtcgaatgtatac

SEQ ID NO: 8453433 - DNA, 22 bp, Homo sapiens
catatttagtgtttggagatcg

SEQ ID NO: 8453434 - DNA, 19 bp, Homo sapiens
catattgtgcttgcatttt

SEQ ID NO: 8453435 - DNA, 22 bp, Homo sapiens
catatttagtgtttggagatcg

SEQ ID NO: 8453436 - DNA, 22 bp, Homo sapiens
catatttatagatctggcattt

SEQ ID NO: 8453437 - DNA, 22 bp, Homo sapiens
catattttagttgctgaacagc

SEQ ID NO: 8453438 - DNA, 22 bp, Homo sapiens
catatttcagtctaagatgtgt

SEQ ID NO: 8453439 - DNA, 22 bp, Homo sapiens
catatttattcttctgccagtg

SEQ ID NO: 8453440 - DNA, 22 bp, Homo sapiens
aggagggagcttaagccaggca

SEQ ID NO: 8453441 - DNA, 22 bp, Homo sapiens
aggagggagcttaagccaggca

SEQ ID NO: 8453442 - DNA, 22 bp, Homo sapiens
caggtggcttctctgcagcctt

SEQ ID NO: 8453443 - DNA, 22 bp, Homo sapiens
aggacaggattgagctgaactg

SEQ ID NO: 8453444 - DNA, 22 bp, Homo sapiens
aggaccagaccgaactagctaa

SEQ ID NO: 8453445 - DNA, 22 bp, Homo sapiens
aggaccaccggtccatccaccc

SEQ ID NO: 8453446 - DNA, 22 bp, Homo sapiens
aggaccagaccgaactagctaa

SEQ ID NO: 8453447 - DNA, 22 bp, Homo sapiens
aggaccagaggccagagtcagc

SEQ ID NO: 8453448 - DNA, 22 bp, Homo sapiens
aggaccagtgagtctggcaagt

SEQ ID NO: 8453449 - DNA, 22 bp, Homo sapiens
aggaccagtgagtctggcaagt

SEQ ID NO: 8453450 - DNA, 22 bp, Homo sapiens
aggaccagtgagtctggcaagt

SEQ ID NO: 8453451 - DNA, 22 bp, Homo sapiens
aggaccagtatgagagcatctg

SEQ ID NO: 8453452 - DNA, 22 bp, Homo sapiens
aggaccagcctccaggtctctt

SEQ ID NO: 8453453 - DNA, 22 bp, Homo sapiens
aggaccagtatgagagcatctg

SEQ ID NO: 8453454 - DNA, 23 bp, Homo sapiens
aggaccaggttcccaaaagtcaa

SEQ ID NO: 8453455 - DNA, 21 bp, Homo sapiens
aggacctagaaaagtgcctag

SEQ ID NO: 8453456 - DNA, 22 bp, Homo sapiens
aggacctactgatatcttagca

SEQ ID NO: 8453457 - DNA, 22 bp, Homo sapiens
aggaccctgagcgggcatgccg

SEQ ID NO: 8453458 - DNA, 22 bp, Homo sapiens
aggacccagaaggtgcagcaga

SEQ ID NO: 8453459 - DNA, 22 bp, Homo sapiens
aggacccacgcacaggaacccc

SEQ ID NO: 8453460 - DNA, 22 bp, Homo sapiens
aggacccaagcacagttcctgg

SEQ ID NO: 8453461 - DNA, 22 bp, Homo sapiens
aggacctgtacctcagcatcta

SEQ ID NO: 8453462 - DNA, 22 bp, Homo sapiens
aggacctttggcaaggctgctc

SEQ ID NO: 8453463 - DNA, 22 bp, Homo sapiens
aggacctggatcacagagatct

SEQ ID NO: 8453464 - DNA, 18 bp, Homo sapiens
cagtggcatagttgagta

SEQ ID NO: 8453465 - DNA, 22 bp, Homo sapiens
cagtggccttgatgcctcattc

SEQ ID NO: 8453466 - DNA, 19 bp, Homo sapiens
cagtggcctggaggtctct

SEQ ID NO: 8453467 - DNA, 22 bp, Homo sapiens
cagtggcctgagccaggcttcc

SEQ ID NO: 8453468 - DNA, 22 bp, Homo sapiens
cagtggcctgagccaggcttcc

SEQ ID NO: 8453469 - DNA, 22 bp, Homo sapiens
cagtggccgcggggctgtgggt

SEQ ID NO: 8453470 - DNA, 22 bp, Homo sapiens
cagtggagagacttttactctt

SEQ ID NO: 8453471 - DNA, 19 bp, Homo sapiens
aggagaagtagcagaaatt

SEQ ID NO: 8453472 - DNA, 22 bp, Homo sapiens
aggagaagtaaggctagatgat

SEQ ID NO: 8453473 - DNA, 22 bp, Homo sapiens
aggagaagtaaggctagatgat

SEQ ID NO: 8453474 - DNA, 22 bp, Homo sapiens
aggagaaggaagtgcatcacta

SEQ ID NO: 8453475 - DNA, 22 bp, Homo sapiens
aggagaaggaagtgcatcacta

SEQ ID NO: 8453476 - DNA, 22 bp, Homo sapiens
aggagaagtaaggctagatgat

SEQ ID NO: 8453477 - DNA, 22 bp, Homo sapiens
cagtgctcatagctgttcctcc

SEQ ID NO: 8453478 - DNA, 22 bp, Homo sapiens
cagtgctcccgctgccgctgtg

SEQ ID NO: 8453479 - DNA, 21 bp, Homo sapiens
cagtgctcaggaatagagaga

SEQ ID NO: 8453480 - DNA, 22 bp, Homo sapiens
cagtgcctgtcttattcttaca

SEQ ID NO: 8453481 - DNA, 22 bp, Homo sapiens
cagtgcctggatagcaacatga

SEQ ID NO: 8453482 - DNA, 22 bp, Homo sapiens
aggactaaggaacagctgattc

SEQ ID NO: 8453483 - DNA, 22 bp, Homo sapiens
aggactcacatagcttcagatg

SEQ ID NO: 8453484 - DNA, 21 bp, Homo sapiens
cagtgcaggggttagcgtgta

SEQ ID NO: 8453485 - DNA, 22 bp, Homo sapiens
aggactgaaaatgagttcttct

SEQ ID NO: 8453486 - DNA, 22 bp, Homo sapiens
cagtgcccttccaggactgcag

SEQ ID NO: 8453487 - DNA, 22 bp, Homo sapiens
cagtgcctcaggccagcctgca

SEQ ID NO: 8453488 - DNA, 22 bp, Homo sapiens
cattaaattccttgttctcaaa

SEQ ID NO: 8453489 - DNA, 22 bp, Homo sapiens
cattaaatcttccagacctcac

SEQ ID NO: 8453490 - DNA, 22 bp, Homo sapiens
catgttttgtgtacagaatatt

SEQ ID NO: 8453491 - DNA, 23 bp, Homo sapiens
catgtttttctatctcagcgtgt

SEQ ID NO: 8453492 - DNA, 22 bp, Homo sapiens
cattaaaatatctcatggtgtt

SEQ ID NO: 8453493 - DNA, 22 bp, Homo sapiens
cattaaaatatctcatggtgtt

SEQ ID NO: 8453494 - DNA, 22 bp, Homo sapiens
aggcactgtactaggtacaggg

SEQ ID NO: 8453495 - DNA, 19 bp, Homo sapiens
aggcagcaggccagggatg

SEQ ID NO: 8453496 - DNA, 19 bp, Homo sapiens
aggcagcaggccagggatg

SEQ ID NO: 8453497 - DNA, 21 bp, Homo sapiens
aggcagcaggatccagggaca

SEQ ID NO: 8453498 - DNA, 17 bp, Homo sapiens
catttgttgatcagttg

SEQ ID NO: 8453499 - DNA, 22 bp, Homo sapiens
catttgaaattcttagaacaaa

SEQ ID NO: 8453500 - DNA, 22 bp, Homo sapiens
catttgaaattcttagaacaaa

SEQ ID NO: 8453501 - DNA, 22 bp, Homo sapiens
catttgaaattcttagaacaaa

SEQ ID NO: 8453502 - DNA, 22 bp, Homo sapiens
ccaagtgttttataagggacag

SEQ ID NO: 8453503 - DNA, 22 bp, Homo sapiens
ccaataattcttcaagtgtttt

SEQ ID NO: 8453504 - DNA, 22 bp, Homo sapiens
ccaatacactttatagaagaaa

SEQ ID NO: 8453505 - DNA, 18 bp, Homo sapiens
aggcaggctggagtgact

SEQ ID NO: 8453506 - DNA, 18 bp, Homo sapiens
aggcaggctggagtgact

SEQ ID NO: 8453507 - DNA, 22 bp, Homo sapiens
ccaaggactggacacacaggtt

SEQ ID NO: 8453508 - DNA, 22 bp, Homo sapiens
ccaaggacgtacaggagataat

SEQ ID NO: 8453509 - DNA, 22 bp, Homo sapiens
ccaagctggatttagctgcaca

SEQ ID NO: 8453510 - DNA, 22 bp, Homo sapiens
ccaagctggacagcagcaagga

SEQ ID NO: 8453511 - DNA, 22 bp, Homo sapiens
ccaaggttgagaaactgtagga

SEQ ID NO: 8453512 - DNA, 22 bp, Homo sapiens
ccaaggggcctttagacactat

SEQ ID NO: 8453513 - DNA, 23 bp, Homo sapiens
aggcagcaggttgtccagggtga

SEQ ID NO: 8453514 - DNA, 23 bp, Homo sapiens
aggcagcaggttgtccagggtga

SEQ ID NO: 8453515 - DNA, 22 bp, Homo sapiens
ccaagcagtctgctaggagttt

SEQ ID NO: 8453516 - DNA, 22 bp, Homo sapiens
ccaagcagagcagcctctctgg

SEQ ID NO: 8453517 - DNA, 22 bp, Homo sapiens
ccaagcagaaccattcaggcac

SEQ ID NO: 8453518 - DNA, 22 bp, Homo sapiens
ccaagcagaaccattcaggcac

SEQ ID NO: 8453519 - DNA, 22 bp, Homo sapiens
ccaagcaaataatcacccacta

SEQ ID NO: 8453520 - DNA, 22 bp, Homo sapiens
ccaagcaaggctaattcacttg

SEQ ID NO: 8453521 - DNA, 22 bp, Homo sapiens
ccaagctacttaggagtctgag

SEQ ID NO: 8453522 - DNA, 22 bp, Homo sapiens
ccaagctgagcaccatctgatc

SEQ ID NO: 8453523 - DNA, 22 bp, Homo sapiens
ccaagctgactgtgctgttgtg

SEQ ID NO: 8453524 - DNA, 22 bp, Homo sapiens
ccaagctggacagcagcaagga

SEQ ID NO: 8453525 - DNA, 22 bp, Homo sapiens
ccaagctgcctgaggcaaattt

SEQ ID NO: 8453526 - DNA, 22 bp, Homo sapiens
aggatttaatcagttggcattt

SEQ ID NO: 8453527 - DNA, 22 bp, Homo sapiens
catgggggtctggacaacaggc

SEQ ID NO: 8453528 - DNA, 22 bp, Homo sapiens
catggggagacacctagggaaa

SEQ ID NO: 8453529 - DNA, 19 bp, Homo sapiens
catggtgaaaccccgtctc

SEQ ID NO: 8453530 - DNA, 19 bp, Homo sapiens
catggtgaaaccccgtctc

SEQ ID NO: 8453531 - DNA, 22 bp, Homo sapiens
catgtcaagcttatctctgtgg

SEQ ID NO: 8453532 - DNA, 22 bp, Homo sapiens
catgtcaagcttatctctgtgg

SEQ ID NO: 8453533 - DNA, 22 bp, Homo sapiens
catgtcaataaatataactgca

SEQ ID NO: 8453534 - DNA, 22 bp, Homo sapiens
catgtcccaaatgcaggcaaag

SEQ ID NO: 8453535 - DNA, 22 bp, Homo sapiens
catggcagaaacctgagctgct

SEQ ID NO: 8453536 - DNA, 22 bp, Homo sapiens
catggaggccaggaaacagcct

SEQ ID NO: 8453537 - DNA, 22 bp, Homo sapiens
catggcaataaacctacacagt

SEQ ID NO: 8453538 - DNA, 22 bp, Homo sapiens
catggcaacaactctttattcc

SEQ ID NO: 8453539 - DNA, 22 bp, Homo sapiens
catggcaataaacctacacagt

SEQ ID NO: 8453540 - DNA, 22 bp, Homo sapiens
catgctaaaccagaacatagga

SEQ ID NO: 8453541 - DNA, 22 bp, Homo sapiens
catggaggaccctcagggagct

SEQ ID NO: 8453542 - DNA, 22 bp, Homo sapiens
aggagggctaggaaaaccagga

SEQ ID NO: 8453543 - DNA, 22 bp, Homo sapiens
aggagggcaggctggctgccta

SEQ ID NO: 8453544 - DNA, 22 bp, Homo sapiens
aggagggcaggctggctgccta

SEQ ID NO: 8453545 - DNA, 21 bp, Homo sapiens
aggagggcacaaggccaggaa

SEQ ID NO: 8453546 - DNA, 21 bp, Homo sapiens
aggagggcacaaggccaggaa

SEQ ID NO: 8453547 - DNA, 22 bp, Homo sapiens
catgctaaaatatctgaagatt

SEQ ID NO: 8453548 - DNA, 16 bp, Homo sapiens
aggaggggaattagga

SEQ ID NO: 8453549 - DNA, 20 bp, Homo sapiens
aggaggggatagaatcaaag

SEQ ID NO: 8453550 - DNA, 20 bp, Homo sapiens
aggaggggatagaatcaaag

SEQ ID NO: 8453551 - DNA, 19 bp, Homo sapiens
aggcttggaacagccttat

SEQ ID NO: 8453552 - DNA, 22 bp, Homo sapiens
aggcttgccacttgttagtcta

SEQ ID NO: 8453553 - DNA, 22 bp, Homo sapiens
aggcttgcacatgcacgcacgt

SEQ ID NO: 8453554 - DNA, 22 bp, Homo sapiens
aggcttcttttagaggggatgg

SEQ ID NO: 8453555 - DNA, 22 bp, Homo sapiens
aggcttcttgggcttcattctg

SEQ ID NO: 8453556 - DNA, 18 bp, Homo sapiens
aggcttcttggctcagtc

SEQ ID NO: 8453557 - DNA, 18 bp, Homo sapiens
aggcttcttggctcagtc

SEQ ID NO: 8453558 - DNA, 18 bp, Homo sapiens
aggcttcttggctcagtc

SEQ ID NO: 8453559 - DNA, 22 bp, Homo sapiens
aggcttcttgcttccaaatgca

SEQ ID NO: 8453560 - DNA, 22 bp, Homo sapiens
aggcttcttgataaaatgcaga

SEQ ID NO: 8453561 - DNA, 22 bp, Homo sapiens
aggcttcttgagccccacaggc

SEQ ID NO: 8453562 - DNA, 22 bp, Homo sapiens
aggcttcttgagccccacaggc

SEQ ID NO: 8453563 - DNA, 22 bp, Homo sapiens
aggcttcttgagccccacaggc

SEQ ID NO: 8453564 - DNA, 22 bp, Homo sapiens
aggcttcttctgcctgtctttg

SEQ ID NO: 8453565 - DNA, 22 bp, Homo sapiens
aggcttcttctgcctgtctttg

SEQ ID NO: 8453566 - DNA, 22 bp, Homo sapiens
aggcttcttctctatgtacaag

SEQ ID NO: 8453567 - DNA, 22 bp, Homo sapiens
aggcttcttcttcctatttagt

SEQ ID NO: 8453568 - DNA, 22 bp, Homo sapiens
aggcttctgtttcttaaaggtg

SEQ ID NO: 8453569 - DNA, 22 bp, Homo sapiens
aggcttctggaatccagtttct

SEQ ID NO: 8453570 - DNA, 22 bp, Homo sapiens
aggcttcttagattggctggag

SEQ ID NO: 8453571 - DNA, 22 bp, Homo sapiens
cccaggaggtggagcttgcagt

SEQ ID NO: 8453572 - DNA, 22 bp, Homo sapiens
aggcttggaggttctgtagcca

SEQ ID NO: 8453573 - DNA, 19 bp, Homo sapiens
aggcttggattgtggccaa

SEQ ID NO: 8453574 - DNA, 22 bp, Homo sapiens
aggctggctggcaggggacaca

SEQ ID NO: 8453575 - DNA, 22 bp, Homo sapiens
aggcttcacattttctaggcct

SEQ ID NO: 8453576 - DNA, 22 bp, Homo sapiens
aggcttcacgatgggtgaggtg

SEQ ID NO: 8453577 - DNA, 19 bp, Homo sapiens
aggcttctaccctgtccag

SEQ ID NO: 8453578 - DNA, 19 bp, Homo sapiens
aggcttctaccctgtccag

SEQ ID NO: 8453579 - DNA, 22 bp, Homo sapiens
aggcttctaaatcacaaggaaa

SEQ ID NO: 8453580 - DNA, 22 bp, Homo sapiens
aggcttcctggaggaagaggta

SEQ ID NO: 8453581 - DNA, 22 bp, Homo sapiens
aggctggctgacttctgaagca

SEQ ID NO: 8453582 - DNA, 22 bp, Homo sapiens
aggctggctgagctgcagcctg

SEQ ID NO: 8453583 - DNA, 22 bp, Homo sapiens
aggctggctgagctgcagcctg

SEQ ID NO: 8453584 - DNA, 22 bp, Homo sapiens
aggctggctgacttctgaagca

SEQ ID NO: 8453585 - DNA, 22 bp, Homo sapiens
aggctggctggcaggggacaca

SEQ ID NO: 8453586 - DNA, 22 bp, Homo sapiens
aggcttctccttcctaccttcc

SEQ ID NO: 8453587 - DNA, 21 bp, Homo sapiens
aggcttctccgtgcaggaaga

SEQ ID NO: 8453588 - DNA, 22 bp, Homo sapiens
aggcttctccacataaagttac

SEQ ID NO: 8453589 - DNA, 22 bp, Homo sapiens
aggcttctagggttggcagcgg

SEQ ID NO: 8453590 - DNA, 22 bp, Homo sapiens
aggcttctagggttggcagcgg

SEQ ID NO: 8453591 - DNA, 22 bp, Homo sapiens
aggcttctcaataggtttgaag

SEQ ID NO: 8453592 - DNA, 22 bp, Homo sapiens
aggcttctagggttggcagcgg

SEQ ID NO: 8453593 - DNA, 22 bp, Homo sapiens
aggcttctagggttggcagcgg

SEQ ID NO: 8453594 - DNA, 22 bp, Homo sapiens
aggcttctaggaaactttctgg

SEQ ID NO: 8453595 - DNA, 19 bp, Homo sapiens
aggcttctaccctgtccag

SEQ ID NO: 8453596 - DNA, 19 bp, Homo sapiens
aggcttctaccctgtccag

SEQ ID NO: 8453597 - DNA, 22 bp, Homo sapiens
aggcttctacgtggtcccaggg

SEQ ID NO: 8453598 - DNA, 22 bp, Homo sapiens
aggcttctacgtggtcccaggg

SEQ ID NO: 8453599 - DNA, 22 bp, Homo sapiens
aggcttctacgtggtcccaggg

SEQ ID NO: 8453600 - DNA, 22 bp, Homo sapiens
aggcttctctgcaagatgttaa

SEQ ID NO: 8453601 - DNA, 22 bp, Homo sapiens
aggcttctgagcatggagtttt

SEQ ID NO: 8453602 - DNA, 22 bp, Homo sapiens
aggcttctgctgatatttcatt

SEQ ID NO: 8453603 - DNA, 22 bp, Homo sapiens
aggcttctgataccatgagaga

SEQ ID NO: 8453604 - DNA, 22 bp, Homo sapiens
aggcttctccttcctaccttcc

SEQ ID NO: 8453605 - DNA, 22 bp, Homo sapiens
aggcttctctccttggcttgca

SEQ ID NO: 8453606 - DNA, 22 bp, Homo sapiens
aggcttctctccttggcttgca

SEQ ID NO: 8453607 - DNA, 22 bp, Homo sapiens
aggcttctgggattcccttggt

SEQ ID NO: 8453608 - DNA, 22 bp, Homo sapiens
aggcttctgggattcccttggt

SEQ ID NO: 8453609 - DNA, 22 bp, Homo sapiens
aggcttctgataccatgagaga

SEQ ID NO: 8453610 - DNA, 22 bp, Homo sapiens
aggcttctgctgtattaacact

SEQ ID NO: 8453611 - DNA, 22 bp, Homo sapiens
aggcttctggggcaccgagcga

SEQ ID NO: 8453612 - DNA, 22 bp, Homo sapiens
aggcttctgtctttaggagttg

SEQ ID NO: 8453613 - DNA, 22 bp, Homo sapiens
aggcttctggggcaccgagcga

SEQ ID NO: 8453614 - DNA, 22 bp, Homo sapiens
aggcttctgtgagctcatacaa

SEQ ID NO: 8453615 - DNA, 22 bp, Homo sapiens
cccagggctgcagatggaggct

SEQ ID NO: 8453616 - DNA, 22 bp, Homo sapiens
cccagggcttttctcactagac

SEQ ID NO: 8453617 - DNA, 22 bp, Homo sapiens
agggaaatctttcaacacttca

SEQ ID NO: 8453618 - DNA, 22 bp, Homo sapiens
agggaaattaatgtgagcaatg

SEQ ID NO: 8453619 - DNA, 22 bp, Homo sapiens
cccaggatggggctgcagttat

SEQ ID NO: 8453620 - DNA, 22 bp, Homo sapiens
cccaggatggggctgcagttat

SEQ ID NO: 8453621 - DNA, 23 bp, Homo sapiens
agggaacaagcaagctgctagtc

SEQ ID NO: 8453622 - DNA, 22 bp, Homo sapiens
agggaacagtgaaaggcatcag

SEQ ID NO: 8453623 - DNA, 22 bp, Homo sapiens
agggaacagtgaaaggcatcag

SEQ ID NO: 8453624 - DNA, 22 bp, Homo sapiens
agggaactccatgaggccagag

SEQ ID NO: 8453625 - DNA, 20 bp, Homo sapiens
cccaggagtttgctcttact

SEQ ID NO: 8453626 - DNA, 22 bp, Homo sapiens
cccaggagtttgagttcagcat

SEQ ID NO: 8453627 - DNA, 22 bp, Homo sapiens
cccaggatgatcgagagtggga

SEQ ID NO: 8453628 - DNA, 23 bp, Homo sapiens
cccaggagtttcactgcaaaggt

SEQ ID NO: 8453629 - DNA, 22 bp, Homo sapiens
cccaggagttggaggctgcagt

SEQ ID NO: 8453630 - DNA, 22 bp, Homo sapiens
cccaggagttggaggctgcagt

SEQ ID NO: 8453631 - DNA, 22 bp, Homo sapiens
agggatgatcagggtagaggct

SEQ ID NO: 8453632 - DNA, 22 bp, Homo sapiens
agggatgactcttggctgattc

SEQ ID NO: 8453633 - DNA, 22 bp, Homo sapiens
agggatggagcccagctgttct

SEQ ID NO: 8453634 - DNA, 22 bp, Homo sapiens
agggatggatcttggccctgga

SEQ ID NO: 8453635 - DNA, 22 bp, Homo sapiens
agggatggaagctcgtctgcaa

SEQ ID NO: 8453636 - DNA, 22 bp, Homo sapiens
agggatggaagctcgtctgcaa

SEQ ID NO: 8453637 - DNA, 22 bp, Homo sapiens
agggatggaagacttgaagacc

SEQ ID NO: 8453638 - DNA, 22 bp, Homo sapiens
agggatgatttcagtgtctgcc

SEQ ID NO: 8453639 - DNA, 22 bp, Homo sapiens
agggatgatggaaagaagcagg

SEQ ID NO: 8453640 - DNA, 22 bp, Homo sapiens
agggatgatggaaagaagcagg

SEQ ID NO: 8453641 - DNA, 22 bp, Homo sapiens
agggagaacagttgcagcagac

SEQ ID NO: 8453642 - DNA, 22 bp, Homo sapiens
agggagaacagttgcagcagac

SEQ ID NO: 8453643 - DNA, 22 bp, Homo sapiens
agggagaaaattggatgcacaa

SEQ ID NO: 8453644 - DNA, 22 bp, Homo sapiens
agggactggctctctgagcagg

SEQ ID NO: 8453645 - DNA, 22 bp, Homo sapiens
agggagaaggtccatgcctgtc

SEQ ID NO: 8453646 - DNA, 22 bp, Homo sapiens
agggatggcaagttaacctgag

SEQ ID NO: 8453647 - DNA, 22 bp, Homo sapiens
agggatggatcttggccctgga

SEQ ID NO: 8453648 - DNA, 22 bp, Homo sapiens
ccctcccaggagtggccagaga

SEQ ID NO: 8453649 - DNA, 22 bp, Homo sapiens
ccctcccaggagtggccagaga

SEQ ID NO: 8453650 - DNA, 20 bp, Homo sapiens
ccctctgcacatggctgtgg

SEQ ID NO: 8453651 - DNA, 22 bp, Homo sapiens
ccctctctgacttctgaacttg

SEQ ID NO: 8453652 - DNA, 22 bp, Homo sapiens
ccctctgctgcctggctgggtc

SEQ ID NO: 8453653 - DNA, 22 bp, Homo sapiens
ccctctgcaggctggacctgcc

SEQ ID NO: 8453654 - DNA, 20 bp, Homo sapiens
ccctctgcacatggctgtgg

SEQ ID NO: 8453655 - DNA, 22 bp, Homo sapiens
ccctctgcctgcgccctggtgt

SEQ ID NO: 8453656 - DNA, 20 bp, Homo sapiens
ccctctgctacactgggagc

SEQ ID NO: 8453657 - DNA, 20 bp, Homo sapiens
ccctggactcctgagcaaac

SEQ ID NO: 8453658 - DNA, 22 bp, Homo sapiens
agggctcctatgatgctctgcc

SEQ ID NO: 8453659 - DNA, 22 bp, Homo sapiens
agggctccgggccaccggcctg

SEQ ID NO: 8453660 - DNA, 22 bp, Homo sapiens
agggctctgttggggtcagcac

SEQ ID NO: 8453661 - DNA, 22 bp, Homo sapiens
agggctctgttggggtcagcac

SEQ ID NO: 8453662 - DNA, 22 bp, Homo sapiens
cctcctctgtgcagctgtgggt

SEQ ID NO: 8453663 - DNA, 22 bp, Homo sapiens
agggctctgtccccagaggccc

SEQ ID NO: 8453664 - DNA, 22 bp, Homo sapiens
agggctctgtgactatcactgc

SEQ ID NO: 8453665 - DNA, 22 bp, Homo sapiens
agggctctgtccccagaggccc

SEQ ID NO: 8453666 - DNA, 22 bp, Homo sapiens
agggctctggggtggcagagat

SEQ ID NO: 8453667 - DNA, 22 bp, Homo sapiens
agggccctagggaatgagacat

SEQ ID NO: 8453668 - DNA, 22 bp, Homo sapiens
agggccctccccgctcagggca

SEQ ID NO: 8453669 - DNA, 22 bp, Homo sapiens
agggccctgagttgcagccctg

SEQ ID NO: 8453670 - DNA, 22 bp, Homo sapiens
agggccctgagttgcagccctg

SEQ ID NO: 8453671 - DNA, 22 bp, Homo sapiens
agggccctctggcaggccaggc

SEQ ID NO: 8453672 - DNA, 22 bp, Homo sapiens
agggccctctggcaggccaggc

SEQ ID NO: 8453673 - DNA, 23 bp, Homo sapiens
agggcctcaggagggctgcatgg

SEQ ID NO: 8453674 - DNA, 23 bp, Homo sapiens
agggcctcaggagggctgcatgg

SEQ ID NO: 8453675 - DNA, 22 bp, Homo sapiens
agggctccaaggaagtgtagct

SEQ ID NO: 8453676 - DNA, 22 bp, Homo sapiens
agggctccaggggaccatcagt

SEQ ID NO: 8453677 - DNA, 22 bp, Homo sapiens
agggccctaaggaaggcacaca

SEQ ID NO: 8453678 - DNA, 22 bp, Homo sapiens
agggccccatagtcactgcccg

SEQ ID NO: 8453679 - DNA, 22 bp, Homo sapiens
ccgccaggatattgtggctttt

SEQ ID NO: 8453680 - DNA, 22 bp, Homo sapiens
ccgaggctggagtgcagtggcg

SEQ ID NO: 8453681 - DNA, 22 bp, Homo sapiens
ccgaggctggcctcagggctgt

SEQ ID NO: 8453682 - DNA, 22 bp, Homo sapiens
ccgaggctcctccccgagtctg

SEQ ID NO: 8453683 - DNA, 22 bp, Homo sapiens
agggccagagtctgtgtagata

SEQ ID NO: 8453684 - DNA, 22 bp, Homo sapiens
agggccagagtctgtgtagata

SEQ ID NO: 8453685 - DNA, 22 bp, Homo sapiens
agggccagaatccctcagtcta

SEQ ID NO: 8453686 - DNA, 22 bp, Homo sapiens
agggccagaatccctcagtcta

SEQ ID NO: 8453687 - DNA, 22 bp, Homo sapiens
agggccagaatccctcagtcta

SEQ ID NO: 8453688 - DNA, 22 bp, Homo sapiens
agggccagaatccctcagtcta

SEQ ID NO: 8453689 - DNA, 22 bp, Homo sapiens
agggccagaatccctcagtcta

SEQ ID NO: 8453690 - DNA, 22 bp, Homo sapiens
agggccagaggcaccttgcagc

SEQ ID NO: 8453691 - DNA, 22 bp, Homo sapiens
agggccagaggcaccttgcagc

SEQ ID NO: 8453692 - DNA, 22 bp, Homo sapiens
aggggagaaaaatgccttctgt

SEQ ID NO: 8453693 - DNA, 22 bp, Homo sapiens
aggggagaaaaatgccttctgt

SEQ ID NO: 8453694 - DNA, 22 bp, Homo sapiens
aggggacatttagcaatgacta

SEQ ID NO: 8453695 - DNA, 21 bp, Homo sapiens
aggggacagagtagctccagg

SEQ ID NO: 8453696 - DNA, 21 bp, Homo sapiens
aggggacagagtagctccagg

SEQ ID NO: 8453697 - DNA, 22 bp, Homo sapiens
aggggagactggaatctaacat

SEQ ID NO: 8453698 - DNA, 22 bp, Homo sapiens
aggggagaatttcaactcaggt

SEQ ID NO: 8453699 - DNA, 22 bp, Homo sapiens
aggggagagaacataaggaagt

SEQ ID NO: 8453700 - DNA, 22 bp, Homo sapiens
aggggagagaacataaggaagt

SEQ ID NO: 8453701 - DNA, 22 bp, Homo sapiens
aggggagagaacataaggaagt

SEQ ID NO: 8453702 - DNA, 22 bp, Homo sapiens
aggggagaggtgagcaacttct

SEQ ID NO: 8453703 - DNA, 22 bp, Homo sapiens
aggggagagaacataaggaagt

SEQ ID NO: 8453704 - DNA, 22 bp, Homo sapiens
aggggagagttaatgtgaatgt

SEQ ID NO: 8453705 - DNA, 22 bp, Homo sapiens
cctgagagtgagtgcctcctta

SEQ ID NO: 8453706 - DNA, 22 bp, Homo sapiens
cctgagagtgcgtgcctcctta

SEQ ID NO: 8453707 - DNA, 22 bp, Homo sapiens
cctgagctttaaaagccatgta

SEQ ID NO: 8453708 - DNA, 17 bp, Homo sapiens
aggggagagtgggaaga

SEQ ID NO: 8453709 - DNA, 22 bp, Homo sapiens
aggggagaggtgagcaacttct

SEQ ID NO: 8453710 - DNA, 17 bp, Homo sapiens
aggggagagtgggaaga

SEQ ID NO: 8453711 - DNA, 17 bp, Homo sapiens
aggggagagtgggaaga

SEQ ID NO: 8453712 - DNA, 22 bp, Homo sapiens
cctgagctttaaaagccatgta

SEQ ID NO: 8453713 - DNA, 22 bp, Homo sapiens
cctgagctttaaaagccatgta

SEQ ID NO: 8453714 - DNA, 19 bp, Homo sapiens
cctgaggaaaagatgattg

SEQ ID NO: 8453715 - DNA, 22 bp, Homo sapiens
cctgagctttaaaagccatgta

SEQ ID NO: 8453716 - DNA, 22 bp, Homo sapiens
cctgaggacacacgctgcagga

SEQ ID NO: 8453717 - DNA, 22 bp, Homo sapiens
cctgaggacagtgtgaccatgg

SEQ ID NO: 8453718 - DNA, 22 bp, Homo sapiens
aggggctgcctggcttggcact

SEQ ID NO: 8453719 - DNA, 22 bp, Homo sapiens
aggggctggagttcgaggttac

SEQ ID NO: 8453720 - DNA, 22 bp, Homo sapiens
aggggctgggacagagccaagc

SEQ ID NO: 8453721 - DNA, 22 bp, Homo sapiens
cctgaggatgccagcatgggtg

SEQ ID NO: 8453722 - DNA, 22 bp, Homo sapiens
cctgaggaccagcacccatctg

SEQ ID NO: 8453723 - DNA, 22 bp, Homo sapiens
cctgaggagattgtggctgggg

SEQ ID NO: 8453724 - DNA, 22 bp, Homo sapiens
cctgaggagattgtggctgggg

SEQ ID NO: 8453725 - DNA, 22 bp, Homo sapiens
cctgaggcaaggacttggtggc

SEQ ID NO: 8453726 - DNA, 19 bp, Homo sapiens
cctctgccagcccgcctct

SEQ ID NO: 8453727 - DNA, 18 bp, Homo sapiens
cctctgccatagccagca

SEQ ID NO: 8453728 - DNA, 22 bp, Homo sapiens
cctctgggaagccagtcctgct

SEQ ID NO: 8453729 - DNA, 22 bp, Homo sapiens
cctctggcttactgttgggttt

SEQ ID NO: 8453730 - DNA, 21 bp, Homo sapiens
cctctggcttgtgctgtgccc

SEQ ID NO: 8453731 - DNA, 22 bp, Homo sapiens
cctctgggagactgctactgag

SEQ ID NO: 8453732 - DNA, 16 bp, Homo sapiens
cctctgggatgtttgc

SEQ ID NO: 8453733 - DNA, 22 bp, Homo sapiens
cctctgggcaggtagcagcagc

SEQ ID NO: 8453734 - DNA, 22 bp, Homo sapiens
cctctgggccagcctggaccct

SEQ ID NO: 8453735 - DNA, 22 bp, Homo sapiens
cctctgggcaggtagcagcagc

SEQ ID NO: 8453736 - DNA, 22 bp, Homo sapiens
cctctgggcaggtagcagcagc

SEQ ID NO: 8453737 - DNA, 16 bp, Homo sapiens
cctctgggcctgcaag

SEQ ID NO: 8453738 - DNA, 22 bp, Homo sapiens
cctctgggcggagatctgctgc

SEQ ID NO: 8453739 - DNA, 22 bp, Homo sapiens
cctctgggcggagatctgctgc

SEQ ID NO: 8453740 - DNA, 22 bp, Homo sapiens
cctctgggcctggaagggcagt

SEQ ID NO: 8453741 - DNA, 23 bp, Homo sapiens
agggctgatgccattgcagctct

SEQ ID NO: 8453742 - DNA, 22 bp, Homo sapiens
agggctgagtgggagagagttg

SEQ ID NO: 8453743 - DNA, 22 bp, Homo sapiens
cctcctggccctgggcctggaa

SEQ ID NO: 8453744 - DNA, 22 bp, Homo sapiens
cctcctggccctgggcctggaa

SEQ ID NO: 8453745 - DNA, 22 bp, Homo sapiens
cctcctggccctgggcctggaa

SEQ ID NO: 8453746 - DNA, 22 bp, Homo sapiens
cctcctggatggatttggtgga

SEQ ID NO: 8453747 - DNA, 22 bp, Homo sapiens
cctcctggatggatttggtgga

SEQ ID NO: 8453748 - DNA, 22 bp, Homo sapiens
cctcctggaggctctagggaaa

SEQ ID NO: 8453749 - DNA, 22 bp, Homo sapiens
cctcctggaggctctagggaaa

SEQ ID NO: 8453750 - DNA, 22 bp, Homo sapiens
cctcctggaggctctagggaaa

SEQ ID NO: 8453751 - DNA, 19 bp, Homo sapiens
cctcctgctagatatgcaa

SEQ ID NO: 8453752 - DNA, 22 bp, Homo sapiens
cctcctgcggcgtccgcgctct

SEQ ID NO: 8453753 - DNA, 22 bp, Homo sapiens
cctcctgcggcgtccgcgctct

SEQ ID NO: 8453754 - DNA, 21 bp, Homo sapiens
cctcctgcccgcaagctaggg

SEQ ID NO: 8453755 - DNA, 22 bp, Homo sapiens
cctcctgcacttgctttccttc

SEQ ID NO: 8453756 - DNA, 22 bp, Homo sapiens
cctcctggagcattggtgagga

SEQ ID NO: 8453757 - DNA, 22 bp, Homo sapiens
cctcctggagcattggtgagga

SEQ ID NO: 8453758 - DNA, 22 bp, Homo sapiens
cctcctggaggctctaagggag

SEQ ID NO: 8453759 - DNA, 22 bp, Homo sapiens
cctcctggaggctctaagggag

SEQ ID NO: 8453760 - DNA, 22 bp, Homo sapiens
cctcctggaggctctaagggag

SEQ ID NO: 8453761 - DNA, 22 bp, Homo sapiens
cctcctggaaaaattccctggc

SEQ ID NO: 8453762 - DNA, 22 bp, Homo sapiens
cctcctggaaaaattccctggc

SEQ ID NO: 8453763 - DNA, 22 bp, Homo sapiens
ccaggagctatgtacacactat

SEQ ID NO: 8453764 - DNA, 22 bp, Homo sapiens
ccaggagctatgtacacactat

SEQ ID NO: 8453765 - DNA, 17 bp, Homo sapiens
ccaggagcgtgggtctc

SEQ ID NO: 8453766 - DNA, 17 bp, Homo sapiens
ccaggagcgtgggtctc

SEQ ID NO: 8453767 - DNA, 22 bp, Homo sapiens
ccaggagctggagggtgcagtg

SEQ ID NO: 8453768 - DNA, 22 bp, Homo sapiens
ccaggagctggagggtgcagtg

SEQ ID NO: 8453769 - DNA, 22 bp, Homo sapiens
ccaggaggaaagaccagcccat

SEQ ID NO: 8453770 - DNA, 22 bp, Homo sapiens
ccaggagctggcatgtggagag

SEQ ID NO: 8453771 - DNA, 22 bp, Homo sapiens
aggctcagtctgttcatgcact

SEQ ID NO: 8453772 - DNA, 22 bp, Homo sapiens
aggctcagtcccggcccgcgcc

SEQ ID NO: 8453773 - DNA, 22 bp, Homo sapiens
aggctcagtatagctggcaagt

SEQ ID NO: 8453774 - DNA, 22 bp, Homo sapiens
aggctcagcctgggcctagagc

SEQ ID NO: 8453775 - DNA, 22 bp, Homo sapiens
aggctcatccccacaaagcaaa

SEQ ID NO: 8453776 - DNA, 22 bp, Homo sapiens
aggctccaaattaccaagctct

SEQ ID NO: 8453777 - DNA, 22 bp, Homo sapiens
aggctcagttcacgtcaacttt

SEQ ID NO: 8453778 - DNA, 22 bp, Homo sapiens
aggctcagttctgtggtgagcc

SEQ ID NO: 8453779 - DNA, 22 bp, Homo sapiens
aggctcagttctgtggtgagcc

SEQ ID NO: 8453780 - DNA, 23 bp, Homo sapiens
ccagggaaggccatcttcaactg

SEQ ID NO: 8453781 - DNA, 22 bp, Homo sapiens
ccagggaaggctctgcctgctt

SEQ ID NO: 8453782 - DNA, 22 bp, Homo sapiens
ccagggaaggctctgcctgctt

SEQ ID NO: 8453783 - DNA, 22 bp, Homo sapiens
aggctccaccctacagagctcc

SEQ ID NO: 8453784 - DNA, 22 bp, Homo sapiens
ccaggctgtaaacaccttcaaa

SEQ ID NO: 8453785 - DNA, 22 bp, Homo sapiens
ccaggctgtaaacaccttcaaa

SEQ ID NO: 8453786 - DNA, 22 bp, Homo sapiens
aggctccaccagtcaggtgcat

SEQ ID NO: 8453787 - DNA, 22 bp, Homo sapiens
aggctccaccagtcaggtgcat

SEQ ID NO: 8453788 - DNA, 22 bp, Homo sapiens
ccagggagcccacaggacaatg

SEQ ID NO: 8453789 - DNA, 22 bp, Homo sapiens
aggctcctagcctgtggctggt

SEQ ID NO: 8453790 - DNA, 22 bp, Homo sapiens
aggctcctagcctgtggctggt

SEQ ID NO: 8453791 - DNA, 22 bp, Homo sapiens
aggctcctagcctgtggctggt

SEQ ID NO: 8453792 - DNA, 20 bp, Homo sapiens
aggctcctccaggatgtgtg

SEQ ID NO: 8453793 - DNA, 17 bp, Homo sapiens
aggctcctcctaaggtc

SEQ ID NO: 8453794 - DNA, 17 bp, Homo sapiens
aggctcctcctaaggtc

SEQ ID NO: 8453795 - DNA, 17 bp, Homo sapiens
aggctcctcctaaggtc

SEQ ID NO: 8453796 - DNA, 22 bp, Homo sapiens
aggctcctgagaggcagaggct

SEQ ID NO: 8453797 - DNA, 22 bp, Homo sapiens
aggctcctgagaggcagaggct

SEQ ID NO: 8453798 - DNA, 22 bp, Homo sapiens
aggctcctgagaggcagaggct

SEQ ID NO: 8453799 - DNA, 22 bp, Homo sapiens
aggctcctcggggctgacggcg

SEQ ID NO: 8453800 - DNA, 22 bp, Homo sapiens
aggctcctcggggctgacggcg

SEQ ID NO: 8453801 - DNA, 18 bp, Homo sapiens
ccagggagcttattagga

SEQ ID NO: 8453802 - DNA, 22 bp, Homo sapiens
ccagggagcggggctgggtctc

SEQ ID NO: 8453803 - DNA, 22 bp, Homo sapiens
ccagggagcctggtgtgtcagc

SEQ ID NO: 8453804 - DNA, 22 bp, Homo sapiens
ccagggaggagcatttcatggt

SEQ ID NO: 8453805 - DNA, 22 bp, Homo sapiens
ccagggaggagcatttcatggt

SEQ ID NO: 8453806 - DNA, 22 bp, Homo sapiens
aggctcctgggtgtggccgcca

SEQ ID NO: 8453807 - DNA, 22 bp, Homo sapiens
aggctccttgctcacaggctca

SEQ ID NO: 8453808 - DNA, 22 bp, Homo sapiens
aggctccttgctcacaggctca

SEQ ID NO: 8453809 - DNA, 22 bp, Homo sapiens
aggctccttcacagcactcgcc

SEQ ID NO: 8453810 - DNA, 22 bp, Homo sapiens
aggctcctgcaggtgaggtgct

SEQ ID NO: 8453811 - DNA, 22 bp, Homo sapiens
aggctcctgggtgtggccgcca

SEQ ID NO: 8453812 - DNA, 22 bp, Homo sapiens
aggctcctgggtgtggccgcca

SEQ ID NO: 8453813 - DNA, 20 bp, Homo sapiens
aggctcctgtacctgaggaa

SEQ ID NO: 8453814 - DNA, 22 bp, Homo sapiens
aggctcctgcaggccttgtagg

SEQ ID NO: 8453815 - DNA, 22 bp, Homo sapiens
ccagggtgagaaaaggctggat

SEQ ID NO: 8453816 - DNA, 22 bp, Homo sapiens
ccagggtgagaaaaggctggat

SEQ ID NO: 8453817 - DNA, 22 bp, Homo sapiens
ccagggtgagtgtcatgggtta

SEQ ID NO: 8453818 - DNA, 20 bp, Homo sapiens
cccagagccatagccagaca

SEQ ID NO: 8453819 - DNA, 20 bp, Homo sapiens
cccagagccatagccagaca

SEQ ID NO: 8453820 - DNA, 22 bp, Homo sapiens
cccagagcatgtgctgcctttg

SEQ ID NO: 8453821 - DNA, 22 bp, Homo sapiens
cccagagcatgtgctgcctttg

SEQ ID NO: 8453822 - DNA, 22 bp, Homo sapiens
cccagagcatgtgctgcctttg

SEQ ID NO: 8453823 - DNA, 22 bp, Homo sapiens
cccagagcatgtgctgcctttg

SEQ ID NO: 8453824 - DNA, 22 bp, Homo sapiens
cccagagatgtcctgagtgata

SEQ ID NO: 8453825 - DNA, 23 bp, Homo sapiens
cccagagcacagcctccagatgc

SEQ ID NO: 8453826 - DNA, 22 bp, Homo sapiens
cccagagccggtggtgctcaca

SEQ ID NO: 8453827 - DNA, 21 bp, Homo sapiens
cccagagcctagggagggcac

SEQ ID NO: 8453828 - DNA, 21 bp, Homo sapiens
cccagagcctagggagggcac

SEQ ID NO: 8453829 - DNA, 17 bp, Homo sapiens
aggctggctcacaggga

SEQ ID NO: 8453830 - DNA, 17 bp, Homo sapiens
aggctggctcacaggga

SEQ ID NO: 8453831 - DNA, 17 bp, Homo sapiens
aggctggctcacaggga

SEQ ID NO: 8453832 - DNA, 22 bp, Homo sapiens
aggctggctcggcttttctgtc

SEQ ID NO: 8453833 - DNA, 22 bp, Homo sapiens
aggctggctcggcttttctgtc

SEQ ID NO: 8453834 - DNA, 22 bp, Homo sapiens
aggctggctgaaaaacaccctt

SEQ ID NO: 8453835 - DNA, 22 bp, Homo sapiens
aggctgcctcgtgagctcgctg

SEQ ID NO: 8453836 - DNA, 22 bp, Homo sapiens
aggctgcctcgtgagctcgctg

SEQ ID NO: 8453837 - DNA, 22 bp, Homo sapiens
aggctgcctctgcaggatccct

SEQ ID NO: 8453838 - DNA, 22 bp, Homo sapiens
aggctgcctctgcaggatccct

SEQ ID NO: 8453839 - DNA, 22 bp, Homo sapiens
aggctgcctcttttgagagggt

SEQ ID NO: 8453840 - DNA, 22 bp, Homo sapiens
cccactgctgctctccatggca

SEQ ID NO: 8453841 - DNA, 22 bp, Homo sapiens
aggctgctcacctccctgtctg

SEQ ID NO: 8453842 - DNA, 22 bp, Homo sapiens
aggctgcctgttccaatctcct

SEQ ID NO: 8453843 - DNA, 22 bp, Homo sapiens
aggctgctataaacattcccgt

SEQ ID NO: 8453844 - DNA, 22 bp, Homo sapiens
aggctgctcacctccctgtctg

SEQ ID NO: 8453845 - DNA, 20 bp, Homo sapiens
aggctgcctaaggctctgca

SEQ ID NO: 8453846 - DNA, 20 bp, Homo sapiens
aggctgcctaaggctctgca

SEQ ID NO: 8453847 - DNA, 19 bp, Homo sapiens
aggctgcctcaccctccct

SEQ ID NO: 8453848 - DNA, 22 bp, Homo sapiens
ccatgggcgcacaggcctggag

SEQ ID NO: 8453849 - DNA, 22 bp, Homo sapiens
ccatggctcttaccttgttata

SEQ ID NO: 8453850 - DNA, 22 bp, Homo sapiens
ccatggctccttgccctgtagc

SEQ ID NO: 8453851 - DNA, 22 bp, Homo sapiens
ccatggctaagtatctgtagaa

SEQ ID NO: 8453852 - DNA, 19 bp, Homo sapiens
ccatgcagcctgggggcag

SEQ ID NO: 8453853 - DNA, 22 bp, Homo sapiens
aggctgagtcgggaggatcact

SEQ ID NO: 8453854 - DNA, 22 bp, Homo sapiens
ccatggcttacagatggagcat

SEQ ID NO: 8453855 - DNA, 22 bp, Homo sapiens
ccatggcttctttctctgccag

SEQ ID NO: 8453856 - DNA, 22 bp, Homo sapiens
aggctgaggtaggaggatcgct

SEQ ID NO: 8453857 - DNA, 20 bp, Homo sapiens
aggctgagggtgattgtgtc

SEQ ID NO: 8453858 - DNA, 22 bp, Homo sapiens
aggctgaggtgtgctgtgatcg

SEQ ID NO: 8453859 - DNA, 22 bp, Homo sapiens
aggctgagtcgggaggatcact

SEQ ID NO: 8453860 - DNA, 22 bp, Homo sapiens
aggctgagtcaagttagggtga

SEQ ID NO: 8453861 - DNA, 22 bp, Homo sapiens
aggctgaggtgtgctgtgatcg

SEQ ID NO: 8453862 - DNA, 22 bp, Homo sapiens
aggctgagtcaagttagggtga

SEQ ID NO: 8453863 - DNA, 22 bp, Homo sapiens
ccagggtgctctgtggcgtcgc

SEQ ID NO: 8453864 - DNA, 22 bp, Homo sapiens
ccagggtggaggctggatggag

SEQ ID NO: 8453865 - DNA, 22 bp, Homo sapiens
aggctctgtgcagcctgcatct

SEQ ID NO: 8453866 - DNA, 22 bp, Homo sapiens
aggctctgtgatgtgccaggca

SEQ ID NO: 8453867 - DNA, 22 bp, Homo sapiens
aggctctgtgatccacaatgag

SEQ ID NO: 8453868 - DNA, 22 bp, Homo sapiens
aggctgaggggcgagggaccct

SEQ ID NO: 8453869 - DNA, 20 bp, Homo sapiens
aggctgagggtgattgtgtc

SEQ ID NO: 8453870 - DNA, 22 bp, Homo sapiens
aggctgaggtaggaggatcgct

SEQ ID NO: 8453871 - DNA, 22 bp, Homo sapiens
aggctgaggcgggtagatcacc

SEQ ID NO: 8453872 - DNA, 22 bp, Homo sapiens
ccagcctgaaatgcctcatcct

SEQ ID NO: 8453873 - DNA, 22 bp, Homo sapiens
aggccagagaggggaccagcct

SEQ ID NO: 8453874 - DNA, 22 bp, Homo sapiens
ccagccctgccagagagagctg

SEQ ID NO: 8453875 - DNA, 22 bp, Homo sapiens
ccagcctcatcgcctgcctgtc

SEQ ID NO: 8453876 - DNA, 21 bp, Homo sapiens
ccagctttcccaagtcccttt

SEQ ID NO: 8453877 - DNA, 22 bp, Homo sapiens
ccagcttggaatatgccattgt

SEQ ID NO: 8453878 - DNA, 19 bp, Homo sapiens
ccagctggcctgggacctc

SEQ ID NO: 8453879 - DNA, 22 bp, Homo sapiens
aggcccagctggacaaactgct

SEQ ID NO: 8453880 - DNA, 22 bp, Homo sapiens
aggcccagctggacaaactgct

SEQ ID NO: 8453881 - DNA, 22 bp, Homo sapiens
aggcccagctggacaaactgct

SEQ ID NO: 8453882 - DNA, 19 bp, Homo sapiens
aggcccagcgctgggggct

SEQ ID NO: 8453883 - DNA, 19 bp, Homo sapiens
aggcccagcgctgggggct

SEQ ID NO: 8453884 - DNA, 19 bp, Homo sapiens
aggcccagcgctgggggct

SEQ ID NO: 8453885 - DNA, 19 bp, Homo sapiens
aggcccagcgctgggggct

SEQ ID NO: 8453886 - DNA, 22 bp, Homo sapiens
aggcccagcccgtcctcgtgct

SEQ ID NO: 8453887 - DNA, 22 bp, Homo sapiens
aggcccagcccgtcctcgtgct

SEQ ID NO: 8453888 - DNA, 22 bp, Homo sapiens
aggcccagcccgtcctcgtgct

SEQ ID NO: 8453889 - DNA, 22 bp, Homo sapiens
aggcccagagcaggaaagggtt

SEQ ID NO: 8453890 - DNA, 21 bp, Homo sapiens
aggcccagagtcttgggggga

SEQ ID NO: 8453891 - DNA, 22 bp, Homo sapiens
aggcccagagagccagttagtg

SEQ ID NO: 8453892 - DNA, 22 bp, Homo sapiens
ccagcctggactgggtcttgtg

SEQ ID NO: 8453893 - DNA, 22 bp, Homo sapiens
ccagcttttcctctcattgctt

SEQ ID NO: 8453894 - DNA, 22 bp, Homo sapiens
aggccctggcccccagagattc

SEQ ID NO: 8453895 - DNA, 22 bp, Homo sapiens
aggccctggcccccagagattc

SEQ ID NO: 8453896 - DNA, 22 bp, Homo sapiens
aggccctggcactgcctgggag

SEQ ID NO: 8453897 - DNA, 22 bp, Homo sapiens
ccaggacaagtgtggccatggc

SEQ ID NO: 8453898 - DNA, 22 bp, Homo sapiens
ccaggacaattcgtcactttct

SEQ ID NO: 8453899 - DNA, 22 bp, Homo sapiens
ccaggacaattcgtcactttct

SEQ ID NO: 8453900 - DNA, 22 bp, Homo sapiens
aggccctgggagcagagatgca

SEQ ID NO: 8453901 - DNA, 18 bp, Homo sapiens
aggccctggcctcgaaca

SEQ ID NO: 8453902 - DNA, 22 bp, Homo sapiens
ccaggagcgcgtgaacaggctg

SEQ ID NO: 8453903 - DNA, 22 bp, Homo sapiens
ccaggagcgggaaaaggaagaa

SEQ ID NO: 8453904 - DNA, 22 bp, Homo sapiens
ccaggagatttttccatagcac

SEQ ID NO: 8453905 - DNA, 22 bp, Homo sapiens
ccaggagatttttccatagcac

SEQ ID NO: 8453906 - DNA, 22 bp, Homo sapiens
ccaggagatttttccatagcac

SEQ ID NO: 8453907 - DNA, 19 bp, Homo sapiens
ccaggagagcttggagaag

SEQ ID NO: 8453908 - DNA, 22 bp, Homo sapiens
ccaggagatgggaaagtagcag

SEQ ID NO: 8453909 - DNA, 22 bp, Homo sapiens
ccaggagatgggagcatctaaa

SEQ ID NO: 8453910 - DNA, 22 bp, Homo sapiens
ccaggagatgggaaagtagcag

SEQ ID NO: 8453911 - DNA, 22 bp, Homo sapiens
ccaggagagctctcgttcagtg

SEQ ID NO: 8453912 - DNA, 22 bp, Homo sapiens
ccaggagagcattgcacagagg

SEQ ID NO: 8453913 - DNA, 22 bp, Homo sapiens
ccaggagagcattgcacagagg

SEQ ID NO: 8453914 - DNA, 22 bp, Homo sapiens
ccaggagagcaggcgtgcagct

SEQ ID NO: 8453915 - DNA, 22 bp, Homo sapiens
ccaggagagcaggcgtgcagct

SEQ ID NO: 8453916 - DNA, 22 bp, Homo sapiens
ccaggagagcagaagcccaggc

SEQ ID NO: 8453917 - DNA, 22 bp, Homo sapiens
ccaggagagcagaagcccaggc

SEQ ID NO: 8453918 - DNA, 22 bp, Homo sapiens
ccagagaggtagcttaccctct

SEQ ID NO: 8453919 - DNA, 22 bp, Homo sapiens
ccagagaggggaagggcttgcc

SEQ ID NO: 8453920 - DNA, 22 bp, Homo sapiens
ccagagagtaggaggcattatt

SEQ ID NO: 8453921 - DNA, 22 bp, Homo sapiens
ccagagagtatcatggagagta

SEQ ID NO: 8453922 - DNA, 20 bp, Homo sapiens
ccacaggagtccagtcgacc

SEQ ID NO: 8453923 - DNA, 22 bp, Homo sapiens
ccacaggaccagaggagatcac

SEQ ID NO: 8453924 - DNA, 22 bp, Homo sapiens
ccacaggacggaggtctggccg

SEQ ID NO: 8453925 - DNA, 22 bp, Homo sapiens
ccacaggacggaggtctggccg

SEQ ID NO: 8453926 - DNA, 22 bp, Homo sapiens
ccacaggacggaggtctggccg

SEQ ID NO: 8453927 - DNA, 22 bp, Homo sapiens
ccacaggaggatgttcagacaa

SEQ ID NO: 8453928 - DNA, 20 bp, Homo sapiens
ccacaggagtccagtcgacc

SEQ ID NO: 8453929 - DNA, 22 bp, Homo sapiens
aggcaggggagctggaagggta

SEQ ID NO: 8453930 - DNA, 22 bp, Homo sapiens
aggcagggtcttgctatgttgc

SEQ ID NO: 8453931 - DNA, 22 bp, Homo sapiens
aggcaggggagctggaagggta

SEQ ID NO: 8453932 - DNA, 22 bp, Homo sapiens
aggcagggtgatgataatgatt

SEQ ID NO: 8453933 - DNA, 17 bp, Homo sapiens
ccacagctgggtgcctt

SEQ ID NO: 8453934 - DNA, 22 bp, Homo sapiens
ccacagcttcgcagtctgctgc

SEQ ID NO: 8453935 - DNA, 22 bp, Homo sapiens
ccacagcttcttatatcactgg

SEQ ID NO: 8453936 - DNA, 21 bp, Homo sapiens
ccacagctggtctctgagccc

SEQ ID NO: 8453937 - DNA, 22 bp, Homo sapiens
ccacagcttcgcagtctgctgc

SEQ ID NO: 8453938 - DNA, 22 bp, Homo sapiens
ccacaggacacaactgctgacc

SEQ ID NO: 8453939 - DNA, 22 bp, Homo sapiens
ccacaggacacaactgctgacc

SEQ ID NO: 8453940 - DNA, 22 bp, Homo sapiens
aggccagacagctagaaacagg

SEQ ID NO: 8453941 - DNA, 22 bp, Homo sapiens
aggccagaacagctctgcacca

SEQ ID NO: 8453942 - DNA, 22 bp, Homo sapiens
ccagcagaggggcggagtgcag

SEQ ID NO: 8453943 - DNA, 22 bp, Homo sapiens
ccagcagagctggaagtgtgct

SEQ ID NO: 8453944 - DNA, 22 bp, Homo sapiens
ccagcagagggcgcttcacacc

SEQ ID NO: 8453945 - DNA, 19 bp, Homo sapiens
ccagcagaagccactcctg

SEQ ID NO: 8453946 - DNA, 22 bp, Homo sapiens
ccagcagacacacaggcgtggg

SEQ ID NO: 8453947 - DNA, 22 bp, Homo sapiens
ccagcagaagctcccgctgggt

SEQ ID NO: 8453948 - DNA, 22 bp, Homo sapiens
ccagcagagcatggggaggaag

SEQ ID NO: 8453949 - DNA, 22 bp, Homo sapiens
ccagcagagctggaagtgtgct

SEQ ID NO: 8453950 - DNA, 22 bp, Homo sapiens
ccagcagagctcaaacttcctg

SEQ ID NO: 8453951 - DNA, 22 bp, Homo sapiens
ccagcagagctcaaacttcctg

SEQ ID NO: 8453952 - DNA, 22 bp, Homo sapiens
ccagcagagcatggggaggaag

SEQ ID NO: 8453953 - DNA, 19 bp, Homo sapiens
ccagcagacacagctgccc

SEQ ID NO: 8453954 - DNA, 22 bp, Homo sapiens
ccagagcagatgtggccttggt

SEQ ID NO: 8453955 - DNA, 22 bp, Homo sapiens
ccagagcaattctcacagaact

SEQ ID NO: 8453956 - DNA, 21 bp, Homo sapiens
aggcatggaaatggcacactg

SEQ ID NO: 8453957 - DNA, 22 bp, Homo sapiens
aggcatggacatttcggcagct

SEQ ID NO: 8453958 - DNA, 22 bp, Homo sapiens
aggcatggatggatccagggct

SEQ ID NO: 8453959 - DNA, 23 bp, Homo sapiens
aggcatggcatggatggtggctc

SEQ ID NO: 8453960 - DNA, 23 bp, Homo sapiens
aggcatggcatggatggtggctc

SEQ ID NO: 8453961 - DNA, 22 bp, Homo sapiens
atttggtagtgattgaaattat

SEQ ID NO: 8453962 - DNA, 20 bp, Homo sapiens
atttgggacgattggccacc

SEQ ID NO: 8453963 - DNA, 22 bp, Homo sapiens
atttgggagttgctagtgagtt

SEQ ID NO: 8453964 - DNA, 22 bp, Homo sapiens
atttgggaattatttgcctaat

SEQ ID NO: 8453965 - DNA, 22 bp, Homo sapiens
atttgggaatgtgcattatact

SEQ ID NO: 8453966 - DNA, 22 bp, Homo sapiens
atttcttcctctgtcagtaact

SEQ ID NO: 8453967 - DNA, 22 bp, Homo sapiens
atttggtgaggtagccattgtt

SEQ ID NO: 8453968 - DNA, 22 bp, Homo sapiens
attttagatttaagaataaggt

SEQ ID NO: 8453969 - DNA, 22 bp, Homo sapiens
atttgtctctgcactttactca

SEQ ID NO: 8453970 - DNA, 22 bp, Homo sapiens
attttagatttaagaataaggt

SEQ ID NO: 8453971 - DNA, 22 bp, Homo sapiens
atttgtctagtggtattcacgt

SEQ ID NO: 8453972 - DNA, 21 bp, Homo sapiens
attttcattaattcagtgtgg

SEQ ID NO: 8453973 - DNA, 22 bp, Homo sapiens
attttcattttgcagggtgaga

SEQ ID NO: 8453974 - DNA, 22 bp, Homo sapiens
attttccttctaagaggaaggt

SEQ ID NO: 8453975 - DNA, 22 bp, Homo sapiens
attttccttgtgggttagcgaa

SEQ ID NO: 8453976 - DNA, 22 bp, Homo sapiens
gcctgtgctgttccctctgcca

SEQ ID NO: 8453977 - DNA, 22 bp, Homo sapiens
attttcctccatgtgagcagtt

SEQ ID NO: 8453978 - DNA, 22 bp, Homo sapiens
attttcctctggtttccccaga

SEQ ID NO: 8453979 - DNA, 22 bp, Homo sapiens
attttcctcaagcctctggaag

SEQ ID NO: 8453980 - DNA, 22 bp, Homo sapiens
attttcctagtcatgtgcttct

SEQ ID NO: 8453981 - DNA, 22 bp, Homo sapiens
gccttcccaagacgcctgagtt

SEQ ID NO: 8453982 - DNA, 19 bp, Homo sapiens
gccttcccaccacccgtcc

SEQ ID NO: 8453983 - DNA, 22 bp, Homo sapiens
gccttcccaccctgcgaggctg

SEQ ID NO: 8453984 - DNA, 22 bp, Homo sapiens
gccttccctctcatcctgctgg

SEQ ID NO: 8453985 - DNA, 22 bp, Homo sapiens
gccttcctgcagctctgagcgt

SEQ ID NO: 8453986 - DNA, 22 bp, Homo sapiens
gccttccctggctaggcaagca

SEQ ID NO: 8453987 - DNA, 22 bp, Homo sapiens
gccttccttacacctgctcagc

SEQ ID NO: 8453988 - DNA, 22 bp, Homo sapiens
gccttccttacacctgctcagc

SEQ ID NO: 8453989 - DNA, 22 bp, Homo sapiens
gctcagagagtttcacaagttt

SEQ ID NO: 8453990 - DNA, 22 bp, Homo sapiens
gctcagagagtttcacaagttt

SEQ ID NO: 8453991 - DNA, 22 bp, Homo sapiens
gctcagagagattaaataattt

SEQ ID NO: 8453992 - DNA, 22 bp, Homo sapiens
gctcagagagattaaataattt

SEQ ID NO: 8453993 - DNA, 21 bp, Homo sapiens
gctcagagagggtaattaacc

SEQ ID NO: 8453994 - DNA, 19 bp, Homo sapiens
gctcagagacacctgttgc

SEQ ID NO: 8453995 - DNA, 22 bp, Homo sapiens
gctcagagagaggctcaccatt

SEQ ID NO: 8453996 - DNA, 22 bp, Homo sapiens
gctcagagagaggatatgttat

SEQ ID NO: 8453997 - DNA, 22 bp, Homo sapiens
gctcagagagaggatatgttat

SEQ ID NO: 8453998 - DNA, 19 bp, Homo sapiens
gctcagagacacctgttgc

SEQ ID NO: 8453999 - DNA, 22 bp, Homo sapiens
gctcagagaagttaaggaattt

SEQ ID NO: 8454000 - DNA, 22 bp, Homo sapiens
gctcagagaagcggtttcgcct

SEQ ID NO: 8454001 - DNA, 22 bp, Homo sapiens
gctcagagaaattataggaatt

SEQ ID NO: 8454002 - DNA, 22 bp, Homo sapiens
gctcagagaagttaaggaattt

SEQ ID NO: 8454003 - DNA, 22 bp, Homo sapiens
gctcagagaagttgtgcctggc

SEQ ID NO: 8454004 - DNA, 22 bp, Homo sapiens
gctcagagaatttactgctgcc

SEQ ID NO: 8454005 - DNA, 22 bp, Homo sapiens
gctcagagaagttgtgcctggc

SEQ ID NO: 8454006 - DNA, 22 bp, Homo sapiens
gctcagagaatttactgctgcc

SEQ ID NO: 8454007 - DNA, 22 bp, Homo sapiens
gctcagagaatttactgctgcc

SEQ ID NO: 8454008 - DNA, 22 bp, Homo sapiens
gctcagagaatcagcagacacc

SEQ ID NO: 8454009 - DNA, 22 bp, Homo sapiens
gctcagagaatcagcagacacc

SEQ ID NO: 8454010 - DNA, 22 bp, Homo sapiens
caaaagatacttgcatctaact

SEQ ID NO: 8454011 - DNA, 22 bp, Homo sapiens
caaaagatacttgcatctaact

SEQ ID NO: 8454012 - DNA, 21 bp, Homo sapiens
caaaagagactgattcttgga

SEQ ID NO: 8454013 - DNA, 22 bp, Homo sapiens
caaaagcaaagtccctgaatgt

SEQ ID NO: 8454014 - DNA, 20 bp, Homo sapiens
caaaagcaatgaagttatga

SEQ ID NO: 8454015 - DNA, 22 bp, Homo sapiens
caaaagcagcaagtttatatgt

SEQ ID NO: 8454016 - DNA, 22 bp, Homo sapiens
caaaagcagcaagtttatatgt

SEQ ID NO: 8454017 - DNA, 20 bp, Homo sapiens
caaaagcaatgaagttatga

SEQ ID NO: 8454018 - DNA, 22 bp, Homo sapiens
attttgatgctatctaatgaat

SEQ ID NO: 8454019 - DNA, 17 bp, Homo sapiens
gccttccttcctccaca

SEQ ID NO: 8454020 - DNA, 22 bp, Homo sapiens
attttgataatcatgttagaga

SEQ ID NO: 8454021 - DNA, 22 bp, Homo sapiens
attttgataatcatgttagaga

SEQ ID NO: 8454022 - DNA, 22 bp, Homo sapiens
attttgaatcaccttggaagaa

SEQ ID NO: 8454023 - DNA, 22 bp, Homo sapiens
gccttccttttaccaccagcca

SEQ ID NO: 8454024 - DNA, 17 bp, Homo sapiens
gccttccttcctccaca

SEQ ID NO: 8454025 - DNA, 22 bp, Homo sapiens
attttgcacactatgcagcttt

SEQ ID NO: 8454026 - DNA, 22 bp, Homo sapiens
attttgcacactatgcagcttt

SEQ ID NO: 8454027 - DNA, 22 bp, Homo sapiens
attttgatgtatctttgtagct

SEQ ID NO: 8454028 - DNA, 22 bp, Homo sapiens
gctcaaatttcagactcatgaa

SEQ ID NO: 8454029 - DNA, 22 bp, Homo sapiens
gctcaaatcccagcgggctcct

SEQ ID NO: 8454030 - DNA, 22 bp, Homo sapiens
gctcaaatgtcatggggagcct

SEQ ID NO: 8454031 - DNA, 22 bp, Homo sapiens
gctcagagaaaactggggcttg

SEQ ID NO: 8454032 - DNA, 22 bp, Homo sapiens
gctcagagaaaactggggcttg

SEQ ID NO: 8454033 - DNA, 22 bp, Homo sapiens
gctcagagaaaactggggcttg

SEQ ID NO: 8454034 - DNA, 22 bp, Homo sapiens
gctcagagaaaactggggcttg

SEQ ID NO: 8454035 - DNA, 22 bp, Homo sapiens
gctcagagaaattataggaatt

SEQ ID NO: 8454036 - DNA, 22 bp, Homo sapiens
gctcagagaaattataggaatt

SEQ ID NO: 8454037 - DNA, 22 bp, Homo sapiens
gctcagagaaagattagtccct

SEQ ID NO: 8454038 - DNA, 22 bp, Homo sapiens
caaagactgcataacacatgaa

SEQ ID NO: 8454039 - DNA, 22 bp, Homo sapiens
caaagacacgggaaacaacgtt

SEQ ID NO: 8454040 - DNA, 22 bp, Homo sapiens
caaagacacgggaaacaacgtt

SEQ ID NO: 8454041 - DNA, 22 bp, Homo sapiens
caaagacacgggaaacaacgtt

SEQ ID NO: 8454042 - DNA, 20 bp, Homo sapiens
caaagacatgctaggggtgg

SEQ ID NO: 8454043 - DNA, 22 bp, Homo sapiens
gctctgagattgagcctttggt

SEQ ID NO: 8454044 - DNA, 22 bp, Homo sapiens
gctctgagatcattcactgtaa

SEQ ID NO: 8454045 - DNA, 22 bp, Homo sapiens
gctctgagagtgggtgattctg

SEQ ID NO: 8454046 - DNA, 22 bp, Homo sapiens
caaagaagagatttacagagct

SEQ ID NO: 8454047 - DNA, 22 bp, Homo sapiens
caaagacacgggaaacaacgtt

SEQ ID NO: 8454048 - DNA, 22 bp, Homo sapiens
gctcccagggaccgcagggcag

SEQ ID NO: 8454049 - DNA, 22 bp, Homo sapiens
gctcccagggaccgcagggcag

SEQ ID NO: 8454050 - DNA, 22 bp, Homo sapiens
gctcccagggacactggccact

SEQ ID NO: 8454051 - DNA, 22 bp, Homo sapiens
gctcccaggcatggaggtaatt

SEQ ID NO: 8454052 - DNA, 22 bp, Homo sapiens
gctcccaggcatggaggtaatt

SEQ ID NO: 8454053 - DNA, 22 bp, Homo sapiens
gctcccagggacactggccact

SEQ ID NO: 8454054 - DNA, 22 bp, Homo sapiens
caaaagcagcaagtttatatgt

SEQ ID NO: 8454055 - DNA, 22 bp, Homo sapiens
caaaagcagcaagtttatatgt

SEQ ID NO: 8454056 - DNA, 22 bp, Homo sapiens
caaaagcagcaagtttatatgt

SEQ ID NO: 8454057 - DNA, 22 bp, Homo sapiens
gctcccaggatgaggagccagg

SEQ ID NO: 8454058 - DNA, 22 bp, Homo sapiens
gctcccagtctgatggaggaga

SEQ ID NO: 8454059 - DNA, 22 bp, Homo sapiens
gctcccagtctgatggaggaga

SEQ ID NO: 8454060 - DNA, 22 bp, Homo sapiens
gctccccagcttagccctggct

SEQ ID NO: 8454061 - DNA, 22 bp, Homo sapiens
gctcccaggttcttgggccttg

SEQ ID NO: 8454062 - DNA, 22 bp, Homo sapiens
gctcccagggcagcgcagaaga

SEQ ID NO: 8454063 - DNA, 22 bp, Homo sapiens
gctcccagggcagcgcagaaga

SEQ ID NO: 8454064 - DNA, 22 bp, Homo sapiens
atttagtttaggaaaagtaggt

SEQ ID NO: 8454065 - DNA, 22 bp, Homo sapiens
atttataacgtgcagccagggt

SEQ ID NO: 8454066 - DNA, 22 bp, Homo sapiens
gccagctggagtgagagtgggc

SEQ ID NO: 8454067 - DNA, 21 bp, Homo sapiens
atttagaaggaaattttgcaa

SEQ ID NO: 8454068 - DNA, 21 bp, Homo sapiens
atttagaaggaaattttgcaa

SEQ ID NO: 8454069 - DNA, 22 bp, Homo sapiens
atttagaagttggagggcaaga

SEQ ID NO: 8454070 - DNA, 22 bp, Homo sapiens
gccagctgctggaacagcgcga

SEQ ID NO: 8454071 - DNA, 22 bp, Homo sapiens
gccagctgcttctccagaattt

SEQ ID NO: 8454072 - DNA, 22 bp, Homo sapiens
gccagctggagactggcagggg

SEQ ID NO: 8454073 - DNA, 22 bp, Homo sapiens
atttatgacaaccaaagagtga

SEQ ID NO: 8454074 - DNA, 22 bp, Homo sapiens
atttatctctggaaactaagca

SEQ ID NO: 8454075 - DNA, 22 bp, Homo sapiens
atttatctctggaaactaagca

SEQ ID NO: 8454076 - DNA, 22 bp, Homo sapiens
atttatcaccagttagctgact

SEQ ID NO: 8454077 - DNA, 22 bp, Homo sapiens
atttatattttgggagctcctg

SEQ ID NO: 8454078 - DNA, 22 bp, Homo sapiens
atttatgactggtgaatagaac

SEQ ID NO: 8454079 - DNA, 22 bp, Homo sapiens
gccatcatatcccctgtgacct

SEQ ID NO: 8454080 - DNA, 22 bp, Homo sapiens
gccatcatatcccctgtgacct

SEQ ID NO: 8454081 - DNA, 22 bp, Homo sapiens
gccaggtggctgagcagctgca

SEQ ID NO: 8454082 - DNA, 22 bp, Homo sapiens
attgtacagatgaggtaagtga

SEQ ID NO: 8454083 - DNA, 22 bp, Homo sapiens
attgtacagatgaacctcactc

SEQ ID NO: 8454084 - DNA, 22 bp, Homo sapiens
attgtacaggttggaggaagtg

SEQ ID NO: 8454085 - DNA, 22 bp, Homo sapiens
attgtacaggttggaggaagtg

SEQ ID NO: 8454086 - DNA, 22 bp, Homo sapiens
attgtacataaaatgtatgtct

SEQ ID NO: 8454087 - DNA, 22 bp, Homo sapiens
attgtacatatgatgtatgtaa

SEQ ID NO: 8454088 - DNA, 19 bp, Homo sapiens
attgtacattgagtttggc

SEQ ID NO: 8454089 - DNA, 22 bp, Homo sapiens
gccagagtgccatcagtgccat

SEQ ID NO: 8454090 - DNA, 20 bp, Homo sapiens
gccagagttatgatgagagg

SEQ ID NO: 8454091 - DNA, 22 bp, Homo sapiens
gccagccacaagggaggcttgt

SEQ ID NO: 8454092 - DNA, 22 bp, Homo sapiens
gccagccaagattgagaaggta

SEQ ID NO: 8454093 - DNA, 22 bp, Homo sapiens
gccagccacgttagactggccc

SEQ ID NO: 8454094 - DNA, 22 bp, Homo sapiens
gccagccacaagggaggcttgt

SEQ ID NO: 8454095 - DNA, 21 bp, Homo sapiens
gccagctgcagggcttccttg

SEQ ID NO: 8454096 - DNA, 22 bp, Homo sapiens
gccagccagtttgctgatggct

SEQ ID NO: 8454097 - DNA, 22 bp, Homo sapiens
gccagccagtttgctgatggct

SEQ ID NO: 8454098 - DNA, 22 bp, Homo sapiens
gccagccagagtccatctgaga

SEQ ID NO: 8454099 - DNA, 22 bp, Homo sapiens
gccagccagaaacgtcacactg

SEQ ID NO: 8454100 - DNA, 22 bp, Homo sapiens
gccagccagagaggcatggtta

SEQ ID NO: 8454101 - DNA, 18 bp, Homo sapiens
gccagccaggcgttgctc

SEQ ID NO: 8454102 - DNA, 22 bp, Homo sapiens
gccagccagagtggctgtgtgt

SEQ ID NO: 8454103 - DNA, 22 bp, Homo sapiens
gccagccaggaagaaagtaaga

SEQ ID NO: 8454104 - DNA, 22 bp, Homo sapiens
gccagccagggaagggagagac

SEQ ID NO: 8454105 - DNA, 23 bp, Homo sapiens
gccagccagaatttctccactgt

SEQ ID NO: 8454106 - DNA, 23 bp, Homo sapiens
gccagccagaatttctccactgt

SEQ ID NO: 8454107 - DNA, 22 bp, Homo sapiens
gccagccagaaacgtcacactg

SEQ ID NO: 8454108 - DNA, 22 bp, Homo sapiens
gccagccacttcccagactggc

SEQ ID NO: 8454109 - DNA, 22 bp, Homo sapiens
gccagccagaaacgtcacactg

SEQ ID NO: 8454110 - DNA, 22 bp, Homo sapiens
gccagccacttcccagactggc

SEQ ID NO: 8454111 - DNA, 22 bp, Homo sapiens
gccagccacttcagctatggct

SEQ ID NO: 8454112 - DNA, 23 bp, Homo sapiens
atttcctaaaagataatcattac

SEQ ID NO: 8454113 - DNA, 23 bp, Homo sapiens
atttcctactataaaagaggtaa

SEQ ID NO: 8454114 - DNA, 22 bp, Homo sapiens
atttcctaacagaggcaacagt

SEQ ID NO: 8454115 - DNA, 22 bp, Homo sapiens
atttcctaatttatgcaggagt

SEQ ID NO: 8454116 - DNA, 22 bp, Homo sapiens
atttcctaatttagggatagac

SEQ ID NO: 8454117 - DNA, 22 bp, Homo sapiens
gccctgggctccctgctccaca

SEQ ID NO: 8454118 - DNA, 17 bp, Homo sapiens
gccctgcctgctgccct

SEQ ID NO: 8454119 - DNA, 17 bp, Homo sapiens
gccctgcctgctgccct

SEQ ID NO: 8454120 - DNA, 22 bp, Homo sapiens
gccctggggaaggtgtctccaa

SEQ ID NO: 8454121 - DNA, 22 bp, Homo sapiens
gccctggggaaggtgtctccaa

SEQ ID NO: 8454122 - DNA, 22 bp, Homo sapiens
gccctggggaaggtgtctccaa

SEQ ID NO: 8454123 - DNA, 22 bp, Homo sapiens
atttcccactcaggccgcggcg

SEQ ID NO: 8454124 - DNA, 22 bp, Homo sapiens
gccctgtgagtcatgcggcaga

SEQ ID NO: 8454125 - DNA, 22 bp, Homo sapiens
gccctgtgagtcatgcggcaga

SEQ ID NO: 8454126 - DNA, 22 bp, Homo sapiens
gccctgtgcaggtgtgcagcag

SEQ ID NO: 8454127 - DNA, 22 bp, Homo sapiens
gccctgtgcaggtgtgcagcag

SEQ ID NO: 8454128 - DNA, 22 bp, Homo sapiens
gccctgtgccagtcacgctgtg

SEQ ID NO: 8454129 - DNA, 22 bp, Homo sapiens
gccctgtgccagtcacgctgtg

SEQ ID NO: 8454130 - DNA, 22 bp, Homo sapiens
gccctggttttagaggagcagg

SEQ ID NO: 8454131 - DNA, 18 bp, Homo sapiens
gccctggtggagctggtg

SEQ ID NO: 8454132 - DNA, 22 bp, Homo sapiens
atttcttacataacaaattgtt

SEQ ID NO: 8454133 - DNA, 22 bp, Homo sapiens
atttcttcaggttcttctagga

SEQ ID NO: 8454134 - DNA, 22 bp, Homo sapiens
atttcttatgaatattgactgt

SEQ ID NO: 8454135 - DNA, 22 bp, Homo sapiens
atttcttatgaatattgactgt

SEQ ID NO: 8454136 - DNA, 22 bp, Homo sapiens
gcccagtagttcaaggttgcag

SEQ ID NO: 8454137 - DNA, 22 bp, Homo sapiens
gcccagtctcttctggccctgt

SEQ ID NO: 8454138 - DNA, 22 bp, Homo sapiens
gcccaggtttcatctgctccgt

SEQ ID NO: 8454139 - DNA, 22 bp, Homo sapiens
gcccagtctcttctggccctgt

SEQ ID NO: 8454140 - DNA, 22 bp, Homo sapiens
gcccaggttggagagcagtggc

SEQ ID NO: 8454141 - DNA, 22 bp, Homo sapiens
gcccaggttggagagcagtggc

SEQ ID NO: 8454142 - DNA, 22 bp, Homo sapiens
gcccaggtgccctctgccttac

SEQ ID NO: 8454143 - DNA, 22 bp, Homo sapiens
gcccagggtgcttagaacccat

SEQ ID NO: 8454144 - DNA, 22 bp, Homo sapiens
gcccagggtgaagtgcagttgt

SEQ ID NO: 8454145 - DNA, 22 bp, Homo sapiens
gcccagggtctacaaaaatatt

SEQ ID NO: 8454146 - DNA, 19 bp, Homo sapiens
gcccaggggcccgatgctg

SEQ ID NO: 8454147 - DNA, 22 bp, Homo sapiens
atttcaaggctattaatataaa

SEQ ID NO: 8454148 - DNA, 19 bp, Homo sapiens
atttcaagaggtttattgg

SEQ ID NO: 8454149 - DNA, 22 bp, Homo sapiens
atttcaaggactacttttcaat

SEQ ID NO: 8454150 - DNA, 22 bp, Homo sapiens
atttcaaggctacagaaacctt

SEQ ID NO: 8454151 - DNA, 22 bp, Homo sapiens
atttcaaggctattaatataaa

SEQ ID NO: 8454152 - DNA, 22 bp, Homo sapiens
atttcaaggctattaatataaa

SEQ ID NO: 8454153 - DNA, 22 bp, Homo sapiens
gccatctgcgcggtgtccagct

SEQ ID NO: 8454154 - DNA, 22 bp, Homo sapiens
gccatctgctgctctccagtgt

SEQ ID NO: 8454155 - DNA, 22 bp, Homo sapiens
gccatctgctgctctccagtgt

SEQ ID NO: 8454156 - DNA, 22 bp, Homo sapiens
gccatctggcattgcagcacct

SEQ ID NO: 8454157 - DNA, 22 bp, Homo sapiens
gccatcctctgagcactaggca

SEQ ID NO: 8454158 - DNA, 20 bp, Homo sapiens
gccatccagcctcccaggag

SEQ ID NO: 8454159 - DNA, 22 bp, Homo sapiens
gccatgagtaaactggaaagcc

SEQ ID NO: 8454160 - DNA, 22 bp, Homo sapiens
gccatgcttggtatgctgtgag

SEQ ID NO: 8454161 - DNA, 22 bp, Homo sapiens
attaactgtactttctaatttt

SEQ ID NO: 8454162 - DNA, 22 bp, Homo sapiens
attaagactattgatatttaca

SEQ ID NO: 8454163 - DNA, 22 bp, Homo sapiens
attaagactgcccatgttttta

SEQ ID NO: 8454164 - DNA, 22 bp, Homo sapiens
attaagagcctactatgtgccg

SEQ ID NO: 8454165 - DNA, 22 bp, Homo sapiens
attaagatcattgtagaagatt

SEQ ID NO: 8454166 - DNA, 22 bp, Homo sapiens
attatattgagtataaccagag

SEQ ID NO: 8454167 - DNA, 22 bp, Homo sapiens
attatattgagtataaccagag

SEQ ID NO: 8454168 - DNA, 22 bp, Homo sapiens
attatattgagtataaccagag

SEQ ID NO: 8454169 - DNA, 22 bp, Homo sapiens
attatccagcaccaatgtcaga

SEQ ID NO: 8454170 - DNA, 22 bp, Homo sapiens
attatatttgaaaggttggaag

SEQ ID NO: 8454171 - DNA, 22 bp, Homo sapiens
gcacacagaattgattcactgt

SEQ ID NO: 8454172 - DNA, 22 bp, Homo sapiens
gcacacagactaaccatatttc

SEQ ID NO: 8454173 - DNA, 22 bp, Homo sapiens
gcacacagactaaccatatttc

SEQ ID NO: 8454174 - DNA, 16 bp, Homo sapiens
gcacacagccagcctt

SEQ ID NO: 8454175 - DNA, 22 bp, Homo sapiens
gcacacagagaggtggtatgtc

SEQ ID NO: 8454176 - DNA, 22 bp, Homo sapiens
gcacacagattaggaaacagaa

SEQ ID NO: 8454177 - DNA, 22 bp, Homo sapiens
gcacacagctagattaccattc

SEQ ID NO: 8454178 - DNA, 22 bp, Homo sapiens
gcaccagggagggtgtgcttca

SEQ ID NO: 8454179 - DNA, 22 bp, Homo sapiens
gcaccagggtgctgtgttctgg

SEQ ID NO: 8454180 - DNA, 22 bp, Homo sapiens
gcacacaggcagtttccagcca

SEQ ID NO: 8454181 - DNA, 22 bp, Homo sapiens
gcaccaggcagctgagcaggcc

SEQ ID NO: 8454182 - DNA, 22 bp, Homo sapiens
gcaccaggcagctgagcaggcc

SEQ ID NO: 8454183 - DNA, 22 bp, Homo sapiens
attcaagtccagcttctctaca

SEQ ID NO: 8454184 - DNA, 22 bp, Homo sapiens
gcagagattatgccatggaaag

SEQ ID NO: 8454185 - DNA, 22 bp, Homo sapiens
attcaagtacagttttcttctt

SEQ ID NO: 8454186 - DNA, 22 bp, Homo sapiens
gcagagatccttgctggatgac

SEQ ID NO: 8454187 - DNA, 22 bp, Homo sapiens
gcagagatggctgcctctgagt

SEQ ID NO: 8454188 - DNA, 21 bp, Homo sapiens
gcagagaatgaactttggctt

SEQ ID NO: 8454189 - DNA, 22 bp, Homo sapiens
gcagagaggaatgaagccatcc

SEQ ID NO: 8454190 - DNA, 22 bp, Homo sapiens
attatgtatttggtatagtttg

SEQ ID NO: 8454191 - DNA, 22 bp, Homo sapiens
attatctatgtagaatgatttt

SEQ ID NO: 8454192 - DNA, 22 bp, Homo sapiens
attatcttgataaaatggcagt

SEQ ID NO: 8454193 - DNA, 22 bp, Homo sapiens
gcaccatgatggagcctcatta

SEQ ID NO: 8454194 - DNA, 22 bp, Homo sapiens
gcaccattgctgggctagttcc

SEQ ID NO: 8454195 - DNA, 22 bp, Homo sapiens
attaaattttcactaggctccc

SEQ ID NO: 8454196 - DNA, 22 bp, Homo sapiens
attaaattggacgctgggggaa

SEQ ID NO: 8454197 - DNA, 22 bp, Homo sapiens
attaaattggatctgcatagtt

SEQ ID NO: 8454198 - DNA, 22 bp, Homo sapiens
gattcttatgagtgaactttac

SEQ ID NO: 8454199 - DNA, 22 bp, Homo sapiens
gattctgatctatagtgttata

SEQ ID NO: 8454200 - DNA, 22 bp, Homo sapiens
gattctgatctatagtgttata

SEQ ID NO: 8454201 - DNA, 22 bp, Homo sapiens
gattctgagctggtgttttacg

SEQ ID NO: 8454202 - DNA, 22 bp, Homo sapiens
gattctgagctggtgttttacg

SEQ ID NO: 8454203 - DNA, 22 bp, Homo sapiens
gattctctgctatctatcacct

SEQ ID NO: 8454204 - DNA, 22 bp, Homo sapiens
gatgtggatgatcttagatggt

SEQ ID NO: 8454205 - DNA, 22 bp, Homo sapiens
gattcatgttatagagagtcag

SEQ ID NO: 8454206 - DNA, 22 bp, Homo sapiens
gattccacagcttcgaggtctt

SEQ ID NO: 8454207 - DNA, 22 bp, Homo sapiens
gattcactcatattttacgttt

SEQ ID NO: 8454208 - DNA, 22 bp, Homo sapiens
gatgtgaggactcatgtggagg

SEQ ID NO: 8454209 - DNA, 22 bp, Homo sapiens
gatgtgagtggtagctgggatt

SEQ ID NO: 8454210 - DNA, 22 bp, Homo sapiens
gatgtctttgccatgcatgtgt

SEQ ID NO: 8454211 - DNA, 22 bp, Homo sapiens
gatgtctttagggcaaaatatt

SEQ ID NO: 8454212 - DNA, 22 bp, Homo sapiens
gatgatgggatccagcaatgta

SEQ ID NO: 8454213 - DNA, 21 bp, Homo sapiens
gatgatggcaggcagcactgg

SEQ ID NO: 8454214 - DNA, 20 bp, Homo sapiens
gatggatttcaacacctttc

SEQ ID NO: 8454215 - DNA, 22 bp, Homo sapiens
gatggatactataggaggcaca

SEQ ID NO: 8454216 - DNA, 22 bp, Homo sapiens
gatggcagtgggcctcgagtcc

SEQ ID NO: 8454217 - DNA, 22 bp, Homo sapiens
gatggccaaggaccacgcatcg

SEQ ID NO: 8454218 - DNA, 22 bp, Homo sapiens
gatggcagtcaaccaggtgagg

SEQ ID NO: 8454219 - DNA, 22 bp, Homo sapiens
gatggcagcagcagccagggat

SEQ ID NO: 8454220 - DNA, 22 bp, Homo sapiens
gatggcagcatattgacagcat

SEQ ID NO: 8454221 - DNA, 22 bp, Homo sapiens
gatggcaggcaggtgagtagag

SEQ ID NO: 8454222 - DNA, 22 bp, Homo sapiens
gatggcaggtagtggtctcatc

SEQ ID NO: 8454223 - DNA, 20 bp, Homo sapiens
gagtgggccatggagtgaga

SEQ ID NO: 8454224 - DNA, 22 bp, Homo sapiens
gagtggggaaagccaggacaga

SEQ ID NO: 8454225 - DNA, 22 bp, Homo sapiens
gagtggggaaagccaggacaga

SEQ ID NO: 8454226 - DNA, 23 bp, Homo sapiens
gagtggggagaaattggttaaac

SEQ ID NO: 8454227 - DNA, 22 bp, Homo sapiens
gagtggggcccactgctgggtg

SEQ ID NO: 8454228 - DNA, 22 bp, Homo sapiens
attctttgcatctctgggtggc

SEQ ID NO: 8454229 - DNA, 22 bp, Homo sapiens
attctttccagacactgattgc

SEQ ID NO: 8454230 - DNA, 22 bp, Homo sapiens
attcttttaaatggcagtagta

SEQ ID NO: 8454231 - DNA, 22 bp, Homo sapiens
attcttttcccaactgctttaa

SEQ ID NO: 8454232 - DNA, 22 bp, Homo sapiens
attctttccagacactgattgc

SEQ ID NO: 8454233 - DNA, 20 bp, Homo sapiens
gcagggcatcttggccccca

SEQ ID NO: 8454234 - DNA, 22 bp, Homo sapiens
gcagggcagtgtgtctgtgggg

SEQ ID NO: 8454235 - DNA, 22 bp, Homo sapiens
gcagggcagtaagagctagagt

SEQ ID NO: 8454236 - DNA, 20 bp, Homo sapiens
attctgctttctgatagagc

SEQ ID NO: 8454237 - DNA, 22 bp, Homo sapiens
attctgcacttcctttgcttcc

SEQ ID NO: 8454238 - DNA, 22 bp, Homo sapiens
attctgatgcctgggtactgcc

SEQ ID NO: 8454239 - DNA, 15 bp, Homo sapiens
gcaggcaggtcacct

SEQ ID NO: 8454240 - DNA, 22 bp, Homo sapiens
gcagtaagatgtttcccagagc

SEQ ID NO: 8454241 - DNA, 22 bp, Homo sapiens
gcagtaagaaagtcaagcagtt

SEQ ID NO: 8454242 - DNA, 22 bp, Homo sapiens
attgcaaagcattgtgagcgca

SEQ ID NO: 8454243 - DNA, 16 bp, Homo sapiens
gcagtaaaatggttag

SEQ ID NO: 8454244 - DNA, 22 bp, Homo sapiens
gcagtaaagcctgagatatatg

SEQ ID NO: 8454245 - DNA, 22 bp, Homo sapiens
gcagtaaataattttgtgtata

SEQ ID NO: 8454246 - DNA, 22 bp, Homo sapiens
gcagtaaattgagagtcatgtt

SEQ ID NO: 8454247 - DNA, 22 bp, Homo sapiens
gcagtaaaggtgacaatatagg

SEQ ID NO: 8454248 - DNA, 22 bp, Homo sapiens
attgcaaataactgtactgaat

SEQ ID NO: 8454249 - DNA, 22 bp, Homo sapiens
attgcaaaggtcccattcaaga

SEQ ID NO: 8454250 - DNA, 22 bp, Homo sapiens
attgcaaaggtcccattcaaga

SEQ ID NO: 8454251 - DNA, 22 bp, Homo sapiens
attgcaaatggtttggtcatct

SEQ ID NO: 8454252 - DNA, 22 bp, Homo sapiens
attgcaaatgagtcttaatata

SEQ ID NO: 8454253 - DNA, 22 bp, Homo sapiens
attcttttttaaggaatagaac

SEQ ID NO: 8454254 - DNA, 22 bp, Homo sapiens
gcagtaaaaaaggatatgtgca

SEQ ID NO: 8454255 - DNA, 22 bp, Homo sapiens
gcaggttagatttaatccattc

SEQ ID NO: 8454256 - DNA, 22 bp, Homo sapiens
gcaggtgtgggtggctgccagg

SEQ ID NO: 8454257 - DNA, 22 bp, Homo sapiens
attgcactccggcctgggtgac

SEQ ID NO: 8454258 - DNA, 22 bp, Homo sapiens
attgcactccagcctgggtgac

SEQ ID NO: 8454259 - DNA, 22 bp, Homo sapiens
gcatccaaaccattcatcagcc

SEQ ID NO: 8454260 - DNA, 18 bp, Homo sapiens
attgcacaccagcctggg

SEQ ID NO: 8454261 - DNA, 22 bp, Homo sapiens
gcatgcttttatatctgtttaa

SEQ ID NO: 8454262 - DNA, 22 bp, Homo sapiens
gcatggcaagatcaggagacca

SEQ ID NO: 8454263 - DNA, 21 bp, Homo sapiens
gcatggcaggtcactggggca

SEQ ID NO: 8454264 - DNA, 22 bp, Homo sapiens
gcatggcagccagtacatggtg

SEQ ID NO: 8454265 - DNA, 22 bp, Homo sapiens
attccaaaggttaatgcccatt

SEQ ID NO: 8454266 - DNA, 22 bp, Homo sapiens
attccaaaggctggcctggagg

SEQ ID NO: 8454267 - DNA, 22 bp, Homo sapiens
attccaaagcctgaataatgga

SEQ ID NO: 8454268 - DNA, 22 bp, Homo sapiens
attccaaagcacatcagaacta

SEQ ID NO: 8454269 - DNA, 22 bp, Homo sapiens
attccaaaggttaatgcccatt

SEQ ID NO: 8454270 - DNA, 22 bp, Homo sapiens
attccacacagtaatactcaat

SEQ ID NO: 8454271 - DNA, 22 bp, Homo sapiens
attccacagccgataccatgac

SEQ ID NO: 8454272 - DNA, 22 bp, Homo sapiens
attccacagctacatcaatcta

SEQ ID NO: 8454273 - DNA, 22 bp, Homo sapiens
attccacaggactaccaatgtg

SEQ ID NO: 8454274 - DNA, 22 bp, Homo sapiens
attccacataggccttcatgac

SEQ ID NO: 8454275 - DNA, 20 bp, Homo sapiens
attccacttatatgaggtcc

SEQ ID NO: 8454276 - DNA, 20 bp, Homo sapiens
attcacaaagccagtgttgc

SEQ ID NO: 8454277 - DNA, 22 bp, Homo sapiens
attcacaaaatgatatagatac

SEQ ID NO: 8454278 - DNA, 22 bp, Homo sapiens
attccaaagacagaagcagctg

SEQ ID NO: 8454279 - DNA, 22 bp, Homo sapiens
attctgatatcttattctagct

SEQ ID NO: 8454280 - DNA, 22 bp, Homo sapiens
gcagctgtggtgctgagatagg

SEQ ID NO: 8454281 - DNA, 22 bp, Homo sapiens
attctgatcattcaagatgtca

SEQ ID NO: 8454282 - DNA, 22 bp, Homo sapiens
attctctttgtataacatcttg

SEQ ID NO: 8454283 - DNA, 22 bp, Homo sapiens
attctctgtttccaagatgaaa

SEQ ID NO: 8454284 - DNA, 22 bp, Homo sapiens
attctctttgtataacatcttg

SEQ ID NO: 8454285 - DNA, 22 bp, Homo sapiens
attctgagaaatgcattgtcag

SEQ ID NO: 8454286 - DNA, 20 bp, Homo sapiens
gcaggcagggaatgggggtg

SEQ ID NO: 8454287 - DNA, 20 bp, Homo sapiens
gcaggcagggaatgggggtg

SEQ ID NO: 8454288 - DNA, 22 bp, Homo sapiens
gcaggcaggcttccttgaactg

SEQ ID NO: 8454289 - DNA, 22 bp, Homo sapiens
gcaggcaggagcccaactgcct

SEQ ID NO: 8454290 - DNA, 22 bp, Homo sapiens
gcaggcaggaaggactaagtaa

SEQ ID NO: 8454291 - DNA, 19 bp, Homo sapiens
gcaggcagctggggtatcc

SEQ ID NO: 8454292 - DNA, 19 bp, Homo sapiens
gcaggcagctggggtatcc

SEQ ID NO: 8454293 - DNA, 22 bp, Homo sapiens
gcagcttcctgagtgtggacag

SEQ ID NO: 8454294 - DNA, 22 bp, Homo sapiens
atctttcttatttgaagaaaga

SEQ ID NO: 8454295 - DNA, 22 bp, Homo sapiens
atctttcttatttgaagaaaga

SEQ ID NO: 8454296 - DNA, 22 bp, Homo sapiens
atctttctctgcactatacaat

SEQ ID NO: 8454297 - DNA, 22 bp, Homo sapiens
atctttctccatatacatcttt

SEQ ID NO: 8454298 - DNA, 22 bp, Homo sapiens
atctttctccatatacatcttt

SEQ ID NO: 8454299 - DNA, 22 bp, Homo sapiens
atctttctatttctaaaaacta

SEQ ID NO: 8454300 - DNA, 22 bp, Homo sapiens
atctttctatttctaaaaacta

SEQ ID NO: 8454301 - DNA, 22 bp, Homo sapiens
atctttctatggtactttctcc

SEQ ID NO: 8454302 - DNA, 22 bp, Homo sapiens
atctttatttattgagcactta

SEQ ID NO: 8454303 - DNA, 21 bp, Homo sapiens
atctttattacgcagagaaga

SEQ ID NO: 8454304 - DNA, 21 bp, Homo sapiens
atctttattacgcagagaaga

SEQ ID NO: 8454305 - DNA, 22 bp, Homo sapiens
atcttgggaattttccaggagt

SEQ ID NO: 8454306 - DNA, 22 bp, Homo sapiens
atcttgggaattttccaggagt

SEQ ID NO: 8454307 - DNA, 22 bp, Homo sapiens
cttctcctctgagtcctgggag

SEQ ID NO: 8454308 - DNA, 22 bp, Homo sapiens
cttctccgacaaccgacgccgg

SEQ ID NO: 8454309 - DNA, 22 bp, Homo sapiens
cttctccctggcttctgcacac

SEQ ID NO: 8454310 - DNA, 22 bp, Homo sapiens
atctggaattaagagaaagtga

SEQ ID NO: 8454311 - DNA, 22 bp, Homo sapiens
atctggaatccttgtggacaat

SEQ ID NO: 8454312 - DNA, 22 bp, Homo sapiens
ctttacagcctccagaaggaac

SEQ ID NO: 8454313 - DNA, 22 bp, Homo sapiens
ctttacatcctgtttcccgttt

SEQ ID NO: 8454314 - DNA, 17 bp, Homo sapiens
cttgttttccactggga

SEQ ID NO: 8454315 - DNA, 22 bp, Homo sapiens
atctttgaagaggacttgaagt

SEQ ID NO: 8454316 - DNA, 22 bp, Homo sapiens
atctttgatctttattgctaag

SEQ ID NO: 8454317 - DNA, 22 bp, Homo sapiens
atctttgactgccattcttgac

SEQ ID NO: 8454318 - DNA, 22 bp, Homo sapiens
atctttgatgactaatgctttg

SEQ ID NO: 8454319 - DNA, 22 bp, Homo sapiens
atctttggaaagccaagcacag

SEQ ID NO: 8454320 - DNA, 22 bp, Homo sapiens
atctttggacggtcccaactga

SEQ ID NO: 8454321 - DNA, 22 bp, Homo sapiens
atctttgctattgtaaatcacg

SEQ ID NO: 8454322 - DNA, 22 bp, Homo sapiens
atctttgcccagagactcagcc

SEQ ID NO: 8454323 - DNA, 22 bp, Homo sapiens
atctttgcccagagactcagcc

SEQ ID NO: 8454324 - DNA, 22 bp, Homo sapiens
atctttgggatatttgtgatta

SEQ ID NO: 8454325 - DNA, 22 bp, Homo sapiens
atctttgggatcctgatttact

SEQ ID NO: 8454326 - DNA, 20 bp, Homo sapiens
atctttggctcagaagcctt

SEQ ID NO: 8454327 - DNA, 22 bp, Homo sapiens
atctttggccacttgtgctgca

SEQ ID NO: 8454328 - DNA, 22 bp, Homo sapiens
atctttggatcgctcccccttc

SEQ ID NO: 8454329 - DNA, 22 bp, Homo sapiens
ctttattcctacaagattttct

SEQ ID NO: 8454330 - DNA, 22 bp, Homo sapiens
ctttattctgcaaattgccttg

SEQ ID NO: 8454331 - DNA, 22 bp, Homo sapiens
ctttactatcaggaataaacaa

SEQ ID NO: 8454332 - DNA, 22 bp, Homo sapiens
ctttacattaatttctactgat

SEQ ID NO: 8454333 - DNA, 22 bp, Homo sapiens
ctttacttcagcaagctttcct

SEQ ID NO: 8454334 - DNA, 22 bp, Homo sapiens
ctttacttctcaaaataaagca

SEQ ID NO: 8454335 - DNA, 22 bp, Homo sapiens
ctttagaaatctggatgtattt

SEQ ID NO: 8454336 - DNA, 22 bp, Homo sapiens
ctttacttgctttgttacaaaa

SEQ ID NO: 8454337 - DNA, 22 bp, Homo sapiens
atgagaggtttcgtcagaggaa

SEQ ID NO: 8454338 - DNA, 18 bp, Homo sapiens
atgagaggtgtcagaaga

SEQ ID NO: 8454339 - DNA, 22 bp, Homo sapiens
atgagagccaccatgcttctgt

SEQ ID NO: 8454340 - DNA, 22 bp, Homo sapiens
atgagcaggaagagcacaaaga

SEQ ID NO: 8454341 - DNA, 22 bp, Homo sapiens
atgagcagatgctcctgcctct

SEQ ID NO: 8454342 - DNA, 22 bp, Homo sapiens
atgagcagatatggattttaga

SEQ ID NO: 8454343 - DNA, 22 bp, Homo sapiens
atgagatgtgtctaatggaacc

SEQ ID NO: 8454344 - DNA, 22 bp, Homo sapiens
atgagacaagagtctaaattca

SEQ ID NO: 8454345 - DNA, 22 bp, Homo sapiens
atgagactacctgtaatgtggc

SEQ ID NO: 8454346 - DNA, 22 bp, Homo sapiens
atgagaaatttattacaagcta

SEQ ID NO: 8454347 - DNA, 22 bp, Homo sapiens
atgagaaatttattacaagcta

SEQ ID NO: 8454348 - DNA, 22 bp, Homo sapiens
atgagaaagttaatcatcatga

SEQ ID NO: 8454349 - DNA, 22 bp, Homo sapiens
atgagaaagagttgtatctaga

SEQ ID NO: 8454350 - DNA, 22 bp, Homo sapiens
cttttgttgcccttgtcgcagg

SEQ ID NO: 8454351 - DNA, 22 bp, Homo sapiens
ctttttcattggctttaggaca

SEQ ID NO: 8454352 - DNA, 22 bp, Homo sapiens
ctttttatagctatgtcctatg

SEQ ID NO: 8454353 - DNA, 22 bp, Homo sapiens
atgacacataaaacaaggactg

SEQ ID NO: 8454354 - DNA, 22 bp, Homo sapiens
atgacagacagaagggattttt

SEQ ID NO: 8454355 - DNA, 22 bp, Homo sapiens
atgacactgtcctagtaaggaa

SEQ ID NO: 8454356 - DNA, 22 bp, Homo sapiens
atgacacttggtgatactttgt

SEQ ID NO: 8454357 - DNA, 22 bp, Homo sapiens
atgacactcgaaaaattgatgc

SEQ ID NO: 8454358 - DNA, 22 bp, Homo sapiens
ctttggcttgcactattacact

SEQ ID NO: 8454359 - DNA, 22 bp, Homo sapiens
ctttgggatttcatgagagcta

SEQ ID NO: 8454360 - DNA, 22 bp, Homo sapiens
ctttgctttactcccactgtgt

SEQ ID NO: 8454361 - DNA, 22 bp, Homo sapiens
ctttggaaaaatacctggcata

SEQ ID NO: 8454362 - DNA, 22 bp, Homo sapiens
ctttggaaaaatacctggcata

SEQ ID NO: 8454363 - DNA, 22 bp, Homo sapiens
ctttggaaaaatacctggcata

SEQ ID NO: 8454364 - DNA, 22 bp, Homo sapiens
ctttggaaagtggttcaggtga

SEQ ID NO: 8454365 - DNA, 22 bp, Homo sapiens
ctttggaaagtggttcaggtga

SEQ ID NO: 8454366 - DNA, 22 bp, Homo sapiens
ctttggaaagtaagcagctaga

SEQ ID NO: 8454367 - DNA, 22 bp, Homo sapiens
ctttggaaaagcataccaagga

SEQ ID NO: 8454368 - DNA, 22 bp, Homo sapiens
ctttggctcatggttttatcca

SEQ ID NO: 8454369 - DNA, 22 bp, Homo sapiens
ctttctttcgaagacgtgatta

SEQ ID NO: 8454370 - DNA, 20 bp, Homo sapiens
ctttgcctattctctgcctg

SEQ ID NO: 8454371 - DNA, 22 bp, Homo sapiens
ctttgcctcctagagcacgttc

SEQ ID NO: 8454372 - DNA, 22 bp, Homo sapiens
ctttgctgccagaacccagcag

SEQ ID NO: 8454373 - DNA, 22 bp, Homo sapiens
gaaggaggctccccaaagtctg

SEQ ID NO: 8454374 - DNA, 22 bp, Homo sapiens
gaaggaggcgttagccctagga

SEQ ID NO: 8454375 - DNA, 22 bp, Homo sapiens
gaaggaggcgttagccctagga

SEQ ID NO: 8454376 - DNA, 22 bp, Homo sapiens
gaagctgggtcgctgggatcct

SEQ ID NO: 8454377 - DNA, 22 bp, Homo sapiens
gaagctggagaatgggtctagg

SEQ ID NO: 8454378 - DNA, 22 bp, Homo sapiens
gaagctggctgaagttcagcta

SEQ ID NO: 8454379 - DNA, 22 bp, Homo sapiens
gaagctggggtgctgagggcaa

SEQ ID NO: 8454380 - DNA, 22 bp, Homo sapiens
gaagctgatgaggaccagattg

SEQ ID NO: 8454381 - DNA, 22 bp, Homo sapiens
gaagctgcgtgtagccatactt

SEQ ID NO: 8454382 - DNA, 22 bp, Homo sapiens
gaagctccgtactatgactttt

SEQ ID NO: 8454383 - DNA, 22 bp, Homo sapiens
gaagccttgaactgcaaacccc

SEQ ID NO: 8454384 - DNA, 22 bp, Homo sapiens
gaagccttatcagtcacttata

SEQ ID NO: 8454385 - DNA, 22 bp, Homo sapiens
atgattacatgtgttaatatac

SEQ ID NO: 8454386 - DNA, 22 bp, Homo sapiens
gaagcagcaaatctgcagtatc

SEQ ID NO: 8454387 - DNA, 22 bp, Homo sapiens
gaagcctgggagggctgggcta

SEQ ID NO: 8454388 - DNA, 22 bp, Homo sapiens
atgcaggagagcatgtttaaga

SEQ ID NO: 8454389 - DNA, 22 bp, Homo sapiens
atgcaggagaccaattggatgg

SEQ ID NO: 8454390 - DNA, 22 bp, Homo sapiens
gaaggatttgagattatcctag

SEQ ID NO: 8454391 - DNA, 22 bp, Homo sapiens
gaaggaggtctgcattctacag

SEQ ID NO: 8454392 - DNA, 22 bp, Homo sapiens
gaaggagggtgcggatctgagc

SEQ ID NO: 8454393 - DNA, 22 bp, Homo sapiens
gaaggagggtgcggatctgagc

SEQ ID NO: 8454394 - DNA, 22 bp, Homo sapiens
atgatgtctatctttgtagtat

SEQ ID NO: 8454395 - DNA, 22 bp, Homo sapiens
atgatgtcatgaatatattagt

SEQ ID NO: 8454396 - DNA, 21 bp, Homo sapiens
gaagagagtcctcatcctgag

SEQ ID NO: 8454397 - DNA, 22 bp, Homo sapiens
gaagagcatatgaagagcatat

SEQ ID NO: 8454398 - DNA, 22 bp, Homo sapiens
gaagagccaggtgtcgctgtgg

SEQ ID NO: 8454399 - DNA, 22 bp, Homo sapiens
atgatggctaggctggttttga

SEQ ID NO: 8454400 - DNA, 22 bp, Homo sapiens
atgatggaggtgtcctggattt

SEQ ID NO: 8454401 - DNA, 22 bp, Homo sapiens
atgatggaggccgtgatggacg

SEQ ID NO: 8454402 - DNA, 22 bp, Homo sapiens
atgagcagtaggttcatggctg

SEQ ID NO: 8454403 - DNA, 22 bp, Homo sapiens
atgagcagtttttaagtagcaa

SEQ ID NO: 8454404 - DNA, 19 bp, Homo sapiens
atgagcaggcaagacaagc

SEQ ID NO: 8454405 - DNA, 22 bp, Homo sapiens
atgagcaggtttaagagaggcc

SEQ ID NO: 8454406 - DNA, 22 bp, Homo sapiens
atgagcaggaagagcacaaaga

SEQ ID NO: 8454407 - DNA, 22 bp, Homo sapiens
atgagcagtttttaagtagcaa

SEQ ID NO: 8454408 - DNA, 22 bp, Homo sapiens
atgagctcatccgagtcacact

SEQ ID NO: 8454409 - DNA, 22 bp, Homo sapiens
atgagctcaggtgtgcaaaata

SEQ ID NO: 8454410 - DNA, 22 bp, Homo sapiens
atgagctgggccatccagtgat

SEQ ID NO: 8454411 - DNA, 22 bp, Homo sapiens
gaagagaaggtgtaggccatcc

SEQ ID NO: 8454412 - DNA, 22 bp, Homo sapiens
gaagtattatagcatattagcc

SEQ ID NO: 8454413 - DNA, 22 bp, Homo sapiens
gaagtcagaaaagaattaggga

SEQ ID NO: 8454414 - DNA, 22 bp, Homo sapiens
gaagtatttctgagttgcccag

SEQ ID NO: 8454415 - DNA, 22 bp, Homo sapiens
gaagtattactctgaatgtatt

SEQ ID NO: 8454416 - DNA, 23 bp, Homo sapiens
gaagtcagccctacagagagcag

SEQ ID NO: 8454417 - DNA, 22 bp, Homo sapiens
gaagtctgcctgccttctctgt

SEQ ID NO: 8454418 - DNA, 22 bp, Homo sapiens
atgccactgcactccagcctag

SEQ ID NO: 8454419 - DNA, 22 bp, Homo sapiens
atgccactgcactccagcctgg

SEQ ID NO: 8454420 - DNA, 22 bp, Homo sapiens
atgccactgcactccagcctgg

SEQ ID NO: 8454421 - DNA, 22 bp, Homo sapiens
atgccactgcacttcagcctgg

SEQ ID NO: 8454422 - DNA, 22 bp, Homo sapiens
gaatttcagatcagagaccatt

SEQ ID NO: 8454423 - DNA, 22 bp, Homo sapiens
gaatttcagaggtaacatcatc

SEQ ID NO: 8454424 - DNA, 22 bp, Homo sapiens
gaatttcaagcagtgcaatgtt

SEQ ID NO: 8454425 - DNA, 19 bp, Homo sapiens
gaatttatctcttcagtcc

SEQ ID NO: 8454426 - DNA, 22 bp, Homo sapiens
atgcctggactgtatcccagat

SEQ ID NO: 8454427 - DNA, 22 bp, Homo sapiens
gaatttcctctaaacccctgag

SEQ ID NO: 8454428 - DNA, 22 bp, Homo sapiens
gaatttggggtgtgttatttca

SEQ ID NO: 8454429 - DNA, 22 bp, Homo sapiens
atgctaattccatgagcacagg

SEQ ID NO: 8454430 - DNA, 22 bp, Homo sapiens
atgctaatgtttgtggaagata

SEQ ID NO: 8454431 - DNA, 22 bp, Homo sapiens
atgctaatgagctaaggagtcc

SEQ ID NO: 8454432 - DNA, 22 bp, Homo sapiens
atgctaaatgttaatgttacct

SEQ ID NO: 8454433 - DNA, 22 bp, Homo sapiens
atgctaaattcagacagggtta

SEQ ID NO: 8454434 - DNA, 22 bp, Homo sapiens
atgctaaaggggtaggcctcct

SEQ ID NO: 8454435 - DNA, 22 bp, Homo sapiens
atgctaaagctttgctttcatt

SEQ ID NO: 8454436 - DNA, 22 bp, Homo sapiens
atgctaaatccagaagcagtca

SEQ ID NO: 8454437 - DNA, 22 bp, Homo sapiens
gacagcttagtgaaaatgtaaa

SEQ ID NO: 8454438 - DNA, 22 bp, Homo sapiens
atgctatgtaactggcagatag

SEQ ID NO: 8454439 - DNA, 22 bp, Homo sapiens
atgctagaagggagcactatgt

SEQ ID NO: 8454440 - DNA, 22 bp, Homo sapiens
gacaggaaacaagaaggcagga

SEQ ID NO: 8454441 - DNA, 16 bp, Homo sapiens
atgctgctattagagg

SEQ ID NO: 8454442 - DNA, 22 bp, Homo sapiens
atgctgaaaattggatttgaat

SEQ ID NO: 8454443 - DNA, 22 bp, Homo sapiens
atgttagtgatagtaaatagtg

SEQ ID NO: 8454444 - DNA, 22 bp, Homo sapiens
atgttatagttataaaatgagg

SEQ ID NO: 8454445 - DNA, 22 bp, Homo sapiens
gaggtgtgatgcagagtggtgg

SEQ ID NO: 8454446 - DNA, 22 bp, Homo sapiens
gaggttcagctgctgcctggta

SEQ ID NO: 8454447 - DNA, 22 bp, Homo sapiens
gaggttcaggacatttctgggg

SEQ ID NO: 8454448 - DNA, 22 bp, Homo sapiens
gaggttcacttcctggatcctt

SEQ ID NO: 8454449 - DNA, 19 bp, Homo sapiens
gaggttcacgcgctggatg

SEQ ID NO: 8454450 - DNA, 22 bp, Homo sapiens
gaggttctgggggtctgcctgg

SEQ ID NO: 8454451 - DNA, 22 bp, Homo sapiens
gaggttcagtcctgctctgtca

SEQ ID NO: 8454452 - DNA, 22 bp, Homo sapiens
gaggttctgggggtctgcctgg

SEQ ID NO: 8454453 - DNA, 22 bp, Homo sapiens
gaggttggagggctggcctgca

SEQ ID NO: 8454454 - DNA, 22 bp, Homo sapiens
gaggttgggaagtccaagctgg

SEQ ID NO: 8454455 - DNA, 22 bp, Homo sapiens
atgttacagagaaagtggaagc

SEQ ID NO: 8454456 - DNA, 22 bp, Homo sapiens
atgttacatagtccttatttgt

SEQ ID NO: 8454457 - DNA, 23 bp, Homo sapiens
atgttacttaacctctctgtgcc

SEQ ID NO: 8454458 - DNA, 22 bp, Homo sapiens
atgttactgtgatcatgatact

SEQ ID NO: 8454459 - DNA, 22 bp, Homo sapiens
atgttacttagaataattctgg

SEQ ID NO: 8454460 - DNA, 22 bp, Homo sapiens
atgttaaaagtctgagtgggag

SEQ ID NO: 8454461 - DNA, 22 bp, Homo sapiens
atgttaaaaaccagtacagttg

SEQ ID NO: 8454462 - DNA, 22 bp, Homo sapiens
atgttaaaagtgaggatggcca

SEQ ID NO: 8454463 - DNA, 23 bp, Homo sapiens
atgttaaacataactgaagagcc

SEQ ID NO: 8454464 - DNA, 22 bp, Homo sapiens
atgttaaaagtgaggatggcca

SEQ ID NO: 8454465 - DNA, 22 bp, Homo sapiens
atgtggctgccacctgcctgaa

SEQ ID NO: 8454466 - DNA, 18 bp, Homo sapiens
atgtggctagtgctactg

SEQ ID NO: 8454467 - DNA, 22 bp, Homo sapiens
atgtggctagtgcaactgagaa

SEQ ID NO: 8454468 - DNA, 20 bp, Homo sapiens
atgtgaggggttgaagtggg

SEQ ID NO: 8454469 - DNA, 22 bp, Homo sapiens
atgtcaggaccctactgcattg

SEQ ID NO: 8454470 - DNA, 22 bp, Homo sapiens
atgtcagatcctcagaaagtct

SEQ ID NO: 8454471 - DNA, 22 bp, Homo sapiens
atgtcagagcttccacaatagt

SEQ ID NO: 8454472 - DNA, 22 bp, Homo sapiens
atgtcagaatctacattctact

SEQ ID NO: 8454473 - DNA, 22 bp, Homo sapiens
atgtcagaagctggatgacagc

SEQ ID NO: 8454474 - DNA, 22 bp, Homo sapiens
atgtcagaagctggatgacagc

SEQ ID NO: 8454475 - DNA, 22 bp, Homo sapiens
atgtggccagtcatgtagtaac

SEQ ID NO: 8454476 - DNA, 22 bp, Homo sapiens
atgtggcacagcacagtaagag

SEQ ID NO: 8454477 - DNA, 22 bp, Homo sapiens
atgtggatgtttatatgaagaa

SEQ ID NO: 8454478 - DNA, 22 bp, Homo sapiens
atgtggatctgttattctagat

SEQ ID NO: 8454479 - DNA, 22 bp, Homo sapiens
atgtggattgtaggaaactgat

SEQ ID NO: 8454480 - DNA, 22 bp, Homo sapiens
atgtggatttgggagtgatcag

SEQ ID NO: 8454481 - DNA, 22 bp, Homo sapiens
atgtggatagcacaggaatggt

SEQ ID NO: 8454482 - DNA, 22 bp, Homo sapiens
atgtggatcacaggggtgtgtc

SEQ ID NO: 8454483 - DNA, 22 bp, Homo sapiens
atgtgcttgcagatgagcctca

SEQ ID NO: 8454484 - DNA, 22 bp, Homo sapiens
atgtgctgagtgtgtatataca

SEQ ID NO: 8454485 - DNA, 22 bp, Homo sapiens
atgtgctggctaactggatggg

SEQ ID NO: 8454486 - DNA, 22 bp, Homo sapiens
atgtgctgtaatccattgaagg

SEQ ID NO: 8454487 - DNA, 22 bp, Homo sapiens
gaggaggggacagtacttgtgc

SEQ ID NO: 8454488 - DNA, 22 bp, Homo sapiens
gaggaggggacagtacttgtgc

SEQ ID NO: 8454489 - DNA, 22 bp, Homo sapiens
gaggaggggcacttgtctccta

SEQ ID NO: 8454490 - DNA, 22 bp, Homo sapiens
gaggcacagagccctaggagct

SEQ ID NO: 8454491 - DNA, 23 bp, Homo sapiens
gaggagggtcgtgctgtgttcct

SEQ ID NO: 8454492 - DNA, 22 bp, Homo sapiens
atgtaggattgagtgatagagg

SEQ ID NO: 8454493 - DNA, 22 bp, Homo sapiens
gaggcacatatatacagagccc

SEQ ID NO: 8454494 - DNA, 22 bp, Homo sapiens
gaggcacatatatacagagccc

SEQ ID NO: 8454495 - DNA, 22 bp, Homo sapiens
gaggcacagttcttcctccaga

SEQ ID NO: 8454496 - DNA, 22 bp, Homo sapiens
gaggcacagtgtttggtcagtg

SEQ ID NO: 8454497 - DNA, 22 bp, Homo sapiens
gaggcacagtcccgaggcaagg

SEQ ID NO: 8454498 - DNA, 22 bp, Homo sapiens
gaggagggcagttcctctttta

SEQ ID NO: 8454499 - DNA, 22 bp, Homo sapiens
gaggagggagctggaagctctt

SEQ ID NO: 8454500 - DNA, 22 bp, Homo sapiens
gaggagggagctggaagctctt

SEQ ID NO: 8454501 - DNA, 22 bp, Homo sapiens
gaggagggcctggtgtcccttc

SEQ ID NO: 8454502 - DNA, 22 bp, Homo sapiens
atgggcaggcaaggtggcgagt

SEQ ID NO: 8454503 - DNA, 22 bp, Homo sapiens
atgtatcagataaagcatgtgg

SEQ ID NO: 8454504 - DNA, 22 bp, Homo sapiens
atgtatcagataaagcatgtgg

SEQ ID NO: 8454505 - DNA, 22 bp, Homo sapiens
atgtatcacagcaatgtagtca

SEQ ID NO: 8454506 - DNA, 22 bp, Homo sapiens
gaggctcccaaggggctaggcc

SEQ ID NO: 8454507 - DNA, 22 bp, Homo sapiens
gaggctccccatgaggccccag

SEQ ID NO: 8454508 - DNA, 22 bp, Homo sapiens
gaggctccctcaactctgggtg

SEQ ID NO: 8454509 - DNA, 22 bp, Homo sapiens
gaggctccctttaggtccagat

SEQ ID NO: 8454510 - DNA, 22 bp, Homo sapiens
gaggctccggtagtagccttga

SEQ ID NO: 8454511 - DNA, 22 bp, Homo sapiens
gaggctccgtgctgctgccctg

SEQ ID NO: 8454512 - DNA, 20 bp, Homo sapiens
gaggctctgggcatggcgcc

SEQ ID NO: 8454513 - DNA, 22 bp, Homo sapiens
gaggctcttcaataggtcaatg

SEQ ID NO: 8454514 - DNA, 22 bp, Homo sapiens
gaggctcctcattcagtatgct

SEQ ID NO: 8454515 - DNA, 22 bp, Homo sapiens
gaggctcctccttacatttacc

SEQ ID NO: 8454516 - DNA, 22 bp, Homo sapiens
gaggctccttgaaagggggact

SEQ ID NO: 8454517 - DNA, 22 bp, Homo sapiens
gaggctctggagtaggtacaca

SEQ ID NO: 8454518 - DNA, 22 bp, Homo sapiens
atgtatttctatgtagtgaaga

SEQ ID NO: 8454519 - DNA, 22 bp, Homo sapiens
gaggctccatggaggagtatgg

SEQ ID NO: 8454520 - DNA, 22 bp, Homo sapiens
gaggcctgggttggaggtgcat

SEQ ID NO: 8454521 - DNA, 22 bp, Homo sapiens
atggctctctagggcccaggtt

SEQ ID NO: 8454522 - DNA, 22 bp, Homo sapiens
atggctgcagagacctgaagaa

SEQ ID NO: 8454523 - DNA, 22 bp, Homo sapiens
atggctgcagagacctgaagaa

SEQ ID NO: 8454524 - DNA, 22 bp, Homo sapiens
atggctgcagagacctgaagaa

SEQ ID NO: 8454525 - DNA, 22 bp, Homo sapiens
atggctgcagccggccctgcgc

SEQ ID NO: 8454526 - DNA, 22 bp, Homo sapiens
atggctgcagccggccctgcgc

SEQ ID NO: 8454527 - DNA, 22 bp, Homo sapiens
atggctgcatcatcctggttga

SEQ ID NO: 8454528 - DNA, 22 bp, Homo sapiens
atggctgcagtccgtgccctgg

SEQ ID NO: 8454529 - DNA, 22 bp, Homo sapiens
atggctgcagtccgtgccctgg

SEQ ID NO: 8454530 - DNA, 22 bp, Homo sapiens
atggctgcagtccgtgccctgg

SEQ ID NO: 8454531 - DNA, 22 bp, Homo sapiens
atggctgcagccggccctgcgc

SEQ ID NO: 8454532 - DNA, 22 bp, Homo sapiens
atggcagacctgggctggagaa

SEQ ID NO: 8454533 - DNA, 22 bp, Homo sapiens
atggcagacctgggctggagaa

SEQ ID NO: 8454534 - DNA, 22 bp, Homo sapiens
atggcagacgaggcagcagggg

SEQ ID NO: 8454535 - DNA, 22 bp, Homo sapiens
atggcagagggattgaacagct

SEQ ID NO: 8454536 - DNA, 22 bp, Homo sapiens
atggctccatagcttcgtttag

SEQ ID NO: 8454537 - DNA, 21 bp, Homo sapiens
atggctcaggccatcaatgga

SEQ ID NO: 8454538 - DNA, 22 bp, Homo sapiens
gagcacaggctttggtggacac

SEQ ID NO: 8454539 - DNA, 22 bp, Homo sapiens
atgggaggaagagaagatgtct

SEQ ID NO: 8454540 - DNA, 22 bp, Homo sapiens
atgggagaaacatcatgaggca

SEQ ID NO: 8454541 - DNA, 22 bp, Homo sapiens
atgggagtccaacatcaaggac

SEQ ID NO: 8454542 - DNA, 22 bp, Homo sapiens
gagcacagctggaggtagcatt

SEQ ID NO: 8454543 - DNA, 22 bp, Homo sapiens
gagcacagctggaggtagcatt

SEQ ID NO: 8454544 - DNA, 22 bp, Homo sapiens
gagcacagctggaggtagcatt

SEQ ID NO: 8454545 - DNA, 22 bp, Homo sapiens
gagcacagctggaggtagcatt

SEQ ID NO: 8454546 - DNA, 22 bp, Homo sapiens
gagcacagctgtcttgcaagct

SEQ ID NO: 8454547 - DNA, 22 bp, Homo sapiens
gagcacaggctgctgtgaactg

SEQ ID NO: 8454548 - DNA, 22 bp, Homo sapiens
gagccccttctgcagtcaggtt

SEQ ID NO: 8454549 - DNA, 22 bp, Homo sapiens
gagccctctctgtaggcaagta

SEQ ID NO: 8454550 - DNA, 19 bp, Homo sapiens
gagccctctccatggccac

SEQ ID NO: 8454551 - DNA, 22 bp, Homo sapiens
gagccctcgggcgagcccgcgc

SEQ ID NO: 8454552 - DNA, 22 bp, Homo sapiens
gagccctccatggagccaggca

SEQ ID NO: 8454553 - DNA, 22 bp, Homo sapiens
gagccctcattgaatctgcatt

SEQ ID NO: 8454554 - DNA, 22 bp, Homo sapiens
gagccctcaccgcctgaccagg

SEQ ID NO: 8454555 - DNA, 22 bp, Homo sapiens
gagccctcaccgcctgaccagg

SEQ ID NO: 8454556 - DNA, 22 bp, Homo sapiens
gagccctcaatgaatctgcatt

SEQ ID NO: 8454557 - DNA, 22 bp, Homo sapiens
atgggcagagctggtgggaggc

SEQ ID NO: 8454558 - DNA, 22 bp, Homo sapiens
gagcccagtctgctcctgcgcc

SEQ ID NO: 8454559 - DNA, 22 bp, Homo sapiens
gagcccagtctgctcctgcgcc

SEQ ID NO: 8454560 - DNA, 22 bp, Homo sapiens
gagcccagtctgctcctgcgcc

SEQ ID NO: 8454561 - DNA, 22 bp, Homo sapiens
gagccccaccctagacattctg

SEQ ID NO: 8454562 - DNA, 17 bp, Homo sapiens
gagctctgtggcacaag

SEQ ID NO: 8454563 - DNA, 21 bp, Homo sapiens
gagctgcaccttgacctgttt

SEQ ID NO: 8454564 - DNA, 22 bp, Homo sapiens
gagctgcactgggggtggaatg

SEQ ID NO: 8454565 - DNA, 22 bp, Homo sapiens
gagctgcacatctgaggctaat

SEQ ID NO: 8454566 - DNA, 22 bp, Homo sapiens
gagctgccagacatgggaatga

SEQ ID NO: 8454567 - DNA, 22 bp, Homo sapiens
gagctgcatgcaactcgaaaat

SEQ ID NO: 8454568 - DNA, 22 bp, Homo sapiens
gagctgcatagctgggatcctc

SEQ ID NO: 8454569 - DNA, 22 bp, Homo sapiens
atggcaattgtaaatggaaaga

SEQ ID NO: 8454570 - DNA, 22 bp, Homo sapiens
atggatgaaggcgaggatgagg

SEQ ID NO: 8454571 - DNA, 22 bp, Homo sapiens
atggatgagtccttgagacaca

SEQ ID NO: 8454572 - DNA, 22 bp, Homo sapiens
atggattggatttttatggacc

SEQ ID NO: 8454573 - DNA, 22 bp, Homo sapiens
atggcagaattaggatttcaag

SEQ ID NO: 8454574 - DNA, 22 bp, Homo sapiens
atggcagacacaggcaggcaga

SEQ ID NO: 8454575 - DNA, 22 bp, Homo sapiens
atggcagaaaggcatgtgggcc

SEQ ID NO: 8454576 - DNA, 22 bp, Homo sapiens
gagacaggcagctagtgggtca

SEQ ID NO: 8454577 - DNA, 22 bp, Homo sapiens
gagacaggccaggtggtactta

SEQ ID NO: 8454578 - DNA, 22 bp, Homo sapiens
atggatctaccttcaggctctg

SEQ ID NO: 8454579 - DNA, 22 bp, Homo sapiens
gagaatctacaggaaaccgaag

SEQ ID NO: 8454580 - DNA, 17 bp, Homo sapiens
gagacagcaggagcccc

SEQ ID NO: 8454581 - DNA, 17 bp, Homo sapiens
gagacagcaggagcccc

SEQ ID NO: 8454582 - DNA, 22 bp, Homo sapiens
gagaatctcaggcacccagaag

SEQ ID NO: 8454583 - DNA, 22 bp, Homo sapiens
gagacaggatttaaccaaagct

SEQ ID NO: 8454584 - DNA, 22 bp, Homo sapiens
gagacagcttaattggtggtca

SEQ ID NO: 8454585 - DNA, 22 bp, Homo sapiens
gagaaggtggacctgaaggagc

SEQ ID NO: 8454586 - DNA, 16 bp, Homo sapiens
atgctgctattagagg

SEQ ID NO: 8454587 - DNA, 22 bp, Homo sapiens
atgctgggaagtcctaaccaca

SEQ ID NO: 8454588 - DNA, 22 bp, Homo sapiens
atgctggggcctcagaccagaa

SEQ ID NO: 8454589 - DNA, 22 bp, Homo sapiens
caactatagatcaaatgagttt

SEQ ID NO: 8454590 - DNA, 22 bp, Homo sapiens
caacaccttgatcttggacttc

SEQ ID NO: 8454591 - DNA, 22 bp, Homo sapiens
caacaccttgatcttggacttc

SEQ ID NO: 8454592 - DNA, 22 bp, Homo sapiens
caacaatatgctgagtttttca

SEQ ID NO: 8454593 - DNA, 22 bp, Homo sapiens
caacaatttcccagtttcccat

SEQ ID NO: 8454594 - DNA, 22 bp, Homo sapiens
caacacaggggttatgccatgg

SEQ ID NO: 8454595 - DNA, 22 bp, Homo sapiens
caacacattgaagctatgatga

SEQ ID NO: 8454596 - DNA, 22 bp, Homo sapiens
caacaagtgggtactttacagg

SEQ ID NO: 8454597 - DNA, 22 bp, Homo sapiens
caacaatatgccagactcaatt

SEQ ID NO: 8454598 - DNA, 22 bp, Homo sapiens
caacaacatgggattcatttct

SEQ ID NO: 8454599 - DNA, 22 bp, Homo sapiens
caacaagcgctcagagcaaagc

SEQ ID NO: 8454600 - DNA, 22 bp, Homo sapiens
gctgccctgtctgcagcaggac

SEQ ID NO: 8454601 - DNA, 22 bp, Homo sapiens
caaattttgtgtgttctctagt

SEQ ID NO: 8454602 - DNA, 22 bp, Homo sapiens
caaattttgtgtgttctctagt

SEQ ID NO: 8454603 - DNA, 21 bp, Homo sapiens
gctgccctggctcagcattca

SEQ ID NO: 8454604 - DNA, 22 bp, Homo sapiens
gctgccctgtccggctctcctg

SEQ ID NO: 8454605 - DNA, 22 bp, Homo sapiens
gctgccctgtccggctctcctg

SEQ ID NO: 8454606 - DNA, 22 bp, Homo sapiens
caagaaacaccaatgactgctg

SEQ ID NO: 8454607 - DNA, 22 bp, Homo sapiens
caacttttctgtgaatttaagt

SEQ ID NO: 8454608 - DNA, 22 bp, Homo sapiens
caacttttgacacgtgtgctaa

SEQ ID NO: 8454609 - DNA, 22 bp, Homo sapiens
caagaaactttattctgccata

SEQ ID NO: 8454610 - DNA, 22 bp, Homo sapiens
caagaaccgcaattacttttgc

SEQ ID NO: 8454611 - DNA, 22 bp, Homo sapiens
caagaacattgtgatcacttca

SEQ ID NO: 8454612 - DNA, 22 bp, Homo sapiens
caagaacagtttgccaaattgg

SEQ ID NO: 8454613 - DNA, 22 bp, Homo sapiens
caaagtcagccagctagtaggt

SEQ ID NO: 8454614 - DNA, 17 bp, Homo sapiens
gctctggcacaggattg

SEQ ID NO: 8454615 - DNA, 22 bp, Homo sapiens
caaagtcagggaagagtggctg

SEQ ID NO: 8454616 - DNA, 22 bp, Homo sapiens
gctctggaagcatctgagagga

SEQ ID NO: 8454617 - DNA, 22 bp, Homo sapiens
gctgccctctgtgtttgtcctt

SEQ ID NO: 8454618 - DNA, 22 bp, Homo sapiens
gctgccctctgtgacccggccc

SEQ ID NO: 8454619 - DNA, 22 bp, Homo sapiens
gctgccctgacaagctactccc

SEQ ID NO: 8454620 - DNA, 22 bp, Homo sapiens
gctgccctcccagggcaagctt

SEQ ID NO: 8454621 - DNA, 22 bp, Homo sapiens
gctgccctcccagggcaagctt

SEQ ID NO: 8454622 - DNA, 22 bp, Homo sapiens
gctgccctctctggccccacac

SEQ ID NO: 8454623 - DNA, 22 bp, Homo sapiens
gctgccctctctggccccacac

SEQ ID NO: 8454624 - DNA, 22 bp, Homo sapiens
gctgccctctgtgacccggccc

SEQ ID NO: 8454625 - DNA, 21 bp, Homo sapiens
gctgccctggctcagcattca

SEQ ID NO: 8454626 - DNA, 22 bp, Homo sapiens
gctgccctgcatctgtgccttc

SEQ ID NO: 8454627 - DNA, 22 bp, Homo sapiens
gctgccctgcctcagactcctc

SEQ ID NO: 8454628 - DNA, 22 bp, Homo sapiens
gctgccctgactccagcagcct

SEQ ID NO: 8454629 - DNA, 22 bp, Homo sapiens
gctgccctgactccagcagcct

SEQ ID NO: 8454630 - DNA, 22 bp, Homo sapiens
gctgccctccagttcccacagt

SEQ ID NO: 8454631 - DNA, 22 bp, Homo sapiens
caaagtgagagaatggcagaaa

SEQ ID NO: 8454632 - DNA, 22 bp, Homo sapiens
caaagtgctaggattacaggcc

SEQ ID NO: 8454633 - DNA, 22 bp, Homo sapiens
caaagtgctaggattacaggcg

SEQ ID NO: 8454634 - DNA, 22 bp, Homo sapiens
caaagtgcctgtaccactttgc

SEQ ID NO: 8454635 - DNA, 22 bp, Homo sapiens
caagaagtgtcagctttttaaa

SEQ ID NO: 8454636 - DNA, 22 bp, Homo sapiens
caagaagttgacagccaggtga

SEQ ID NO: 8454637 - DNA, 22 bp, Homo sapiens
gctggactagaagcagggctca

SEQ ID NO: 8454638 - DNA, 22 bp, Homo sapiens
caagaatcctgttcttgaagat

SEQ ID NO: 8454639 - DNA, 22 bp, Homo sapiens
caagaatcttgcagcttagact

SEQ ID NO: 8454640 - DNA, 22 bp, Homo sapiens
caagaattgtacaaactgggtg

SEQ ID NO: 8454641 - DNA, 22 bp, Homo sapiens
caagaatataaatactttcaaa

SEQ ID NO: 8454642 - DNA, 22 bp, Homo sapiens
gctggaaatcaaagaagtggat

SEQ ID NO: 8454643 - DNA, 22 bp, Homo sapiens
gctggaaaaggaggcaaaatat

SEQ ID NO: 8454644 - DNA, 22 bp, Homo sapiens
gctggaaatgaatggagaggtg

SEQ ID NO: 8454645 - DNA, 22 bp, Homo sapiens
gctggaaggctaggctcagttg

SEQ ID NO: 8454646 - DNA, 22 bp, Homo sapiens
gctggaaggctaggctcagttg

SEQ ID NO: 8454647 - DNA, 22 bp, Homo sapiens
gctggaaggctaggctcagttg

SEQ ID NO: 8454648 - DNA, 22 bp, Homo sapiens
gctgcctgcagtgttttcccag

SEQ ID NO: 8454649 - DNA, 22 bp, Homo sapiens
gctgcctgccctgggtcatctg

SEQ ID NO: 8454650 - DNA, 22 bp, Homo sapiens
gctgctggccgcccagcttctc

SEQ ID NO: 8454651 - DNA, 22 bp, Homo sapiens
gctgcctgccctgggtcatctg

SEQ ID NO: 8454652 - DNA, 22 bp, Homo sapiens
caagccttggaaatccattctg

SEQ ID NO: 8454653 - DNA, 22 bp, Homo sapiens
gctgggctcaccaggccactag

SEQ ID NO: 8454654 - DNA, 22 bp, Homo sapiens
gctgggcttgtggccagctggg

SEQ ID NO: 8454655 - DNA, 22 bp, Homo sapiens
gctggggagcaagagtagtgag

SEQ ID NO: 8454656 - DNA, 22 bp, Homo sapiens
gctggggactccccaccatagc

SEQ ID NO: 8454657 - DNA, 22 bp, Homo sapiens
gctgggcttgtggccagctggg

SEQ ID NO: 8454658 - DNA, 22 bp, Homo sapiens
gctgggcttgtggccagctggg

SEQ ID NO: 8454659 - DNA, 22 bp, Homo sapiens
gctgggcttgtggccagctggg

SEQ ID NO: 8454660 - DNA, 20 bp, Homo sapiens
gctgggctttgactgacaca

SEQ ID NO: 8454661 - DNA, 20 bp, Homo sapiens
gctgggctttgactgacaca

SEQ ID NO: 8454662 - DNA, 20 bp, Homo sapiens
gctgggctttgactgacaca

SEQ ID NO: 8454663 - DNA, 22 bp, Homo sapiens
caagccattctcctgcctcagc

SEQ ID NO: 8454664 - DNA, 22 bp, Homo sapiens
gctggctgaggtctagctcttt

SEQ ID NO: 8454665 - DNA, 17 bp, Homo sapiens
gctggctgacccatgcc

SEQ ID NO: 8454666 - DNA, 22 bp, Homo sapiens
gctggctctttttgccgggctc

SEQ ID NO: 8454667 - DNA, 22 bp, Homo sapiens
gctggctcttcagtggagatag

SEQ ID NO: 8454668 - DNA, 22 bp, Homo sapiens
gctggcccagggtcacctagga

SEQ ID NO: 8454669 - DNA, 22 bp, Homo sapiens
gctggctcttcagtggagatag

SEQ ID NO: 8454670 - DNA, 22 bp, Homo sapiens
gctggctctttttgccgggctc

SEQ ID NO: 8454671 - DNA, 22 bp, Homo sapiens
gctggctctttttgccgggctc

SEQ ID NO: 8454672 - DNA, 22 bp, Homo sapiens
caaggctgtgcagggtccatat

SEQ ID NO: 8454673 - DNA, 22 bp, Homo sapiens
caaggcttatcagccaggagcc

SEQ ID NO: 8454674 - DNA, 22 bp, Homo sapiens
caaggctgtgttagctgccctc

SEQ ID NO: 8454675 - DNA, 22 bp, Homo sapiens
caaggcttaggtggctccctgt

SEQ ID NO: 8454676 - DNA, 22 bp, Homo sapiens
caaggcttagtcagagggtgct

SEQ ID NO: 8454677 - DNA, 21 bp, Homo sapiens
caaggcttaaacattaatcta

SEQ ID NO: 8454678 - DNA, 22 bp, Homo sapiens
caataagccaggtgtttgtgtt

SEQ ID NO: 8454679 - DNA, 22 bp, Homo sapiens
caaggctgtctccagcttccaa

SEQ ID NO: 8454680 - DNA, 22 bp, Homo sapiens
caaggctaagctttggctttct

SEQ ID NO: 8454681 - DNA, 22 bp, Homo sapiens
caaggccttgctgtctcctcct

SEQ ID NO: 8454682 - DNA, 22 bp, Homo sapiens
gctggggagctagacctcagca

SEQ ID NO: 8454683 - DNA, 22 bp, Homo sapiens
caaggctaccctttcaccaaaa

SEQ ID NO: 8454684 - DNA, 22 bp, Homo sapiens
caaggctagaagtccaacatca

SEQ ID NO: 8454685 - DNA, 22 bp, Homo sapiens
caaggctagcaagcagtagtca

SEQ ID NO: 8454686 - DNA, 22 bp, Homo sapiens
caaggctataatgttgctggaa

SEQ ID NO: 8454687 - DNA, 22 bp, Homo sapiens
caaggctgagaaattctgccct

SEQ ID NO: 8454688 - DNA, 22 bp, Homo sapiens
caaggctgctgcgggtcgcacc

SEQ ID NO: 8454689 - DNA, 22 bp, Homo sapiens
caaggctgatcattttcccata

SEQ ID NO: 8454690 - DNA, 22 bp, Homo sapiens
caatagaaaactcaatacttaa

SEQ ID NO: 8454691 - DNA, 18 bp, Homo sapiens
caatagaaacagtaggaa

SEQ ID NO: 8454692 - DNA, 22 bp, Homo sapiens
caatagaaggcacagataggta

SEQ ID NO: 8454693 - DNA, 20 bp, Homo sapiens
caatagaatgtggagataag

SEQ ID NO: 8454694 - DNA, 20 bp, Homo sapiens
caatagaatgtggagataag

SEQ ID NO: 8454695 - DNA, 22 bp, Homo sapiens
caatagcaggtctacagagaga

SEQ ID NO: 8454696 - DNA, 22 bp, Homo sapiens
caatagtatttattgaacacct

SEQ ID NO: 8454697 - DNA, 22 bp, Homo sapiens
caatatataggaacaacttagg

SEQ ID NO: 8454698 - DNA, 22 bp, Homo sapiens
caatatataatgagtactttcc

SEQ ID NO: 8454699 - DNA, 19 bp, Homo sapiens
caatatatagtgagtggat

SEQ ID NO: 8454700 - DNA, 19 bp, Homo sapiens
caatatatagtgagtggat

SEQ ID NO: 8454701 - DNA, 19 bp, Homo sapiens
caatatatagtgagtggat

SEQ ID NO: 8454702 - DNA, 19 bp, Homo sapiens
caatatatagtgagtggat

SEQ ID NO: 8454703 - DNA, 22 bp, Homo sapiens
caatcacaaagagacaagtgtc

SEQ ID NO: 8454704 - DNA, 22 bp, Homo sapiens
caatgttttcaactgacaagta

SEQ ID NO: 8454705 - DNA, 22 bp, Homo sapiens
caatccagtttctgtcagctac

SEQ ID NO: 8454706 - DNA, 22 bp, Homo sapiens
caattcatctgggtaggtagcc

SEQ ID NO: 8454707 - DNA, 22 bp, Homo sapiens
caattcatgggctgaggaaggg

SEQ ID NO: 8454708 - DNA, 22 bp, Homo sapiens
caattcatgtgagcggactctt

SEQ ID NO: 8454709 - DNA, 22 bp, Homo sapiens
caattcatgttaaacagaagca

SEQ ID NO: 8454710 - DNA, 22 bp, Homo sapiens
caattctttgtagaagctctcc

SEQ ID NO: 8454711 - DNA, 22 bp, Homo sapiens
caatttcaagattctgttcttt

SEQ ID NO: 8454712 - DNA, 22 bp, Homo sapiens
caattctttcagctgcatttgt

SEQ ID NO: 8454713 - DNA, 22 bp, Homo sapiens
caattcttggagaagaagcata

SEQ ID NO: 8454714 - DNA, 22 bp, Homo sapiens
caattcattacattgcaaagac

SEQ ID NO: 8454715 - DNA, 22 bp, Homo sapiens
caatttcatcttgtgcttcaat

SEQ ID NO: 8454716 - DNA, 22 bp, Homo sapiens
caatttcaatacaaaatacatt

SEQ ID NO: 8454717 - DNA, 22 bp, Homo sapiens
cacaaataccagtttcctaaca

SEQ ID NO: 8454718 - DNA, 22 bp, Homo sapiens
ggaagctgaggcccagtgaagg

SEQ ID NO: 8454719 - DNA, 22 bp, Homo sapiens
ggaagctgaacttagcaaggaa

SEQ ID NO: 8454720 - DNA, 22 bp, Homo sapiens
ggaagctgaatccagagacagg

SEQ ID NO: 8454721 - DNA, 22 bp, Homo sapiens
ggaagctgaatccagagacagg

SEQ ID NO: 8454722 - DNA, 22 bp, Homo sapiens
ggaagctctgtggcttggagtc

SEQ ID NO: 8454723 - DNA, 22 bp, Homo sapiens
ggaagctctgtggcttggagtc

SEQ ID NO: 8454724 - DNA, 23 bp, Homo sapiens
ggaagctcacgtagtcctgcact

SEQ ID NO: 8454725 - DNA, 22 bp, Homo sapiens
cacaaatgtgcagaaatgtgag

SEQ ID NO: 8454726 - DNA, 22 bp, Homo sapiens
cacaaatgtagtagcttaaaac

SEQ ID NO: 8454727 - DNA, 22 bp, Homo sapiens
cacaaatggccgtgttcaaaga

SEQ ID NO: 8454728 - DNA, 22 bp, Homo sapiens
ggacatttagtttcattgggca

SEQ ID NO: 8454729 - DNA, 22 bp, Homo sapiens
ggacatttctattgagctaaga

SEQ ID NO: 8454730 - DNA, 22 bp, Homo sapiens
ggacatttgcacctacctcagc

SEQ ID NO: 8454731 - DNA, 22 bp, Homo sapiens
ggaccacaatatttgtgaggtt

SEQ ID NO: 8454732 - DNA, 22 bp, Homo sapiens
ggacatttttcttcctacaatg

SEQ ID NO: 8454733 - DNA, 22 bp, Homo sapiens
ggagaaggtggctcagcaaagg

SEQ ID NO: 8454734 - DNA, 22 bp, Homo sapiens
ggagagaggagcccactgctgt

SEQ ID NO: 8454735 - DNA, 22 bp, Homo sapiens
ggagagaggagcccactgctgt

SEQ ID NO: 8454736 - DNA, 22 bp, Homo sapiens
ggagagaggagcccactgctgt

SEQ ID NO: 8454737 - DNA, 22 bp, Homo sapiens
ggagagcagggtcctgagatac

SEQ ID NO: 8454738 - DNA, 20 bp, Homo sapiens
ggagagccacatagtctccc

SEQ ID NO: 8454739 - DNA, 22 bp, Homo sapiens
ggagaaggtgctggtcactgtg

SEQ ID NO: 8454740 - DNA, 22 bp, Homo sapiens
ggagaaggtgctggtcactgtg

SEQ ID NO: 8454741 - DNA, 22 bp, Homo sapiens
ggagaagggtatgtgtggcgga

SEQ ID NO: 8454742 - DNA, 22 bp, Homo sapiens
ggagaagggtatgtgtggcgga

SEQ ID NO: 8454743 - DNA, 22 bp, Homo sapiens
ggagaagggccaattccatgta

SEQ ID NO: 8454744 - DNA, 22 bp, Homo sapiens
ggagaagggcatggtagtttta

SEQ ID NO: 8454745 - DNA, 22 bp, Homo sapiens
ggagaagggcatggtagtttta

SEQ ID NO: 8454746 - DNA, 22 bp, Homo sapiens
ggagaagggacagactcagctt

SEQ ID NO: 8454747 - DNA, 22 bp, Homo sapiens
ggagaaggcgaagtcattcttt

SEQ ID NO: 8454748 - DNA, 22 bp, Homo sapiens
ggagaagggaactgagtttttg

SEQ ID NO: 8454749 - DNA, 22 bp, Homo sapiens
ggagaagggaactgagtttttg

SEQ ID NO: 8454750 - DNA, 22 bp, Homo sapiens
ggagaagggacagactcagctt

SEQ ID NO: 8454751 - DNA, 22 bp, Homo sapiens
cacacagtgggaaaacctgaag

SEQ ID NO: 8454752 - DNA, 22 bp, Homo sapiens
ggactgggtaggagcccagggc

SEQ ID NO: 8454753 - DNA, 22 bp, Homo sapiens
ggactgggtaggagcccagggc

SEQ ID NO: 8454754 - DNA, 22 bp, Homo sapiens
ggactgggtaggagcccagggc

SEQ ID NO: 8454755 - DNA, 22 bp, Homo sapiens
cacacagtagtatgaggcaaaa

SEQ ID NO: 8454756 - DNA, 22 bp, Homo sapiens
cacacaggtatatatatgtaca

SEQ ID NO: 8454757 - DNA, 21 bp, Homo sapiens
cacacagtgatctatccacat

SEQ ID NO: 8454758 - DNA, 22 bp, Homo sapiens
cacacagtggagtattactcag

SEQ ID NO: 8454759 - DNA, 22 bp, Homo sapiens
cacacaggatgaagcagcagaa

SEQ ID NO: 8454760 - DNA, 22 bp, Homo sapiens
cacacaggatgaagcagcagaa

SEQ ID NO: 8454761 - DNA, 22 bp, Homo sapiens
cacacagggagaaagaaagcct

SEQ ID NO: 8454762 - DNA, 22 bp, Homo sapiens
cacacaggtaagcctctttcaa

SEQ ID NO: 8454763 - DNA, 22 bp, Homo sapiens
cacacaggagagtgctggaggt

SEQ ID NO: 8454764 - DNA, 22 bp, Homo sapiens
cacacaggagagtgctggaggt

SEQ ID NO: 8454765 - DNA, 22 bp, Homo sapiens
cactgtaatagcattataagtg

SEQ ID NO: 8454766 - DNA, 22 bp, Homo sapiens
cactgtacagcattaacaaggc

SEQ ID NO: 8454767 - DNA, 22 bp, Homo sapiens
cactgtacccatttaaataaat

SEQ ID NO: 8454768 - DNA, 22 bp, Homo sapiens
cactgtactgggttgaaggacg

SEQ ID NO: 8454769 - DNA, 22 bp, Homo sapiens
cactgtaatagcattataagtg

SEQ ID NO: 8454770 - DNA, 22 bp, Homo sapiens
cactggtgtattagagctagaa

SEQ ID NO: 8454771 - DNA, 22 bp, Homo sapiens
cactggtgccagagaacagaat

SEQ ID NO: 8454772 - DNA, 22 bp, Homo sapiens
cactgggcaattctgagcctaa

SEQ ID NO: 8454773 - DNA, 22 bp, Homo sapiens
cactgggagtcgtaagacacgg

SEQ ID NO: 8454774 - DNA, 22 bp, Homo sapiens
cactgtactgtgaataaggagg

SEQ ID NO: 8454775 - DNA, 22 bp, Homo sapiens
ggctctgctggattgaggccag

SEQ ID NO: 8454776 - DNA, 22 bp, Homo sapiens
ggctctgcttcagaaggctcat

SEQ ID NO: 8454777 - DNA, 22 bp, Homo sapiens
ggctctgcttcagaaggctcat

SEQ ID NO: 8454778 - DNA, 22 bp, Homo sapiens
ggctctgctggtaagatgcctc

SEQ ID NO: 8454779 - DNA, 22 bp, Homo sapiens
cactgcactccagcttgggtga

SEQ ID NO: 8454780 - DNA, 22 bp, Homo sapiens
cactgcactccagcctgggtga

SEQ ID NO: 8454781 - DNA, 22 bp, Homo sapiens
cactgcactccagcctgggtga

SEQ ID NO: 8454782 - DNA, 22 bp, Homo sapiens
cactgcactccagcctgggtca

SEQ ID NO: 8454783 - DNA, 22 bp, Homo sapiens
cactgcactccagcctgggtca

SEQ ID NO: 8454784 - DNA, 22 bp, Homo sapiens
cacttcaacagttatttcttag

SEQ ID NO: 8454785 - DNA, 22 bp, Homo sapiens
cacttagatactagatcacaaa

SEQ ID NO: 8454786 - DNA, 22 bp, Homo sapiens
cacttagaaaacttgagcaagt

SEQ ID NO: 8454787 - DNA, 22 bp, Homo sapiens
cacttagagccagatgcatagt

SEQ ID NO: 8454788 - DNA, 20 bp, Homo sapiens
ggctctggaatctggtgggc

SEQ ID NO: 8454789 - DNA, 22 bp, Homo sapiens
ggctctggaaagtgtccttgat

SEQ ID NO: 8454790 - DNA, 22 bp, Homo sapiens
ggctctggaaagtgtccttgat

SEQ ID NO: 8454791 - DNA, 21 bp, Homo sapiens
cacttgaatggtgttttacaa

SEQ ID NO: 8454792 - DNA, 22 bp, Homo sapiens
cacttgaatggcattgttcctt

SEQ ID NO: 8454793 - DNA, 22 bp, Homo sapiens
cacttgaatgagaatttcctgg

SEQ ID NO: 8454794 - DNA, 22 bp, Homo sapiens
cacttgaatgaaagagactcct

SEQ ID NO: 8454795 - DNA, 17 bp, Homo sapiens
cacttgctggtctacct

SEQ ID NO: 8454796 - DNA, 22 bp, Homo sapiens
cacttggaggccccctgtgccc

SEQ ID NO: 8454797 - DNA, 22 bp, Homo sapiens
cacttgatgttgtcactattgc

SEQ ID NO: 8454798 - DNA, 22 bp, Homo sapiens
cacttgaactgtttgaatgaga

SEQ ID NO: 8454799 - DNA, 22 bp, Homo sapiens
cacttgaagtttgggggactct

SEQ ID NO: 8454800 - DNA, 22 bp, Homo sapiens
cacttgaagtgaattgctcacc

SEQ ID NO: 8454801 - DNA, 22 bp, Homo sapiens
cacttgaaatattaggggtgat

SEQ ID NO: 8454802 - DNA, 22 bp, Homo sapiens
cacttgaacccgggaggctgag

SEQ ID NO: 8454803 - DNA, 23 bp, Homo sapiens
cacttcccctgtggcgagcctgc

SEQ ID NO: 8454804 - DNA, 22 bp, Homo sapiens
cacttctctgataatctcagtt

SEQ ID NO: 8454805 - DNA, 22 bp, Homo sapiens
cacttgaaagtaatggttgtgc

SEQ ID NO: 8454806 - DNA, 22 bp, Homo sapiens
cacttgaaaatcagaggaaatt

SEQ ID NO: 8454807 - DNA, 21 bp, Homo sapiens
cactttaaaaatatctttata

SEQ ID NO: 8454808 - DNA, 22 bp, Homo sapiens
cactgcactccagcctgggaga

SEQ ID NO: 8454809 - DNA, 22 bp, Homo sapiens
cactgcactccagcctgggaga

SEQ ID NO: 8454810 - DNA, 23 bp, Homo sapiens
cactcctgtttctaagccagcat

SEQ ID NO: 8454811 - DNA, 23 bp, Homo sapiens
cactcctgtttctaagccagcat

SEQ ID NO: 8454812 - DNA, 22 bp, Homo sapiens
cactcctgttccactaaatgag

SEQ ID NO: 8454813 - DNA, 22 bp, Homo sapiens
cactccagcctcagtgacagag

SEQ ID NO: 8454814 - DNA, 22 bp, Homo sapiens
cactccctctagttgcattctg

SEQ ID NO: 8454815 - DNA, 22 bp, Homo sapiens
cactcagctgagccctcagccc

SEQ ID NO: 8454816 - DNA, 21 bp, Homo sapiens
cactcagggtatgtgccaggc

SEQ ID NO: 8454817 - DNA, 21 bp, Homo sapiens
cactcagggtatgtgccaggc

SEQ ID NO: 8454818 - DNA, 22 bp, Homo sapiens
cactatatctctttcatctttt

SEQ ID NO: 8454819 - DNA, 17 bp, Homo sapiens
cactagtagtctctggc

SEQ ID NO: 8454820 - DNA, 22 bp, Homo sapiens
ggccagggaggagaggcccctg

SEQ ID NO: 8454821 - DNA, 22 bp, Homo sapiens
cacgccagccggacactgggcc

SEQ ID NO: 8454822 - DNA, 22 bp, Homo sapiens
cacgcttggcttatacagagaa

SEQ ID NO: 8454823 - DNA, 22 bp, Homo sapiens
cacgcgcacactcaggtcaagt

SEQ ID NO: 8454824 - DNA, 20 bp, Homo sapiens
cacctggctgactgtctcca

SEQ ID NO: 8454825 - DNA, 22 bp, Homo sapiens
cacctgggctaaactatgcagg

SEQ ID NO: 8454826 - DNA, 22 bp, Homo sapiens
cacctggagtagcaaggtaatt

SEQ ID NO: 8454827 - DNA, 22 bp, Homo sapiens
ggccaggctggtctcagacttc

SEQ ID NO: 8454828 - DNA, 22 bp, Homo sapiens
ggccaggctggttccttgacct

SEQ ID NO: 8454829 - DNA, 22 bp, Homo sapiens
ggccaggctgccctgggagcag

SEQ ID NO: 8454830 - DNA, 22 bp, Homo sapiens
ggccaggctgccctgggagcag

SEQ ID NO: 8454831 - DNA, 22 bp, Homo sapiens
ggccaggctgccctgggagcag

SEQ ID NO: 8454832 - DNA, 22 bp, Homo sapiens
caccaggcacagctctcctgct

SEQ ID NO: 8454833 - DNA, 22 bp, Homo sapiens
caccaggatgggcaggtaggtc

SEQ ID NO: 8454834 - DNA, 20 bp, Homo sapiens
caccaggcgctctgagaaca

SEQ ID NO: 8454835 - DNA, 22 bp, Homo sapiens
caccaggcacagctctcctgct

SEQ ID NO: 8454836 - DNA, 22 bp, Homo sapiens
caccaggcacatagtaggcact

SEQ ID NO: 8454837 - DNA, 22 bp, Homo sapiens
caccaggctgaaccagagggga

SEQ ID NO: 8454838 - DNA, 22 bp, Homo sapiens
caccaggctgagcctctcatct

SEQ ID NO: 8454839 - DNA, 22 bp, Homo sapiens
caccaggctgagcctctcatct

SEQ ID NO: 8454840 - DNA, 22 bp, Homo sapiens
caccaggctgagcctctcatct

SEQ ID NO: 8454841 - DNA, 22 bp, Homo sapiens
caccaggctgcccaggacaggg

SEQ ID NO: 8454842 - DNA, 22 bp, Homo sapiens
caccaggctgcccaggacaggg

SEQ ID NO: 8454843 - DNA, 22 bp, Homo sapiens
caccaggctggagtgcagaggt

SEQ ID NO: 8454844 - DNA, 22 bp, Homo sapiens
caccctgggctgggcctgttaa

SEQ ID NO: 8454845 - DNA, 22 bp, Homo sapiens
cacattaaaatcctaacttcca

SEQ ID NO: 8454846 - DNA, 22 bp, Homo sapiens
cacattaaaatcctaacttcca

SEQ ID NO: 8454847 - DNA, 22 bp, Homo sapiens
cacattcacttctctgtccacc

SEQ ID NO: 8454848 - DNA, 22 bp, Homo sapiens
cacattcacttctctgtccacc

SEQ ID NO: 8454849 - DNA, 22 bp, Homo sapiens
cacattcagggaacattggagg

SEQ ID NO: 8454850 - DNA, 22 bp, Homo sapiens
cacatgttcttgaagccaactc

SEQ ID NO: 8454851 - DNA, 21 bp, Homo sapiens
cacatgtgaattactgaactg

SEQ ID NO: 8454852 - DNA, 22 bp, Homo sapiens
cacatgtgcagttacatgaatt

SEQ ID NO: 8454853 - DNA, 22 bp, Homo sapiens
cacattcctgagcttcgacctg

SEQ ID NO: 8454854 - DNA, 22 bp, Homo sapiens
cacattcctggtgctcagcagc

SEQ ID NO: 8454855 - DNA, 22 bp, Homo sapiens
cacattccttacattcatagag

SEQ ID NO: 8454856 - DNA, 22 bp, Homo sapiens
caccagctactcgggtttcctg

SEQ ID NO: 8454857 - DNA, 22 bp, Homo sapiens
caccagctactccagggccgtg

SEQ ID NO: 8454858 - DNA, 22 bp, Homo sapiens
cacattcaggtggcatgttaga

SEQ ID NO: 8454859 - DNA, 21 bp, Homo sapiens
cacattccatgggtctattta

SEQ ID NO: 8454860 - DNA, 22 bp, Homo sapiens
cacattccccagagctggggct

SEQ ID NO: 8454861 - DNA, 22 bp, Homo sapiens
cacattcatcagtgttgtactg

SEQ ID NO: 8454862 - DNA, 22 bp, Homo sapiens
caccagcttcccatcgcgggtc

SEQ ID NO: 8454863 - DNA, 22 bp, Homo sapiens
caccagcttctcattgcgggtc

SEQ ID NO: 8454864 - DNA, 22 bp, Homo sapiens
caccagcttgcagtcttaaccc

SEQ ID NO: 8454865 - DNA, 22 bp, Homo sapiens
caccagcttgggctgtggaaat

SEQ ID NO: 8454866 - DNA, 22 bp, Homo sapiens
caccagcttacagtctcacccc

SEQ ID NO: 8454867 - DNA, 22 bp, Homo sapiens
caccagctccaccagggcaggt

SEQ ID NO: 8454868 - DNA, 22 bp, Homo sapiens
caccagctccaccagggcaggt

SEQ ID NO: 8454869 - DNA, 22 bp, Homo sapiens
caccagctctccaccaggtttc

SEQ ID NO: 8454870 - DNA, 22 bp, Homo sapiens
caccagctgcaacaccatctcc

SEQ ID NO: 8454871 - DNA, 22 bp, Homo sapiens
caccaggagcatctaggaggcg

SEQ ID NO: 8454872 - DNA, 22 bp, Homo sapiens
caccagctttgcccactgccca

SEQ ID NO: 8454873 - DNA, 22 bp, Homo sapiens
caccagctttgcccactgccca

SEQ ID NO: 8454874 - DNA, 22 bp, Homo sapiens
caccaggaagtggtggcctggg

SEQ ID NO: 8454875 - DNA, 21 bp, Homo sapiens
ggcaattaggcttctgagtat

SEQ ID NO: 8454876 - DNA, 22 bp, Homo sapiens
ggcaattaaagtactgtgaatg

SEQ ID NO: 8454877 - DNA, 22 bp, Homo sapiens
ggcaattacgtattagtcatgt

SEQ ID NO: 8454878 - DNA, 22 bp, Homo sapiens
ggcaattacgtattagtcatgt

SEQ ID NO: 8454879 - DNA, 22 bp, Homo sapiens
ggcaatagttgtgggttcttta

SEQ ID NO: 8454880 - DNA, 22 bp, Homo sapiens
ggcaagtgtgagaagggactgg

SEQ ID NO: 8454881 - DNA, 22 bp, Homo sapiens
cacatgactctggctacccaga

SEQ ID NO: 8454882 - DNA, 23 bp, Homo sapiens
cacatgacctgacctaggctagg

SEQ ID NO: 8454883 - DNA, 22 bp, Homo sapiens
cacatgaccactctttacttct

SEQ ID NO: 8454884 - DNA, 22 bp, Homo sapiens
cacatgagagcccccaagagca

SEQ ID NO: 8454885 - DNA, 22 bp, Homo sapiens
cacatgagacaattaaagactt

SEQ ID NO: 8454886 - DNA, 22 bp, Homo sapiens
cacatgaggtgacttccaagct

SEQ ID NO: 8454887 - DNA, 22 bp, Homo sapiens
cacatgaggtggagatgaatga

SEQ ID NO: 8454888 - DNA, 19 bp, Homo sapiens
cacatgagggctgagggac

SEQ ID NO: 8454889 - DNA, 19 bp, Homo sapiens
cacatgagggctgagggac

SEQ ID NO: 8454890 - DNA, 22 bp, Homo sapiens
cacatgagagcccccaagagca

SEQ ID NO: 8454891 - DNA, 22 bp, Homo sapiens
cacatgacactattttgttcta

SEQ ID NO: 8454892 - DNA, 22 bp, Homo sapiens
cacatgaattcacatgtatttt

SEQ ID NO: 8454893 - DNA, 22 bp, Homo sapiens
cacatgaataaggctttattgt

SEQ ID NO: 8454894 - DNA, 22 bp, Homo sapiens
cacatgcaccagaaatcaacat

SEQ ID NO: 8454895 - DNA, 22 bp, Homo sapiens
cacatgcaccagaaatcaacat

SEQ ID NO: 8454896 - DNA, 22 bp, Homo sapiens
cacatgagtcctgccaggtatg

SEQ ID NO: 8454897 - DNA, 22 bp, Homo sapiens
cacatgagtgagaacatgcagt

SEQ ID NO: 8454898 - DNA, 22 bp, Homo sapiens
cacatgagtgtaggaagaggga

SEQ ID NO: 8454899 - DNA, 22 bp, Homo sapiens
cacatgcaggagccaatgtaca

SEQ ID NO: 8454900 - DNA, 22 bp, Homo sapiens
cacatgcaggagccaatgtaca

SEQ ID NO: 8454901 - DNA, 22 bp, Homo sapiens
cacatgctccatacagaatggg

SEQ ID NO: 8454902 - DNA, 22 bp, Homo sapiens
ggcagagtggagtgcggcctcc

SEQ ID NO: 8454903 - DNA, 22 bp, Homo sapiens
cacagtgcatgatgggcagaag

SEQ ID NO: 8454904 - DNA, 19 bp, Homo sapiens
cacagtgcagccatttctc

SEQ ID NO: 8454905 - DNA, 22 bp, Homo sapiens
cacagtgcgaaagaaacccagc

SEQ ID NO: 8454906 - DNA, 22 bp, Homo sapiens
ggcaagtcaggaagttgacatt

SEQ ID NO: 8454907 - DNA, 22 bp, Homo sapiens
cacaggtgttcttgcagtgaaa

SEQ ID NO: 8454908 - DNA, 22 bp, Homo sapiens
cacaggtgtctctagtagcgtt

SEQ ID NO: 8454909 - DNA, 22 bp, Homo sapiens
cacaggtgtgtcctggtcttgt

SEQ ID NO: 8454910 - DNA, 22 bp, Homo sapiens
cacagtcttatcccaaccacca

SEQ ID NO: 8454911 - DNA, 22 bp, Homo sapiens
cacagtaaggtatcccagtgaa

SEQ ID NO: 8454912 - DNA, 22 bp, Homo sapiens
cacagtaaccccaggactggga

SEQ ID NO: 8454913 - DNA, 22 bp, Homo sapiens
cacagtaactggcgtgtagtaa

SEQ ID NO: 8454914 - DNA, 22 bp, Homo sapiens
cacagtaactcctgacccctcg

SEQ ID NO: 8454915 - DNA, 22 bp, Homo sapiens
cacagtaagaaatgaagaggta

SEQ ID NO: 8454916 - DNA, 22 bp, Homo sapiens
cacaggttcacctcaggtaggt

SEQ ID NO: 8454917 - DNA, 22 bp, Homo sapiens
cacaggttcaaattcaggtcgc

SEQ ID NO: 8454918 - DNA, 22 bp, Homo sapiens
cacaggcctgtctctttctaac

SEQ ID NO: 8454919 - DNA, 22 bp, Homo sapiens
cacaggcctggggttgagcggg

SEQ ID NO: 8454920 - DNA, 20 bp, Homo sapiens
cacaggccttgtgagcagac

SEQ ID NO: 8454921 - DNA, 18 bp, Homo sapiens
cacaggcaggtgataggt

SEQ ID NO: 8454922 - DNA, 22 bp, Homo sapiens
cacaggccaataccctctctct

SEQ ID NO: 8454923 - DNA, 22 bp, Homo sapiens
cacaggccagtaagactgtgtt

SEQ ID NO: 8454924 - DNA, 20 bp, Homo sapiens
cacaggccccaagacctgta

SEQ ID NO: 8454925 - DNA, 22 bp, Homo sapiens
cacaggtgcaagaagttgcagt

SEQ ID NO: 8454926 - DNA, 22 bp, Homo sapiens
cacaggtccttcctgccctggg

SEQ ID NO: 8454927 - DNA, 22 bp, Homo sapiens
cacaggtagatgccatgcagca

SEQ ID NO: 8454928 - DNA, 22 bp, Homo sapiens
cacaggtaatagcctaggctat

SEQ ID NO: 8454929 - DNA, 22 bp, Homo sapiens
cacagggctttgatggctgagt

SEQ ID NO: 8454930 - DNA, 22 bp, Homo sapiens
cacagggctttgatggctgagt

SEQ ID NO: 8454931 - DNA, 22 bp, Homo sapiens
cacaggggcaaactgtagggga

SEQ ID NO: 8454932 - DNA, 22 bp, Homo sapiens
cacagggttgttctgaggattc

SEQ ID NO: 8454933 - DNA, 22 bp, Homo sapiens
cacaggtaatagcctaggctat

SEQ ID NO: 8454934 - DNA, 22 bp, Homo sapiens
cacaggaggttaggaagtggtc

SEQ ID NO: 8454935 - DNA, 18 bp, Homo sapiens
cacaggagccacactcac

SEQ ID NO: 8454936 - DNA, 22 bp, Homo sapiens
cacaggagtgctgctattgttg

SEQ ID NO: 8454937 - DNA, 20 bp, Homo sapiens
ggagagccacatagtctccc

SEQ ID NO: 8454938 - DNA, 20 bp, Homo sapiens
ggagagccacatagtctccc

SEQ ID NO: 8454939 - DNA, 22 bp, Homo sapiens
cacaggcacccctgactgctca

SEQ ID NO: 8454940 - DNA, 22 bp, Homo sapiens
cacaggcacccctgactgctca

SEQ ID NO: 8454941 - DNA, 22 bp, Homo sapiens
cacaggcacgcctctggccagg

SEQ ID NO: 8454942 - DNA, 22 bp, Homo sapiens
cacaggcaggaggttctccagt

SEQ ID NO: 8454943 - DNA, 18 bp, Homo sapiens
cacaggcaggtgataggt

SEQ ID NO: 8454944 - DNA, 23 bp, Homo sapiens
cacaggcagaaatcaagacggta

SEQ ID NO: 8454945 - DNA, 22 bp, Homo sapiens
gggtacagagagatgaggtaac

SEQ ID NO: 8454946 - DNA, 22 bp, Homo sapiens
gggtaagctgctttatctctct

SEQ ID NO: 8454947 - DNA, 20 bp, Homo sapiens
ggggttggctggcacaggga

SEQ ID NO: 8454948 - DNA, 22 bp, Homo sapiens
ggggttggtttaaatgcttgag

SEQ ID NO: 8454949 - DNA, 20 bp, Homo sapiens
ggggttggctggcacaggga

SEQ ID NO: 8454950 - DNA, 19 bp, Homo sapiens
ggggcctgtgatggtcaca

SEQ ID NO: 8454951 - DNA, 22 bp, Homo sapiens
ggggccttggatctgtgccccg

SEQ ID NO: 8454952 - DNA, 22 bp, Homo sapiens
ggggaggaagctctcagttcca

SEQ ID NO: 8454953 - DNA, 22 bp, Homo sapiens
ggggaggaagctctcagttcca

SEQ ID NO: 8454954 - DNA, 22 bp, Homo sapiens
ggggcagagtagctggggtgtg

SEQ ID NO: 8454955 - DNA, 22 bp, Homo sapiens
ggggcagctaccggaagtaggg

SEQ ID NO: 8454956 - DNA, 22 bp, Homo sapiens
ggggcagatggaacagagcaca

SEQ ID NO: 8454957 - DNA, 22 bp, Homo sapiens
ggggcagatggaacagagcaca

SEQ ID NO: 8454958 - DNA, 22 bp, Homo sapiens
ggggcctctgcagtcacgctgg

SEQ ID NO: 8454959 - DNA, 22 bp, Homo sapiens
gggctgtgctgagtaggaggtg

SEQ ID NO: 8454960 - DNA, 22 bp, Homo sapiens
gggctgtgaggtgagaacttac

SEQ ID NO: 8454961 - DNA, 22 bp, Homo sapiens
gggctgtgaggtgagaacttac

SEQ ID NO: 8454962 - DNA, 22 bp, Homo sapiens
gggctgtgaggtgagaacttac

SEQ ID NO: 8454963 - DNA, 22 bp, Homo sapiens
gggctgtggagccgcgagggct

SEQ ID NO: 8454964 - DNA, 22 bp, Homo sapiens
gggctgtgtaatgtgctctttt

SEQ ID NO: 8454965 - DNA, 22 bp, Homo sapiens
cagagccagcagtggggacagg

SEQ ID NO: 8454966 - DNA, 22 bp, Homo sapiens
cagagccagcccactgttcccg

SEQ ID NO: 8454967 - DNA, 22 bp, Homo sapiens
cagagccagagacctgctgtgc

SEQ ID NO: 8454968 - DNA, 22 bp, Homo sapiens
cagagccagcccactgttcccg

SEQ ID NO: 8454969 - DNA, 22 bp, Homo sapiens
gggctgagtgggcctcttactt

SEQ ID NO: 8454970 - DNA, 22 bp, Homo sapiens
cagagccagagacctgctgtgc

SEQ ID NO: 8454971 - DNA, 21 bp, Homo sapiens
cagagccagactgctgaattt

SEQ ID NO: 8454972 - DNA, 22 bp, Homo sapiens
cagagccagaactagaccttgt

SEQ ID NO: 8454973 - DNA, 22 bp, Homo sapiens
cagatgctaagttatcagcagg

SEQ ID NO: 8454974 - DNA, 22 bp, Homo sapiens
ggtcctctccagcgccacagtg

SEQ ID NO: 8454975 - DNA, 22 bp, Homo sapiens
ggtcctgaggggagctgaaggt

SEQ ID NO: 8454976 - DNA, 22 bp, Homo sapiens
cagatgctaaacaaaggacttt

SEQ ID NO: 8454977 - DNA, 22 bp, Homo sapiens
cagatggcacagatttagagtg

SEQ ID NO: 8454978 - DNA, 22 bp, Homo sapiens
cagattaacacggagcttaaca

SEQ ID NO: 8454979 - DNA, 22 bp, Homo sapiens
ggtcctggatgagacaggtagt

SEQ ID NO: 8454980 - DNA, 22 bp, Homo sapiens
ggtcctggcagctctgtgtcca

SEQ ID NO: 8454981 - DNA, 22 bp, Homo sapiens
ggtcctggaaattgacggaaag

SEQ ID NO: 8454982 - DNA, 22 bp, Homo sapiens
ggtcctggaagtgtaagtggca

SEQ ID NO: 8454983 - DNA, 22 bp, Homo sapiens
ggtcctgcgtctggctcgcccg

SEQ ID NO: 8454984 - DNA, 18 bp, Homo sapiens
cagatgagatgcaatctc

SEQ ID NO: 8454985 - DNA, 22 bp, Homo sapiens
cagatgagagtggccagggttc

SEQ ID NO: 8454986 - DNA, 19 bp, Homo sapiens
cagatgagaaaagtgaggt

SEQ ID NO: 8454987 - DNA, 19 bp, Homo sapiens
cagatgagaaaagtgaggt

SEQ ID NO: 8454988 - DNA, 22 bp, Homo sapiens
cagatgagcatgggcacaagca

SEQ ID NO: 8454989 - DNA, 22 bp, Homo sapiens
cagatgaggggcatataacaat

SEQ ID NO: 8454990 - DNA, 22 bp, Homo sapiens
cagatatgctgagactcctgtg

SEQ ID NO: 8454991 - DNA, 22 bp, Homo sapiens
ggtcaagacgggctctgccctt

SEQ ID NO: 8454992 - DNA, 22 bp, Homo sapiens
ggtatttatatgtctgaagctg

SEQ ID NO: 8454993 - DNA, 22 bp, Homo sapiens
ggtcaaagtgaggagtcaggtt

SEQ ID NO: 8454994 - DNA, 22 bp, Homo sapiens
ggtcaacactgtgaccaacagg

SEQ ID NO: 8454995 - DNA, 22 bp, Homo sapiens
ggtcaacagaggtaatggtaac

SEQ ID NO: 8454996 - DNA, 22 bp, Homo sapiens
ggtatactgcatgacattgggg

SEQ ID NO: 8454997 - DNA, 22 bp, Homo sapiens
gggttcttatagtatcagagct

SEQ ID NO: 8454998 - DNA, 22 bp, Homo sapiens
gggttccctgcctggccactct

SEQ ID NO: 8454999 - DNA, 22 bp, Homo sapiens
gggttccagtctgaaactacag

SEQ ID NO: 8455000 - DNA, 22 bp, Homo sapiens
gggttccaatgatgagcaagag

SEQ ID NO: 8455001 - DNA, 22 bp, Homo sapiens
gggttccaatgatgagcaagag

SEQ ID NO: 8455002 - DNA, 22 bp, Homo sapiens
gggttccaaacatagtcttcct

SEQ ID NO: 8455003 - DNA, 22 bp, Homo sapiens
gggttaaacatgctatatgagt

SEQ ID NO: 8455004 - DNA, 20 bp, Homo sapiens
gggtgtgggcccggccaggc

SEQ ID NO: 8455005 - DNA, 20 bp, Homo sapiens
gggtgtgggcccggccaggc

SEQ ID NO: 8455006 - DNA, 20 bp, Homo sapiens
gggtgtgggcccggccaggc

SEQ ID NO: 8455007 - DNA, 22 bp, Homo sapiens
gggtaggaaatccagaggtggc

SEQ ID NO: 8455008 - DNA, 22 bp, Homo sapiens
gggtccagtagttggtggccgt

SEQ ID NO: 8455009 - DNA, 22 bp, Homo sapiens
gggtccaggtttagtcatttgt

SEQ ID NO: 8455010 - DNA, 22 bp, Homo sapiens
gggtccaggtcttcaggcagag

SEQ ID NO: 8455011 - DNA, 22 bp, Homo sapiens
gggtccaggtcttcaggcagag

SEQ ID NO: 8455012 - DNA, 22 bp, Homo sapiens
gggtccagtttcatctgaggtt

SEQ ID NO: 8455013 - DNA, 19 bp, Homo sapiens
gggtcccactgcccgtctg

SEQ ID NO: 8455014 - DNA, 22 bp, Homo sapiens
gggtccctggaattacttgaca

SEQ ID NO: 8455015 - DNA, 20 bp, Homo sapiens
gggtcctgacttggtctcct

SEQ ID NO: 8455016 - DNA, 22 bp, Homo sapiens
gggtcctgcgtgggcccaggac

SEQ ID NO: 8455017 - DNA, 22 bp, Homo sapiens
gggtcctggaatctgcatttta

SEQ ID NO: 8455018 - DNA, 21 bp, Homo sapiens
gggtcctgggatgggatccag

SEQ ID NO: 8455019 - DNA, 18 bp, Homo sapiens
gggtcctgttcttggaag

SEQ ID NO: 8455020 - DNA, 18 bp, Homo sapiens
gggtcctgtgggagacag

SEQ ID NO: 8455021 - DNA, 22 bp, Homo sapiens
gggaggagggtgctggctaaac

SEQ ID NO: 8455022 - DNA, 22 bp, Homo sapiens
gggagctgctgaacacaagggt

SEQ ID NO: 8455023 - DNA, 22 bp, Homo sapiens
gggagctgcggtcttgcgaaga

SEQ ID NO: 8455024 - DNA, 22 bp, Homo sapiens
gggagctgccttagaccggagg

SEQ ID NO: 8455025 - DNA, 22 bp, Homo sapiens
gggagctgccaccacccctggg

SEQ ID NO: 8455026 - DNA, 22 bp, Homo sapiens
gggaggcacgaggcgcgcagtg

SEQ ID NO: 8455027 - DNA, 22 bp, Homo sapiens
gggaggcatgtgttatccactt

SEQ ID NO: 8455028 - DNA, 22 bp, Homo sapiens
gggaggcagtgctggaggctgg

SEQ ID NO: 8455029 - DNA, 22 bp, Homo sapiens
gggaggcagtgctggaggctgg

SEQ ID NO: 8455030 - DNA, 18 bp, Homo sapiens
cagacactctgctctgca

SEQ ID NO: 8455031 - DNA, 22 bp, Homo sapiens
cagacactattgtgtataaatc

SEQ ID NO: 8455032 - DNA, 22 bp, Homo sapiens
cagacactaggtgacagagtgc

SEQ ID NO: 8455033 - DNA, 22 bp, Homo sapiens
cagacacagatatgcatatggc

SEQ ID NO: 8455034 - DNA, 22 bp, Homo sapiens
cagacacagcaattctgtgttg

SEQ ID NO: 8455035 - DNA, 22 bp, Homo sapiens
cagacacagatatgcatatggc

SEQ ID NO: 8455036 - DNA, 22 bp, Homo sapiens
cagacacaccaggcccattctg

SEQ ID NO: 8455037 - DNA, 22 bp, Homo sapiens
cagacacacaagcaatctaagt

SEQ ID NO: 8455038 - DNA, 22 bp, Homo sapiens
cagacacacaagcaatctaagt

SEQ ID NO: 8455039 - DNA, 22 bp, Homo sapiens
cagacagaaggaaggccaacat

SEQ ID NO: 8455040 - DNA, 22 bp, Homo sapiens
gggagcatttccctgtgttgaa

SEQ ID NO: 8455041 - DNA, 22 bp, Homo sapiens
gggagccaaggagagaggcctt

SEQ ID NO: 8455042 - DNA, 22 bp, Homo sapiens
gggagctgatgatgtaagtccc

SEQ ID NO: 8455043 - DNA, 22 bp, Homo sapiens
cagacaaccaggtctttcagtt

SEQ ID NO: 8455044 - DNA, 22 bp, Homo sapiens
cagaatttagaaaacaacataa

SEQ ID NO: 8455045 - DNA, 22 bp, Homo sapiens
cagaatttttcactcaatcttc

SEQ ID NO: 8455046 - DNA, 22 bp, Homo sapiens
cagaattcgaatgagcagaatc

SEQ ID NO: 8455047 - DNA, 22 bp, Homo sapiens
cagaattatagttgctttttaa

SEQ ID NO: 8455048 - DNA, 22 bp, Homo sapiens
cagaatttaagtggattattct

SEQ ID NO: 8455049 - DNA, 22 bp, Homo sapiens
cagaataaaggtacaattgagt

SEQ ID NO: 8455050 - DNA, 22 bp, Homo sapiens
cagaaacagacatgacgcagta

SEQ ID NO: 8455051 - DNA, 22 bp, Homo sapiens
cagaaaatagagtttctctgag

SEQ ID NO: 8455052 - DNA, 22 bp, Homo sapiens
cagaaaatagagtttctctgag

SEQ ID NO: 8455053 - DNA, 22 bp, Homo sapiens
ggctggcactgaggagagctct

SEQ ID NO: 8455054 - DNA, 22 bp, Homo sapiens
ggctggcactgaggagagctct

SEQ ID NO: 8455055 - DNA, 22 bp, Homo sapiens
cagaaacacttgtagagaagtt

SEQ ID NO: 8455056 - DNA, 19 bp, Homo sapiens
ggctggcaagtgacagtgt

SEQ ID NO: 8455057 - DNA, 22 bp, Homo sapiens
cagagacaacctggtagagaaa

SEQ ID NO: 8455058 - DNA, 22 bp, Homo sapiens
cagagacaacctggtagagaaa

SEQ ID NO: 8455059 - DNA, 22 bp, Homo sapiens
cagagacaacctggtagagaaa

SEQ ID NO: 8455060 - DNA, 22 bp, Homo sapiens
cagagacaacctggtagagaaa

SEQ ID NO: 8455061 - DNA, 22 bp, Homo sapiens
cagagacaacctggtagagaaa

SEQ ID NO: 8455062 - DNA, 22 bp, Homo sapiens
cagagacaccccagaaaataag

SEQ ID NO: 8455063 - DNA, 22 bp, Homo sapiens
cagagacacttaacaggaatgg

SEQ ID NO: 8455064 - DNA, 22 bp, Homo sapiens
cagagacacttaacaggaatgg

SEQ ID NO: 8455065 - DNA, 22 bp, Homo sapiens
gggatctgctccagagggaaaa

SEQ ID NO: 8455066 - DNA, 22 bp, Homo sapiens
gggatctgatttaggatgggag

SEQ ID NO: 8455067 - DNA, 22 bp, Homo sapiens
cagagacaacaagtttaactat

SEQ ID NO: 8455068 - DNA, 22 bp, Homo sapiens
gggatctttctgatgctgtggc

SEQ ID NO: 8455069 - DNA, 22 bp, Homo sapiens
gggatcttgtttaatattgttt

SEQ ID NO: 8455070 - DNA, 20 bp, Homo sapiens
gggatcttccaggctctcct

SEQ ID NO: 8455071 - DNA, 22 bp, Homo sapiens
gggatcttgaaacagctggatt

SEQ ID NO: 8455072 - DNA, 22 bp, Homo sapiens
gggatcttgggaacacccttac

SEQ ID NO: 8455073 - DNA, 21 bp, Homo sapiens
gggatcttgtactggcgtgga

SEQ ID NO: 8455074 - DNA, 22 bp, Homo sapiens
gggatctgtgttgcgatggatt

SEQ ID NO: 8455075 - DNA, 23 bp, Homo sapiens
gggatctgtaagttgaagacaaa

SEQ ID NO: 8455076 - DNA, 23 bp, Homo sapiens
gggatctgtaaacctggagaacc

SEQ ID NO: 8455077 - DNA, 22 bp, Homo sapiens
gggatctggaattttggtatgt

SEQ ID NO: 8455078 - DNA, 22 bp, Homo sapiens
gggatctgggacaacaggtggt

SEQ ID NO: 8455079 - DNA, 22 bp, Homo sapiens
cagagacagaaaatggatctag

SEQ ID NO: 8455080 - DNA, 22 bp, Homo sapiens
gggatgagagctgggacagaag

SEQ ID NO: 8455081 - DNA, 22 bp, Homo sapiens
gggatgagagctgggacagaag

SEQ ID NO: 8455082 - DNA, 22 bp, Homo sapiens
gggatgagagctgggacagaag

SEQ ID NO: 8455083 - DNA, 22 bp, Homo sapiens
cagagcagaaacctgggtgatt

SEQ ID NO: 8455084 - DNA, 22 bp, Homo sapiens
cagagcagaaacctgggtgatt

SEQ ID NO: 8455085 - DNA, 22 bp, Homo sapiens
cagagcagaagcggtcctcaca

SEQ ID NO: 8455086 - DNA, 22 bp, Homo sapiens
cagagcagaagcggtcctcaca

SEQ ID NO: 8455087 - DNA, 22 bp, Homo sapiens
cagagcacccaaggagcatttg

SEQ ID NO: 8455088 - DNA, 22 bp, Homo sapiens
cagagcattgagggtctgccaa

SEQ ID NO: 8455089 - DNA, 22 bp, Homo sapiens
cagagcatgtcaactagcttta

SEQ ID NO: 8455090 - DNA, 22 bp, Homo sapiens
cagagccaacgccacctgccca

SEQ ID NO: 8455091 - DNA, 22 bp, Homo sapiens
cagagccaaacctcagggcccg

SEQ ID NO: 8455092 - DNA, 22 bp, Homo sapiens
cagagccaaatgctgtggttat

SEQ ID NO: 8455093 - DNA, 20 bp, Homo sapiens
cagagccaagagcagcatct

SEQ ID NO: 8455094 - DNA, 20 bp, Homo sapiens
cagagccaagagcagcatct

SEQ ID NO: 8455095 - DNA, 22 bp, Homo sapiens
cagagccacagcctccagattt

SEQ ID NO: 8455096 - DNA, 22 bp, Homo sapiens
cagagccactgcattttacagc

SEQ ID NO: 8455097 - DNA, 22 bp, Homo sapiens
cagagcagtggggttggtcaga

SEQ ID NO: 8455098 - DNA, 19 bp, Homo sapiens
cagagcagtggttcctgaa

SEQ ID NO: 8455099 - DNA, 20 bp, Homo sapiens
cagagcagtgcccaggcggc

SEQ ID NO: 8455100 - DNA, 20 bp, Homo sapiens
cagagcagtgcccaggcggc

SEQ ID NO: 8455101 - DNA, 22 bp, Homo sapiens
cagagcagtggagagtaggtct

SEQ ID NO: 8455102 - DNA, 22 bp, Homo sapiens
cagagcaggggtttcccaggtt

SEQ ID NO: 8455103 - DNA, 22 bp, Homo sapiens
cagagcagtgaggagttgtgta

SEQ ID NO: 8455104 - DNA, 22 bp, Homo sapiens
cagagcagtgaggagttgtgta

SEQ ID NO: 8455105 - DNA, 22 bp, Homo sapiens
cagagcaggcccactgccctcc

SEQ ID NO: 8455106 - DNA, 22 bp, Homo sapiens
gggcaggtacaagatgcttctt

SEQ ID NO: 8455107 - DNA, 22 bp, Homo sapiens
gggcaggggtcagtggccccaa

SEQ ID NO: 8455108 - DNA, 18 bp, Homo sapiens
cagagcagaggtggagcg

SEQ ID NO: 8455109 - DNA, 18 bp, Homo sapiens
cagagcagaggtggagcg

SEQ ID NO: 8455110 - DNA, 22 bp, Homo sapiens
cagagcagaagcggtcctcaca

SEQ ID NO: 8455111 - DNA, 22 bp, Homo sapiens
gtacacttgtcttgaacagcct

SEQ ID NO: 8455112 - DNA, 22 bp, Homo sapiens
gtacacttgtcttgaacagcct

SEQ ID NO: 8455113 - DNA, 22 bp, Homo sapiens
gtacacttgactcataggaaat

SEQ ID NO: 8455114 - DNA, 20 bp, Homo sapiens
gtacacttcatgtttcacct

SEQ ID NO: 8455115 - DNA, 22 bp, Homo sapiens
gtactaaacagagaaccaatat

SEQ ID NO: 8455116 - DNA, 22 bp, Homo sapiens
gtactcagtaatataacatatt

SEQ ID NO: 8455117 - DNA, 20 bp, Homo sapiens
gtactcagatcaagtcagct

SEQ ID NO: 8455118 - DNA, 22 bp, Homo sapiens
gtactacagtttctcattaaat

SEQ ID NO: 8455119 - DNA, 23 bp, Homo sapiens
gtacacatagtgtagttatattt

SEQ ID NO: 8455120 - DNA, 22 bp, Homo sapiens
gtacacataggttactgattaa

SEQ ID NO: 8455121 - DNA, 22 bp, Homo sapiens
gtacacatactattcaaagaga

SEQ ID NO: 8455122 - DNA, 22 bp, Homo sapiens
gtactttaaatcaatgtagatt

SEQ ID NO: 8455123 - DNA, 22 bp, Homo sapiens
gtacttctggccaggctggcca

SEQ ID NO: 8455124 - DNA, 22 bp, Homo sapiens
gtacttctttagtcaatatgta

SEQ ID NO: 8455125 - DNA, 22 bp, Homo sapiens
gtagaaaattaggatgaggctt

SEQ ID NO: 8455126 - DNA, 22 bp, Homo sapiens
gtagaaaattaggatgaggctt

SEQ ID NO: 8455127 - DNA, 22 bp, Homo sapiens
gtagaaaaagcagtaagtctca

SEQ ID NO: 8455128 - DNA, 22 bp, Homo sapiens
gtagaaaaagcagtaagtctca

SEQ ID NO: 8455129 - DNA, 22 bp, Homo sapiens
gtagaaaaagcagtaagtctca

SEQ ID NO: 8455130 - DNA, 22 bp, Homo sapiens
gtactttagagtaaaatagacc

SEQ ID NO: 8455131 - DNA, 22 bp, Homo sapiens
gtaggccatggtggttgtctct

SEQ ID NO: 8455132 - DNA, 22 bp, Homo sapiens
gtaggcagtctctcaggtgatc

SEQ ID NO: 8455133 - DNA, 22 bp, Homo sapiens
gtaggcagtgcttgattttcca

SEQ ID NO: 8455134 - DNA, 22 bp, Homo sapiens
gtaggcaggtggaggagtgaag

SEQ ID NO: 8455135 - DNA, 22 bp, Homo sapiens
gtaggcaggtggaggagtgaag

SEQ ID NO: 8455136 - DNA, 22 bp, Homo sapiens
gtagaaatatttatctctgaga

SEQ ID NO: 8455137 - DNA, 22 bp, Homo sapiens
cagattagttgtgctatggcct

SEQ ID NO: 8455138 - DNA, 22 bp, Homo sapiens
cagattaagtgctcaacagtgt

SEQ ID NO: 8455139 - DNA, 22 bp, Homo sapiens
cagattcactaatagctggcct

SEQ ID NO: 8455140 - DNA, 22 bp, Homo sapiens
cagattcttcattcattctaca

SEQ ID NO: 8455141 - DNA, 22 bp, Homo sapiens
cagattctgggcccagcttgtc

SEQ ID NO: 8455142 - DNA, 22 bp, Homo sapiens
cagattctgaagtctagctgct

SEQ ID NO: 8455143 - DNA, 22 bp, Homo sapiens
cagattctccaggggctgcaga

SEQ ID NO: 8455144 - DNA, 20 bp, Homo sapiens
cagcaaaatgaaaatggatt

SEQ ID NO: 8455145 - DNA, 19 bp, Homo sapiens
cagcagccagggggcccct

SEQ ID NO: 8455146 - DNA, 22 bp, Homo sapiens
cagcagccagacaagatacatc

SEQ ID NO: 8455147 - DNA, 22 bp, Homo sapiens
cagcagccatgtaccacactca

SEQ ID NO: 8455148 - DNA, 22 bp, Homo sapiens
cagcagcccacgcgtgctgtcc

SEQ ID NO: 8455149 - DNA, 22 bp, Homo sapiens
cagcagcctacaatgcacagaa

SEQ ID NO: 8455150 - DNA, 22 bp, Homo sapiens
cagcagcctacaatgcacagaa

SEQ ID NO: 8455151 - DNA, 22 bp, Homo sapiens
cagcagcctacaatgcacagaa

SEQ ID NO: 8455152 - DNA, 22 bp, Homo sapiens
cagcagccactagagggctcac

SEQ ID NO: 8455153 - DNA, 22 bp, Homo sapiens
cagcagccactagagggctcac

SEQ ID NO: 8455154 - DNA, 22 bp, Homo sapiens
gtattttacttacgcatgactt

SEQ ID NO: 8455155 - DNA, 22 bp, Homo sapiens
gtagggactgttctcacctgag

SEQ ID NO: 8455156 - DNA, 22 bp, Homo sapiens
gtcacactcaaaagctaggatg

SEQ ID NO: 8455157 - DNA, 22 bp, Homo sapiens
gtcacagatctcttgagtcaag

SEQ ID NO: 8455158 - DNA, 22 bp, Homo sapiens
gtcacagatctcttgagtcaag

SEQ ID NO: 8455159 - DNA, 22 bp, Homo sapiens
gtcagatctttggggatgctgt

SEQ ID NO: 8455160 - DNA, 22 bp, Homo sapiens
gtcagatctttggggatgctgt

SEQ ID NO: 8455161 - DNA, 22 bp, Homo sapiens
cagcatctcattcattcatgtt

SEQ ID NO: 8455162 - DNA, 22 bp, Homo sapiens
cagcatctccatggctttggag

SEQ ID NO: 8455163 - DNA, 22 bp, Homo sapiens
cagcatctcctgtgcagaggga

SEQ ID NO: 8455164 - DNA, 22 bp, Homo sapiens
gtcagcagtgtcagctctgggg

SEQ ID NO: 8455165 - DNA, 22 bp, Homo sapiens
cagcatctaatcttcatgccgg

SEQ ID NO: 8455166 - DNA, 22 bp, Homo sapiens
gtcagcagggtccccttgagtg

SEQ ID NO: 8455167 - DNA, 22 bp, Homo sapiens
gtcagcagggtccccttgagtg

SEQ ID NO: 8455168 - DNA, 17 bp, Homo sapiens
gtcagcagcttgcttgt

SEQ ID NO: 8455169 - DNA, 22 bp, Homo sapiens
gtcagattaatagcaataataa

SEQ ID NO: 8455170 - DNA, 22 bp, Homo sapiens
gtccagagccggaagagtgaca

SEQ ID NO: 8455171 - DNA, 22 bp, Homo sapiens
gtccagagaggcaggaggctac

SEQ ID NO: 8455172 - DNA, 22 bp, Homo sapiens
gtccagagggctgcaggatgct

SEQ ID NO: 8455173 - DNA, 22 bp, Homo sapiens
gtccagagggctgcaggatgct

SEQ ID NO: 8455174 - DNA, 22 bp, Homo sapiens
gtccagaggtccaggatcaagg

SEQ ID NO: 8455175 - DNA, 20 bp, Homo sapiens
gtccagagtaatgtgctgac

SEQ ID NO: 8455176 - DNA, 20 bp, Homo sapiens
gtccagagtaatgtgctgac

SEQ ID NO: 8455177 - DNA, 22 bp, Homo sapiens
gtccagaggtccaggatcaagg

SEQ ID NO: 8455178 - DNA, 22 bp, Homo sapiens
cagcatctctttttgcattcct

SEQ ID NO: 8455179 - DNA, 22 bp, Homo sapiens
cagcatctctgggagaagcatc

SEQ ID NO: 8455180 - DNA, 22 bp, Homo sapiens
cagcatctctgcaccctccccc

SEQ ID NO: 8455181 - DNA, 22 bp, Homo sapiens
cagcatctggatttcctccact

SEQ ID NO: 8455182 - DNA, 22 bp, Homo sapiens
cagccagaaagtctgttaggga

SEQ ID NO: 8455183 - DNA, 22 bp, Homo sapiens
cagccagaaagtatgttaggga

SEQ ID NO: 8455184 - DNA, 22 bp, Homo sapiens
gtccagagtagtcgagtattct

SEQ ID NO: 8455185 - DNA, 22 bp, Homo sapiens
cagccaggcccagatcatgctg

SEQ ID NO: 8455186 - DNA, 22 bp, Homo sapiens
cagccaggagctccccctgctc

SEQ ID NO: 8455187 - DNA, 22 bp, Homo sapiens
gtgagagatcccccactcatct

SEQ ID NO: 8455188 - DNA, 22 bp, Homo sapiens
gtgagagggctgggctcatgat

SEQ ID NO: 8455189 - DNA, 22 bp, Homo sapiens
gtcctgtgccctgggtggcgct

SEQ ID NO: 8455190 - DNA, 22 bp, Homo sapiens
gtcctgtgccgaggtgggaagc

SEQ ID NO: 8455191 - DNA, 22 bp, Homo sapiens
gtcctgtgctcagacatggggg

SEQ ID NO: 8455192 - DNA, 22 bp, Homo sapiens
gtgaattacatgtatttttaag

SEQ ID NO: 8455193 - DNA, 22 bp, Homo sapiens
gtgaatttagtttgtaagaagg

SEQ ID NO: 8455194 - DNA, 22 bp, Homo sapiens
gtgaattaggacaaaagggctt

SEQ ID NO: 8455195 - DNA, 22 bp, Homo sapiens
gtgaattaggctatggcagagg

SEQ ID NO: 8455196 - DNA, 22 bp, Homo sapiens
cagccaggcccccgagtcgttg

SEQ ID NO: 8455197 - DNA, 22 bp, Homo sapiens
gtcctgtgagattcatgctcaa

SEQ ID NO: 8455198 - DNA, 22 bp, Homo sapiens
gtcctgtgatgagtaccaggtg

SEQ ID NO: 8455199 - DNA, 22 bp, Homo sapiens
gtcctgtgcaccgtgggatgtt

SEQ ID NO: 8455200 - DNA, 22 bp, Homo sapiens
gtcctgtgacctgcatcctgag

SEQ ID NO: 8455201 - DNA, 22 bp, Homo sapiens
gtcctgtgacctgcatcctgag

SEQ ID NO: 8455202 - DNA, 22 bp, Homo sapiens
cagccctctgaagaggcgcttg

SEQ ID NO: 8455203 - DNA, 22 bp, Homo sapiens
cagccctctctgggccccaagg

SEQ ID NO: 8455204 - DNA, 22 bp, Homo sapiens
cagccctcctttcactcccagg

SEQ ID NO: 8455205 - DNA, 22 bp, Homo sapiens
cagccctgaaacaacctcctct

SEQ ID NO: 8455206 - DNA, 19 bp, Homo sapiens
cagccctcttaccactgtg

SEQ ID NO: 8455207 - DNA, 19 bp, Homo sapiens
cagccctcttaccactgtg

SEQ ID NO: 8455208 - DNA, 22 bp, Homo sapiens
cagccctcctaccctgccaggc

SEQ ID NO: 8455209 - DNA, 22 bp, Homo sapiens
cagccctcctttcactcccagg

SEQ ID NO: 8455210 - DNA, 22 bp, Homo sapiens
cagccctcctaccctgccaggc

SEQ ID NO: 8455211 - DNA, 22 bp, Homo sapiens
cagccctcctaccctgccaggc

SEQ ID NO: 8455212 - DNA, 20 bp, Homo sapiens
cagccctccagtggaggcag

SEQ ID NO: 8455213 - DNA, 23 bp, Homo sapiens
gtgagcagcaccatgaggctaga

SEQ ID NO: 8455214 - DNA, 22 bp, Homo sapiens
cagccctcatcccgcctgcgtt

SEQ ID NO: 8455215 - DNA, 22 bp, Homo sapiens
cagccctcatctcagcttcttt

SEQ ID NO: 8455216 - DNA, 23 bp, Homo sapiens
gtgagcagcaccatgaggctaga

SEQ ID NO: 8455217 - DNA, 22 bp, Homo sapiens
gtgagcagagatcgcgtgattg

SEQ ID NO: 8455218 - DNA, 22 bp, Homo sapiens
gtgagcaaaggttaaacattta

SEQ ID NO: 8455219 - DNA, 22 bp, Homo sapiens
cagccctgtccagcagagggtg

SEQ ID NO: 8455220 - DNA, 22 bp, Homo sapiens
cagccctgtccaatgtctgctc

SEQ ID NO: 8455221 - DNA, 22 bp, Homo sapiens
cagccctgtccaatgtctgctc

SEQ ID NO: 8455222 - DNA, 22 bp, Homo sapiens
cagccctggtgccaaggttccc

SEQ ID NO: 8455223 - DNA, 22 bp, Homo sapiens
cagccctgaaacaacctcctct

SEQ ID NO: 8455224 - DNA, 22 bp, Homo sapiens
cagccctgtctatgactgatga

SEQ ID NO: 8455225 - DNA, 22 bp, Homo sapiens
ccaccagagggcagactgtgat

SEQ ID NO: 8455226 - DNA, 22 bp, Homo sapiens
ccaccagcagtgtgcaaggatt

SEQ ID NO: 8455227 - DNA, 22 bp, Homo sapiens
ccaccagcttcagcagccgcgg

SEQ ID NO: 8455228 - DNA, 22 bp, Homo sapiens
ccaccagcttcagcagccgcgg

SEQ ID NO: 8455229 - DNA, 22 bp, Homo sapiens
ccaccagctgcatatgcacgta

SEQ ID NO: 8455230 - DNA, 22 bp, Homo sapiens
ccacatttttgatactctcact

SEQ ID NO: 8455231 - DNA, 22 bp, Homo sapiens
ccaccaagtcccactataattt

SEQ ID NO: 8455232 - DNA, 22 bp, Homo sapiens
ccaccagctttgccaccctgct

SEQ ID NO: 8455233 - DNA, 22 bp, Homo sapiens
ccaccagctttggcggtgacag

SEQ ID NO: 8455234 - DNA, 22 bp, Homo sapiens
ccaccagctttggcggtgacag

SEQ ID NO: 8455235 - DNA, 22 bp, Homo sapiens
ccaccagctttgccaccctgct

SEQ ID NO: 8455236 - DNA, 22 bp, Homo sapiens
tcgcctcatcatcctaattaca

SEQ ID NO: 8455237 - DNA, 22 bp, Homo sapiens
tcgcttgaacccaggaagtgga

SEQ ID NO: 8455238 - DNA, 22 bp, Homo sapiens
tcgctgtgaaaaccttggacaa

SEQ ID NO: 8455239 - DNA, 22 bp, Homo sapiens
tcggagctgtagatgaaaccct

SEQ ID NO: 8455240 - DNA, 22 bp, Homo sapiens
tcgggctcgctctcctagcgga

SEQ ID NO: 8455241 - DNA, 22 bp, Homo sapiens
tcgggctcgctctcctagcgga

SEQ ID NO: 8455242 - DNA, 22 bp, Homo sapiens
ccaccctgtgcaggcgtgggta

SEQ ID NO: 8455243 - DNA, 22 bp, Homo sapiens
ccacatgctcttgttacagtgt

SEQ ID NO: 8455244 - DNA, 22 bp, Homo sapiens
ccacatggagcaggaggtgggg

SEQ ID NO: 8455245 - DNA, 22 bp, Homo sapiens
ccacatttcttcacttgtccca

SEQ ID NO: 8455246 - DNA, 22 bp, Homo sapiens
ccacattctcatgtaatccttt

SEQ ID NO: 8455247 - DNA, 22 bp, Homo sapiens
ccacatctcttgatgtacctac

SEQ ID NO: 8455248 - DNA, 22 bp, Homo sapiens
ccacatctgcagtcccttctgt

SEQ ID NO: 8455249 - DNA, 22 bp, Homo sapiens
ccacatcttttttcctgaacag

SEQ ID NO: 8455250 - DNA, 22 bp, Homo sapiens
ccacatcttttttcctgaacag

SEQ ID NO: 8455251 - DNA, 22 bp, Homo sapiens
ccacatctgttcttagttctga

SEQ ID NO: 8455252 - DNA, 22 bp, Homo sapiens
ccacatctgcatttaatgtata

SEQ ID NO: 8455253 - DNA, 22 bp, Homo sapiens
ccacatctggtggccagtgcta

SEQ ID NO: 8455254 - DNA, 22 bp, Homo sapiens
ccacatctggtggccagtgcta

SEQ ID NO: 8455255 - DNA, 22 bp, Homo sapiens
ccacatgatgaggaagctgaac

SEQ ID NO: 8455256 - DNA, 22 bp, Homo sapiens
tcctgacctcttgctctgacct

SEQ ID NO: 8455257 - DNA, 22 bp, Homo sapiens
tcctgacccaccaagtctgtaa

SEQ ID NO: 8455258 - DNA, 22 bp, Homo sapiens
tcctgaccacactgccttctgc

SEQ ID NO: 8455259 - DNA, 22 bp, Homo sapiens
tcctctccatgtctcacgccac

SEQ ID NO: 8455260 - DNA, 19 bp, Homo sapiens
tcctctgaaggttctttta

SEQ ID NO: 8455261 - DNA, 21 bp, Homo sapiens
tcctctgcagtgaggtggcct

SEQ ID NO: 8455262 - DNA, 22 bp, Homo sapiens
tcctctgagacatcaggttgag

SEQ ID NO: 8455263 - DNA, 22 bp, Homo sapiens
tcctgaagtcacaggctctgag

SEQ ID NO: 8455264 - DNA, 20 bp, Homo sapiens
tcctgaatttcctttctgct

SEQ ID NO: 8455265 - DNA, 22 bp, Homo sapiens
ccactttctgagggaacagcag

SEQ ID NO: 8455266 - DNA, 22 bp, Homo sapiens
tctccacactttctctcccagg

SEQ ID NO: 8455267 - DNA, 22 bp, Homo sapiens
tctccacaccagaaggagctga

SEQ ID NO: 8455268 - DNA, 22 bp, Homo sapiens
tctccacattctattggctata

SEQ ID NO: 8455269 - DNA, 22 bp, Homo sapiens
tctccacagaaggttccaggcc

SEQ ID NO: 8455270 - DNA, 22 bp, Homo sapiens
tctccacagtcccacctcgctt

SEQ ID NO: 8455271 - DNA, 22 bp, Homo sapiens
tctccacaagtgttgagagtac

SEQ ID NO: 8455272 - DNA, 22 bp, Homo sapiens
tctccacaccagaaggagctga

SEQ ID NO: 8455273 - DNA, 22 bp, Homo sapiens
ccagaaaactctacatgcttgt

SEQ ID NO: 8455274 - DNA, 22 bp, Homo sapiens
tctcaaatttatacagagttca

SEQ ID NO: 8455275 - DNA, 22 bp, Homo sapiens
tctcaaatttatacagagttca

SEQ ID NO: 8455276 - DNA, 22 bp, Homo sapiens
tctcaaatttgctggaccagta

SEQ ID NO: 8455277 - DNA, 22 bp, Homo sapiens
tctcaaatttgttagataaaat

SEQ ID NO: 8455278 - DNA, 22 bp, Homo sapiens
tctcaacaccacttgctgaaga

SEQ ID NO: 8455279 - DNA, 22 bp, Homo sapiens
tctcaactaatggtgcaagatg

SEQ ID NO: 8455280 - DNA, 22 bp, Homo sapiens
tctcaagcttgttggtatgttt

SEQ ID NO: 8455281 - DNA, 22 bp, Homo sapiens
tctcaagcttgttggtatgttt

SEQ ID NO: 8455282 - DNA, 22 bp, Homo sapiens
tctcaaatgtaaagcatgattt

SEQ ID NO: 8455283 - DNA, 22 bp, Homo sapiens
tctcaaattcccttttcctcct

SEQ ID NO: 8455284 - DNA, 22 bp, Homo sapiens
tctatattccagatacagatta

SEQ ID NO: 8455285 - DNA, 22 bp, Homo sapiens
tctatattccagatacagatta

SEQ ID NO: 8455286 - DNA, 22 bp, Homo sapiens
tctatattatacatccaggatt

SEQ ID NO: 8455287 - DNA, 22 bp, Homo sapiens
tctatataacctccacttctac

SEQ ID NO: 8455288 - DNA, 22 bp, Homo sapiens
ccacctcctcggccatgtgacg

SEQ ID NO: 8455289 - DNA, 22 bp, Homo sapiens
ccacctcctcggccatgtgacg

SEQ ID NO: 8455290 - DNA, 22 bp, Homo sapiens
ccacctctcagggtttcctaat

SEQ ID NO: 8455291 - DNA, 22 bp, Homo sapiens
tctccctggagccctgaagcat

SEQ ID NO: 8455292 - DNA, 23 bp, Homo sapiens
tctccctgaggttgttagcatta

SEQ ID NO: 8455293 - DNA, 20 bp, Homo sapiens
tctccctgcccatctcagat

SEQ ID NO: 8455294 - DNA, 22 bp, Homo sapiens
tctcccacagtctcccatggct

SEQ ID NO: 8455295 - DNA, 22 bp, Homo sapiens
tctccctcattcctgcttccat

SEQ ID NO: 8455296 - DNA, 22 bp, Homo sapiens
ccagagagctacaaggcataaa

SEQ ID NO: 8455297 - DNA, 22 bp, Homo sapiens
ccagagagctacaaggcataaa

SEQ ID NO: 8455298 - DNA, 22 bp, Homo sapiens
ccagagagagtactgggctctg

SEQ ID NO: 8455299 - DNA, 22 bp, Homo sapiens
tctccaggaaagacactggact

SEQ ID NO: 8455300 - DNA, 19 bp, Homo sapiens
tctccagctttgggctttt

SEQ ID NO: 8455301 - DNA, 22 bp, Homo sapiens
tctccaggaaagacactggact

SEQ ID NO: 8455302 - DNA, 22 bp, Homo sapiens
tctccaggaagccctccctgac

SEQ ID NO: 8455303 - DNA, 22 bp, Homo sapiens
tctccaggaaccatcatggtaa

SEQ ID NO: 8455304 - DNA, 22 bp, Homo sapiens
tctccagaaatggggctgggga

SEQ ID NO: 8455305 - DNA, 22 bp, Homo sapiens
tctccagagtaaccttggagca

SEQ ID NO: 8455306 - DNA, 21 bp, Homo sapiens
tctccagagtgggaggaaatc

SEQ ID NO: 8455307 - DNA, 22 bp, Homo sapiens
tctgagagcaaggcattagcag

SEQ ID NO: 8455308 - DNA, 22 bp, Homo sapiens
ccagcccttcccaactggccag

SEQ ID NO: 8455309 - DNA, 22 bp, Homo sapiens
ccagcccttcccaactggccag

SEQ ID NO: 8455310 - DNA, 22 bp, Homo sapiens
tctgagagcaggaggagctgct

SEQ ID NO: 8455311 - DNA, 22 bp, Homo sapiens
tctgagagccactgaacagcaa

SEQ ID NO: 8455312 - DNA, 22 bp, Homo sapiens
tctgagagccactgaacagcaa

SEQ ID NO: 8455313 - DNA, 22 bp, Homo sapiens
tctgagagcatcactggggtac

SEQ ID NO: 8455314 - DNA, 22 bp, Homo sapiens
tctgagaggtgaattcagcaaa

SEQ ID NO: 8455315 - DNA, 22 bp, Homo sapiens
tctgagagctgtagaagcctat

SEQ ID NO: 8455316 - DNA, 22 bp, Homo sapiens
tctgagagctctggggcccctt

SEQ ID NO: 8455317 - DNA, 22 bp, Homo sapiens
tctgatataaaagtgacattca

SEQ ID NO: 8455318 - DNA, 22 bp, Homo sapiens
tctgatatcgcactaaactctg

SEQ ID NO: 8455319 - DNA, 22 bp, Homo sapiens
tctgagagtctctgaggcagat

SEQ ID NO: 8455320 - DNA, 22 bp, Homo sapiens
tctgcagaagctcactaaatcc

SEQ ID NO: 8455321 - DNA, 22 bp, Homo sapiens
tctgcagaaggaatcagctgag

SEQ ID NO: 8455322 - DNA, 19 bp, Homo sapiens
tctgcagaaggcatacatg

SEQ ID NO: 8455323 - DNA, 22 bp, Homo sapiens
tctgcagaattcgaggaagaaa

SEQ ID NO: 8455324 - DNA, 20 bp, Homo sapiens
ccagcatgtacacatgtgga

SEQ ID NO: 8455325 - DNA, 20 bp, Homo sapiens
ccagcatgtacacatgtgga

SEQ ID NO: 8455326 - DNA, 22 bp, Homo sapiens
ccagccctcactgaggcctctc

SEQ ID NO: 8455327 - DNA, 22 bp, Homo sapiens
ccagccctcactgaggcctctc

SEQ ID NO: 8455328 - DNA, 22 bp, Homo sapiens
ccagccacagcttccagctcct

SEQ ID NO: 8455329 - DNA, 22 bp, Homo sapiens
ccagccctgcctctcagggccc

SEQ ID NO: 8455330 - DNA, 22 bp, Homo sapiens
ccagccctgtaaggatgaggca

SEQ ID NO: 8455331 - DNA, 22 bp, Homo sapiens
ccagccctgcctctcagggccc

SEQ ID NO: 8455332 - DNA, 22 bp, Homo sapiens
ccagccctgtcaccaactggag

SEQ ID NO: 8455333 - DNA, 22 bp, Homo sapiens
ccagccctgtcaccaactggag

SEQ ID NO: 8455334 - DNA, 19 bp, Homo sapiens
ccagccctgtcacttcttg

SEQ ID NO: 8455335 - DNA, 22 bp, Homo sapiens
ccagccctgtttatgtgtcact

SEQ ID NO: 8455336 - DNA, 22 bp, Homo sapiens
ccagcccttcccaactggccag

SEQ ID NO: 8455337 - DNA, 19 bp, Homo sapiens
ccagcaggttcatttcagg

SEQ ID NO: 8455338 - DNA, 22 bp, Homo sapiens
ccagcatcagcacccaaggagc

SEQ ID NO: 8455339 - DNA, 22 bp, Homo sapiens
ccagcagggttggtttcttctg

SEQ ID NO: 8455340 - DNA, 22 bp, Homo sapiens
ccagcaggtgtagggctcatgg

SEQ ID NO: 8455341 - DNA, 22 bp, Homo sapiens
tctctgtgtgtgtgacagcatt

SEQ ID NO: 8455342 - DNA, 22 bp, Homo sapiens
tctctgttcatggcactatgtc

SEQ ID NO: 8455343 - DNA, 22 bp, Homo sapiens
tctcttaactggttcagcaatt

SEQ ID NO: 8455344 - DNA, 22 bp, Homo sapiens
ccagcatgagacgatgatgaag

SEQ ID NO: 8455345 - DNA, 22 bp, Homo sapiens
ccagcatctatgtgctgttgat

SEQ ID NO: 8455346 - DNA, 22 bp, Homo sapiens
ccagcatcctcagctcacttct

SEQ ID NO: 8455347 - DNA, 22 bp, Homo sapiens
ccagcatctaacgctcctggga

SEQ ID NO: 8455348 - DNA, 22 bp, Homo sapiens
ccagcatcgacttcctgcctga

SEQ ID NO: 8455349 - DNA, 22 bp, Homo sapiens
ccagcatccatgctccctcggg

SEQ ID NO: 8455350 - DNA, 22 bp, Homo sapiens
ccagcatccatgctccctcggg

SEQ ID NO: 8455351 - DNA, 22 bp, Homo sapiens
tctgaattcttagaattaaagg

SEQ ID NO: 8455352 - DNA, 20 bp, Homo sapiens
tctgaattgagtgaatgtct

SEQ ID NO: 8455353 - DNA, 22 bp, Homo sapiens
tctgaatcacagtcattcagct

SEQ ID NO: 8455354 - DNA, 22 bp, Homo sapiens
tctgaattaatcatgcctcttt

SEQ ID NO: 8455355 - DNA, 22 bp, Homo sapiens
tctgaattcagtatggtctttc

SEQ ID NO: 8455356 - DNA, 22 bp, Homo sapiens
tctgaattctgacaatttgaat

SEQ ID NO: 8455357 - DNA, 22 bp, Homo sapiens
ccagcagccagagaaggacctc

SEQ ID NO: 8455358 - DNA, 22 bp, Homo sapiens
ccagcagccagagaaggacctc

SEQ ID NO: 8455359 - DNA, 22 bp, Homo sapiens
ccagcagagggtcttggccatt

SEQ ID NO: 8455360 - DNA, 22 bp, Homo sapiens
ccagcagagtctaggaaggagg

SEQ ID NO: 8455361 - DNA, 22 bp, Homo sapiens
ccagcactgctctcagactgag

SEQ ID NO: 8455362 - DNA, 22 bp, Homo sapiens
ccagcagggcagtgccctggac

SEQ ID NO: 8455363 - DNA, 22 bp, Homo sapiens
ccagcagggcagtgccctggac

SEQ ID NO: 8455364 - DNA, 22 bp, Homo sapiens
ccagcaggggaatatttttagg

SEQ ID NO: 8455365 - DNA, 21 bp, Homo sapiens
ccagcagctcaaggatctctt

SEQ ID NO: 8455366 - DNA, 22 bp, Homo sapiens
ccagcagctccctcagggtccg

SEQ ID NO: 8455367 - DNA, 22 bp, Homo sapiens
ccagcagctgcaaagcctgggt

SEQ ID NO: 8455368 - DNA, 22 bp, Homo sapiens
ccagcagctgcaaagcctgggt

SEQ ID NO: 8455369 - DNA, 23 bp, Homo sapiens
tctcctggctgcactgtggccac

SEQ ID NO: 8455370 - DNA, 23 bp, Homo sapiens
tctcctggctgcactgtggccac

SEQ ID NO: 8455371 - DNA, 23 bp, Homo sapiens
tctcctggctgcactgtggccac

SEQ ID NO: 8455372 - DNA, 17 bp, Homo sapiens
tctcctggctctatcag

SEQ ID NO: 8455373 - DNA, 17 bp, Homo sapiens
tctcctggctctatcag

SEQ ID NO: 8455374 - DNA, 17 bp, Homo sapiens
tctcctggctctatcag

SEQ ID NO: 8455375 - DNA, 22 bp, Homo sapiens
tctcctggctctaaaaggctgt

SEQ ID NO: 8455376 - DNA, 22 bp, Homo sapiens
tctcctggctctaaaaggctgt

SEQ ID NO: 8455377 - DNA, 22 bp, Homo sapiens
tctcctggcctttaggttaagg

SEQ ID NO: 8455378 - DNA, 22 bp, Homo sapiens
tctcctggcctttaggttaagg

SEQ ID NO: 8455379 - DNA, 22 bp, Homo sapiens
tctcctggccgggctgtcccct

SEQ ID NO: 8455380 - DNA, 22 bp, Homo sapiens
tctcctggccgggctgtcccct

SEQ ID NO: 8455381 - DNA, 22 bp, Homo sapiens
tctcctggctcaccaggctgga

SEQ ID NO: 8455382 - DNA, 22 bp, Homo sapiens
tctcctggctcaccaggctgga

SEQ ID NO: 8455383 - DNA, 23 bp, Homo sapiens
tctctgagttgtactttcccttg

SEQ ID NO: 8455384 - DNA, 22 bp, Homo sapiens
tctctgagttttaaggatgatg

SEQ ID NO: 8455385 - DNA, 20 bp, Homo sapiens
tctctgagtttcctaatttg

SEQ ID NO: 8455386 - DNA, 20 bp, Homo sapiens
tctctgcagcagaggctggg

SEQ ID NO: 8455387 - DNA, 20 bp, Homo sapiens
tctctgcagcagaggctggg

SEQ ID NO: 8455388 - DNA, 22 bp, Homo sapiens
tctctgcagtcttgggcaggca

SEQ ID NO: 8455389 - DNA, 22 bp, Homo sapiens
tctctgcagctaagaaattaat

SEQ ID NO: 8455390 - DNA, 22 bp, Homo sapiens
tctctgcacttgcacataagct

SEQ ID NO: 8455391 - DNA, 19 bp, Homo sapiens
tctctgcagcgcgcccggc

SEQ ID NO: 8455392 - DNA, 22 bp, Homo sapiens
tctctgcatccccagggctctc

SEQ ID NO: 8455393 - DNA, 22 bp, Homo sapiens
tctctgcatcccagggctcagc

SEQ ID NO: 8455394 - DNA, 22 bp, Homo sapiens
tctctgcatgacccaaggctga

SEQ ID NO: 8455395 - DNA, 22 bp, Homo sapiens
tctctgcatgacccaaggctga

SEQ ID NO: 8455396 - DNA, 23 bp, Homo sapiens
tctctgcatgtcctgagcacatc

SEQ ID NO: 8455397 - DNA, 22 bp, Homo sapiens
tctctgatgctgccagggaaaa

SEQ ID NO: 8455398 - DNA, 22 bp, Homo sapiens
tctctgcaactacatcttaggg

SEQ ID NO: 8455399 - DNA, 22 bp, Homo sapiens
tctctgggaaatggagaatttt

SEQ ID NO: 8455400 - DNA, 22 bp, Homo sapiens
tctctgggaatgggcctgggta

SEQ ID NO: 8455401 - DNA, 22 bp, Homo sapiens
tctctgggaattcacaagccct

SEQ ID NO: 8455402 - DNA, 22 bp, Homo sapiens
tctctgggaattcacaagccct

SEQ ID NO: 8455403 - DNA, 22 bp, Homo sapiens
tctctgggacactgggtcagtt

SEQ ID NO: 8455404 - DNA, 22 bp, Homo sapiens
tctctgggacactgggtcagtt

SEQ ID NO: 8455405 - DNA, 22 bp, Homo sapiens
tctctgggaattttttggacat

SEQ ID NO: 8455406 - DNA, 22 bp, Homo sapiens
tctctgggagccaggatgacac

SEQ ID NO: 8455407 - DNA, 22 bp, Homo sapiens
tctctgggagcaattgtttgct

SEQ ID NO: 8455408 - DNA, 22 bp, Homo sapiens
tctctgggagcaattgtttgct

SEQ ID NO: 8455409 - DNA, 22 bp, Homo sapiens
tctctgggagttgagcagcagc

SEQ ID NO: 8455410 - DNA, 22 bp, Homo sapiens
tctctgggagttgagcagcagc

SEQ ID NO: 8455411 - DNA, 21 bp, Homo sapiens
tctctgggaggacttgtgaga

SEQ ID NO: 8455412 - DNA, 21 bp, Homo sapiens
tctctgggaggacttgtgaga

SEQ ID NO: 8455413 - DNA, 22 bp, Homo sapiens
tccccagaggtgaggcagcttt

SEQ ID NO: 8455414 - DNA, 22 bp, Homo sapiens
tccccagacagcgggaggcctg

SEQ ID NO: 8455415 - DNA, 22 bp, Homo sapiens
tccccagattcatgtctgctgt

SEQ ID NO: 8455416 - DNA, 22 bp, Homo sapiens
tccccagcttgctacttctgct

SEQ ID NO: 8455417 - DNA, 22 bp, Homo sapiens
tccccagcttgctacttctgct

SEQ ID NO: 8455418 - DNA, 22 bp, Homo sapiens
tccccagcattgagggtctctc

SEQ ID NO: 8455419 - DNA, 22 bp, Homo sapiens
tcccgttgatgacggtgcatcc

SEQ ID NO: 8455420 - DNA, 22 bp, Homo sapiens
tccctaggaccccaccttccgc

SEQ ID NO: 8455421 - DNA, 22 bp, Homo sapiens
cattgattatggaaagcagtgg

SEQ ID NO: 8455422 - DNA, 20 bp, Homo sapiens
cattgcaaagtagcagactg

SEQ ID NO: 8455423 - DNA, 22 bp, Homo sapiens
cattgattattgaagggtcttt

SEQ ID NO: 8455424 - DNA, 22 bp, Homo sapiens
cattgcaacttcaaactcctgg

SEQ ID NO: 8455425 - DNA, 22 bp, Homo sapiens
tcccagggtcctcttctggaat

SEQ ID NO: 8455426 - DNA, 22 bp, Homo sapiens
tcccagggtcctcttctggaat

SEQ ID NO: 8455427 - DNA, 22 bp, Homo sapiens
cattgaaagagataaagccttt

SEQ ID NO: 8455428 - DNA, 22 bp, Homo sapiens
cattgaaacctaacataggctg

SEQ ID NO: 8455429 - DNA, 22 bp, Homo sapiens
cattgaaatatggaaactgatg

SEQ ID NO: 8455430 - DNA, 22 bp, Homo sapiens
tcccaggatctgagggcagaga

SEQ ID NO: 8455431 - DNA, 22 bp, Homo sapiens
catttggaccaaaatagccaac

SEQ ID NO: 8455432 - DNA, 22 bp, Homo sapiens
catttggattttgaagagagta

SEQ ID NO: 8455433 - DNA, 22 bp, Homo sapiens
catttggattttgaagagagta

SEQ ID NO: 8455434 - DNA, 20 bp, Homo sapiens
catttgggatcatgaggttt

SEQ ID NO: 8455435 - DNA, 22 bp, Homo sapiens
catttggaaagagactagagaa

SEQ ID NO: 8455436 - DNA, 22 bp, Homo sapiens
catttgtagtatctgtttatat

SEQ ID NO: 8455437 - DNA, 22 bp, Homo sapiens
catttgtagttaaaaatgtctc

SEQ ID NO: 8455438 - DNA, 17 bp, Homo sapiens
tcctccccgcagttgca

SEQ ID NO: 8455439 - DNA, 17 bp, Homo sapiens
tcctccccgcagttgca

SEQ ID NO: 8455440 - DNA, 22 bp, Homo sapiens
tcctcccctcagggcaacggat

SEQ ID NO: 8455441 - DNA, 22 bp, Homo sapiens
tccctagtcgcatctgtggaga

SEQ ID NO: 8455442 - DNA, 22 bp, Homo sapiens
tccctagtagacccagatcatt

SEQ ID NO: 8455443 - DNA, 22 bp, Homo sapiens
tccctagtcgcatctgtggaga

SEQ ID NO: 8455444 - DNA, 22 bp, Homo sapiens
tcctcagcattagcacagacat

SEQ ID NO: 8455445 - DNA, 22 bp, Homo sapiens
tcctagaagatggatcagagaa

SEQ ID NO: 8455446 - DNA, 22 bp, Homo sapiens
tccctcagaaattctctctgaa

SEQ ID NO: 8455447 - DNA, 22 bp, Homo sapiens
tccctcagaaattctctctgaa

SEQ ID NO: 8455448 - DNA, 22 bp, Homo sapiens
tcctagaaggatcattctagtg

SEQ ID NO: 8455449 - DNA, 22 bp, Homo sapiens
tccctcactggttctgcatccc

SEQ ID NO: 8455450 - DNA, 22 bp, Homo sapiens
tcctcaggatctaggagtgctt

SEQ ID NO: 8455451 - DNA, 22 bp, Homo sapiens
tcctcagcttttatttcacttg

SEQ ID NO: 8455452 - DNA, 22 bp, Homo sapiens
tcccagagcccaagttggagag

SEQ ID NO: 8455453 - DNA, 22 bp, Homo sapiens
cattcattctgtaagtaactat

SEQ ID NO: 8455454 - DNA, 22 bp, Homo sapiens
cattcatttactttcaacagct

SEQ ID NO: 8455455 - DNA, 22 bp, Homo sapiens
cattcattcacattttgtctat

SEQ ID NO: 8455456 - DNA, 22 bp, Homo sapiens
cattcattcagcaactgttatt

SEQ ID NO: 8455457 - DNA, 22 bp, Homo sapiens
tcccagaggactgttggtgcta

SEQ ID NO: 8455458 - DNA, 22 bp, Homo sapiens
tcccagccacaggtgtagccct

SEQ ID NO: 8455459 - DNA, 22 bp, Homo sapiens
tcccagccacaggtgtagccct

SEQ ID NO: 8455460 - DNA, 22 bp, Homo sapiens
tcccagaggaaatggcagctga

SEQ ID NO: 8455461 - DNA, 22 bp, Homo sapiens
tcccagaggaaatggcagctga

SEQ ID NO: 8455462 - DNA, 22 bp, Homo sapiens
tcccagagcctctgccactctg

SEQ ID NO: 8455463 - DNA, 22 bp, Homo sapiens
tcccagccaggctctaccactt

SEQ ID NO: 8455464 - DNA, 22 bp, Homo sapiens
tcccagccaggctctaccactt

SEQ ID NO: 8455465 - DNA, 22 bp, Homo sapiens
tcccagccacagtttccacctg

SEQ ID NO: 8455466 - DNA, 22 bp, Homo sapiens
tcccagccacagtttccacctg

SEQ ID NO: 8455467 - DNA, 22 bp, Homo sapiens
tcccagccattcctttaggtgt

SEQ ID NO: 8455468 - DNA, 22 bp, Homo sapiens
tcccagcccagacttctccagt

SEQ ID NO: 8455469 - DNA, 22 bp, Homo sapiens
tcccagcccagatttgtgtgac

SEQ ID NO: 8455470 - DNA, 22 bp, Homo sapiens
tcccaggacaggccacatggaa

SEQ ID NO: 8455471 - DNA, 22 bp, Homo sapiens
tcccaggaattgaagccagtgt

SEQ ID NO: 8455472 - DNA, 22 bp, Homo sapiens
tcccaggacatgggctctgctc

SEQ ID NO: 8455473 - DNA, 22 bp, Homo sapiens
tcccaggacaggccacatggaa

SEQ ID NO: 8455474 - DNA, 22 bp, Homo sapiens
tcccaggacttccagttggagg

SEQ ID NO: 8455475 - DNA, 22 bp, Homo sapiens
catgttaatatgcattgagtac

SEQ ID NO: 8455476 - DNA, 22 bp, Homo sapiens
catgttaatgaatttttgcagt

SEQ ID NO: 8455477 - DNA, 22 bp, Homo sapiens
catgttaatatgcattgagtac

SEQ ID NO: 8455478 - DNA, 22 bp, Homo sapiens
catgttaactaagattaactat

SEQ ID NO: 8455479 - DNA, 22 bp, Homo sapiens
catgttaaattgagtttgcaat

SEQ ID NO: 8455480 - DNA, 22 bp, Homo sapiens
catgttctaatattgtgacata

SEQ ID NO: 8455481 - DNA, 22 bp, Homo sapiens
cattcaaaggcatgtcctattt

SEQ ID NO: 8455482 - DNA, 22 bp, Homo sapiens
cattatattacagcactgttaa

SEQ ID NO: 8455483 - DNA, 22 bp, Homo sapiens
catgtttaattgcgatgtttga

SEQ ID NO: 8455484 - DNA, 22 bp, Homo sapiens
catgttgtatcattctgttcct

SEQ ID NO: 8455485 - DNA, 22 bp, Homo sapiens
cattcacaaaaccacatgccat

SEQ ID NO: 8455486 - DNA, 22 bp, Homo sapiens
cattcacaaaaccacatgccat

SEQ ID NO: 8455487 - DNA, 22 bp, Homo sapiens
cattcacaatggattgcttcaa

SEQ ID NO: 8455488 - DNA, 22 bp, Homo sapiens
cattcatccactgttggaaatt

SEQ ID NO: 8455489 - DNA, 22 bp, Homo sapiens
cattcattagaatagatatgta

SEQ ID NO: 8455490 - DNA, 19 bp, Homo sapiens
tccagactgtccaggctat

SEQ ID NO: 8455491 - DNA, 19 bp, Homo sapiens
tccagccctgttccctttt

SEQ ID NO: 8455492 - DNA, 19 bp, Homo sapiens
tccagccctgttccctttt

SEQ ID NO: 8455493 - DNA, 22 bp, Homo sapiens
tccagccctgtgtctgggagag

SEQ ID NO: 8455494 - DNA, 22 bp, Homo sapiens
tccagccctgtggcttccaccc

SEQ ID NO: 8455495 - DNA, 22 bp, Homo sapiens
tccagccctgtggcttccaccc

SEQ ID NO: 8455496 - DNA, 22 bp, Homo sapiens
tccagcccagctgtccccttca

SEQ ID NO: 8455497 - DNA, 22 bp, Homo sapiens
tccagcccagctcctctcagaa

SEQ ID NO: 8455498 - DNA, 22 bp, Homo sapiens
tccagcccagctgtccccttca

SEQ ID NO: 8455499 - DNA, 22 bp, Homo sapiens
tccagagagccacggacagggg

SEQ ID NO: 8455500 - DNA, 22 bp, Homo sapiens
tccagctgcaaggggcacagct

SEQ ID NO: 8455501 - DNA, 17 bp, Homo sapiens
tccagcctcctctgctg

SEQ ID NO: 8455502 - DNA, 17 bp, Homo sapiens
tccagcctcctctgctg

SEQ ID NO: 8455503 - DNA, 22 bp, Homo sapiens
tccagcctcctatttaccctaa

SEQ ID NO: 8455504 - DNA, 22 bp, Homo sapiens
tccagcctaggggaacagctgc

SEQ ID NO: 8455505 - DNA, 22 bp, Homo sapiens
tccagcctaatgttcttcccac

SEQ ID NO: 8455506 - DNA, 22 bp, Homo sapiens
tccagcctcatttctcctgctt

SEQ ID NO: 8455507 - DNA, 22 bp, Homo sapiens
catgttaaaatatacattctga

SEQ ID NO: 8455508 - DNA, 22 bp, Homo sapiens
catgttaaaatatacattctga

SEQ ID NO: 8455509 - DNA, 22 bp, Homo sapiens
catgtgtgtggctgacaatttt

SEQ ID NO: 8455510 - DNA, 22 bp, Homo sapiens
catgtgtgtccatgtgactaag

SEQ ID NO: 8455511 - DNA, 22 bp, Homo sapiens
catgtgtgtgagggaaacatgt

SEQ ID NO: 8455512 - DNA, 22 bp, Homo sapiens
catgtgtgtctccaccagctgc

SEQ ID NO: 8455513 - DNA, 22 bp, Homo sapiens
catgtgtgtctccaccagctgc

SEQ ID NO: 8455514 - DNA, 22 bp, Homo sapiens
tccaggctccctcaggatgcac

SEQ ID NO: 8455515 - DNA, 22 bp, Homo sapiens
tccaggctccctcaggatgcac

SEQ ID NO: 8455516 - DNA, 20 bp, Homo sapiens
tccaggctcctccacttagt

SEQ ID NO: 8455517 - DNA, 22 bp, Homo sapiens
tccaggctcccctgcgtgctcc

SEQ ID NO: 8455518 - DNA, 22 bp, Homo sapiens
tccaggctcccctgcgtgctcc

SEQ ID NO: 8455519 - DNA, 18 bp, Homo sapiens
tccaggctccaggctaac

SEQ ID NO: 8455520 - DNA, 18 bp, Homo sapiens
tccaggctccaggctaac

SEQ ID NO: 8455521 - DNA, 22 bp, Homo sapiens
tccaggctcccctgcgtgctcc

SEQ ID NO: 8455522 - DNA, 19 bp, Homo sapiens
tccaggctccattggcaga

SEQ ID NO: 8455523 - DNA, 22 bp, Homo sapiens
tccaggcagcccttcctgactc

SEQ ID NO: 8455524 - DNA, 22 bp, Homo sapiens
tccagctggcctaacttcaggg

SEQ ID NO: 8455525 - DNA, 22 bp, Homo sapiens
tccagctggcccggccatgaat

SEQ ID NO: 8455526 - DNA, 22 bp, Homo sapiens
tccaggcccatggagcagagct

SEQ ID NO: 8455527 - DNA, 22 bp, Homo sapiens
tccaggcccatggagcagagct

SEQ ID NO: 8455528 - DNA, 22 bp, Homo sapiens
tccaggccccactgaagcccct

SEQ ID NO: 8455529 - DNA, 22 bp, Homo sapiens
tccaggccccactgaagcccct

SEQ ID NO: 8455530 - DNA, 22 bp, Homo sapiens
tccaggcccatggagcagagct

SEQ ID NO: 8455531 - DNA, 22 bp, Homo sapiens
tccaggcccatggagcagagct

SEQ ID NO: 8455532 - DNA, 22 bp, Homo sapiens
tccaggccccagcaccttggga

SEQ ID NO: 8455533 - DNA, 22 bp, Homo sapiens
tccaggccccagaccgtactgc

SEQ ID NO: 8455534 - DNA, 22 bp, Homo sapiens
tccaggccccagcaccttggga

SEQ ID NO: 8455535 - DNA, 22 bp, Homo sapiens
tccaggccccccacgctaatgg

SEQ ID NO: 8455536 - DNA, 22 bp, Homo sapiens
tccaggccccagaccgtactgc

SEQ ID NO: 8455537 - DNA, 22 bp, Homo sapiens
tccaggccccagaccgtactgc

SEQ ID NO: 8455538 - DNA, 22 bp, Homo sapiens
tccaggccccactgaagcccct

SEQ ID NO: 8455539 - DNA, 22 bp, Homo sapiens
tccaggcccctgcctgggcctg

SEQ ID NO: 8455540 - DNA, 22 bp, Homo sapiens
tccaggcccctgcctgggcctg

SEQ ID NO: 8455541 - DNA, 22 bp, Homo sapiens
tccaggctcagtcaagcacttc

SEQ ID NO: 8455542 - DNA, 22 bp, Homo sapiens
tccaggcccgagatgggctgga

SEQ ID NO: 8455543 - DNA, 22 bp, Homo sapiens
tccaggcccgagatgggctgga

SEQ ID NO: 8455544 - DNA, 22 bp, Homo sapiens
tcattcccccataatggtattt

SEQ ID NO: 8455545 - DNA, 22 bp, Homo sapiens
tcattccatttccagctctgaa

SEQ ID NO: 8455546 - DNA, 22 bp, Homo sapiens
tcattcggcaatagtgtgttag

SEQ ID NO: 8455547 - DNA, 22 bp, Homo sapiens
tcatttatcgctgccttttaaa

SEQ ID NO: 8455548 - DNA, 19 bp, Homo sapiens
tcattgaacataattactt

SEQ ID NO: 8455549 - DNA, 22 bp, Homo sapiens
tcatttatgcaggaatggcata

SEQ ID NO: 8455550 - DNA, 22 bp, Homo sapiens
tcatttatcgctgccttttaaa

SEQ ID NO: 8455551 - DNA, 21 bp, Homo sapiens
tcatttattgagaaatgactg

SEQ ID NO: 8455552 - DNA, 22 bp, Homo sapiens
tccagaccatggatggctgcaa

SEQ ID NO: 8455553 - DNA, 20 bp, Homo sapiens
tccacatcttttgagatgtg

SEQ ID NO: 8455554 - DNA, 14 bp, Homo sapiens
tccacatcagcagt

SEQ ID NO: 8455555 - DNA, 22 bp, Homo sapiens
tccacattatgtttctcctttc

SEQ ID NO: 8455556 - DNA, 22 bp, Homo sapiens
tccacatctctcgccaaccaat

SEQ ID NO: 8455557 - DNA, 22 bp, Homo sapiens
tccacatctaggtttgtcaaca

SEQ ID NO: 8455558 - DNA, 22 bp, Homo sapiens
tccacatccattgcttgacttt

SEQ ID NO: 8455559 - DNA, 22 bp, Homo sapiens
tccacatcaagggcagagaggt

SEQ ID NO: 8455560 - DNA, 22 bp, Homo sapiens
tccacagttttgccactagctg

SEQ ID NO: 8455561 - DNA, 22 bp, Homo sapiens
tccacagtggttgaactagttt

SEQ ID NO: 8455562 - DNA, 22 bp, Homo sapiens
tccacagtggttgaactagtaa

SEQ ID NO: 8455563 - DNA, 21 bp, Homo sapiens
tccaagccttcaacacattca

SEQ ID NO: 8455564 - DNA, 22 bp, Homo sapiens
tccacagggcctttctggtgtg

SEQ ID NO: 8455565 - DNA, 22 bp, Homo sapiens
tccacagggcctttctggtgtg

SEQ ID NO: 8455566 - DNA, 22 bp, Homo sapiens
tccacagtctatttttagtcta

SEQ ID NO: 8455567 - DNA, 22 bp, Homo sapiens
tccacaggtatgaggccccacc

SEQ ID NO: 8455568 - DNA, 22 bp, Homo sapiens
tccacaggtatgaggccccacc

SEQ ID NO: 8455569 - DNA, 22 bp, Homo sapiens
tccacaggtatttctccttgct

SEQ ID NO: 8455570 - DNA, 22 bp, Homo sapiens
tccacaggtatttctccttgct

SEQ ID NO: 8455571 - DNA, 22 bp, Homo sapiens
tcatgacaggtgagtttttagg

SEQ ID NO: 8455572 - DNA, 22 bp, Homo sapiens
tcatcataatatggaatcttgt

SEQ ID NO: 8455573 - DNA, 22 bp, Homo sapiens
tcatcagtttagaaaaaatatg

SEQ ID NO: 8455574 - DNA, 22 bp, Homo sapiens
tcatcatccttttttgaagagt

SEQ ID NO: 8455575 - DNA, 18 bp, Homo sapiens
tcatgaggtagaggctgg

SEQ ID NO: 8455576 - DNA, 22 bp, Homo sapiens
tcatgaggatttactagactag

SEQ ID NO: 8455577 - DNA, 18 bp, Homo sapiens
tcatgaggaaggagaaga

SEQ ID NO: 8455578 - DNA, 22 bp, Homo sapiens
tcatgatttttctttacagttg

SEQ ID NO: 8455579 - DNA, 22 bp, Homo sapiens
tcatgatttcctggttaaggac

SEQ ID NO: 8455580 - DNA, 22 bp, Homo sapiens
tcatgcaaggctgaaacatggt

SEQ ID NO: 8455581 - DNA, 22 bp, Homo sapiens
catcttttcagaagccattctg

SEQ ID NO: 8455582 - DNA, 22 bp, Homo sapiens
catcttttggcctattctgagg

SEQ ID NO: 8455583 - DNA, 22 bp, Homo sapiens
catcttttggcctattctgagg

SEQ ID NO: 8455584 - DNA, 22 bp, Homo sapiens
catcttttggtaggagccgggc

SEQ ID NO: 8455585 - DNA, 22 bp, Homo sapiens
catgaaaaatttactgttaaca

SEQ ID NO: 8455586 - DNA, 22 bp, Homo sapiens
catgaaaaatttactgttaaca

SEQ ID NO: 8455587 - DNA, 19 bp, Homo sapiens
tcatgtctctcatctgtga

SEQ ID NO: 8455588 - DNA, 22 bp, Homo sapiens
tcattcatcagttggtagagat

SEQ ID NO: 8455589 - DNA, 20 bp, Homo sapiens
tcattccaaatagttcagca

SEQ ID NO: 8455590 - DNA, 22 bp, Homo sapiens
tcattcattgcttaccctgtgt

SEQ ID NO: 8455591 - DNA, 22 bp, Homo sapiens
catctttgttttggatataatc

SEQ ID NO: 8455592 - DNA, 22 bp, Homo sapiens
catctttgtttcatctgtccag

SEQ ID NO: 8455593 - DNA, 22 bp, Homo sapiens
catctttgttctgtaaactttt

SEQ ID NO: 8455594 - DNA, 22 bp, Homo sapiens
catctttgttctgtaaactttt

SEQ ID NO: 8455595 - DNA, 22 bp, Homo sapiens
catctttgtaacttccacataa

SEQ ID NO: 8455596 - DNA, 22 bp, Homo sapiens
catctttgtaacttccacataa

SEQ ID NO: 8455597 - DNA, 22 bp, Homo sapiens
catctttggttttctatatgcc

SEQ ID NO: 8455598 - DNA, 22 bp, Homo sapiens
catctttgcccatccacttcca

SEQ ID NO: 8455599 - DNA, 20 bp, Homo sapiens
catctttggcaggactcctt

SEQ ID NO: 8455600 - DNA, 22 bp, Homo sapiens
catctttggagaaacttccgtt

SEQ ID NO: 8455601 - DNA, 19 bp, Homo sapiens
catctttggtcacctagtc

SEQ ID NO: 8455602 - DNA, 22 bp, Homo sapiens
catctttgggctgcatggaagg

SEQ ID NO: 8455603 - DNA, 22 bp, Homo sapiens
cagtgccaaggagaaggacagc

SEQ ID NO: 8455604 - DNA, 20 bp, Homo sapiens
tcacaggagggaaggcaggt

SEQ ID NO: 8455605 - DNA, 22 bp, Homo sapiens
tcacaggaggactgaaagatat

SEQ ID NO: 8455606 - DNA, 20 bp, Homo sapiens
tcacaggagggaaggcaggt

SEQ ID NO: 8455607 - DNA, 22 bp, Homo sapiens
tcacaggagtcaaggaatagta

SEQ ID NO: 8455608 - DNA, 22 bp, Homo sapiens
tcacagagaactataatccatc

SEQ ID NO: 8455609 - DNA, 22 bp, Homo sapiens
tcacagagaaatgtggcacaaa

SEQ ID NO: 8455610 - DNA, 22 bp, Homo sapiens
tcacagagaaaagctatcacaa

SEQ ID NO: 8455611 - DNA, 21 bp, Homo sapiens
tcacagactggtcagtgaggc

SEQ ID NO: 8455612 - DNA, 22 bp, Homo sapiens
tcacagactggtcagtcaactt

SEQ ID NO: 8455613 - DNA, 22 bp, Homo sapiens
tcacaggagcccaggggagctg

SEQ ID NO: 8455614 - DNA, 22 bp, Homo sapiens
tcacaggaccctgagggtggcg

SEQ ID NO: 8455615 - DNA, 22 bp, Homo sapiens
tcacagctttgagcagagacca

SEQ ID NO: 8455616 - DNA, 22 bp, Homo sapiens
tcacagctttgagcagagacca

SEQ ID NO: 8455617 - DNA, 22 bp, Homo sapiens
tcacaggaaccatcagagaaat

SEQ ID NO: 8455618 - DNA, 22 bp, Homo sapiens
tcacaggacagccttccacccg

SEQ ID NO: 8455619 - DNA, 22 bp, Homo sapiens
tcacaagactgagcttgcttga

SEQ ID NO: 8455620 - DNA, 22 bp, Homo sapiens
tcacaagacagaaaacatttag

SEQ ID NO: 8455621 - DNA, 22 bp, Homo sapiens
cagtgacgtaaactgcatgtgc

SEQ ID NO: 8455622 - DNA, 22 bp, Homo sapiens
cagtgacacccagtctggccca

SEQ ID NO: 8455623 - DNA, 22 bp, Homo sapiens
cagtgacagcaagcagtgctgg

SEQ ID NO: 8455624 - DNA, 22 bp, Homo sapiens
cagtgagagagaacgcattcat

SEQ ID NO: 8455625 - DNA, 22 bp, Homo sapiens
tcacagactcaagggcatagga

SEQ ID NO: 8455626 - DNA, 22 bp, Homo sapiens
tcacagactcttgattgtctaa

SEQ ID NO: 8455627 - DNA, 22 bp, Homo sapiens
tcacagacgcatcctcaggtag

SEQ ID NO: 8455628 - DNA, 22 bp, Homo sapiens
cagtgaggaagctgtctggacc

SEQ ID NO: 8455629 - DNA, 22 bp, Homo sapiens
cagtgagcacggccagagggga

SEQ ID NO: 8455630 - DNA, 22 bp, Homo sapiens
tcacaacaggaaggaccagctg

SEQ ID NO: 8455631 - DNA, 22 bp, Homo sapiens
tcacaagaatttgtagatgaaa

SEQ ID NO: 8455632 - DNA, 22 bp, Homo sapiens
tcacaaatattttaacagtagg

SEQ ID NO: 8455633 - DNA, 22 bp, Homo sapiens
tcaatgagaaagacacagtctt

SEQ ID NO: 8455634 - DNA, 22 bp, Homo sapiens
tcaatgagccagaatgtagtac

SEQ ID NO: 8455635 - DNA, 22 bp, Homo sapiens
tcaatgagctggggacgtgtac

SEQ ID NO: 8455636 - DNA, 22 bp, Homo sapiens
tcaatgaggtaatcagtcaccc

SEQ ID NO: 8455637 - DNA, 22 bp, Homo sapiens
tcaatgaggtgattgctgtcct

SEQ ID NO: 8455638 - DNA, 22 bp, Homo sapiens
tatttcttttcgtgacttattg

SEQ ID NO: 8455639 - DNA, 22 bp, Homo sapiens
tatttcttttcgtgacttattg

SEQ ID NO: 8455640 - DNA, 22 bp, Homo sapiens
cagtagttattagttgccactg

SEQ ID NO: 8455641 - DNA, 18 bp, Homo sapiens
cagtataaccagcaactc

SEQ ID NO: 8455642 - DNA, 22 bp, Homo sapiens
cagtatacgactaacgcatgac

SEQ ID NO: 8455643 - DNA, 22 bp, Homo sapiens
cagtagcttcagttgaggcctg

SEQ ID NO: 8455644 - DNA, 22 bp, Homo sapiens
cagtagcttcagttgaggcctg

SEQ ID NO: 8455645 - DNA, 22 bp, Homo sapiens
cagtagtctttttcctcctaga

SEQ ID NO: 8455646 - DNA, 22 bp, Homo sapiens
tatttccaagctgaatccaatg

SEQ ID NO: 8455647 - DNA, 22 bp, Homo sapiens
tatttccaccctcagtaaggaa

SEQ ID NO: 8455648 - DNA, 22 bp, Homo sapiens
tatttccaaaagcctattatga

SEQ ID NO: 8455649 - DNA, 22 bp, Homo sapiens
tatttccacctattattttctg

SEQ ID NO: 8455650 - DNA, 22 bp, Homo sapiens
cagtagcccactagtatgcagt

SEQ ID NO: 8455651 - DNA, 22 bp, Homo sapiens
cagtagccttatttggatcatt

SEQ ID NO: 8455652 - DNA, 21 bp, Homo sapiens
tatttctttgactctctccct

SEQ ID NO: 8455653 - DNA, 22 bp, Homo sapiens
tatttctttcaggtatgtgttg

SEQ ID NO: 8455654 - DNA, 22 bp, Homo sapiens
tatttctttcaggtatgtgttg

SEQ ID NO: 8455655 - DNA, 22 bp, Homo sapiens
tatttctttcaggtatgtgttg

SEQ ID NO: 8455656 - DNA, 22 bp, Homo sapiens
tatttcttgttccctccaagtt

SEQ ID NO: 8455657 - DNA, 22 bp, Homo sapiens
tatttcttgttccctccaagtt

SEQ ID NO: 8455658 - DNA, 22 bp, Homo sapiens
cagtcccagacccagaaggtgg

SEQ ID NO: 8455659 - DNA, 22 bp, Homo sapiens
cagtcccagacatagtaaggga

SEQ ID NO: 8455660 - DNA, 22 bp, Homo sapiens
cagtcccagaagagcctgggag

SEQ ID NO: 8455661 - DNA, 22 bp, Homo sapiens
cagtcccagaagagcctgggag

SEQ ID NO: 8455662 - DNA, 22 bp, Homo sapiens
cagtcccagaagagcctgggag

SEQ ID NO: 8455663 - DNA, 20 bp, Homo sapiens
cagtcccaatccagggccag

SEQ ID NO: 8455664 - DNA, 20 bp, Homo sapiens
cagtcccaatccagggccag

SEQ ID NO: 8455665 - DNA, 20 bp, Homo sapiens
cagtcccaatccagggccag

SEQ ID NO: 8455666 - DNA, 22 bp, Homo sapiens
cagtcccaccaggatcgctctt

SEQ ID NO: 8455667 - DNA, 22 bp, Homo sapiens
cagtcccacaagatctccacaa

SEQ ID NO: 8455668 - DNA, 22 bp, Homo sapiens
cagtcccacaagatctccacaa

SEQ ID NO: 8455669 - DNA, 22 bp, Homo sapiens
cagtcccactagtgccaatacc

SEQ ID NO: 8455670 - DNA, 22 bp, Homo sapiens
cagtcccaaggaggaagcagtc

SEQ ID NO: 8455671 - DNA, 19 bp, Homo sapiens
cagtcccaaattcttgtca

SEQ ID NO: 8455672 - DNA, 22 bp, Homo sapiens
cagtatatgctctttcatcaaa

SEQ ID NO: 8455673 - DNA, 22 bp, Homo sapiens
caggttgggatcggttgcaatg

SEQ ID NO: 8455674 - DNA, 22 bp, Homo sapiens
caggttgggctgcgaggaggag

SEQ ID NO: 8455675 - DNA, 22 bp, Homo sapiens
caggttggtcggcaagtacaca

SEQ ID NO: 8455676 - DNA, 22 bp, Homo sapiens
caggttctggggctccactgtg

SEQ ID NO: 8455677 - DNA, 22 bp, Homo sapiens
caggttctgggtcctgggtcct

SEQ ID NO: 8455678 - DNA, 22 bp, Homo sapiens
caggttcttaagtaacagcaca

SEQ ID NO: 8455679 - DNA, 22 bp, Homo sapiens
caggttcttaacttgttcttcc

SEQ ID NO: 8455680 - DNA, 22 bp, Homo sapiens
caggttcttgtttcaaacagac

SEQ ID NO: 8455681 - DNA, 22 bp, Homo sapiens
caggttctggagatgcagagat

SEQ ID NO: 8455682 - DNA, 22 bp, Homo sapiens
caggttctggagatgcagagat

SEQ ID NO: 8455683 - DNA, 22 bp, Homo sapiens
caggttctgaggatggtgcctg

SEQ ID NO: 8455684 - DNA, 22 bp, Homo sapiens
caggttctcagaaggcagtcac

SEQ ID NO: 8455685 - DNA, 22 bp, Homo sapiens
caggttctcagaaggcagtcac

SEQ ID NO: 8455686 - DNA, 22 bp, Homo sapiens
caggttctatactgaataattt

SEQ ID NO: 8455687 - DNA, 22 bp, Homo sapiens
tatttcaggtatggtgtgaaat

SEQ ID NO: 8455688 - DNA, 22 bp, Homo sapiens
tatttcatctggaacaaggtaa

SEQ ID NO: 8455689 - DNA, 22 bp, Homo sapiens
tatttcatctggaacaaggtaa

SEQ ID NO: 8455690 - DNA, 22 bp, Homo sapiens
tatttcattctttatcaggagc

SEQ ID NO: 8455691 - DNA, 22 bp, Homo sapiens
caggttcccttgcagctaagtg

SEQ ID NO: 8455692 - DNA, 22 bp, Homo sapiens
cagggtggccctgtggtctcat

SEQ ID NO: 8455693 - DNA, 22 bp, Homo sapiens
cagggtggccctgtggtctcat

SEQ ID NO: 8455694 - DNA, 22 bp, Homo sapiens
cagggtggccctgtggtctcat

SEQ ID NO: 8455695 - DNA, 22 bp, Homo sapiens
cagggtgggcacccagcctcca

SEQ ID NO: 8455696 - DNA, 22 bp, Homo sapiens
cagggtgggcacccagcctcca

SEQ ID NO: 8455697 - DNA, 23 bp, Homo sapiens
cagtgtgacgaggtgaggcaggc

SEQ ID NO: 8455698 - DNA, 22 bp, Homo sapiens
cagtgtgaggaattagtgtcca

SEQ ID NO: 8455699 - DNA, 22 bp, Homo sapiens
cagtgtctgggacagaaagtca

SEQ ID NO: 8455700 - DNA, 22 bp, Homo sapiens
cagtgtttgcttaagttatatg

SEQ ID NO: 8455701 - DNA, 22 bp, Homo sapiens
cagttaaaagaagtctatctta

SEQ ID NO: 8455702 - DNA, 22 bp, Homo sapiens
cagttaaaaggtatgctaccaa

SEQ ID NO: 8455703 - DNA, 22 bp, Homo sapiens
cagttaaaagaagtctatctta

SEQ ID NO: 8455704 - DNA, 22 bp, Homo sapiens
cagttaaaagaagtctatctta

SEQ ID NO: 8455705 - DNA, 22 bp, Homo sapiens
cagttaaaatgtgctataagaa

SEQ ID NO: 8455706 - DNA, 22 bp, Homo sapiens
cagttaaaaggtatgctaccaa

SEQ ID NO: 8455707 - DNA, 22 bp, Homo sapiens
cagttaaaatgtgctataagaa

SEQ ID NO: 8455708 - DNA, 22 bp, Homo sapiens
cagttaaacgatgatggggtca

SEQ ID NO: 8455709 - DNA, 22 bp, Homo sapiens
cagttaaacagattgagtgtta

SEQ ID NO: 8455710 - DNA, 22 bp, Homo sapiens
cagttaaacgggccatgtgagt

SEQ ID NO: 8455711 - DNA, 22 bp, Homo sapiens
cagttaaacagattgagtgtta

SEQ ID NO: 8455712 - DNA, 22 bp, Homo sapiens
cagttaaaatgtgctataagaa

SEQ ID NO: 8455713 - DNA, 22 bp, Homo sapiens
tcagagaaatgacaatatatag

SEQ ID NO: 8455714 - DNA, 22 bp, Homo sapiens
tcagagaaataattgctgagtt

SEQ ID NO: 8455715 - DNA, 22 bp, Homo sapiens
tcagagaaataattgctgagtt

SEQ ID NO: 8455716 - DNA, 22 bp, Homo sapiens
tcagagaaaggccaaaatatca

SEQ ID NO: 8455717 - DNA, 22 bp, Homo sapiens
tcagagaaatgctgagctcatg

SEQ ID NO: 8455718 - DNA, 22 bp, Homo sapiens
tcagagaaatgctgagctcatg

SEQ ID NO: 8455719 - DNA, 22 bp, Homo sapiens
tcagagaacacagaggtgatgt

SEQ ID NO: 8455720 - DNA, 21 bp, Homo sapiens
tcagagaacccggcaggcaag

SEQ ID NO: 8455721 - DNA, 22 bp, Homo sapiens
cagtgtctccagatgctccaat

SEQ ID NO: 8455722 - DNA, 21 bp, Homo sapiens
tcagacttgagctcttctaca

SEQ ID NO: 8455723 - DNA, 23 bp, Homo sapiens
tcagaagtgggatacaaagctga

SEQ ID NO: 8455724 - DNA, 20 bp, Homo sapiens
tcagaagtgcagctgcccct

SEQ ID NO: 8455725 - DNA, 21 bp, Homo sapiens
tcagaagtgcagcccaggaat

SEQ ID NO: 8455726 - DNA, 20 bp, Homo sapiens
tcagaagtgcagctgcccct

SEQ ID NO: 8455727 - DNA, 23 bp, Homo sapiens
tcagaagtgggatacaaagctga

SEQ ID NO: 8455728 - DNA, 22 bp, Homo sapiens
cagtggctggttagggacagga

SEQ ID NO: 8455729 - DNA, 20 bp, Homo sapiens
cagtggctgataacaaatta

SEQ ID NO: 8455730 - DNA, 22 bp, Homo sapiens
cagtggctgagagtggacactg

SEQ ID NO: 8455731 - DNA, 22 bp, Homo sapiens
cagtggcttcttcctagagcca

SEQ ID NO: 8455732 - DNA, 22 bp, Homo sapiens
cagtggcttctcatgtcattca

SEQ ID NO: 8455733 - DNA, 22 bp, Homo sapiens
cagtggcttaaataagattagg

SEQ ID NO: 8455734 - DNA, 22 bp, Homo sapiens
cagtgccacttaatgaggctgc

SEQ ID NO: 8455735 - DNA, 22 bp, Homo sapiens
cagtgccatgtctgagccccta

SEQ ID NO: 8455736 - DNA, 23 bp, Homo sapiens
cagtgggaggactgagataaaac

SEQ ID NO: 8455737 - DNA, 23 bp, Homo sapiens
cagtgggaggactgagataaaac

SEQ ID NO: 8455738 - DNA, 22 bp, Homo sapiens
cagtgggattgggattggaacc

SEQ ID NO: 8455739 - DNA, 22 bp, Homo sapiens
cagtgggaaagtgaagagcatt

SEQ ID NO: 8455740 - DNA, 22 bp, Homo sapiens
cagtgggaaagtgaagagcatt

SEQ ID NO: 8455741 - DNA, 22 bp, Homo sapiens
cagtggggtttctgtgggtgct

SEQ ID NO: 8455742 - DNA, 23 bp, Homo sapiens
cagtgggcttctaactgctcctg

SEQ ID NO: 8455743 - DNA, 22 bp, Homo sapiens
cagtggggaggccaggatagaa

SEQ ID NO: 8455744 - DNA, 22 bp, Homo sapiens
cagtgggggggccatgctgcag

SEQ ID NO: 8455745 - DNA, 22 bp, Homo sapiens
cagtgggggggccatgctgcag

SEQ ID NO: 8455746 - DNA, 22 bp, Homo sapiens
cagtggggggactgaggcctga

SEQ ID NO: 8455747 - DNA, 22 bp, Homo sapiens
cagtggggggactgaggcctga

SEQ ID NO: 8455748 - DNA, 22 bp, Homo sapiens
cagtggggggactgaggcctga

SEQ ID NO: 8455749 - DNA, 22 bp, Homo sapiens
cataaagtctcataattcactt

SEQ ID NO: 8455750 - DNA, 22 bp, Homo sapiens
cataaagtaaagatgtcttcca

SEQ ID NO: 8455751 - DNA, 22 bp, Homo sapiens
cataaagtaaagatgtcttcca

SEQ ID NO: 8455752 - DNA, 22 bp, Homo sapiens
cataaactcttgagattcttgt

SEQ ID NO: 8455753 - DNA, 22 bp, Homo sapiens
cataaattcagttctgcctctt

SEQ ID NO: 8455754 - DNA, 22 bp, Homo sapiens
cataaattgtacccattccaac

SEQ ID NO: 8455755 - DNA, 22 bp, Homo sapiens
tcaggaaactacagttgaacta

SEQ ID NO: 8455756 - DNA, 22 bp, Homo sapiens
cataaaatggcttgttctttaa

SEQ ID NO: 8455757 - DNA, 22 bp, Homo sapiens
tcaggaaagagtaatgtataca

SEQ ID NO: 8455758 - DNA, 22 bp, Homo sapiens
tcaggaaagaagatgctcagtg

SEQ ID NO: 8455759 - DNA, 22 bp, Homo sapiens
tcagctgccccagtggccccag

SEQ ID NO: 8455760 - DNA, 22 bp, Homo sapiens
tcagctttgcaagttagaaaat

SEQ ID NO: 8455761 - DNA, 22 bp, Homo sapiens
cagtttaaagaaggatgggagt

SEQ ID NO: 8455762 - DNA, 22 bp, Homo sapiens
tcagcagccgcagctgactcag

SEQ ID NO: 8455763 - DNA, 19 bp, Homo sapiens
cagtttaactaattttatc

SEQ ID NO: 8455764 - DNA, 22 bp, Homo sapiens
cagtttaacctatccattatgt

SEQ ID NO: 8455765 - DNA, 22 bp, Homo sapiens
cagtttaaggcaggacatggga

SEQ ID NO: 8455766 - DNA, 19 bp, Homo sapiens
tcagcagcactgtgatttc

SEQ ID NO: 8455767 - DNA, 21 bp, Homo sapiens
tcagcagcatctgcctagagt

SEQ ID NO: 8455768 - DNA, 22 bp, Homo sapiens
tcagcagaggggaaggcatctg

SEQ ID NO: 8455769 - DNA, 22 bp, Homo sapiens
tcagcagatgggttgtgttggc

SEQ ID NO: 8455770 - DNA, 22 bp, Homo sapiens
tcagcagagtttcatcttggga

SEQ ID NO: 8455771 - DNA, 22 bp, Homo sapiens
tcagcagacctgttatttggat

SEQ ID NO: 8455772 - DNA, 22 bp, Homo sapiens
tcagcagacattattttctggc

SEQ ID NO: 8455773 - DNA, 22 bp, Homo sapiens
tcagcagagcgagaccaagtca

SEQ ID NO: 8455774 - DNA, 22 bp, Homo sapiens
tcagcagaggagtgtcttgccc

SEQ ID NO: 8455775 - DNA, 22 bp, Homo sapiens
cagttaaagctgcatgtgtcag

SEQ ID NO: 8455776 - DNA, 22 bp, Homo sapiens
cagttaaacgggccatgtgagt

SEQ ID NO: 8455777 - DNA, 22 bp, Homo sapiens
cagttaaagctgcatgtgtcag

SEQ ID NO: 8455778 - DNA, 22 bp, Homo sapiens
cagttaaagctgcatgtgtcag

SEQ ID NO: 8455779 - DNA, 22 bp, Homo sapiens
cagttaaacgggccatgtgagt

SEQ ID NO: 8455780 - DNA, 22 bp, Homo sapiens
cagttaaacgggccatgtgagt

SEQ ID NO: 8455781 - DNA, 22 bp, Homo sapiens
cagttaaagtgcttatcacaga

SEQ ID NO: 8455782 - DNA, 22 bp, Homo sapiens
cagttaaagtgcttatcacaga

SEQ ID NO: 8455783 - DNA, 22 bp, Homo sapiens
cagttaaaggcccaatatctgg

SEQ ID NO: 8455784 - DNA, 22 bp, Homo sapiens
cagttaaatgatgtgccctaga

SEQ ID NO: 8455785 - DNA, 22 bp, Homo sapiens
cagttaaagtgcttatcacaga

SEQ ID NO: 8455786 - DNA, 22 bp, Homo sapiens
cagttaaatgatgtgccctaga

SEQ ID NO: 8455787 - DNA, 22 bp, Homo sapiens
cagttaaatttggctgttttct

SEQ ID NO: 8455788 - DNA, 22 bp, Homo sapiens
cagttaaattctccagttacca

SEQ ID NO: 8455789 - DNA, 22 bp, Homo sapiens
cagttaaattctccagttacca

SEQ ID NO: 8455790 - DNA, 22 bp, Homo sapiens
cagttaaattctccagttacca

SEQ ID NO: 8455791 - DNA, 22 bp, Homo sapiens
cagttaaatttggctgttttct

SEQ ID NO: 8455792 - DNA, 22 bp, Homo sapiens
cagttaactgagctctgtgaga

SEQ ID NO: 8455793 - DNA, 18 bp, Homo sapiens
cagttacaccttcattca

SEQ ID NO: 8455794 - DNA, 22 bp, Homo sapiens
cagttacagagccagttagaga

SEQ ID NO: 8455795 - DNA, 22 bp, Homo sapiens
cagttacagagccagttagaga

SEQ ID NO: 8455796 - DNA, 19 bp, Homo sapiens
cagttacagcagctaagac

SEQ ID NO: 8455797 - DNA, 19 bp, Homo sapiens
cagttacagcagctaagac

SEQ ID NO: 8455798 - DNA, 22 bp, Homo sapiens
cagttacacaccattgtgaaca

SEQ ID NO: 8455799 - DNA, 22 bp, Homo sapiens
cagttacacaccattgtgaaca

SEQ ID NO: 8455800 - DNA, 21 bp, Homo sapiens
cagttacacaagtgttaccag

SEQ ID NO: 8455801 - DNA, 21 bp, Homo sapiens
cagttacacaagtgttaccag

SEQ ID NO: 8455802 - DNA, 18 bp, Homo sapiens
cagttacaccttcattca

SEQ ID NO: 8455803 - DNA, 22 bp, Homo sapiens
cagttacatatttagtaggtta

SEQ ID NO: 8455804 - DNA, 22 bp, Homo sapiens
cagttacatatttagtaggtta

SEQ ID NO: 8455805 - DNA, 22 bp, Homo sapiens
cagttacataaatgataaaatg

SEQ ID NO: 8455806 - DNA, 22 bp, Homo sapiens
cagttacataaatgataaaatg

SEQ ID NO: 8455807 - DNA, 19 bp, Homo sapiens
cagttacaggcactgtggg

SEQ ID NO: 8455808 - DNA, 21 bp, Homo sapiens
cagttacagccaggacaaggc

SEQ ID NO: 8455809 - DNA, 21 bp, Homo sapiens
cagttacagccaggacaaggc

SEQ ID NO: 8455810 - DNA, 22 bp, Homo sapiens
cagttacagctgcaccagagcc

SEQ ID NO: 8455811 - DNA, 22 bp, Homo sapiens
cagttacagctgcaccagagcc

SEQ ID NO: 8455812 - DNA, 19 bp, Homo sapiens
cagttacaggcactgtggg

SEQ ID NO: 8455813 - DNA, 22 bp, Homo sapiens
cagttacattaataatgcacat

SEQ ID NO: 8455814 - DNA, 22 bp, Homo sapiens
cagttacattaataatgcacat

SEQ ID NO: 8455815 - DNA, 22 bp, Homo sapiens
cagttacatgctcatgtcatca

SEQ ID NO: 8455816 - DNA, 22 bp, Homo sapiens
cagttacatgctcatgtcatca

SEQ ID NO: 8455817 - DNA, 22 bp, Homo sapiens
cagttacatgctcatgtcatca

SEQ ID NO: 8455818 - DNA, 22 bp, Homo sapiens
cagttactgtatgtcaaagact

SEQ ID NO: 8455819 - DNA, 22 bp, Homo sapiens
cagttactcaataattcttgcg

SEQ ID NO: 8455820 - DNA, 22 bp, Homo sapiens
cagttaccatcttcagtgatga

SEQ ID NO: 8455821 - DNA, 22 bp, Homo sapiens
taggaaattagaacttggaaac

SEQ ID NO: 8455822 - DNA, 22 bp, Homo sapiens
taggaaattagaacttggaaac

SEQ ID NO: 8455823 - DNA, 22 bp, Homo sapiens
taggaaattctcttgctaagtt

SEQ ID NO: 8455824 - DNA, 22 bp, Homo sapiens
taggaaattgccaatatatgac

SEQ ID NO: 8455825 - DNA, 22 bp, Homo sapiens
taggaaattgccaatatatgac

SEQ ID NO: 8455826 - DNA, 22 bp, Homo sapiens
taggaaattgacacctgcttga

SEQ ID NO: 8455827 - DNA, 22 bp, Homo sapiens
taggacatgctacataaatagg

SEQ ID NO: 8455828 - DNA, 22 bp, Homo sapiens
taggaacagtcctagaaatctg

SEQ ID NO: 8455829 - DNA, 22 bp, Homo sapiens
taggaaattttactggtctggg

SEQ ID NO: 8455830 - DNA, 22 bp, Homo sapiens
taggaacaaagagcctcacatt

SEQ ID NO: 8455831 - DNA, 22 bp, Homo sapiens
taggaaattggaaactcttcac

SEQ ID NO: 8455832 - DNA, 22 bp, Homo sapiens
tagctattttgcttggaaatac

SEQ ID NO: 8455833 - DNA, 22 bp, Homo sapiens
tagctcaaaggttaagtgtgga

SEQ ID NO: 8455834 - DNA, 22 bp, Homo sapiens
tagctcaaaggttaagtgtgga

SEQ ID NO: 8455835 - DNA, 22 bp, Homo sapiens
tagctcagcaggtgggacaggt

SEQ ID NO: 8455836 - DNA, 22 bp, Homo sapiens
tagctcatgtaatccgaacata

SEQ ID NO: 8455837 - DNA, 22 bp, Homo sapiens
tagctcctacaagtacagcaaa

SEQ ID NO: 8455838 - DNA, 22 bp, Homo sapiens
tagctcctggctgcagggcctc

SEQ ID NO: 8455839 - DNA, 22 bp, Homo sapiens
tagctacatacttggccattct

SEQ ID NO: 8455840 - DNA, 22 bp, Homo sapiens
tagctacactgaggctgcttaa

SEQ ID NO: 8455841 - DNA, 22 bp, Homo sapiens
tagctattgttggtagttaccc

SEQ ID NO: 8455842 - DNA, 22 bp, Homo sapiens
tagctattgttggtagttaccc

SEQ ID NO: 8455843 - DNA, 22 bp, Homo sapiens
tagctatttagcccagataagt

SEQ ID NO: 8455844 - DNA, 22 bp, Homo sapiens
tagctatttggaaaattccaat

SEQ ID NO: 8455845 - DNA, 22 bp, Homo sapiens
tagctatttggaaaattccaat

SEQ ID NO: 8455846 - DNA, 22 bp, Homo sapiens
taggacatgtgttttatatatg

SEQ ID NO: 8455847 - DNA, 19 bp, Homo sapiens
taggaccctggtggccccc

SEQ ID NO: 8455848 - DNA, 22 bp, Homo sapiens
taggacttggtttgaagatttt

SEQ ID NO: 8455849 - DNA, 18 bp, Homo sapiens
taggagagaatttattta

SEQ ID NO: 8455850 - DNA, 17 bp, Homo sapiens
taggagactggctgtcc

SEQ ID NO: 8455851 - DNA, 22 bp, Homo sapiens
taggagaggtgaatggcacact

SEQ ID NO: 8455852 - DNA, 22 bp, Homo sapiens
taggagagctgaactattgtct

SEQ ID NO: 8455853 - DNA, 22 bp, Homo sapiens
cagggcctcattgtcagtcctg

SEQ ID NO: 8455854 - DNA, 22 bp, Homo sapiens
taggagctataatgtgaagtct

SEQ ID NO: 8455855 - DNA, 21 bp, Homo sapiens
taggagctgatggggaagtag

SEQ ID NO: 8455856 - DNA, 22 bp, Homo sapiens
taggagcttttggagtcctgtg

SEQ ID NO: 8455857 - DNA, 22 bp, Homo sapiens
cagggcctgcttccttcttgtt

SEQ ID NO: 8455858 - DNA, 22 bp, Homo sapiens
cagggcctggagctgggcctgc

SEQ ID NO: 8455859 - DNA, 22 bp, Homo sapiens
cagggcctgcttccttcttgtt

SEQ ID NO: 8455860 - DNA, 22 bp, Homo sapiens
cagggcctgcttccttcttgtt

SEQ ID NO: 8455861 - DNA, 22 bp, Homo sapiens
cagggctcagggactgcagaaa

SEQ ID NO: 8455862 - DNA, 22 bp, Homo sapiens
cagggctcagggactgcagaaa

SEQ ID NO: 8455863 - DNA, 22 bp, Homo sapiens
cagggccttgttcaggagtgaa

SEQ ID NO: 8455864 - DNA, 22 bp, Homo sapiens
cagggccttgttcaggagtgaa

SEQ ID NO: 8455865 - DNA, 22 bp, Homo sapiens
cagggccttcgtaagtgtccgg

SEQ ID NO: 8455866 - DNA, 22 bp, Homo sapiens
cagggccttcgtaagtgtccgg

SEQ ID NO: 8455867 - DNA, 22 bp, Homo sapiens
cagggccttatcctgccattga

SEQ ID NO: 8455868 - DNA, 22 bp, Homo sapiens
cagggcctgtacaagtcccacc

SEQ ID NO: 8455869 - DNA, 22 bp, Homo sapiens
cagggcctgtacaagtcccacc

SEQ ID NO: 8455870 - DNA, 22 bp, Homo sapiens
cagggcctgtacaagtcccacc

SEQ ID NO: 8455871 - DNA, 22 bp, Homo sapiens
cagggcctgtcacgacgctcat

SEQ ID NO: 8455872 - DNA, 22 bp, Homo sapiens
tagggacaaagagctgaggcct

SEQ ID NO: 8455873 - DNA, 22 bp, Homo sapiens
tagggctattctgagtaataat

SEQ ID NO: 8455874 - DNA, 22 bp, Homo sapiens
tagggctataagagaataagac

SEQ ID NO: 8455875 - DNA, 22 bp, Homo sapiens
tagggcagttataacattagtg

SEQ ID NO: 8455876 - DNA, 22 bp, Homo sapiens
tagggtacatgtgcacaacatg

SEQ ID NO: 8455877 - DNA, 22 bp, Homo sapiens
tagggtagtaccatgctgccag

SEQ ID NO: 8455878 - DNA, 22 bp, Homo sapiens
tagggtccaagccttataatta

SEQ ID NO: 8455879 - DNA, 22 bp, Homo sapiens
tagggtcctcatctgtaaatga

SEQ ID NO: 8455880 - DNA, 22 bp, Homo sapiens
tagggtcctgcctacagagaca

SEQ ID NO: 8455881 - DNA, 22 bp, Homo sapiens
tagggtcccagataggagccag

SEQ ID NO: 8455882 - DNA, 22 bp, Homo sapiens
tagggtccatatggatgaatgg

SEQ ID NO: 8455883 - DNA, 22 bp, Homo sapiens
tagggtggttagaaggagtatg

SEQ ID NO: 8455884 - DNA, 22 bp, Homo sapiens
tagggtggagactggaagcagg

SEQ ID NO: 8455885 - DNA, 22 bp, Homo sapiens
taggtagaaatagatattggta

SEQ ID NO: 8455886 - DNA, 22 bp, Homo sapiens
caggggaagatgccaagggaga

SEQ ID NO: 8455887 - DNA, 22 bp, Homo sapiens
cagggctttgaacaggcatcaa

SEQ ID NO: 8455888 - DNA, 22 bp, Homo sapiens
caggggagttttatgcaacaga

SEQ ID NO: 8455889 - DNA, 22 bp, Homo sapiens
caggggagtgagtccctctctg

SEQ ID NO: 8455890 - DNA, 22 bp, Homo sapiens
tagtcttttgagaagtatatct

SEQ ID NO: 8455891 - DNA, 19 bp, Homo sapiens
tagtctttattcttaattt

SEQ ID NO: 8455892 - DNA, 22 bp, Homo sapiens
tagtctttcatttggagcattt

SEQ ID NO: 8455893 - DNA, 22 bp, Homo sapiens
tagtgaaacagttatcaatctg

SEQ ID NO: 8455894 - DNA, 22 bp, Homo sapiens
tagtctttttaataaataatgc

SEQ ID NO: 8455895 - DNA, 22 bp, Homo sapiens
tagtgaaatgagaatgtatgac

SEQ ID NO: 8455896 - DNA, 22 bp, Homo sapiens
tagtgaaagtcaaagacagcta

SEQ ID NO: 8455897 - DNA, 22 bp, Homo sapiens
tatattgtctctgccttgtctg

SEQ ID NO: 8455898 - DNA, 22 bp, Homo sapiens
tatattgttggtgggaatataa

SEQ ID NO: 8455899 - DNA, 19 bp, Homo sapiens
tagtgagtagtgaattaga

SEQ ID NO: 8455900 - DNA, 22 bp, Homo sapiens
cagggtggccaggtagataata

SEQ ID NO: 8455901 - DNA, 22 bp, Homo sapiens
cagggtggcactcagcgcatct

SEQ ID NO: 8455902 - DNA, 22 bp, Homo sapiens
tatcatttaacagaatcattgc

SEQ ID NO: 8455903 - DNA, 22 bp, Homo sapiens
tatcagtgattgctgtatacaa

SEQ ID NO: 8455904 - DNA, 23 bp, Homo sapiens
tatcagtaagcatccctgaaccc

SEQ ID NO: 8455905 - DNA, 22 bp, Homo sapiens
tatcataagttaattaaacagt

SEQ ID NO: 8455906 - DNA, 22 bp, Homo sapiens
tatcatctgcaaagcacatcta

SEQ ID NO: 8455907 - DNA, 22 bp, Homo sapiens
tatcatcttgttgtcatgcagc

SEQ ID NO: 8455908 - DNA, 22 bp, Homo sapiens
tagcaagagtgggctttgtggg

SEQ ID NO: 8455909 - DNA, 22 bp, Homo sapiens
tagcaagaggtgaaggtttcat

SEQ ID NO: 8455910 - DNA, 22 bp, Homo sapiens
tagcaagatcgtgtctctaaaa

SEQ ID NO: 8455911 - DNA, 22 bp, Homo sapiens
tagcaagatccttccctggcgt

SEQ ID NO: 8455912 - DNA, 22 bp, Homo sapiens
tagcaagatgtcactccaagtt

SEQ ID NO: 8455913 - DNA, 22 bp, Homo sapiens
tagcaagatgatgaattattca

SEQ ID NO: 8455914 - DNA, 22 bp, Homo sapiens
tagcaagtagatactcatttag

SEQ ID NO: 8455915 - DNA, 22 bp, Homo sapiens
tagcaagtatgatactccatga

SEQ ID NO: 8455916 - DNA, 22 bp, Homo sapiens
tagcaatccgttgatcccttgc

SEQ ID NO: 8455917 - DNA, 22 bp, Homo sapiens
tagctacaatcactgtcctttg

SEQ ID NO: 8455918 - DNA, 22 bp, Homo sapiens
tagataaattagaaagtttact

SEQ ID NO: 8455919 - DNA, 22 bp, Homo sapiens
tagataaattagaaagtttact

SEQ ID NO: 8455920 - DNA, 22 bp, Homo sapiens
tagataatttggcatcatattg

SEQ ID NO: 8455921 - DNA, 22 bp, Homo sapiens
tagataatttggcatcatattg

SEQ ID NO: 8455922 - DNA, 22 bp, Homo sapiens
cagggcaaagtcttctagaacc

SEQ ID NO: 8455923 - DNA, 22 bp, Homo sapiens
cagggcaaagagagcacatgct

SEQ ID NO: 8455924 - DNA, 22 bp, Homo sapiens
cagggatggcgctggctgcccg

SEQ ID NO: 8455925 - DNA, 22 bp, Homo sapiens
cagggatggcgctggctgcccg

SEQ ID NO: 8455926 - DNA, 22 bp, Homo sapiens
cagggcacagttatggaggtgg

SEQ ID NO: 8455927 - DNA, 21 bp, Homo sapiens
cagggcacacagaggatggta

SEQ ID NO: 8455928 - DNA, 22 bp, Homo sapiens
tagataaaagggcaaagggcat

SEQ ID NO: 8455929 - DNA, 22 bp, Homo sapiens
tagataaattagaaagtttact

SEQ ID NO: 8455930 - DNA, 22 bp, Homo sapiens
tagagtgttgtaattgaaaagg

SEQ ID NO: 8455931 - DNA, 22 bp, Homo sapiens
tagagtgttttgttaggcagca

SEQ ID NO: 8455932 - DNA, 22 bp, Homo sapiens
tagaggaaccaggcaggctgag

SEQ ID NO: 8455933 - DNA, 22 bp, Homo sapiens
tagaggaaccaggcaggctgag

SEQ ID NO: 8455934 - DNA, 22 bp, Homo sapiens
tagaggagaacacaaattatag

SEQ ID NO: 8455935 - DNA, 22 bp, Homo sapiens
tagagcttagagaatgagtttg

SEQ ID NO: 8455936 - DNA, 19 bp, Homo sapiens
tagagcttgttttaggaag

SEQ ID NO: 8455937 - DNA, 22 bp, Homo sapiens
tagaggaaatttccaaggtgag

SEQ ID NO: 8455938 - DNA, 22 bp, Homo sapiens
tagagcttgattggattcaggg

SEQ ID NO: 8455939 - DNA, 21 bp, Homo sapiens
tagagcttggcacagagtaga

SEQ ID NO: 8455940 - DNA, 22 bp, Homo sapiens
tagagcttggactgcattttcg

SEQ ID NO: 8455941 - DNA, 22 bp, Homo sapiens
tagagctggaatttgcagcaag

SEQ ID NO: 8455942 - DNA, 22 bp, Homo sapiens
tagagctggaatttgcagcaag

SEQ ID NO: 8455943 - DNA, 22 bp, Homo sapiens
tagaatatgattaattttctta

SEQ ID NO: 8455944 - DNA, 22 bp, Homo sapiens
tagaatatgtggtgtatacttt

SEQ ID NO: 8455945 - DNA, 22 bp, Homo sapiens
tagaatcaagcagtagagcaga

SEQ ID NO: 8455946 - DNA, 21 bp, Homo sapiens
tagaatcactaataagatgta

SEQ ID NO: 8455947 - DNA, 22 bp, Homo sapiens
tagaatcaagcagtagagcaga

SEQ ID NO: 8455948 - DNA, 22 bp, Homo sapiens
caggctgggcagcctccccggc

SEQ ID NO: 8455949 - DNA, 22 bp, Homo sapiens
caggctgggcagcctccccggc

SEQ ID NO: 8455950 - DNA, 22 bp, Homo sapiens
caggctgggctccggagataaa

SEQ ID NO: 8455951 - DNA, 22 bp, Homo sapiens
caggctgggctccggagataaa

SEQ ID NO: 8455952 - DNA, 22 bp, Homo sapiens
caggctgggctccggagataaa

SEQ ID NO: 8455953 - DNA, 22 bp, Homo sapiens
caggctgggctccggagataaa

SEQ ID NO: 8455954 - DNA, 22 bp, Homo sapiens
caggctgggctggtgttagagt

SEQ ID NO: 8455955 - DNA, 22 bp, Homo sapiens
caggctgggctggtgttagagt

SEQ ID NO: 8455956 - DNA, 22 bp, Homo sapiens
caggctggtcccagagcattgc

SEQ ID NO: 8455957 - DNA, 22 bp, Homo sapiens
caggctgggctggtgttagagt

SEQ ID NO: 8455958 - DNA, 22 bp, Homo sapiens
tactgtctttccatccttgcct

SEQ ID NO: 8455959 - DNA, 22 bp, Homo sapiens
tactgtcttttcctaaatgggt

SEQ ID NO: 8455960 - DNA, 22 bp, Homo sapiens
tactgtctgggttcccaagcaa

SEQ ID NO: 8455961 - DNA, 22 bp, Homo sapiens
tactgtctggcaattaagaatc

SEQ ID NO: 8455962 - DNA, 22 bp, Homo sapiens
tactgtctttaggggtagaaat

SEQ ID NO: 8455963 - DNA, 23 bp, Homo sapiens
tactgtcttctattaagtaagga

SEQ ID NO: 8455964 - DNA, 22 bp, Homo sapiens
caggctggagtgagtgtagtgg

SEQ ID NO: 8455965 - DNA, 22 bp, Homo sapiens
caggctggagtacaattgtgtg

SEQ ID NO: 8455966 - DNA, 22 bp, Homo sapiens
caggctggagtgagtgtagtgg

SEQ ID NO: 8455967 - DNA, 22 bp, Homo sapiens
caggctggagtgagtgtagtgg

SEQ ID NO: 8455968 - DNA, 22 bp, Homo sapiens
caggctggagtgcaatggtgct

SEQ ID NO: 8455969 - DNA, 22 bp, Homo sapiens
caggctggagtgcagtggcgcc

SEQ ID NO: 8455970 - DNA, 22 bp, Homo sapiens
caggctggagtgcaatggcaca

SEQ ID NO: 8455971 - DNA, 22 bp, Homo sapiens
caggctggagtgcaatggcaca

SEQ ID NO: 8455972 - DNA, 22 bp, Homo sapiens
caggctggagtgcaatgacgcc

SEQ ID NO: 8455973 - DNA, 22 bp, Homo sapiens
caggctggagtgagtgtagtgg

SEQ ID NO: 8455974 - DNA, 22 bp, Homo sapiens
tagaatatacactacagcttaa

SEQ ID NO: 8455975 - DNA, 22 bp, Homo sapiens
tagaatacagtttaagaactac

SEQ ID NO: 8455976 - DNA, 22 bp, Homo sapiens
tagaacataagtcattcatttg

SEQ ID NO: 8455977 - DNA, 22 bp, Homo sapiens
tagaacatcaggttgaatttgg

SEQ ID NO: 8455978 - DNA, 22 bp, Homo sapiens
caggctggagtgcagtggggcg

SEQ ID NO: 8455979 - DNA, 22 bp, Homo sapiens
tagaacataagtcattcatttg

SEQ ID NO: 8455980 - DNA, 22 bp, Homo sapiens
caggctggagtgcagtggtgcc

SEQ ID NO: 8455981 - DNA, 22 bp, Homo sapiens
caggctggagtgcagtggcgct

SEQ ID NO: 8455982 - DNA, 22 bp, Homo sapiens
caggctggagtgcagtggcgct

SEQ ID NO: 8455983 - DNA, 22 bp, Homo sapiens
caggctggagtgcagtggcgcc

SEQ ID NO: 8455984 - DNA, 22 bp, Homo sapiens
caggctggagtgcagtggcgcc

SEQ ID NO: 8455985 - DNA, 22 bp, Homo sapiens
caggctggagtgcagtggggcg

SEQ ID NO: 8455986 - DNA, 22 bp, Homo sapiens
caggctggagtgcagtggggcg

SEQ ID NO: 8455987 - DNA, 22 bp, Homo sapiens
caggctggagtgcagtggcgct

SEQ ID NO: 8455988 - DNA, 22 bp, Homo sapiens
tactgtctaataagattgatgg

SEQ ID NO: 8455989 - DNA, 22 bp, Homo sapiens
tactgtatttgataagtgaagt

SEQ ID NO: 8455990 - DNA, 22 bp, Homo sapiens
tactgtctctgccctggccagg

SEQ ID NO: 8455991 - DNA, 22 bp, Homo sapiens
tactgtctatacacttgattac

SEQ ID NO: 8455992 - DNA, 22 bp, Homo sapiens
tactgtctgcttcttatagctt

SEQ ID NO: 8455993 - DNA, 22 bp, Homo sapiens
tactgtctggagttgccaaagg

SEQ ID NO: 8455994 - DNA, 21 bp, Homo sapiens
tactgtagccttgcactgtag

SEQ ID NO: 8455995 - DNA, 22 bp, Homo sapiens
tactgtatatgcttgtatctga

SEQ ID NO: 8455996 - DNA, 22 bp, Homo sapiens
tactattttgacatgaaattga

SEQ ID NO: 8455997 - DNA, 22 bp, Homo sapiens
tactatttggaattttaaattg

SEQ ID NO: 8455998 - DNA, 22 bp, Homo sapiens
tactatttttgcaacgtataca

SEQ ID NO: 8455999 - DNA, 22 bp, Homo sapiens
gtgaggggccaagagtagggca

SEQ ID NO: 8456000 - DNA, 22 bp, Homo sapiens
gtgaggggagtaaagccatgtt

SEQ ID NO: 8456001 - DNA, 22 bp, Homo sapiens
cagccctgtctatgactgatga

SEQ ID NO: 8456002 - DNA, 20 bp, Homo sapiens
cagccctgtgacctggccct

SEQ ID NO: 8456003 - DNA, 20 bp, Homo sapiens
cagccctgtgacctggccct

SEQ ID NO: 8456004 - DNA, 22 bp, Homo sapiens
gtgagggataatatgcggggtt

SEQ ID NO: 8456005 - DNA, 22 bp, Homo sapiens
gtgaggggtggctgagcagttt

SEQ ID NO: 8456006 - DNA, 22 bp, Homo sapiens
tgtaatcattacagtacatgga

SEQ ID NO: 8456007 - DNA, 22 bp, Homo sapiens
tgtaatgagaaagagagtgaat

SEQ ID NO: 8456008 - DNA, 22 bp, Homo sapiens
tgtaatggagcttagagttatc

SEQ ID NO: 8456009 - DNA, 22 bp, Homo sapiens
tgtaatggaaaaacattagcat

SEQ ID NO: 8456010 - DNA, 22 bp, Homo sapiens
tgtaatgatgtacttagaagga

SEQ ID NO: 8456011 - DNA, 22 bp, Homo sapiens
tgtaagttttgtgaaacaaaca

SEQ ID NO: 8456012 - DNA, 22 bp, Homo sapiens
tgtaataatgaggcatccagcc

SEQ ID NO: 8456013 - DNA, 20 bp, Homo sapiens
cctgctgtttccatggggcc

SEQ ID NO: 8456014 - DNA, 22 bp, Homo sapiens
cctgctgtgtgacgggatgtta

SEQ ID NO: 8456015 - DNA, 22 bp, Homo sapiens
cctgctttgctggtaccatcag

SEQ ID NO: 8456016 - DNA, 22 bp, Homo sapiens
tgtaaagagaagaaacgtgagc

SEQ ID NO: 8456017 - DNA, 22 bp, Homo sapiens
cctggaaaacatgggaatcaca

SEQ ID NO: 8456018 - DNA, 22 bp, Homo sapiens
tgtaaagacagataaaacagca

SEQ ID NO: 8456019 - DNA, 22 bp, Homo sapiens
tgtacagtgtagtcatgaggtt

SEQ ID NO: 8456020 - DNA, 22 bp, Homo sapiens
tgtacagtggaaaatggattcg

SEQ ID NO: 8456021 - DNA, 22 bp, Homo sapiens
tgtacagtgtaaataagtggat

SEQ ID NO: 8456022 - DNA, 22 bp, Homo sapiens
tgtaattatgttgttagagtat

SEQ ID NO: 8456023 - DNA, 22 bp, Homo sapiens
tgtaattaacgttcttgttaga

SEQ ID NO: 8456024 - DNA, 22 bp, Homo sapiens
tgtaattcattcaactgaagaa

SEQ ID NO: 8456025 - DNA, 22 bp, Homo sapiens
tgtaattatttctgtgcagtca

SEQ ID NO: 8456026 - DNA, 22 bp, Homo sapiens
tgtaatgggctactaggaagag

SEQ ID NO: 8456027 - DNA, 22 bp, Homo sapiens
tgtacatgaataaaagatcttg

SEQ ID NO: 8456028 - DNA, 22 bp, Homo sapiens
tgtacattgtcactcatcaagt

SEQ ID NO: 8456029 - DNA, 22 bp, Homo sapiens
tgtacattgtcactcatcaagt

SEQ ID NO: 8456030 - DNA, 22 bp, Homo sapiens
tgtacatttagagctcaataga

SEQ ID NO: 8456031 - DNA, 22 bp, Homo sapiens
cctggagcactctccctggctg

SEQ ID NO: 8456032 - DNA, 22 bp, Homo sapiens
cctggagcactctccctggctg

SEQ ID NO: 8456033 - DNA, 22 bp, Homo sapiens
cctggagggaccctggccctgt

SEQ ID NO: 8456034 - DNA, 22 bp, Homo sapiens
cctggagggcagcccattctgg

SEQ ID NO: 8456035 - DNA, 22 bp, Homo sapiens
cctggaggcggaggttgcagtg

SEQ ID NO: 8456036 - DNA, 22 bp, Homo sapiens
cctggaggctctgggagggcag

SEQ ID NO: 8456037 - DNA, 22 bp, Homo sapiens
cctggaggagcgctgaccagct

SEQ ID NO: 8456038 - DNA, 22 bp, Homo sapiens
cctggaggagcgctgaccagct

SEQ ID NO: 8456039 - DNA, 22 bp, Homo sapiens
cctggagcttttccatcctgga

SEQ ID NO: 8456040 - DNA, 22 bp, Homo sapiens
cctggagcttttccatcctgga

SEQ ID NO: 8456041 - DNA, 18 bp, Homo sapiens
cctggagctccacagcaa

SEQ ID NO: 8456042 - DNA, 22 bp, Homo sapiens
tgtcaacaccaaagcctcccag

SEQ ID NO: 8456043 - DNA, 22 bp, Homo sapiens
tgtcaacagatactagagagct

SEQ ID NO: 8456044 - DNA, 22 bp, Homo sapiens
tgtcaacattggctgacagttg

SEQ ID NO: 8456045 - DNA, 22 bp, Homo sapiens
tgtattcagtgatttcacaata

SEQ ID NO: 8456046 - DNA, 22 bp, Homo sapiens
tgtattcagtgcctagcatatg

SEQ ID NO: 8456047 - DNA, 22 bp, Homo sapiens
tgtattctctcaatatttcata

SEQ ID NO: 8456048 - DNA, 22 bp, Homo sapiens
tgtattcagtgcctagcatatg

SEQ ID NO: 8456049 - DNA, 23 bp, Homo sapiens
tgtcaacaaaactttcaggagaa

SEQ ID NO: 8456050 - DNA, 22 bp, Homo sapiens
cctggaggggaccaggaccagg

SEQ ID NO: 8456051 - DNA, 22 bp, Homo sapiens
cctggagggcgccgcacagtcc

SEQ ID NO: 8456052 - DNA, 22 bp, Homo sapiens
tgggtcagaatcagagagttgc

SEQ ID NO: 8456053 - DNA, 18 bp, Homo sapiens
cctgccagtctggagcag

SEQ ID NO: 8456054 - DNA, 22 bp, Homo sapiens
cctgccaggcgagtctaggcca

SEQ ID NO: 8456055 - DNA, 22 bp, Homo sapiens
cctgccaggcgagtctaggcca

SEQ ID NO: 8456056 - DNA, 22 bp, Homo sapiens
cctgccaggccagtgagcttcc

SEQ ID NO: 8456057 - DNA, 22 bp, Homo sapiens
cctgccaggctttgggcttctg

SEQ ID NO: 8456058 - DNA, 22 bp, Homo sapiens
cctgccaggctttcaggtttgg

SEQ ID NO: 8456059 - DNA, 22 bp, Homo sapiens
cctgccagggccagaggccagc

SEQ ID NO: 8456060 - DNA, 22 bp, Homo sapiens
cctgccagggccagaggccagc

SEQ ID NO: 8456061 - DNA, 22 bp, Homo sapiens
cctgccagggccttggaagaaa

SEQ ID NO: 8456062 - DNA, 18 bp, Homo sapiens
cctgccagtctggagcag

SEQ ID NO: 8456063 - DNA, 22 bp, Homo sapiens
cctgccagtcactatgtcacct

SEQ ID NO: 8456064 - DNA, 20 bp, Homo sapiens
cctgcctgcctcggctcatt

SEQ ID NO: 8456065 - DNA, 22 bp, Homo sapiens
cctgcctgcctgctggccggga

SEQ ID NO: 8456066 - DNA, 20 bp, Homo sapiens
cctgcctgcctcggctcatt

SEQ ID NO: 8456067 - DNA, 22 bp, Homo sapiens
cctgcctggggacaaaggaggg

SEQ ID NO: 8456068 - DNA, 23 bp, Homo sapiens
cctgcctgttctaactccatttc

SEQ ID NO: 8456069 - DNA, 22 bp, Homo sapiens
cctgcctgtccctcagtccaca

SEQ ID NO: 8456070 - DNA, 22 bp, Homo sapiens
cctgcctgtccctcagtccaca

SEQ ID NO: 8456071 - DNA, 22 bp, Homo sapiens
cctgctgtcccctgagcctgga

SEQ ID NO: 8456072 - DNA, 22 bp, Homo sapiens
cctgctgtcagtggggcaggca

SEQ ID NO: 8456073 - DNA, 22 bp, Homo sapiens
cctgctgtcagtggggcaggca

SEQ ID NO: 8456074 - DNA, 22 bp, Homo sapiens
cctgctgtaatgtgtctttatt

SEQ ID NO: 8456075 - DNA, 22 bp, Homo sapiens
cctgctgtagggcccctggggc

SEQ ID NO: 8456076 - DNA, 22 bp, Homo sapiens
cctgctgtgaaactggcatatg

SEQ ID NO: 8456077 - DNA, 22 bp, Homo sapiens
cctgctgtctgctgtgttaagc

SEQ ID NO: 8456078 - DNA, 22 bp, Homo sapiens
cctgctgtctctgggcaggcag

SEQ ID NO: 8456079 - DNA, 22 bp, Homo sapiens
cctgctgtgaccggggagcagg

SEQ ID NO: 8456080 - DNA, 20 bp, Homo sapiens
cctgctgtgctttccatgga

SEQ ID NO: 8456081 - DNA, 22 bp, Homo sapiens
cctgctggcgtggctggcgccc

SEQ ID NO: 8456082 - DNA, 22 bp, Homo sapiens
cctgctggctggtagagttccg

SEQ ID NO: 8456083 - DNA, 20 bp, Homo sapiens
cctgctgggaaccctctgaa

SEQ ID NO: 8456084 - DNA, 22 bp, Homo sapiens
cctgctgggcctgagcaatgag

SEQ ID NO: 8456085 - DNA, 22 bp, Homo sapiens
cctgctggcattcttgctccct

SEQ ID NO: 8456086 - DNA, 22 bp, Homo sapiens
cctgctggccagtggagggctg

SEQ ID NO: 8456087 - DNA, 22 bp, Homo sapiens
cctgctggcgcttgtctgggag

SEQ ID NO: 8456088 - DNA, 22 bp, Homo sapiens
cctgctggcggggacccagtga

SEQ ID NO: 8456089 - DNA, 22 bp, Homo sapiens
tggtctgataccggattccagt

SEQ ID NO: 8456090 - DNA, 22 bp, Homo sapiens
tggtctgaggaacaccagcact

SEQ ID NO: 8456091 - DNA, 22 bp, Homo sapiens
tggtctgattcttgctccccaa

SEQ ID NO: 8456092 - DNA, 23 bp, Homo sapiens
tggtctgaagcctcaggttcctc

SEQ ID NO: 8456093 - DNA, 22 bp, Homo sapiens
tggtctcttcttccaagatggc

SEQ ID NO: 8456094 - DNA, 22 bp, Homo sapiens
cctgctgctatgaaggtgacag

SEQ ID NO: 8456095 - DNA, 22 bp, Homo sapiens
cctgctggacgtggaggagggg

SEQ ID NO: 8456096 - DNA, 22 bp, Homo sapiens
cctgctggacaggggtgttcat

SEQ ID NO: 8456097 - DNA, 17 bp, Homo sapiens
tggtctggaagaactga

SEQ ID NO: 8456098 - DNA, 22 bp, Homo sapiens
tggtctggggaccgagggttac

SEQ ID NO: 8456099 - DNA, 20 bp, Homo sapiens
tggtctggagccagtgagga

SEQ ID NO: 8456100 - DNA, 22 bp, Homo sapiens
tggtctgggcaaatccttctga

SEQ ID NO: 8456101 - DNA, 22 bp, Homo sapiens
cctctttgttcaggctgctggc

SEQ ID NO: 8456102 - DNA, 22 bp, Homo sapiens
cctctttgtgcctgcaggctgc

SEQ ID NO: 8456103 - DNA, 22 bp, Homo sapiens
cctctttgactctcaggtcttt

SEQ ID NO: 8456104 - DNA, 22 bp, Homo sapiens
cctctttgagattcagttttcc

SEQ ID NO: 8456105 - DNA, 18 bp, Homo sapiens
cctgaagcctgtgtcttt

SEQ ID NO: 8456106 - DNA, 17 bp, Homo sapiens
cctgaaggcacttccag

SEQ ID NO: 8456107 - DNA, 22 bp, Homo sapiens
tgggccagcaattgctgctcag

SEQ ID NO: 8456108 - DNA, 22 bp, Homo sapiens
cctcttggagtctatcattctg

SEQ ID NO: 8456109 - DNA, 22 bp, Homo sapiens
cctctttgacaagtacctgccc

SEQ ID NO: 8456110 - DNA, 22 bp, Homo sapiens
cctctttgactatagtagttaa

SEQ ID NO: 8456111 - DNA, 22 bp, Homo sapiens
tgggccagagagtaagaaaggt

SEQ ID NO: 8456112 - DNA, 22 bp, Homo sapiens
tgggccagaggcatggagctat

SEQ ID NO: 8456113 - DNA, 21 bp, Homo sapiens
tgggccagatctgagtttcta

SEQ ID NO: 8456114 - DNA, 22 bp, Homo sapiens
cctctggccacatgggacatag

SEQ ID NO: 8456115 - DNA, 22 bp, Homo sapiens
cctctggccagagaaaggccag

SEQ ID NO: 8456116 - DNA, 22 bp, Homo sapiens
cctctggccatcccccattaag

SEQ ID NO: 8456117 - DNA, 22 bp, Homo sapiens
cctctggcctaggccgggagag

SEQ ID NO: 8456118 - DNA, 22 bp, Homo sapiens
cctctggccattctttgatgga

SEQ ID NO: 8456119 - DNA, 22 bp, Homo sapiens
tgggccactaccttctctggat

SEQ ID NO: 8456120 - DNA, 22 bp, Homo sapiens
cctctggctcacagcaccaact

SEQ ID NO: 8456121 - DNA, 22 bp, Homo sapiens
tgggccactcttccctgggtct

SEQ ID NO: 8456122 - DNA, 22 bp, Homo sapiens
tgggccactgctgcggaaggcg

SEQ ID NO: 8456123 - DNA, 22 bp, Homo sapiens
tgggagcctggcaggccagagg

SEQ ID NO: 8456124 - DNA, 22 bp, Homo sapiens
tgggagcctggcaggccagagg

SEQ ID NO: 8456125 - DNA, 22 bp, Homo sapiens
tgggagccattttagaggctgc

SEQ ID NO: 8456126 - DNA, 22 bp, Homo sapiens
tgggagcagttgtgaagctcag

SEQ ID NO: 8456127 - DNA, 22 bp, Homo sapiens
tgggagcaggtgtgctagggaa

SEQ ID NO: 8456128 - DNA, 22 bp, Homo sapiens
tgggagcagttcaggtgtggct

SEQ ID NO: 8456129 - DNA, 22 bp, Homo sapiens
cctctggcaacttcacagccca

SEQ ID NO: 8456130 - DNA, 22 bp, Homo sapiens
cctctggcaagtgatttatcat

SEQ ID NO: 8456131 - DNA, 16 bp, Homo sapiens
cctctggcaattagat

SEQ ID NO: 8456132 - DNA, 22 bp, Homo sapiens
cctctggcagccagccagttgt

SEQ ID NO: 8456133 - DNA, 22 bp, Homo sapiens
cctctggcatagcaagtggcct

SEQ ID NO: 8456134 - DNA, 23 bp, Homo sapiens
tgggagctcaagggaggctgccc

SEQ ID NO: 8456135 - DNA, 22 bp, Homo sapiens
tgggagctcagaaagggaggtc

SEQ ID NO: 8456136 - DNA, 22 bp, Homo sapiens
cctctggatctttctccacact

SEQ ID NO: 8456137 - DNA, 22 bp, Homo sapiens
cctctggcaacttcacagccca

SEQ ID NO: 8456138 - DNA, 23 bp, Homo sapiens
tggctctctcagtgctgcagagg

SEQ ID NO: 8456139 - DNA, 23 bp, Homo sapiens
tggctctctcagtgctgcagagg

SEQ ID NO: 8456140 - DNA, 22 bp, Homo sapiens
cctccctgccggctggactagt

SEQ ID NO: 8456141 - DNA, 22 bp, Homo sapiens
tgggagcaggctgatgataggt

SEQ ID NO: 8456142 - DNA, 22 bp, Homo sapiens
tggctctgaccaggtagaggag

SEQ ID NO: 8456143 - DNA, 22 bp, Homo sapiens
tggctctgaccaggtagaggag

SEQ ID NO: 8456144 - DNA, 21 bp, Homo sapiens
tgggagagcgttgctgtcctc

SEQ ID NO: 8456145 - DNA, 22 bp, Homo sapiens
tggctctctgggaggtcctggc

SEQ ID NO: 8456146 - DNA, 21 bp, Homo sapiens
tggctctgaaagagtgctgca

SEQ ID NO: 8456147 - DNA, 21 bp, Homo sapiens
tggctctgaaagagtgctgca

SEQ ID NO: 8456148 - DNA, 22 bp, Homo sapiens
cctgacaggcggaggctgcagt

SEQ ID NO: 8456149 - DNA, 22 bp, Homo sapiens
cctgacagttaattgtcctgta

SEQ ID NO: 8456150 - DNA, 23 bp, Homo sapiens
cctgaccctgtctccctcacatg

SEQ ID NO: 8456151 - DNA, 22 bp, Homo sapiens
cctgagaaacctggtgcaatta

SEQ ID NO: 8456152 - DNA, 22 bp, Homo sapiens
cctgactctggccaggccagct

SEQ ID NO: 8456153 - DNA, 22 bp, Homo sapiens
cctgagaatgtttaacagagaa

SEQ ID NO: 8456154 - DNA, 22 bp, Homo sapiens
cctgagaatttgtggttcagga

SEQ ID NO: 8456155 - DNA, 22 bp, Homo sapiens
cctgagacatgaaccaggctcc

SEQ ID NO: 8456156 - DNA, 22 bp, Homo sapiens
cctgagaaatagcatcattttt

SEQ ID NO: 8456157 - DNA, 22 bp, Homo sapiens
cctgagaagagcttatgagtga

SEQ ID NO: 8456158 - DNA, 22 bp, Homo sapiens
cctgagaaatagcatcattttt

SEQ ID NO: 8456159 - DNA, 22 bp, Homo sapiens
cctgagaataattctccatagc

SEQ ID NO: 8456160 - DNA, 22 bp, Homo sapiens
cctgaggccctggctgtgctga

SEQ ID NO: 8456161 - DNA, 22 bp, Homo sapiens
cctgagcttgatccttctgtct

SEQ ID NO: 8456162 - DNA, 22 bp, Homo sapiens
cctgaggctggcccttccatcc

SEQ ID NO: 8456163 - DNA, 22 bp, Homo sapiens
cctgaggctccacctccagaga

SEQ ID NO: 8456164 - DNA, 22 bp, Homo sapiens
cctgaggctcgcgcgcccctgg

SEQ ID NO: 8456165 - DNA, 22 bp, Homo sapiens
cctgagggcgtaattaacagtg

SEQ ID NO: 8456166 - DNA, 22 bp, Homo sapiens
cctgagggagggtataggctgt

SEQ ID NO: 8456167 - DNA, 22 bp, Homo sapiens
cctgagggcgccgagctcccag

SEQ ID NO: 8456168 - DNA, 22 bp, Homo sapiens
cctgagggatctgtggaatagc

SEQ ID NO: 8456169 - DNA, 22 bp, Homo sapiens
cctgaggggctgcaggccagct

SEQ ID NO: 8456170 - DNA, 22 bp, Homo sapiens
cctgagggaacatgcacccaat

SEQ ID NO: 8456171 - DNA, 22 bp, Homo sapiens
cctgaggcttaatctgtcccaa

SEQ ID NO: 8456172 - DNA, 22 bp, Homo sapiens
cctgcaagactatttagttcca

SEQ ID NO: 8456173 - DNA, 22 bp, Homo sapiens
cctgcaagacctgagacacacc

SEQ ID NO: 8456174 - DNA, 23 bp, Homo sapiens
cctgcaaagaaacaagccacctg

SEQ ID NO: 8456175 - DNA, 22 bp, Homo sapiens
cctgcaccacactcactgctca

SEQ ID NO: 8456176 - DNA, 22 bp, Homo sapiens
cctgcaccacaaggcttcagag

SEQ ID NO: 8456177 - DNA, 22 bp, Homo sapiens
cctgattagggtctttcaaatg

SEQ ID NO: 8456178 - DNA, 22 bp, Homo sapiens
cctgcacctctgtgcttggaac

SEQ ID NO: 8456179 - DNA, 22 bp, Homo sapiens
cctgcacctgagcagcctgact

SEQ ID NO: 8456180 - DNA, 22 bp, Homo sapiens
cctgcaccttcaagaaaataat

SEQ ID NO: 8456181 - DNA, 22 bp, Homo sapiens
cctgcacctgccatgtgagata

SEQ ID NO: 8456182 - DNA, 22 bp, Homo sapiens
cctgcacccaggccgcacctct

SEQ ID NO: 8456183 - DNA, 22 bp, Homo sapiens
cctgcaccaggcccagcatggt

SEQ ID NO: 8456184 - DNA, 22 bp, Homo sapiens
cctgcaccaggcccagcatggt

SEQ ID NO: 8456185 - DNA, 22 bp, Homo sapiens
cctgcacctaacacaacgctct

SEQ ID NO: 8456186 - DNA, 22 bp, Homo sapiens
cctgccaggagctggtgctgca

SEQ ID NO: 8456187 - DNA, 22 bp, Homo sapiens
cctgccaggagctggtgctgca

SEQ ID NO: 8456188 - DNA, 22 bp, Homo sapiens
cctgccagacgcaccagggggc

SEQ ID NO: 8456189 - DNA, 22 bp, Homo sapiens
cctgccagacgcaccagggggc

SEQ ID NO: 8456190 - DNA, 22 bp, Homo sapiens
cctgccagacgcaccagggggc

SEQ ID NO: 8456191 - DNA, 22 bp, Homo sapiens
tgggggtgtcctggtgcacaca

SEQ ID NO: 8456192 - DNA, 22 bp, Homo sapiens
tgggggtggttcttgcctccag

SEQ ID NO: 8456193 - DNA, 22 bp, Homo sapiens
tgggggtgtgccagggacctcc

SEQ ID NO: 8456194 - DNA, 22 bp, Homo sapiens
tgggggtgtgccagggacctcc

SEQ ID NO: 8456195 - DNA, 22 bp, Homo sapiens
cctgaggtcagccattcttgcc

SEQ ID NO: 8456196 - DNA, 22 bp, Homo sapiens
cctgaggtcacaacttgcttat

SEQ ID NO: 8456197 - DNA, 22 bp, Homo sapiens
cctgagggtcaaggagccctag

SEQ ID NO: 8456198 - DNA, 22 bp, Homo sapiens
tgggggtggttcttgcctccag

SEQ ID NO: 8456199 - DNA, 22 bp, Homo sapiens
tgggggtgtcctggtgcacaca

SEQ ID NO: 8456200 - DNA, 22 bp, Homo sapiens
ccctggtgccctgggtcagcct

SEQ ID NO: 8456201 - DNA, 22 bp, Homo sapiens
ccctggtggggccagacttgct

SEQ ID NO: 8456202 - DNA, 22 bp, Homo sapiens
ccctgggataccagacaccaga

SEQ ID NO: 8456203 - DNA, 22 bp, Homo sapiens
ccctggtggtacggcactggca

SEQ ID NO: 8456204 - DNA, 22 bp, Homo sapiens
ccctggtggtacggcactggca

SEQ ID NO: 8456205 - DNA, 22 bp, Homo sapiens
ccctggtgtggatgtgattggc

SEQ ID NO: 8456206 - DNA, 22 bp, Homo sapiens
ccctgtctcattgatcacttgt

SEQ ID NO: 8456207 - DNA, 22 bp, Homo sapiens
ccctgtgcctcagtttcctcat

SEQ ID NO: 8456208 - DNA, 22 bp, Homo sapiens
ccctgtgccagagaggcaggag

SEQ ID NO: 8456209 - DNA, 22 bp, Homo sapiens
ccctgtgctgtcatgctgggcg

SEQ ID NO: 8456210 - DNA, 22 bp, Homo sapiens
ccctgtgcacacacttcactct

SEQ ID NO: 8456211 - DNA, 22 bp, Homo sapiens
ccctgtgcagatggcagctggg

SEQ ID NO: 8456212 - DNA, 22 bp, Homo sapiens
ccctgtgcattggagggtgttt

SEQ ID NO: 8456213 - DNA, 22 bp, Homo sapiens
ccggctactcgggaggctgacg

SEQ ID NO: 8456214 - DNA, 22 bp, Homo sapiens
ccgtggtcacctgagctccttg

SEQ ID NO: 8456215 - DNA, 22 bp, Homo sapiens
ccgggctggagtgcaatggctc

SEQ ID NO: 8456216 - DNA, 22 bp, Homo sapiens
ccgggttgaggttcccatagat

SEQ ID NO: 8456217 - DNA, 22 bp, Homo sapiens
ccggtcccaggtgccccggtga

SEQ ID NO: 8456218 - DNA, 22 bp, Homo sapiens
ccggctactcgggaggctgacg

SEQ ID NO: 8456219 - DNA, 22 bp, Homo sapiens
ccggctactcgggaggctgacg

SEQ ID NO: 8456220 - DNA, 22 bp, Homo sapiens
ccggctactcgggaggctgacg

SEQ ID NO: 8456221 - DNA, 22 bp, Homo sapiens
ccgggcctcgggacaccgggta

SEQ ID NO: 8456222 - DNA, 22 bp, Homo sapiens
ccgggagcaggcgccaccgcca

SEQ ID NO: 8456223 - DNA, 22 bp, Homo sapiens
cctaaagaattttcatagagct

SEQ ID NO: 8456224 - DNA, 22 bp, Homo sapiens
cctatttgtaggctgggccagt

SEQ ID NO: 8456225 - DNA, 21 bp, Homo sapiens
cctcaaagatgatggggtttc

SEQ ID NO: 8456226 - DNA, 22 bp, Homo sapiens
cctcacccagtcacctaggtgg

SEQ ID NO: 8456227 - DNA, 22 bp, Homo sapiens
cctcacccagtcacctaggtgg

SEQ ID NO: 8456228 - DNA, 22 bp, Homo sapiens
cctcacccagtcacctaggtgg

SEQ ID NO: 8456229 - DNA, 22 bp, Homo sapiens
cctcacccactacactcaaggg

SEQ ID NO: 8456230 - DNA, 22 bp, Homo sapiens
cctcacccactacactcaaggg

SEQ ID NO: 8456231 - DNA, 22 bp, Homo sapiens
cctcacagtttggctaactgtg

SEQ ID NO: 8456232 - DNA, 22 bp, Homo sapiens
cctcacagcttttcaaagtgga

SEQ ID NO: 8456233 - DNA, 22 bp, Homo sapiens
tggctacaagtgtgtttagttt

SEQ ID NO: 8456234 - DNA, 22 bp, Homo sapiens
tggctacatttatactctcatt

SEQ ID NO: 8456235 - DNA, 23 bp, Homo sapiens
tggctactttatgaggttgagga

SEQ ID NO: 8456236 - DNA, 22 bp, Homo sapiens
tggctactcaacatgtactcat

SEQ ID NO: 8456237 - DNA, 22 bp, Homo sapiens
tggctcagcctggccctttcat

SEQ ID NO: 8456238 - DNA, 22 bp, Homo sapiens
tggctcagccattcgtgttgcc

SEQ ID NO: 8456239 - DNA, 22 bp, Homo sapiens
tggctcagcgcggcctggtctt

SEQ ID NO: 8456240 - DNA, 22 bp, Homo sapiens
tggctcagcgcggcctggtctt

SEQ ID NO: 8456241 - DNA, 22 bp, Homo sapiens
cctccccatgacccggtgctgg

SEQ ID NO: 8456242 - DNA, 22 bp, Homo sapiens
cctcccagatgtgcccaatgga

SEQ ID NO: 8456243 - DNA, 22 bp, Homo sapiens
cctcccctcagacagagactgg

SEQ ID NO: 8456244 - DNA, 22 bp, Homo sapiens
cctccccatgacccggtgctgg

SEQ ID NO: 8456245 - DNA, 23 bp, Homo sapiens
tggctcagctagttttccatttc

SEQ ID NO: 8456246 - DNA, 22 bp, Homo sapiens
tggctcagcggtggcagcagac

SEQ ID NO: 8456247 - DNA, 22 bp, Homo sapiens
tggctcagcggtggcagcagac

SEQ ID NO: 8456248 - DNA, 19 bp, Homo sapiens
cctccccttggaccagcaa

SEQ ID NO: 8456249 - DNA, 22 bp, Homo sapiens
cctccctctgttagagctgtct

SEQ ID NO: 8456250 - DNA, 22 bp, Homo sapiens
cctccctctttcagtcccacag

SEQ ID NO: 8456251 - DNA, 22 bp, Homo sapiens
cctccctctttcagtcccacag

SEQ ID NO: 8456252 - DNA, 22 bp, Homo sapiens
cctccctccattgccatcgtct

SEQ ID NO: 8456253 - DNA, 22 bp, Homo sapiens
tggctaacaaggtgaaaccccg

SEQ ID NO: 8456254 - DNA, 22 bp, Homo sapiens
tggctaacaaggtgaaaccccg

SEQ ID NO: 8456255 - DNA, 22 bp, Homo sapiens
tggctaacaaggtgaaaccccg

SEQ ID NO: 8456256 - DNA, 22 bp, Homo sapiens
cctcagctgtcttttccgaggt

SEQ ID NO: 8456257 - DNA, 22 bp, Homo sapiens
cctcagctgcttccctggagcc

SEQ ID NO: 8456258 - DNA, 22 bp, Homo sapiens
cctcagctcccatgagatctgc

SEQ ID NO: 8456259 - DNA, 22 bp, Homo sapiens
cctcagctcccatgagatctgc

SEQ ID NO: 8456260 - DNA, 22 bp, Homo sapiens
tggcctctcctggcagcatcca

SEQ ID NO: 8456261 - DNA, 22 bp, Homo sapiens
tggcctcggcatccagcaagag

SEQ ID NO: 8456262 - DNA, 22 bp, Homo sapiens
tggcctcggcatccagcaagag

SEQ ID NO: 8456263 - DNA, 23 bp, Homo sapiens
cctcagcatggcaggagcccagc

SEQ ID NO: 8456264 - DNA, 23 bp, Homo sapiens
cctcagcatggcaggagcccagc

SEQ ID NO: 8456265 - DNA, 22 bp, Homo sapiens
cctcagcatcctggtgaagtag

SEQ ID NO: 8456266 - DNA, 22 bp, Homo sapiens
cctcagccttggccccaggcag

SEQ ID NO: 8456267 - DNA, 22 bp, Homo sapiens
tggcctcccctaacagcctctt

SEQ ID NO: 8456268 - DNA, 22 bp, Homo sapiens
tggcctcagattattgcacagt

SEQ ID NO: 8456269 - DNA, 22 bp, Homo sapiens
tggcctcaaccgtcctaagcac

SEQ ID NO: 8456270 - DNA, 22 bp, Homo sapiens
tggcctcaatctgtcctccagc

SEQ ID NO: 8456271 - DNA, 22 bp, Homo sapiens
tggcctcaatctgtcctccagc

SEQ ID NO: 8456272 - DNA, 22 bp, Homo sapiens
cctcagaagctcaaggacattg

SEQ ID NO: 8456273 - DNA, 22 bp, Homo sapiens
tggcctcaaccgtcctaagcac

SEQ ID NO: 8456274 - DNA, 22 bp, Homo sapiens
cctcagaagaagtggaattgat

SEQ ID NO: 8456275 - DNA, 19 bp, Homo sapiens
cctcaccctgcagaggagg

SEQ ID NO: 8456276 - DNA, 19 bp, Homo sapiens
cctcaccctgcagaggagg

SEQ ID NO: 8456277 - DNA, 19 bp, Homo sapiens
cctcaccctgcagaggagg

SEQ ID NO: 8456278 - DNA, 22 bp, Homo sapiens
ccctgcagtgtgacctcaccta

SEQ ID NO: 8456279 - DNA, 22 bp, Homo sapiens
ccctgcagtcctttcttggctc

SEQ ID NO: 8456280 - DNA, 22 bp, Homo sapiens
ccctgcctctgaagctgctcag

SEQ ID NO: 8456281 - DNA, 22 bp, Homo sapiens
ccctgcctctgaagctgctcag

SEQ ID NO: 8456282 - DNA, 22 bp, Homo sapiens
ccctgcctgtgggcatcaacat

SEQ ID NO: 8456283 - DNA, 22 bp, Homo sapiens
ccctgcctgtgggcatcaacat

SEQ ID NO: 8456284 - DNA, 22 bp, Homo sapiens
tggacaggttgagtaggaggag

SEQ ID NO: 8456285 - DNA, 22 bp, Homo sapiens
tggacaggttgagtaggaggag

SEQ ID NO: 8456286 - DNA, 22 bp, Homo sapiens
tggacaggtttgggtgcctgtt

SEQ ID NO: 8456287 - DNA, 22 bp, Homo sapiens
tggacagttactgagcttgagt

SEQ ID NO: 8456288 - DNA, 22 bp, Homo sapiens
ccctgcagaaccacagacaaac

SEQ ID NO: 8456289 - DNA, 17 bp, Homo sapiens
ccctgcaccctactctc

SEQ ID NO: 8456290 - DNA, 22 bp, Homo sapiens
ccctgcagatcagtgagaactt

SEQ ID NO: 8456291 - DNA, 22 bp, Homo sapiens
ccctgcagagggatgggggcag

SEQ ID NO: 8456292 - DNA, 20 bp, Homo sapiens
ccctgcagccatgggagtgg

SEQ ID NO: 8456293 - DNA, 22 bp, Homo sapiens
ccctgcagccggccagctcatt

SEQ ID NO: 8456294 - DNA, 22 bp, Homo sapiens
ccctgccttgttggagcctatg

SEQ ID NO: 8456295 - DNA, 22 bp, Homo sapiens
ccctgccttgttggagcctatg

SEQ ID NO: 8456296 - DNA, 22 bp, Homo sapiens
ccctgccttgttggagcctatg

SEQ ID NO: 8456297 - DNA, 22 bp, Homo sapiens
ccctgctgaatcccatggagtc

SEQ ID NO: 8456298 - DNA, 22 bp, Homo sapiens
ccctgctagttgtctcagtgat

SEQ ID NO: 8456299 - DNA, 22 bp, Homo sapiens
tggaggtctgcaaggcgctgga

SEQ ID NO: 8456300 - DNA, 22 bp, Homo sapiens
tggaggtcgcgcgggtgctgca

SEQ ID NO: 8456301 - DNA, 22 bp, Homo sapiens
tggaggtacataatgagagggt

SEQ ID NO: 8456302 - DNA, 22 bp, Homo sapiens
tggagggtcaccccttgctgag

SEQ ID NO: 8456303 - DNA, 22 bp, Homo sapiens
tggaggtgagtgtggtacagca

SEQ ID NO: 8456304 - DNA, 22 bp, Homo sapiens
tggaagggaacaggtgggtgtt

SEQ ID NO: 8456305 - DNA, 22 bp, Homo sapiens
tggaagggaacaggtgggtgtt

SEQ ID NO: 8456306 - DNA, 22 bp, Homo sapiens
tggaagggaaagtttggggtcc

SEQ ID NO: 8456307 - DNA, 22 bp, Homo sapiens
tggaagggaaagtttggggtcc

SEQ ID NO: 8456308 - DNA, 22 bp, Homo sapiens
tggaaggcctgttgtgtcctag

SEQ ID NO: 8456309 - DNA, 22 bp, Homo sapiens
tggaaggcctgttgtgtcctag

SEQ ID NO: 8456310 - DNA, 22 bp, Homo sapiens
tggaaggctgtgattactgtgc

SEQ ID NO: 8456311 - DNA, 21 bp, Homo sapiens
tggaaggctgctctgccaggg

SEQ ID NO: 8456312 - DNA, 22 bp, Homo sapiens
tggaagaatttggggataaatt

SEQ ID NO: 8456313 - DNA, 22 bp, Homo sapiens
tggaagaatgtttgccttataa

SEQ ID NO: 8456314 - DNA, 22 bp, Homo sapiens
tggaagaatgctccacagggaa

SEQ ID NO: 8456315 - DNA, 20 bp, Homo sapiens
tggaagacactgaagggcca

SEQ ID NO: 8456316 - DNA, 22 bp, Homo sapiens
cccgggttgtccgcgcgtccgg

SEQ ID NO: 8456317 - DNA, 22 bp, Homo sapiens
tggaagaagctacaagcggtga

SEQ ID NO: 8456318 - DNA, 22 bp, Homo sapiens
tggaagaagctacaagcggtga

SEQ ID NO: 8456319 - DNA, 22 bp, Homo sapiens
tggaagaaggcagagaggcatt

SEQ ID NO: 8456320 - DNA, 22 bp, Homo sapiens
tggaagaataggatagaagaac

SEQ ID NO: 8456321 - DNA, 22 bp, Homo sapiens
tggaagaatatgggggtacaga

SEQ ID NO: 8456322 - DNA, 22 bp, Homo sapiens
tggaagaatagaagatggttga

SEQ ID NO: 8456323 - DNA, 20 bp, Homo sapiens
tggaagaagaactcaggctt

SEQ ID NO: 8456324 - DNA, 22 bp, Homo sapiens
tggaaagacatgtccttcatta

SEQ ID NO: 8456325 - DNA, 22 bp, Homo sapiens
tggaaagacattcagccgctgg

SEQ ID NO: 8456326 - DNA, 22 bp, Homo sapiens
ccctagaacacgcagacactga

SEQ ID NO: 8456327 - DNA, 22 bp, Homo sapiens
ccctagaacacgcagacactga

SEQ ID NO: 8456328 - DNA, 22 bp, Homo sapiens
ccctagaaatgaaagcatacgt

SEQ ID NO: 8456329 - DNA, 17 bp, Homo sapiens
tgcctccagcagggtga

SEQ ID NO: 8456330 - DNA, 22 bp, Homo sapiens
tgcctcagtttcatctgcagaa

SEQ ID NO: 8456331 - DNA, 22 bp, Homo sapiens
tgcctcagtttcatctgcagaa

SEQ ID NO: 8456332 - DNA, 22 bp, Homo sapiens
tgcctcagtttcatctgcagaa

SEQ ID NO: 8456333 - DNA, 22 bp, Homo sapiens
tgcctcagtttctccatatgaa

SEQ ID NO: 8456334 - DNA, 22 bp, Homo sapiens
tgcctcagtttctccatatgaa

SEQ ID NO: 8456335 - DNA, 22 bp, Homo sapiens
tgcctccaacagcccatcctag

SEQ ID NO: 8456336 - DNA, 22 bp, Homo sapiens
tgcctccaccattgctcacttt

SEQ ID NO: 8456337 - DNA, 22 bp, Homo sapiens
tgcctgccttgctgctggacag

SEQ ID NO: 8456338 - DNA, 22 bp, Homo sapiens
tgcctgcctctggagcccatcc

SEQ ID NO: 8456339 - DNA, 22 bp, Homo sapiens
tgcctgcctctggcagccctgc

SEQ ID NO: 8456340 - DNA, 18 bp, Homo sapiens
tgcctgccccgtaagggt

SEQ ID NO: 8456341 - DNA, 22 bp, Homo sapiens
tgcctgcctaggaagctgtgaa

SEQ ID NO: 8456342 - DNA, 22 bp, Homo sapiens
tgctttatttataaaatagcaa

SEQ ID NO: 8456343 - DNA, 21 bp, Homo sapiens
tgatacaggaatggttctatg

SEQ ID NO: 8456344 - DNA, 22 bp, Homo sapiens
tgatacagtcagctcacaattg

SEQ ID NO: 8456345 - DNA, 22 bp, Homo sapiens
tgaggcagtgatgtttaagcac

SEQ ID NO: 8456346 - DNA, 18 bp, Homo sapiens
tgaggcagtcagtgatgg

SEQ ID NO: 8456347 - DNA, 18 bp, Homo sapiens
tgaggcagtcagtgatgg

SEQ ID NO: 8456348 - DNA, 22 bp, Homo sapiens
tgatgacagcaaaaaatgctag

SEQ ID NO: 8456349 - DNA, 22 bp, Homo sapiens
tgatgacaatgttgctgcaata

SEQ ID NO: 8456350 - DNA, 22 bp, Homo sapiens
tgatgacagtgttacagctcca

SEQ ID NO: 8456351 - DNA, 22 bp, Homo sapiens
tgatgacatgtgggctgtggct

SEQ ID NO: 8456352 - DNA, 22 bp, Homo sapiens
tgatgaattagtaacaaatgag

SEQ ID NO: 8456353 - DNA, 22 bp, Homo sapiens
tgatgacaaactttcctgatgc

SEQ ID NO: 8456354 - DNA, 22 bp, Homo sapiens
tgatgacatgtgggctgtggct

SEQ ID NO: 8456355 - DNA, 22 bp, Homo sapiens
tgatgagagaggtcattgaaat

SEQ ID NO: 8456356 - DNA, 22 bp, Homo sapiens
tgatgaggacccatcacctggt

SEQ ID NO: 8456357 - DNA, 22 bp, Homo sapiens
tgatgaggagactgtggcttgg

SEQ ID NO: 8456358 - DNA, 22 bp, Homo sapiens
tgatgaggacctggtctctgct

SEQ ID NO: 8456359 - DNA, 22 bp, Homo sapiens
tgatgagggaactggttcatac

SEQ ID NO: 8456360 - DNA, 22 bp, Homo sapiens
tgatgaggcatatgctacacat

SEQ ID NO: 8456361 - DNA, 22 bp, Homo sapiens
tgatgaggcttcttggtgaaca

SEQ ID NO: 8456362 - DNA, 22 bp, Homo sapiens
tgatgagggagatttgagccca

SEQ ID NO: 8456363 - DNA, 22 bp, Homo sapiens
tgatgagggcagttcttgttgc

SEQ ID NO: 8456364 - DNA, 22 bp, Homo sapiens
tgatgagggggaacagagattt

SEQ ID NO: 8456365 - DNA, 21 bp, Homo sapiens
tgatgaggtcatagcaccctc

SEQ ID NO: 8456366 - DNA, 22 bp, Homo sapiens
tgatgaggggctcagaggtcag

SEQ ID NO: 8456367 - DNA, 22 bp, Homo sapiens
ccagtgtggtaggtccacaggt

SEQ ID NO: 8456368 - DNA, 22 bp, Homo sapiens
tgaggcagtcaccccctcctgc

SEQ ID NO: 8456369 - DNA, 22 bp, Homo sapiens
tgaggcagtattttagtgactt

SEQ ID NO: 8456370 - DNA, 22 bp, Homo sapiens
tgaggcaggtaagcaagttttg

SEQ ID NO: 8456371 - DNA, 22 bp, Homo sapiens
tgaggcaggtaagcaagttttg

SEQ ID NO: 8456372 - DNA, 22 bp, Homo sapiens
tgaggcagtattctccattcca

SEQ ID NO: 8456373 - DNA, 22 bp, Homo sapiens
tgattcaaatattgtgtatgat

SEQ ID NO: 8456374 - DNA, 17 bp, Homo sapiens
tgattcaactagaaact

SEQ ID NO: 8456375 - DNA, 22 bp, Homo sapiens
tgattcaactttcataacaaaa

SEQ ID NO: 8456376 - DNA, 22 bp, Homo sapiens
tgattcaactttcataacaaaa

SEQ ID NO: 8456377 - DNA, 22 bp, Homo sapiens
tgattatattctaacttcataa

SEQ ID NO: 8456378 - DNA, 23 bp, Homo sapiens
tgattacaggaagttcaagtgtt

SEQ ID NO: 8456379 - DNA, 22 bp, Homo sapiens
tgattacactatttgggaatag

SEQ ID NO: 8456380 - DNA, 22 bp, Homo sapiens
tgattacacagcagtaatttca

SEQ ID NO: 8456381 - DNA, 22 bp, Homo sapiens
tgattacattggtaatgtttat

SEQ ID NO: 8456382 - DNA, 22 bp, Homo sapiens
tgattacagtatttgagatcca

SEQ ID NO: 8456383 - DNA, 22 bp, Homo sapiens
cccaaaggttgaggctgcagtg

SEQ ID NO: 8456384 - DNA, 22 bp, Homo sapiens
cccaagccagaccctgaccctg

SEQ ID NO: 8456385 - DNA, 22 bp, Homo sapiens
cccaagaggtggaggttgcagt

SEQ ID NO: 8456386 - DNA, 22 bp, Homo sapiens
ccatggcaatggtcagtctatt

SEQ ID NO: 8456387 - DNA, 19 bp, Homo sapiens
ccatggcaatgatctgatg

SEQ ID NO: 8456388 - DNA, 19 bp, Homo sapiens
ccatggcaatgatctgatg

SEQ ID NO: 8456389 - DNA, 22 bp, Homo sapiens
ccatggccaggaaagccaaggt

SEQ ID NO: 8456390 - DNA, 22 bp, Homo sapiens
ccatggccaattgcaccttgct

SEQ ID NO: 8456391 - DNA, 23 bp, Homo sapiens
ccatggccaatgtcaagctacta

SEQ ID NO: 8456392 - DNA, 22 bp, Homo sapiens
ccatggcattttatgtgtctta

SEQ ID NO: 8456393 - DNA, 22 bp, Homo sapiens
ccatggcagcctggcctggctt

SEQ ID NO: 8456394 - DNA, 22 bp, Homo sapiens
ccatggccgccgctgctcagga

SEQ ID NO: 8456395 - DNA, 22 bp, Homo sapiens
ccatggccgccgctgctcagga

SEQ ID NO: 8456396 - DNA, 22 bp, Homo sapiens
ccatggccaattgcaccttgct

SEQ ID NO: 8456397 - DNA, 22 bp, Homo sapiens
ccatggcctcgctctacgtggg

SEQ ID NO: 8456398 - DNA, 22 bp, Homo sapiens
cccagagagcacaggtggtggg

SEQ ID NO: 8456399 - DNA, 19 bp, Homo sapiens
cccagagagatctcttgcc

SEQ ID NO: 8456400 - DNA, 22 bp, Homo sapiens
cccagagagcatttggacaaag

SEQ ID NO: 8456401 - DNA, 22 bp, Homo sapiens
cccagagaggtaaaacagcctt

SEQ ID NO: 8456402 - DNA, 22 bp, Homo sapiens
cccagaggtgaaggaggtggga

SEQ ID NO: 8456403 - DNA, 22 bp, Homo sapiens
cccagaggtgaaggaggtggga

SEQ ID NO: 8456404 - DNA, 22 bp, Homo sapiens
cccagagggtggaggttgcagt

SEQ ID NO: 8456405 - DNA, 22 bp, Homo sapiens
tgcagagtaaaagcagatgcta

SEQ ID NO: 8456406 - DNA, 22 bp, Homo sapiens
cccagagaatctttcagaaagg

SEQ ID NO: 8456407 - DNA, 23 bp, Homo sapiens
cccagcagagatgaggaggggtc

SEQ ID NO: 8456408 - DNA, 22 bp, Homo sapiens
cccagcagaatctgatgagggc

SEQ ID NO: 8456409 - DNA, 22 bp, Homo sapiens
tgcagcagtgttccttggcttg

SEQ ID NO: 8456410 - DNA, 22 bp, Homo sapiens
cccagcagccagaatgaggagc

SEQ ID NO: 8456411 - DNA, 22 bp, Homo sapiens
cccagcagccagaatgaggagc

SEQ ID NO: 8456412 - DNA, 22 bp, Homo sapiens
cccagcagccagaatgaggagc

SEQ ID NO: 8456413 - DNA, 22 bp, Homo sapiens
tgattcaactttcttgaatgca

SEQ ID NO: 8456414 - DNA, 19 bp, Homo sapiens
cccacaggaggacatatgg

SEQ ID NO: 8456415 - DNA, 22 bp, Homo sapiens
cccacaggcaggggcagagaca

SEQ ID NO: 8456416 - DNA, 22 bp, Homo sapiens
cccacagaatgccaatgagacc

SEQ ID NO: 8456417 - DNA, 22 bp, Homo sapiens
cccacaggcaggtgcatgggct

SEQ ID NO: 8456418 - DNA, 22 bp, Homo sapiens
cccacaggcaggtgcatgggct

SEQ ID NO: 8456419 - DNA, 22 bp, Homo sapiens
cccacaggcaggggcagagaca

SEQ ID NO: 8456420 - DNA, 22 bp, Homo sapiens
cccacaggcaggggcagagaca

SEQ ID NO: 8456421 - DNA, 22 bp, Homo sapiens
cccacaggcaggggcagagaca

SEQ ID NO: 8456422 - DNA, 22 bp, Homo sapiens
cccacaggccctgctgccttga

SEQ ID NO: 8456423 - DNA, 22 bp, Homo sapiens
cccacaggccctgctgccttga

SEQ ID NO: 8456424 - DNA, 22 bp, Homo sapiens
cccacaggccctgctgccttga

SEQ ID NO: 8456425 - DNA, 22 bp, Homo sapiens
cccacagggctgctgatggcag

SEQ ID NO: 8456426 - DNA, 22 bp, Homo sapiens
cccacagggctgctgatggcag

SEQ ID NO: 8456427 - DNA, 22 bp, Homo sapiens
cccacaggtccccatgaactcg

SEQ ID NO: 8456428 - DNA, 22 bp, Homo sapiens
cccacaggtccccatgaactcg

SEQ ID NO: 8456429 - DNA, 22 bp, Homo sapiens
cccacaggtggaagcctcggaa

SEQ ID NO: 8456430 - DNA, 22 bp, Homo sapiens
cccacaggtggaagcctcggaa

SEQ ID NO: 8456431 - DNA, 22 bp, Homo sapiens
cccacatcccttccccgctgtg

SEQ ID NO: 8456432 - DNA, 22 bp, Homo sapiens
cccacatctcacatcttggaac

SEQ ID NO: 8456433 - DNA, 22 bp, Homo sapiens
cccacatctcacatcttggaac

SEQ ID NO: 8456434 - DNA, 22 bp, Homo sapiens
cccacaggtgtgagcttgctgg

SEQ ID NO: 8456435 - DNA, 22 bp, Homo sapiens
cccacaggtggaagcctcggaa

SEQ ID NO: 8456436 - DNA, 22 bp, Homo sapiens
cccacatttttgagtcttcatc

SEQ ID NO: 8456437 - DNA, 23 bp, Homo sapiens
cccacatgtctgagtcagtgcca

SEQ ID NO: 8456438 - DNA, 22 bp, Homo sapiens
cccaccacgtgctttgctggag

SEQ ID NO: 8456439 - DNA, 22 bp, Homo sapiens
cccacccactctgaccagaagc

SEQ ID NO: 8456440 - DNA, 22 bp, Homo sapiens
cccacccactctgaccagaagc

SEQ ID NO: 8456441 - DNA, 22 bp, Homo sapiens
tgcagagatagaactactttct

SEQ ID NO: 8456442 - DNA, 21 bp, Homo sapiens
cccaccccataaggcagaacc

SEQ ID NO: 8456443 - DNA, 21 bp, Homo sapiens
cccaccccataaggcagaacc

SEQ ID NO: 8456444 - DNA, 22 bp, Homo sapiens
tgcagaggtgaaagactagcaa

SEQ ID NO: 8456445 - DNA, 21 bp, Homo sapiens
tgcagagatatctgaagcaga

SEQ ID NO: 8456446 - DNA, 22 bp, Homo sapiens
tgcagaggtgaaagactagcaa

SEQ ID NO: 8456447 - DNA, 22 bp, Homo sapiens
tgcagaggtttccaggcaagtt

SEQ ID NO: 8456448 - DNA, 22 bp, Homo sapiens
tgcagaggtttccaggcaagtt

SEQ ID NO: 8456449 - DNA, 22 bp, Homo sapiens
tgcagaggtttccaggcaagtt

SEQ ID NO: 8456450 - DNA, 22 bp, Homo sapiens
tgcatatatcttatttttctgt

SEQ ID NO: 8456451 - DNA, 22 bp, Homo sapiens
cccaggagacagaaacagaggt

SEQ ID NO: 8456452 - DNA, 22 bp, Homo sapiens
cccaggagataacgttcccaag

SEQ ID NO: 8456453 - DNA, 22 bp, Homo sapiens
tgcatcaaattctgaaattagc

SEQ ID NO: 8456454 - DNA, 22 bp, Homo sapiens
tgcatcaaaactggactccttc

SEQ ID NO: 8456455 - DNA, 22 bp, Homo sapiens
cccaggaggacattccataccc

SEQ ID NO: 8456456 - DNA, 22 bp, Homo sapiens
tgcatattgtccttgatattat

SEQ ID NO: 8456457 - DNA, 22 bp, Homo sapiens
tgcatattgtgaaaatgtagat

SEQ ID NO: 8456458 - DNA, 22 bp, Homo sapiens
cccaggaggaggaaaaagctcg

SEQ ID NO: 8456459 - DNA, 22 bp, Homo sapiens
cccaggaggaggaaaaagctcg

SEQ ID NO: 8456460 - DNA, 22 bp, Homo sapiens
cccaggaggcagaagttgcagt

SEQ ID NO: 8456461 - DNA, 22 bp, Homo sapiens
cccaggaggcagaagttgcagt

SEQ ID NO: 8456462 - DNA, 22 bp, Homo sapiens
cccaggaggcagagcttgcagt

SEQ ID NO: 8456463 - DNA, 22 bp, Homo sapiens
cccaggaggcctgcctggccgg

SEQ ID NO: 8456464 - DNA, 22 bp, Homo sapiens
cccaggaggcagaggttggagc

SEQ ID NO: 8456465 - DNA, 22 bp, Homo sapiens
cccaggaggcagatgttgcagt

SEQ ID NO: 8456466 - DNA, 21 bp, Homo sapiens
cccaggaggctgagaagagca

SEQ ID NO: 8456467 - DNA, 22 bp, Homo sapiens
tgcccagcttcttacttttaaa

SEQ ID NO: 8456468 - DNA, 21 bp, Homo sapiens
cccaggaggctgagaagagca

SEQ ID NO: 8456469 - DNA, 21 bp, Homo sapiens
cccaggaggctgagaagagca

SEQ ID NO: 8456470 - DNA, 22 bp, Homo sapiens
tgccctcagcagcagctcctgc

SEQ ID NO: 8456471 - DNA, 22 bp, Homo sapiens
tgccctcagccacctccaagtt

SEQ ID NO: 8456472 - DNA, 22 bp, Homo sapiens
tgcccaggatctggcgatgctc

SEQ ID NO: 8456473 - DNA, 22 bp, Homo sapiens
tgccctcagaattgctccctgc

SEQ ID NO: 8456474 - DNA, 22 bp, Homo sapiens
tgccctccacagtggctccacc

SEQ ID NO: 8456475 - DNA, 22 bp, Homo sapiens
tgccctccacagtggctccacc

SEQ ID NO: 8456476 - DNA, 23 bp, Homo sapiens
tgccctcccaatgcttcggtcac

SEQ ID NO: 8456477 - DNA, 22 bp, Homo sapiens
tgccctccctgtactgtcagga

SEQ ID NO: 8456478 - DNA, 22 bp, Homo sapiens
tgccctcccacattatggctgt

SEQ ID NO: 8456479 - DNA, 22 bp, Homo sapiens
cccaggagtaagtgacattgtt

SEQ ID NO: 8456480 - DNA, 22 bp, Homo sapiens
cccaggaggttggggctacagt

SEQ ID NO: 8456481 - DNA, 21 bp, Homo sapiens
cccaggagtcctatttaaatg

SEQ ID NO: 8456482 - DNA, 22 bp, Homo sapiens
cccaggaggttgaggctgcagt

SEQ ID NO: 8456483 - DNA, 19 bp, Homo sapiens
tgccctgcacgctgtcctg

SEQ ID NO: 8456484 - DNA, 22 bp, Homo sapiens
tgccctgaggcactccatccat

SEQ ID NO: 8456485 - DNA, 22 bp, Homo sapiens
cccaggaggttggggctacagt

SEQ ID NO: 8456486 - DNA, 22 bp, Homo sapiens
cccaggaggttgaggctgcagt

SEQ ID NO: 8456487 - DNA, 22 bp, Homo sapiens
tgcctcagtctaaagtctctca

SEQ ID NO: 8456488 - DNA, 23 bp, Homo sapiens
tgcctcagtggaatgtgagggtg

SEQ ID NO: 8456489 - DNA, 22 bp, Homo sapiens
tgccctggttacactggagtcc

SEQ ID NO: 8456490 - DNA, 20 bp, Homo sapiens
cccaggagtgagcagcttta

SEQ ID NO: 8456491 - DNA, 21 bp, Homo sapiens
cccaggagaagaaaagatgca

SEQ ID NO: 8456492 - DNA, 21 bp, Homo sapiens
cccaggagaagaaaagatgca

SEQ ID NO: 8456493 - DNA, 22 bp, Homo sapiens
cccaggagaatataatgttctt

SEQ ID NO: 8456494 - DNA, 22 bp, Homo sapiens
cccaggactcttcactgcagcc

SEQ ID NO: 8456495 - DNA, 22 bp, Homo sapiens
cccaggactctgacacccccaa

SEQ ID NO: 8456496 - DNA, 22 bp, Homo sapiens
cccaggactctgacacccccaa

SEQ ID NO: 8456497 - DNA, 22 bp, Homo sapiens
cccaggaccatccttctgtgcc

SEQ ID NO: 8456498 - DNA, 22 bp, Homo sapiens
cccaggacccttcaatggctcc

SEQ ID NO: 8456499 - DNA, 22 bp, Homo sapiens
cccaggaccgcgcggctgagcg

SEQ ID NO: 8456500 - DNA, 22 bp, Homo sapiens
cccaggaccgcgcggctgagcg

SEQ ID NO: 8456501 - DNA, 22 bp, Homo sapiens
cccaggactaatgagctctacg

SEQ ID NO: 8456502 - DNA, 22 bp, Homo sapiens
cccagctccagagccagaaaca

SEQ ID NO: 8456503 - DNA, 22 bp, Homo sapiens
cccagctcccatgttctccaat

SEQ ID NO: 8456504 - DNA, 22 bp, Homo sapiens
tgcagtgcctcggcagtgcagc

SEQ ID NO: 8456505 - DNA, 22 bp, Homo sapiens
tgcaggtgctgtgtcaagagag

SEQ ID NO: 8456506 - DNA, 22 bp, Homo sapiens
cccagccctgacctattggaaa

SEQ ID NO: 8456507 - DNA, 22 bp, Homo sapiens
tgcaggtggacacgggagacgg

SEQ ID NO: 8456508 - DNA, 22 bp, Homo sapiens
tgcagtcttccagctgcacaaa

SEQ ID NO: 8456509 - DNA, 22 bp, Homo sapiens
tgcagtctgtacattttaagaa

SEQ ID NO: 8456510 - DNA, 22 bp, Homo sapiens
tgcagtctgtacattttaagaa

SEQ ID NO: 8456511 - DNA, 22 bp, Homo sapiens
tgcagtctggatgtcctcagat

SEQ ID NO: 8456512 - DNA, 22 bp, Homo sapiens
tgcagtggaatctggagagcag

SEQ ID NO: 8456513 - DNA, 22 bp, Homo sapiens
tgcagtggaagaggtggagatc

SEQ ID NO: 8456514 - DNA, 22 bp, Homo sapiens
cccagctcatcaggagccgccc

SEQ ID NO: 8456515 - DNA, 22 bp, Homo sapiens
cccagccaagtgatctgaccgc

SEQ ID NO: 8456516 - DNA, 22 bp, Homo sapiens
cccagccagcctcttcccatat

SEQ ID NO: 8456517 - DNA, 22 bp, Homo sapiens
cccagccaaggtgctggtgttg

SEQ ID NO: 8456518 - DNA, 22 bp, Homo sapiens
cccagccaaaagcaagtttacc

SEQ ID NO: 8456519 - DNA, 22 bp, Homo sapiens
cccagccaaggtgctggtgttg

SEQ ID NO: 8456520 - DNA, 22 bp, Homo sapiens
cccagcatgcacgctgacactc

SEQ ID NO: 8456521 - DNA, 22 bp, Homo sapiens
cccagcatctccaggcatggcc

SEQ ID NO: 8456522 - DNA, 22 bp, Homo sapiens
cccagcagtaaccagtggaaat

SEQ ID NO: 8456523 - DNA, 22 bp, Homo sapiens
cccagcaggtgccatcactctg

SEQ ID NO: 8456524 - DNA, 22 bp, Homo sapiens
cccagcccatctcaaaggtcta

SEQ ID NO: 8456525 - DNA, 22 bp, Homo sapiens
cccagcccatctcaaaggtcta

SEQ ID NO: 8456526 - DNA, 22 bp, Homo sapiens
cccagcccccgagtgtctggaa

SEQ ID NO: 8456527 - DNA, 22 bp, Homo sapiens
cccagcccccgagtgtctggaa

SEQ ID NO: 8456528 - DNA, 20 bp, Homo sapiens
cccagcccctacctgttgcc

SEQ ID NO: 8456529 - DNA, 20 bp, Homo sapiens
cccagcccctacctgttgcc

SEQ ID NO: 8456530 - DNA, 22 bp, Homo sapiens
cccagccctgacctattggaaa

SEQ ID NO: 8456531 - DNA, 20 bp, Homo sapiens
cccagcccgggccgcgctcg

SEQ ID NO: 8456532 - DNA, 22 bp, Homo sapiens
cccagccagcctcttcccatat

SEQ ID NO: 8456533 - DNA, 19 bp, Homo sapiens
cccagccaggtcttgcatc

SEQ ID NO: 8456534 - DNA, 18 bp, Homo sapiens
cccagcccaccatttctc

SEQ ID NO: 8456535 - DNA, 22 bp, Homo sapiens
cccagcccagcgttcgaggggt

SEQ ID NO: 8456536 - DNA, 22 bp, Homo sapiens
cccagcccagcgttcgaggggt

SEQ ID NO: 8456537 - DNA, 22 bp, Homo sapiens
cccagcccacggtcctgggtgg

SEQ ID NO: 8456538 - DNA, 22 bp, Homo sapiens
cccagcccacggtcctgggtgg

SEQ ID NO: 8456539 - DNA, 22 bp, Homo sapiens
tgactttagaattttatccaga

SEQ ID NO: 8456540 - DNA, 22 bp, Homo sapiens
tgactttaagctatctgattct

SEQ ID NO: 8456541 - DNA, 22 bp, Homo sapiens
tgacccatttgcttttcctgta

SEQ ID NO: 8456542 - DNA, 22 bp, Homo sapiens
tgaccccactgtgctcagaggt

SEQ ID NO: 8456543 - DNA, 22 bp, Homo sapiens
ccagggtctctgctgcctgaga

SEQ ID NO: 8456544 - DNA, 22 bp, Homo sapiens
tgagaaaactcaaagacagatc

SEQ ID NO: 8456545 - DNA, 22 bp, Homo sapiens
tgacccatcaggccacatgagg

SEQ ID NO: 8456546 - DNA, 22 bp, Homo sapiens
tgacccattaaccactttccct

SEQ ID NO: 8456547 - DNA, 22 bp, Homo sapiens
tgacccattggtccctagatcc

SEQ ID NO: 8456548 - DNA, 22 bp, Homo sapiens
tgacccatggtctgatcatagg

SEQ ID NO: 8456549 - DNA, 22 bp, Homo sapiens
tgaccatttgatctacattcca

SEQ ID NO: 8456550 - DNA, 22 bp, Homo sapiens
tgaccaggatactgcagggatg

SEQ ID NO: 8456551 - DNA, 22 bp, Homo sapiens
tgaccacacgtctggaattgtg

SEQ ID NO: 8456552 - DNA, 23 bp, Homo sapiens
ccagggcccctacaccactgtcc

SEQ ID NO: 8456553 - DNA, 23 bp, Homo sapiens
ccagggcccctacaccactgtcc

SEQ ID NO: 8456554 - DNA, 22 bp, Homo sapiens
tgacatgctaagattatgttat

SEQ ID NO: 8456555 - DNA, 22 bp, Homo sapiens
tgacatttttataagagtcaaa

SEQ ID NO: 8456556 - DNA, 22 bp, Homo sapiens
ccagggcccacggccagaatag

SEQ ID NO: 8456557 - DNA, 22 bp, Homo sapiens
ccaggctttaagaggtggaaac

SEQ ID NO: 8456558 - DNA, 19 bp, Homo sapiens
ccaggctttatgcaaatac

SEQ ID NO: 8456559 - DNA, 22 bp, Homo sapiens
ccaggcttttctcatggagtca

SEQ ID NO: 8456560 - DNA, 22 bp, Homo sapiens
ccaggctttctcctgactcaca

SEQ ID NO: 8456561 - DNA, 22 bp, Homo sapiens
ccaggcttttagctgcatggca

SEQ ID NO: 8456562 - DNA, 22 bp, Homo sapiens
ccaggctttcccagcctctcca

SEQ ID NO: 8456563 - DNA, 22 bp, Homo sapiens
tgacaattgcagacacagaagt

SEQ ID NO: 8456564 - DNA, 22 bp, Homo sapiens
tgacaattcattatatctacag

SEQ ID NO: 8456565 - DNA, 22 bp, Homo sapiens
tgacagagccaagatcagtact

SEQ ID NO: 8456566 - DNA, 22 bp, Homo sapiens
tgacagaggagctggaatgatt

SEQ ID NO: 8456567 - DNA, 22 bp, Homo sapiens
tgacagagaggtaagttatgaa

SEQ ID NO: 8456568 - DNA, 22 bp, Homo sapiens
ccagggccaagagacctcgagg

SEQ ID NO: 8456569 - DNA, 22 bp, Homo sapiens
ccagggcatgtaactaatggtg

SEQ ID NO: 8456570 - DNA, 22 bp, Homo sapiens
tgagcagaaaagaatgctgagc

SEQ ID NO: 8456571 - DNA, 22 bp, Homo sapiens
tgagcagaagccctcctggact

SEQ ID NO: 8456572 - DNA, 22 bp, Homo sapiens
tgagcagaagccctcctggact

SEQ ID NO: 8456573 - DNA, 22 bp, Homo sapiens
tgagcagacttgatgaggcagc

SEQ ID NO: 8456574 - DNA, 22 bp, Homo sapiens
tgagctggcaggggctcaggga

SEQ ID NO: 8456575 - DNA, 19 bp, Homo sapiens
tgagctggctgagcctctc

SEQ ID NO: 8456576 - DNA, 22 bp, Homo sapiens
tgagctggcaggggctcaggga

SEQ ID NO: 8456577 - DNA, 22 bp, Homo sapiens
tgagcccaggagttggaggctg

SEQ ID NO: 8456578 - DNA, 22 bp, Homo sapiens
tgagctggcacttttcctggga

SEQ ID NO: 8456579 - DNA, 19 bp, Homo sapiens
tgagctggctgagcctctc

SEQ ID NO: 8456580 - DNA, 19 bp, Homo sapiens
tgagctggctgagcctctc

SEQ ID NO: 8456581 - DNA, 22 bp, Homo sapiens
tgagctggcttgtcaaccaggg

SEQ ID NO: 8456582 - DNA, 22 bp, Homo sapiens
tgagctgggaagagcagccaga

SEQ ID NO: 8456583 - DNA, 22 bp, Homo sapiens
tgagctgggaagagcagccaga

SEQ ID NO: 8456584 - DNA, 22 bp, Homo sapiens
tgagctgggaagagcagccaga

SEQ ID NO: 8456585 - DNA, 23 bp, Homo sapiens
tgagctggtattgtccatctcca

SEQ ID NO: 8456586 - DNA, 23 bp, Homo sapiens
tgagctgggcctgcaggggtctc

SEQ ID NO: 8456587 - DNA, 23 bp, Homo sapiens
tgagctgggcctgcaggggtctc

SEQ ID NO: 8456588 - DNA, 22 bp, Homo sapiens
tgagctgggctgggctgagctg

SEQ ID NO: 8456589 - DNA, 22 bp, Homo sapiens
tgagctgggctgggctgagctg

SEQ ID NO: 8456590 - DNA, 22 bp, Homo sapiens
tgagctgggctgggctgagctg

SEQ ID NO: 8456591 - DNA, 22 bp, Homo sapiens
tgaggacattaggaagtgaagg

SEQ ID NO: 8456592 - DNA, 22 bp, Homo sapiens
tgaggacattgagactggagac

SEQ ID NO: 8456593 - DNA, 22 bp, Homo sapiens
tgaggacatgagtgggacagag

SEQ ID NO: 8456594 - DNA, 22 bp, Homo sapiens
tgaggacatgagtgggacagag

SEQ ID NO: 8456595 - DNA, 22 bp, Homo sapiens
tgaggacattggtcaggacatg

SEQ ID NO: 8456596 - DNA, 22 bp, Homo sapiens
ccagggtttcttctctgtatag

SEQ ID NO: 8456597 - DNA, 22 bp, Homo sapiens
ccagggtttaaattctgactat

SEQ ID NO: 8456598 - DNA, 22 bp, Homo sapiens
ccagggttggtctctctgaggt

SEQ ID NO: 8456599 - DNA, 22 bp, Homo sapiens
ccaggtcaagctcccctgtggt

SEQ ID NO: 8456600 - DNA, 22 bp, Homo sapiens
ccaggtcaagctcccctgtggt

SEQ ID NO: 8456601 - DNA, 22 bp, Homo sapiens
ccaggtaacttgagaacatgag

SEQ ID NO: 8456602 - DNA, 22 bp, Homo sapiens
ccagggttgctgtatggcactt

SEQ ID NO: 8456603 - DNA, 22 bp, Homo sapiens
ccagggttggcaagcaaggctt

SEQ ID NO: 8456604 - DNA, 22 bp, Homo sapiens
ccagggtggggtccaggaacca

SEQ ID NO: 8456605 - DNA, 22 bp, Homo sapiens
ccagggtggggtccaggaacca

SEQ ID NO: 8456606 - DNA, 22 bp, Homo sapiens
ccagggtgggaggctgaaggcg

SEQ ID NO: 8456607 - DNA, 22 bp, Homo sapiens
ccagggtggcgtagatgctggg

SEQ ID NO: 8456608 - DNA, 22 bp, Homo sapiens
ccagggtgggaggctgaaggcg

SEQ ID NO: 8456609 - DNA, 22 bp, Homo sapiens
ccagggtggggcaggcccactg

SEQ ID NO: 8456610 - DNA, 22 bp, Homo sapiens
tgagcacctactgtattccagg

SEQ ID NO: 8456611 - DNA, 22 bp, Homo sapiens
tgagaggtgaggcatgaggcat

SEQ ID NO: 8456612 - DNA, 22 bp, Homo sapiens
tgagaggtcattaggccatgag

SEQ ID NO: 8456613 - DNA, 22 bp, Homo sapiens
tgagaggtcattaggccatgag

SEQ ID NO: 8456614 - DNA, 19 bp, Homo sapiens
tgagactgggtgcagtact

SEQ ID NO: 8456615 - DNA, 22 bp, Homo sapiens
tgagacttggcactgaggaact

SEQ ID NO: 8456616 - DNA, 22 bp, Homo sapiens
tgagacttcctgatgaggcccg

SEQ ID NO: 8456617 - DNA, 22 bp, Homo sapiens
tgagacttaagaggtcatgttg

SEQ ID NO: 8456618 - DNA, 19 bp, Homo sapiens
tgagactgggtgcagtact

SEQ ID NO: 8456619 - DNA, 22 bp, Homo sapiens
ccaggtctatcaagttgggctc

SEQ ID NO: 8456620 - DNA, 22 bp, Homo sapiens
tctttattttatgcttgtgcaa

SEQ ID NO: 8456621 - DNA, 22 bp, Homo sapiens
tctttattttatgcttgtgcaa

SEQ ID NO: 8456622 - DNA, 22 bp, Homo sapiens
tctttcaaagcaaaatgaggct

SEQ ID NO: 8456623 - DNA, 22 bp, Homo sapiens
tctttattttatgcttgtgcaa

SEQ ID NO: 8456624 - DNA, 22 bp, Homo sapiens
tctttcaaagctgtagtagatt

SEQ ID NO: 8456625 - DNA, 22 bp, Homo sapiens
tctttattttatgcttgtgcaa

SEQ ID NO: 8456626 - DNA, 22 bp, Homo sapiens
tctttcaaagtaacaaccacga

SEQ ID NO: 8456627 - DNA, 22 bp, Homo sapiens
tctttcaaagctgtagtagatt

SEQ ID NO: 8456628 - DNA, 22 bp, Homo sapiens
ccaggctagagagcagtggcac

SEQ ID NO: 8456629 - DNA, 18 bp, Homo sapiens
ccaggctacttcttggcc

SEQ ID NO: 8456630 - DNA, 19 bp, Homo sapiens
ccaggcctggcgtctccgc

SEQ ID NO: 8456631 - DNA, 19 bp, Homo sapiens
ccaggcctggcgtctccgc

SEQ ID NO: 8456632 - DNA, 22 bp, Homo sapiens
tctttatttctgaatcccccat

SEQ ID NO: 8456633 - DNA, 22 bp, Homo sapiens
tctttatttaagtctgttgtaa

SEQ ID NO: 8456634 - DNA, 22 bp, Homo sapiens
tctttaatataaaggaatgaat

SEQ ID NO: 8456635 - DNA, 22 bp, Homo sapiens
tctttaatataaaggaatgaat

SEQ ID NO: 8456636 - DNA, 17 bp, Homo sapiens
ccaggctccatcactgt

SEQ ID NO: 8456637 - DNA, 17 bp, Homo sapiens
ccaggctccatcactgt

SEQ ID NO: 8456638 - DNA, 22 bp, Homo sapiens
ccaggctcaggtgcgagagaca

SEQ ID NO: 8456639 - DNA, 22 bp, Homo sapiens
ccaggctcagggcagactttca

SEQ ID NO: 8456640 - DNA, 22 bp, Homo sapiens
ccaggctcaggcctgctcgttg

SEQ ID NO: 8456641 - DNA, 22 bp, Homo sapiens
ccaggctcaggcctgctcgttg

SEQ ID NO: 8456642 - DNA, 22 bp, Homo sapiens
ccaggctcagctattaagaaac

SEQ ID NO: 8456643 - DNA, 22 bp, Homo sapiens
ccaggctcagcgcgcacgtctg

SEQ ID NO: 8456644 - DNA, 22 bp, Homo sapiens
ccaggctcagcgcgcacgtctg

SEQ ID NO: 8456645 - DNA, 22 bp, Homo sapiens
ccaggctagagagcagtggcat

SEQ ID NO: 8456646 - DNA, 22 bp, Homo sapiens
ccaggctagagtgcaatggcat

SEQ ID NO: 8456647 - DNA, 22 bp, Homo sapiens
ccaggctagagtgcagtggcgt

SEQ ID NO: 8456648 - DNA, 22 bp, Homo sapiens
ccaggctagagtgcaatggcgc

SEQ ID NO: 8456649 - DNA, 22 bp, Homo sapiens
ccaggctagagtgcagtggcat

SEQ ID NO: 8456650 - DNA, 22 bp, Homo sapiens
ccaggctagcccagaccacagg

SEQ ID NO: 8456651 - DNA, 22 bp, Homo sapiens
ccaggctcacagcatcccagga

SEQ ID NO: 8456652 - DNA, 22 bp, Homo sapiens
ccaggctcactgactaccacat

SEQ ID NO: 8456653 - DNA, 22 bp, Homo sapiens
ccaggctcacctggagcccctg

SEQ ID NO: 8456654 - DNA, 22 bp, Homo sapiens
ccaggctcacctggagcccctg

SEQ ID NO: 8456655 - DNA, 22 bp, Homo sapiens
ccaggctcacctggagcccctg

SEQ ID NO: 8456656 - DNA, 22 bp, Homo sapiens
ccagccctttgtggttcactga

SEQ ID NO: 8456657 - DNA, 22 bp, Homo sapiens
ccagcccttgaggtctgtccat

SEQ ID NO: 8456658 - DNA, 22 bp, Homo sapiens
ccagcccttgagatggaaggga

SEQ ID NO: 8456659 - DNA, 22 bp, Homo sapiens
ccagcccttgaggtctgtccat

SEQ ID NO: 8456660 - DNA, 22 bp, Homo sapiens
ccagcccttgaggtctgtccat

SEQ ID NO: 8456661 - DNA, 22 bp, Homo sapiens
tctgcagacaggaagctgaggc

SEQ ID NO: 8456662 - DNA, 22 bp, Homo sapiens
tctgcagaattgtctcaagcta

SEQ ID NO: 8456663 - DNA, 22 bp, Homo sapiens
tctgcagagcctcaggagaaca

SEQ ID NO: 8456664 - DNA, 17 bp, Homo sapiens
tctgcagaggcaaacct

SEQ ID NO: 8456665 - DNA, 22 bp, Homo sapiens
tcttgtcctaagagctggattc

SEQ ID NO: 8456666 - DNA, 22 bp, Homo sapiens
tcttgttatcaggaaaacagta

SEQ ID NO: 8456667 - DNA, 22 bp, Homo sapiens
tcttgtttctgtatataatgac

SEQ ID NO: 8456668 - DNA, 22 bp, Homo sapiens
tcttgtgtggaactgcttttct

SEQ ID NO: 8456669 - DNA, 22 bp, Homo sapiens
tcttgttaaagtgaagatactg

SEQ ID NO: 8456670 - DNA, 22 bp, Homo sapiens
tctttaaagttggagcttgcaa

SEQ ID NO: 8456671 - DNA, 22 bp, Homo sapiens
tcttgtttggattttgggcagt

SEQ ID NO: 8456672 - DNA, 22 bp, Homo sapiens
tcttgtttcttctaagcagcag

SEQ ID NO: 8456673 - DNA, 22 bp, Homo sapiens
tcttgtttctgtatataatgac

SEQ ID NO: 8456674 - DNA, 22 bp, Homo sapiens
tcttgtaattaactagaaagat

SEQ ID NO: 8456675 - DNA, 21 bp, Homo sapiens
tcttgtattggatctgtgtgt

SEQ ID NO: 8456676 - DNA, 22 bp, Homo sapiens
tcttgtatgtgtattttgctgt

SEQ ID NO: 8456677 - DNA, 21 bp, Homo sapiens
ccagcctcagatcagggagct

SEQ ID NO: 8456678 - DNA, 22 bp, Homo sapiens
tgaaacagctatcagtagactg

SEQ ID NO: 8456679 - DNA, 22 bp, Homo sapiens
tgaaacagctatcagtagactg

SEQ ID NO: 8456680 - DNA, 22 bp, Homo sapiens
tgaaagcagcaccaataccatt

SEQ ID NO: 8456681 - DNA, 22 bp, Homo sapiens
tgaaagcagcaccaataccatt

SEQ ID NO: 8456682 - DNA, 22 bp, Homo sapiens
tgaaagcagatagctctgttgt

SEQ ID NO: 8456683 - DNA, 21 bp, Homo sapiens
tgaaacagatggaagtatttg

SEQ ID NO: 8456684 - DNA, 22 bp, Homo sapiens
ccaggctcctcatgatcttgtt

SEQ ID NO: 8456685 - DNA, 22 bp, Homo sapiens
ccaggctcctcatgatcttgtt

SEQ ID NO: 8456686 - DNA, 22 bp, Homo sapiens
ccaggctccgcatagaccccac

SEQ ID NO: 8456687 - DNA, 22 bp, Homo sapiens
ccaggctccgcatagaccccac

SEQ ID NO: 8456688 - DNA, 22 bp, Homo sapiens
ccaggctcctcatgatcttgtt

SEQ ID NO: 8456689 - DNA, 22 bp, Homo sapiens
ccaggctccccaggaggccctt

SEQ ID NO: 8456690 - DNA, 22 bp, Homo sapiens
ccaggctccccaggaggccctt

SEQ ID NO: 8456691 - DNA, 22 bp, Homo sapiens
ccaggctccccaggaggccctt

SEQ ID NO: 8456692 - DNA, 22 bp, Homo sapiens
ccaggctccgcatagaccccac

SEQ ID NO: 8456693 - DNA, 22 bp, Homo sapiens
tgaaagctgtacatgtggtaca

SEQ ID NO: 8456694 - DNA, 22 bp, Homo sapiens
tgaaagctgtacatgtggtaca

SEQ ID NO: 8456695 - DNA, 20 bp, Homo sapiens
tgaaagcatgtggtatttgg

SEQ ID NO: 8456696 - DNA, 22 bp, Homo sapiens
tgaaagcatgcttgccaagctt

SEQ ID NO: 8456697 - DNA, 22 bp, Homo sapiens
tgaaagcattagtctaaggtag

SEQ ID NO: 8456698 - DNA, 22 bp, Homo sapiens
tgaaagcagtgatttctccttc

SEQ ID NO: 8456699 - DNA, 22 bp, Homo sapiens
tgaaagcaggcgggctacttta

SEQ ID NO: 8456700 - DNA, 22 bp, Homo sapiens
tgaaagcagtgccatgattatg

SEQ ID NO: 8456701 - DNA, 22 bp, Homo sapiens
tgaaagcatatgctaaagacca

SEQ ID NO: 8456702 - DNA, 22 bp, Homo sapiens
tgaaagcatgcttgccaagctt

SEQ ID NO: 8456703 - DNA, 22 bp, Homo sapiens
ccaggctgctcacaagctgccc

SEQ ID NO: 8456704 - DNA, 22 bp, Homo sapiens
ccaggctgctcacaagctgccc

SEQ ID NO: 8456705 - DNA, 22 bp, Homo sapiens
ccaggctgccgaggaaagaaag

SEQ ID NO: 8456706 - DNA, 22 bp, Homo sapiens
ccaggctgctcacaagctgccc

SEQ ID NO: 8456707 - DNA, 22 bp, Homo sapiens
tgaaaggaagagggctactcct

SEQ ID NO: 8456708 - DNA, 22 bp, Homo sapiens
ccaggctgagcatgattggagc

SEQ ID NO: 8456709 - DNA, 22 bp, Homo sapiens
ccaggctgagcatgattggagc

SEQ ID NO: 8456710 - DNA, 22 bp, Homo sapiens
ccaggctgagcatgattggagc

SEQ ID NO: 8456711 - DNA, 22 bp, Homo sapiens
ccaggctgcagtcaaggggcat

SEQ ID NO: 8456712 - DNA, 22 bp, Homo sapiens
ccaggctgcagtcaaggggcat

SEQ ID NO: 8456713 - DNA, 22 bp, Homo sapiens
ccaggctgcagtcaaggggcat

SEQ ID NO: 8456714 - DNA, 22 bp, Homo sapiens
ccaggctgccgaggaaagaaag

SEQ ID NO: 8456715 - DNA, 22 bp, Homo sapiens
tgaacagatcaatagaactgac

SEQ ID NO: 8456716 - DNA, 22 bp, Homo sapiens
tgaacagatggcccagcagagg

SEQ ID NO: 8456717 - DNA, 22 bp, Homo sapiens
tgaacagatggcccagcagagg

SEQ ID NO: 8456718 - DNA, 22 bp, Homo sapiens
tgaagaggccaaactatcattg

SEQ ID NO: 8456719 - DNA, 20 bp, Homo sapiens
tgaagaggaagaggacggcc

SEQ ID NO: 8456720 - DNA, 22 bp, Homo sapiens
tgaagagattaagttggttttg

SEQ ID NO: 8456721 - DNA, 22 bp, Homo sapiens
tgaagagtgcttgagattttaa

SEQ ID NO: 8456722 - DNA, 22 bp, Homo sapiens
tgaagaggccgtgtgcaggtga

SEQ ID NO: 8456723 - DNA, 22 bp, Homo sapiens
tgaagagattaagttggttttg

SEQ ID NO: 8456724 - DNA, 22 bp, Homo sapiens
tgaagagatagaagtacatgct

SEQ ID NO: 8456725 - DNA, 22 bp, Homo sapiens
tgaagagaagaaaattatcttt

SEQ ID NO: 8456726 - DNA, 22 bp, Homo sapiens
tgaagctttaggatgggttcat

SEQ ID NO: 8456727 - DNA, 22 bp, Homo sapiens
tgaaggagaaatggaaagtggg

SEQ ID NO: 8456728 - DNA, 22 bp, Homo sapiens
tgaaggaatgagggagtgggtc

SEQ ID NO: 8456729 - DNA, 22 bp, Homo sapiens
ctggagagttggaagatggact

SEQ ID NO: 8456730 - DNA, 22 bp, Homo sapiens
ctggagagttggaagatggact

SEQ ID NO: 8456731 - DNA, 22 bp, Homo sapiens
ctggagagagaaaaagccttaa

SEQ ID NO: 8456732 - DNA, 22 bp, Homo sapiens
ctggagagatcctcctgaaaaa

SEQ ID NO: 8456733 - DNA, 22 bp, Homo sapiens
ctggagaggctgggaacaggtt

SEQ ID NO: 8456734 - DNA, 22 bp, Homo sapiens
ctggagaggctgggaacaggtt

SEQ ID NO: 8456735 - DNA, 22 bp, Homo sapiens
ctggagagggagccctggcagt

SEQ ID NO: 8456736 - DNA, 22 bp, Homo sapiens
ctggagagggagccctggcagt

SEQ ID NO: 8456737 - DNA, 22 bp, Homo sapiens
ctggagcagcaggtggccaggg

SEQ ID NO: 8456738 - DNA, 22 bp, Homo sapiens
ctggagcaggtttaggagtccc

SEQ ID NO: 8456739 - DNA, 22 bp, Homo sapiens
ctggagccggaccagggacggt

SEQ ID NO: 8456740 - DNA, 22 bp, Homo sapiens
ctggagcctgcagttttcactt

SEQ ID NO: 8456741 - DNA, 22 bp, Homo sapiens
ctggagccggcgagccccagcc

SEQ ID NO: 8456742 - DNA, 22 bp, Homo sapiens
ctggagccggcgagccccagcc

SEQ ID NO: 8456743 - DNA, 22 bp, Homo sapiens
ctggagccgcatggagcaggga

SEQ ID NO: 8456744 - DNA, 22 bp, Homo sapiens
ctggaaggggcagtctttgggc

SEQ ID NO: 8456745 - DNA, 22 bp, Homo sapiens
ctggaagggaaatctcttggca

SEQ ID NO: 8456746 - DNA, 22 bp, Homo sapiens
ctggaagggaaatctcttggca

SEQ ID NO: 8456747 - DNA, 22 bp, Homo sapiens
ctggaaggcagaggttgcagtg

SEQ ID NO: 8456748 - DNA, 22 bp, Homo sapiens
ctggaaggcggaggttgtagtg

SEQ ID NO: 8456749 - DNA, 22 bp, Homo sapiens
ctggaaggctctgctgcctgtc

SEQ ID NO: 8456750 - DNA, 22 bp, Homo sapiens
ctggaaggagaaggaggctgtg

SEQ ID NO: 8456751 - DNA, 22 bp, Homo sapiens
ctggaaggagcccgggcggatc

SEQ ID NO: 8456752 - DNA, 19 bp, Homo sapiens
ctggaaggagggactgttc

SEQ ID NO: 8456753 - DNA, 22 bp, Homo sapiens
ctggaagggtctacttagcaga

SEQ ID NO: 8456754 - DNA, 22 bp, Homo sapiens
ctggaagggtctacttagcaga

SEQ ID NO: 8456755 - DNA, 22 bp, Homo sapiens
ctggaagggtcagagtgatgag

SEQ ID NO: 8456756 - DNA, 22 bp, Homo sapiens
ctggaaggtctgtccccactgc

SEQ ID NO: 8456757 - DNA, 22 bp, Homo sapiens
ctggaaggtaacaaggccatta

SEQ ID NO: 8456758 - DNA, 22 bp, Homo sapiens
ctggaaagtgcttttctgagag

SEQ ID NO: 8456759 - DNA, 22 bp, Homo sapiens
ctggaaagtgcatgtaatgagg

SEQ ID NO: 8456760 - DNA, 22 bp, Homo sapiens
ctggaaagtgctgagacaattg

SEQ ID NO: 8456761 - DNA, 22 bp, Homo sapiens
ctggaaagtcaggtcagaaact

SEQ ID NO: 8456762 - DNA, 22 bp, Homo sapiens
ctgctgtgagtttggaggtcta

SEQ ID NO: 8456763 - DNA, 22 bp, Homo sapiens
ctgctgtctttatttcactgct

SEQ ID NO: 8456764 - DNA, 22 bp, Homo sapiens
ctgctgtgagtggttcttgcct

SEQ ID NO: 8456765 - DNA, 22 bp, Homo sapiens
ctggaagagtgactttgcattt

SEQ ID NO: 8456766 - DNA, 22 bp, Homo sapiens
ctgcctttgaaagttctgttga

SEQ ID NO: 8456767 - DNA, 22 bp, Homo sapiens
ctgcctttgcccttgacactgt

SEQ ID NO: 8456768 - DNA, 22 bp, Homo sapiens
ctgccttggtttctagcagggc

SEQ ID NO: 8456769 - DNA, 22 bp, Homo sapiens
ctgcctttgtgatcagttcttt

SEQ ID NO: 8456770 - DNA, 22 bp, Homo sapiens
ctgcggctctgcgggcagctgg

SEQ ID NO: 8456771 - DNA, 22 bp, Homo sapiens
ctgccttttcatctgagctgga

SEQ ID NO: 8456772 - DNA, 22 bp, Homo sapiens
ctgctctgttcccccatcatct

SEQ ID NO: 8456773 - DNA, 22 bp, Homo sapiens
ctgctctgtttcttagctgggt

SEQ ID NO: 8456774 - DNA, 22 bp, Homo sapiens
ctgcctgtggtctgtgatctaa

SEQ ID NO: 8456775 - DNA, 22 bp, Homo sapiens
ctgcctgttagtctagcagtta

SEQ ID NO: 8456776 - DNA, 22 bp, Homo sapiens
ctgcctgtgtgtgcctgcagaa

SEQ ID NO: 8456777 - DNA, 22 bp, Homo sapiens
ctgcctgtgtctattccttttt

SEQ ID NO: 8456778 - DNA, 22 bp, Homo sapiens
ctgcctggggaatgtgaggatt

SEQ ID NO: 8456779 - DNA, 22 bp, Homo sapiens
ctgcctgtggacaccctggagg

SEQ ID NO: 8456780 - DNA, 22 bp, Homo sapiens
ctgcctgtggacaccctggagg

SEQ ID NO: 8456781 - DNA, 22 bp, Homo sapiens
ctgcccctgccaggcagctgtc

SEQ ID NO: 8456782 - DNA, 22 bp, Homo sapiens
ctgcctgtttcctcttgctccc

SEQ ID NO: 8456783 - DNA, 22 bp, Homo sapiens
ctgccttcatctctgagctggg

SEQ ID NO: 8456784 - DNA, 22 bp, Homo sapiens
ctgcctgttcctgatcattcta

SEQ ID NO: 8456785 - DNA, 22 bp, Homo sapiens
ctgccttccaaccccagactcc

SEQ ID NO: 8456786 - DNA, 22 bp, Homo sapiens
ctgccttccaaccccagactcc

SEQ ID NO: 8456787 - DNA, 22 bp, Homo sapiens
ctgccttgcaccggctctctgg

SEQ ID NO: 8456788 - DNA, 22 bp, Homo sapiens
ctgccttctttcaagggtaagc

SEQ ID NO: 8456789 - DNA, 22 bp, Homo sapiens
ctgctgtccaacctgcactcgc

SEQ ID NO: 8456790 - DNA, 22 bp, Homo sapiens
ctgctgtccaacctgcactcgc

SEQ ID NO: 8456791 - DNA, 22 bp, Homo sapiens
ctgctgtccaggagtgccctgt

SEQ ID NO: 8456792 - DNA, 22 bp, Homo sapiens
ctgctgtcccagcctcctcaca

SEQ ID NO: 8456793 - DNA, 22 bp, Homo sapiens
ctgctgtcgccgagctgcatgc

SEQ ID NO: 8456794 - DNA, 22 bp, Homo sapiens
ctgctgtcgccgagctgcatgc

SEQ ID NO: 8456795 - DNA, 22 bp, Homo sapiens
ctgctgtcgccacggtcgccgc

SEQ ID NO: 8456796 - DNA, 22 bp, Homo sapiens
ctgctggttgcacagagctagg

SEQ ID NO: 8456797 - DNA, 22 bp, Homo sapiens
ctgctgtcaaaaatcactccat

SEQ ID NO: 8456798 - DNA, 22 bp, Homo sapiens
ctgctgtaatgagtcagcatct

SEQ ID NO: 8456799 - DNA, 22 bp, Homo sapiens
ctgctgtcaaaaatcactccat

SEQ ID NO: 8456800 - DNA, 22 bp, Homo sapiens
ctgctgtaatgagtcagcatct

SEQ ID NO: 8456801 - DNA, 22 bp, Homo sapiens
ctgctgtacttaggaagaggaa

SEQ ID NO: 8456802 - DNA, 22 bp, Homo sapiens
ctgctgggtccccctgctgatt

SEQ ID NO: 8456803 - DNA, 22 bp, Homo sapiens
ctgctgggtccccctgctgatt

SEQ ID NO: 8456804 - DNA, 22 bp, Homo sapiens
ctgctgggtctatgcaagtgga

SEQ ID NO: 8456805 - DNA, 19 bp, Homo sapiens
ctgctgggtgctgagggag

SEQ ID NO: 8456806 - DNA, 22 bp, Homo sapiens
ctgctggtaccagtggccgtca

SEQ ID NO: 8456807 - DNA, 22 bp, Homo sapiens
ctgctgagaaaagactgaggga

SEQ ID NO: 8456808 - DNA, 22 bp, Homo sapiens
ctgctgagaaaagactgaggga

SEQ ID NO: 8456809 - DNA, 22 bp, Homo sapiens
ctgctgagagccacgtggcaca

SEQ ID NO: 8456810 - DNA, 22 bp, Homo sapiens
ctgctgaacctttgctagataa

SEQ ID NO: 8456811 - DNA, 22 bp, Homo sapiens
ctgctcttgagggactgcggtc

SEQ ID NO: 8456812 - DNA, 22 bp, Homo sapiens
ctgctgaagttgttggtctttt

SEQ ID NO: 8456813 - DNA, 22 bp, Homo sapiens
ctgctgagatgccaggagctct

SEQ ID NO: 8456814 - DNA, 22 bp, Homo sapiens
ctgctgagagccccagctgaga

SEQ ID NO: 8456815 - DNA, 22 bp, Homo sapiens
ctgctgggaaggtctgctcagt

SEQ ID NO: 8456816 - DNA, 22 bp, Homo sapiens
ctgctgagcatcagggctgccc

SEQ ID NO: 8456817 - DNA, 22 bp, Homo sapiens
ctgctgggaaggtctgctcagt

SEQ ID NO: 8456818 - DNA, 22 bp, Homo sapiens
ttttgcttttgtaacacagtgt

SEQ ID NO: 8456819 - DNA, 22 bp, Homo sapiens
ttttgcttttgtaacacagtgt

SEQ ID NO: 8456820 - DNA, 22 bp, Homo sapiens
ttttgcttgagtgcacaaaatg

SEQ ID NO: 8456821 - DNA, 22 bp, Homo sapiens
ttttgcttgagtgcacaaaatg

SEQ ID NO: 8456822 - DNA, 22 bp, Homo sapiens
ttttgcttgagtgcacaaaatg

SEQ ID NO: 8456823 - DNA, 22 bp, Homo sapiens
ttttggaatcatttacagagca

SEQ ID NO: 8456824 - DNA, 22 bp, Homo sapiens
ctcttcccagctccacgagagg

SEQ ID NO: 8456825 - DNA, 22 bp, Homo sapiens
ctgagcagtagagggtctcttt

SEQ ID NO: 8456826 - DNA, 22 bp, Homo sapiens
ctgagcagtctagccaggtgtt

SEQ ID NO: 8456827 - DNA, 22 bp, Homo sapiens
ctgagcagtctagccaggtgtt

SEQ ID NO: 8456828 - DNA, 22 bp, Homo sapiens
ctgagcaggatattcacagcag

SEQ ID NO: 8456829 - DNA, 22 bp, Homo sapiens
ctgagcagtgctttgcagtggg

SEQ ID NO: 8456830 - DNA, 22 bp, Homo sapiens
ctgagcagtctgactcaagcta

SEQ ID NO: 8456831 - DNA, 22 bp, Homo sapiens
ctgagcagcgtggggagctggc

SEQ ID NO: 8456832 - DNA, 22 bp, Homo sapiens
ctgagcaggacagtgggagacc

SEQ ID NO: 8456833 - DNA, 22 bp, Homo sapiens
ctgagcaggatattcacagcag

SEQ ID NO: 8456834 - DNA, 22 bp, Homo sapiens
ctgagcagcgtggggagctggc

SEQ ID NO: 8456835 - DNA, 22 bp, Homo sapiens
ctgagcagaagggtgcacgtgc

SEQ ID NO: 8456836 - DNA, 22 bp, Homo sapiens
ctgagcagaccatggcagaggt

SEQ ID NO: 8456837 - DNA, 19 bp, Homo sapiens
ctgagcagcggcagcactt

SEQ ID NO: 8456838 - DNA, 19 bp, Homo sapiens
ctgagcagcggcagcactt

SEQ ID NO: 8456839 - DNA, 18 bp, Homo sapiens
ctgaggctggcaggagcc

SEQ ID NO: 8456840 - DNA, 18 bp, Homo sapiens
ctgaggctggcaggagcc

SEQ ID NO: 8456841 - DNA, 18 bp, Homo sapiens
ctgaggctggcaggagcc

SEQ ID NO: 8456842 - DNA, 17 bp, Homo sapiens
ctgaggggagtgctgtg

SEQ ID NO: 8456843 - DNA, 22 bp, Homo sapiens
ctgaggtctattttgaaactgc

SEQ ID NO: 8456844 - DNA, 17 bp, Homo sapiens
ctgaggggagtgctgtg

SEQ ID NO: 8456845 - DNA, 22 bp, Homo sapiens
ctgaggctccctcgggtctgct

SEQ ID NO: 8456846 - DNA, 22 bp, Homo sapiens
ctgaggctctgggtgtcactgt

SEQ ID NO: 8456847 - DNA, 22 bp, Homo sapiens
ctgaggctgaagagggcctacg

SEQ ID NO: 8456848 - DNA, 22 bp, Homo sapiens
ctgaggctgcccagggccaggt

SEQ ID NO: 8456849 - DNA, 22 bp, Homo sapiens
ctgaggctgcccagggccaggt

SEQ ID NO: 8456850 - DNA, 22 bp, Homo sapiens
ctgaggccgttggtgggcctta

SEQ ID NO: 8456851 - DNA, 22 bp, Homo sapiens
ctgagccaaaaagcagagcttg

SEQ ID NO: 8456852 - DNA, 22 bp, Homo sapiens
ctgagccaaaaagcagagcttg

SEQ ID NO: 8456853 - DNA, 22 bp, Homo sapiens
ctgagccaaaaagcagagcttg

SEQ ID NO: 8456854 - DNA, 22 bp, Homo sapiens
ctgagccaaaaagcagagcttg

SEQ ID NO: 8456855 - DNA, 22 bp, Homo sapiens
ctgagcatggccggtccatggt

SEQ ID NO: 8456856 - DNA, 22 bp, Homo sapiens
ctgaggctaacctcgagagaca

SEQ ID NO: 8456857 - DNA, 22 bp, Homo sapiens
ctgaggctaacctcgagagaca

SEQ ID NO: 8456858 - DNA, 22 bp, Homo sapiens
ctgaggcctggtgaggtggtga

SEQ ID NO: 8456859 - DNA, 22 bp, Homo sapiens
ctgaggtgagaggaggccatgt

SEQ ID NO: 8456860 - DNA, 22 bp, Homo sapiens
ctgaggtgagaggaggccatgt

SEQ ID NO: 8456861 - DNA, 23 bp, Homo sapiens
ctgaggtctgcaattctagtagt

SEQ ID NO: 8456862 - DNA, 19 bp, Homo sapiens
ctgaggtgcagtaagaggc

SEQ ID NO: 8456863 - DNA, 22 bp, Homo sapiens
ctgaggtgttgatgacctatgc

SEQ ID NO: 8456864 - DNA, 22 bp, Homo sapiens
ctgaggtgtggtctgggagtat

SEQ ID NO: 8456865 - DNA, 22 bp, Homo sapiens
ctgaggtgtttagtaggggcgg

SEQ ID NO: 8456866 - DNA, 22 bp, Homo sapiens
ctgaggtggcgcctctctttaa

SEQ ID NO: 8456867 - DNA, 22 bp, Homo sapiens
ctgcagctgggccagggccacc

SEQ ID NO: 8456868 - DNA, 22 bp, Homo sapiens
ctgcagctgtctctactgggca

SEQ ID NO: 8456869 - DNA, 22 bp, Homo sapiens
ctgcaggaattcaaagtgagct

SEQ ID NO: 8456870 - DNA, 22 bp, Homo sapiens
ctgcaggacagggaggagcaag

SEQ ID NO: 8456871 - DNA, 22 bp, Homo sapiens
ctgcaggactgaaagatgaggt

SEQ ID NO: 8456872 - DNA, 22 bp, Homo sapiens
ctgcaggaatctgtgctaggtg

SEQ ID NO: 8456873 - DNA, 22 bp, Homo sapiens
ctgcaggaatctgtgctaggtg

SEQ ID NO: 8456874 - DNA, 22 bp, Homo sapiens
ctgcaggaaggggacggagtgg

SEQ ID NO: 8456875 - DNA, 22 bp, Homo sapiens
ctgccccagtgccaggcaggtg

SEQ ID NO: 8456876 - DNA, 22 bp, Homo sapiens
ctgccccaccccaacctgaggt

SEQ ID NO: 8456877 - DNA, 22 bp, Homo sapiens
ctgccccaggacctcttctgga

SEQ ID NO: 8456878 - DNA, 22 bp, Homo sapiens
ctgccccagcctggggccttct

SEQ ID NO: 8456879 - DNA, 22 bp, Homo sapiens
ctgccccaggcctccttttctt

SEQ ID NO: 8456880 - DNA, 22 bp, Homo sapiens
ctgccccaggcctccttttctt

SEQ ID NO: 8456881 - DNA, 22 bp, Homo sapiens
ctgccccaggacctcttctgga

SEQ ID NO: 8456882 - DNA, 22 bp, Homo sapiens
ctgccccaggacctcttctgga

SEQ ID NO: 8456883 - DNA, 22 bp, Homo sapiens
ctgcccaggaaggagaggatgg

SEQ ID NO: 8456884 - DNA, 22 bp, Homo sapiens
ctgcccaggaaccagaggggca

SEQ ID NO: 8456885 - DNA, 22 bp, Homo sapiens
ctgcccaggggagtgctgtcgg

SEQ ID NO: 8456886 - DNA, 22 bp, Homo sapiens
ctgcccaggggagtgctgtcgg

SEQ ID NO: 8456887 - DNA, 22 bp, Homo sapiens
ctgcccaggctgaaggaacatc

SEQ ID NO: 8456888 - DNA, 21 bp, Homo sapiens
ctgcccatttgtgatgtcccc

SEQ ID NO: 8456889 - DNA, 22 bp, Homo sapiens
ctgcccagtttgggagcctttc

SEQ ID NO: 8456890 - DNA, 22 bp, Homo sapiens
ctgcccagtttgggagcctttc

SEQ ID NO: 8456891 - DNA, 21 bp, Homo sapiens
ctgcaggatgctgaagccagg

SEQ ID NO: 8456892 - DNA, 22 bp, Homo sapiens
ctgcaggagtgaaagcaggcct

SEQ ID NO: 8456893 - DNA, 22 bp, Homo sapiens
ctgcaggagtgaaagcaggcct

SEQ ID NO: 8456894 - DNA, 22 bp, Homo sapiens
ctgcaggagtgaaagcaggcct

SEQ ID NO: 8456895 - DNA, 22 bp, Homo sapiens
ctgcaggatttcatgggctgac

SEQ ID NO: 8456896 - DNA, 22 bp, Homo sapiens
ctgcaggatttcatgggctgac

SEQ ID NO: 8456897 - DNA, 22 bp, Homo sapiens
ctgcaggagggctggggaagcc

SEQ ID NO: 8456898 - DNA, 22 bp, Homo sapiens
ctgcaggagcaagcctgggaga

SEQ ID NO: 8456899 - DNA, 22 bp, Homo sapiens
ctgccatgtgtgaaaggggagg

SEQ ID NO: 8456900 - DNA, 22 bp, Homo sapiens
ctgccatgtgtgaaaggggagg

SEQ ID NO: 8456901 - DNA, 22 bp, Homo sapiens
ctgccatgttacctgcacaggt

SEQ ID NO: 8456902 - DNA, 22 bp, Homo sapiens
ctgcccagattttaccacctgc

SEQ ID NO: 8456903 - DNA, 20 bp, Homo sapiens
ctgcccagccactgagggat

SEQ ID NO: 8456904 - DNA, 20 bp, Homo sapiens
ctgcccagccactgagggat

SEQ ID NO: 8456905 - DNA, 22 bp, Homo sapiens
ctgcccagattttaccacctgc

SEQ ID NO: 8456906 - DNA, 20 bp, Homo sapiens
ctgcccagccactgagggat

SEQ ID NO: 8456907 - DNA, 20 bp, Homo sapiens
ctgcccagccactgagggat

SEQ ID NO: 8456908 - DNA, 22 bp, Homo sapiens
tttcagaatagcaaagcaagct

SEQ ID NO: 8456909 - DNA, 22 bp, Homo sapiens
ctcctgtgttcaagcgattctc

SEQ ID NO: 8456910 - DNA, 23 bp, Homo sapiens
tttcagaagtggtcctaggaagc

SEQ ID NO: 8456911 - DNA, 22 bp, Homo sapiens
tttcagaagtcacagttgactg

SEQ ID NO: 8456912 - DNA, 23 bp, Homo sapiens
tttcagaagtggtcctaggaagc

SEQ ID NO: 8456913 - DNA, 22 bp, Homo sapiens
tttcagaagtcaactaggtaaa

SEQ ID NO: 8456914 - DNA, 23 bp, Homo sapiens
tttcagaagtggtcctaggaagc

SEQ ID NO: 8456915 - DNA, 22 bp, Homo sapiens
tttcagaatagcaaagcaagct

SEQ ID NO: 8456916 - DNA, 22 bp, Homo sapiens
ctccttcagctgaatccctgct

SEQ ID NO: 8456917 - DNA, 22 bp, Homo sapiens
ctccttcatgtcatgtgtccgg

SEQ ID NO: 8456918 - DNA, 22 bp, Homo sapiens
ctccttcatgtcatgtgtccgg

SEQ ID NO: 8456919 - DNA, 22 bp, Homo sapiens
ctccttcacgcaggctgccatg

SEQ ID NO: 8456920 - DNA, 22 bp, Homo sapiens
ctccttcccatgagtgtgggca

SEQ ID NO: 8456921 - DNA, 22 bp, Homo sapiens
ctccttccaacaagagaaagag

SEQ ID NO: 8456922 - DNA, 22 bp, Homo sapiens
ctccttcccctactcagcatcc

SEQ ID NO: 8456923 - DNA, 22 bp, Homo sapiens
ctccttcccttcaagtgttcct

SEQ ID NO: 8456924 - DNA, 22 bp, Homo sapiens
ctccttcccttcaagtgttcct

SEQ ID NO: 8456925 - DNA, 22 bp, Homo sapiens
ctccttccctaccatcaatgtt

SEQ ID NO: 8456926 - DNA, 19 bp, Homo sapiens
ctccttccctggtttctgt

SEQ ID NO: 8456927 - DNA, 22 bp, Homo sapiens
ctccttcccctactcagcatcc

SEQ ID NO: 8456928 - DNA, 22 bp, Homo sapiens
ctccttcctgcagatctgagat

SEQ ID NO: 8456929 - DNA, 22 bp, Homo sapiens
ctccttcctgccccagtgataa

SEQ ID NO: 8456930 - DNA, 22 bp, Homo sapiens
ctccttcctgccccagtgataa

SEQ ID NO: 8456931 - DNA, 22 bp, Homo sapiens
tttcagtttccagctttgtcat

SEQ ID NO: 8456932 - DNA, 22 bp, Homo sapiens
tttcagtttatgtcttgaatta

SEQ ID NO: 8456933 - DNA, 22 bp, Homo sapiens
tttcagtttagactaaaggtag

SEQ ID NO: 8456934 - DNA, 22 bp, Homo sapiens
tttcacatataggggaagctac

SEQ ID NO: 8456935 - DNA, 22 bp, Homo sapiens
tttattcatcatctgttcatat

SEQ ID NO: 8456936 - DNA, 22 bp, Homo sapiens
tttattcattgtttcgtcgcag

SEQ ID NO: 8456937 - DNA, 22 bp, Homo sapiens
tttattcatcatctgttcatat

SEQ ID NO: 8456938 - DNA, 22 bp, Homo sapiens
tttattcatcatctgttcatat

SEQ ID NO: 8456939 - DNA, 20 bp, Homo sapiens
tttattcagcctaccctctt

SEQ ID NO: 8456940 - DNA, 22 bp, Homo sapiens
tttattcagcagcagcagtggt

SEQ ID NO: 8456941 - DNA, 22 bp, Homo sapiens
tttcagaaccaagagagacatc

SEQ ID NO: 8456942 - DNA, 22 bp, Homo sapiens
tttcagaaccgctaaaataaat

SEQ ID NO: 8456943 - DNA, 22 bp, Homo sapiens
tttcagaaggggagaaaggtca

SEQ ID NO: 8456944 - DNA, 22 bp, Homo sapiens
tttcagaaggggagaaaggtca

SEQ ID NO: 8456945 - DNA, 22 bp, Homo sapiens
tttcagaagtcaactaggtaaa

SEQ ID NO: 8456946 - DNA, 22 bp, Homo sapiens
tttcagaagtcaactaggtaaa

SEQ ID NO: 8456947 - DNA, 22 bp, Homo sapiens
tttcagaaattatattagatgc

SEQ ID NO: 8456948 - DNA, 22 bp, Homo sapiens
tttcagaaccaagagagacatc

SEQ ID NO: 8456949 - DNA, 22 bp, Homo sapiens
tttcagaaattgttattattct

SEQ ID NO: 8456950 - DNA, 22 bp, Homo sapiens
tttatgattattttaaagcagc

SEQ ID NO: 8456951 - DNA, 22 bp, Homo sapiens
tttatgcatctctaggaagggc

SEQ ID NO: 8456952 - DNA, 19 bp, Homo sapiens
tttattcacctttaccttg

SEQ ID NO: 8456953 - DNA, 22 bp, Homo sapiens
tttattcactcattcagccagt

SEQ ID NO: 8456954 - DNA, 22 bp, Homo sapiens
tttattcacttcagtgccaaag

SEQ ID NO: 8456955 - DNA, 22 bp, Homo sapiens
tttattcactggggtctgcccg

SEQ ID NO: 8456956 - DNA, 22 bp, Homo sapiens
ctccaggagggggatggctgta

SEQ ID NO: 8456957 - DNA, 22 bp, Homo sapiens
ctccaggagggggatggctgta

SEQ ID NO: 8456958 - DNA, 22 bp, Homo sapiens
ctccaggaggttgctgcttcct

SEQ ID NO: 8456959 - DNA, 22 bp, Homo sapiens
ctccaggagggcttcctgtgat

SEQ ID NO: 8456960 - DNA, 22 bp, Homo sapiens
ctccaggagggcttcctgtgat

SEQ ID NO: 8456961 - DNA, 22 bp, Homo sapiens
ctccaggactgaggacagagct

SEQ ID NO: 8456962 - DNA, 19 bp, Homo sapiens
ctccaggatggctgggcga

SEQ ID NO: 8456963 - DNA, 19 bp, Homo sapiens
ctccaggatggctgggcga

SEQ ID NO: 8456964 - DNA, 22 bp, Homo sapiens
ctccaggagtggcctggacacc

SEQ ID NO: 8456965 - DNA, 22 bp, Homo sapiens
ctccaggccaagattaagtaat

SEQ ID NO: 8456966 - DNA, 23 bp, Homo sapiens
tttatattcctaatgtcttgagc

SEQ ID NO: 8456967 - DNA, 23 bp, Homo sapiens
tttatattcctaatgtcttgagc

SEQ ID NO: 8456968 - DNA, 22 bp, Homo sapiens
tttatattacctggaatagctt

SEQ ID NO: 8456969 - DNA, 22 bp, Homo sapiens
ctccaggcccctggccttctgc

SEQ ID NO: 8456970 - DNA, 22 bp, Homo sapiens
ctccaggcccacgtcgaggagg

SEQ ID NO: 8456971 - DNA, 22 bp, Homo sapiens
ctccaggcccacgtcgaggagg

SEQ ID NO: 8456972 - DNA, 22 bp, Homo sapiens
ctccaggccatggctgcggagg

SEQ ID NO: 8456973 - DNA, 22 bp, Homo sapiens
tttctacaatttttggcatgag

SEQ ID NO: 8456974 - DNA, 22 bp, Homo sapiens
tttctacagaagatacactgct

SEQ ID NO: 8456975 - DNA, 22 bp, Homo sapiens
tttctacagctggtgcaacttt

SEQ ID NO: 8456976 - DNA, 22 bp, Homo sapiens
tttctacagctggtgcaacttt

SEQ ID NO: 8456977 - DNA, 22 bp, Homo sapiens
tttccaatgtagatgtctctgg

SEQ ID NO: 8456978 - DNA, 22 bp, Homo sapiens
tttccacacaggctctactact

SEQ ID NO: 8456979 - DNA, 22 bp, Homo sapiens
tttccaagttgttaccttctac

SEQ ID NO: 8456980 - DNA, 22 bp, Homo sapiens
tttccaagtactgagctgtcaa

SEQ ID NO: 8456981 - DNA, 22 bp, Homo sapiens
tttccaagagcttatttctgaa

SEQ ID NO: 8456982 - DNA, 22 bp, Homo sapiens
tttccaagagcttatttctgaa

SEQ ID NO: 8456983 - DNA, 22 bp, Homo sapiens
tttcattacgtgtttgacttgt

SEQ ID NO: 8456984 - DNA, 22 bp, Homo sapiens
tttcatgttacatttaaaatgt

SEQ ID NO: 8456985 - DNA, 22 bp, Homo sapiens
tttcatgttagttggttcttgg

SEQ ID NO: 8456986 - DNA, 22 bp, Homo sapiens
tttcatgttggatactgtttca

SEQ ID NO: 8456987 - DNA, 22 bp, Homo sapiens
tttcatgttggggagttgagtg

SEQ ID NO: 8456988 - DNA, 19 bp, Homo sapiens
tttcatgtttttggtgaga

SEQ ID NO: 8456989 - DNA, 22 bp, Homo sapiens
tttctcaaaagacagaagtgaa

SEQ ID NO: 8456990 - DNA, 22 bp, Homo sapiens
tttctcaacctcaacactattt

SEQ ID NO: 8456991 - DNA, 22 bp, Homo sapiens
tttctcaaattgcatgagtagc

SEQ ID NO: 8456992 - DNA, 23 bp, Homo sapiens
tttctcaaagagtggcagcttca

SEQ ID NO: 8456993 - DNA, 22 bp, Homo sapiens
tttctcaagttcagatatttga

SEQ ID NO: 8456994 - DNA, 19 bp, Homo sapiens
ctctctggcggtgtctgcg

SEQ ID NO: 8456995 - DNA, 18 bp, Homo sapiens
ctctctggtctggatccc

SEQ ID NO: 8456996 - DNA, 22 bp, Homo sapiens
tttctcaagtactgcacatgaa

SEQ ID NO: 8456997 - DNA, 22 bp, Homo sapiens
tttctcaagtactgcacatgaa

SEQ ID NO: 8456998 - DNA, 22 bp, Homo sapiens
ctctgaaagcaaaactagagaa

SEQ ID NO: 8456999 - DNA, 22 bp, Homo sapiens
ctctctgtcttggcatttggtc

SEQ ID NO: 8457000 - DNA, 22 bp, Homo sapiens
ctctctgtgctcacaagggcag

SEQ ID NO: 8457001 - DNA, 22 bp, Homo sapiens
ctctctgtggtggctgtcccat

SEQ ID NO: 8457002 - DNA, 22 bp, Homo sapiens
ctctctgtatgtgtatatttat

SEQ ID NO: 8457003 - DNA, 22 bp, Homo sapiens
ctctctggtttcagcgaagggg

SEQ ID NO: 8457004 - DNA, 22 bp, Homo sapiens
ctctctgttatgctttcatgaa

SEQ ID NO: 8457005 - DNA, 22 bp, Homo sapiens
ctctctgttcattgagtcaaaa

SEQ ID NO: 8457006 - DNA, 22 bp, Homo sapiens
ctctgaagggagggccaagccc

SEQ ID NO: 8457007 - DNA, 22 bp, Homo sapiens
ctctgaagatggtaccagcttt

SEQ ID NO: 8457008 - DNA, 22 bp, Homo sapiens
ctctgaaggtttctgttactgt

SEQ ID NO: 8457009 - DNA, 22 bp, Homo sapiens
tttgaaaattagacacaggcta

SEQ ID NO: 8457010 - DNA, 22 bp, Homo sapiens
tttgaaaatttaagtgctacac

SEQ ID NO: 8457011 - DNA, 22 bp, Homo sapiens
tttgaaacccgtcactttgagt

SEQ ID NO: 8457012 - DNA, 22 bp, Homo sapiens
tttgaaacccgtcactttgagt

SEQ ID NO: 8457013 - DNA, 22 bp, Homo sapiens
tttgaaacctagttatatgact

SEQ ID NO: 8457014 - DNA, 22 bp, Homo sapiens
tttgaaacctagttatatgact

SEQ ID NO: 8457015 - DNA, 22 bp, Homo sapiens
tttgaaactcatgatcatcact

SEQ ID NO: 8457016 - DNA, 22 bp, Homo sapiens
tttgaaactctgaacatgtttc

SEQ ID NO: 8457017 - DNA, 22 bp, Homo sapiens
tttgaaagaaaccagtgagtga

SEQ ID NO: 8457018 - DNA, 22 bp, Homo sapiens
tttgaaagaaaccagtgagtga

SEQ ID NO: 8457019 - DNA, 22 bp, Homo sapiens
ctctgcaacttctagcagtgtc

SEQ ID NO: 8457020 - DNA, 22 bp, Homo sapiens
ctctgcaaggccctccagtagc

SEQ ID NO: 8457021 - DNA, 22 bp, Homo sapiens
ctctgcaatctgagcacttgta

SEQ ID NO: 8457022 - DNA, 22 bp, Homo sapiens
ctctgcaagtccagcccctggc

SEQ ID NO: 8457023 - DNA, 22 bp, Homo sapiens
ctctgcacccccggctcctcgt

SEQ ID NO: 8457024 - DNA, 22 bp, Homo sapiens
ctctgaggtttcctcacaagct

SEQ ID NO: 8457025 - DNA, 22 bp, Homo sapiens
ctctgaggtctaggaccatggc

SEQ ID NO: 8457026 - DNA, 22 bp, Homo sapiens
ctctgaggtctaggaccatggc

SEQ ID NO: 8457027 - DNA, 22 bp, Homo sapiens
ctctgaggttccctgggtccca

SEQ ID NO: 8457028 - DNA, 22 bp, Homo sapiens
ctctgaggttcctttgccctcg

SEQ ID NO: 8457029 - DNA, 22 bp, Homo sapiens
ctctgcagaatttgagctgctc

SEQ ID NO: 8457030 - DNA, 22 bp, Homo sapiens
ctctgcagagcctccagcccag

SEQ ID NO: 8457031 - DNA, 22 bp, Homo sapiens
ctctgcagaatttgagctgctc

SEQ ID NO: 8457032 - DNA, 22 bp, Homo sapiens
ctctgcagaggcccaaggctga

SEQ ID NO: 8457033 - DNA, 22 bp, Homo sapiens
ctctgcagaggcccaaggctga

SEQ ID NO: 8457034 - DNA, 22 bp, Homo sapiens
ctctgcagaggcccaaggctga

SEQ ID NO: 8457035 - DNA, 21 bp, Homo sapiens
tttgaatagaaatagtgctta

SEQ ID NO: 8457036 - DNA, 20 bp, Homo sapiens
tttgactcaggcctttagcc

SEQ ID NO: 8457037 - DNA, 22 bp, Homo sapiens
tttgactcagcaaattcacagg

SEQ ID NO: 8457038 - DNA, 22 bp, Homo sapiens
tttgcaaaccggagctctgcaa

SEQ ID NO: 8457039 - DNA, 22 bp, Homo sapiens
tttgcaaacacttaagaagaga

SEQ ID NO: 8457040 - DNA, 22 bp, Homo sapiens
tttgagaagatgtaatgttaag

SEQ ID NO: 8457041 - DNA, 22 bp, Homo sapiens
tttgcaaaatgaggtgaagagt

SEQ ID NO: 8457042 - DNA, 22 bp, Homo sapiens
tttgcaaaattattcccagcat

SEQ ID NO: 8457043 - DNA, 22 bp, Homo sapiens
tttgcaaaattattcccagcat

SEQ ID NO: 8457044 - DNA, 22 bp, Homo sapiens
tttgagaagataggggaatact

SEQ ID NO: 8457045 - DNA, 22 bp, Homo sapiens
tttgacttctgggcattttggt

SEQ ID NO: 8457046 - DNA, 22 bp, Homo sapiens
tttgacttctatctagtaagaa

SEQ ID NO: 8457047 - DNA, 22 bp, Homo sapiens
tttgactcttctagcaagtgtg

SEQ ID NO: 8457048 - DNA, 22 bp, Homo sapiens
tttgactcttgcccagtttggc

SEQ ID NO: 8457049 - DNA, 22 bp, Homo sapiens
tttgactcctttgtgaaaagag

SEQ ID NO: 8457050 - DNA, 22 bp, Homo sapiens
tttgactctagtcatagaagtg

SEQ ID NO: 8457051 - DNA, 19 bp, Homo sapiens
tttgactcctcatttttat

SEQ ID NO: 8457052 - DNA, 22 bp, Homo sapiens
tttgactccagagcccattttt

SEQ ID NO: 8457053 - DNA, 22 bp, Homo sapiens
tttgcaaagtgcttgcagagta

SEQ ID NO: 8457054 - DNA, 22 bp, Homo sapiens
tttgcaaagtgactattatatg

SEQ ID NO: 8457055 - DNA, 22 bp, Homo sapiens
ctctggcacactccttccaggt

SEQ ID NO: 8457056 - DNA, 20 bp, Homo sapiens
ctctggcaaaggatgcctat

SEQ ID NO: 8457057 - DNA, 22 bp, Homo sapiens
ctctggagtgggtggccgggag

SEQ ID NO: 8457058 - DNA, 22 bp, Homo sapiens
tttgcaaagtccattgaagtta

SEQ ID NO: 8457059 - DNA, 18 bp, Homo sapiens
tttgcaaaggaagtatgg

SEQ ID NO: 8457060 - DNA, 18 bp, Homo sapiens
tttgcaaaggaagtatgg

SEQ ID NO: 8457061 - DNA, 18 bp, Homo sapiens
tttgcaaaggaagtatgg

SEQ ID NO: 8457062 - DNA, 22 bp, Homo sapiens
tttgcaaactttcctctggacc

SEQ ID NO: 8457063 - DNA, 22 bp, Homo sapiens
ctctggcctgcttcctcaggta

SEQ ID NO: 8457064 - DNA, 22 bp, Homo sapiens
ctctggcctggggcctgctccc

SEQ ID NO: 8457065 - DNA, 22 bp, Homo sapiens
ctctggcctggggcctgctccc

SEQ ID NO: 8457066 - DNA, 22 bp, Homo sapiens
ctctggcagagctgtagacttc

SEQ ID NO: 8457067 - DNA, 22 bp, Homo sapiens
ctctggcacactccttccaggt

SEQ ID NO: 8457068 - DNA, 21 bp, Homo sapiens
tttgttcaggcaagttacagt

SEQ ID NO: 8457069 - DNA, 22 bp, Homo sapiens
tttgttcagctctcattgatta

SEQ ID NO: 8457070 - DNA, 22 bp, Homo sapiens
ctctgggtgtgacagcacctgg

SEQ ID NO: 8457071 - DNA, 21 bp, Homo sapiens
tttgttcaggggcaaagttaa

SEQ ID NO: 8457072 - DNA, 22 bp, Homo sapiens
ctctgggtggtctcactgagtg

SEQ ID NO: 8457073 - DNA, 22 bp, Homo sapiens
ctctgggtgtcttaggagctca

SEQ ID NO: 8457074 - DNA, 22 bp, Homo sapiens
ctctgggtgggcagcagatgga

SEQ ID NO: 8457075 - DNA, 22 bp, Homo sapiens
ctctgggtctacctgtggccag

SEQ ID NO: 8457076 - DNA, 22 bp, Homo sapiens
ctctgggtcctggggctacaag

SEQ ID NO: 8457077 - DNA, 20 bp, Homo sapiens
ctctgggtcgagacagactt

SEQ ID NO: 8457078 - DNA, 22 bp, Homo sapiens
ctctgggtctataatgcagctg

SEQ ID NO: 8457079 - DNA, 22 bp, Homo sapiens
ctctgggtctccctgaggctaa

SEQ ID NO: 8457080 - DNA, 20 bp, Homo sapiens
ctctgggctgcaccctcgcc

SEQ ID NO: 8457081 - DNA, 20 bp, Homo sapiens
ctctgggctgcaccctcgcc

SEQ ID NO: 8457082 - DNA, 19 bp, Homo sapiens
ctctgggctgcatcttggt

SEQ ID NO: 8457083 - DNA, 22 bp, Homo sapiens
tttggaattccatttctgcatt

SEQ ID NO: 8457084 - DNA, 22 bp, Homo sapiens
tttggaattctgcagctcatgt

SEQ ID NO: 8457085 - DNA, 22 bp, Homo sapiens
tttggaattacttactcaagcc

SEQ ID NO: 8457086 - DNA, 22 bp, Homo sapiens
tttggaattatgcttaaagttt

SEQ ID NO: 8457087 - DNA, 22 bp, Homo sapiens
tttggaatggtaccttcagttg

SEQ ID NO: 8457088 - DNA, 22 bp, Homo sapiens
tttggaatgtagtttaatcatc

SEQ ID NO: 8457089 - DNA, 22 bp, Homo sapiens
tttggaatggaatagagattgc

SEQ ID NO: 8457090 - DNA, 22 bp, Homo sapiens
tttggaatggtaccttcagttg

SEQ ID NO: 8457091 - DNA, 22 bp, Homo sapiens
tttggaatgacagatatcaata

SEQ ID NO: 8457092 - DNA, 22 bp, Homo sapiens
tttggaatgcccatggactggt

SEQ ID NO: 8457093 - DNA, 22 bp, Homo sapiens
tttggaatggaatagagattgc

SEQ ID NO: 8457094 - DNA, 22 bp, Homo sapiens
tttggaatgaaacagcagagcc

SEQ ID NO: 8457095 - DNA, 22 bp, Homo sapiens
tttggaataatcagatcctagt

SEQ ID NO: 8457096 - DNA, 22 bp, Homo sapiens
tttggaatagcatagaagctca

SEQ ID NO: 8457097 - DNA, 22 bp, Homo sapiens
tttgttcattttgagctcatca

SEQ ID NO: 8457098 - DNA, 22 bp, Homo sapiens
ctctgtgccctactgctcagct

SEQ ID NO: 8457099 - DNA, 22 bp, Homo sapiens
ctctgtgcctcagttttcttct

SEQ ID NO: 8457100 - DNA, 22 bp, Homo sapiens
ctctgtgattttgtgagccaga

SEQ ID NO: 8457101 - DNA, 22 bp, Homo sapiens
ctctgtgcttatgctccatggg

SEQ ID NO: 8457102 - DNA, 22 bp, Homo sapiens
ctctgtgcgggccatggtcagg

SEQ ID NO: 8457103 - DNA, 22 bp, Homo sapiens
ctctgtgctcccatgctagtaa

SEQ ID NO: 8457104 - DNA, 22 bp, Homo sapiens
ctctgtggaagaagaaagaagg

SEQ ID NO: 8457105 - DNA, 22 bp, Homo sapiens
ctctgtggaagaagaaagaagg

SEQ ID NO: 8457106 - DNA, 17 bp, Homo sapiens
ctctgtggaggtgttta

SEQ ID NO: 8457107 - DNA, 22 bp, Homo sapiens
ctctgtggctacacaaacctcc

SEQ ID NO: 8457108 - DNA, 22 bp, Homo sapiens
ctctgtggcttgcctttctgtc

SEQ ID NO: 8457109 - DNA, 22 bp, Homo sapiens
ctctgtgggaagctgggtgtga

SEQ ID NO: 8457110 - DNA, 22 bp, Homo sapiens
ctctgtgggaggaggagtaggc

SEQ ID NO: 8457111 - DNA, 22 bp, Homo sapiens
ctctgtgggccagagaggcccc

SEQ ID NO: 8457112 - DNA, 22 bp, Homo sapiens
ctctgtgggcctgtgctttagt

SEQ ID NO: 8457113 - DNA, 22 bp, Homo sapiens
ctctgtgggggagaggcagctg

SEQ ID NO: 8457114 - DNA, 22 bp, Homo sapiens
ctctgtggtggagtgggtcacc

SEQ ID NO: 8457115 - DNA, 22 bp, Homo sapiens
ctctgtgggtatttatatgtat

SEQ ID NO: 8457116 - DNA, 22 bp, Homo sapiens
ctctgtggtaaaatagcagtat

SEQ ID NO: 8457117 - DNA, 22 bp, Homo sapiens
ttttgcctgagagtgaaaataa

SEQ ID NO: 8457118 - DNA, 22 bp, Homo sapiens
ttttgcctagggttgacccgtt

SEQ ID NO: 8457119 - DNA, 17 bp, Homo sapiens
ttttctctcttggattc

SEQ ID NO: 8457120 - DNA, 22 bp, Homo sapiens
ttttgcctgagatccgagtctg

SEQ ID NO: 8457121 - DNA, 22 bp, Homo sapiens
ttttgcctgtgaatactatctt

SEQ ID NO: 8457122 - DNA, 22 bp, Homo sapiens
ttttgcctgcactgtatatata

SEQ ID NO: 8457123 - DNA, 22 bp, Homo sapiens
ctctgtggttagactatggctg

SEQ ID NO: 8457124 - DNA, 22 bp, Homo sapiens
ttagacaggatgtatgaaagct

SEQ ID NO: 8457125 - DNA, 18 bp, Homo sapiens
ccttcagctctgccagta

SEQ ID NO: 8457126 - DNA, 21 bp, Homo sapiens
ttagcaaagcaaacacatgct

SEQ ID NO: 8457127 - DNA, 21 bp, Homo sapiens
ttagcaaagcaaacacatgct

SEQ ID NO: 8457128 - DNA, 22 bp, Homo sapiens
ccttgaaaccctgacactctgt

SEQ ID NO: 8457129 - DNA, 22 bp, Homo sapiens
ccttgaaaccctgacactctgt

SEQ ID NO: 8457130 - DNA, 22 bp, Homo sapiens
ccttgaaaccacatcttagaaa

SEQ ID NO: 8457131 - DNA, 22 bp, Homo sapiens
ccttgaaagccaggcagaggaa

SEQ ID NO: 8457132 - DNA, 22 bp, Homo sapiens
ttagcaccttgaacagaccctg

SEQ ID NO: 8457133 - DNA, 22 bp, Homo sapiens
ttagcaaatatcttgaaacagg

SEQ ID NO: 8457134 - DNA, 22 bp, Homo sapiens
ttagcaattccaggtaagttat

SEQ ID NO: 8457135 - DNA, 22 bp, Homo sapiens
ttagcaattgattctcataagc

SEQ ID NO: 8457136 - DNA, 22 bp, Homo sapiens
ttagcaatgtatgattaaaata

SEQ ID NO: 8457137 - DNA, 21 bp, Homo sapiens
ttagcaagtctacccatttct

SEQ ID NO: 8457138 - DNA, 22 bp, Homo sapiens
ttagcaatcctaggctggatca

SEQ ID NO: 8457139 - DNA, 22 bp, Homo sapiens
ttagcaatatgaatgcatttgc

SEQ ID NO: 8457140 - DNA, 20 bp, Homo sapiens
ccttcagaacttacatagta

SEQ ID NO: 8457141 - DNA, 22 bp, Homo sapiens
ccttcaagttcctggtccctgg

SEQ ID NO: 8457142 - DNA, 22 bp, Homo sapiens
ccttcaatcagcagtctagctt

SEQ ID NO: 8457143 - DNA, 22 bp, Homo sapiens
ccttcaaggcaaggagggctgg

SEQ ID NO: 8457144 - DNA, 22 bp, Homo sapiens
ccttcagaatgaaattctaatg

SEQ ID NO: 8457145 - DNA, 22 bp, Homo sapiens
ttacagtttatccaggaagagc

SEQ ID NO: 8457146 - DNA, 22 bp, Homo sapiens
ttacataacggtatgaaaaatg

SEQ ID NO: 8457147 - DNA, 22 bp, Homo sapiens
ttagggaaataaaattatcagt

SEQ ID NO: 8457148 - DNA, 22 bp, Homo sapiens
ccttgccctgagcaggggtcag

SEQ ID NO: 8457149 - DNA, 22 bp, Homo sapiens
ccttgaaatgttctcactgggg

SEQ ID NO: 8457150 - DNA, 22 bp, Homo sapiens
ccttgagaggaagtttgtagaa

SEQ ID NO: 8457151 - DNA, 22 bp, Homo sapiens
ccttgagacacagccaaagatg

SEQ ID NO: 8457152 - DNA, 22 bp, Homo sapiens
ccttgagatgagctaatttttt

SEQ ID NO: 8457153 - DNA, 22 bp, Homo sapiens
ccttgcagttgttactgtagcc

SEQ ID NO: 8457154 - DNA, 22 bp, Homo sapiens
ttatatttctggtagccttcag

SEQ ID NO: 8457155 - DNA, 22 bp, Homo sapiens
ttatatttctggtagccttcag

SEQ ID NO: 8457156 - DNA, 22 bp, Homo sapiens
ttatattgtgtaataagtgaag

SEQ ID NO: 8457157 - DNA, 22 bp, Homo sapiens
ttatattagttagacttgctgt

SEQ ID NO: 8457158 - DNA, 22 bp, Homo sapiens
ttatattagttagacttgctgt

SEQ ID NO: 8457159 - DNA, 22 bp, Homo sapiens
ttatattgtgtaataagtgaag

SEQ ID NO: 8457160 - DNA, 22 bp, Homo sapiens
ttatcatgacttcaagcatcca

SEQ ID NO: 8457161 - DNA, 22 bp, Homo sapiens
ttatcattgtcgcagtctaatt

SEQ ID NO: 8457162 - DNA, 22 bp, Homo sapiens
ttatcagagtccccaaaagaaa

SEQ ID NO: 8457163 - DNA, 22 bp, Homo sapiens
ttataactttggatatgacaag

SEQ ID NO: 8457164 - DNA, 22 bp, Homo sapiens
ttataacaacagtttactttaa

SEQ ID NO: 8457165 - DNA, 22 bp, Homo sapiens
ttataacactgccttgtcacca

SEQ ID NO: 8457166 - DNA, 23 bp, Homo sapiens
ttataaatattttcaggtgtgtt

SEQ ID NO: 8457167 - DNA, 23 bp, Homo sapiens
ttataaatattttcaggtgtgtt

SEQ ID NO: 8457168 - DNA, 22 bp, Homo sapiens
tgtcagagcaatgaggttcagc

SEQ ID NO: 8457169 - DNA, 21 bp, Homo sapiens
tgtcagagcttgtaggacatt

SEQ ID NO: 8457170 - DNA, 22 bp, Homo sapiens
tgtcagagagcaggcagtagaa

SEQ ID NO: 8457171 - DNA, 22 bp, Homo sapiens
tgtcagacctgtgatttcagca

SEQ ID NO: 8457172 - DNA, 22 bp, Homo sapiens
tgtcagagagcaggcagtagaa

SEQ ID NO: 8457173 - DNA, 22 bp, Homo sapiens
tgtcaatagttttgagttctct

SEQ ID NO: 8457174 - DNA, 20 bp, Homo sapiens
tgtcagcaattaggagaaaa

SEQ ID NO: 8457175 - DNA, 22 bp, Homo sapiens
tgtcagctcccagtcagagaga

SEQ ID NO: 8457176 - DNA, 22 bp, Homo sapiens
ttaaatagtaggtctattttgg

SEQ ID NO: 8457177 - DNA, 22 bp, Homo sapiens
ttaaatagtaggtctattttgg

SEQ ID NO: 8457178 - DNA, 22 bp, Homo sapiens
ttaaattagtcaagcttctctg

SEQ ID NO: 8457179 - DNA, 22 bp, Homo sapiens
ttaaattattgagggattgtca

SEQ ID NO: 8457180 - DNA, 22 bp, Homo sapiens
ttaaattagtcaagcttctctg

SEQ ID NO: 8457181 - DNA, 22 bp, Homo sapiens
tgtcagcatttaaggagtaagg

SEQ ID NO: 8457182 - DNA, 22 bp, Homo sapiens
tgtcagctcccagtcagagaga

SEQ ID NO: 8457183 - DNA, 22 bp, Homo sapiens
tgtcagcatgaaccctgaatta

SEQ ID NO: 8457184 - DNA, 22 bp, Homo sapiens
tgtcagcagaagtggtgcactc

SEQ ID NO: 8457185 - DNA, 22 bp, Homo sapiens
tgtcagcagatctcctgcagcc

SEQ ID NO: 8457186 - DNA, 22 bp, Homo sapiens
tgtcagcagtatctctatctca

SEQ ID NO: 8457187 - DNA, 22 bp, Homo sapiens
ttaaattttagaaacagactct

SEQ ID NO: 8457188 - DNA, 22 bp, Homo sapiens
ttaagatttgtagagaaaaagc

SEQ ID NO: 8457189 - DNA, 22 bp, Homo sapiens
ttaagaggtggtcgtgtctgtg

SEQ ID NO: 8457190 - DNA, 22 bp, Homo sapiens
ttaaattccagcctcataatag

SEQ ID NO: 8457191 - DNA, 22 bp, Homo sapiens
ttaaattatttctagtgaggtg

SEQ ID NO: 8457192 - DNA, 22 bp, Homo sapiens
ttaaattattgagggattgtca

SEQ ID NO: 8457193 - DNA, 22 bp, Homo sapiens
ttaaattgtcatttgagcaatg

SEQ ID NO: 8457194 - DNA, 22 bp, Homo sapiens
ccttagatcaggctgtctaggg

SEQ ID NO: 8457195 - DNA, 22 bp, Homo sapiens
ccttagaaggctgaataattct

SEQ ID NO: 8457196 - DNA, 22 bp, Homo sapiens
ccttagaggcaggaagaattgc

SEQ ID NO: 8457197 - DNA, 22 bp, Homo sapiens
ccttagaaggctgaataattct

SEQ ID NO: 8457198 - DNA, 22 bp, Homo sapiens
ccttacctgattgctggcatcc

SEQ ID NO: 8457199 - DNA, 22 bp, Homo sapiens
ccttagaaggctgaataattct

SEQ ID NO: 8457200 - DNA, 22 bp, Homo sapiens
ccttagaagaaagttacttttt

SEQ ID NO: 8457201 - DNA, 22 bp, Homo sapiens
ccttagaaatgtaccaaaggaa

SEQ ID NO: 8457202 - DNA, 22 bp, Homo sapiens
ccttagaaaatcatggaatatt

SEQ ID NO: 8457203 - DNA, 22 bp, Homo sapiens
ccttaggggtgacagaaatacc

SEQ ID NO: 8457204 - DNA, 22 bp, Homo sapiens
ttacaaagagtgccagagtgtg

SEQ ID NO: 8457205 - DNA, 21 bp, Homo sapiens
cctgtgtgtgtccctttaaga

SEQ ID NO: 8457206 - DNA, 22 bp, Homo sapiens
ttaagcataattaaagtgaaat

SEQ ID NO: 8457207 - DNA, 22 bp, Homo sapiens
ccttaatttctgtccttcagat

SEQ ID NO: 8457208 - DNA, 22 bp, Homo sapiens
ccttaaactttatcttgtgaga

SEQ ID NO: 8457209 - DNA, 22 bp, Homo sapiens
ccttaaactctgatatgatatt

SEQ ID NO: 8457210 - DNA, 22 bp, Homo sapiens
ttacaaagattatattcagtta

SEQ ID NO: 8457211 - DNA, 22 bp, Homo sapiens
ttacaaagattatattcagtta

SEQ ID NO: 8457212 - DNA, 22 bp, Homo sapiens
ttacaaagagtgttcttttcca

SEQ ID NO: 8457213 - DNA, 22 bp, Homo sapiens
ttacaaagcgctttacctctga

SEQ ID NO: 8457214 - DNA, 22 bp, Homo sapiens
ttacaaagcaggtcagctgaaa

SEQ ID NO: 8457215 - DNA, 22 bp, Homo sapiens
ttacaaagcaggtcagctgaaa

SEQ ID NO: 8457216 - DNA, 22 bp, Homo sapiens
ttacaaagcaggtcagctgaaa

SEQ ID NO: 8457217 - DNA, 22 bp, Homo sapiens
ttacaaagcaggtcagctgaaa

SEQ ID NO: 8457218 - DNA, 22 bp, Homo sapiens
ttacaaagcgttgagacaagta

SEQ ID NO: 8457219 - DNA, 22 bp, Homo sapiens
ttacagtgttacttgatgtcca

SEQ ID NO: 8457220 - DNA, 22 bp, Homo sapiens
ttacagtgttacttgatgtcca

SEQ ID NO: 8457221 - DNA, 22 bp, Homo sapiens
ttacagtgtgcaatcccagaat

SEQ ID NO: 8457222 - DNA, 22 bp, Homo sapiens
ttacagtgtgcaatcccagaat

SEQ ID NO: 8457223 - DNA, 22 bp, Homo sapiens
ttacagtggtcatttgggaaaa

SEQ ID NO: 8457224 - DNA, 22 bp, Homo sapiens
ttacagttactggtactgttaa

SEQ ID NO: 8457225 - DNA, 22 bp, Homo sapiens
ttacagttaatgtgactaacca

SEQ ID NO: 8457226 - DNA, 22 bp, Homo sapiens
ttacagtttatccaggaagagc

SEQ ID NO: 8457227 - DNA, 22 bp, Homo sapiens
ttacagtttatccaggaagagc

SEQ ID NO: 8457228 - DNA, 22 bp, Homo sapiens
ttacagtttaccaagaatattg

SEQ ID NO: 8457229 - DNA, 22 bp, Homo sapiens
ttacagtttacataagaattgt

SEQ ID NO: 8457230 - DNA, 22 bp, Homo sapiens
ttacagtttacataagaattgt

SEQ ID NO: 8457231 - DNA, 22 bp, Homo sapiens
ttacagtttaagaggaaacaaa

SEQ ID NO: 8457232 - DNA, 22 bp, Homo sapiens
ttacagttgttctatcagcatg

SEQ ID NO: 8457233 - DNA, 22 bp, Homo sapiens
cggacccactcggatcccagcc

SEQ ID NO: 8457234 - DNA, 22 bp, Homo sapiens
ttcaaattaccacatttgctta

SEQ ID NO: 8457235 - DNA, 22 bp, Homo sapiens
ttcaaatggttagactgttagc

SEQ ID NO: 8457236 - DNA, 22 bp, Homo sapiens
ttcaaatggttagactgttagc

SEQ ID NO: 8457237 - DNA, 22 bp, Homo sapiens
ttcaaatgcaagttactacttt

SEQ ID NO: 8457238 - DNA, 22 bp, Homo sapiens
cggaggttgaggctgcagtgag

SEQ ID NO: 8457239 - DNA, 22 bp, Homo sapiens
ttcaaagtgcttttaaccttta

SEQ ID NO: 8457240 - DNA, 22 bp, Homo sapiens
ttcaaagtttcaatctgtatca

SEQ ID NO: 8457241 - DNA, 22 bp, Homo sapiens
ttcaaatcctagccctgtggcc

SEQ ID NO: 8457242 - DNA, 22 bp, Homo sapiens
ttcaaatgatggcagtcctggc

SEQ ID NO: 8457243 - DNA, 22 bp, Homo sapiens
cggcacagccgggcaaggctgg

SEQ ID NO: 8457244 - DNA, 22 bp, Homo sapiens
cggcacagccgggcaaggctgg

SEQ ID NO: 8457245 - DNA, 22 bp, Homo sapiens
cggggccctggggctgaaggtc

SEQ ID NO: 8457246 - DNA, 22 bp, Homo sapiens
cggggcaggagtccctgtagag

SEQ ID NO: 8457247 - DNA, 23 bp, Homo sapiens
cggggccagggtcaggaccggtc

SEQ ID NO: 8457248 - DNA, 22 bp, Homo sapiens
cggggcagaaagttgtcttttg

SEQ ID NO: 8457249 - DNA, 22 bp, Homo sapiens
cgggctggctgcagctgctgga

SEQ ID NO: 8457250 - DNA, 22 bp, Homo sapiens
cgggcaaggcgagactaggccc

SEQ ID NO: 8457251 - DNA, 22 bp, Homo sapiens
cgggaggaaaggcgaggctctg

SEQ ID NO: 8457252 - DNA, 22 bp, Homo sapiens
cgtggctggggcgactccacgg

SEQ ID NO: 8457253 - DNA, 22 bp, Homo sapiens
cggggctgctcgtcctcctgtg

SEQ ID NO: 8457254 - DNA, 22 bp, Homo sapiens
cgtgacagggtctggctggtca

SEQ ID NO: 8457255 - DNA, 22 bp, Homo sapiens
cgtgggagtggtgggtgctcag

SEQ ID NO: 8457256 - DNA, 22 bp, Homo sapiens
cgtgggaggaaaaatgggcttc

SEQ ID NO: 8457257 - DNA, 22 bp, Homo sapiens
cgtggctggtggacctgagggc

SEQ ID NO: 8457258 - DNA, 22 bp, Homo sapiens
cggggctgaggcaacgcggaga

SEQ ID NO: 8457259 - DNA, 22 bp, Homo sapiens
cggggctgcgctcttcctgccg

SEQ ID NO: 8457260 - DNA, 22 bp, Homo sapiens
ttatccaacatgacttatgtcc

SEQ ID NO: 8457261 - DNA, 22 bp, Homo sapiens
ccttttgaaggtgttgttaagt

SEQ ID NO: 8457262 - DNA, 22 bp, Homo sapiens
ccttttctgaaccacttaaata

SEQ ID NO: 8457263 - DNA, 22 bp, Homo sapiens
cctttttccctggagggacagc

SEQ ID NO: 8457264 - DNA, 22 bp, Homo sapiens
ccttttgctctcccatccagaa

SEQ ID NO: 8457265 - DNA, 22 bp, Homo sapiens
ccttttggccaggtcagtgcag

SEQ ID NO: 8457266 - DNA, 22 bp, Homo sapiens
cgactgtcatacacaagacatg

SEQ ID NO: 8457267 - DNA, 22 bp, Homo sapiens
cgagagccggaaggggcggtgc

SEQ ID NO: 8457268 - DNA, 22 bp, Homo sapiens
cgagagatgggttggcaggggc

SEQ ID NO: 8457269 - DNA, 22 bp, Homo sapiens
cgaaatcagcatcttgaggcaa

SEQ ID NO: 8457270 - DNA, 22 bp, Homo sapiens
ttattcagcatttagaggaagg

SEQ ID NO: 8457271 - DNA, 22 bp, Homo sapiens
ttattgcaaaggaagagcttga

SEQ ID NO: 8457272 - DNA, 20 bp, Homo sapiens
ttatttcagttgctagattg

SEQ ID NO: 8457273 - DNA, 21 bp, Homo sapiens
ttatttcacatggacttccag

SEQ ID NO: 8457274 - DNA, 22 bp, Homo sapiens
ttatttcaaaagagcttggggt

SEQ ID NO: 8457275 - DNA, 22 bp, Homo sapiens
ttatttcatgtaaaatttatgt

SEQ ID NO: 8457276 - DNA, 22 bp, Homo sapiens
ttatttcatataatgttatcaa

SEQ ID NO: 8457277 - DNA, 22 bp, Homo sapiens
ttatttcatataatgttatcaa

SEQ ID NO: 8457278 - DNA, 22 bp, Homo sapiens
cgctgcagacgcgctggcgaaa

SEQ ID NO: 8457279 - DNA, 22 bp, Homo sapiens
cgctgcagctggctgcagggaa

SEQ ID NO: 8457280 - DNA, 22 bp, Homo sapiens
ctccaggactgaggacagagct

SEQ ID NO: 8457281 - DNA, 22 bp, Homo sapiens
ctccaggactgaggacagagct

SEQ ID NO: 8457282 - DNA, 22 bp, Homo sapiens
ctccaggactgaggacagagct

SEQ ID NO: 8457283 - DNA, 22 bp, Homo sapiens
ctccaggactcaggcccctggg

SEQ ID NO: 8457284 - DNA, 22 bp, Homo sapiens
ctccaggactcaggcccctggg

SEQ ID NO: 8457285 - DNA, 22 bp, Homo sapiens
ctccaggactcaggcccctggg

SEQ ID NO: 8457286 - DNA, 22 bp, Homo sapiens
ctccaggacccagtggctccag

SEQ ID NO: 8457287 - DNA, 22 bp, Homo sapiens
ctccaggacccagtggctccag

SEQ ID NO: 8457288 - DNA, 22 bp, Homo sapiens
ctccaggacccagtggctccag

SEQ ID NO: 8457289 - DNA, 22 bp, Homo sapiens
ctccaggacccagtggctccag

SEQ ID NO: 8457290 - DNA, 22 bp, Homo sapiens
ctccaggacccagtggctccag

SEQ ID NO: 8457291 - DNA, 22 bp, Homo sapiens
ctccaggaccagggctcctgga

SEQ ID NO: 8457292 - DNA, 22 bp, Homo sapiens
ctccaggacagattcagggcca

SEQ ID NO: 8457293 - DNA, 22 bp, Homo sapiens
ctccaggacactaacccaggct

SEQ ID NO: 8457294 - DNA, 22 bp, Homo sapiens
ctccaggaccagggctcctgga

SEQ ID NO: 8457295 - DNA, 22 bp, Homo sapiens
ctccaggaccagggctcctgga

SEQ ID NO: 8457296 - DNA, 22 bp, Homo sapiens
ctccaggaccagggctcctgga

SEQ ID NO: 8457297 - DNA, 22 bp, Homo sapiens
ttggctgaccagaacctgcccc

SEQ ID NO: 8457298 - DNA, 22 bp, Homo sapiens
ttggctgcaatcacagggactc

SEQ ID NO: 8457299 - DNA, 22 bp, Homo sapiens
ttggctgcattttgggttcgtt

SEQ ID NO: 8457300 - DNA, 22 bp, Homo sapiens
ttggctgccgagcgcatcccgg

SEQ ID NO: 8457301 - DNA, 22 bp, Homo sapiens
ttggctgccttcacccctggcc

SEQ ID NO: 8457302 - DNA, 22 bp, Homo sapiens
ttggctgcctgtggatcgcatt

SEQ ID NO: 8457303 - DNA, 21 bp, Homo sapiens
ttggctgcctgagattagaat

SEQ ID NO: 8457304 - DNA, 22 bp, Homo sapiens
ctccaggacactaacccaggct

SEQ ID NO: 8457305 - DNA, 22 bp, Homo sapiens
ctccagcctcatctcctggctg

SEQ ID NO: 8457306 - DNA, 22 bp, Homo sapiens
ttggctgctaatggctgacagc

SEQ ID NO: 8457307 - DNA, 22 bp, Homo sapiens
ctccagataggagggggtcccc

SEQ ID NO: 8457308 - DNA, 22 bp, Homo sapiens
ctccagagtcacactgcctggg

SEQ ID NO: 8457309 - DNA, 22 bp, Homo sapiens
ttggctctggaactatttctga

SEQ ID NO: 8457310 - DNA, 22 bp, Homo sapiens
ttggctctgatggggatcagga

SEQ ID NO: 8457311 - DNA, 22 bp, Homo sapiens
ctccagaggatgcaggtgaggg

SEQ ID NO: 8457312 - DNA, 22 bp, Homo sapiens
ctccagaggaaagcacatagtg

SEQ ID NO: 8457313 - DNA, 22 bp, Homo sapiens
ctccagaggaaagcacatagtg

SEQ ID NO: 8457314 - DNA, 22 bp, Homo sapiens
ctccagaggaaagcacatagtg

SEQ ID NO: 8457315 - DNA, 18 bp, Homo sapiens
ctccagagctgtgagaca

SEQ ID NO: 8457316 - DNA, 22 bp, Homo sapiens
ttggaagcattctgaatgtcca

SEQ ID NO: 8457317 - DNA, 19 bp, Homo sapiens
ttggaaggagccagagtgg

SEQ ID NO: 8457318 - DNA, 22 bp, Homo sapiens
ttggaaggatttagagatgtct

SEQ ID NO: 8457319 - DNA, 19 bp, Homo sapiens
ctcagtctggctctgcctg

SEQ ID NO: 8457320 - DNA, 22 bp, Homo sapiens
ttggaaaagtgaaactagatgc

SEQ ID NO: 8457321 - DNA, 22 bp, Homo sapiens
ttggagggactgagcttcagtc

SEQ ID NO: 8457322 - DNA, 22 bp, Homo sapiens
ttggaaggctgaatggcctctc

SEQ ID NO: 8457323 - DNA, 22 bp, Homo sapiens
ttggaaggccctgcctagcagg

SEQ ID NO: 8457324 - DNA, 20 bp, Homo sapiens
ttggaaggtggagaagagga

SEQ ID NO: 8457325 - DNA, 22 bp, Homo sapiens
ttggatccatctcaggcatagg

SEQ ID NO: 8457326 - DNA, 22 bp, Homo sapiens
ttggatacagatgaaaggaagg

SEQ ID NO: 8457327 - DNA, 22 bp, Homo sapiens
ttggagtcagatgactgtagga

SEQ ID NO: 8457328 - DNA, 22 bp, Homo sapiens
ttgcccaggctggagtgcagta

SEQ ID NO: 8457329 - DNA, 22 bp, Homo sapiens
ttgcccaggctggagtgcagta

SEQ ID NO: 8457330 - DNA, 22 bp, Homo sapiens
ttgcccagagtccacagcgtac

SEQ ID NO: 8457331 - DNA, 22 bp, Homo sapiens
ttgcatgctagaaagattgatt

SEQ ID NO: 8457332 - DNA, 22 bp, Homo sapiens
ttgcccaggctggagtgcagtg

SEQ ID NO: 8457333 - DNA, 22 bp, Homo sapiens
ttgcccaggctggagtgcagtg

SEQ ID NO: 8457334 - DNA, 22 bp, Homo sapiens
ttgccctgaagaacgtcccaga

SEQ ID NO: 8457335 - DNA, 22 bp, Homo sapiens
ttgccctgcgttaccatctctt

SEQ ID NO: 8457336 - DNA, 22 bp, Homo sapiens
ttgccctgcgggtcctgcgcaa

SEQ ID NO: 8457337 - DNA, 22 bp, Homo sapiens
ttgccctgtcttaagctggcaa

SEQ ID NO: 8457338 - DNA, 22 bp, Homo sapiens
ttgccctgtcagtagaagtgca

SEQ ID NO: 8457339 - DNA, 22 bp, Homo sapiens
ctcagggatggtgaagcaccca

SEQ ID NO: 8457340 - DNA, 22 bp, Homo sapiens
ctcagggccaaggatgctgttg

SEQ ID NO: 8457341 - DNA, 22 bp, Homo sapiens
ctcagggcggcgggcagcccag

SEQ ID NO: 8457342 - DNA, 22 bp, Homo sapiens
ctcagggcggcgggcagcccag

SEQ ID NO: 8457343 - DNA, 22 bp, Homo sapiens
ctcaggtcacaggatggccagg

SEQ ID NO: 8457344 - DNA, 22 bp, Homo sapiens
ctcaggtcacggatctgagctg

SEQ ID NO: 8457345 - DNA, 22 bp, Homo sapiens
ctcaggtcgctatttctcttac

SEQ ID NO: 8457346 - DNA, 22 bp, Homo sapiens
ctcagggtgcagcacagttcct

SEQ ID NO: 8457347 - DNA, 22 bp, Homo sapiens
ctcagggcttgagtgtccagga

SEQ ID NO: 8457348 - DNA, 21 bp, Homo sapiens
ctcagggcttggtgtcctcat

SEQ ID NO: 8457349 - DNA, 22 bp, Homo sapiens
ctcagggcttgagtgtccagga

SEQ ID NO: 8457350 - DNA, 21 bp, Homo sapiens
ctcagggcttggtgtcctcat

SEQ ID NO: 8457351 - DNA, 22 bp, Homo sapiens
ctcaggaggtggtagaggccct

SEQ ID NO: 8457352 - DNA, 22 bp, Homo sapiens
ctcaggaggtggtagaggccct

SEQ ID NO: 8457353 - DNA, 22 bp, Homo sapiens
ctcaggaggtggtagaggccct

SEQ ID NO: 8457354 - DNA, 22 bp, Homo sapiens
ctcaggaggtggtagaggccct

SEQ ID NO: 8457355 - DNA, 22 bp, Homo sapiens
ctcaggaggtggtagaggccct

SEQ ID NO: 8457356 - DNA, 22 bp, Homo sapiens
ctcaggaggtggtagaggccct

SEQ ID NO: 8457357 - DNA, 22 bp, Homo sapiens
ctcaggaggtggtagaggccct

SEQ ID NO: 8457358 - DNA, 22 bp, Homo sapiens
ctcaggaggtttcctgtctagg

SEQ ID NO: 8457359 - DNA, 22 bp, Homo sapiens
ctcaggaggtttcctgtctagg

SEQ ID NO: 8457360 - DNA, 22 bp, Homo sapiens
ctcaggaggtttcctgtctagg

SEQ ID NO: 8457361 - DNA, 22 bp, Homo sapiens
ctcaggagtagttcagcagctg

SEQ ID NO: 8457362 - DNA, 22 bp, Homo sapiens
ctcaggaggccattctcaaggt

SEQ ID NO: 8457363 - DNA, 22 bp, Homo sapiens
ctcaggaggccattctcaaggt

SEQ ID NO: 8457364 - DNA, 22 bp, Homo sapiens
ctcaggaggccattctcaaggt

SEQ ID NO: 8457365 - DNA, 22 bp, Homo sapiens
ctcaggaggatgactgccttgg

SEQ ID NO: 8457366 - DNA, 22 bp, Homo sapiens
ctcaggaggatgactgccttgg

SEQ ID NO: 8457367 - DNA, 22 bp, Homo sapiens
ctcaggagcttcctcagcccat

SEQ ID NO: 8457368 - DNA, 22 bp, Homo sapiens
ctcaggagcttcctcagcccat

SEQ ID NO: 8457369 - DNA, 22 bp, Homo sapiens
ctcaggaggaggaagttcattg

SEQ ID NO: 8457370 - DNA, 22 bp, Homo sapiens
ctcaggagtagttcagcagctg

SEQ ID NO: 8457371 - DNA, 22 bp, Homo sapiens
ctcaggagtagttcagcagctg

SEQ ID NO: 8457372 - DNA, 22 bp, Homo sapiens
ctcaggagtagttcagcagctg

SEQ ID NO: 8457373 - DNA, 22 bp, Homo sapiens
ttgcagtttgcttttaatggga

SEQ ID NO: 8457374 - DNA, 22 bp, Homo sapiens
ctcaggagatgacagaaggtat

SEQ ID NO: 8457375 - DNA, 22 bp, Homo sapiens
ctcaggagatgacagaaggtat

SEQ ID NO: 8457376 - DNA, 22 bp, Homo sapiens
ctcaggagagtcttatatctcc

SEQ ID NO: 8457377 - DNA, 22 bp, Homo sapiens
ctcaggagatgacagaaggtat

SEQ ID NO: 8457378 - DNA, 22 bp, Homo sapiens
ctcaggagacagtgtccacatg

SEQ ID NO: 8457379 - DNA, 22 bp, Homo sapiens
ctcaggagacagtgtccacatg

SEQ ID NO: 8457380 - DNA, 22 bp, Homo sapiens
ctcaggagacagtgtccacatg

SEQ ID NO: 8457381 - DNA, 22 bp, Homo sapiens
ctcaggagacagtgtccacatg

SEQ ID NO: 8457382 - DNA, 22 bp, Homo sapiens
ctcaggaaccgcggcagcagcc

SEQ ID NO: 8457383 - DNA, 22 bp, Homo sapiens
ctcaggacagattccagagaaa

SEQ ID NO: 8457384 - DNA, 22 bp, Homo sapiens
ctcaggacagattccagagaaa

SEQ ID NO: 8457385 - DNA, 22 bp, Homo sapiens
ctcagccccaatttgccctctt

SEQ ID NO: 8457386 - DNA, 22 bp, Homo sapiens
ctcagccccaatttgccctctt

SEQ ID NO: 8457387 - DNA, 23 bp, Homo sapiens
ctcagaggcctgtccagggtggt

SEQ ID NO: 8457388 - DNA, 23 bp, Homo sapiens
ctcagaggcctgtccagggtggt

SEQ ID NO: 8457389 - DNA, 22 bp, Homo sapiens
ctcagaggcaagcaaggagctg

SEQ ID NO: 8457390 - DNA, 22 bp, Homo sapiens
ctcagcttctacctcctgagtg

SEQ ID NO: 8457391 - DNA, 22 bp, Homo sapiens
ctcagcttctacctcctgagtg

SEQ ID NO: 8457392 - DNA, 22 bp, Homo sapiens
ctcaggaaaatattgaagaagt

SEQ ID NO: 8457393 - DNA, 22 bp, Homo sapiens
ttctttctgtcatggtgtactg

SEQ ID NO: 8457394 - DNA, 22 bp, Homo sapiens
ttctttctggggtccttcggct

SEQ ID NO: 8457395 - DNA, 22 bp, Homo sapiens
ttctttctgtccataatgagac

SEQ ID NO: 8457396 - DNA, 22 bp, Homo sapiens
ctcagaaaggtgccatttatgt

SEQ ID NO: 8457397 - DNA, 21 bp, Homo sapiens
ctcagagacaaatgccatccc

SEQ ID NO: 8457398 - DNA, 22 bp, Homo sapiens
ctcagagaaatgtcacaacaat

SEQ ID NO: 8457399 - DNA, 22 bp, Homo sapiens
ctcagagaaaaggagcaagggt

SEQ ID NO: 8457400 - DNA, 22 bp, Homo sapiens
ttctttctgggaagagttcaga

SEQ ID NO: 8457401 - DNA, 21 bp, Homo sapiens
ttctttctgaatctgaagtat

SEQ ID NO: 8457402 - DNA, 22 bp, Homo sapiens
ttctttctctccacaaggcttg

SEQ ID NO: 8457403 - DNA, 22 bp, Homo sapiens
ttctttctgaatacagttgagt

SEQ ID NO: 8457404 - DNA, 22 bp, Homo sapiens
ctcagagagggcaccagggcca

SEQ ID NO: 8457405 - DNA, 22 bp, Homo sapiens
ctcagagagtgaattcctgcct

SEQ ID NO: 8457406 - DNA, 22 bp, Homo sapiens
ctcagagaggttgaacaacttg

SEQ ID NO: 8457407 - DNA, 22 bp, Homo sapiens
ctcagagatatagtccctgctt

SEQ ID NO: 8457408 - DNA, 22 bp, Homo sapiens
ctcagagcaatgaacatgcaaa

SEQ ID NO: 8457409 - DNA, 22 bp, Homo sapiens
ctcagagcaatgaacatgcaaa

SEQ ID NO: 8457410 - DNA, 22 bp, Homo sapiens
ctcagagcaatgaacatgcaaa

SEQ ID NO: 8457411 - DNA, 22 bp, Homo sapiens
ctcagagcacttttgaaagctc

SEQ ID NO: 8457412 - DNA, 22 bp, Homo sapiens
ctcagagcacttttgaaagctc

SEQ ID NO: 8457413 - DNA, 22 bp, Homo sapiens
ctcagagcacagtttatgacag

SEQ ID NO: 8457414 - DNA, 22 bp, Homo sapiens
ctcagagcacagtttatgacag

SEQ ID NO: 8457415 - DNA, 22 bp, Homo sapiens
ctcagagcacttttgaaagctc

SEQ ID NO: 8457416 - DNA, 22 bp, Homo sapiens
ctcagagcacttttgaaagctc

SEQ ID NO: 8457417 - DNA, 17 bp, Homo sapiens
ctcagagcaggacagaa

SEQ ID NO: 8457418 - DNA, 22 bp, Homo sapiens
ctcagaggcaagcaaggagctg

SEQ ID NO: 8457419 - DNA, 22 bp, Homo sapiens
ctcagagctgaggccagggaca

SEQ ID NO: 8457420 - DNA, 22 bp, Homo sapiens
ctcagagctgaggccagggaca

SEQ ID NO: 8457421 - DNA, 22 bp, Homo sapiens
ctcagagctgaggccagggaca

SEQ ID NO: 8457422 - DNA, 22 bp, Homo sapiens
ctcagagctcagctttgttagt

SEQ ID NO: 8457423 - DNA, 22 bp, Homo sapiens
ctcagagctcagctttgttagt

SEQ ID NO: 8457424 - DNA, 22 bp, Homo sapiens
ctcagagctcgtgggaccttgg

SEQ ID NO: 8457425 - DNA, 22 bp, Homo sapiens
ctcagagctcgtgggaccttgg

SEQ ID NO: 8457426 - DNA, 22 bp, Homo sapiens
ctcagagccccaggagggtgtg

SEQ ID NO: 8457427 - DNA, 22 bp, Homo sapiens
ctcagagctcagctttgttagt

SEQ ID NO: 8457428 - DNA, 22 bp, Homo sapiens
ctcagagcccagggtacacccg

SEQ ID NO: 8457429 - DNA, 22 bp, Homo sapiens
ctcagagcccagggtacacccg

SEQ ID NO: 8457430 - DNA, 22 bp, Homo sapiens
ctcagagccccaggagggtgtg

SEQ ID NO: 8457431 - DNA, 17 bp, Homo sapiens
ctcagagcaggacagaa

SEQ ID NO: 8457432 - DNA, 17 bp, Homo sapiens
ctcagagcaggacagaa

SEQ ID NO: 8457433 - DNA, 17 bp, Homo sapiens
ctcagagcaggacagaa

SEQ ID NO: 8457434 - DNA, 21 bp, Homo sapiens
ctcagagcagttcagagggat

SEQ ID NO: 8457435 - DNA, 21 bp, Homo sapiens
ctcagagcagttcagagggat

SEQ ID NO: 8457436 - DNA, 21 bp, Homo sapiens
ctcagagcagttcagagggat

SEQ ID NO: 8457437 - DNA, 21 bp, Homo sapiens
ctcagagcagttcagagggat

SEQ ID NO: 8457438 - DNA, 21 bp, Homo sapiens
ctcagagcagttcagagggat

SEQ ID NO: 8457439 - DNA, 22 bp, Homo sapiens
ctcagagccagttagcaggtgc

SEQ ID NO: 8457440 - DNA, 22 bp, Homo sapiens
ctcagagccagttagcaggtgc

SEQ ID NO: 8457441 - DNA, 22 bp, Homo sapiens
ctcagagccagttagcaggtgc

SEQ ID NO: 8457442 - DNA, 22 bp, Homo sapiens
ctcagagcccagggtacacccg

SEQ ID NO: 8457443 - DNA, 22 bp, Homo sapiens
ctcagagccagttagcaggtgc

SEQ ID NO: 8457444 - DNA, 22 bp, Homo sapiens
ttctggcttcatctgacaagcc

SEQ ID NO: 8457445 - DNA, 22 bp, Homo sapiens
ctataaatctacccagcattgg

SEQ ID NO: 8457446 - DNA, 22 bp, Homo sapiens
ctataactgggtattagactac

SEQ ID NO: 8457447 - DNA, 22 bp, Homo sapiens
ttctggctccagatgcttctgt

SEQ ID NO: 8457448 - DNA, 22 bp, Homo sapiens
ttctggctcgattctctgaccg

SEQ ID NO: 8457449 - DNA, 22 bp, Homo sapiens
ttctggctctcccctgctgggt

SEQ ID NO: 8457450 - DNA, 22 bp, Homo sapiens
ttctggctgaaagtttatttga

SEQ ID NO: 8457451 - DNA, 20 bp, Homo sapiens
ttctggcaaacagagttctt

SEQ ID NO: 8457452 - DNA, 22 bp, Homo sapiens
ttctggcatgagagatgggggt

SEQ ID NO: 8457453 - DNA, 22 bp, Homo sapiens
ttctggcatctgggggaggcct

SEQ ID NO: 8457454 - DNA, 22 bp, Homo sapiens
ctatagaaaattgtatcacacg

SEQ ID NO: 8457455 - DNA, 22 bp, Homo sapiens
ctatactactatacagatgtaa

SEQ ID NO: 8457456 - DNA, 22 bp, Homo sapiens
ctcacccatatctccatgactc

SEQ ID NO: 8457457 - DNA, 22 bp, Homo sapiens
ctcacaggttctgcagctcaca

SEQ ID NO: 8457458 - DNA, 22 bp, Homo sapiens
ctcacaggttagttgtgtggat

SEQ ID NO: 8457459 - DNA, 22 bp, Homo sapiens
ctcacaggttctgcagctcaca

SEQ ID NO: 8457460 - DNA, 22 bp, Homo sapiens
ctcactcagacatccagtgcag

SEQ ID NO: 8457461 - DNA, 22 bp, Homo sapiens
ctcacccctgtaattccagcac

SEQ ID NO: 8457462 - DNA, 22 bp, Homo sapiens
ctcaccccactaccccttggtg

SEQ ID NO: 8457463 - DNA, 22 bp, Homo sapiens
ctcacccatatctccatgactc

SEQ ID NO: 8457464 - DNA, 22 bp, Homo sapiens
ctcacctccaggagctgctggc

SEQ ID NO: 8457465 - DNA, 22 bp, Homo sapiens
ctcacctgggtcagacagttgt

SEQ ID NO: 8457466 - DNA, 19 bp, Homo sapiens
ctcacctggaggtgctgat

SEQ ID NO: 8457467 - DNA, 22 bp, Homo sapiens
ctagagaagaggttaagcatga

SEQ ID NO: 8457468 - DNA, 22 bp, Homo sapiens
ctagagaagaggctcagccagc

SEQ ID NO: 8457469 - DNA, 22 bp, Homo sapiens
ctagagaaaatgatagcaggaa

SEQ ID NO: 8457470 - DNA, 22 bp, Homo sapiens
ctagaaatattttacagtcaag

SEQ ID NO: 8457471 - DNA, 22 bp, Homo sapiens
ctagaaagatacttaaatcaag

SEQ ID NO: 8457472 - DNA, 18 bp, Homo sapiens
ctagatgagcttggcaag

SEQ ID NO: 8457473 - DNA, 22 bp, Homo sapiens
ctagagctgttctgtgcactca

SEQ ID NO: 8457474 - DNA, 22 bp, Homo sapiens
ctagagctgttctgtgcactca

SEQ ID NO: 8457475 - DNA, 22 bp, Homo sapiens
ctagagctattcaaggttttat

SEQ ID NO: 8457476 - DNA, 22 bp, Homo sapiens
ctagagctttctgctggtgttg

SEQ ID NO: 8457477 - DNA, 22 bp, Homo sapiens
cgttagtggagtttgaagctgt

SEQ ID NO: 8457478 - DNA, 18 bp, Homo sapiens
cgtttttccgggattgca

SEQ ID NO: 8457479 - DNA, 22 bp, Homo sapiens
cgtttttcagtggtcttaggtc

SEQ ID NO: 8457480 - DNA, 22 bp, Homo sapiens
cgtgtaacccctgaactcgcat

SEQ ID NO: 8457481 - DNA, 22 bp, Homo sapiens
ttctgcatctgaatttaagtac

SEQ ID NO: 8457482 - DNA, 22 bp, Homo sapiens
ttctgcatgtgtttcaaatact

SEQ ID NO: 8457483 - DNA, 22 bp, Homo sapiens
ttctggaagccccagagtcaga

SEQ ID NO: 8457484 - DNA, 23 bp, Homo sapiens
ttctggatgttctagtctgagag

SEQ ID NO: 8457485 - DNA, 22 bp, Homo sapiens
ttctgcataggctatatttgtt

SEQ ID NO: 8457486 - DNA, 22 bp, Homo sapiens
ttctgcagtgtgcagggcctgt

SEQ ID NO: 8457487 - DNA, 22 bp, Homo sapiens
ttctattaatatgttaattctg

SEQ ID NO: 8457488 - DNA, 22 bp, Homo sapiens
ttctatgtagtagcagagccaa

SEQ ID NO: 8457489 - DNA, 22 bp, Homo sapiens
ttctatgttctaagtctcaagg

SEQ ID NO: 8457490 - DNA, 22 bp, Homo sapiens
ttctatgtggcatcaagctcag

SEQ ID NO: 8457491 - DNA, 22 bp, Homo sapiens
ttctatgtgttgacaagcctga

SEQ ID NO: 8457492 - DNA, 22 bp, Homo sapiens
gaaatacagaaagggctgaatg

SEQ ID NO: 8457493 - DNA, 22 bp, Homo sapiens
gaaatatacattgcaggaagag

SEQ ID NO: 8457494 - DNA, 22 bp, Homo sapiens
gaaagacatagttgcaagatgg

SEQ ID NO: 8457495 - DNA, 22 bp, Homo sapiens
gaaatattacagtggaggggat

SEQ ID NO: 8457496 - DNA, 22 bp, Homo sapiens
gaaatattcttgtcttgttttc

SEQ ID NO: 8457497 - DNA, 22 bp, Homo sapiens
gaaatattgggactcagagctt

SEQ ID NO: 8457498 - DNA, 22 bp, Homo sapiens
gaaatattgtactggagatgtt

SEQ ID NO: 8457499 - DNA, 22 bp, Homo sapiens
gaaattaagcaggggtctgtgg

SEQ ID NO: 8457500 - DNA, 22 bp, Homo sapiens
gaaattattgctagagactgca

SEQ ID NO: 8457501 - DNA, 22 bp, Homo sapiens
gaaattaaccacctttggcttt

SEQ ID NO: 8457502 - DNA, 22 bp, Homo sapiens
gaaatgttttacaaggcatact

SEQ ID NO: 8457503 - DNA, 22 bp, Homo sapiens
gaaatgtttgggaggagtcaac

SEQ ID NO: 8457504 - DNA, 22 bp, Homo sapiens
gaagaacgtcttataaattcac

SEQ ID NO: 8457505 - DNA, 22 bp, Homo sapiens
gaagaacacctgctgcccagtg

SEQ ID NO: 8457506 - DNA, 22 bp, Homo sapiens
gaactttaaaacaaagtacagt

SEQ ID NO: 8457507 - DNA, 22 bp, Homo sapiens
gaagaaggaagatcatgcttga

SEQ ID NO: 8457508 - DNA, 19 bp, Homo sapiens
gaagaagcttgagaagtag

SEQ ID NO: 8457509 - DNA, 22 bp, Homo sapiens
gaagaagacatggaacaatagt

SEQ ID NO: 8457510 - DNA, 22 bp, Homo sapiens
gaagaagacatggaacaatagt

SEQ ID NO: 8457511 - DNA, 22 bp, Homo sapiens
gaaaaatgagctgatgtcaggg

SEQ ID NO: 8457512 - DNA, 22 bp, Homo sapiens
gaaaaatgagctgatgtcaggg

SEQ ID NO: 8457513 - DNA, 22 bp, Homo sapiens
gaaaaatgctccaaatctgtgg

SEQ ID NO: 8457514 - DNA, 22 bp, Homo sapiens
gaaaccagctagaggcagaggg

SEQ ID NO: 8457515 - DNA, 22 bp, Homo sapiens
cttttttcctaaggcaacatga

SEQ ID NO: 8457516 - DNA, 22 bp, Homo sapiens
gaaaaaggataaatacagtgtt

SEQ ID NO: 8457517 - DNA, 22 bp, Homo sapiens
cttttttcctaaggcaacatga

SEQ ID NO: 8457518 - DNA, 22 bp, Homo sapiens
ctttttgttgtataagcccttt

SEQ ID NO: 8457519 - DNA, 22 bp, Homo sapiens
gaaactgaatataagaaaggta

SEQ ID NO: 8457520 - DNA, 22 bp, Homo sapiens
gaaactctcgcatcctgggaac

SEQ ID NO: 8457521 - DNA, 22 bp, Homo sapiens
gaaacctttgccgatggggtcc

SEQ ID NO: 8457522 - DNA, 22 bp, Homo sapiens
gaaacctgagtgcagatcagga

SEQ ID NO: 8457523 - DNA, 22 bp, Homo sapiens
gaaaccctgagaggtggtctgg

SEQ ID NO: 8457524 - DNA, 22 bp, Homo sapiens
gaaagaatcaactatgtctctg

SEQ ID NO: 8457525 - DNA, 22 bp, Homo sapiens
gaaagaatcaactatgtctctg

SEQ ID NO: 8457526 - DNA, 22 bp, Homo sapiens
gaaactttcatgaatataagat

SEQ ID NO: 8457527 - DNA, 22 bp, Homo sapiens
gaaactttggctaaaagccaga

SEQ ID NO: 8457528 - DNA, 22 bp, Homo sapiens
cttttgttaggagaaaacatca

SEQ ID NO: 8457529 - DNA, 22 bp, Homo sapiens
cttttgttaggagaaaacatca

SEQ ID NO: 8457530 - DNA, 20 bp, Homo sapiens
ctttggcaatgagaacaggg

SEQ ID NO: 8457531 - DNA, 16 bp, Homo sapiens
ctttttctcccctctt

SEQ ID NO: 8457532 - DNA, 22 bp, Homo sapiens
ctttttctgatgttccatgatt

SEQ ID NO: 8457533 - DNA, 22 bp, Homo sapiens
ctttttctgatgttccatgatt

SEQ ID NO: 8457534 - DNA, 22 bp, Homo sapiens
ctttttcttctaggtgtgcctg

SEQ ID NO: 8457535 - DNA, 20 bp, Homo sapiens
ctttttctccagctctgagc

SEQ ID NO: 8457536 - DNA, 22 bp, Homo sapiens
ctttttctaatcataattgtct

SEQ ID NO: 8457537 - DNA, 22 bp, Homo sapiens
ctttttctaatcataattgtct

SEQ ID NO: 8457538 - DNA, 22 bp, Homo sapiens
ctttggatggctgtgtgtttat

SEQ ID NO: 8457539 - DNA, 22 bp, Homo sapiens
ctttggaggtcatagccaagag

SEQ ID NO: 8457540 - DNA, 22 bp, Homo sapiens
ctttggaggtcatagccaagag

SEQ ID NO: 8457541 - DNA, 22 bp, Homo sapiens
ctttggagttccctaatttccc

SEQ ID NO: 8457542 - DNA, 21 bp, Homo sapiens
ctttggcaagggagaagtcac

SEQ ID NO: 8457543 - DNA, 22 bp, Homo sapiens
ctttggaggaaaattgaggtca

SEQ ID NO: 8457544 - DNA, 22 bp, Homo sapiens
ctttggaggacctatgtgcaat

SEQ ID NO: 8457545 - DNA, 22 bp, Homo sapiens
ctttggaatgcacagaggtgta

SEQ ID NO: 8457546 - DNA, 22 bp, Homo sapiens
ctttggaatcattgcttattca

SEQ ID NO: 8457547 - DNA, 22 bp, Homo sapiens
ctttggaataatcaagctctga

SEQ ID NO: 8457548 - DNA, 22 bp, Homo sapiens
ctttggaagtaaagtcagcagg

SEQ ID NO: 8457549 - DNA, 22 bp, Homo sapiens
ctttggaataatttcctggagt

SEQ ID NO: 8457550 - DNA, 22 bp, Homo sapiens
ctttggaataatttcctggagt

SEQ ID NO: 8457551 - DNA, 22 bp, Homo sapiens
ctttggaataatcaagctctga

SEQ ID NO: 8457552 - DNA, 22 bp, Homo sapiens
ctttggaagccaggcagttcac

SEQ ID NO: 8457553 - DNA, 22 bp, Homo sapiens
ctttggaactgtaaggagatgg

SEQ ID NO: 8457554 - DNA, 22 bp, Homo sapiens
ctttggaacacccagctctgtg

SEQ ID NO: 8457555 - DNA, 22 bp, Homo sapiens
ctttggaacatactgctgagct

SEQ ID NO: 8457556 - DNA, 22 bp, Homo sapiens
ctttggaacatactgctgagct

SEQ ID NO: 8457557 - DNA, 22 bp, Homo sapiens
ctttggaaggcagagctctgtg

SEQ ID NO: 8457558 - DNA, 22 bp, Homo sapiens
ctttggaaggcagagctctgtg

SEQ ID NO: 8457559 - DNA, 22 bp, Homo sapiens
ctttggaaggaagacctttcag

SEQ ID NO: 8457560 - DNA, 22 bp, Homo sapiens
ctttggaaggaacaggattctc

SEQ ID NO: 8457561 - DNA, 22 bp, Homo sapiens
ctttctagttgacagcatgcca

SEQ ID NO: 8457562 - DNA, 22 bp, Homo sapiens
ctttctagagtatggagtctgt

SEQ ID NO: 8457563 - DNA, 22 bp, Homo sapiens
ctttctagtaggaagtagatca

SEQ ID NO: 8457564 - DNA, 22 bp, Homo sapiens
ctttctagactgtccagatgat

SEQ ID NO: 8457565 - DNA, 20 bp, Homo sapiens
ctttctctaatttataagta

SEQ ID NO: 8457566 - DNA, 20 bp, Homo sapiens
ctttctctaatttataagta

SEQ ID NO: 8457567 - DNA, 22 bp, Homo sapiens
ctttctctgtgtggtaaagggc

SEQ ID NO: 8457568 - DNA, 22 bp, Homo sapiens
ctttctctgtgtttcacatgct

SEQ ID NO: 8457569 - DNA, 22 bp, Homo sapiens
ctttctcttacccaaggatctg

SEQ ID NO: 8457570 - DNA, 22 bp, Homo sapiens
ctttctcttcactgtcatgatc

SEQ ID NO: 8457571 - DNA, 22 bp, Homo sapiens
ctttggaacacccagctctgtg

SEQ ID NO: 8457572 - DNA, 22 bp, Homo sapiens
ctttggaacacatgggcatggt

SEQ ID NO: 8457573 - DNA, 22 bp, Homo sapiens
ctttggaacaagaagaaatggc

SEQ ID NO: 8457574 - DNA, 22 bp, Homo sapiens
ctttgcattctcagcacagagc

SEQ ID NO: 8457575 - DNA, 22 bp, Homo sapiens
ctttgcatacaatttttagaaa

SEQ ID NO: 8457576 - DNA, 21 bp, Homo sapiens
ctttgcatacagatgccaatt

SEQ ID NO: 8457577 - DNA, 21 bp, Homo sapiens
ctttgcatctatatgttctca

SEQ ID NO: 8457578 - DNA, 21 bp, Homo sapiens
ctttgcatctatatgttctca

SEQ ID NO: 8457579 - DNA, 21 bp, Homo sapiens
ctttgcatctatatgttctca

SEQ ID NO: 8457580 - DNA, 22 bp, Homo sapiens
ctttccagacctccttgtagct

SEQ ID NO: 8457581 - DNA, 22 bp, Homo sapiens
ctttcctagttggtcccagcac

SEQ ID NO: 8457582 - DNA, 22 bp, Homo sapiens
ctttcctagtagttacagaatg

SEQ ID NO: 8457583 - DNA, 22 bp, Homo sapiens
cttggagtcaataagatctaga

SEQ ID NO: 8457584 - DNA, 22 bp, Homo sapiens
cttggaggaaggggctcttctg

SEQ ID NO: 8457585 - DNA, 22 bp, Homo sapiens
cttggaggaaaggcagggagac

SEQ ID NO: 8457586 - DNA, 22 bp, Homo sapiens
cttggagcaacacatgacatct

SEQ ID NO: 8457587 - DNA, 22 bp, Homo sapiens
ctttcgatcaagggtcccttca

SEQ ID NO: 8457588 - DNA, 22 bp, Homo sapiens
ctttcctctggcactgtctggt

SEQ ID NO: 8457589 - DNA, 22 bp, Homo sapiens
cttcttcctgctgcagcctcca

SEQ ID NO: 8457590 - DNA, 22 bp, Homo sapiens
cttcttctggacaggcagctcc

SEQ ID NO: 8457591 - DNA, 22 bp, Homo sapiens
cttcttcatgtattgatagtct

SEQ ID NO: 8457592 - DNA, 19 bp, Homo sapiens
cttcttcttggcagccaag

SEQ ID NO: 8457593 - DNA, 22 bp, Homo sapiens
cttgcctctgctaatggtttct

SEQ ID NO: 8457594 - DNA, 22 bp, Homo sapiens
cttgcctgaggaacagagggta

SEQ ID NO: 8457595 - DNA, 22 bp, Homo sapiens
cttgcctgccactacagctgaa

SEQ ID NO: 8457596 - DNA, 22 bp, Homo sapiens
cttgcttttgctgatgattaag

SEQ ID NO: 8457597 - DNA, 22 bp, Homo sapiens
cttgctttccaaatgactcact

SEQ ID NO: 8457598 - DNA, 22 bp, Homo sapiens
cttggagacaggacaggcagaa

SEQ ID NO: 8457599 - DNA, 22 bp, Homo sapiens
cttggagacaggacaggcagaa

SEQ ID NO: 8457600 - DNA, 22 bp, Homo sapiens
cttggaatcaagtttttggaga

SEQ ID NO: 8457601 - DNA, 22 bp, Homo sapiens
cttggaatggggcagaaaatgg

SEQ ID NO: 8457602 - DNA, 21 bp, Homo sapiens
cttggaacgggtagaactcac

SEQ ID NO: 8457603 - DNA, 21 bp, Homo sapiens
cttggaacgggtagaactcac

SEQ ID NO: 8457604 - DNA, 22 bp, Homo sapiens
cttggaattgatgattttcata

SEQ ID NO: 8457605 - DNA, 22 bp, Homo sapiens
cttggactggacccgaggaatg

SEQ ID NO: 8457606 - DNA, 22 bp, Homo sapiens
cttccccaggacctctgctaaa

SEQ ID NO: 8457607 - DNA, 22 bp, Homo sapiens
cttcccagcacctcagtctggc

SEQ ID NO: 8457608 - DNA, 22 bp, Homo sapiens
cttcccaggtgctcttagcatg

SEQ ID NO: 8457609 - DNA, 22 bp, Homo sapiens
cttcccaggtgctcttagcatg

SEQ ID NO: 8457610 - DNA, 22 bp, Homo sapiens
cttcccagttctgcttgagggg

SEQ ID NO: 8457611 - DNA, 22 bp, Homo sapiens
cttcccagttctgcttgagggg

SEQ ID NO: 8457612 - DNA, 22 bp, Homo sapiens
cttcccagacggggtggcagcc

SEQ ID NO: 8457613 - DNA, 22 bp, Homo sapiens
cttcccagttctgcttgagggg

SEQ ID NO: 8457614 - DNA, 22 bp, Homo sapiens
cttcccagcacctcagtctggc

SEQ ID NO: 8457615 - DNA, 22 bp, Homo sapiens
cttcccagcacctcagtctggc

SEQ ID NO: 8457616 - DNA, 22 bp, Homo sapiens
cttcccagcacctcagtctggc

SEQ ID NO: 8457617 - DNA, 22 bp, Homo sapiens
cttcccagacggggtggcagcc

SEQ ID NO: 8457618 - DNA, 22 bp, Homo sapiens
cttcccagaacaatgtaggctt

SEQ ID NO: 8457619 - DNA, 22 bp, Homo sapiens
cttccaggtccttcttgagaag

SEQ ID NO: 8457620 - DNA, 22 bp, Homo sapiens
cttcccagaccttagagtgcag

SEQ ID NO: 8457621 - DNA, 22 bp, Homo sapiens
cttcccagaccttagagtgcag

SEQ ID NO: 8457622 - DNA, 22 bp, Homo sapiens
cttccctgataagagcctcaga

SEQ ID NO: 8457623 - DNA, 22 bp, Homo sapiens
cttccctggtgttagcccaatg

SEQ ID NO: 8457624 - DNA, 22 bp, Homo sapiens
cttccctgataagagcctcaga

SEQ ID NO: 8457625 - DNA, 22 bp, Homo sapiens
cttccctgagctttctcaggct

SEQ ID NO: 8457626 - DNA, 22 bp, Homo sapiens
cttccctgataagagcctcaga

SEQ ID NO: 8457627 - DNA, 19 bp, Homo sapiens
cttcccctgttacctcact

SEQ ID NO: 8457628 - DNA, 22 bp, Homo sapiens
cttctgtgaccaccagcagccc

SEQ ID NO: 8457629 - DNA, 19 bp, Homo sapiens
cttctgtgatacatcagtc

SEQ ID NO: 8457630 - DNA, 22 bp, Homo sapiens
cttctgtgaagagcagaaccat

SEQ ID NO: 8457631 - DNA, 22 bp, Homo sapiens
cttctgtagccagtaacatata

SEQ ID NO: 8457632 - DNA, 22 bp, Homo sapiens
cttctgtgagtcagtgtttctg

SEQ ID NO: 8457633 - DNA, 22 bp, Homo sapiens
cttcccttctgtgcagggcaga

SEQ ID NO: 8457634 - DNA, 22 bp, Homo sapiens
cttcttcagcacaatattgatg

SEQ ID NO: 8457635 - DNA, 22 bp, Homo sapiens
cttcttcaatagcaagcgcata

SEQ ID NO: 8457636 - DNA, 22 bp, Homo sapiens
cttcacagccaacatgggcaca

SEQ ID NO: 8457637 - DNA, 22 bp, Homo sapiens
cttcacagcatgagctttggag

SEQ ID NO: 8457638 - DNA, 22 bp, Homo sapiens
cttcacaggcaagtctgttttt

SEQ ID NO: 8457639 - DNA, 22 bp, Homo sapiens
cttcacagtataggtccctgag

SEQ ID NO: 8457640 - DNA, 22 bp, Homo sapiens
cttcacagtcaccctgctgtgt

SEQ ID NO: 8457641 - DNA, 20 bp, Homo sapiens
ctgttaaaaggtatgaattc

SEQ ID NO: 8457642 - DNA, 22 bp, Homo sapiens
ctgttaaaagcactgccatcct

SEQ ID NO: 8457643 - DNA, 22 bp, Homo sapiens
ctgttaaaaagaccaatggatt

SEQ ID NO: 8457644 - DNA, 20 bp, Homo sapiens
ctgttaaaaggtatgaattc

SEQ ID NO: 8457645 - DNA, 22 bp, Homo sapiens
ctgttaaatgagaaagcagact

SEQ ID NO: 8457646 - DNA, 22 bp, Homo sapiens
ctgttaaatgagaaagcagact

SEQ ID NO: 8457647 - DNA, 22 bp, Homo sapiens
ctgttaaatgagaaagcagact

SEQ ID NO: 8457648 - DNA, 22 bp, Homo sapiens
ctgttaaatagactgcagtgca

SEQ ID NO: 8457649 - DNA, 22 bp, Homo sapiens
ctgttaaatagactgcagtgca

SEQ ID NO: 8457650 - DNA, 22 bp, Homo sapiens
cttccaggacaccagggtagta

SEQ ID NO: 8457651 - DNA, 22 bp, Homo sapiens
cttcagaaataacaacaattac

SEQ ID NO: 8457652 - DNA, 22 bp, Homo sapiens
cttccagggtccaggaagagcc

SEQ ID NO: 8457653 - DNA, 22 bp, Homo sapiens
cttccaggacaccagggtagta

SEQ ID NO: 8457654 - DNA, 22 bp, Homo sapiens
cttcactgtgcttcaagcagct

SEQ ID NO: 8457655 - DNA, 22 bp, Homo sapiens
cttcagaaactagtaacagcta

SEQ ID NO: 8457656 - DNA, 22 bp, Homo sapiens
cttcacagtctttatttcctcc

SEQ ID NO: 8457657 - DNA, 22 bp, Homo sapiens
cttcactgatgggacagctcaa

SEQ ID NO: 8457658 - DNA, 22 bp, Homo sapiens
ctggtggttcaggagaatggct

SEQ ID NO: 8457659 - DNA, 22 bp, Homo sapiens
ctggtgtccgcaacgggcagcg

SEQ ID NO: 8457660 - DNA, 22 bp, Homo sapiens
ctggtgtggactccgcgcggag

SEQ ID NO: 8457661 - DNA, 22 bp, Homo sapiens
ctggtagtttgcaaaatggtgt

SEQ ID NO: 8457662 - DNA, 22 bp, Homo sapiens
ctggtagcagtgaagctgttga

SEQ ID NO: 8457663 - DNA, 22 bp, Homo sapiens
ctggtgcctcctctcccaggtc

SEQ ID NO: 8457664 - DNA, 22 bp, Homo sapiens
ctggtgcctcctctcccaggtc

SEQ ID NO: 8457665 - DNA, 22 bp, Homo sapiens
ctggtacagtgttacaaaatgg

SEQ ID NO: 8457666 - DNA, 22 bp, Homo sapiens
ctggtacagggaaataaaggaa

SEQ ID NO: 8457667 - DNA, 22 bp, Homo sapiens
ctggtacaaaatgctgatatca

SEQ ID NO: 8457668 - DNA, 22 bp, Homo sapiens
ctggtacatagtaagaacacaa

SEQ ID NO: 8457669 - DNA, 22 bp, Homo sapiens
ctgggttttattacagtgagct

SEQ ID NO: 8457670 - DNA, 22 bp, Homo sapiens
ctgggttttattacagtgagct

SEQ ID NO: 8457671 - DNA, 22 bp, Homo sapiens
ctgggtttagggtctccccttg

SEQ ID NO: 8457672 - DNA, 22 bp, Homo sapiens
ctgggtttagggtctccccttg

SEQ ID NO: 8457673 - DNA, 22 bp, Homo sapiens
ctgggttcttggcacagcagga

SEQ ID NO: 8457674 - DNA, 22 bp, Homo sapiens
ctgggttctatttttggcttca

SEQ ID NO: 8457675 - DNA, 22 bp, Homo sapiens
ctgggttctctgcttagggcct

SEQ ID NO: 8457676 - DNA, 22 bp, Homo sapiens
ctgggttccatgtagccaagag

SEQ ID NO: 8457677 - DNA, 22 bp, Homo sapiens
ctgggttctatttttggcttca

SEQ ID NO: 8457678 - DNA, 22 bp, Homo sapiens
ctgggtggttttgatgtgaatt

SEQ ID NO: 8457679 - DNA, 22 bp, Homo sapiens
ctgggtggaaagtgctgagaat

SEQ ID NO: 8457680 - DNA, 22 bp, Homo sapiens
ctgggtgtcaggagacatgatg

SEQ ID NO: 8457681 - DNA, 22 bp, Homo sapiens
ctgggttccatgtagccaagag

SEQ ID NO: 8457682 - DNA, 22 bp, Homo sapiens
ctggggtgtctcgtctgccatt

SEQ ID NO: 8457683 - DNA, 22 bp, Homo sapiens
ctggggtggatgggtccaagtt

SEQ ID NO: 8457684 - DNA, 22 bp, Homo sapiens
ctggggtggagattggcaatct

SEQ ID NO: 8457685 - DNA, 22 bp, Homo sapiens
ctggggggctactgacagagga

SEQ ID NO: 8457686 - DNA, 22 bp, Homo sapiens
ctgggggtcttgaaagggagag

SEQ ID NO: 8457687 - DNA, 22 bp, Homo sapiens
ctgggggtcgcgcctctgggca

SEQ ID NO: 8457688 - DNA, 20 bp, Homo sapiens
ctgggctcggtggccctggc

SEQ ID NO: 8457689 - DNA, 18 bp, Homo sapiens
ctgggctcgagagatcct

SEQ ID NO: 8457690 - DNA, 18 bp, Homo sapiens
ctgggctcgagagatcct

SEQ ID NO: 8457691 - DNA, 22 bp, Homo sapiens
ctgggctctaagggagcaccgt

SEQ ID NO: 8457692 - DNA, 20 bp, Homo sapiens
ctgggctcggtggccctggc

SEQ ID NO: 8457693 - DNA, 22 bp, Homo sapiens
ctgggctcctaaccatccaggt

SEQ ID NO: 8457694 - DNA, 22 bp, Homo sapiens
ctgggctcctaaccatccaggt

SEQ ID NO: 8457695 - DNA, 22 bp, Homo sapiens
ctgggctcctaaccatccaggt

SEQ ID NO: 8457696 - DNA, 22 bp, Homo sapiens
ctgggctcctaaccatccaggt

SEQ ID NO: 8457697 - DNA, 22 bp, Homo sapiens
ctgggctcctaaccatccaggt

SEQ ID NO: 8457698 - DNA, 22 bp, Homo sapiens
ctgggctccctcatgtgtctgc

SEQ ID NO: 8457699 - DNA, 22 bp, Homo sapiens
ctgggctcagtgtctcactcct

SEQ ID NO: 8457700 - DNA, 22 bp, Homo sapiens
ctgggctccctcatgtgtctgc

SEQ ID NO: 8457701 - DNA, 22 bp, Homo sapiens
ctggggctgtaggaggacttat

SEQ ID NO: 8457702 - DNA, 22 bp, Homo sapiens
ctggggctggtgaggcaggctc

SEQ ID NO: 8457703 - DNA, 22 bp, Homo sapiens
ctgggggcagcaagaagccatg

SEQ ID NO: 8457704 - DNA, 22 bp, Homo sapiens
ctgggggcagcaagaagccatg

SEQ ID NO: 8457705 - DNA, 22 bp, Homo sapiens
ctgggggcagcaagaagccatg

SEQ ID NO: 8457706 - DNA, 22 bp, Homo sapiens
ctgggggccttacggaactcca

SEQ ID NO: 8457707 - DNA, 22 bp, Homo sapiens
ctgggggccttacggaactcca

SEQ ID NO: 8457708 - DNA, 22 bp, Homo sapiens
ctgggggccttacggaactcca

SEQ ID NO: 8457709 - DNA, 22 bp, Homo sapiens
ctgggcctcaccctagaccaat

SEQ ID NO: 8457710 - DNA, 22 bp, Homo sapiens
ctgggcctcacacccaccaaat

SEQ ID NO: 8457711 - DNA, 22 bp, Homo sapiens
ctgggcctcacacccaccaaat

SEQ ID NO: 8457712 - DNA, 22 bp, Homo sapiens
ctgggcctcaatctcagagttt

SEQ ID NO: 8457713 - DNA, 22 bp, Homo sapiens
ctgggcctcaagctcagatttc

SEQ ID NO: 8457714 - DNA, 23 bp, Homo sapiens
ctgggcctatggtctgaatccaa

SEQ ID NO: 8457715 - DNA, 22 bp, Homo sapiens
ctgggcctcatccagccacaac

SEQ ID NO: 8457716 - DNA, 22 bp, Homo sapiens
ctgggcctcatccccagagttt

SEQ ID NO: 8457717 - DNA, 22 bp, Homo sapiens
ctgggcctcatcctcagagttt

SEQ ID NO: 8457718 - DNA, 22 bp, Homo sapiens
ctgggcctcatccccagagttt

SEQ ID NO: 8457719 - DNA, 22 bp, Homo sapiens
ctgggcctcatccccagagttt

SEQ ID NO: 8457720 - DNA, 22 bp, Homo sapiens
ctgggcctaggatggaagggcc

SEQ ID NO: 8457721 - DNA, 22 bp, Homo sapiens
ctgggcctagcaacagaggagt

SEQ ID NO: 8457722 - DNA, 22 bp, Homo sapiens
ctgggcctagcaacagaggagt

SEQ ID NO: 8457723 - DNA, 22 bp, Homo sapiens
ctgggcctagcaacagaggagt

SEQ ID NO: 8457724 - DNA, 22 bp, Homo sapiens
ctgggcctagaggaagctgaca

SEQ ID NO: 8457725 - DNA, 22 bp, Homo sapiens
ctgggcccaggcggctctcgga

SEQ ID NO: 8457726 - DNA, 22 bp, Homo sapiens
ctgggccctatggaagaaaggg

SEQ ID NO: 8457727 - DNA, 22 bp, Homo sapiens
ctgggccctgaagacagtcagg

SEQ ID NO: 8457728 - DNA, 22 bp, Homo sapiens
ctgggccctatggaagaaaggg

SEQ ID NO: 8457729 - DNA, 22 bp, Homo sapiens
ctgggcctaacccacagcgttt

SEQ ID NO: 8457730 - DNA, 22 bp, Homo sapiens
ctgggctcagcaggccaaggcc

SEQ ID NO: 8457731 - DNA, 22 bp, Homo sapiens
ctgggctcagcaggccaaggcc

SEQ ID NO: 8457732 - DNA, 22 bp, Homo sapiens
ctgggctcaaatcctggccctg

SEQ ID NO: 8457733 - DNA, 22 bp, Homo sapiens
ctgggctcaaatcctggccctg

SEQ ID NO: 8457734 - DNA, 22 bp, Homo sapiens
ctgggcctccacgggccatcac

SEQ ID NO: 8457735 - DNA, 22 bp, Homo sapiens
ctgggcctccacgggccatcac

SEQ ID NO: 8457736 - DNA, 22 bp, Homo sapiens
ctgggcctccacgggccatcac

SEQ ID NO: 8457737 - DNA, 22 bp, Homo sapiens
ctgggcctcatgcacagagatg

SEQ ID NO: 8457738 - DNA, 22 bp, Homo sapiens
ctgggctcagtggctcatggct

SEQ ID NO: 8457739 - DNA, 22 bp, Homo sapiens
ctgggctcagtggctcatggct

SEQ ID NO: 8457740 - DNA, 22 bp, Homo sapiens
ctgggctcagtggctcatggct

SEQ ID NO: 8457741 - DNA, 22 bp, Homo sapiens
ctgggctcagtgtctcactcct

SEQ ID NO: 8457742 - DNA, 22 bp, Homo sapiens
ctgggctcagcccatgctgtcc

SEQ ID NO: 8457743 - DNA, 22 bp, Homo sapiens
ctgggctcagcccatgctgtcc

SEQ ID NO: 8457744 - DNA, 22 bp, Homo sapiens
ctgggctccactacttgctaac

SEQ ID NO: 8457745 - DNA, 22 bp, Homo sapiens
ctgggctccactacttgctaac

SEQ ID NO: 8457746 - DNA, 22 bp, Homo sapiens
ctgggctccactcccacagtgt

SEQ ID NO: 8457747 - DNA, 22 bp, Homo sapiens
ctgggctccactcccacagtgt

SEQ ID NO: 8457748 - DNA, 22 bp, Homo sapiens
ctgggctccactcccacagtgt

SEQ ID NO: 8457749 - DNA, 22 bp, Homo sapiens
ctgggctcagtgtctcactcct

SEQ ID NO: 8457750 - DNA, 22 bp, Homo sapiens
ctgggctccactacttgctaac

SEQ ID NO: 8457751 - DNA, 19 bp, Homo sapiens
ctgggagttcactgctgcc

SEQ ID NO: 8457752 - DNA, 22 bp, Homo sapiens
ctgggcccaggcggctctcgga

SEQ ID NO: 8457753 - DNA, 22 bp, Homo sapiens
ctgggaggcggagcttgcagtg

SEQ ID NO: 8457754 - DNA, 22 bp, Homo sapiens
ctggagctcagcccaggttcca

SEQ ID NO: 8457755 - DNA, 22 bp, Homo sapiens
ctggagctccagggtctcctct

SEQ ID NO: 8457756 - DNA, 22 bp, Homo sapiens
ctggagccttcaccaggggaaa

SEQ ID NO: 8457757 - DNA, 22 bp, Homo sapiens
ctggagctcagcccaggttcca

SEQ ID NO: 8457758 - DNA, 22 bp, Homo sapiens
ctggagctcagcccaggttcca

SEQ ID NO: 8457759 - DNA, 22 bp, Homo sapiens
ctggagctaggaagtccaagat

SEQ ID NO: 8457760 - DNA, 22 bp, Homo sapiens
ctgggaggcggaggttgcagtg

SEQ ID NO: 8457761 - DNA, 22 bp, Homo sapiens
ctgggaggcggaggttgcagtg

SEQ ID NO: 8457762 - DNA, 20 bp, Homo sapiens
ctgtggtgagcaggagagta

SEQ ID NO: 8457763 - DNA, 22 bp, Homo sapiens
ctgtggtgagcaactgactgaa

SEQ ID NO: 8457764 - DNA, 22 bp, Homo sapiens
ctgtgtgagcatcacttcagat

SEQ ID NO: 8457765 - DNA, 22 bp, Homo sapiens
ctgtgtgatgggaagaatgttt

SEQ ID NO: 8457766 - DNA, 18 bp, Homo sapiens
ctgtgggctggtgcatga

SEQ ID NO: 8457767 - DNA, 22 bp, Homo sapiens
ctgtgggctgaaagtgctcccg

SEQ ID NO: 8457768 - DNA, 22 bp, Homo sapiens
ctgtgtgtgctacaggcttcca

SEQ ID NO: 8457769 - DNA, 22 bp, Homo sapiens
ctgtgtgtgtctgcagcatact

SEQ ID NO: 8457770 - DNA, 22 bp, Homo sapiens
ctgtggcttctgggtcagttca

SEQ ID NO: 8457771 - DNA, 22 bp, Homo sapiens
ctgtggcttctaggtccccgat

SEQ ID NO: 8457772 - DNA, 22 bp, Homo sapiens
ctgtggcttctaggtccccgat

SEQ ID NO: 8457773 - DNA, 22 bp, Homo sapiens
ctgtggcatttagaggttgcgt

SEQ ID NO: 8457774 - DNA, 22 bp, Homo sapiens
ctgtggctttctctgcctcctt

SEQ ID NO: 8457775 - DNA, 22 bp, Homo sapiens
ctgtgggagcactggggaccga

SEQ ID NO: 8457776 - DNA, 22 bp, Homo sapiens
ctgtgggagcagcaccaaggac

SEQ ID NO: 8457777 - DNA, 22 bp, Homo sapiens
ctgtgggagggtgagagaacca

SEQ ID NO: 8457778 - DNA, 22 bp, Homo sapiens
ctgtgggagggaaggcgcggcc

SEQ ID NO: 8457779 - DNA, 22 bp, Homo sapiens
ctgtgggctcccagcttctctc

SEQ ID NO: 8457780 - DNA, 22 bp, Homo sapiens
ctgtgggcgcctgtcagcctca

SEQ ID NO: 8457781 - DNA, 22 bp, Homo sapiens
ctgtgggatgggacctcagctg

SEQ ID NO: 8457782 - DNA, 22 bp, Homo sapiens
ctgtgggattcatgacattaat

SEQ ID NO: 8457783 - DNA, 22 bp, Homo sapiens
ctgtgggcctagtctggcctag

SEQ ID NO: 8457784 - DNA, 22 bp, Homo sapiens
ctgtgggcatttgagtgtgggt

SEQ ID NO: 8457785 - DNA, 22 bp, Homo sapiens
ctgtggagtttgtggcgctgac

SEQ ID NO: 8457786 - DNA, 22 bp, Homo sapiens
ctgtggagtttgtggcgctgac

SEQ ID NO: 8457787 - DNA, 22 bp, Homo sapiens
ctgtggcaagtctgcctgtcac

SEQ ID NO: 8457788 - DNA, 22 bp, Homo sapiens
ctgtggcactcaagaagcctcc

SEQ ID NO: 8457789 - DNA, 22 bp, Homo sapiens
ctgtggcagggaagaggccatg

SEQ ID NO: 8457790 - DNA, 22 bp, Homo sapiens
ctgtggcagggaagaggccatg

SEQ ID NO: 8457791 - DNA, 20 bp, Homo sapiens
ctgtggcatctgtcatggtg

SEQ ID NO: 8457792 - DNA, 22 bp, Homo sapiens
ctgtggcattgtgaggactgca

SEQ ID NO: 8457793 - DNA, 22 bp, Homo sapiens
ctggtttattcgtcacaccgga

SEQ ID NO: 8457794 - DNA, 17 bp, Homo sapiens
ctggtttatgggcagtg

SEQ ID NO: 8457795 - DNA, 22 bp, Homo sapiens
ctggttttgtcagaagctttat

SEQ ID NO: 8457796 - DNA, 22 bp, Homo sapiens
ctgtccagtgcagagaacagag

SEQ ID NO: 8457797 - DNA, 22 bp, Homo sapiens
ctggttctgatgttcttggctt

SEQ ID NO: 8457798 - DNA, 22 bp, Homo sapiens
ctggtttagtgaaataggccag

SEQ ID NO: 8457799 - DNA, 22 bp, Homo sapiens
ctggtttatgtatcatctagaa

SEQ ID NO: 8457800 - DNA, 22 bp, Homo sapiens
ctggtttataaatctgtggcca

SEQ ID NO: 8457801 - DNA, 22 bp, Homo sapiens
ctggtttatgagggaagggatg

SEQ ID NO: 8457802 - DNA, 19 bp, Homo sapiens
ctggtttaggtagtgagtc

SEQ ID NO: 8457803 - DNA, 22 bp, Homo sapiens
ctggtttagtaggggactgaag

SEQ ID NO: 8457804 - DNA, 22 bp, Homo sapiens
ctggtttagtcataatggagaa

SEQ ID NO: 8457805 - DNA, 22 bp, Homo sapiens
ctggttggtgccacatggtggc

SEQ ID NO: 8457806 - DNA, 22 bp, Homo sapiens
ctggtttaaaattactggttaa

SEQ ID NO: 8457807 - DNA, 22 bp, Homo sapiens
ctggtttaaccatgtatcctgg

SEQ ID NO: 8457808 - DNA, 22 bp, Homo sapiens
ctggtttaagcttatatagttg

SEQ ID NO: 8457809 - DNA, 22 bp, Homo sapiens
ctggtttacccaagatttgctg

SEQ ID NO: 8457810 - DNA, 22 bp, Homo sapiens
ctggtttactctgcactgctca

SEQ ID NO: 8457811 - DNA, 22 bp, Homo sapiens
ctggtttagctgtaaggttccc

SEQ ID NO: 8457812 - DNA, 22 bp, Homo sapiens
ctgtcccaggatcctgactcca

SEQ ID NO: 8457813 - DNA, 22 bp, Homo sapiens
ctgtcccagccccgtactctaa

SEQ ID NO: 8457814 - DNA, 19 bp, Homo sapiens
ctgtcccagactctgctct

SEQ ID NO: 8457815 - DNA, 19 bp, Homo sapiens
ctgtcccagactctgctct

SEQ ID NO: 8457816 - DNA, 22 bp, Homo sapiens
ctgtcccagatgttctcagcac

SEQ ID NO: 8457817 - DNA, 22 bp, Homo sapiens
ctgtccatggcaatgatgcaga

SEQ ID NO: 8457818 - DNA, 22 bp, Homo sapiens
ctgtccatggtgctggacggtc

SEQ ID NO: 8457819 - DNA, 22 bp, Homo sapiens
ctgtcccacaagcagtgtgcac

SEQ ID NO: 8457820 - DNA, 22 bp, Homo sapiens
ctgtcccctgtgctttcacttg

SEQ ID NO: 8457821 - DNA, 22 bp, Homo sapiens
ctgtccccgcgagtccagagct

SEQ ID NO: 8457822 - DNA, 22 bp, Homo sapiens
ctgtcccatccttactctaccc

SEQ ID NO: 8457823 - DNA, 18 bp, Homo sapiens
ctgtcccatcctcaggtt

SEQ ID NO: 8457824 - DNA, 18 bp, Homo sapiens
ctgtcccatcctcaggtt

SEQ ID NO: 8457825 - DNA, 22 bp, Homo sapiens
ctgtcccaggatcctgactcca

SEQ ID NO: 8457826 - DNA, 22 bp, Homo sapiens
ctgtcccagtgatcctgagtgc

SEQ ID NO: 8457827 - DNA, 20 bp, Homo sapiens
ctgtgaccagagacccagga

SEQ ID NO: 8457828 - DNA, 22 bp, Homo sapiens
ctgtgacccagttcctggcacc

SEQ ID NO: 8457829 - DNA, 22 bp, Homo sapiens
ctgtgaatgctagtaagagtgc

SEQ ID NO: 8457830 - DNA, 22 bp, Homo sapiens
ctgtgaattgaatatgactatg

SEQ ID NO: 8457831 - DNA, 22 bp, Homo sapiens
ctgtctgtgtggacacggctgc

SEQ ID NO: 8457832 - DNA, 22 bp, Homo sapiens
ctgtctgttatctcaccagtcc

SEQ ID NO: 8457833 - DNA, 22 bp, Homo sapiens
ctgtgaaactggacagcacttg

SEQ ID NO: 8457834 - DNA, 22 bp, Homo sapiens
ctgtctgttcagattcattact

SEQ ID NO: 8457835 - DNA, 22 bp, Homo sapiens
ctgtccctcatcacctctgggt

SEQ ID NO: 8457836 - DNA, 22 bp, Homo sapiens
ctgtccctcatcacctctgggt

SEQ ID NO: 8457837 - DNA, 19 bp, Homo sapiens
ctgtccctcccaggtatga

SEQ ID NO: 8457838 - DNA, 22 bp, Homo sapiens
ctgtccctcagttctgggcaaa

SEQ ID NO: 8457839 - DNA, 21 bp, Homo sapiens
ctgtgacctttctttcctcct

SEQ ID NO: 8457840 - DNA, 22 bp, Homo sapiens
ctgtgaccttagcaagggaaat

SEQ ID NO: 8457841 - DNA, 22 bp, Homo sapiens
ctgtgacctccaggaaggggtg

SEQ ID NO: 8457842 - DNA, 22 bp, Homo sapiens
ctgtgaccttagcaagggaaat

SEQ ID NO: 8457843 - DNA, 22 bp, Homo sapiens
ctgtgactgggtgacagtcctc

SEQ ID NO: 8457844 - DNA, 22 bp, Homo sapiens
ctgtgagagtggtggcctaggc

SEQ ID NO: 8457845 - DNA, 22 bp, Homo sapiens
ctgtgagactgatagggaagag

SEQ ID NO: 8457846 - DNA, 19 bp, Homo sapiens
ctgtggactctagatcatg

SEQ ID NO: 8457847 - DNA, 20 bp, Homo sapiens
ctgtggaattttaccatgcg

SEQ ID NO: 8457848 - DNA, 22 bp, Homo sapiens
ctgtggaattgatgcttagtgt

SEQ ID NO: 8457849 - DNA, 22 bp, Homo sapiens
ctgtggaatcatcaggtcttac

SEQ ID NO: 8457850 - DNA, 22 bp, Homo sapiens
ctgtggaaggtttagataggta

SEQ ID NO: 8457851 - DNA, 22 bp, Homo sapiens
ctgtgagggcagggaccagagg

SEQ ID NO: 8457852 - DNA, 22 bp, Homo sapiens
gagggctgatgcttacttattt

SEQ ID NO: 8457853 - DNA, 22 bp, Homo sapiens
gagggctgataacaggaataca

SEQ ID NO: 8457854 - DNA, 22 bp, Homo sapiens
gagggtcctggctaagtctgac

SEQ ID NO: 8457855 - DNA, 22 bp, Homo sapiens
gagggtgcaggaggatggtagt

SEQ ID NO: 8457856 - DNA, 22 bp, Homo sapiens
gagggtggctcctccctgggcc

SEQ ID NO: 8457857 - DNA, 22 bp, Homo sapiens
gagggtggcctttagagcccat

SEQ ID NO: 8457858 - DNA, 22 bp, Homo sapiens
gaggtctggaccaagtcgcccc

SEQ ID NO: 8457859 - DNA, 22 bp, Homo sapiens
gaggtctgggcttgggcctggt

SEQ ID NO: 8457860 - DNA, 22 bp, Homo sapiens
gaggtctgggatggggcctgaa

SEQ ID NO: 8457861 - DNA, 22 bp, Homo sapiens
gaggtcctctgtgtccgcgggc

SEQ ID NO: 8457862 - DNA, 22 bp, Homo sapiens
gagggtgggctcctatctgggt

SEQ ID NO: 8457863 - DNA, 22 bp, Homo sapiens
gagggtggggaatagactgcta

SEQ ID NO: 8457864 - DNA, 19 bp, Homo sapiens
gagtacaggtgcagaaatg

SEQ ID NO: 8457865 - DNA, 22 bp, Homo sapiens
gagtaattttcttaaaacatca

SEQ ID NO: 8457866 - DNA, 22 bp, Homo sapiens
gagtaattagagcaatgacttt

SEQ ID NO: 8457867 - DNA, 22 bp, Homo sapiens
gagtaattccaatataaatcac

SEQ ID NO: 8457868 - DNA, 22 bp, Homo sapiens
gagtaattctggtaaatcattg

SEQ ID NO: 8457869 - DNA, 22 bp, Homo sapiens
gaggttggtgaggggacacggt

SEQ ID NO: 8457870 - DNA, 22 bp, Homo sapiens
gaggtgggagggcagtccctaa

SEQ ID NO: 8457871 - DNA, 22 bp, Homo sapiens
gaggtgcctggcgatgtctctg

SEQ ID NO: 8457872 - DNA, 22 bp, Homo sapiens
gaggtgatggttgcacaatgct

SEQ ID NO: 8457873 - DNA, 22 bp, Homo sapiens
gaggtgagtggatcacgaggtc

SEQ ID NO: 8457874 - DNA, 22 bp, Homo sapiens
gaggtcttgtctgatagggaaa

SEQ ID NO: 8457875 - DNA, 22 bp, Homo sapiens
gaggtcttcacaaagaacagca

SEQ ID NO: 8457876 - DNA, 22 bp, Homo sapiens
gaggtcttagaagaaaaatcat

SEQ ID NO: 8457877 - DNA, 22 bp, Homo sapiens
gaggtgagaagggggtcagatg

SEQ ID NO: 8457878 - DNA, 22 bp, Homo sapiens
gaggtgagaagggggtcagatg

SEQ ID NO: 8457879 - DNA, 22 bp, Homo sapiens
gaggtggatgttgcagtgagct

SEQ ID NO: 8457880 - DNA, 22 bp, Homo sapiens
gagggctgataaatgcgcatgg

SEQ ID NO: 8457881 - DNA, 22 bp, Homo sapiens
gagggctgaagtgttttatgag

SEQ ID NO: 8457882 - DNA, 22 bp, Homo sapiens
gagggcctactggacatgtcag

SEQ ID NO: 8457883 - DNA, 22 bp, Homo sapiens
gagggccctggctggctccagc

SEQ ID NO: 8457884 - DNA, 22 bp, Homo sapiens
gagggccaggcagcaagaaggc

SEQ ID NO: 8457885 - DNA, 22 bp, Homo sapiens
gagggccagcagcctcagcatg

SEQ ID NO: 8457886 - DNA, 22 bp, Homo sapiens
gagggccagcagcctcagcatg

SEQ ID NO: 8457887 - DNA, 22 bp, Homo sapiens
gagggacagctaaagagaaatt

SEQ ID NO: 8457888 - DNA, 22 bp, Homo sapiens
gagggacctttacacagacatt

SEQ ID NO: 8457889 - DNA, 22 bp, Homo sapiens
gagggaatggtgtgcaagaggt

SEQ ID NO: 8457890 - DNA, 22 bp, Homo sapiens
gagggacagctaaagagaaatt

SEQ ID NO: 8457891 - DNA, 22 bp, Homo sapiens
gagggccacgttcagggctctc

SEQ ID NO: 8457892 - DNA, 22 bp, Homo sapiens
gaggctgtaagtgtggagccta

SEQ ID NO: 8457893 - DNA, 22 bp, Homo sapiens
gaggctgtaacttgggcactgg

SEQ ID NO: 8457894 - DNA, 22 bp, Homo sapiens
gaggctggtttgccttttggca

SEQ ID NO: 8457895 - DNA, 21 bp, Homo sapiens
gaggctgtctgctgctggcct

SEQ ID NO: 8457896 - DNA, 22 bp, Homo sapiens
gaggctgtctgttagcctggga

SEQ ID NO: 8457897 - DNA, 22 bp, Homo sapiens
gaggcggcggccgagcctggct

SEQ ID NO: 8457898 - DNA, 22 bp, Homo sapiens
gaggctggggtctgcctttctg

SEQ ID NO: 8457899 - DNA, 22 bp, Homo sapiens
gaggctggtaggaaaggaaaca

SEQ ID NO: 8457900 - DNA, 22 bp, Homo sapiens
gaggctcaaacctggacagagc

SEQ ID NO: 8457901 - DNA, 22 bp, Homo sapiens
gaggctggttcccttgatcttt

SEQ ID NO: 8457902 - DNA, 22 bp, Homo sapiens
gaggctggttctgaagtactgt

SEQ ID NO: 8457903 - DNA, 22 bp, Homo sapiens
gaggctggtggttagttccatt

SEQ ID NO: 8457904 - DNA, 22 bp, Homo sapiens
gaggctggtcagccctaagatc

SEQ ID NO: 8457905 - DNA, 22 bp, Homo sapiens
gaggctggtaggaaaggaaaca

SEQ ID NO: 8457906 - DNA, 22 bp, Homo sapiens
gaggcctgtcgctaggcctctg

SEQ ID NO: 8457907 - DNA, 22 bp, Homo sapiens
gaggcctgtagtcatggatgta

SEQ ID NO: 8457908 - DNA, 22 bp, Homo sapiens
gaggcctgtcgctaggcctctg

SEQ ID NO: 8457909 - DNA, 22 bp, Homo sapiens
gaggcgagaagctggagatggt

SEQ ID NO: 8457910 - DNA, 19 bp, Homo sapiens
gaggcgaggcgtgcaggag

SEQ ID NO: 8457911 - DNA, 19 bp, Homo sapiens
gaggcgaggcgtgcaggag

SEQ ID NO: 8457912 - DNA, 22 bp, Homo sapiens
gaggcctggtttgcatgagaat

SEQ ID NO: 8457913 - DNA, 22 bp, Homo sapiens
gaggcctggtttgcatgagaat

SEQ ID NO: 8457914 - DNA, 22 bp, Homo sapiens
gaggcctggtttccagcatcct

SEQ ID NO: 8457915 - DNA, 22 bp, Homo sapiens
gaggcctggtgtgtctcccgct

SEQ ID NO: 8457916 - DNA, 22 bp, Homo sapiens
gaggcctggtctatgagatgtt

SEQ ID NO: 8457917 - DNA, 22 bp, Homo sapiens
gaggcctggtgctgtgtccaca

SEQ ID NO: 8457918 - DNA, 22 bp, Homo sapiens
gaggccagaatgagctgaatgc

SEQ ID NO: 8457919 - DNA, 22 bp, Homo sapiens
gaggccagaatgagctgaatgc

SEQ ID NO: 8457920 - DNA, 22 bp, Homo sapiens
gaggccagaagtgcctcgggct

SEQ ID NO: 8457921 - DNA, 22 bp, Homo sapiens
gaggccagaagtgcctcgggct

SEQ ID NO: 8457922 - DNA, 22 bp, Homo sapiens
gaggccagaagtctgagatcag

SEQ ID NO: 8457923 - DNA, 22 bp, Homo sapiens
gaggccagaagtctgagatcag

SEQ ID NO: 8457924 - DNA, 22 bp, Homo sapiens
gaggcctggaattccagcctgg

SEQ ID NO: 8457925 - DNA, 22 bp, Homo sapiens
gaggcctggaattccagcctgg

SEQ ID NO: 8457926 - DNA, 22 bp, Homo sapiens
gaggccagatactctcttctgc

SEQ ID NO: 8457927 - DNA, 22 bp, Homo sapiens
gaggccagatactctcttctgc

SEQ ID NO: 8457928 - DNA, 22 bp, Homo sapiens
gaggcctggaccagccacagag

SEQ ID NO: 8457929 - DNA, 22 bp, Homo sapiens
gaggcctggaccagccacagag

SEQ ID NO: 8457930 - DNA, 22 bp, Homo sapiens
gaggccagaatgagtctctggg

SEQ ID NO: 8457931 - DNA, 22 bp, Homo sapiens
gaggccagaatgagtctctggg

SEQ ID NO: 8457932 - DNA, 22 bp, Homo sapiens
gaggccagactgccttttatga

SEQ ID NO: 8457933 - DNA, 22 bp, Homo sapiens
gaggccagagttccccgagtca

SEQ ID NO: 8457934 - DNA, 22 bp, Homo sapiens
gaggccagagttccccgagtca

SEQ ID NO: 8457935 - DNA, 22 bp, Homo sapiens
gaggccagagttccccgagtca

SEQ ID NO: 8457936 - DNA, 22 bp, Homo sapiens
gaggcaagaaaggactttctag

SEQ ID NO: 8457937 - DNA, 22 bp, Homo sapiens
gaggcaagaaaggactttctag

SEQ ID NO: 8457938 - DNA, 22 bp, Homo sapiens
gaggatggaggtgtgagctatg

SEQ ID NO: 8457939 - DNA, 22 bp, Homo sapiens
gaggcatggcctgaggctagga

SEQ ID NO: 8457940 - DNA, 22 bp, Homo sapiens
gaggcatggcctgaggctagga

SEQ ID NO: 8457941 - DNA, 22 bp, Homo sapiens
gaggcatgcagagctggagcag

SEQ ID NO: 8457942 - DNA, 22 bp, Homo sapiens
gaggcaagaaaggactttctag

SEQ ID NO: 8457943 - DNA, 22 bp, Homo sapiens
gaggcaagagaagccagctttc

SEQ ID NO: 8457944 - DNA, 22 bp, Homo sapiens
gaggaccacagatgagcctgca

SEQ ID NO: 8457945 - DNA, 22 bp, Homo sapiens
gaggacagtgtgatctgccagc

SEQ ID NO: 8457946 - DNA, 22 bp, Homo sapiens
gaggacagtgtgatctgccagc

SEQ ID NO: 8457947 - DNA, 22 bp, Homo sapiens
gaggagagaagctaacggtgct

SEQ ID NO: 8457948 - DNA, 22 bp, Homo sapiens
gaggagacggggtgcctggagc

SEQ ID NO: 8457949 - DNA, 22 bp, Homo sapiens
gaggagagaacattcctccata

SEQ ID NO: 8457950 - DNA, 22 bp, Homo sapiens
gaggagagaacattcctccata

SEQ ID NO: 8457951 - DNA, 22 bp, Homo sapiens
gaggagacagtggagccgctac

SEQ ID NO: 8457952 - DNA, 22 bp, Homo sapiens
gaggactgaaacttacaggaaa

SEQ ID NO: 8457953 - DNA, 22 bp, Homo sapiens
gaggagacatatttttgaagca

SEQ ID NO: 8457954 - DNA, 22 bp, Homo sapiens
gaggaggtggagtcatgcagag

SEQ ID NO: 8457955 - DNA, 22 bp, Homo sapiens
gaggagtgccagccgtggagtc

SEQ ID NO: 8457956 - DNA, 20 bp, Homo sapiens
gaggagtcttgtagaaaatg

SEQ ID NO: 8457957 - DNA, 22 bp, Homo sapiens
gaggagtgggttagtgcttatt

SEQ ID NO: 8457958 - DNA, 22 bp, Homo sapiens
gaggagtggagttgctgggttg

SEQ ID NO: 8457959 - DNA, 22 bp, Homo sapiens
gaggagtgtattccacaccact

SEQ ID NO: 8457960 - DNA, 22 bp, Homo sapiens
gaggatgctgcagtgcaggaca

SEQ ID NO: 8457961 - DNA, 18 bp, Homo sapiens
gaggatggaaggagatgc

SEQ ID NO: 8457962 - DNA, 18 bp, Homo sapiens
gaggatggaaggagatgc

SEQ ID NO: 8457963 - DNA, 22 bp, Homo sapiens
gagctgtgaaaagtgcctgggg

SEQ ID NO: 8457964 - DNA, 22 bp, Homo sapiens
gagctgtgacacgcagcccagg

SEQ ID NO: 8457965 - DNA, 22 bp, Homo sapiens
gagctggtgtgtgcccgagcac

SEQ ID NO: 8457966 - DNA, 22 bp, Homo sapiens
gagctggttctgtccagggaat

SEQ ID NO: 8457967 - DNA, 22 bp, Homo sapiens
gaggacaggagactcactgttt

SEQ ID NO: 8457968 - DNA, 17 bp, Homo sapiens
gaggacagggaagtagg

SEQ ID NO: 8457969 - DNA, 22 bp, Homo sapiens
gagctgtgccaatctgtctggg

SEQ ID NO: 8457970 - DNA, 20 bp, Homo sapiens
gagctgtgctctcaggagcc

SEQ ID NO: 8457971 - DNA, 22 bp, Homo sapiens
gagctgtgattggtgtctcact

SEQ ID NO: 8457972 - DNA, 22 bp, Homo sapiens
gagctgtggaaggcagggacca

SEQ ID NO: 8457973 - DNA, 22 bp, Homo sapiens
gagctgtgcttataccaattca

SEQ ID NO: 8457974 - DNA, 22 bp, Homo sapiens
gagctgggcacacgccacttga

SEQ ID NO: 8457975 - DNA, 22 bp, Homo sapiens
gagctcctggattgctcctagg

SEQ ID NO: 8457976 - DNA, 22 bp, Homo sapiens
gagctcctggattgctcctagg

SEQ ID NO: 8457977 - DNA, 22 bp, Homo sapiens
gagctccctggaggttcagata

SEQ ID NO: 8457978 - DNA, 22 bp, Homo sapiens
gagctccagggaacagcagcta

SEQ ID NO: 8457979 - DNA, 22 bp, Homo sapiens
gagctcctgaaacgttcctgcc

SEQ ID NO: 8457980 - DNA, 22 bp, Homo sapiens
gagctcctgctgcatcctgcct

SEQ ID NO: 8457981 - DNA, 22 bp, Homo sapiens
gagctcctggattgctcctagg

SEQ ID NO: 8457982 - DNA, 22 bp, Homo sapiens
gagctcctgctgcatcctgcct

SEQ ID NO: 8457983 - DNA, 22 bp, Homo sapiens
gagctcctcccagggtagcact

SEQ ID NO: 8457984 - DNA, 22 bp, Homo sapiens
gagctcctgaaacgttcctgcc

SEQ ID NO: 8457985 - DNA, 22 bp, Homo sapiens
gagctcctatggtcggtggctc

SEQ ID NO: 8457986 - DNA, 22 bp, Homo sapiens
gagctcctatggtcggtggctc

SEQ ID NO: 8457987 - DNA, 22 bp, Homo sapiens
gagctgggtatatggctttatg

SEQ ID NO: 8457988 - DNA, 22 bp, Homo sapiens
gagctggtcagtttcagggcca

SEQ ID NO: 8457989 - DNA, 22 bp, Homo sapiens
gagctggtcagtttcaggagag

SEQ ID NO: 8457990 - DNA, 22 bp, Homo sapiens
gagctggtgatcagctggagga

SEQ ID NO: 8457991 - DNA, 22 bp, Homo sapiens
gagctggtcgaaatgggctgac

SEQ ID NO: 8457992 - DNA, 22 bp, Homo sapiens
gagcaggcctggggtgaggcct

SEQ ID NO: 8457993 - DNA, 19 bp, Homo sapiens
gagcaggccacacatgtgt

SEQ ID NO: 8457994 - DNA, 19 bp, Homo sapiens
gagcaggccacacatgtgt

SEQ ID NO: 8457995 - DNA, 22 bp, Homo sapiens
gagcaggccagcaatggaaggg

SEQ ID NO: 8457996 - DNA, 22 bp, Homo sapiens
gagctcagactcgggcctgggg

SEQ ID NO: 8457997 - DNA, 22 bp, Homo sapiens
gagcaggctctgcctgtgtgtc

SEQ ID NO: 8457998 - DNA, 22 bp, Homo sapiens
gagcaggcctggggtgaggcct

SEQ ID NO: 8457999 - DNA, 22 bp, Homo sapiens
gagctcagaggattctggggag

SEQ ID NO: 8458000 - DNA, 22 bp, Homo sapiens
gagctcagaggcgtctttgtcc

SEQ ID NO: 8458001 - DNA, 22 bp, Homo sapiens
gagctcagagcctatagttggt

SEQ ID NO: 8458002 - DNA, 22 bp, Homo sapiens
gagcaggctctgcctgtgtgtc

SEQ ID NO: 8458003 - DNA, 22 bp, Homo sapiens
gagctcagagcctatagttggt

SEQ ID NO: 8458004 - DNA, 22 bp, Homo sapiens
gagcaggcaaagatgaaaggag

SEQ ID NO: 8458005 - DNA, 22 bp, Homo sapiens
gagcaggatgggagctggggcc

SEQ ID NO: 8458006 - DNA, 22 bp, Homo sapiens
gagcaggacgtgggaatgggaa

SEQ ID NO: 8458007 - DNA, 22 bp, Homo sapiens
gagcaggcaactctgcagtgcc

SEQ ID NO: 8458008 - DNA, 22 bp, Homo sapiens
gagcaggcaactctgcagtgcc

SEQ ID NO: 8458009 - DNA, 19 bp, Homo sapiens
gagcaggccacacatgtgt

SEQ ID NO: 8458010 - DNA, 22 bp, Homo sapiens
gagctcagcaaaggtctgtgtg

SEQ ID NO: 8458011 - DNA, 22 bp, Homo sapiens
gagctcagattctggtgtcaga

SEQ ID NO: 8458012 - DNA, 22 bp, Homo sapiens
gagctcagcactaaaatcatgt

SEQ ID NO: 8458013 - DNA, 22 bp, Homo sapiens
gagctcagcccaaagagcagtg

SEQ ID NO: 8458014 - DNA, 22 bp, Homo sapiens
gagctcagcctgaggcctggct

SEQ ID NO: 8458015 - DNA, 22 bp, Homo sapiens
gagctcagcccaaagagcagtg

SEQ ID NO: 8458016 - DNA, 18 bp, Homo sapiens
gagctcagcgtgtttcta

SEQ ID NO: 8458017 - DNA, 22 bp, Homo sapiens
gagctcaggagcatcagaagaa

SEQ ID NO: 8458018 - DNA, 22 bp, Homo sapiens
gagctcagggcattgagcaaga

SEQ ID NO: 8458019 - DNA, 22 bp, Homo sapiens
gagctcaggtggtcaaaacaat

SEQ ID NO: 8458020 - DNA, 23 bp, Homo sapiens
gagctcaggtagggctcgcccgc

SEQ ID NO: 8458021 - DNA, 22 bp, Homo sapiens
gagctcagtgtagtcatggctt

SEQ ID NO: 8458022 - DNA, 22 bp, Homo sapiens
gagctccaccaccttcaggcag

SEQ ID NO: 8458023 - DNA, 22 bp, Homo sapiens
gagctcattgtggatggatggg

SEQ ID NO: 8458024 - DNA, 22 bp, Homo sapiens
gagctccacttagcaaggccac

SEQ ID NO: 8458025 - DNA, 22 bp, Homo sapiens
gagctccacttagcaaggccac

SEQ ID NO: 8458026 - DNA, 22 bp, Homo sapiens
gagctccagagttagacacccg

SEQ ID NO: 8458027 - DNA, 22 bp, Homo sapiens
gagctccagagttagacacccg

SEQ ID NO: 8458028 - DNA, 22 bp, Homo sapiens
gaattaactggcagttagtgct

SEQ ID NO: 8458029 - DNA, 22 bp, Homo sapiens
gaattacaaagtgagacaagct

SEQ ID NO: 8458030 - DNA, 22 bp, Homo sapiens
gaattacagccagaagaatgaa

SEQ ID NO: 8458031 - DNA, 22 bp, Homo sapiens
gaattacagccagaagaatgaa

SEQ ID NO: 8458032 - DNA, 22 bp, Homo sapiens
gaattacagccagaagaatgaa

SEQ ID NO: 8458033 - DNA, 22 bp, Homo sapiens
gaattacagccagaagaatgaa

SEQ ID NO: 8458034 - DNA, 22 bp, Homo sapiens
gaattacaaagtgagacaagct

SEQ ID NO: 8458035 - DNA, 22 bp, Homo sapiens
gaattacagagttgttaagtca

SEQ ID NO: 8458036 - DNA, 22 bp, Homo sapiens
gaattacagagttgttaagtca

SEQ ID NO: 8458037 - DNA, 22 bp, Homo sapiens
gaattacaaagtgagacaagct

SEQ ID NO: 8458038 - DNA, 22 bp, Homo sapiens
gaattacaaagtgagacaagct

SEQ ID NO: 8458039 - DNA, 22 bp, Homo sapiens
gaattacataataaaatgagag

SEQ ID NO: 8458040 - DNA, 22 bp, Homo sapiens
gaattacataataaaatgagag

SEQ ID NO: 8458041 - DNA, 22 bp, Homo sapiens
gaattacataataaaatgagag

SEQ ID NO: 8458042 - DNA, 22 bp, Homo sapiens
gaattacatagtttctaggttc

SEQ ID NO: 8458043 - DNA, 22 bp, Homo sapiens
gaatgctgagtcttatctctta

SEQ ID NO: 8458044 - DNA, 22 bp, Homo sapiens
gaatggctgaatgtcttaaatt

SEQ ID NO: 8458045 - DNA, 22 bp, Homo sapiens
gaatgatttggttgtttagatt

SEQ ID NO: 8458046 - DNA, 22 bp, Homo sapiens
gaatgcagtgacggaggcttac

SEQ ID NO: 8458047 - DNA, 22 bp, Homo sapiens
gaatgcatgtgaagcaaagaat

SEQ ID NO: 8458048 - DNA, 22 bp, Homo sapiens
gaatgcatgtgaagcaaagaat

SEQ ID NO: 8458049 - DNA, 22 bp, Homo sapiens
gaatgctattatttctgtgtgt

SEQ ID NO: 8458050 - DNA, 22 bp, Homo sapiens
gaatgctaagcatgtgggagtt

SEQ ID NO: 8458051 - DNA, 22 bp, Homo sapiens
gaatgctaagcatgtgggagtt

SEQ ID NO: 8458052 - DNA, 22 bp, Homo sapiens
gaagaatatataatgattttgt

SEQ ID NO: 8458053 - DNA, 22 bp, Homo sapiens
gaagaatattcttgatcttaga

SEQ ID NO: 8458054 - DNA, 22 bp, Homo sapiens
gaagaatctgaggacagtcatt

SEQ ID NO: 8458055 - DNA, 22 bp, Homo sapiens
gacaaaagtgttttgaacaagg

SEQ ID NO: 8458056 - DNA, 22 bp, Homo sapiens
gacaaactgaagtatatttaga

SEQ ID NO: 8458057 - DNA, 18 bp, Homo sapiens
gacaaaagtacagacaga

SEQ ID NO: 8458058 - DNA, 22 bp, Homo sapiens
gacaaaactgagatcacactgt

SEQ ID NO: 8458059 - DNA, 22 bp, Homo sapiens
gacaaaagtgttttgaacaagg

SEQ ID NO: 8458060 - DNA, 18 bp, Homo sapiens
gacaaaagtacagacaga

SEQ ID NO: 8458061 - DNA, 22 bp, Homo sapiens
gaattttattactagtcaactg

SEQ ID NO: 8458062 - DNA, 22 bp, Homo sapiens
gaatttacaagttgaataacaa

SEQ ID NO: 8458063 - DNA, 22 bp, Homo sapiens
gaattttcaggtagcaatttca

SEQ ID NO: 8458064 - DNA, 22 bp, Homo sapiens
gacaaaacacattagtttaaaa

SEQ ID NO: 8458065 - DNA, 22 bp, Homo sapiens
gacaacaataatgtggagctga

SEQ ID NO: 8458066 - DNA, 22 bp, Homo sapiens
gacaaatgaatgatgaacacca

SEQ ID NO: 8458067 - DNA, 22 bp, Homo sapiens
gacagcagccacagggagaggg

SEQ ID NO: 8458068 - DNA, 22 bp, Homo sapiens
gacagcagccacagggagaggg

SEQ ID NO: 8458069 - DNA, 22 bp, Homo sapiens
gacagcagggaaagtccagacc

SEQ ID NO: 8458070 - DNA, 22 bp, Homo sapiens
gacagcagggaaagtccagacc

SEQ ID NO: 8458071 - DNA, 22 bp, Homo sapiens
gacagcagggaaagtccagacc

SEQ ID NO: 8458072 - DNA, 22 bp, Homo sapiens
gacagcagggacatgtaggaag

SEQ ID NO: 8458073 - DNA, 22 bp, Homo sapiens
gacagcaggatgtgaggggatg

SEQ ID NO: 8458074 - DNA, 22 bp, Homo sapiens
gacagcaggatgtgaggggatg

SEQ ID NO: 8458075 - DNA, 22 bp, Homo sapiens
gacatgggatgagatgaagcat

SEQ ID NO: 8458076 - DNA, 22 bp, Homo sapiens
gacatgctaattactggttcaa

SEQ ID NO: 8458077 - DNA, 22 bp, Homo sapiens
gacctgagattttgaggctcat

SEQ ID NO: 8458078 - DNA, 22 bp, Homo sapiens
gacctgagattttgaggctcat

SEQ ID NO: 8458079 - DNA, 22 bp, Homo sapiens
gacattaatggcaaattaatta

SEQ ID NO: 8458080 - DNA, 22 bp, Homo sapiens
gaccttagaacgtgacacaaga

SEQ ID NO: 8458081 - DNA, 22 bp, Homo sapiens
gaccttcagtgtgtttctcaca

SEQ ID NO: 8458082 - DNA, 22 bp, Homo sapiens
gacctgggtaaggggctgacaa

SEQ ID NO: 8458083 - DNA, 22 bp, Homo sapiens
gacctggcctgcacagccctta

SEQ ID NO: 8458084 - DNA, 22 bp, Homo sapiens
gacctggggtaagcttggcaac

SEQ ID NO: 8458085 - DNA, 22 bp, Homo sapiens
gacctggggtaagcttggcaac

SEQ ID NO: 8458086 - DNA, 22 bp, Homo sapiens
gacctggggtaagcttggcaac

SEQ ID NO: 8458087 - DNA, 22 bp, Homo sapiens
gactaggctctcatagaggtag

SEQ ID NO: 8458088 - DNA, 22 bp, Homo sapiens
gactactcaaactttctctata

SEQ ID NO: 8458089 - DNA, 22 bp, Homo sapiens
gaccttcttgctgtgtcctaac

SEQ ID NO: 8458090 - DNA, 17 bp, Homo sapiens
gacagctggttcctggc

SEQ ID NO: 8458091 - DNA, 22 bp, Homo sapiens
gacagctgtacactcctggtta

SEQ ID NO: 8458092 - DNA, 22 bp, Homo sapiens
gacagctggcagtggaaaggtg

SEQ ID NO: 8458093 - DNA, 17 bp, Homo sapiens
gacagctgggcgcacgc

SEQ ID NO: 8458094 - DNA, 19 bp, Homo sapiens
gacagtgcagttgtagtac

SEQ ID NO: 8458095 - DNA, 22 bp, Homo sapiens
gacagtctgggcacacatgaaa

SEQ ID NO: 8458096 - DNA, 22 bp, Homo sapiens
gacatatactatggatggttct

SEQ ID NO: 8458097 - DNA, 22 bp, Homo sapiens
gacatctggaggagatgaatgg

SEQ ID NO: 8458098 - DNA, 22 bp, Homo sapiens
gacatctgaggccctcagagcc

SEQ ID NO: 8458099 - DNA, 22 bp, Homo sapiens
gacatctccaaggcaacctgtt

SEQ ID NO: 8458100 - DNA, 22 bp, Homo sapiens
gacagcagggacatgtaggaag

SEQ ID NO: 8458101 - DNA, 22 bp, Homo sapiens
gacagcagggacatgtaggaag

SEQ ID NO: 8458102 - DNA, 22 bp, Homo sapiens
gacagcagggacatgtaggaag

SEQ ID NO: 8458103 - DNA, 22 bp, Homo sapiens
gacagcaggtgcttgggaaagg

SEQ ID NO: 8458104 - DNA, 22 bp, Homo sapiens
gacagcaggtgcttgggaaagg

SEQ ID NO: 8458105 - DNA, 22 bp, Homo sapiens
gacagcagtcctggagttccca

SEQ ID NO: 8458106 - DNA, 22 bp, Homo sapiens
gacagcagtcctggagttccca

SEQ ID NO: 8458107 - DNA, 22 bp, Homo sapiens
gacagcatccaagagggaggga

SEQ ID NO: 8458108 - DNA, 22 bp, Homo sapiens
gacagcagtttttctctagggt

SEQ ID NO: 8458109 - DNA, 22 bp, Homo sapiens
gacagcatggtgtctgttcagg

SEQ ID NO: 8458110 - DNA, 22 bp, Homo sapiens
gacagccatcagcacacgctgc

SEQ ID NO: 8458111 - DNA, 22 bp, Homo sapiens
gacagccatgcacttctgctgt

SEQ ID NO: 8458112 - DNA, 22 bp, Homo sapiens
gacagctccagctcctccaggc

SEQ ID NO: 8458113 - DNA, 22 bp, Homo sapiens
gacagctgcctctgtgtagatc

SEQ ID NO: 8458114 - DNA, 22 bp, Homo sapiens
gacagctgctcccgtttctgct

SEQ ID NO: 8458115 - DNA, 22 bp, Homo sapiens
gacagctgcatcctcagacaca

SEQ ID NO: 8458116 - DNA, 22 bp, Homo sapiens
gacagctgctcccgtttctgct

SEQ ID NO: 8458117 - DNA, 22 bp, Homo sapiens
gagcaagattttataagttgtg

SEQ ID NO: 8458118 - DNA, 22 bp, Homo sapiens
gagcaagactcactgcatcttg

SEQ ID NO: 8458119 - DNA, 22 bp, Homo sapiens
gagcaagactcactgcatcttg

SEQ ID NO: 8458120 - DNA, 22 bp, Homo sapiens
gagcaagactacaggcagatga

SEQ ID NO: 8458121 - DNA, 22 bp, Homo sapiens
gagcaagatcctgtttttctat

SEQ ID NO: 8458122 - DNA, 22 bp, Homo sapiens
gagcaagagtgttggactttga

SEQ ID NO: 8458123 - DNA, 22 bp, Homo sapiens
gagcaagattaaaaggctgggt

SEQ ID NO: 8458124 - DNA, 22 bp, Homo sapiens
gagcaagatcctgtttttctat

SEQ ID NO: 8458125 - DNA, 22 bp, Homo sapiens
gagcacagatcctggagccaca

SEQ ID NO: 8458126 - DNA, 22 bp, Homo sapiens
gagcacagatcctggagccaca

SEQ ID NO: 8458127 - DNA, 22 bp, Homo sapiens
gagcacagatcctggagccaca

SEQ ID NO: 8458128 - DNA, 22 bp, Homo sapiens
gagcacagatcctggagccaca

SEQ ID NO: 8458129 - DNA, 22 bp, Homo sapiens
gagcacagatcctggagccaca

SEQ ID NO: 8458130 - DNA, 22 bp, Homo sapiens
gagcacagaactaaatgctggt

SEQ ID NO: 8458131 - DNA, 22 bp, Homo sapiens
gagcacagaatcttcccatgca

SEQ ID NO: 8458132 - DNA, 22 bp, Homo sapiens
gagcacagaactaaatgctggt

SEQ ID NO: 8458133 - DNA, 22 bp, Homo sapiens
gagcacagaactaaatgctggt

SEQ ID NO: 8458134 - DNA, 22 bp, Homo sapiens
gagcaagaccctgggttctctc

SEQ ID NO: 8458135 - DNA, 19 bp, Homo sapiens
gagcaacatatgtaaactc

SEQ ID NO: 8458136 - DNA, 22 bp, Homo sapiens
gagcaaaataaattctgacaaa

SEQ ID NO: 8458137 - DNA, 22 bp, Homo sapiens
gagcaaaataaattctgacaaa

SEQ ID NO: 8458138 - DNA, 22 bp, Homo sapiens
gagcaaacatcagtgatgtctg

SEQ ID NO: 8458139 - DNA, 22 bp, Homo sapiens
gagaggcagaggcctgaaaccg

SEQ ID NO: 8458140 - DNA, 22 bp, Homo sapiens
gagatttattgacttaacagta

SEQ ID NO: 8458141 - DNA, 22 bp, Homo sapiens
gagcactgagctggaattggag

SEQ ID NO: 8458142 - DNA, 22 bp, Homo sapiens
gagcacgttgaagcgcactgtc

SEQ ID NO: 8458143 - DNA, 22 bp, Homo sapiens
gagcaccgcctccacgatgccc

SEQ ID NO: 8458144 - DNA, 22 bp, Homo sapiens
gagcactgaggaaagctggtta

SEQ ID NO: 8458145 - DNA, 20 bp, Homo sapiens
gagcacagtaatgactgcta

SEQ ID NO: 8458146 - DNA, 20 bp, Homo sapiens
gagcacagtaatgactgcta

SEQ ID NO: 8458147 - DNA, 22 bp, Homo sapiens
gagcacagtgcagtttctgcta

SEQ ID NO: 8458148 - DNA, 22 bp, Homo sapiens
gagcagagcttctcaaagtaaa

SEQ ID NO: 8458149 - DNA, 22 bp, Homo sapiens
gagcagagaatccagctaagtg

SEQ ID NO: 8458150 - DNA, 23 bp, Homo sapiens
gagcagagcgggcgggggtcctg

SEQ ID NO: 8458151 - DNA, 22 bp, Homo sapiens
gagcaggaaggccagaagggtc

SEQ ID NO: 8458152 - DNA, 22 bp, Homo sapiens
gagcaggaaggccagaagggtc

SEQ ID NO: 8458153 - DNA, 22 bp, Homo sapiens
gagagcaggctctcgggggcca

SEQ ID NO: 8458154 - DNA, 22 bp, Homo sapiens
gagagccagcagtaaagacatt

SEQ ID NO: 8458155 - DNA, 22 bp, Homo sapiens
gagagcaggaggcagcgggacg

SEQ ID NO: 8458156 - DNA, 22 bp, Homo sapiens
gagagcaggaggcagcgggacg

SEQ ID NO: 8458157 - DNA, 22 bp, Homo sapiens
gagagcaggaggcagcgggacg

SEQ ID NO: 8458158 - DNA, 18 bp, Homo sapiens
gagagcccagcaggtggt

SEQ ID NO: 8458159 - DNA, 23 bp, Homo sapiens
gagagcccattggcaggggtacc

SEQ ID NO: 8458160 - DNA, 22 bp, Homo sapiens
gagagccagctcactccagggc

SEQ ID NO: 8458161 - DNA, 22 bp, Homo sapiens
gagagccatggtggagatgggg

SEQ ID NO: 8458162 - DNA, 22 bp, Homo sapiens
gagagagaaggcctgtgggtgt

SEQ ID NO: 8458163 - DNA, 22 bp, Homo sapiens
gagagacagcacacagtgtggg

SEQ ID NO: 8458164 - DNA, 22 bp, Homo sapiens
gagagacagcacacagtgtggg

SEQ ID NO: 8458165 - DNA, 22 bp, Homo sapiens
gagagaatgtacatgctagggg

SEQ ID NO: 8458166 - DNA, 22 bp, Homo sapiens
gagagacagcagaacgtgcagc

SEQ ID NO: 8458167 - DNA, 22 bp, Homo sapiens
gagagacagcagaacgtgcagc

SEQ ID NO: 8458168 - DNA, 22 bp, Homo sapiens
gagagccctgcatggctgatga

SEQ ID NO: 8458169 - DNA, 22 bp, Homo sapiens
gagagccctcactccttccctg

SEQ ID NO: 8458170 - DNA, 22 bp, Homo sapiens
gagaggagtccctatcacagtt

SEQ ID NO: 8458171 - DNA, 18 bp, Homo sapiens
gagaggagccagaatttt

SEQ ID NO: 8458172 - DNA, 22 bp, Homo sapiens
gagaggaggtggctatgacagc

SEQ ID NO: 8458173 - DNA, 22 bp, Homo sapiens
gagaggaggtggctatgacagc

SEQ ID NO: 8458174 - DNA, 22 bp, Homo sapiens
gagaggaggtggctatgacagc

SEQ ID NO: 8458175 - DNA, 22 bp, Homo sapiens
gagaactgattagcatttgcca

SEQ ID NO: 8458176 - DNA, 22 bp, Homo sapiens
gagaacttcaggattattcaag

SEQ ID NO: 8458177 - DNA, 22 bp, Homo sapiens
gagaacctactgtatactatat

SEQ ID NO: 8458178 - DNA, 22 bp, Homo sapiens
gagaacttgaacttttcctctg

SEQ ID NO: 8458179 - DNA, 21 bp, Homo sapiens
gagaactgaaccagagcagct

SEQ ID NO: 8458180 - DNA, 21 bp, Homo sapiens
gagaactgaaccagagcagct

SEQ ID NO: 8458181 - DNA, 22 bp, Homo sapiens
gagaacctctccacaagtctgg

SEQ ID NO: 8458182 - DNA, 22 bp, Homo sapiens
gagaacctctccacaagtctgg

SEQ ID NO: 8458183 - DNA, 22 bp, Homo sapiens
gagaacctactgtatactatat

SEQ ID NO: 8458184 - DNA, 22 bp, Homo sapiens
gagaaagggaacttacagagtg

SEQ ID NO: 8458185 - DNA, 22 bp, Homo sapiens
gagaacaggctctggagtcaga

SEQ ID NO: 8458186 - DNA, 19 bp, Homo sapiens
gactccaactttaagcatg

SEQ ID NO: 8458187 - DNA, 22 bp, Homo sapiens
gagagaagaacaatgtcattca

SEQ ID NO: 8458188 - DNA, 22 bp, Homo sapiens
gagaagctctagaggtgttttt

SEQ ID NO: 8458189 - DNA, 22 bp, Homo sapiens
gagaagccgagtcagctgagcc

SEQ ID NO: 8458190 - DNA, 22 bp, Homo sapiens
gagagaagggggatatgagcct

SEQ ID NO: 8458191 - DNA, 22 bp, Homo sapiens
gagagaagaatgttccgaggcc

SEQ ID NO: 8458192 - DNA, 22 bp, Homo sapiens
gagagaagaatgttccgaggcc

SEQ ID NO: 8458193 - DNA, 22 bp, Homo sapiens
gagaagcaatcagtggccaccc

SEQ ID NO: 8458194 - DNA, 22 bp, Homo sapiens
tcccagagccaagctatggatg

SEQ ID NO: 8458195 - DNA, 22 bp, Homo sapiens
tcccagagcagtactccaggag

SEQ ID NO: 8458196 - DNA, 22 bp, Homo sapiens
tcccagaggcagttggtaactt

SEQ ID NO: 8458197 - DNA, 22 bp, Homo sapiens
tcccagaggctccagtctctat

SEQ ID NO: 8458198 - DNA, 22 bp, Homo sapiens
tcccagagtattagcaattgct

SEQ ID NO: 8458199 - DNA, 22 bp, Homo sapiens
tcccagagtattagcaattgct

SEQ ID NO: 8458200 - DNA, 22 bp, Homo sapiens
tcccagcataacaaactgcccg

SEQ ID NO: 8458201 - DNA, 22 bp, Homo sapiens
tcccagaggtctctgctggttc

SEQ ID NO: 8458202 - DNA, 22 bp, Homo sapiens
tcccagcccaggtatgatgata

SEQ ID NO: 8458203 - DNA, 22 bp, Homo sapiens
tcccagccggtgcctgggtccc

SEQ ID NO: 8458204 - DNA, 22 bp, Homo sapiens
tcccagcataacaaactgcccg

SEQ ID NO: 8458205 - DNA, 22 bp, Homo sapiens
tcccagcattaatgcctgtcag

SEQ ID NO: 8458206 - DNA, 22 bp, Homo sapiens
tcccagcctcctgacagttttg

SEQ ID NO: 8458207 - DNA, 22 bp, Homo sapiens
tcccagccggtgcctgggtccc

SEQ ID NO: 8458208 - DNA, 22 bp, Homo sapiens
tcccagccggtgcctgggtccc

SEQ ID NO: 8458209 - DNA, 22 bp, Homo sapiens
tcccagcctcctgacagttttg

SEQ ID NO: 8458210 - DNA, 22 bp, Homo sapiens
tcccagcctgacagtgcatcaa

SEQ ID NO: 8458211 - DNA, 22 bp, Homo sapiens
tcccagcctggaccctgccagt

SEQ ID NO: 8458212 - DNA, 22 bp, Homo sapiens
tcccagcctggaccctgccagt

SEQ ID NO: 8458213 - DNA, 22 bp, Homo sapiens
tcccagcctggaccctgccagt

SEQ ID NO: 8458214 - DNA, 22 bp, Homo sapiens
tcccagccttatctcccctggc

SEQ ID NO: 8458215 - DNA, 22 bp, Homo sapiens
tcccagccttatctcccctggc

SEQ ID NO: 8458216 - DNA, 22 bp, Homo sapiens
tcccagccttccagtctggttt

SEQ ID NO: 8458217 - DNA, 22 bp, Homo sapiens
tcccaggccataaaactcagag

SEQ ID NO: 8458218 - DNA, 16 bp, Homo sapiens
tcccaggccaggtgga

SEQ ID NO: 8458219 - DNA, 22 bp, Homo sapiens
tcccaggccacacttggggaac

SEQ ID NO: 8458220 - DNA, 22 bp, Homo sapiens
tcccaggcgcctggtggggagc

SEQ ID NO: 8458221 - DNA, 22 bp, Homo sapiens
tcccaggcaggtgacaggggga

SEQ ID NO: 8458222 - DNA, 22 bp, Homo sapiens
tcccaggccacacttggggaac

SEQ ID NO: 8458223 - DNA, 22 bp, Homo sapiens
tcccagcctttctttctccagc

SEQ ID NO: 8458224 - DNA, 22 bp, Homo sapiens
tcccagccttccttgtggtgaa

SEQ ID NO: 8458225 - DNA, 22 bp, Homo sapiens
tcccagccttccttgtggtgaa

SEQ ID NO: 8458226 - DNA, 22 bp, Homo sapiens
tcccagagacatcatttctccg

SEQ ID NO: 8458227 - DNA, 22 bp, Homo sapiens
tcccagagatttcctctccttc

SEQ ID NO: 8458228 - DNA, 22 bp, Homo sapiens
tcccagagacagagcctcctcc

SEQ ID NO: 8458229 - DNA, 22 bp, Homo sapiens
tcccagagcagatgtgctaaag

SEQ ID NO: 8458230 - DNA, 22 bp, Homo sapiens
tcccaaatataatgcaagagac

SEQ ID NO: 8458231 - DNA, 22 bp, Homo sapiens
tcccaaatataatgcaagagac

SEQ ID NO: 8458232 - DNA, 22 bp, Homo sapiens
tccatttactattctcatatcg

SEQ ID NO: 8458233 - DNA, 19 bp, Homo sapiens
tcccaagatttctgtatca

SEQ ID NO: 8458234 - DNA, 22 bp, Homo sapiens
tccattcttttgctgtcttcct

SEQ ID NO: 8458235 - DNA, 17 bp, Homo sapiens
tccattcctaaggccct

SEQ ID NO: 8458236 - DNA, 22 bp, Homo sapiens
tccatgggtagccctggttgag

SEQ ID NO: 8458237 - DNA, 22 bp, Homo sapiens
tccattatacttctgattcaaa

SEQ ID NO: 8458238 - DNA, 22 bp, Homo sapiens
tccaggtgagtgcaggtgcaga

SEQ ID NO: 8458239 - DNA, 22 bp, Homo sapiens
tccaggtcttcctattccaggt

SEQ ID NO: 8458240 - DNA, 22 bp, Homo sapiens
tccaggtctggttggacaggtt

SEQ ID NO: 8458241 - DNA, 23 bp, Homo sapiens
tccagtagggagtctgcttactt

SEQ ID NO: 8458242 - DNA, 19 bp, Homo sapiens
tccatgcccaggcaccaag

SEQ ID NO: 8458243 - DNA, 19 bp, Homo sapiens
tccatgcccaggcaccaag

SEQ ID NO: 8458244 - DNA, 18 bp, Homo sapiens
tccagggcttcctcctct

SEQ ID NO: 8458245 - DNA, 18 bp, Homo sapiens
tccagggcttcctcctct

SEQ ID NO: 8458246 - DNA, 19 bp, Homo sapiens
tccagggctttatggcttt

SEQ ID NO: 8458247 - DNA, 21 bp, Homo sapiens
tccagggctttgattctctca

SEQ ID NO: 8458248 - DNA, 21 bp, Homo sapiens
tccagggctttgattctctca

SEQ ID NO: 8458249 - DNA, 22 bp, Homo sapiens
tccaggtctggcctgctaggca

SEQ ID NO: 8458250 - DNA, 22 bp, Homo sapiens
tccaggtctggcctgctaggca

SEQ ID NO: 8458251 - DNA, 21 bp, Homo sapiens
tccagggaacttctcaggaat

SEQ ID NO: 8458252 - DNA, 23 bp, Homo sapiens
tccaggctgggacttcaactggc

SEQ ID NO: 8458253 - DNA, 23 bp, Homo sapiens
tccaggctgggacttcaactggc

SEQ ID NO: 8458254 - DNA, 22 bp, Homo sapiens
tccagggaagagcagaggctac

SEQ ID NO: 8458255 - DNA, 22 bp, Homo sapiens
tccagggaagagcagaggctac

SEQ ID NO: 8458256 - DNA, 22 bp, Homo sapiens
tccagggaaggtgtgaggctgg

SEQ ID NO: 8458257 - DNA, 22 bp, Homo sapiens
tccagggaaggtgtgaggctgg

SEQ ID NO: 8458258 - DNA, 22 bp, Homo sapiens
tccagggctgggttggctcagc

SEQ ID NO: 8458259 - DNA, 22 bp, Homo sapiens
tccagggctgggttggctcagc

SEQ ID NO: 8458260 - DNA, 18 bp, Homo sapiens
tccagggcttcctcctct

SEQ ID NO: 8458261 - DNA, 22 bp, Homo sapiens
tccaggctggagtgcagtggcg

SEQ ID NO: 8458262 - DNA, 22 bp, Homo sapiens
tccaggctggagtgcagtggcg

SEQ ID NO: 8458263 - DNA, 22 bp, Homo sapiens
tccaggctggagtgcagtggca

SEQ ID NO: 8458264 - DNA, 22 bp, Homo sapiens
tccaggctggagtgcagtggca

SEQ ID NO: 8458265 - DNA, 22 bp, Homo sapiens
tccaggctggacatgaggcggg

SEQ ID NO: 8458266 - DNA, 22 bp, Homo sapiens
tccaggctggctcttcaaaatt

SEQ ID NO: 8458267 - DNA, 22 bp, Homo sapiens
tccaggctggcctcgcgtgaca

SEQ ID NO: 8458268 - DNA, 18 bp, Homo sapiens
tccaggctggattgatga

SEQ ID NO: 8458269 - DNA, 21 bp, Homo sapiens
tccaggctggaaggggcgttg

SEQ ID NO: 8458270 - DNA, 22 bp, Homo sapiens
tccaggctggacatgaggcggg

SEQ ID NO: 8458271 - DNA, 22 bp, Homo sapiens
tccaggctagcctggtagagaa

SEQ ID NO: 8458272 - DNA, 22 bp, Homo sapiens
tccaggctagcctggtagagaa

SEQ ID NO: 8458273 - DNA, 22 bp, Homo sapiens
tccaggctagagtgcagtggcc

SEQ ID NO: 8458274 - DNA, 22 bp, Homo sapiens
tccaggctagagtgcagtggcc

SEQ ID NO: 8458275 - DNA, 22 bp, Homo sapiens
tccaggctagaagtcacaggcc

SEQ ID NO: 8458276 - DNA, 22 bp, Homo sapiens
tccaggctacttggattcctgg

SEQ ID NO: 8458277 - DNA, 22 bp, Homo sapiens
tccaggcctctagccctctctt

SEQ ID NO: 8458278 - DNA, 22 bp, Homo sapiens
tccaggcctctagccctctctt

SEQ ID NO: 8458279 - DNA, 22 bp, Homo sapiens
tccaggcctctagcccctatct

SEQ ID NO: 8458280 - DNA, 22 bp, Homo sapiens
tccaggcctctagcccctatct

SEQ ID NO: 8458281 - DNA, 22 bp, Homo sapiens
tccaggcctgactataaatgta

SEQ ID NO: 8458282 - DNA, 22 bp, Homo sapiens
tccaggcctgactataaatgta

SEQ ID NO: 8458283 - DNA, 22 bp, Homo sapiens
tccaggcctgcaatgacaaagc

SEQ ID NO: 8458284 - DNA, 22 bp, Homo sapiens
tccaggcctgcaatgacaaagc

SEQ ID NO: 8458285 - DNA, 22 bp, Homo sapiens
tccaggcctgactataaatgta

SEQ ID NO: 8458286 - DNA, 22 bp, Homo sapiens
tccaggcctgcaatgacaaagc

SEQ ID NO: 8458287 - DNA, 22 bp, Homo sapiens
tccaggcctgcctggtgtttgc

SEQ ID NO: 8458288 - DNA, 18 bp, Homo sapiens
tccaggcctgaagtgtcc

SEQ ID NO: 8458289 - DNA, 22 bp, Homo sapiens
tccaggcctttgcacatgttgt

SEQ ID NO: 8458290 - DNA, 22 bp, Homo sapiens
tccaggcctttgcacatgttgt

SEQ ID NO: 8458291 - DNA, 20 bp, Homo sapiens
tccaggccttgttctcagat

SEQ ID NO: 8458292 - DNA, 22 bp, Homo sapiens
tccaggctacttggattcctgg

SEQ ID NO: 8458293 - DNA, 22 bp, Homo sapiens
tccaggctaattttgcattgtt

SEQ ID NO: 8458294 - DNA, 22 bp, Homo sapiens
tccaggctaattttgcattgtt

SEQ ID NO: 8458295 - DNA, 22 bp, Homo sapiens
tccaggctaattttgcattgtt

SEQ ID NO: 8458296 - DNA, 22 bp, Homo sapiens
tccaggccttgacaggtcagtt

SEQ ID NO: 8458297 - DNA, 22 bp, Homo sapiens
tccaggccttgacaggtcagtt

SEQ ID NO: 8458298 - DNA, 22 bp, Homo sapiens
tccaggccttgacaggtcagtt

SEQ ID NO: 8458299 - DNA, 20 bp, Homo sapiens
tccaggccttgttctcagat

SEQ ID NO: 8458300 - DNA, 22 bp, Homo sapiens
tccaggcctggctccattcagt

SEQ ID NO: 8458301 - DNA, 22 bp, Homo sapiens
tccaggcctggctccattcagt

SEQ ID NO: 8458302 - DNA, 22 bp, Homo sapiens
tccctgagagcactggggagcc

SEQ ID NO: 8458303 - DNA, 22 bp, Homo sapiens
tccctgagagcactggggagcc

SEQ ID NO: 8458304 - DNA, 22 bp, Homo sapiens
tccctgagaaagcccaggaggt

SEQ ID NO: 8458305 - DNA, 22 bp, Homo sapiens
tccctgagactctggagtgtaa

SEQ ID NO: 8458306 - DNA, 22 bp, Homo sapiens
tccctgccctgccttcatggtt

SEQ ID NO: 8458307 - DNA, 22 bp, Homo sapiens
tccctgcctcctggcagtgcca

SEQ ID NO: 8458308 - DNA, 22 bp, Homo sapiens
tccctgcctcctggcagtgcca

SEQ ID NO: 8458309 - DNA, 22 bp, Homo sapiens
tccctgaaacatctctgtggat

SEQ ID NO: 8458310 - DNA, 20 bp, Homo sapiens
tccctcctgcagatagagaa

SEQ ID NO: 8458311 - DNA, 19 bp, Homo sapiens
tccctccctgtaatctcac

SEQ ID NO: 8458312 - DNA, 20 bp, Homo sapiens
tccctccctccagctctggg

SEQ ID NO: 8458313 - DNA, 19 bp, Homo sapiens
tccctcagtctgccaggcc

SEQ ID NO: 8458314 - DNA, 19 bp, Homo sapiens
tccctcagtctgccaggcc

SEQ ID NO: 8458315 - DNA, 20 bp, Homo sapiens
tccctcagtttccagccctg

SEQ ID NO: 8458316 - DNA, 20 bp, Homo sapiens
tccctcagtttccagccctg

SEQ ID NO: 8458317 - DNA, 22 bp, Homo sapiens
tccctcatctcacatgtgtgtg

SEQ ID NO: 8458318 - DNA, 22 bp, Homo sapiens
tccctccccacttctgagcttt

SEQ ID NO: 8458319 - DNA, 22 bp, Homo sapiens
tccctccccacttctgagcttt

SEQ ID NO: 8458320 - DNA, 23 bp, Homo sapiens
tccctcaggccttatctccatct

SEQ ID NO: 8458321 - DNA, 22 bp, Homo sapiens
tccctcagggtgcagttgcttt

SEQ ID NO: 8458322 - DNA, 20 bp, Homo sapiens
tccctcaggtcattgggctg

SEQ ID NO: 8458323 - DNA, 22 bp, Homo sapiens
tccctcagtccctggacaggca

SEQ ID NO: 8458324 - DNA, 20 bp, Homo sapiens
tccctcagtcctggctttgt

SEQ ID NO: 8458325 - DNA, 22 bp, Homo sapiens
tccctcaggtggttcttgtttc

SEQ ID NO: 8458326 - DNA, 22 bp, Homo sapiens
tccctcagtccctggacaggca

SEQ ID NO: 8458327 - DNA, 22 bp, Homo sapiens
tccctcagcttgtctccatgca

SEQ ID NO: 8458328 - DNA, 22 bp, Homo sapiens
tccctcaggacccaacttgtaa

SEQ ID NO: 8458329 - DNA, 22 bp, Homo sapiens
tccctcagcttgtctccatgca

SEQ ID NO: 8458330 - DNA, 22 bp, Homo sapiens
tccctcagctcatatttatgcc

SEQ ID NO: 8458331 - DNA, 20 bp, Homo sapiens
tcccaggctgggctccagct

SEQ ID NO: 8458332 - DNA, 20 bp, Homo sapiens
tcccaggctgggctccagct

SEQ ID NO: 8458333 - DNA, 20 bp, Homo sapiens
tcccaggctgggctccagct

SEQ ID NO: 8458334 - DNA, 22 bp, Homo sapiens
tcccaggctggggccaggtgac

SEQ ID NO: 8458335 - DNA, 22 bp, Homo sapiens
tcccaggctgggggcctgaagt

SEQ ID NO: 8458336 - DNA, 23 bp, Homo sapiens
tcccagggaaggtgagcgaggct

SEQ ID NO: 8458337 - DNA, 22 bp, Homo sapiens
tcccagggacaccaagctgttt

SEQ ID NO: 8458338 - DNA, 22 bp, Homo sapiens
tcccaggctaggcctctgcgtt

SEQ ID NO: 8458339 - DNA, 22 bp, Homo sapiens
tcccaggctaccagtgaggtca

SEQ ID NO: 8458340 - DNA, 22 bp, Homo sapiens
tcccaggctaggcctctgcgtt

SEQ ID NO: 8458341 - DNA, 22 bp, Homo sapiens
tcccaggctaggcctctgcgtt

SEQ ID NO: 8458342 - DNA, 22 bp, Homo sapiens
tcccaggctggcaggcagcagt

SEQ ID NO: 8458343 - DNA, 20 bp, Homo sapiens
tcccaggctccaccctagac

SEQ ID NO: 8458344 - DNA, 22 bp, Homo sapiens
tcccaggctcttcaaggaagac

SEQ ID NO: 8458345 - DNA, 20 bp, Homo sapiens
tcccaggctccaccctagac

SEQ ID NO: 8458346 - DNA, 20 bp, Homo sapiens
tcccaggctccaccctagac

SEQ ID NO: 8458347 - DNA, 15 bp, Homo sapiens
tccctcagctaaaga

SEQ ID NO: 8458348 - DNA, 22 bp, Homo sapiens
tccctcagcaggaatgtggcag

SEQ ID NO: 8458349 - DNA, 22 bp, Homo sapiens
tccctcagcaggaactggcctg

SEQ ID NO: 8458350 - DNA, 20 bp, Homo sapiens
tccctcagcacttctacctc

SEQ ID NO: 8458351 - DNA, 22 bp, Homo sapiens
tccctcagattggcaattagat

SEQ ID NO: 8458352 - DNA, 22 bp, Homo sapiens
tccctcagatgagctcctagca

SEQ ID NO: 8458353 - DNA, 22 bp, Homo sapiens
tccctcagacagatgtgttcct

SEQ ID NO: 8458354 - DNA, 22 bp, Homo sapiens
tccctcagagggcaagcgcaga

SEQ ID NO: 8458355 - DNA, 22 bp, Homo sapiens
tccctcagagaccgtggtgcag

SEQ ID NO: 8458356 - DNA, 21 bp, Homo sapiens
tccctcagacagggtgcctat

SEQ ID NO: 8458357 - DNA, 22 bp, Homo sapiens
tccctcagagggcaagcgcaga

SEQ ID NO: 8458358 - DNA, 22 bp, Homo sapiens
tccctcagatgagctcctagca

SEQ ID NO: 8458359 - DNA, 21 bp, Homo sapiens
tccctcagaaggtagccaagc

SEQ ID NO: 8458360 - DNA, 18 bp, Homo sapiens
tccctcagaattatagaa

SEQ ID NO: 8458361 - DNA, 22 bp, Homo sapiens
tcccgcatgccgccggtgaaca

SEQ ID NO: 8458362 - DNA, 22 bp, Homo sapiens
tcccagggactctctgccttcc

SEQ ID NO: 8458363 - DNA, 22 bp, Homo sapiens
tcccagggacaccaagctgttt

SEQ ID NO: 8458364 - DNA, 22 bp, Homo sapiens
tcccagggacccagcctgatac

SEQ ID NO: 8458365 - DNA, 22 bp, Homo sapiens
tcctagttctctgccagtcgct

SEQ ID NO: 8458366 - DNA, 22 bp, Homo sapiens
tcctagtaagcggctttctggg

SEQ ID NO: 8458367 - DNA, 22 bp, Homo sapiens
tcctcacagctggttcattcag

SEQ ID NO: 8458368 - DNA, 20 bp, Homo sapiens
tcctcagaagacatttgggg

SEQ ID NO: 8458369 - DNA, 22 bp, Homo sapiens
tcctcagaagaacccctagatt

SEQ ID NO: 8458370 - DNA, 22 bp, Homo sapiens
tcctcagaatggatggcagggg

SEQ ID NO: 8458371 - DNA, 22 bp, Homo sapiens
tcctcagaatccaaactgcagt

SEQ ID NO: 8458372 - DNA, 22 bp, Homo sapiens
tcctcagaatcacctggcagct

SEQ ID NO: 8458373 - DNA, 22 bp, Homo sapiens
tcctcagaatcacctggcagct

SEQ ID NO: 8458374 - DNA, 22 bp, Homo sapiens
tcctcagaaacccctgtgaggt

SEQ ID NO: 8458375 - DNA, 22 bp, Homo sapiens
tcctcacagggcaggaaggagg

SEQ ID NO: 8458376 - DNA, 23 bp, Homo sapiens
tcctcagcatgttttgtcatgta

SEQ ID NO: 8458377 - DNA, 22 bp, Homo sapiens
tcctcagcaaacacttcactct

SEQ ID NO: 8458378 - DNA, 22 bp, Homo sapiens
tcctcagatgctcttggacgcc

SEQ ID NO: 8458379 - DNA, 22 bp, Homo sapiens
tcctcagagcatagcgctgtct

SEQ ID NO: 8458380 - DNA, 22 bp, Homo sapiens
tcctcagagcagccctccgcat

SEQ ID NO: 8458381 - DNA, 22 bp, Homo sapiens
tcctcagatacctggcagatca

SEQ ID NO: 8458382 - DNA, 22 bp, Homo sapiens
tcctcagatataaatgagggtg

SEQ ID NO: 8458383 - DNA, 22 bp, Homo sapiens
tcctcagacaccctgctggctt

SEQ ID NO: 8458384 - DNA, 22 bp, Homo sapiens
tcctcagagatgggcatctaag

SEQ ID NO: 8458385 - DNA, 22 bp, Homo sapiens
tcctcagagatgggcatctaag

SEQ ID NO: 8458386 - DNA, 22 bp, Homo sapiens
tcctcagacttccctttgtgta

SEQ ID NO: 8458387 - DNA, 21 bp, Homo sapiens
tcctcagggccccagagcact

SEQ ID NO: 8458388 - DNA, 21 bp, Homo sapiens
tcctcagggccccagagcact

SEQ ID NO: 8458389 - DNA, 22 bp, Homo sapiens
tcctcagcattagcacagacat

SEQ ID NO: 8458390 - DNA, 22 bp, Homo sapiens
tcctagaatctttgtaagattg

SEQ ID NO: 8458391 - DNA, 22 bp, Homo sapiens
tcctagaatagtgtgtctggag

SEQ ID NO: 8458392 - DNA, 22 bp, Homo sapiens
tcctagaatagtgtgtctggag

SEQ ID NO: 8458393 - DNA, 22 bp, Homo sapiens
tcctagaataagtaacaggaca

SEQ ID NO: 8458394 - DNA, 22 bp, Homo sapiens
tcctagaataatctttgactgc

SEQ ID NO: 8458395 - DNA, 22 bp, Homo sapiens
tcctagaataatctttgactgc

SEQ ID NO: 8458396 - DNA, 19 bp, Homo sapiens
tcctagaatgagggtgttg

SEQ ID NO: 8458397 - DNA, 22 bp, Homo sapiens
tcctagaatctttgtaagattg

SEQ ID NO: 8458398 - DNA, 22 bp, Homo sapiens
tcctagaatgcacctctgctgt

SEQ ID NO: 8458399 - DNA, 22 bp, Homo sapiens
tcctagaggatggtaggaagct

SEQ ID NO: 8458400 - DNA, 22 bp, Homo sapiens
tcctaggcagttggtgctccat

SEQ ID NO: 8458401 - DNA, 22 bp, Homo sapiens
tcctaggcagttggtgctccat

SEQ ID NO: 8458402 - DNA, 22 bp, Homo sapiens
tcctaggcccagcctgagctgt

SEQ ID NO: 8458403 - DNA, 22 bp, Homo sapiens
tcctaggcccagcctgagctgt

SEQ ID NO: 8458404 - DNA, 22 bp, Homo sapiens
tcctaggcccagcctgagctgt

SEQ ID NO: 8458405 - DNA, 22 bp, Homo sapiens
tcctaggcctggcctggtggat

SEQ ID NO: 8458406 - DNA, 22 bp, Homo sapiens
tcctagggattcaacactgaac

SEQ ID NO: 8458407 - DNA, 22 bp, Homo sapiens
tcctagggttggagacagtgac

SEQ ID NO: 8458408 - DNA, 22 bp, Homo sapiens
tccctgggacggccttttggag

SEQ ID NO: 8458409 - DNA, 22 bp, Homo sapiens
tccctgggactcagacatggaa

SEQ ID NO: 8458410 - DNA, 22 bp, Homo sapiens
tccctgggactcagacatggaa

SEQ ID NO: 8458411 - DNA, 22 bp, Homo sapiens
tccctgggagatgatgatgagg

SEQ ID NO: 8458412 - DNA, 15 bp, Homo sapiens
tccctgggagatggt

SEQ ID NO: 8458413 - DNA, 16 bp, Homo sapiens
tccctgggagtggtgg

SEQ ID NO: 8458414 - DNA, 22 bp, Homo sapiens
tcctaaaggctgcttttatatt

SEQ ID NO: 8458415 - DNA, 18 bp, Homo sapiens
tccctgggatataattac

SEQ ID NO: 8458416 - DNA, 22 bp, Homo sapiens
tccctggcacaagaaggctgtc

SEQ ID NO: 8458417 - DNA, 22 bp, Homo sapiens
tccctggcacaagaaggctgtc

SEQ ID NO: 8458418 - DNA, 22 bp, Homo sapiens
tccctgcctctcagacttcctt

SEQ ID NO: 8458419 - DNA, 23 bp, Homo sapiens
tccctggccgcaatggccgcctt

SEQ ID NO: 8458420 - DNA, 22 bp, Homo sapiens
tccctggccattcctctaggcc

SEQ ID NO: 8458421 - DNA, 22 bp, Homo sapiens
tccctggccattcctctaggcc

SEQ ID NO: 8458422 - DNA, 22 bp, Homo sapiens
tccctggctgggggctgccttg

SEQ ID NO: 8458423 - DNA, 22 bp, Homo sapiens
tccctggcctggaaggatatca

SEQ ID NO: 8458424 - DNA, 22 bp, Homo sapiens
tccctgggaccggcagctcaca

SEQ ID NO: 8458425 - DNA, 22 bp, Homo sapiens
tccctgggaattaatatttgga

SEQ ID NO: 8458426 - DNA, 22 bp, Homo sapiens
tccctgggaacaaaggatgaga

SEQ ID NO: 8458427 - DNA, 22 bp, Homo sapiens
tccctgggaacaaaggatgaga

SEQ ID NO: 8458428 - DNA, 22 bp, Homo sapiens
tccctgggaaatgtcagtttca

SEQ ID NO: 8458429 - DNA, 22 bp, Homo sapiens
tcctgagcttcagtttcttcat

SEQ ID NO: 8458430 - DNA, 22 bp, Homo sapiens
tcctgagctgccgcatcagcag

SEQ ID NO: 8458431 - DNA, 22 bp, Homo sapiens
tcctgagctttacagtaaggac

SEQ ID NO: 8458432 - DNA, 22 bp, Homo sapiens
tcctgaggaaagttcatgaatg

SEQ ID NO: 8458433 - DNA, 22 bp, Homo sapiens
tcctgagctgacacttggggag

SEQ ID NO: 8458434 - DNA, 22 bp, Homo sapiens
tcctgagctcccatgaacaggc

SEQ ID NO: 8458435 - DNA, 22 bp, Homo sapiens
tcctgaggaatgtgaagagaac

SEQ ID NO: 8458436 - DNA, 22 bp, Homo sapiens
tcctgaggactaacaggaagga

SEQ ID NO: 8458437 - DNA, 22 bp, Homo sapiens
tcctgaggactaacaggaagga

SEQ ID NO: 8458438 - DNA, 22 bp, Homo sapiens
tcctgaggctcactttgaatgt

SEQ ID NO: 8458439 - DNA, 22 bp, Homo sapiens
tcctgagtgagagctgggaggt

SEQ ID NO: 8458440 - DNA, 22 bp, Homo sapiens
tcctgaggtggattgagcagag

SEQ ID NO: 8458441 - DNA, 22 bp, Homo sapiens
tcctgaggctaaagtgcagtgg

SEQ ID NO: 8458442 - DNA, 22 bp, Homo sapiens
tcctgaggctaaagtgcagtgg

SEQ ID NO: 8458443 - DNA, 22 bp, Homo sapiens
tcctgagtggttgttttcttcc

SEQ ID NO: 8458444 - DNA, 22 bp, Homo sapiens
tcctgaggaccctgtcaggggc

SEQ ID NO: 8458445 - DNA, 22 bp, Homo sapiens
tcctgaggagaagagtgctagg

SEQ ID NO: 8458446 - DNA, 22 bp, Homo sapiens
tcctgaggatggttgaagtgca

SEQ ID NO: 8458447 - DNA, 22 bp, Homo sapiens
tcctgaggcctctgtgatgtga

SEQ ID NO: 8458448 - DNA, 22 bp, Homo sapiens
tcctgaggccctgttagggtct

SEQ ID NO: 8458449 - DNA, 22 bp, Homo sapiens
tcctgagatgtggagctccatg

SEQ ID NO: 8458450 - DNA, 22 bp, Homo sapiens
tcctgagattctgcatttctaa

SEQ ID NO: 8458451 - DNA, 20 bp, Homo sapiens
tcctgagatttaaggggttc

SEQ ID NO: 8458452 - DNA, 22 bp, Homo sapiens
tcctgagcacctatgccatggc

SEQ ID NO: 8458453 - DNA, 22 bp, Homo sapiens
tcctgagccctggggtcagtgt

SEQ ID NO: 8458454 - DNA, 22 bp, Homo sapiens
tcctgagcacctatgccatggc

SEQ ID NO: 8458455 - DNA, 20 bp, Homo sapiens
tcctgagcctccaccatgtc

SEQ ID NO: 8458456 - DNA, 22 bp, Homo sapiens
tcctgagccctgtaggaccctg

SEQ ID NO: 8458457 - DNA, 20 bp, Homo sapiens
tcctgagcctccaccatgtc

SEQ ID NO: 8458458 - DNA, 22 bp, Homo sapiens
tcctgagccctgtaggaccctg

SEQ ID NO: 8458459 - DNA, 22 bp, Homo sapiens
tcctgagataaatctcatgtga

SEQ ID NO: 8458460 - DNA, 22 bp, Homo sapiens
tcctgagagccttggcttcaga

SEQ ID NO: 8458461 - DNA, 22 bp, Homo sapiens
tcctgagaggtgtgaggtgcag

SEQ ID NO: 8458462 - DNA, 22 bp, Homo sapiens
tcctgagagtcaagaatgcagg

SEQ ID NO: 8458463 - DNA, 23 bp, Homo sapiens
tcctgagatgagacagtgctgcc

SEQ ID NO: 8458464 - DNA, 22 bp, Homo sapiens
tcctgagatgagacagtgctgc

SEQ ID NO: 8458465 - DNA, 22 bp, Homo sapiens
tcctctttctcaacattagtta

SEQ ID NO: 8458466 - DNA, 22 bp, Homo sapiens
tcctctgggctccctgcaacag

SEQ ID NO: 8458467 - DNA, 22 bp, Homo sapiens
tcctctgggctccctgcaacag

SEQ ID NO: 8458468 - DNA, 22 bp, Homo sapiens
tcctctggggcgtggtcctgga

SEQ ID NO: 8458469 - DNA, 22 bp, Homo sapiens
tcctctggggcgtggtcctgga

SEQ ID NO: 8458470 - DNA, 19 bp, Homo sapiens
tcctctggtaccacccttg

SEQ ID NO: 8458471 - DNA, 22 bp, Homo sapiens
tcctgagacatctctgctggtc

SEQ ID NO: 8458472 - DNA, 22 bp, Homo sapiens
tcctgagagcagagtccaggtg

SEQ ID NO: 8458473 - DNA, 22 bp, Homo sapiens
tcctgagaatagagttgcatgt

SEQ ID NO: 8458474 - DNA, 22 bp, Homo sapiens
tcctgaagatgaaaagagaggt

SEQ ID NO: 8458475 - DNA, 22 bp, Homo sapiens
tcctgaagaacgaagtcatgta

SEQ ID NO: 8458476 - DNA, 22 bp, Homo sapiens
tcctgcaggggctgaggaacca

SEQ ID NO: 8458477 - DNA, 19 bp, Homo sapiens
tcctgcaggtggcttgcag

SEQ ID NO: 8458478 - DNA, 20 bp, Homo sapiens
tcctgcagtcgctagcgccc

SEQ ID NO: 8458479 - DNA, 20 bp, Homo sapiens
tcctgcagtcgctagcgccc

SEQ ID NO: 8458480 - DNA, 21 bp, Homo sapiens
tcctgcaggaggcctgagagg

SEQ ID NO: 8458481 - DNA, 22 bp, Homo sapiens
tcctgcaggccagaggggtgag

SEQ ID NO: 8458482 - DNA, 22 bp, Homo sapiens
tcctgcagccttgggctggagc

SEQ ID NO: 8458483 - DNA, 22 bp, Homo sapiens
tcctgcagctgaagctcatgtg

SEQ ID NO: 8458484 - DNA, 22 bp, Homo sapiens
tcctgcagctgcagacctgggg

SEQ ID NO: 8458485 - DNA, 22 bp, Homo sapiens
tcctgatgatattgctctttct

SEQ ID NO: 8458486 - DNA, 22 bp, Homo sapiens
tcctgcacattagtatttttta

SEQ ID NO: 8458487 - DNA, 21 bp, Homo sapiens
tcctgcagaatgccttcctac

SEQ ID NO: 8458488 - DNA, 19 bp, Homo sapiens
tcctgcagaccagacctgt

SEQ ID NO: 8458489 - DNA, 22 bp, Homo sapiens
tcctgcagacatttacaccttt

SEQ ID NO: 8458490 - DNA, 22 bp, Homo sapiens
tcctgcagagacagaggcctca

SEQ ID NO: 8458491 - DNA, 22 bp, Homo sapiens
tcctgcagacctcagtcaggtc

SEQ ID NO: 8458492 - DNA, 23 bp, Homo sapiens
tcctgcagataagctggttgaca

SEQ ID NO: 8458493 - DNA, 22 bp, Homo sapiens
tcctgcagagccgccctcaggt

SEQ ID NO: 8458494 - DNA, 22 bp, Homo sapiens
tcctgcagccactgcaggcaga

SEQ ID NO: 8458495 - DNA, 22 bp, Homo sapiens
tcctgcagcatccgtcgtctgt

SEQ ID NO: 8458496 - DNA, 22 bp, Homo sapiens
tcctgcagccactgcaggcaga

SEQ ID NO: 8458497 - DNA, 22 bp, Homo sapiens
tcctgcagccactgcaggcaga

SEQ ID NO: 8458498 - DNA, 22 bp, Homo sapiens
tcctgcctaccttgcggaggtg

SEQ ID NO: 8458499 - DNA, 22 bp, Homo sapiens
tcctgcctcaggctctggagta

SEQ ID NO: 8458500 - DNA, 22 bp, Homo sapiens
tcctgcctgcaatcccagcact

SEQ ID NO: 8458501 - DNA, 22 bp, Homo sapiens
tcaagaaggagactccactgtg

SEQ ID NO: 8458502 - DNA, 22 bp, Homo sapiens
tcaagaactgtgaagagtctga

SEQ ID NO: 8458503 - DNA, 22 bp, Homo sapiens
tcaactaactctattatttgaa

SEQ ID NO: 8458504 - DNA, 22 bp, Homo sapiens
tcaactaaggcacaatctctaa

SEQ ID NO: 8458505 - DNA, 22 bp, Homo sapiens
tcaactaaggcacaatctctaa

SEQ ID NO: 8458506 - DNA, 22 bp, Homo sapiens
tcaactggttcttgaatgtata

SEQ ID NO: 8458507 - DNA, 20 bp, Homo sapiens
tcaacctactgtgctcaagt

SEQ ID NO: 8458508 - DNA, 22 bp, Homo sapiens
tcaagaaactgtgctacagagt

SEQ ID NO: 8458509 - DNA, 22 bp, Homo sapiens
tcaacagttctgtccaattaat

SEQ ID NO: 8458510 - DNA, 22 bp, Homo sapiens
tcaacagttgcactggagaggt

SEQ ID NO: 8458511 - DNA, 19 bp, Homo sapiens
tcaacagtggtgctgtgga

SEQ ID NO: 8458512 - DNA, 22 bp, Homo sapiens
tcaacagtggcaaagaggcacg

SEQ ID NO: 8458513 - DNA, 22 bp, Homo sapiens
tcaacagttgcactggagaggt

SEQ ID NO: 8458514 - DNA, 22 bp, Homo sapiens
tcaaatgaggctgatgaatgtg

SEQ ID NO: 8458515 - DNA, 22 bp, Homo sapiens
tcaaatgcacctctcatttgtt

SEQ ID NO: 8458516 - DNA, 19 bp, Homo sapiens
tcaaatgccaatgtcacag

SEQ ID NO: 8458517 - DNA, 22 bp, Homo sapiens
tcaacactaaagaataatcttt

SEQ ID NO: 8458518 - DNA, 22 bp, Homo sapiens
tcaacacaacagagaaatgctg

SEQ ID NO: 8458519 - DNA, 22 bp, Homo sapiens
tcaacaccacaatttcttaact

SEQ ID NO: 8458520 - DNA, 22 bp, Homo sapiens
tcaacaattgcatgttgatgtt

SEQ ID NO: 8458521 - DNA, 22 bp, Homo sapiens
tcaacaataggatatagcaggt

SEQ ID NO: 8458522 - DNA, 22 bp, Homo sapiens
tcaacaatgggtctgtaatgga

SEQ ID NO: 8458523 - DNA, 22 bp, Homo sapiens
tcacagtgtgaaggtcagtcac

SEQ ID NO: 8458524 - DNA, 22 bp, Homo sapiens
tcacagtgtcgtccttgggtgt

SEQ ID NO: 8458525 - DNA, 22 bp, Homo sapiens
tcacagtgaggagttacagttt

SEQ ID NO: 8458526 - DNA, 22 bp, Homo sapiens
tcacagtgataactaagtcctg

SEQ ID NO: 8458527 - DNA, 22 bp, Homo sapiens
tcacagtgatgacgtgggagca

SEQ ID NO: 8458528 - DNA, 22 bp, Homo sapiens
tcacagtgatgacgtgggagca

SEQ ID NO: 8458529 - DNA, 22 bp, Homo sapiens
tcacagtgcaccagtgtgaagc

SEQ ID NO: 8458530 - DNA, 22 bp, Homo sapiens
tcacagtgggacttttatcgct

SEQ ID NO: 8458531 - DNA, 22 bp, Homo sapiens
tcacagtgcaggatcagttaat

SEQ ID NO: 8458532 - DNA, 22 bp, Homo sapiens
tcagaaaataactgttagtttg

SEQ ID NO: 8458533 - DNA, 22 bp, Homo sapiens
tcagaaaataactgttagtttg

SEQ ID NO: 8458534 - DNA, 22 bp, Homo sapiens
tcactgctctgaaagtacaggg

SEQ ID NO: 8458535 - DNA, 22 bp, Homo sapiens
tcacatttgcaattgcattgtt

SEQ ID NO: 8458536 - DNA, 22 bp, Homo sapiens
tcagaacaggttgtactatgtc

SEQ ID NO: 8458537 - DNA, 22 bp, Homo sapiens
tcagaacagcagggtgtggctg

SEQ ID NO: 8458538 - DNA, 22 bp, Homo sapiens
tcagaacagctctcagatatcc

SEQ ID NO: 8458539 - DNA, 22 bp, Homo sapiens
tcagaagttaatacgaggagaa

SEQ ID NO: 8458540 - DNA, 22 bp, Homo sapiens
tcagaagttaatacgaggagaa

SEQ ID NO: 8458541 - DNA, 22 bp, Homo sapiens
tcagaagttgaaggctcttttt

SEQ ID NO: 8458542 - DNA, 20 bp, Homo sapiens
tcagaacagtagaggagcta

SEQ ID NO: 8458543 - DNA, 20 bp, Homo sapiens
tcagaagtttcctggagcat

SEQ ID NO: 8458544 - DNA, 23 bp, Homo sapiens
tcagaagtttggttgtaacatgg

SEQ ID NO: 8458545 - DNA, 22 bp, Homo sapiens
tcagaagttgagatattcaggg

SEQ ID NO: 8458546 - DNA, 22 bp, Homo sapiens
tcagaagttgataaagtagttg

SEQ ID NO: 8458547 - DNA, 22 bp, Homo sapiens
tcagaagtttcaatcccagctg

SEQ ID NO: 8458548 - DNA, 22 bp, Homo sapiens
tcagaagtttcaatcccagctg

SEQ ID NO: 8458549 - DNA, 22 bp, Homo sapiens
tcagaatatgctaatgacattt

SEQ ID NO: 8458550 - DNA, 22 bp, Homo sapiens
tcagaatatattcatgttgtca

SEQ ID NO: 8458551 - DNA, 23 bp, Homo sapiens
tcagaataataacctagtaactg

SEQ ID NO: 8458552 - DNA, 22 bp, Homo sapiens
tcagaataaacatgggcatggg

SEQ ID NO: 8458553 - DNA, 22 bp, Homo sapiens
tcagaataagttatgaaatgaa

SEQ ID NO: 8458554 - DNA, 22 bp, Homo sapiens
tcagaatctgcatttaacaaaa

SEQ ID NO: 8458555 - DNA, 21 bp, Homo sapiens
tcagaatctgtgagctatctc

SEQ ID NO: 8458556 - DNA, 22 bp, Homo sapiens
tcagaatctgaaaagcgcttgg

SEQ ID NO: 8458557 - DNA, 22 bp, Homo sapiens
tcagaatctctggaggcttggc

SEQ ID NO: 8458558 - DNA, 22 bp, Homo sapiens
tcagaatggcccataaatagtc

SEQ ID NO: 8458559 - DNA, 22 bp, Homo sapiens
tcagaatctttctagagtctag

SEQ ID NO: 8458560 - DNA, 22 bp, Homo sapiens
tcagaaagacgaaacagatggg

SEQ ID NO: 8458561 - DNA, 22 bp, Homo sapiens
tcagaaaggagttagaggtctc

SEQ ID NO: 8458562 - DNA, 22 bp, Homo sapiens
tcagaaaggccacatggtgcag

SEQ ID NO: 8458563 - DNA, 22 bp, Homo sapiens
tcagaaagcttttacttaaaca

SEQ ID NO: 8458564 - DNA, 22 bp, Homo sapiens
tcagaacaattgggaaccatta

SEQ ID NO: 8458565 - DNA, 22 bp, Homo sapiens
tcagaacagaagctggctataa

SEQ ID NO: 8458566 - DNA, 22 bp, Homo sapiens
tcagaacagaagaaggaacacg

SEQ ID NO: 8458567 - DNA, 22 bp, Homo sapiens
tcagctggaagatggtgcagaa

SEQ ID NO: 8458568 - DNA, 22 bp, Homo sapiens
tcagctggaagatggtgcagaa

SEQ ID NO: 8458569 - DNA, 22 bp, Homo sapiens
tcagctggagatccttgttgtg

SEQ ID NO: 8458570 - DNA, 18 bp, Homo sapiens
tcagctggggctgcagcc

SEQ ID NO: 8458571 - DNA, 18 bp, Homo sapiens
tcagctggggctgcagcc

SEQ ID NO: 8458572 - DNA, 22 bp, Homo sapiens
tcagctggcaggttctgggaag

SEQ ID NO: 8458573 - DNA, 22 bp, Homo sapiens
tcagctggcatcggctcaccca

SEQ ID NO: 8458574 - DNA, 18 bp, Homo sapiens
tcagctggggctgcagcc

SEQ ID NO: 8458575 - DNA, 22 bp, Homo sapiens
tcagctgggtgagtgttctgca

SEQ ID NO: 8458576 - DNA, 18 bp, Homo sapiens
tcagctgggtttctgggt

SEQ ID NO: 8458577 - DNA, 22 bp, Homo sapiens
tcagctggtgagtggatagaca

SEQ ID NO: 8458578 - DNA, 22 bp, Homo sapiens
tcagctggtgtttcttctcctt

SEQ ID NO: 8458579 - DNA, 22 bp, Homo sapiens
tcaggaagggtggtccacaggg

SEQ ID NO: 8458580 - DNA, 22 bp, Homo sapiens
tcaggaagggtggtccacaggg

SEQ ID NO: 8458581 - DNA, 22 bp, Homo sapiens
tcaggaagggctcagtctgtgc

SEQ ID NO: 8458582 - DNA, 22 bp, Homo sapiens
tcaggaagggtggtccacaggg

SEQ ID NO: 8458583 - DNA, 22 bp, Homo sapiens
tcaggaagtataatcagattca

SEQ ID NO: 8458584 - DNA, 22 bp, Homo sapiens
tcaggagactggcagtgcccac

SEQ ID NO: 8458585 - DNA, 18 bp, Homo sapiens
tcaggagacacagacgca

SEQ ID NO: 8458586 - DNA, 22 bp, Homo sapiens
tcaggagaatcagggctgtcct

SEQ ID NO: 8458587 - DNA, 19 bp, Homo sapiens
tcaggactgacttgaagtc

SEQ ID NO: 8458588 - DNA, 22 bp, Homo sapiens
tcaggacttcattacctcaggt

SEQ ID NO: 8458589 - DNA, 22 bp, Homo sapiens
tcaggacagttccctgcaaatt

SEQ ID NO: 8458590 - DNA, 22 bp, Homo sapiens
tcaggacagttccctgcaaatt

SEQ ID NO: 8458591 - DNA, 22 bp, Homo sapiens
tcaggacagactagactagcgt

SEQ ID NO: 8458592 - DNA, 22 bp, Homo sapiens
tcaggacaccctgtgcttcctt

SEQ ID NO: 8458593 - DNA, 22 bp, Homo sapiens
tcaggacaacatgttgctaatc

SEQ ID NO: 8458594 - DNA, 22 bp, Homo sapiens
tcaggacacttggcacaaggtc

SEQ ID NO: 8458595 - DNA, 22 bp, Homo sapiens
tcaggacagaaggctgccaggg

SEQ ID NO: 8458596 - DNA, 22 bp, Homo sapiens
tcaggacagactagactagcgt

SEQ ID NO: 8458597 - DNA, 22 bp, Homo sapiens
tcagcatgttcttaggtcacag

SEQ ID NO: 8458598 - DNA, 22 bp, Homo sapiens
tcagccacttccctctggtcag

SEQ ID NO: 8458599 - DNA, 22 bp, Homo sapiens
tcagccaagcagccatcatctg

SEQ ID NO: 8458600 - DNA, 22 bp, Homo sapiens
tcagcatttcagaagtggcata

SEQ ID NO: 8458601 - DNA, 22 bp, Homo sapiens
tcagctctgcactccactgtgg

SEQ ID NO: 8458602 - DNA, 22 bp, Homo sapiens
tcagccagccagctacaggctt

SEQ ID NO: 8458603 - DNA, 19 bp, Homo sapiens
tcagctctggggtcagtgg

SEQ ID NO: 8458604 - DNA, 22 bp, Homo sapiens
tcagcaggcaggaggcatgcca

SEQ ID NO: 8458605 - DNA, 22 bp, Homo sapiens
tcagcaggcagaaatctgcaga

SEQ ID NO: 8458606 - DNA, 21 bp, Homo sapiens
tcagcaaaataagcaaatgga

SEQ ID NO: 8458607 - DNA, 22 bp, Homo sapiens
tcagcaaacattgattggactt

SEQ ID NO: 8458608 - DNA, 22 bp, Homo sapiens
tcagcaggcggttccttgtggg

SEQ ID NO: 8458609 - DNA, 22 bp, Homo sapiens
tcagcaggctctggttgaccat

SEQ ID NO: 8458610 - DNA, 22 bp, Homo sapiens
tcagcaggctctggttgaccat

SEQ ID NO: 8458611 - DNA, 22 bp, Homo sapiens
tcagcaggctgtcagcaggggc

SEQ ID NO: 8458612 - DNA, 22 bp, Homo sapiens
tcagcaggctgtcagcaggggc

SEQ ID NO: 8458613 - DNA, 22 bp, Homo sapiens
tcagcaggctgtcagcaggggc

SEQ ID NO: 8458614 - DNA, 22 bp, Homo sapiens
tcagcaggcaggaggcatgcca

SEQ ID NO: 8458615 - DNA, 22 bp, Homo sapiens
tcagcaggcaggaggcatgcca

SEQ ID NO: 8458616 - DNA, 22 bp, Homo sapiens
tcagcaggcaggaggcatgcca

SEQ ID NO: 8458617 - DNA, 22 bp, Homo sapiens
tcagcaggcagtgggtcacaat

SEQ ID NO: 8458618 - DNA, 22 bp, Homo sapiens
tcagcaggcccatcctccaggc

SEQ ID NO: 8458619 - DNA, 22 bp, Homo sapiens
tcagcaggcccatcctccaggc

SEQ ID NO: 8458620 - DNA, 22 bp, Homo sapiens
tcagcagggaggctctgtgccc

SEQ ID NO: 8458621 - DNA, 22 bp, Homo sapiens
tcagcagggagaggagaatgca

SEQ ID NO: 8458622 - DNA, 22 bp, Homo sapiens
tcagcagggagaggagaatgca

SEQ ID NO: 8458623 - DNA, 22 bp, Homo sapiens
tcagcagggcatactgagccta

SEQ ID NO: 8458624 - DNA, 22 bp, Homo sapiens
tcagcagggcatactgagccta

SEQ ID NO: 8458625 - DNA, 22 bp, Homo sapiens
tcagcagggccatgctctctct

SEQ ID NO: 8458626 - DNA, 22 bp, Homo sapiens
tcagcagggccatgctctctct

SEQ ID NO: 8458627 - DNA, 22 bp, Homo sapiens
tcagcagggcctccttgtgcag

SEQ ID NO: 8458628 - DNA, 17 bp, Homo sapiens
tcagcaggggccaagct

SEQ ID NO: 8458629 - DNA, 17 bp, Homo sapiens
tcagcaggggccaagct

SEQ ID NO: 8458630 - DNA, 22 bp, Homo sapiens
tcagcaggggccgttgggtgga

SEQ ID NO: 8458631 - DNA, 22 bp, Homo sapiens
tcagcaggggccgttgggtgga

SEQ ID NO: 8458632 - DNA, 22 bp, Homo sapiens
tcagcagggctgggagctgtga

SEQ ID NO: 8458633 - DNA, 22 bp, Homo sapiens
tcagcagggctgggagctgtga

SEQ ID NO: 8458634 - DNA, 22 bp, Homo sapiens
tcagcagggctgtggtgtggct

SEQ ID NO: 8458635 - DNA, 21 bp, Homo sapiens
tcagagtgtgttacagcaagc

SEQ ID NO: 8458636 - DNA, 22 bp, Homo sapiens
tcagagtgttttactaaacaag

SEQ ID NO: 8458637 - DNA, 22 bp, Homo sapiens
tcagacacagatgagacaagga

SEQ ID NO: 8458638 - DNA, 22 bp, Homo sapiens
tcagattttattttcctgttac

SEQ ID NO: 8458639 - DNA, 22 bp, Homo sapiens
tcagatggcataggttggaatt

SEQ ID NO: 8458640 - DNA, 22 bp, Homo sapiens
tcagatggatttatactatttc

SEQ ID NO: 8458641 - DNA, 22 bp, Homo sapiens
tcagatggaaaggttactgtcc

SEQ ID NO: 8458642 - DNA, 22 bp, Homo sapiens
tcagatggaatgatgccactgc

SEQ ID NO: 8458643 - DNA, 22 bp, Homo sapiens
tcagatggattcattacatgac

SEQ ID NO: 8458644 - DNA, 22 bp, Homo sapiens
tcagatggaggcaatgttacct

SEQ ID NO: 8458645 - DNA, 22 bp, Homo sapiens
tcagatgctagggctgagctat

SEQ ID NO: 8458646 - DNA, 22 bp, Homo sapiens
tccaaatattcggtctttctga

SEQ ID NO: 8458647 - DNA, 22 bp, Homo sapiens
tccaaatattcatctacttctg

SEQ ID NO: 8458648 - DNA, 22 bp, Homo sapiens
tccaaatgagctctgccttcca

SEQ ID NO: 8458649 - DNA, 22 bp, Homo sapiens
tccaaattctatgttctttcca

SEQ ID NO: 8458650 - DNA, 22 bp, Homo sapiens
tccaagctgtatgttcctagag

SEQ ID NO: 8458651 - DNA, 22 bp, Homo sapiens
tccaagctctctatgccatgat

SEQ ID NO: 8458652 - DNA, 22 bp, Homo sapiens
tccaatgttcctgctttcagct

SEQ ID NO: 8458653 - DNA, 22 bp, Homo sapiens
tccaatatttctcacatatgga

SEQ ID NO: 8458654 - DNA, 22 bp, Homo sapiens
tccaatatttctcatatatgga

SEQ ID NO: 8458655 - DNA, 22 bp, Homo sapiens
tccaatatttctcatatatgga

SEQ ID NO: 8458656 - DNA, 22 bp, Homo sapiens
tccaatattcattaaaatgcag

SEQ ID NO: 8458657 - DNA, 22 bp, Homo sapiens
tccaataaccacaatcagatag

SEQ ID NO: 8458658 - DNA, 22 bp, Homo sapiens
tccaaggctccggccctggcgt

SEQ ID NO: 8458659 - DNA, 22 bp, Homo sapiens
tccaagtcttccttcccaaacc

SEQ ID NO: 8458660 - DNA, 22 bp, Homo sapiens
tccaagtcttccttcccaaacc

SEQ ID NO: 8458661 - DNA, 22 bp, Homo sapiens
tccaaagtaatttcacttctgt

SEQ ID NO: 8458662 - DNA, 22 bp, Homo sapiens
tccaaagtaatttcacttctgt

SEQ ID NO: 8458663 - DNA, 18 bp, Homo sapiens
tccaaagctgctggtttt

SEQ ID NO: 8458664 - DNA, 22 bp, Homo sapiens
tccaaatatacagaatctcctc

SEQ ID NO: 8458665 - DNA, 22 bp, Homo sapiens
tccaaatatagatgagttgtaa

SEQ ID NO: 8458666 - DNA, 23 bp, Homo sapiens
tccaaatacctgtcaccttgtct

SEQ ID NO: 8458667 - DNA, 22 bp, Homo sapiens
tccaaagccccatgcactttct

SEQ ID NO: 8458668 - DNA, 18 bp, Homo sapiens
tccaaagccagagaagtt

SEQ ID NO: 8458669 - DNA, 22 bp, Homo sapiens
tccaaagccgactgacatctga

SEQ ID NO: 8458670 - DNA, 22 bp, Homo sapiens
tccaaacgggagccaaatgagc

SEQ ID NO: 8458671 - DNA, 18 bp, Homo sapiens
tccaaaatcatgtatttt

SEQ ID NO: 8458672 - DNA, 22 bp, Homo sapiens
tccaaaaaacgtttgaatagtt

SEQ ID NO: 8458673 - DNA, 22 bp, Homo sapiens
tcatttgtgtgagtgatttgac

SEQ ID NO: 8458674 - DNA, 22 bp, Homo sapiens
tcatttttagcgcgcaaaagtt

SEQ ID NO: 8458675 - DNA, 21 bp, Homo sapiens
tcatttttattgctaccttgc

SEQ ID NO: 8458676 - DNA, 22 bp, Homo sapiens
tccaaaacagaactctgtgaat

SEQ ID NO: 8458677 - DNA, 22 bp, Homo sapiens
tccaaaaaacgtttgaatagtt

SEQ ID NO: 8458678 - DNA, 22 bp, Homo sapiens
tcattttttgcatacctgtgtc

SEQ ID NO: 8458679 - DNA, 22 bp, Homo sapiens
tcatttttttccggtaggaata

SEQ ID NO: 8458680 - DNA, 22 bp, Homo sapiens
tcatttttctcttacacgtaga

SEQ ID NO: 8458681 - DNA, 22 bp, Homo sapiens
tcatttctgagccttccatgat

SEQ ID NO: 8458682 - DNA, 22 bp, Homo sapiens
tcatttctctgagtctgataat

SEQ ID NO: 8458683 - DNA, 22 bp, Homo sapiens
tcatttggagccttcctgtttt

SEQ ID NO: 8458684 - DNA, 22 bp, Homo sapiens
tcatttctccgacctgctgtcc

SEQ ID NO: 8458685 - DNA, 21 bp, Homo sapiens
tcatttctctatgtatttcac

SEQ ID NO: 8458686 - DNA, 23 bp, Homo sapiens
tcatttcatccagccttgagagt

SEQ ID NO: 8458687 - DNA, 17 bp, Homo sapiens
tcatttcagtaaatcca

SEQ ID NO: 8458688 - DNA, 22 bp, Homo sapiens
tcatttccctcctacaaagagg

SEQ ID NO: 8458689 - DNA, 22 bp, Homo sapiens
tcatttcaatgatactactaag

SEQ ID NO: 8458690 - DNA, 22 bp, Homo sapiens
tcatttatattgtattctgtag

SEQ ID NO: 8458691 - DNA, 22 bp, Homo sapiens
tcatgcatctgggctggctggt

SEQ ID NO: 8458692 - DNA, 22 bp, Homo sapiens
tcatgcatatttgtagtagttc

SEQ ID NO: 8458693 - DNA, 22 bp, Homo sapiens
tcattgtaattatctgtggtat

SEQ ID NO: 8458694 - DNA, 22 bp, Homo sapiens
tcattgtaattatctgtggtat

SEQ ID NO: 8458695 - DNA, 22 bp, Homo sapiens
tcatttataaggatgcaattaa

SEQ ID NO: 8458696 - DNA, 22 bp, Homo sapiens
tcatttacatagaaacaatata

SEQ ID NO: 8458697 - DNA, 22 bp, Homo sapiens
tcattgttgcgttaatgtcttc

SEQ ID NO: 8458698 - DNA, 22 bp, Homo sapiens
tcatttaataatttttgagtag

SEQ ID NO: 8458699 - DNA, 22 bp, Homo sapiens
tcatttacacttcacaaatgga

SEQ ID NO: 8458700 - DNA, 22 bp, Homo sapiens
tcatttacacttcacaaatgga

SEQ ID NO: 8458701 - DNA, 22 bp, Homo sapiens
tcagttaatggtaagggtgaaa

SEQ ID NO: 8458702 - DNA, 23 bp, Homo sapiens
tcataaatattagcacagtagga

SEQ ID NO: 8458703 - DNA, 22 bp, Homo sapiens
tcataaatagttgtgcctgaat

SEQ ID NO: 8458704 - DNA, 22 bp, Homo sapiens
tcagttaacaactatttattga

SEQ ID NO: 8458705 - DNA, 22 bp, Homo sapiens
tcagttaacggaaaggggtgtg

SEQ ID NO: 8458706 - DNA, 22 bp, Homo sapiens
tcagttaagactgcactggact

SEQ ID NO: 8458707 - DNA, 23 bp, Homo sapiens
tcagttaactgtgttacctgtgc

SEQ ID NO: 8458708 - DNA, 22 bp, Homo sapiens
tcagttaacaactatttattga

SEQ ID NO: 8458709 - DNA, 22 bp, Homo sapiens
tcagtgtttttaaagcaatata

SEQ ID NO: 8458710 - DNA, 20 bp, Homo sapiens
tcagttaagttgctgaatct

SEQ ID NO: 8458711 - DNA, 22 bp, Homo sapiens
tcagttaagcactataccctaa

SEQ ID NO: 8458712 - DNA, 22 bp, Homo sapiens
tcagttaagaggccacggcagt

SEQ ID NO: 8458713 - DNA, 22 bp, Homo sapiens
tcagttaatcaatgtggtctaa

SEQ ID NO: 8458714 - DNA, 22 bp, Homo sapiens
tcagttaatatgggtaaagcat

SEQ ID NO: 8458715 - DNA, 22 bp, Homo sapiens
tcagttaatggattctgtcaga

SEQ ID NO: 8458716 - DNA, 22 bp, Homo sapiens
tcagtgtttgtggcaaatgtta

SEQ ID NO: 8458717 - DNA, 22 bp, Homo sapiens
tcagtgtttcctgtggtacagc

SEQ ID NO: 8458718 - DNA, 22 bp, Homo sapiens
tcagtgtttcctagagcatata

SEQ ID NO: 8458719 - DNA, 22 bp, Homo sapiens
tcagtctatccagctcagatcc

SEQ ID NO: 8458720 - DNA, 22 bp, Homo sapiens
tcagtattcctggaaatacaag

SEQ ID NO: 8458721 - DNA, 22 bp, Homo sapiens
tcatgcagaggaaggctagttt

SEQ ID NO: 8458722 - DNA, 22 bp, Homo sapiens
tcatctttgtatccctaacaca

SEQ ID NO: 8458723 - DNA, 22 bp, Homo sapiens
tcatctttcctcaaaagatcca

SEQ ID NO: 8458724 - DNA, 22 bp, Homo sapiens
tcatctttcctcaaaagatcca

SEQ ID NO: 8458725 - DNA, 22 bp, Homo sapiens
tcatctttaccccttgcttcaa

SEQ ID NO: 8458726 - DNA, 22 bp, Homo sapiens
tcatctgaggtttgaggcagtt

SEQ ID NO: 8458727 - DNA, 23 bp, Homo sapiens
tcatctgtaagtatctgtggagt

SEQ ID NO: 8458728 - DNA, 22 bp, Homo sapiens
tcatctgtcatccacaaagctg

SEQ ID NO: 8458729 - DNA, 22 bp, Homo sapiens
tcatctgtctgttcaacagcct

SEQ ID NO: 8458730 - DNA, 22 bp, Homo sapiens
tcatctgaggcaccagagcata

SEQ ID NO: 8458731 - DNA, 22 bp, Homo sapiens
tcatctgtgcaggactcagaag

SEQ ID NO: 8458732 - DNA, 22 bp, Homo sapiens
tcatctgttatgggagtttttg

SEQ ID NO: 8458733 - DNA, 22 bp, Homo sapiens
tcatctgtggctgcttttgtgc

SEQ ID NO: 8458734 - DNA, 22 bp, Homo sapiens
tcatctgttcatacacatgcgt

SEQ ID NO: 8458735 - DNA, 22 bp, Homo sapiens
tcatcttgcagtgtgtgttctg

SEQ ID NO: 8458736 - DNA, 22 bp, Homo sapiens
tcatagaaatatcacgtctttt

SEQ ID NO: 8458737 - DNA, 22 bp, Homo sapiens
tcatagaaatggaaagtatatt

SEQ ID NO: 8458738 - DNA, 22 bp, Homo sapiens
tcatagaagcaccagaagatat

SEQ ID NO: 8458739 - DNA, 22 bp, Homo sapiens
tcatagaatgagttaatgaact

SEQ ID NO: 8458740 - DNA, 22 bp, Homo sapiens
tcatctgaacatgcagcctgtg

SEQ ID NO: 8458741 - DNA, 22 bp, Homo sapiens
tcatctgaagattgctgttcaa

SEQ ID NO: 8458742 - DNA, 22 bp, Homo sapiens
tcataaattagctgtctttgaa

SEQ ID NO: 8458743 - DNA, 22 bp, Homo sapiens
tcataaatgcagtgtcataaat

SEQ ID NO: 8458744 - DNA, 22 bp, Homo sapiens
tcagggctcagcatctggcatt

SEQ ID NO: 8458745 - DNA, 23 bp, Homo sapiens
tcagggctcacacgttttctggc

SEQ ID NO: 8458746 - DNA, 22 bp, Homo sapiens
tcagggctccggaagtggcctc

SEQ ID NO: 8458747 - DNA, 22 bp, Homo sapiens
tcagggctcagtgggataggtc

SEQ ID NO: 8458748 - DNA, 22 bp, Homo sapiens
tcagggctgactgctactctcc

SEQ ID NO: 8458749 - DNA, 22 bp, Homo sapiens
tcagggctgcagaagaggcagg

SEQ ID NO: 8458750 - DNA, 22 bp, Homo sapiens
tcagggctgcatacaggagata

SEQ ID NO: 8458751 - DNA, 22 bp, Homo sapiens
tcagggctgcagaagaggcagg

SEQ ID NO: 8458752 - DNA, 22 bp, Homo sapiens
tcagggctgcatacaggagata

SEQ ID NO: 8458753 - DNA, 22 bp, Homo sapiens
tcagggctgcatacaggagata

SEQ ID NO: 8458754 - DNA, 21 bp, Homo sapiens
tcagtaaaaaaactacctaga

SEQ ID NO: 8458755 - DNA, 22 bp, Homo sapiens
tcagtaaaacctgcttttagtg

SEQ ID NO: 8458756 - DNA, 22 bp, Homo sapiens
tcagtaaaataaaacatgggac

SEQ ID NO: 8458757 - DNA, 22 bp, Homo sapiens
tcagtaaaagggtgctttactc

SEQ ID NO: 8458758 - DNA, 22 bp, Homo sapiens
tcagggccctggacaaccctcc

SEQ ID NO: 8458759 - DNA, 22 bp, Homo sapiens
tcagtatcaggctggaattaag

SEQ ID NO: 8458760 - DNA, 23 bp, Homo sapiens
tcagtaccacagctgcatgacct

SEQ ID NO: 8458761 - DNA, 22 bp, Homo sapiens
tcagtagcagaaagcaatgagt

SEQ ID NO: 8458762 - DNA, 22 bp, Homo sapiens
tcagtaaatgcttgcaggccga

SEQ ID NO: 8458763 - DNA, 22 bp, Homo sapiens
tcagtaaatgcctttctgtgaa

SEQ ID NO: 8458764 - DNA, 22 bp, Homo sapiens
tcagtaaatgagcaaaaatttc

SEQ ID NO: 8458765 - DNA, 22 bp, Homo sapiens
tcagtaaatgaatgaatatatg

SEQ ID NO: 8458766 - DNA, 22 bp, Homo sapiens
tcagtaaccctgctgttcagag

SEQ ID NO: 8458767 - DNA, 23 bp, Homo sapiens
tcagtaaatggtaaagtctcttc

SEQ ID NO: 8458768 - DNA, 22 bp, Homo sapiens
tcagtaaatggttgctgttatt

SEQ ID NO: 8458769 - DNA, 22 bp, Homo sapiens
tcagtaaaggggaggtgatggg

SEQ ID NO: 8458770 - DNA, 22 bp, Homo sapiens
tcagtaaaggctaggttatgct

SEQ ID NO: 8458771 - DNA, 21 bp, Homo sapiens
tcagtaaacctaaagattgta

SEQ ID NO: 8458772 - DNA, 22 bp, Homo sapiens
tcagtaaacaggtttaagtcct

SEQ ID NO: 8458773 - DNA, 22 bp, Homo sapiens
tcagtaaaattacagatctaca

SEQ ID NO: 8458774 - DNA, 22 bp, Homo sapiens
tcagtaaagttctttcttgctg

SEQ ID NO: 8458775 - DNA, 22 bp, Homo sapiens
tcagtaaagtctctagagggta

SEQ ID NO: 8458776 - DNA, 22 bp, Homo sapiens
tcagtaaataactcagatgctc

SEQ ID NO: 8458777 - DNA, 22 bp, Homo sapiens
tcagtaaataactcagatgctc

SEQ ID NO: 8458778 - DNA, 22 bp, Homo sapiens
tcagtaaataactcagatgctc

SEQ ID NO: 8458779 - DNA, 22 bp, Homo sapiens
tcagtaaatctctaattggcat

SEQ ID NO: 8458780 - DNA, 22 bp, Homo sapiens
tcaggctttgggtcaggctctg

SEQ ID NO: 8458781 - DNA, 22 bp, Homo sapiens
tcaggctttgggtcaggctctg

SEQ ID NO: 8458782 - DNA, 22 bp, Homo sapiens
tcaggctttgggaatgccactt

SEQ ID NO: 8458783 - DNA, 18 bp, Homo sapiens
tcaggctttgagagaatc

SEQ ID NO: 8458784 - DNA, 22 bp, Homo sapiens
tcaggcttttcttccctcagtg

SEQ ID NO: 8458785 - DNA, 22 bp, Homo sapiens
tcaggcttttcctgcctcctac

SEQ ID NO: 8458786 - DNA, 22 bp, Homo sapiens
tcaggcttttcctgcctcctac

SEQ ID NO: 8458787 - DNA, 22 bp, Homo sapiens
tcaggcttccaggctctgctga

SEQ ID NO: 8458788 - DNA, 22 bp, Homo sapiens
tcaggcttccaggctctgctga

SEQ ID NO: 8458789 - DNA, 22 bp, Homo sapiens
tcaggcttgaggtctgtatgtg

SEQ ID NO: 8458790 - DNA, 22 bp, Homo sapiens
tcaggcttgcgatggaagtcac

SEQ ID NO: 8458791 - DNA, 22 bp, Homo sapiens
tcaggcttgaggtctgtatgtg

SEQ ID NO: 8458792 - DNA, 22 bp, Homo sapiens
tcaggctttgaagtctagctgg

SEQ ID NO: 8458793 - DNA, 22 bp, Homo sapiens
tcaggctttgaagtctagctgg

SEQ ID NO: 8458794 - DNA, 22 bp, Homo sapiens
tcaggcttgtctctagagcaat

SEQ ID NO: 8458795 - DNA, 22 bp, Homo sapiens
tcaggcttgggaggcccagggc

SEQ ID NO: 8458796 - DNA, 22 bp, Homo sapiens
tcaggcttggtgctccagtgcc

SEQ ID NO: 8458797 - DNA, 22 bp, Homo sapiens
tcaggctgtatatcttgcactc

SEQ ID NO: 8458798 - DNA, 22 bp, Homo sapiens
tcaggctgtagggcccctggag

SEQ ID NO: 8458799 - DNA, 22 bp, Homo sapiens
tcaggctgttcctgtccaaaat

SEQ ID NO: 8458800 - DNA, 22 bp, Homo sapiens
tcaggcttcactcctgtccaag

SEQ ID NO: 8458801 - DNA, 22 bp, Homo sapiens
tcaggctgttcctgtccaaaat

SEQ ID NO: 8458802 - DNA, 20 bp, Homo sapiens
tcaggctggtgggctttccc

SEQ ID NO: 8458803 - DNA, 20 bp, Homo sapiens
tcaggctggtgggctttccc

SEQ ID NO: 8458804 - DNA, 22 bp, Homo sapiens
tcaggctggtccccacagtgga

SEQ ID NO: 8458805 - DNA, 17 bp, Homo sapiens
tcaggctgggtgcagtg

SEQ ID NO: 8458806 - DNA, 22 bp, Homo sapiens
tcaggctggtccccacagtgga

SEQ ID NO: 8458807 - DNA, 22 bp, Homo sapiens
tcaggctggtggtcagatggct

SEQ ID NO: 8458808 - DNA, 22 bp, Homo sapiens
tcaggctggtggtcagatggct

SEQ ID NO: 8458809 - DNA, 22 bp, Homo sapiens
tcaggctgtaaatggtgtgggt

SEQ ID NO: 8458810 - DNA, 22 bp, Homo sapiens
tcaggctgtaaatggtgtgggt

SEQ ID NO: 8458811 - DNA, 22 bp, Homo sapiens
tcaggctgtagggcccctggag

SEQ ID NO: 8458812 - DNA, 22 bp, Homo sapiens
tcaggagacttatgtcacagtg

SEQ ID NO: 8458813 - DNA, 17 bp, Homo sapiens
tcaggctgggtgcagtg

SEQ ID NO: 8458814 - DNA, 17 bp, Homo sapiens
tcaggctgggtgcagtg

SEQ ID NO: 8458815 - DNA, 22 bp, Homo sapiens
tagcaaaggatgactatgtacc

SEQ ID NO: 8458816 - DNA, 22 bp, Homo sapiens
tagcaagaagctgtcacaggtg

SEQ ID NO: 8458817 - DNA, 22 bp, Homo sapiens
tagcaagaaaacacaagaatta

SEQ ID NO: 8458818 - DNA, 22 bp, Homo sapiens
tagcaactgctctattctagga

SEQ ID NO: 8458819 - DNA, 22 bp, Homo sapiens
tagcaacatggttatcacatta

SEQ ID NO: 8458820 - DNA, 22 bp, Homo sapiens
tagcaacctatggatagagaag

SEQ ID NO: 8458821 - DNA, 22 bp, Homo sapiens
tagcaaccagaacagcactcta

SEQ ID NO: 8458822 - DNA, 22 bp, Homo sapiens
tagcaacataagaaacattttg

SEQ ID NO: 8458823 - DNA, 22 bp, Homo sapiens
tagcaacataagaaacattttg

SEQ ID NO: 8458824 - DNA, 22 bp, Homo sapiens
tagcaacaagtgactatctata

SEQ ID NO: 8458825 - DNA, 22 bp, Homo sapiens
tagatgaacagaaagccactgt

SEQ ID NO: 8458826 - DNA, 22 bp, Homo sapiens
tagatgaagcaacatgtgtaat

SEQ ID NO: 8458827 - DNA, 22 bp, Homo sapiens
tagatgaaggctgagcacctgt

SEQ ID NO: 8458828 - DNA, 22 bp, Homo sapiens
tagatctgatacaattcatctg

SEQ ID NO: 8458829 - DNA, 22 bp, Homo sapiens
tagatctgatacaattcatctg

SEQ ID NO: 8458830 - DNA, 22 bp, Homo sapiens
tagatcctgcataggttgtgct

SEQ ID NO: 8458831 - DNA, 20 bp, Homo sapiens
tagatcctggggatttattg

SEQ ID NO: 8458832 - DNA, 23 bp, Homo sapiens
tagatccttccaactactcttac

SEQ ID NO: 8458833 - DNA, 22 bp, Homo sapiens
tagatcctgagccctatctact

SEQ ID NO: 8458834 - DNA, 23 bp, Homo sapiens
tagatcctatggctgtgtgcaga

SEQ ID NO: 8458835 - DNA, 22 bp, Homo sapiens
tagatctgatacaattcatctg

SEQ ID NO: 8458836 - DNA, 22 bp, Homo sapiens
tagatctgatacaattcatctg

SEQ ID NO: 8458837 - DNA, 22 bp, Homo sapiens
tagatctttcactactgtgtag

SEQ ID NO: 8458838 - DNA, 22 bp, Homo sapiens
tagatcttgttacagatttcct

SEQ ID NO: 8458839 - DNA, 23 bp, Homo sapiens
tagatcttcatctaattctgtag

SEQ ID NO: 8458840 - DNA, 22 bp, Homo sapiens
tagatgaaaggtctagcacagt

SEQ ID NO: 8458841 - DNA, 22 bp, Homo sapiens
tagcaaaagctcaacaggaagg

SEQ ID NO: 8458842 - DNA, 22 bp, Homo sapiens
tagctgaattgtgggagaccta

SEQ ID NO: 8458843 - DNA, 22 bp, Homo sapiens
tagctgggaattatctggttgc

SEQ ID NO: 8458844 - DNA, 22 bp, Homo sapiens
tagctggcttatataaaagggc

SEQ ID NO: 8458845 - DNA, 22 bp, Homo sapiens
tagctgcttctcacatgggcaa

SEQ ID NO: 8458846 - DNA, 22 bp, Homo sapiens
tagctgcttcagtctaggtctc

SEQ ID NO: 8458847 - DNA, 22 bp, Homo sapiens
tagctgcccatctttcctttag

SEQ ID NO: 8458848 - DNA, 22 bp, Homo sapiens
tagcaggcatctcagagataat

SEQ ID NO: 8458849 - DNA, 22 bp, Homo sapiens
tagcaggcatggagatgactgt

SEQ ID NO: 8458850 - DNA, 22 bp, Homo sapiens
tagcaggcttgtgaatggagcc

SEQ ID NO: 8458851 - DNA, 19 bp, Homo sapiens
tagaactgaggacttgcat

SEQ ID NO: 8458852 - DNA, 22 bp, Homo sapiens
tagaactagaacaaggatttga

SEQ ID NO: 8458853 - DNA, 22 bp, Homo sapiens
tagaactctggtcttctcatcc

SEQ ID NO: 8458854 - DNA, 22 bp, Homo sapiens
tagaactgctctcatacttgct

SEQ ID NO: 8458855 - DNA, 21 bp, Homo sapiens
tagaactgacgatttcagagt

SEQ ID NO: 8458856 - DNA, 22 bp, Homo sapiens
tagaactgacgttagggaagaa

SEQ ID NO: 8458857 - DNA, 22 bp, Homo sapiens
tagaaccagtccacagaatttg

SEQ ID NO: 8458858 - DNA, 22 bp, Homo sapiens
tagaacctattagaaatgtatt

SEQ ID NO: 8458859 - DNA, 22 bp, Homo sapiens
tagaaccaccttctcctttacc

SEQ ID NO: 8458860 - DNA, 22 bp, Homo sapiens
tagaacctccagagtggccccc

SEQ ID NO: 8458861 - DNA, 22 bp, Homo sapiens
tagaaccagtccacagaatttg

SEQ ID NO: 8458862 - DNA, 22 bp, Homo sapiens
tagaacctattagaaatgtatt

SEQ ID NO: 8458863 - DNA, 22 bp, Homo sapiens
tagaacctcataagaatcgaaa

SEQ ID NO: 8458864 - DNA, 22 bp, Homo sapiens
tagaacctccacaggacctcca

SEQ ID NO: 8458865 - DNA, 22 bp, Homo sapiens
tagaacctcataagaatcgaaa

SEQ ID NO: 8458866 - DNA, 19 bp, Homo sapiens
tagaacctggatttcagga

SEQ ID NO: 8458867 - DNA, 22 bp, Homo sapiens
tagaacctctgattatgttact

SEQ ID NO: 8458868 - DNA, 19 bp, Homo sapiens
tagaacctggatttcagga

SEQ ID NO: 8458869 - DNA, 22 bp, Homo sapiens
tagaacctctgattatgttact

SEQ ID NO: 8458870 - DNA, 22 bp, Homo sapiens
tagaactaagagttatcattta

SEQ ID NO: 8458871 - DNA, 22 bp, Homo sapiens
tagaactggaattttgtggttt

SEQ ID NO: 8458872 - DNA, 22 bp, Homo sapiens
tagaactggcggctagaccact

SEQ ID NO: 8458873 - DNA, 22 bp, Homo sapiens
tagaactgtccaagtctgagct

SEQ ID NO: 8458874 - DNA, 22 bp, Homo sapiens
tagaacttagcactagacttgt

SEQ ID NO: 8458875 - DNA, 22 bp, Homo sapiens
tagaacttccaattcagggctg

SEQ ID NO: 8458876 - DNA, 22 bp, Homo sapiens
tagaacttcttacagctaagtt

SEQ ID NO: 8458877 - DNA, 22 bp, Homo sapiens
tagaacttattagaaaggctca

SEQ ID NO: 8458878 - DNA, 22 bp, Homo sapiens
tagaacttatttggcattattt

SEQ ID NO: 8458879 - DNA, 22 bp, Homo sapiens
tagaacttgaatgtgaaatcag

SEQ ID NO: 8458880 - DNA, 22 bp, Homo sapiens
tagaacttgagatcaggtcttc

SEQ ID NO: 8458881 - DNA, 22 bp, Homo sapiens
tagaacttgtgaaatatcaatg

SEQ ID NO: 8458882 - DNA, 22 bp, Homo sapiens
tagaacttgatagacagtacaa

SEQ ID NO: 8458883 - DNA, 22 bp, Homo sapiens
tacttacatgaattcaagagca

SEQ ID NO: 8458884 - DNA, 22 bp, Homo sapiens
tagaaatgggttacatttagag

SEQ ID NO: 8458885 - DNA, 22 bp, Homo sapiens
tagaacatgggatagagttttt

SEQ ID NO: 8458886 - DNA, 22 bp, Homo sapiens
tagaacatgctcatgtataaat

SEQ ID NO: 8458887 - DNA, 22 bp, Homo sapiens
tagaacatgggatagagttttt

SEQ ID NO: 8458888 - DNA, 22 bp, Homo sapiens
tagaacatgtgaaaatatagcc

SEQ ID NO: 8458889 - DNA, 22 bp, Homo sapiens
tagaaccaccttctcctttacc

SEQ ID NO: 8458890 - DNA, 23 bp, Homo sapiens
tagaacatcggtgtcttggagca

SEQ ID NO: 8458891 - DNA, 22 bp, Homo sapiens
tagaacatgacttatttttgga

SEQ ID NO: 8458892 - DNA, 21 bp, Homo sapiens
tagaagcacataggttcaaag

SEQ ID NO: 8458893 - DNA, 22 bp, Homo sapiens
tagacagatttaaaggaatgga

SEQ ID NO: 8458894 - DNA, 22 bp, Homo sapiens
tagaagcacaggttaaaggcat

SEQ ID NO: 8458895 - DNA, 22 bp, Homo sapiens
tagaagattctaaagtggagag

SEQ ID NO: 8458896 - DNA, 22 bp, Homo sapiens
tagaagaacatgtcaaactata

SEQ ID NO: 8458897 - DNA, 22 bp, Homo sapiens
tagaagaacatgtcaaactata

SEQ ID NO: 8458898 - DNA, 22 bp, Homo sapiens
tagaagaacatgtcaaactata

SEQ ID NO: 8458899 - DNA, 22 bp, Homo sapiens
tagaagataagacaagtgctgc

SEQ ID NO: 8458900 - DNA, 22 bp, Homo sapiens
tagaagaaaagcacttagagat

SEQ ID NO: 8458901 - DNA, 22 bp, Homo sapiens
tagaactttcagaaattccaaa

SEQ ID NO: 8458902 - DNA, 20 bp, Homo sapiens
tagaacttttcagtatggat

SEQ ID NO: 8458903 - DNA, 22 bp, Homo sapiens
tagactagaggatcagcaaggg

SEQ ID NO: 8458904 - DNA, 23 bp, Homo sapiens
tagactgcaggctccttgagggc

SEQ ID NO: 8458905 - DNA, 22 bp, Homo sapiens
tagactcagacagaaaatgtgt

SEQ ID NO: 8458906 - DNA, 19 bp, Homo sapiens
tagactctaatgttaagct

SEQ ID NO: 8458907 - DNA, 22 bp, Homo sapiens
tagactgtgagctccttgaggg

SEQ ID NO: 8458908 - DNA, 22 bp, Homo sapiens
tagacctgaaatatggacctgg

SEQ ID NO: 8458909 - DNA, 22 bp, Homo sapiens
tagacaggagtcaggctagaat

SEQ ID NO: 8458910 - DNA, 22 bp, Homo sapiens
tagacaggaaacattaggatgg

SEQ ID NO: 8458911 - DNA, 22 bp, Homo sapiens
tagactttgatattgtacaccc

SEQ ID NO: 8458912 - DNA, 22 bp, Homo sapiens
tagactttgatattgtacaccc

SEQ ID NO: 8458913 - DNA, 20 bp, Homo sapiens
tagacttttcatcaacctta

SEQ ID NO: 8458914 - DNA, 22 bp, Homo sapiens
tagacttttcaaaatctagacc

SEQ ID NO: 8458915 - DNA, 22 bp, Homo sapiens
tagagaaaaccactggtgagct

SEQ ID NO: 8458916 - DNA, 22 bp, Homo sapiens
tagagaaaagcagggatcagga

SEQ ID NO: 8458917 - DNA, 22 bp, Homo sapiens
tagagaaaagcagggatcagga

SEQ ID NO: 8458918 - DNA, 22 bp, Homo sapiens
tagagaaacagaaccaacaggg

SEQ ID NO: 8458919 - DNA, 22 bp, Homo sapiens
tagagaaataagctttgccttg

SEQ ID NO: 8458920 - DNA, 22 bp, Homo sapiens
tagagagccagttgtcatagtt

SEQ ID NO: 8458921 - DNA, 22 bp, Homo sapiens
tagagacaccagtaccattctg

SEQ ID NO: 8458922 - DNA, 22 bp, Homo sapiens
tagagacagaaagtagaatggt

SEQ ID NO: 8458923 - DNA, 20 bp, Homo sapiens
tagagagaggatattaaagt

SEQ ID NO: 8458924 - DNA, 22 bp, Homo sapiens
tagatataaggtccttagaaca

SEQ ID NO: 8458925 - DNA, 22 bp, Homo sapiens
tagatatcagaaatagaattta

SEQ ID NO: 8458926 - DNA, 22 bp, Homo sapiens
tagatcatggagtaaaatggaa

SEQ ID NO: 8458927 - DNA, 21 bp, Homo sapiens
tagatcatggtattctttggc

SEQ ID NO: 8458928 - DNA, 22 bp, Homo sapiens
tagatccagctgttatgttatg

SEQ ID NO: 8458929 - DNA, 22 bp, Homo sapiens
tagatacctgctggacctcatt

SEQ ID NO: 8458930 - DNA, 19 bp, Homo sapiens
tagatactgatgaactcca

SEQ ID NO: 8458931 - DNA, 22 bp, Homo sapiens
tagagtctagtgtatacaaagt

SEQ ID NO: 8458932 - DNA, 22 bp, Homo sapiens
tagagtctagtgtatacaaagt

SEQ ID NO: 8458933 - DNA, 22 bp, Homo sapiens
tagatacatacattttaaaatg

SEQ ID NO: 8458934 - DNA, 20 bp, Homo sapiens
tagatacccaatgctcatca

SEQ ID NO: 8458935 - DNA, 22 bp, Homo sapiens
tagatacatttttctttcctgt

SEQ ID NO: 8458936 - DNA, 22 bp, Homo sapiens
tagtgcagaggaggagcctctg

SEQ ID NO: 8458937 - DNA, 22 bp, Homo sapiens
tagtgcaggttaataggacttc

SEQ ID NO: 8458938 - DNA, 22 bp, Homo sapiens
tagtgcaggttaataggacttc

SEQ ID NO: 8458939 - DNA, 22 bp, Homo sapiens
tagtgcagggttttaagcactg

SEQ ID NO: 8458940 - DNA, 22 bp, Homo sapiens
tagtgcatacctaacatttttg

SEQ ID NO: 8458941 - DNA, 22 bp, Homo sapiens
taggggaagtctcagaatgcag

SEQ ID NO: 8458942 - DNA, 22 bp, Homo sapiens
taggggaaagcagaatcctgga

SEQ ID NO: 8458943 - DNA, 23 bp, Homo sapiens
taggggaaaaatcttctgcaatt

SEQ ID NO: 8458944 - DNA, 22 bp, Homo sapiens
taggggcagaagcggcggtcca

SEQ ID NO: 8458945 - DNA, 22 bp, Homo sapiens
tagggggctgtcctgtgcatta

SEQ ID NO: 8458946 - DNA, 22 bp, Homo sapiens
tagggggctttgctgcttgaca

SEQ ID NO: 8458947 - DNA, 21 bp, Homo sapiens
tagggggcagtgggatgctta

SEQ ID NO: 8458948 - DNA, 22 bp, Homo sapiens
tagttacagaagataagggtat

SEQ ID NO: 8458949 - DNA, 22 bp, Homo sapiens
tagttacagaagataagggtat

SEQ ID NO: 8458950 - DNA, 22 bp, Homo sapiens
tagttacacatgggtagggaat

SEQ ID NO: 8458951 - DNA, 22 bp, Homo sapiens
tagttacagagaaatgatttga

SEQ ID NO: 8458952 - DNA, 22 bp, Homo sapiens
tagttacagaagataagggtat

SEQ ID NO: 8458953 - DNA, 22 bp, Homo sapiens
tagttacagcaggcaggatata

SEQ ID NO: 8458954 - DNA, 22 bp, Homo sapiens
tagttacagatctaggactgtt

SEQ ID NO: 8458955 - DNA, 22 bp, Homo sapiens
tagttacagatctaggactgtt

SEQ ID NO: 8458956 - DNA, 22 bp, Homo sapiens
tagttacagagaaatgatttga

SEQ ID NO: 8458957 - DNA, 22 bp, Homo sapiens
tagttacaattatgcatggaaa

SEQ ID NO: 8458958 - DNA, 22 bp, Homo sapiens
tagttacaattatgcatggaaa

SEQ ID NO: 8458959 - DNA, 22 bp, Homo sapiens
tagttacacatgggtagggaat

SEQ ID NO: 8458960 - DNA, 22 bp, Homo sapiens
tagttacaatgggttctgtgac

SEQ ID NO: 8458961 - DNA, 22 bp, Homo sapiens
tagttacaatgggttctgtgac

SEQ ID NO: 8458962 - DNA, 22 bp, Homo sapiens
tagttacaaaccaacaggcagc

SEQ ID NO: 8458963 - DNA, 22 bp, Homo sapiens
tagttacaaaccaacaggcagc

SEQ ID NO: 8458964 - DNA, 22 bp, Homo sapiens
tagttttatgaattggtataat

SEQ ID NO: 8458965 - DNA, 22 bp, Homo sapiens
tagttttatgaattggtataat

SEQ ID NO: 8458966 - DNA, 22 bp, Homo sapiens
tagttttgattagtattgtctt

SEQ ID NO: 8458967 - DNA, 22 bp, Homo sapiens
tagtttttaagtgtacaatttc

SEQ ID NO: 8458968 - DNA, 22 bp, Homo sapiens
tagttttataatgttaacatct

SEQ ID NO: 8458969 - DNA, 22 bp, Homo sapiens
tagttttataatgttaacatct

SEQ ID NO: 8458970 - DNA, 22 bp, Homo sapiens
tagttttataatgttaacatct

SEQ ID NO: 8458971 - DNA, 22 bp, Homo sapiens
tagtttatgattttttggaagg

SEQ ID NO: 8458972 - DNA, 22 bp, Homo sapiens
tagtttcatatgcaaaatagta

SEQ ID NO: 8458973 - DNA, 22 bp, Homo sapiens
tagtttccatgttatacagttt

SEQ ID NO: 8458974 - DNA, 22 bp, Homo sapiens
tagtttcatatgcaaaatagta

SEQ ID NO: 8458975 - DNA, 22 bp, Homo sapiens
tagtttaccaaattgatcttcc

SEQ ID NO: 8458976 - DNA, 22 bp, Homo sapiens
tagtttactgttcactttgccc

SEQ ID NO: 8458977 - DNA, 22 bp, Homo sapiens
tagtttagcactaagaaaaaca

SEQ ID NO: 8458978 - DNA, 22 bp, Homo sapiens
tagtttagcatacatcttcagg

SEQ ID NO: 8458979 - DNA, 22 bp, Homo sapiens
tagttgacttctctatcccagc

SEQ ID NO: 8458980 - DNA, 22 bp, Homo sapiens
tagtttaatggtcaactaatga

SEQ ID NO: 8458981 - DNA, 22 bp, Homo sapiens
tagttcttcatgaattcagctt

SEQ ID NO: 8458982 - DNA, 23 bp, Homo sapiens
tagttacattattgtcagagctg

SEQ ID NO: 8458983 - DNA, 23 bp, Homo sapiens
tagttacattattgtcagagctg

SEQ ID NO: 8458984 - DNA, 22 bp, Homo sapiens
tagttacataaagtggactgtt

SEQ ID NO: 8458985 - DNA, 22 bp, Homo sapiens
tagttacataaagtggactgtt

SEQ ID NO: 8458986 - DNA, 22 bp, Homo sapiens
tagttacagtgcatagcaagat

SEQ ID NO: 8458987 - DNA, 22 bp, Homo sapiens
tagttacagtgcatagcaagat

SEQ ID NO: 8458988 - DNA, 22 bp, Homo sapiens
tagttacagcaggcaggatata

SEQ ID NO: 8458989 - DNA, 22 bp, Homo sapiens
tagttacaggagtttctgaaat

SEQ ID NO: 8458990 - DNA, 22 bp, Homo sapiens
tagttacaggagtttctgaaat

SEQ ID NO: 8458991 - DNA, 22 bp, Homo sapiens
taggccagcccttagtcctgtc

SEQ ID NO: 8458992 - DNA, 22 bp, Homo sapiens
taggccaggaatcagcaagctt

SEQ ID NO: 8458993 - DNA, 22 bp, Homo sapiens
taggccagattgttatccatgg

SEQ ID NO: 8458994 - DNA, 22 bp, Homo sapiens
taggccagcccttagtcctgtc

SEQ ID NO: 8458995 - DNA, 22 bp, Homo sapiens
taggccagattactagagtagg

SEQ ID NO: 8458996 - DNA, 22 bp, Homo sapiens
taggccaggacagagcttccag

SEQ ID NO: 8458997 - DNA, 23 bp, Homo sapiens
taggccagggtgacctggggaga

SEQ ID NO: 8458998 - DNA, 22 bp, Homo sapiens
taggccaggagtcagacagatt

SEQ ID NO: 8458999 - DNA, 22 bp, Homo sapiens
taggccagtggcaggttgtgtg

SEQ ID NO: 8459000 - DNA, 22 bp, Homo sapiens
taggccagttggtggccctgga

SEQ ID NO: 8459001 - DNA, 18 bp, Homo sapiens
taggccagtatacttttc

SEQ ID NO: 8459002 - DNA, 22 bp, Homo sapiens
taggccagtaaaatgtttcagt

SEQ ID NO: 8459003 - DNA, 22 bp, Homo sapiens
taggcagattccatattttggc

SEQ ID NO: 8459004 - DNA, 22 bp, Homo sapiens
taggcagatgttaacaggaaaa

SEQ ID NO: 8459005 - DNA, 22 bp, Homo sapiens
taggcagcgcttggctgtgctt

SEQ ID NO: 8459006 - DNA, 20 bp, Homo sapiens
taggcagcttgacccttggt

SEQ ID NO: 8459007 - DNA, 22 bp, Homo sapiens
taggcagcttaggttagaagtg

SEQ ID NO: 8459008 - DNA, 22 bp, Homo sapiens
tagctggtcctcagctccagcc

SEQ ID NO: 8459009 - DNA, 22 bp, Homo sapiens
tagctgggttgaggtcatctac

SEQ ID NO: 8459010 - DNA, 22 bp, Homo sapiens
tagctgggtctctgttttctca

SEQ ID NO: 8459011 - DNA, 22 bp, Homo sapiens
tagctgggactactggccctgc

SEQ ID NO: 8459012 - DNA, 22 bp, Homo sapiens
tagctgggagtgtctgatgggt

SEQ ID NO: 8459013 - DNA, 22 bp, Homo sapiens
tagctgtccagtgagtcccttt

SEQ ID NO: 8459014 - DNA, 22 bp, Homo sapiens
tagctgtggagcagaggtctcc

SEQ ID NO: 8459015 - DNA, 22 bp, Homo sapiens
tagctgtgaaacagcagaagag

SEQ ID NO: 8459016 - DNA, 22 bp, Homo sapiens
taggcagagaggccataagaat

SEQ ID NO: 8459017 - DNA, 22 bp, Homo sapiens
tagggctgctttgtattctgct

SEQ ID NO: 8459018 - DNA, 22 bp, Homo sapiens
tagggctgctgcagatgacagg

SEQ ID NO: 8459019 - DNA, 22 bp, Homo sapiens
tagggctggcgtgctcagggaa

SEQ ID NO: 8459020 - DNA, 19 bp, Homo sapiens
tagggctggccgggcggtg

SEQ ID NO: 8459021 - DNA, 22 bp, Homo sapiens
tagggctgcctatggctagata

SEQ ID NO: 8459022 - DNA, 22 bp, Homo sapiens
tagggctgcagaacaatggcct

SEQ ID NO: 8459023 - DNA, 22 bp, Homo sapiens
tagggctgccatttgcttttct

SEQ ID NO: 8459024 - DNA, 22 bp, Homo sapiens
tagggctgaggcaacaagggag

SEQ ID NO: 8459025 - DNA, 22 bp, Homo sapiens
tagggctgggtacactcttgcc

SEQ ID NO: 8459026 - DNA, 22 bp, Homo sapiens
tagggctgtggtcagtcctcta

SEQ ID NO: 8459027 - DNA, 16 bp, Homo sapiens
tagggctgggaaggag

SEQ ID NO: 8459028 - DNA, 22 bp, Homo sapiens
tagggctgtgtctccaggacca

SEQ ID NO: 8459029 - DNA, 22 bp, Homo sapiens
tagggctgttagtaattctcag

SEQ ID NO: 8459030 - DNA, 22 bp, Homo sapiens
tagggctgtttaaaagtgaggt

SEQ ID NO: 8459031 - DNA, 22 bp, Homo sapiens
tagggcttagaaaagaatttac

SEQ ID NO: 8459032 - DNA, 21 bp, Homo sapiens
tatggtaaccagacaagaatg

SEQ ID NO: 8459033 - DNA, 22 bp, Homo sapiens
tatgggtgttaatggtgagaga

SEQ ID NO: 8459034 - DNA, 22 bp, Homo sapiens
tatgtaaaggattgagatgaat

SEQ ID NO: 8459035 - DNA, 22 bp, Homo sapiens
tatgtacatacatgtgcatacg

SEQ ID NO: 8459036 - DNA, 22 bp, Homo sapiens
tatgtacatacatgtgcatacg

SEQ ID NO: 8459037 - DNA, 22 bp, Homo sapiens
tatgtacatatacacgtgtgtg

SEQ ID NO: 8459038 - DNA, 22 bp, Homo sapiens
tatggaaagtgttttcttctgt

SEQ ID NO: 8459039 - DNA, 22 bp, Homo sapiens
tatggaaagggagtttaatttg

SEQ ID NO: 8459040 - DNA, 22 bp, Homo sapiens
tatggaaagctctttttgattg

SEQ ID NO: 8459041 - DNA, 22 bp, Homo sapiens
tatggaaagggagtttaatttg

SEQ ID NO: 8459042 - DNA, 22 bp, Homo sapiens
tatggaaactaattcatttttc

SEQ ID NO: 8459043 - DNA, 22 bp, Homo sapiens
tatggaaaaatgtatcttgtca

SEQ ID NO: 8459044 - DNA, 22 bp, Homo sapiens
tatggaaataattagacaagtg

SEQ ID NO: 8459045 - DNA, 22 bp, Homo sapiens
tatggcttcttttgcaactact

SEQ ID NO: 8459046 - DNA, 22 bp, Homo sapiens
tatggcttctgggccaaattta

SEQ ID NO: 8459047 - DNA, 22 bp, Homo sapiens
tattaagtatcttgatgacaaa

SEQ ID NO: 8459048 - DNA, 22 bp, Homo sapiens
tattaacattttatgaaaataa

SEQ ID NO: 8459049 - DNA, 22 bp, Homo sapiens
tattaacatgaactgacttttc

SEQ ID NO: 8459050 - DNA, 22 bp, Homo sapiens
tattaataagtgactactagct

SEQ ID NO: 8459051 - DNA, 22 bp, Homo sapiens
tattaataagtgactactagct

SEQ ID NO: 8459052 - DNA, 21 bp, Homo sapiens
tattaatatgtctaagctgat

SEQ ID NO: 8459053 - DNA, 21 bp, Homo sapiens
tattaatatgtctaagctgat

SEQ ID NO: 8459054 - DNA, 22 bp, Homo sapiens
tattaataaatatgtaggggcc

SEQ ID NO: 8459055 - DNA, 22 bp, Homo sapiens
tattaatatgtgtgtgcatgta

SEQ ID NO: 8459056 - DNA, 22 bp, Homo sapiens
tatgtcacattgtaacagtgtg

SEQ ID NO: 8459057 - DNA, 22 bp, Homo sapiens
tatgtattctcagatttactaa

SEQ ID NO: 8459058 - DNA, 22 bp, Homo sapiens
tatgtattctcagatttactaa

SEQ ID NO: 8459059 - DNA, 22 bp, Homo sapiens
tatgtattctgagtacaagttc

SEQ ID NO: 8459060 - DNA, 22 bp, Homo sapiens
tatgtatccgtgtgtgtacaga

SEQ ID NO: 8459061 - DNA, 22 bp, Homo sapiens
tatgtagcaatagcatcatact

SEQ ID NO: 8459062 - DNA, 22 bp, Homo sapiens
tatccaaacatatagtctctct

SEQ ID NO: 8459063 - DNA, 22 bp, Homo sapiens
tatccaaagagattcatgttct

SEQ ID NO: 8459064 - DNA, 22 bp, Homo sapiens
tatccaaaggaacaatcacagc

SEQ ID NO: 8459065 - DNA, 22 bp, Homo sapiens
tatccaaagtggcatattatag

SEQ ID NO: 8459066 - DNA, 22 bp, Homo sapiens
tatccaaaggaacaatcacagc

SEQ ID NO: 8459067 - DNA, 22 bp, Homo sapiens
tatccaaaggaacaatcacagc

SEQ ID NO: 8459068 - DNA, 22 bp, Homo sapiens
tatccaaaggaacaatcacagc

SEQ ID NO: 8459069 - DNA, 22 bp, Homo sapiens
tatcattttactgtgacatttt

SEQ ID NO: 8459070 - DNA, 22 bp, Homo sapiens
tatcatttgttattattagtgg

SEQ ID NO: 8459071 - DNA, 22 bp, Homo sapiens
tatcatttaacagaatcattgc

SEQ ID NO: 8459072 - DNA, 22 bp, Homo sapiens
tatcttttgagttctcaagatg

SEQ ID NO: 8459073 - DNA, 23 bp, Homo sapiens
tatctttttcaatgttggaaata

SEQ ID NO: 8459074 - DNA, 22 bp, Homo sapiens
tatgaaaaggtggccaatgtag

SEQ ID NO: 8459075 - DNA, 18 bp, Homo sapiens
tatcttttccagtggtat

SEQ ID NO: 8459076 - DNA, 18 bp, Homo sapiens
tatcttttccagtggtat

SEQ ID NO: 8459077 - DNA, 22 bp, Homo sapiens
tatgaaaatttagctgaagcat

SEQ ID NO: 8459078 - DNA, 22 bp, Homo sapiens
tatgaaaaggtggccaatgtag

SEQ ID NO: 8459079 - DNA, 22 bp, Homo sapiens
tatgaaacattcatacaaataa

SEQ ID NO: 8459080 - DNA, 22 bp, Homo sapiens
tatgaaagaatctcagagcaca

SEQ ID NO: 8459081 - DNA, 22 bp, Homo sapiens
tatgaaaatttagctgaagcat

SEQ ID NO: 8459082 - DNA, 22 bp, Homo sapiens
tatgaaggatacacctctgatt

SEQ ID NO: 8459083 - DNA, 22 bp, Homo sapiens
tatgaagattgcggtctggaat

SEQ ID NO: 8459084 - DNA, 22 bp, Homo sapiens
tatgacaaatgatatatttggc

SEQ ID NO: 8459085 - DNA, 20 bp, Homo sapiens
tatgaattctggtccctggg

SEQ ID NO: 8459086 - DNA, 22 bp, Homo sapiens
tatgaattctgttcattgatga

SEQ ID NO: 8459087 - DNA, 22 bp, Homo sapiens
tatgaattctcttgtgtatagt

SEQ ID NO: 8459088 - DNA, 22 bp, Homo sapiens
tatgaaattgccatttttatgg

SEQ ID NO: 8459089 - DNA, 22 bp, Homo sapiens
tatgaaatggtagtaggaaggg

SEQ ID NO: 8459090 - DNA, 22 bp, Homo sapiens
tatgaaatgatggggaaaatag

SEQ ID NO: 8459091 - DNA, 22 bp, Homo sapiens
tatgaaatttctagttctgctt

SEQ ID NO: 8459092 - DNA, 22 bp, Homo sapiens
tatgaaatttaaacacagatca

SEQ ID NO: 8459093 - DNA, 22 bp, Homo sapiens
tatcagctcggaatctgttgaa

SEQ ID NO: 8459094 - DNA, 22 bp, Homo sapiens
tatcagaaatcaacacacagtg

SEQ ID NO: 8459095 - DNA, 22 bp, Homo sapiens
tatcacttgcgttttggcagag

SEQ ID NO: 8459096 - DNA, 19 bp, Homo sapiens
tatcactgggcactgagga

SEQ ID NO: 8459097 - DNA, 22 bp, Homo sapiens
tatcactgacctgtatcagttg

SEQ ID NO: 8459098 - DNA, 22 bp, Homo sapiens
tatcactacacttcagctttaa

SEQ ID NO: 8459099 - DNA, 22 bp, Homo sapiens
tatcagaaatgccttaaattgg

SEQ ID NO: 8459100 - DNA, 22 bp, Homo sapiens
tagttttttcaacaaatggtgc

SEQ ID NO: 8459101 - DNA, 22 bp, Homo sapiens
tataaagaagtgtaaacaggaa

SEQ ID NO: 8459102 - DNA, 22 bp, Homo sapiens
tataaagagtctcaaagaagtt

SEQ ID NO: 8459103 - DNA, 22 bp, Homo sapiens
tataaagagtctcaaagaagtt

SEQ ID NO: 8459104 - DNA, 22 bp, Homo sapiens
tataaagagtctcaaagaagtt

SEQ ID NO: 8459105 - DNA, 22 bp, Homo sapiens
tatttgatagagataaatgata

SEQ ID NO: 8459106 - DNA, 22 bp, Homo sapiens
tatttgatggttctaaaacagc

SEQ ID NO: 8459107 - DNA, 22 bp, Homo sapiens
tatttgcaggacatagatatgg

SEQ ID NO: 8459108 - DNA, 22 bp, Homo sapiens
tatttgcaggcttttgtcatgg

SEQ ID NO: 8459109 - DNA, 22 bp, Homo sapiens
tatttgcaggcttttgtcatgg

SEQ ID NO: 8459110 - DNA, 22 bp, Homo sapiens
tatttgcaggacatagatatgg

SEQ ID NO: 8459111 - DNA, 22 bp, Homo sapiens
tatttgaagggagaaagtgcca

SEQ ID NO: 8459112 - DNA, 22 bp, Homo sapiens
tatttcttgttattctcgttga

SEQ ID NO: 8459113 - DNA, 22 bp, Homo sapiens
tatttcttgttattctcgttga

SEQ ID NO: 8459114 - DNA, 22 bp, Homo sapiens
tatttcttgagtggtcagtttc

SEQ ID NO: 8459115 - DNA, 22 bp, Homo sapiens
tattgtcaagaagtttatagtg

SEQ ID NO: 8459116 - DNA, 22 bp, Homo sapiens
tattgtattaaggattcaagta

SEQ ID NO: 8459117 - DNA, 22 bp, Homo sapiens
tattgtattaaggattcaagta

SEQ ID NO: 8459118 - DNA, 23 bp, Homo sapiens
tattacaattggtcttattaaga

SEQ ID NO: 8459119 - DNA, 23 bp, Homo sapiens
tattacaattggtcttattaaga

SEQ ID NO: 8459120 - DNA, 22 bp, Homo sapiens
tattacaagaaagggcatgaat

SEQ ID NO: 8459121 - DNA, 23 bp, Homo sapiens
tattacaattggtcttattaaga

SEQ ID NO: 8459122 - DNA, 23 bp, Homo sapiens
tattacaattggtcttattaaga

SEQ ID NO: 8459123 - DNA, 22 bp, Homo sapiens
tattacaatttacattgcactt

SEQ ID NO: 8459124 - DNA, 22 bp, Homo sapiens
tattacaaattataatgggaga

SEQ ID NO: 8459125 - DNA, 22 bp, Homo sapiens
tattacaaattataatgggaga

SEQ ID NO: 8459126 - DNA, 22 bp, Homo sapiens
tattacaagaaagggcatgaat

SEQ ID NO: 8459127 - DNA, 22 bp, Homo sapiens
tattacaagaaagggcatgaat

SEQ ID NO: 8459128 - DNA, 22 bp, Homo sapiens
tatttaactggaaacacaatga

SEQ ID NO: 8459129 - DNA, 22 bp, Homo sapiens
tatttaactggaaacacaatga

SEQ ID NO: 8459130 - DNA, 22 bp, Homo sapiens
tatttaagatgtgtcataaaga

SEQ ID NO: 8459131 - DNA, 22 bp, Homo sapiens
tatttaaaatagtgctccagca

SEQ ID NO: 8459132 - DNA, 22 bp, Homo sapiens
tatttaaaaagaggccagctgg

SEQ ID NO: 8459133 - DNA, 22 bp, Homo sapiens
tattgtgcccctcccaggaaca

SEQ ID NO: 8459134 - DNA, 22 bp, Homo sapiens
tattgtttctggctgtggcagc

SEQ ID NO: 8459135 - DNA, 22 bp, Homo sapiens
tattgtttctggctgtggcagc

SEQ ID NO: 8459136 - DNA, 22 bp, Homo sapiens
tcaaaaataagatattctggac

SEQ ID NO: 8459137 - DNA, 22 bp, Homo sapiens
tatttttgcctctcagataaaa

SEQ ID NO: 8459138 - DNA, 22 bp, Homo sapiens
tattttgaggtatttttgagct

SEQ ID NO: 8459139 - DNA, 22 bp, Homo sapiens
tcaaagagctattcagttgtgg

SEQ ID NO: 8459140 - DNA, 20 bp, Homo sapiens
tcaaagcaaagggagatgat

SEQ ID NO: 8459141 - DNA, 19 bp, Homo sapiens
tcaaagcaagcatgttctg

SEQ ID NO: 8459142 - DNA, 22 bp, Homo sapiens
tcaaactgaattaaacacttgt

SEQ ID NO: 8459143 - DNA, 22 bp, Homo sapiens
tcaaagaacatcatctgaaatg

SEQ ID NO: 8459144 - DNA, 17 bp, Homo sapiens
tcaaagaatgcatgcag

SEQ ID NO: 8459145 - DNA, 22 bp, Homo sapiens
tcaaataccagcaatttcatgt

SEQ ID NO: 8459146 - DNA, 22 bp, Homo sapiens
tcaaatacatggtcaatcaact

SEQ ID NO: 8459147 - DNA, 22 bp, Homo sapiens
tcaaatacatggtcaatcaact

SEQ ID NO: 8459148 - DNA, 22 bp, Homo sapiens
tcaaatacagaagatcctttcc

SEQ ID NO: 8459149 - DNA, 22 bp, Homo sapiens
tcaaataatgccattcatcatc

SEQ ID NO: 8459150 - DNA, 22 bp, Homo sapiens
tcaaataccagcaatttcatgt

SEQ ID NO: 8459151 - DNA, 22 bp, Homo sapiens
tcaaataggcttgtagtgactg

SEQ ID NO: 8459152 - DNA, 22 bp, Homo sapiens
tcaaatagttgacattaacttg

SEQ ID NO: 8459153 - DNA, 22 bp, Homo sapiens
tcaaatcccagctcagcctctc

SEQ ID NO: 8459154 - DNA, 22 bp, Homo sapiens
tcaaatctttaacatgtgcaaa

SEQ ID NO: 8459155 - DNA, 22 bp, Homo sapiens
tcaaatctttaacatgtgcaaa

SEQ ID NO: 8459156 - DNA, 22 bp, Homo sapiens
tcaaatcagcaagcagcttccc

SEQ ID NO: 8459157 - DNA, 22 bp, Homo sapiens
tcaaatcaccaaactcactggc

SEQ ID NO: 8459158 - DNA, 22 bp, Homo sapiens
tcaaataatgccattcatcatc

SEQ ID NO: 8459159 - DNA, 22 bp, Homo sapiens
tcaaataaggagtcatgaccat

SEQ ID NO: 8459160 - DNA, 22 bp, Homo sapiens
tcaaagtttttgagaattacat

SEQ ID NO: 8459161 - DNA, 22 bp, Homo sapiens
tcaaataaggagtcatgaccat

SEQ ID NO: 8459162 - DNA, 22 bp, Homo sapiens
tcaaagtatctcatggagagca

SEQ ID NO: 8459163 - DNA, 17 bp, Homo sapiens
tcaaagtattctgatgc

SEQ ID NO: 8459164 - DNA, 22 bp, Homo sapiens
tcaaagtataattgcttttttg

SEQ ID NO: 8459165 - DNA, 22 bp, Homo sapiens
tcaaagtaagaatttattacaa

SEQ ID NO: 8459166 - DNA, 23 bp, Homo sapiens
tcaaagtagttttatccaataaa

SEQ ID NO: 8459167 - DNA, 22 bp, Homo sapiens
tcaaagggtccttaacatgaga

SEQ ID NO: 8459168 - DNA, 22 bp, Homo sapiens
tcaaagggtagcccagggaaga

SEQ ID NO: 8459169 - DNA, 22 bp, Homo sapiens
tcaaagtaaaagtatagagttt

SEQ ID NO: 8459170 - DNA, 22 bp, Homo sapiens
tcaaagggtaatgtaatagtct

SEQ ID NO: 8459171 - DNA, 22 bp, Homo sapiens
taaggaaaatggacatcaaaca

SEQ ID NO: 8459172 - DNA, 22 bp, Homo sapiens
taagctggagcttcccccgtcc

SEQ ID NO: 8459173 - DNA, 22 bp, Homo sapiens
taagctggggctatgctaaata

SEQ ID NO: 8459174 - DNA, 22 bp, Homo sapiens
taagcctgcatgaaccatgaga

SEQ ID NO: 8459175 - DNA, 22 bp, Homo sapiens
taagctcactgtaagaactgat

SEQ ID NO: 8459176 - DNA, 22 bp, Homo sapiens
taagcattatggtaaagaagta

SEQ ID NO: 8459177 - DNA, 22 bp, Homo sapiens
taagccactgagatttggggtt

SEQ ID NO: 8459178 - DNA, 22 bp, Homo sapiens
taagccatcatcatggctttgg

SEQ ID NO: 8459179 - DNA, 22 bp, Homo sapiens
taagcccacatttttctgaaga

SEQ ID NO: 8459180 - DNA, 22 bp, Homo sapiens
taaggaaaatggacatcaaaca

SEQ ID NO: 8459181 - DNA, 22 bp, Homo sapiens
taaggaaagtgccatgatttct

SEQ ID NO: 8459182 - DNA, 22 bp, Homo sapiens
taatataccaaactgtaatttt

SEQ ID NO: 8459183 - DNA, 22 bp, Homo sapiens
taatataccaaactgtaatttt

SEQ ID NO: 8459184 - DNA, 22 bp, Homo sapiens
taatataccaaactgtaatttt

SEQ ID NO: 8459185 - DNA, 22 bp, Homo sapiens
taatatatacctttgttaggaa

SEQ ID NO: 8459186 - DNA, 22 bp, Homo sapiens
taatatatacctttgttaggaa

SEQ ID NO: 8459187 - DNA, 22 bp, Homo sapiens
taatatacttcccatagtttga

SEQ ID NO: 8459188 - DNA, 22 bp, Homo sapiens
taatatacttcccatagtttga

SEQ ID NO: 8459189 - DNA, 22 bp, Homo sapiens
taaggacattagaaatgatgct

SEQ ID NO: 8459190 - DNA, 22 bp, Homo sapiens
taaggacattggttttgagtaa

SEQ ID NO: 8459191 - DNA, 22 bp, Homo sapiens
taaggaatgcttgaatgttcct

SEQ ID NO: 8459192 - DNA, 22 bp, Homo sapiens
taaggaatagtgctatgaaaaa

SEQ ID NO: 8459193 - DNA, 22 bp, Homo sapiens
taaggacaatcaggttagtagc

SEQ ID NO: 8459194 - DNA, 22 bp, Homo sapiens
taaggacaatttgtcgcttgca

SEQ ID NO: 8459195 - DNA, 22 bp, Homo sapiens
taatagttgtgactttgtaaag

SEQ ID NO: 8459196 - DNA, 22 bp, Homo sapiens
taatctatcaagcaacaaagtg

SEQ ID NO: 8459197 - DNA, 22 bp, Homo sapiens
taatctagtcccacatggaatt

SEQ ID NO: 8459198 - DNA, 22 bp, Homo sapiens
taatcgtatgtgtatcaaatca

SEQ ID NO: 8459199 - DNA, 22 bp, Homo sapiens
taatctactgtttatatgaaat

SEQ ID NO: 8459200 - DNA, 22 bp, Homo sapiens
taatctagaacatatgagagca

SEQ ID NO: 8459201 - DNA, 22 bp, Homo sapiens
taatatatttctgctaagctca

SEQ ID NO: 8459202 - DNA, 22 bp, Homo sapiens
taatatctacttcatagagttt

SEQ ID NO: 8459203 - DNA, 18 bp, Homo sapiens
taatccatatgctttgcc

SEQ ID NO: 8459204 - DNA, 22 bp, Homo sapiens
taatatatttctgctaagctca

SEQ ID NO: 8459205 - DNA, 22 bp, Homo sapiens
taatatatttctgctaagctca

SEQ ID NO: 8459206 - DNA, 22 bp, Homo sapiens
taatatatttctgctaagctca

SEQ ID NO: 8459207 - DNA, 22 bp, Homo sapiens
taattattatgacaacaattgc

SEQ ID NO: 8459208 - DNA, 22 bp, Homo sapiens
taattattatgacaacaattgc

SEQ ID NO: 8459209 - DNA, 22 bp, Homo sapiens
taatttatgatgcaaagaaaag

SEQ ID NO: 8459210 - DNA, 22 bp, Homo sapiens
taatttacttgcaaataacaat

SEQ ID NO: 8459211 - DNA, 22 bp, Homo sapiens
taattgaactaacatgcaaaca

SEQ ID NO: 8459212 - DNA, 22 bp, Homo sapiens
taattctagattgacattttga

SEQ ID NO: 8459213 - DNA, 22 bp, Homo sapiens
taattcttcaggccttttgtct

SEQ ID NO: 8459214 - DNA, 22 bp, Homo sapiens
taattcatgggcccagtgatat

SEQ ID NO: 8459215 - DNA, 22 bp, Homo sapiens
tacacatacaccaatgtggtca

SEQ ID NO: 8459216 - DNA, 22 bp, Homo sapiens
tacacagtagagtataatgcgt

SEQ ID NO: 8459217 - DNA, 22 bp, Homo sapiens
tacacagtaaatggtaaataca

SEQ ID NO: 8459218 - DNA, 22 bp, Homo sapiens
tacacagttccatttaagccag

SEQ ID NO: 8459219 - DNA, 22 bp, Homo sapiens
tacacagttttgctcccatgat

SEQ ID NO: 8459220 - DNA, 22 bp, Homo sapiens
tacacagtaaatggtaaataca

SEQ ID NO: 8459221 - DNA, 22 bp, Homo sapiens
tacacacagaggccatgggatt

SEQ ID NO: 8459222 - DNA, 22 bp, Homo sapiens
tacacacagaggccatgggatt

SEQ ID NO: 8459223 - DNA, 22 bp, Homo sapiens
tacacacatgcatttgccttat

SEQ ID NO: 8459224 - DNA, 22 bp, Homo sapiens
tacacacatgcatttgccttat

SEQ ID NO: 8459225 - DNA, 22 bp, Homo sapiens
tacacacatgcatttgccttat

SEQ ID NO: 8459226 - DNA, 22 bp, Homo sapiens
tacacacctgcctgcagactct

SEQ ID NO: 8459227 - DNA, 22 bp, Homo sapiens
tacagaatgttatgaagcatag

SEQ ID NO: 8459228 - DNA, 22 bp, Homo sapiens
tacagaattagattattagaga

SEQ ID NO: 8459229 - DNA, 22 bp, Homo sapiens
tacagaatgtgtatcattacca

SEQ ID NO: 8459230 - DNA, 22 bp, Homo sapiens
tacagaatgtgtatcattacca

SEQ ID NO: 8459231 - DNA, 22 bp, Homo sapiens
tacagaattagattattagaga

SEQ ID NO: 8459232 - DNA, 22 bp, Homo sapiens
tacagaattagattattagaga

SEQ ID NO: 8459233 - DNA, 22 bp, Homo sapiens
tacagacaaagagcatgcggta

SEQ ID NO: 8459234 - DNA, 22 bp, Homo sapiens
tacagaatagaatagggacagg

SEQ ID NO: 8459235 - DNA, 20 bp, Homo sapiens
tacagaatgcaataaaatgg

SEQ ID NO: 8459236 - DNA, 22 bp, Homo sapiens
tacaacatttacgttaggctgt

SEQ ID NO: 8459237 - DNA, 22 bp, Homo sapiens
tacaacgtgggactttgtttct

SEQ ID NO: 8459238 - DNA, 22 bp, Homo sapiens
tacaagaaatttctgcatatat

SEQ ID NO: 8459239 - DNA, 22 bp, Homo sapiens
tacaagaaatttctgcatatat

SEQ ID NO: 8459240 - DNA, 22 bp, Homo sapiens
tacaagaaatttctgcatatat

SEQ ID NO: 8459241 - DNA, 22 bp, Homo sapiens
tacaagaaagtccagtgggttt

SEQ ID NO: 8459242 - DNA, 22 bp, Homo sapiens
tacaagaaactacatgaatgca

SEQ ID NO: 8459243 - DNA, 22 bp, Homo sapiens
tacaacattgtgttgcttcata

SEQ ID NO: 8459244 - DNA, 22 bp, Homo sapiens
tacaacatgtggtcctttatga

SEQ ID NO: 8459245 - DNA, 22 bp, Homo sapiens
tacaacatgtaaagtggtttaa

SEQ ID NO: 8459246 - DNA, 22 bp, Homo sapiens
tacaacataacgggcattcagt

SEQ ID NO: 8459247 - DNA, 22 bp, Homo sapiens
tacaacataacgggcattcagt

SEQ ID NO: 8459248 - DNA, 21 bp, Homo sapiens
tacaagaccggattcgggccc

SEQ ID NO: 8459249 - DNA, 22 bp, Homo sapiens
tacaagaatgtcttaaaagctc

SEQ ID NO: 8459250 - DNA, 22 bp, Homo sapiens
tacaagaatttctttctggttg

SEQ ID NO: 8459251 - DNA, 21 bp, Homo sapiens
tacaagaccggattcgggccc

SEQ ID NO: 8459252 - DNA, 22 bp, Homo sapiens
tacaagacgagggaagttcttt

SEQ ID NO: 8459253 - DNA, 22 bp, Homo sapiens
tacaagaaggatggagcccact

SEQ ID NO: 8459254 - DNA, 22 bp, Homo sapiens
tacaagaaggaaaactagcaat

SEQ ID NO: 8459255 - DNA, 22 bp, Homo sapiens
tacaagaagaggcagagctgga

SEQ ID NO: 8459256 - DNA, 22 bp, Homo sapiens
tacaagaatgtcttaaaagctc

SEQ ID NO: 8459257 - DNA, 20 bp, Homo sapiens
tacaagaatccccagttgtc

SEQ ID NO: 8459258 - DNA, 22 bp, Homo sapiens
tacaagaaggatggagcccact

SEQ ID NO: 8459259 - DNA, 22 bp, Homo sapiens
tacaagataagaattggcaagg

SEQ ID NO: 8459260 - DNA, 22 bp, Homo sapiens
tacaagaggtatatagaaacag

SEQ ID NO: 8459261 - DNA, 21 bp, Homo sapiens
tacaagatagaggtaatatat

SEQ ID NO: 8459262 - DNA, 22 bp, Homo sapiens
tacaagatgacaggtgcatgat

SEQ ID NO: 8459263 - DNA, 22 bp, Homo sapiens
tacacaatgacttaagatgtca

SEQ ID NO: 8459264 - DNA, 22 bp, Homo sapiens
tacacaatctgtttttccattt

SEQ ID NO: 8459265 - DNA, 22 bp, Homo sapiens
tacacaactgacaaccattctg

SEQ ID NO: 8459266 - DNA, 22 bp, Homo sapiens
tacatgtatgtgttaatatctg

SEQ ID NO: 8459267 - DNA, 22 bp, Homo sapiens
tacatgtatgtgtacgtgcatg

SEQ ID NO: 8459268 - DNA, 22 bp, Homo sapiens
tacatgtatgtgttaatatctg

SEQ ID NO: 8459269 - DNA, 22 bp, Homo sapiens
tacatgtatgtgttaatatctg

SEQ ID NO: 8459270 - DNA, 22 bp, Homo sapiens
tacatgtacatgcataggtaga

SEQ ID NO: 8459271 - DNA, 20 bp, Homo sapiens
taccaacagcaggaagcata

SEQ ID NO: 8459272 - DNA, 22 bp, Homo sapiens
taccaaatgtaatcattctaat

SEQ ID NO: 8459273 - DNA, 22 bp, Homo sapiens
tacatgtaagacatgagactct

SEQ ID NO: 8459274 - DNA, 22 bp, Homo sapiens
tacatgtaattttcatagtaag

SEQ ID NO: 8459275 - DNA, 22 bp, Homo sapiens
tacatgtaagacatgagactct

SEQ ID NO: 8459276 - DNA, 22 bp, Homo sapiens
tacatggtggtggcacttgact

SEQ ID NO: 8459277 - DNA, 22 bp, Homo sapiens
tacatgcttctatatgtgaagt

SEQ ID NO: 8459278 - DNA, 22 bp, Homo sapiens
tacatgcttaaaatgcaatgtt

SEQ ID NO: 8459279 - DNA, 22 bp, Homo sapiens
tacatgctccttatgagaatct

SEQ ID NO: 8459280 - DNA, 22 bp, Homo sapiens
tacatgctccactttctcctgt

SEQ ID NO: 8459281 - DNA, 22 bp, Homo sapiens
tacatgctggtgactgtagaca

SEQ ID NO: 8459282 - DNA, 22 bp, Homo sapiens
tacatgctcagtaactttcagt

SEQ ID NO: 8459283 - DNA, 22 bp, Homo sapiens
tacatgaagaaaattaagcagt

SEQ ID NO: 8459284 - DNA, 22 bp, Homo sapiens
tacatgaagaaaattaagcagt

SEQ ID NO: 8459285 - DNA, 22 bp, Homo sapiens
tacatgaagatgaatgtatggc

SEQ ID NO: 8459286 - DNA, 22 bp, Homo sapiens
tacatgaatgtttcaatattgt

SEQ ID NO: 8459287 - DNA, 22 bp, Homo sapiens
tacatgaatgtttcaatattgt

SEQ ID NO: 8459288 - DNA, 22 bp, Homo sapiens
tacagtgtgacatttctacaaa

SEQ ID NO: 8459289 - DNA, 22 bp, Homo sapiens
tacagtgtttcccccaggatag

SEQ ID NO: 8459290 - DNA, 22 bp, Homo sapiens
tacagtgtgacatttctacaaa

SEQ ID NO: 8459291 - DNA, 22 bp, Homo sapiens
tacagttaaaaagttcaatggt

SEQ ID NO: 8459292 - DNA, 22 bp, Homo sapiens
tacatgcaattaagagggtgaa

SEQ ID NO: 8459293 - DNA, 22 bp, Homo sapiens
tacatgaatgtttcaatattgt

SEQ ID NO: 8459294 - DNA, 22 bp, Homo sapiens
tacatgcatgtcacagaatgaa

SEQ ID NO: 8459295 - DNA, 19 bp, Homo sapiens
tacatgcagcaggcacgca

SEQ ID NO: 8459296 - DNA, 22 bp, Homo sapiens
tacagagatactctagatcaaa

SEQ ID NO: 8459297 - DNA, 22 bp, Homo sapiens
tacagagatactctagatcaaa

SEQ ID NO: 8459298 - DNA, 22 bp, Homo sapiens
tacagaggagaccaaggctcag

SEQ ID NO: 8459299 - DNA, 22 bp, Homo sapiens
tacagaggaggggattttaata

SEQ ID NO: 8459300 - DNA, 22 bp, Homo sapiens
tacagaggagaccaaggctcag

SEQ ID NO: 8459301 - DNA, 22 bp, Homo sapiens
tacagaggcacatgcaattttc

SEQ ID NO: 8459302 - DNA, 22 bp, Homo sapiens
tacagaggaggtggttgggagt

SEQ ID NO: 8459303 - DNA, 22 bp, Homo sapiens
tacagagggtaattgatcaagg

SEQ ID NO: 8459304 - DNA, 22 bp, Homo sapiens
tacagaggggacatggaagaca

SEQ ID NO: 8459305 - DNA, 22 bp, Homo sapiens
tacagagggattatctaagggt

SEQ ID NO: 8459306 - DNA, 22 bp, Homo sapiens
tacagaggctgggttttcaggg

SEQ ID NO: 8459307 - DNA, 22 bp, Homo sapiens
tacagtgctttttggtggagaa

SEQ ID NO: 8459308 - DNA, 22 bp, Homo sapiens
tacagtgctttttggtggagaa

SEQ ID NO: 8459309 - DNA, 22 bp, Homo sapiens
tacagtgtatgtatttgtaggt

SEQ ID NO: 8459310 - DNA, 22 bp, Homo sapiens
tacagtggggagctcaggagag

SEQ ID NO: 8459311 - DNA, 22 bp, Homo sapiens
tacagtgcaatgtgatgtagat

SEQ ID NO: 8459312 - DNA, 22 bp, Homo sapiens
tacagtgcaatgtgatgtagat

SEQ ID NO: 8459313 - DNA, 22 bp, Homo sapiens
tacagtgcacatttcttaggaa

SEQ ID NO: 8459314 - DNA, 22 bp, Homo sapiens
tacagtgcacatttcttaggaa

SEQ ID NO: 8459315 - DNA, 22 bp, Homo sapiens
tacagtgcatagaggcatgata

SEQ ID NO: 8459316 - DNA, 22 bp, Homo sapiens
tacagtgcatagaggcatgata

SEQ ID NO: 8459317 - DNA, 22 bp, Homo sapiens
tacagtgcgatttttaggcctc

SEQ ID NO: 8459318 - DNA, 22 bp, Homo sapiens
tacagtgcgggtgcgggcctct

SEQ ID NO: 8459319 - DNA, 22 bp, Homo sapiens
tacagtgcgatttttaggcctc

SEQ ID NO: 8459320 - DNA, 22 bp, Homo sapiens
tacagtgcttggtatctagtaa

SEQ ID NO: 8459321 - DNA, 22 bp, Homo sapiens
tacagtgcttggtatctagtaa

SEQ ID NO: 8459322 - DNA, 22 bp, Homo sapiens
tacagtgctagaacctgctgta

SEQ ID NO: 8459323 - DNA, 22 bp, Homo sapiens
tacagtcaagcataagaagtca

SEQ ID NO: 8459324 - DNA, 22 bp, Homo sapiens
tacagtcaacattgatgatgat

SEQ ID NO: 8459325 - DNA, 22 bp, Homo sapiens
tacagtgagactggctcaggga

SEQ ID NO: 8459326 - DNA, 23 bp, Homo sapiens
tactacagggtcttgctatgaat

SEQ ID NO: 8459327 - DNA, 22 bp, Homo sapiens
tactacatacagaatttagaga

SEQ ID NO: 8459328 - DNA, 22 bp, Homo sapiens
taccattttgaaacatttcatc

SEQ ID NO: 8459329 - DNA, 22 bp, Homo sapiens
tactacaagggccctaaaaggt

SEQ ID NO: 8459330 - DNA, 22 bp, Homo sapiens
taccatttgagagagaacataa

SEQ ID NO: 8459331 - DNA, 22 bp, Homo sapiens
taccatttgagagagaacataa

SEQ ID NO: 8459332 - DNA, 22 bp, Homo sapiens
taccatttgagagagaacataa

SEQ ID NO: 8459333 - DNA, 22 bp, Homo sapiens
taccatttcattctttcctcat

SEQ ID NO: 8459334 - DNA, 22 bp, Homo sapiens
taccatttctacatatcttgtc

SEQ ID NO: 8459335 - DNA, 22 bp, Homo sapiens
tactagttctcatatgaaataa

SEQ ID NO: 8459336 - DNA, 22 bp, Homo sapiens
tactagaagctgtaatttttca

SEQ ID NO: 8459337 - DNA, 23 bp, Homo sapiens
tactatggttattatccctctcc

SEQ ID NO: 8459338 - DNA, 22 bp, Homo sapiens
tactagtttttaggaaaagtga

SEQ ID NO: 8459339 - DNA, 22 bp, Homo sapiens
taccacagtttatctattcagc

SEQ ID NO: 8459340 - DNA, 22 bp, Homo sapiens
taccacagtttatctattcagc

SEQ ID NO: 8459341 - DNA, 22 bp, Homo sapiens
taccaagtgataataggaaagc

SEQ ID NO: 8459342 - DNA, 22 bp, Homo sapiens
taccacctccatcctcctttca

SEQ ID NO: 8459343 - DNA, 22 bp, Homo sapiens
taccagcaactggaagtcagat

SEQ ID NO: 8459344 - DNA, 22 bp, Homo sapiens
taccaggagttacaggcagcag

SEQ ID NO: 8459345 - DNA, 22 bp, Homo sapiens
taccaggaatggggtcaccgtc

SEQ ID NO: 8459346 - DNA, 15 bp, Homo sapiens
taccagctgatccgt

SEQ ID NO: 8459347 - DNA, 22 bp, Homo sapiens
taccagcttccttcaagatgtg

SEQ ID NO: 8459348 - DNA, 22 bp, Homo sapiens
taccagcctctgttgggggtgg

SEQ ID NO: 8459349 - DNA, 22 bp, Homo sapiens
taccagccttttaacatgggcc

SEQ ID NO: 8459350 - DNA, 22 bp, Homo sapiens
taccagctcacacaatctttgt

SEQ ID NO: 8459351 - DNA, 22 bp, Homo sapiens
taccagcctgaccctgtctgac

SEQ ID NO: 8459352 - DNA, 22 bp, Homo sapiens
taccagcctcagttgtgagccc

SEQ ID NO: 8459353 - DNA, 19 bp, Homo sapiens
taccagcctcctgcctgat

SEQ ID NO: 8459354 - DNA, 19 bp, Homo sapiens
taccatccaagctggtttg

SEQ ID NO: 8459355 - DNA, 22 bp, Homo sapiens
taccaggcagctgcacagaggc

SEQ ID NO: 8459356 - DNA, 22 bp, Homo sapiens
taccatttcagtaaaaacttag

SEQ ID NO: 8459357 - DNA, 22 bp, Homo sapiens
taccatttcagtaaaaacttag

SEQ ID NO: 8459358 - DNA, 22 bp, Homo sapiens
taccatttcagtaaaaacttag

SEQ ID NO: 8459359 - DNA, 22 bp, Homo sapiens
taccattattcacatgatcttt

SEQ ID NO: 8459360 - DNA, 22 bp, Homo sapiens
taccatgtcaagcgagacatgt

SEQ ID NO: 8459361 - DNA, 22 bp, Homo sapiens
taccatttacttgaaaataaaa

SEQ ID NO: 8459362 - DNA, 19 bp, Homo sapiens
taccatgttgactttcctg

SEQ ID NO: 8459363 - DNA, 22 bp, Homo sapiens
tacttacagagcttataagtta

SEQ ID NO: 8459364 - DNA, 22 bp, Homo sapiens
tacttacagaaggaagcaattg

SEQ ID NO: 8459365 - DNA, 22 bp, Homo sapiens
tacttacagaaggaagcaattg

SEQ ID NO: 8459366 - DNA, 22 bp, Homo sapiens
tacttacagagcttataagtta

SEQ ID NO: 8459367 - DNA, 22 bp, Homo sapiens
tacttaaaactgatagaatctc

SEQ ID NO: 8459368 - DNA, 22 bp, Homo sapiens
tacttaaataattgctgctatt

SEQ ID NO: 8459369 - DNA, 22 bp, Homo sapiens
tactgttaatgttaaattcagg

SEQ ID NO: 8459370 - DNA, 22 bp, Homo sapiens
tactgttagagcgatttgtcct

SEQ ID NO: 8459371 - DNA, 22 bp, Homo sapiens
tactgttagagccagaaaccta

SEQ ID NO: 8459372 - DNA, 18 bp, Homo sapiens
tactgtttaattgattac

SEQ ID NO: 8459373 - DNA, 22 bp, Homo sapiens
tactgttttctttatagtacag

SEQ ID NO: 8459374 - DNA, 22 bp, Homo sapiens
tactgtttttgcctctttagaa

SEQ ID NO: 8459375 - DNA, 22 bp, Homo sapiens
tacttaaaaattatcaaagtgg

SEQ ID NO: 8459376 - DNA, 22 bp, Homo sapiens
tactccagacattctgtcctcg

SEQ ID NO: 8459377 - DNA, 22 bp, Homo sapiens
tactgaaactcttgtaaatatc

SEQ ID NO: 8459378 - DNA, 22 bp, Homo sapiens
tactgaaagaatacataatttc

SEQ ID NO: 8459379 - DNA, 22 bp, Homo sapiens
tactgtactgtcttttttgctg

SEQ ID NO: 8459380 - DNA, 22 bp, Homo sapiens
tactgtactcaacatgtgagtt

SEQ ID NO: 8459381 - DNA, 22 bp, Homo sapiens
tactgtacattccgtttgttgc

SEQ ID NO: 8459382 - DNA, 22 bp, Homo sapiens
tactgtactgcagttctgcaaa

SEQ ID NO: 8459383 - DNA, 22 bp, Homo sapiens
tactgtgtgcccagccgagctg

SEQ ID NO: 8459384 - DNA, 22 bp, Homo sapiens
taacatattgtgtggcactagg

SEQ ID NO: 8459385 - DNA, 22 bp, Homo sapiens
taacagttttgagttttgcttc

SEQ ID NO: 8459386 - DNA, 22 bp, Homo sapiens
taacataacttttccttgaccc

SEQ ID NO: 8459387 - DNA, 22 bp, Homo sapiens
taacagttggtgtaatttcttg

SEQ ID NO: 8459388 - DNA, 22 bp, Homo sapiens
taacagttggtgtaatttcttg

SEQ ID NO: 8459389 - DNA, 22 bp, Homo sapiens
taacatgaaactccaaatggta

SEQ ID NO: 8459390 - DNA, 22 bp, Homo sapiens
taacatgatttgctatttagat

SEQ ID NO: 8459391 - DNA, 22 bp, Homo sapiens
taacagtaaagtaagttagctt

SEQ ID NO: 8459392 - DNA, 22 bp, Homo sapiens
taacagggtaggagggcatgaa

SEQ ID NO: 8459393 - DNA, 22 bp, Homo sapiens
taacagtaaagtaagttagctt

SEQ ID NO: 8459394 - DNA, 20 bp, Homo sapiens
taacagtaagtgatgttaca

SEQ ID NO: 8459395 - DNA, 22 bp, Homo sapiens
taacagtaaagtaagttagctt

SEQ ID NO: 8459396 - DNA, 22 bp, Homo sapiens
taacagtacatccttttctctt

SEQ ID NO: 8459397 - DNA, 20 bp, Homo sapiens
taacagtaagtgatgttaca

SEQ ID NO: 8459398 - DNA, 22 bp, Homo sapiens
taacagtagccttatgtggtct

SEQ ID NO: 8459399 - DNA, 22 bp, Homo sapiens
taacagtagccttatgtggtct

SEQ ID NO: 8459400 - DNA, 22 bp, Homo sapiens
taacagtaccattaactttgat

SEQ ID NO: 8459401 - DNA, 22 bp, Homo sapiens
taacagtatagcctaacatttc

SEQ ID NO: 8459402 - DNA, 22 bp, Homo sapiens
taacagtatagcctaacatttc

SEQ ID NO: 8459403 - DNA, 22 bp, Homo sapiens
taacagtatccccatttgcaag

SEQ ID NO: 8459404 - DNA, 22 bp, Homo sapiens
taacagtatatttaccaaacct

SEQ ID NO: 8459405 - DNA, 22 bp, Homo sapiens
taacagtattgaagataaacta

SEQ ID NO: 8459406 - DNA, 22 bp, Homo sapiens
taacagtattgaagataaacta

SEQ ID NO: 8459407 - DNA, 22 bp, Homo sapiens
taaatgtggagactcaggagtc

SEQ ID NO: 8459408 - DNA, 22 bp, Homo sapiens
taaatgttatgcccatcatcca

SEQ ID NO: 8459409 - DNA, 22 bp, Homo sapiens
taaatgtgttagtcatggtttt

SEQ ID NO: 8459410 - DNA, 22 bp, Homo sapiens
taaatgtttagtcttatttggg

SEQ ID NO: 8459411 - DNA, 22 bp, Homo sapiens
taagagcactgaagtcttctta

SEQ ID NO: 8459412 - DNA, 22 bp, Homo sapiens
taagagaactggatagatagga

SEQ ID NO: 8459413 - DNA, 22 bp, Homo sapiens
taagacttccaggaaaaggtgg

SEQ ID NO: 8459414 - DNA, 22 bp, Homo sapiens
taagacttcattagtaatatgg

SEQ ID NO: 8459415 - DNA, 18 bp, Homo sapiens
taagagcagactgtaggc

SEQ ID NO: 8459416 - DNA, 22 bp, Homo sapiens
taagagcttagctaaggatgtg

SEQ ID NO: 8459417 - DNA, 21 bp, Homo sapiens
taagcatatcagatagactct

SEQ ID NO: 8459418 - DNA, 22 bp, Homo sapiens
taagacagggtctattcttagt

SEQ ID NO: 8459419 - DNA, 18 bp, Homo sapiens
taacatgttttcattaag

SEQ ID NO: 8459420 - DNA, 21 bp, Homo sapiens
taagacagtatgaatactttc

SEQ ID NO: 8459421 - DNA, 22 bp, Homo sapiens
taagactgtgagctcagagact

SEQ ID NO: 8459422 - DNA, 21 bp, Homo sapiens
taaaactgtaactttgtcctg

SEQ ID NO: 8459423 - DNA, 22 bp, Homo sapiens
taaaactgcttggtatggtcta

SEQ ID NO: 8459424 - DNA, 22 bp, Homo sapiens
taaaactgaatacatactgagg

SEQ ID NO: 8459425 - DNA, 22 bp, Homo sapiens
taaaactgaatacatactgagg

SEQ ID NO: 8459426 - DNA, 22 bp, Homo sapiens
taaaactgaatacatactgagg

SEQ ID NO: 8459427 - DNA, 22 bp, Homo sapiens
gttttacaaatgacggcattca

SEQ ID NO: 8459428 - DNA, 22 bp, Homo sapiens
gttttacaaatgacggcattca

SEQ ID NO: 8459429 - DNA, 21 bp, Homo sapiens
taaaagatgacaagacagctc

SEQ ID NO: 8459430 - DNA, 21 bp, Homo sapiens
taaaagatgacaagacagctc

SEQ ID NO: 8459431 - DNA, 22 bp, Homo sapiens
taaaagatatcttagggatttg

SEQ ID NO: 8459432 - DNA, 22 bp, Homo sapiens
taaaagatatcttagggatttg

SEQ ID NO: 8459433 - DNA, 22 bp, Homo sapiens
taaaagatcactggctgcttta

SEQ ID NO: 8459434 - DNA, 22 bp, Homo sapiens
taaaagacatataactgtagga

SEQ ID NO: 8459435 - DNA, 22 bp, Homo sapiens
taaaagacatataactgtagga

SEQ ID NO: 8459436 - DNA, 22 bp, Homo sapiens
taaaagagaatggataacagag

SEQ ID NO: 8459437 - DNA, 22 bp, Homo sapiens
taaaagaccctctagagtccca

SEQ ID NO: 8459438 - DNA, 22 bp, Homo sapiens
taaaagaccctctagagtccca

SEQ ID NO: 8459439 - DNA, 22 bp, Homo sapiens
taaaagaccacaaggtggtaat

SEQ ID NO: 8459440 - DNA, 22 bp, Homo sapiens
taaaagttagctaggacaaagt

SEQ ID NO: 8459441 - DNA, 20 bp, Homo sapiens
taaagacataagctactatc

SEQ ID NO: 8459442 - DNA, 22 bp, Homo sapiens
taaagacagatggaccagccat

SEQ ID NO: 8459443 - DNA, 23 bp, Homo sapiens
taaagacagccttcaggattctg

SEQ ID NO: 8459444 - DNA, 22 bp, Homo sapiens
taaagacataggatcagggaga

SEQ ID NO: 8459445 - DNA, 20 bp, Homo sapiens
taaagacataagctactatc

SEQ ID NO: 8459446 - DNA, 22 bp, Homo sapiens
taaagacatgcaaagtctaatt

SEQ ID NO: 8459447 - DNA, 22 bp, Homo sapiens
taaagacatggtgtaggtgaac

SEQ ID NO: 8459448 - DNA, 22 bp, Homo sapiens
taaagacatgcaaagtctaatt

SEQ ID NO: 8459449 - DNA, 22 bp, Homo sapiens
taaaaggaggttgaagctgtca

SEQ ID NO: 8459450 - DNA, 22 bp, Homo sapiens
taaaaggaggttgaagctgtca

SEQ ID NO: 8459451 - DNA, 19 bp, Homo sapiens
taaaaggatgtggaaggat

SEQ ID NO: 8459452 - DNA, 22 bp, Homo sapiens
taaaaggattagcaggatgggc

SEQ ID NO: 8459453 - DNA, 22 bp, Homo sapiens
taaaagattttataggaacaag

SEQ ID NO: 8459454 - DNA, 22 bp, Homo sapiens
taaaagattttataggaacaag

SEQ ID NO: 8459455 - DNA, 22 bp, Homo sapiens
taaaagattttataggaacaag

SEQ ID NO: 8459456 - DNA, 22 bp, Homo sapiens
taaaagctcttctgttgagtta

SEQ ID NO: 8459457 - DNA, 22 bp, Homo sapiens
taaaagctgagatatcctgtac

SEQ ID NO: 8459458 - DNA, 22 bp, Homo sapiens
taaaagtatactttcaaaggag

SEQ ID NO: 8459459 - DNA, 22 bp, Homo sapiens
taaaagtaggaatgaaacgcat

SEQ ID NO: 8459460 - DNA, 22 bp, Homo sapiens
taaaaggcacttggatgctgag

SEQ ID NO: 8459461 - DNA, 22 bp, Homo sapiens
taaaaggcaatactagatgagt

SEQ ID NO: 8459462 - DNA, 22 bp, Homo sapiens
taaatgcagttagtacttgcca

SEQ ID NO: 8459463 - DNA, 22 bp, Homo sapiens
taaatgataataatgctagtgt

SEQ ID NO: 8459464 - DNA, 22 bp, Homo sapiens
taaagcacatatcttacaataa

SEQ ID NO: 8459465 - DNA, 22 bp, Homo sapiens
taaagcacgtctatttaatgat

SEQ ID NO: 8459466 - DNA, 22 bp, Homo sapiens
taaagcagccagggtctaagcc

SEQ ID NO: 8459467 - DNA, 22 bp, Homo sapiens
taaatgatttatgtatgtgaaa

SEQ ID NO: 8459468 - DNA, 22 bp, Homo sapiens
taaatgcaagggaaaggcaaga

SEQ ID NO: 8459469 - DNA, 22 bp, Homo sapiens
taaagataagacatcaactgag

SEQ ID NO: 8459470 - DNA, 22 bp, Homo sapiens
taaagcaaggaatagagtagtc

SEQ ID NO: 8459471 - DNA, 22 bp, Homo sapiens
taaagcaaggaatagagtagtc

SEQ ID NO: 8459472 - DNA, 22 bp, Homo sapiens
taaagcaagacacacccatagc

SEQ ID NO: 8459473 - DNA, 23 bp, Homo sapiens
taaagcaaagtcaagtgcactcc

SEQ ID NO: 8459474 - DNA, 23 bp, Homo sapiens
taaagcaaagtcaagtgcactcc

SEQ ID NO: 8459475 - DNA, 22 bp, Homo sapiens
taaagcaatttgagcaagttct

SEQ ID NO: 8459476 - DNA, 22 bp, Homo sapiens
gttatacatatgtgttaacaaa

SEQ ID NO: 8459477 - DNA, 22 bp, Homo sapiens
gttataaatgactgcaaaagtt

SEQ ID NO: 8459478 - DNA, 22 bp, Homo sapiens
gttatattcaaaatgaggctgt

SEQ ID NO: 8459479 - DNA, 22 bp, Homo sapiens
gttatattcaaaatgaggctgt

SEQ ID NO: 8459480 - DNA, 22 bp, Homo sapiens
gttatcttctatttctcatact

SEQ ID NO: 8459481 - DNA, 22 bp, Homo sapiens
gttatcttccctttgatgattt

SEQ ID NO: 8459482 - DNA, 22 bp, Homo sapiens
gttatattgccaagtatattgt

SEQ ID NO: 8459483 - DNA, 22 bp, Homo sapiens
gttatattgccaagtatattgt

SEQ ID NO: 8459484 - DNA, 22 bp, Homo sapiens
gttatattcaaaatgaggctgt

SEQ ID NO: 8459485 - DNA, 22 bp, Homo sapiens
gttatattggcagaagagaaga

SEQ ID NO: 8459486 - DNA, 22 bp, Homo sapiens
gttatattggcagaagagaaga

SEQ ID NO: 8459487 - DNA, 22 bp, Homo sapiens
gttctgcttaaattattgatcc

SEQ ID NO: 8459488 - DNA, 22 bp, Homo sapiens
gttctgctgtgtctcagcaggt

SEQ ID NO: 8459489 - DNA, 22 bp, Homo sapiens
gttattgtccagcacagttggg

SEQ ID NO: 8459490 - DNA, 22 bp, Homo sapiens
gttatttataaggtgtaactcc

SEQ ID NO: 8459491 - DNA, 22 bp, Homo sapiens
gtgtttataggagtgaatgctg

SEQ ID NO: 8459492 - DNA, 19 bp, Homo sapiens
gtgtttactgtgtgcagaa

SEQ ID NO: 8459493 - DNA, 22 bp, Homo sapiens
gtgtttacagataaagtgagct

SEQ ID NO: 8459494 - DNA, 22 bp, Homo sapiens
gtgtttatacagcaaagagcat

SEQ ID NO: 8459495 - DNA, 22 bp, Homo sapiens
gttaaataacctcatgtccgtt

SEQ ID NO: 8459496 - DNA, 22 bp, Homo sapiens
gttaaataacctcatgtccgtt

SEQ ID NO: 8459497 - DNA, 18 bp, Homo sapiens
gttaacaattactaacgc

SEQ ID NO: 8459498 - DNA, 22 bp, Homo sapiens
gttaacaagaattactctggaa

SEQ ID NO: 8459499 - DNA, 22 bp, Homo sapiens
gttaaattcgatgatggataaa

SEQ ID NO: 8459500 - DNA, 22 bp, Homo sapiens
gtgctggctggggcatcaggca

SEQ ID NO: 8459501 - DNA, 22 bp, Homo sapiens
gtgctggctggacatggagcac

SEQ ID NO: 8459502 - DNA, 21 bp, Homo sapiens
gtgctgggacacagccaggct

SEQ ID NO: 8459503 - DNA, 21 bp, Homo sapiens
gtgctgggacacagccaggct

SEQ ID NO: 8459504 - DNA, 21 bp, Homo sapiens
gtgctgggacacagccaggct

SEQ ID NO: 8459505 - DNA, 21 bp, Homo sapiens
gtgctgggacacagccaggct

SEQ ID NO: 8459506 - DNA, 22 bp, Homo sapiens
gtgctggctgccaggaggctgc

SEQ ID NO: 8459507 - DNA, 22 bp, Homo sapiens
gtgttgacacagccatcttgtc

SEQ ID NO: 8459508 - DNA, 22 bp, Homo sapiens
gtgttcttttgcttcacagaaa

SEQ ID NO: 8459509 - DNA, 17 bp, Homo sapiens
gtgttcacaatgactgt

SEQ ID NO: 8459510 - DNA, 22 bp, Homo sapiens
gtgttcatggatgtcaatttga

SEQ ID NO: 8459511 - DNA, 22 bp, Homo sapiens
gtgttctctctacaggaattta

SEQ ID NO: 8459512 - DNA, 22 bp, Homo sapiens
gtgttcattgctagtgaggtgt

SEQ ID NO: 8459513 - DNA, 22 bp, Homo sapiens
gttgacagaaaaataacatagc

SEQ ID NO: 8459514 - DNA, 22 bp, Homo sapiens
gttgacagtgaccctgaaagca

SEQ ID NO: 8459515 - DNA, 22 bp, Homo sapiens
gttgaataattcatagaagcta

SEQ ID NO: 8459516 - DNA, 22 bp, Homo sapiens
gttgaaatcctaaccccctagt

SEQ ID NO: 8459517 - DNA, 22 bp, Homo sapiens
gttgaaatgagggattaatcag

SEQ ID NO: 8459518 - DNA, 22 bp, Homo sapiens
gttgaaatttgtgataatttag

SEQ ID NO: 8459519 - DNA, 22 bp, Homo sapiens
gttgaaaatgactttataccat

SEQ ID NO: 8459520 - DNA, 22 bp, Homo sapiens
gttgaaaatgactttataccat

SEQ ID NO: 8459521 - DNA, 22 bp, Homo sapiens
gttctttaagtggagaaggaaa

SEQ ID NO: 8459522 - DNA, 19 bp, Homo sapiens
gttctttcatagtaagagc

SEQ ID NO: 8459523 - DNA, 22 bp, Homo sapiens
gttctttaggggcccaatttcc

SEQ ID NO: 8459524 - DNA, 19 bp, Homo sapiens
gttctttcatagtaagagc

SEQ ID NO: 8459525 - DNA, 22 bp, Homo sapiens
gttcttttggtagagtgtgcat

SEQ ID NO: 8459526 - DNA, 19 bp, Homo sapiens
gttcttttcacctctgtgc

SEQ ID NO: 8459527 - DNA, 19 bp, Homo sapiens
gttcttttcacctctgtgc

SEQ ID NO: 8459528 - DNA, 19 bp, Homo sapiens
gttcttttcacctctgtgc

SEQ ID NO: 8459529 - DNA, 22 bp, Homo sapiens
gttgaaaatacagattcctagg

SEQ ID NO: 8459530 - DNA, 22 bp, Homo sapiens
gttgaaaatacagattcctagg

SEQ ID NO: 8459531 - DNA, 22 bp, Homo sapiens
gttctttaaactgctgctctgt

SEQ ID NO: 8459532 - DNA, 22 bp, Homo sapiens
gttctttaacctagtctcattt

SEQ ID NO: 8459533 - DNA, 22 bp, Homo sapiens
gtttcaaagcacagctcacatt

SEQ ID NO: 8459534 - DNA, 22 bp, Homo sapiens
gttgagagttaagcgggctaat

SEQ ID NO: 8459535 - DNA, 22 bp, Homo sapiens
gtttatatgtgtgccactctta

SEQ ID NO: 8459536 - DNA, 22 bp, Homo sapiens
gtttatattcaacggagtatct

SEQ ID NO: 8459537 - DNA, 22 bp, Homo sapiens
gtttatcacaataaataattct

SEQ ID NO: 8459538 - DNA, 22 bp, Homo sapiens
gtttatcattattattagcaac

SEQ ID NO: 8459539 - DNA, 22 bp, Homo sapiens
gtttctttctattgactgaaca

SEQ ID NO: 8459540 - DNA, 22 bp, Homo sapiens
gtttcttttgtgatcaccaacc

SEQ ID NO: 8459541 - DNA, 22 bp, Homo sapiens
gtttcttttaaaatatgtagac

SEQ ID NO: 8459542 - DNA, 22 bp, Homo sapiens
gtttcttttaaaatatgtagac

SEQ ID NO: 8459543 - DNA, 22 bp, Homo sapiens
gtttcactgcaaactgactttt

SEQ ID NO: 8459544 - DNA, 22 bp, Homo sapiens
gtttcaaataggtttcagcaaa

SEQ ID NO: 8459545 - DNA, 22 bp, Homo sapiens
gtttgtgtcaatgacttctgca

SEQ ID NO: 8459546 - DNA, 22 bp, Homo sapiens
gtttgtcccacttctggcagaa

SEQ ID NO: 8459547 - DNA, 22 bp, Homo sapiens
gtttgcatgtgtacttaattgg

SEQ ID NO: 8459548 - DNA, 22 bp, Homo sapiens
gtttgcatggaagacagtgagt

SEQ ID NO: 8459549 - DNA, 22 bp, Homo sapiens
gtttgcatgtattaagtcaata

SEQ ID NO: 8459550 - DNA, 22 bp, Homo sapiens
gtttgcatgtgtacttaattgg

SEQ ID NO: 8459551 - DNA, 21 bp, Homo sapiens
gtttgcatgaacaagtcagcc

SEQ ID NO: 8459552 - DNA, 22 bp, Homo sapiens
gtttgcatatctgtgaaatgga

SEQ ID NO: 8459553 - DNA, 22 bp, Homo sapiens
gagtagcagccacagaggaccc

SEQ ID NO: 8459554 - DNA, 22 bp, Homo sapiens
gagtagcattctagagtatgct

SEQ ID NO: 8459555 - DNA, 22 bp, Homo sapiens
gagtacttaactccaaatagga

SEQ ID NO: 8459556 - DNA, 22 bp, Homo sapiens
gagtagggtttccaggttagag

SEQ ID NO: 8459557 - DNA, 22 bp, Homo sapiens
gagtattcaatatatacaaatg

SEQ ID NO: 8459558 - DNA, 22 bp, Homo sapiens
gagtatttatatgtaagtacct

SEQ ID NO: 8459559 - DNA, 22 bp, Homo sapiens
gcaaggaggctggtggaggaag

SEQ ID NO: 8459560 - DNA, 22 bp, Homo sapiens
gcaaggagactgtagggccaag

SEQ ID NO: 8459561 - DNA, 22 bp, Homo sapiens
gcaaggagactgtagggccaag

SEQ ID NO: 8459562 - DNA, 22 bp, Homo sapiens
gcaaggaagcagagttgctatc

SEQ ID NO: 8459563 - DNA, 17 bp, Homo sapiens
gcaaggaagttctttgc

SEQ ID NO: 8459564 - DNA, 22 bp, Homo sapiens
gcaaggaagagcaggtggtgct

SEQ ID NO: 8459565 - DNA, 22 bp, Homo sapiens
gcaatacagtaggtttattggt

SEQ ID NO: 8459566 - DNA, 22 bp, Homo sapiens
gcaataaacatgtttgatgcgc

SEQ ID NO: 8459567 - DNA, 18 bp, Homo sapiens
gcaaggctcaggccaggc

SEQ ID NO: 8459568 - DNA, 22 bp, Homo sapiens
gcaaggcagcgcggagtagcta

SEQ ID NO: 8459569 - DNA, 20 bp, Homo sapiens
gcaaggcacagtgaggaggg

SEQ ID NO: 8459570 - DNA, 22 bp, Homo sapiens
gcaaggcagcatccttttgagg

SEQ ID NO: 8459571 - DNA, 21 bp, Homo sapiens
gcaaggcaatgccatgatttc

SEQ ID NO: 8459572 - DNA, 22 bp, Homo sapiens
gcacatggcggccagcaggtga

SEQ ID NO: 8459573 - DNA, 22 bp, Homo sapiens
gcacatgtgagagtagaggcct

SEQ ID NO: 8459574 - DNA, 22 bp, Homo sapiens
gcacatgtcttattcactgtta

SEQ ID NO: 8459575 - DNA, 22 bp, Homo sapiens
gcacattgttactcttactgtg

SEQ ID NO: 8459576 - DNA, 22 bp, Homo sapiens
gcacagcacagcaacatgtttt

SEQ ID NO: 8459577 - DNA, 22 bp, Homo sapiens
gcacagagagtcccgggtgccc

SEQ ID NO: 8459578 - DNA, 20 bp, Homo sapiens
gcacagagatgagcaaagta

SEQ ID NO: 8459579 - DNA, 22 bp, Homo sapiens
gcacagagagcagtgggggaca

SEQ ID NO: 8459580 - DNA, 22 bp, Homo sapiens
gcacagagagcagtgggggaca

SEQ ID NO: 8459581 - DNA, 22 bp, Homo sapiens
gcacagaagtaaaatacaagtc

SEQ ID NO: 8459582 - DNA, 22 bp, Homo sapiens
gcacagaagtaaaatacaagtc

SEQ ID NO: 8459583 - DNA, 22 bp, Homo sapiens
gcacagaataacactctgggct

SEQ ID NO: 8459584 - DNA, 22 bp, Homo sapiens
gcacagacatatccatatttac

SEQ ID NO: 8459585 - DNA, 22 bp, Homo sapiens
gcacagactcaccttaatttga

SEQ ID NO: 8459586 - DNA, 22 bp, Homo sapiens
gcacagaaccagacatgaggca

SEQ ID NO: 8459587 - DNA, 22 bp, Homo sapiens
gcacagaaccctatctttcgga

SEQ ID NO: 8459588 - DNA, 22 bp, Homo sapiens
gcacagaacttctcttagtagg

SEQ ID NO: 8459589 - DNA, 22 bp, Homo sapiens
gcacagaagagctttggaatga

SEQ ID NO: 8459590 - DNA, 22 bp, Homo sapiens
gcacccagaggtcagcagtgct

SEQ ID NO: 8459591 - DNA, 22 bp, Homo sapiens
gcacccagaggtcagcagtgct

SEQ ID NO: 8459592 - DNA, 22 bp, Homo sapiens
gcagaaggatccgcaggtgcaa

SEQ ID NO: 8459593 - DNA, 22 bp, Homo sapiens
gcagaaggatccgcaggtgcaa

SEQ ID NO: 8459594 - DNA, 22 bp, Homo sapiens
gcaccaggagaatcacgttaga

SEQ ID NO: 8459595 - DNA, 22 bp, Homo sapiens
gcaccagcctgagcctcttgca

SEQ ID NO: 8459596 - DNA, 22 bp, Homo sapiens
gcaccagctgcagggtggctga

SEQ ID NO: 8459597 - DNA, 22 bp, Homo sapiens
gcaccagctgccttctgtgccc

SEQ ID NO: 8459598 - DNA, 22 bp, Homo sapiens
gcaccagctgctgggttctaga

SEQ ID NO: 8459599 - DNA, 22 bp, Homo sapiens
gcaccaggaagctgttatagca

SEQ ID NO: 8459600 - DNA, 22 bp, Homo sapiens
gcaccagagggggctctgcagg

SEQ ID NO: 8459601 - DNA, 23 bp, Homo sapiens
gcagacagagcagactaagacaa

SEQ ID NO: 8459602 - DNA, 22 bp, Homo sapiens
gcagacaatttattagcagatt

SEQ ID NO: 8459603 - DNA, 22 bp, Homo sapiens
gcagacacatccactcctacag

SEQ ID NO: 8459604 - DNA, 22 bp, Homo sapiens
gcagattactggactgattcca

SEQ ID NO: 8459605 - DNA, 19 bp, Homo sapiens
gcagagtggggtggagggt

SEQ ID NO: 8459606 - DNA, 22 bp, Homo sapiens
gcagagtgggagcccagggctg

SEQ ID NO: 8459607 - DNA, 22 bp, Homo sapiens
gcagagtgaagcatttctttct

SEQ ID NO: 8459608 - DNA, 22 bp, Homo sapiens
gcagagtgagccgaggctgctc

SEQ ID NO: 8459609 - DNA, 22 bp, Homo sapiens
gcagagtgatggaatgtgggtg

SEQ ID NO: 8459610 - DNA, 22 bp, Homo sapiens
gcagagtgaggaagagcttcca

SEQ ID NO: 8459611 - DNA, 18 bp, Homo sapiens
gcagagtgcgtctctgtg

SEQ ID NO: 8459612 - DNA, 18 bp, Homo sapiens
gcagagtgcgtctctgtg

SEQ ID NO: 8459613 - DNA, 19 bp, Homo sapiens
gcagagtcaagagctgctg

SEQ ID NO: 8459614 - DNA, 19 bp, Homo sapiens
gcagagtcaagagctgctg

SEQ ID NO: 8459615 - DNA, 22 bp, Homo sapiens
gcagagtcaggtccaaggactg

SEQ ID NO: 8459616 - DNA, 22 bp, Homo sapiens
gcaggcctaagagaaggcattg

SEQ ID NO: 8459617 - DNA, 18 bp, Homo sapiens
gcaggcctagaacttggt

SEQ ID NO: 8459618 - DNA, 22 bp, Homo sapiens
gcaggcctcccctgctggagct

SEQ ID NO: 8459619 - DNA, 20 bp, Homo sapiens
gcaggccctctctctagtct

SEQ ID NO: 8459620 - DNA, 22 bp, Homo sapiens
gcagggcagctgaagctaggtg

SEQ ID NO: 8459621 - DNA, 22 bp, Homo sapiens
gcagggcagctgaagctaggtg

SEQ ID NO: 8459622 - DNA, 22 bp, Homo sapiens
gcagggcagctcactgtggttc

SEQ ID NO: 8459623 - DNA, 22 bp, Homo sapiens
gcagggcagctcactgtggttc

SEQ ID NO: 8459624 - DNA, 22 bp, Homo sapiens
gcagggcagccacaggccccct

SEQ ID NO: 8459625 - DNA, 22 bp, Homo sapiens
gcaggcatctctgtagccaggg

SEQ ID NO: 8459626 - DNA, 22 bp, Homo sapiens
gcaggcatggtcgctgccaggt

SEQ ID NO: 8459627 - DNA, 22 bp, Homo sapiens
gcaggcagtttgcttttccctc

SEQ ID NO: 8459628 - DNA, 22 bp, Homo sapiens
gcaggcattagcccccatggct

SEQ ID NO: 8459629 - DNA, 22 bp, Homo sapiens
gcaggccaagccctcgcagaga

SEQ ID NO: 8459630 - DNA, 22 bp, Homo sapiens
gcagctgtactggcagcattgt

SEQ ID NO: 8459631 - DNA, 22 bp, Homo sapiens
gcagctgtagaggggagaaaga

SEQ ID NO: 8459632 - DNA, 22 bp, Homo sapiens
gcaggcccagagtcgctggcct

SEQ ID NO: 8459633 - DNA, 22 bp, Homo sapiens
gcaggccagctgtgcagatggg

SEQ ID NO: 8459634 - DNA, 22 bp, Homo sapiens
gcaggccacagtggagtctctg

SEQ ID NO: 8459635 - DNA, 22 bp, Homo sapiens
gcaggccacagtggagtctctg

SEQ ID NO: 8459636 - DNA, 22 bp, Homo sapiens
gcaggccactgtctcctctggg

SEQ ID NO: 8459637 - DNA, 22 bp, Homo sapiens
gcaggccactgtctcctctggg

SEQ ID NO: 8459638 - DNA, 22 bp, Homo sapiens
gcagggccagtgcagagaggaa

SEQ ID NO: 8459639 - DNA, 22 bp, Homo sapiens
gcagggccagtgcagagaggaa

SEQ ID NO: 8459640 - DNA, 22 bp, Homo sapiens
gcagggtgtgtctcatacagtt

SEQ ID NO: 8459641 - DNA, 22 bp, Homo sapiens
gcaggtgatgtgatgtgagcat

SEQ ID NO: 8459642 - DNA, 22 bp, Homo sapiens
gcaggtctggcatagagcctgc

SEQ ID NO: 8459643 - DNA, 22 bp, Homo sapiens
gcaggtctggcatagagcctgc

SEQ ID NO: 8459644 - DNA, 22 bp, Homo sapiens
gcaggtctggcatagagcctgc

SEQ ID NO: 8459645 - DNA, 22 bp, Homo sapiens
gcaggtctgttgattacagtca

SEQ ID NO: 8459646 - DNA, 22 bp, Homo sapiens
gcaggtcttgaaggtgtgattt

SEQ ID NO: 8459647 - DNA, 22 bp, Homo sapiens
gcaggtcttgaaggtgtgattt

SEQ ID NO: 8459648 - DNA, 22 bp, Homo sapiens
gcaggtctgttgattacagtca

SEQ ID NO: 8459649 - DNA, 22 bp, Homo sapiens
gcaggtctggagggcactgggg

SEQ ID NO: 8459650 - DNA, 22 bp, Homo sapiens
gcaggtctcaatctgagcaggc

SEQ ID NO: 8459651 - DNA, 22 bp, Homo sapiens
gcaggtctcaatctgagcaggc

SEQ ID NO: 8459652 - DNA, 22 bp, Homo sapiens
gcaggtctatcaggctgcaggt

SEQ ID NO: 8459653 - DNA, 22 bp, Homo sapiens
gcaggtctatcaggctgcaggt

SEQ ID NO: 8459654 - DNA, 22 bp, Homo sapiens
gcaggtcccagaaagttaattc

SEQ ID NO: 8459655 - DNA, 22 bp, Homo sapiens
gcaggtctagaagctgcctctg

SEQ ID NO: 8459656 - DNA, 22 bp, Homo sapiens
gcaggtctagaagctgcctctg

SEQ ID NO: 8459657 - DNA, 22 bp, Homo sapiens
gcaggtctatcaggctgcaggt

SEQ ID NO: 8459658 - DNA, 19 bp, Homo sapiens
gcaggtcattaggctaggt

SEQ ID NO: 8459659 - DNA, 19 bp, Homo sapiens
gcaggtcattaggctaggt

SEQ ID NO: 8459660 - DNA, 22 bp, Homo sapiens
gcaggtaagagaggctggcttc

SEQ ID NO: 8459661 - DNA, 22 bp, Homo sapiens
gcagcacaaagtccccagggac

SEQ ID NO: 8459662 - DNA, 22 bp, Homo sapiens
gcagcaagaggtttctgttgac

SEQ ID NO: 8459663 - DNA, 22 bp, Homo sapiens
gcagcagatgtgggcccagagc

SEQ ID NO: 8459664 - DNA, 22 bp, Homo sapiens
gcagcagcagcaattttctgtc

SEQ ID NO: 8459665 - DNA, 22 bp, Homo sapiens
gcagcagattgttttttcacct

SEQ ID NO: 8459666 - DNA, 21 bp, Homo sapiens
gcagccactgccttcaacaat

SEQ ID NO: 8459667 - DNA, 22 bp, Homo sapiens
gcagccactagttttcctgttt

SEQ ID NO: 8459668 - DNA, 22 bp, Homo sapiens
gcagccaccctcaaggctgaat

SEQ ID NO: 8459669 - DNA, 22 bp, Homo sapiens
gcagcagcccagggctctcaga

SEQ ID NO: 8459670 - DNA, 22 bp, Homo sapiens
gcagcagcccagggctctcaga

SEQ ID NO: 8459671 - DNA, 22 bp, Homo sapiens
gcagccagccctagtcccactt

SEQ ID NO: 8459672 - DNA, 21 bp, Homo sapiens
gcagccagccgagaccatgcc

SEQ ID NO: 8459673 - DNA, 21 bp, Homo sapiens
gcagccagccgagaccatgcc

SEQ ID NO: 8459674 - DNA, 22 bp, Homo sapiens
gcagccaggaaagctggaccct

SEQ ID NO: 8459675 - DNA, 22 bp, Homo sapiens
gcagccagcccctctgacctct

SEQ ID NO: 8459676 - DNA, 22 bp, Homo sapiens
gcagccagagggggtgtgatca

SEQ ID NO: 8459677 - DNA, 22 bp, Homo sapiens
gcagctgggacactgaggccag

SEQ ID NO: 8459678 - DNA, 22 bp, Homo sapiens
gcagctgggacactgaggccag

SEQ ID NO: 8459679 - DNA, 22 bp, Homo sapiens
gcagctgggacactgaggccag

SEQ ID NO: 8459680 - DNA, 22 bp, Homo sapiens
gcagctgggccccagcctctcc

SEQ ID NO: 8459681 - DNA, 22 bp, Homo sapiens
gcagctgggtctgtgtgggctg

SEQ ID NO: 8459682 - DNA, 22 bp, Homo sapiens
gcagctgggtctgtgtgggctg

SEQ ID NO: 8459683 - DNA, 22 bp, Homo sapiens
gcagctggttaatgggagaatt

SEQ ID NO: 8459684 - DNA, 22 bp, Homo sapiens
gcagctggtgcaaatgtcactc

SEQ ID NO: 8459685 - DNA, 22 bp, Homo sapiens
gcagctggtctggcctagagta

SEQ ID NO: 8459686 - DNA, 22 bp, Homo sapiens
gcagctggctcagagaggtggg

SEQ ID NO: 8459687 - DNA, 22 bp, Homo sapiens
gcagcccacagctggaggccta

SEQ ID NO: 8459688 - DNA, 22 bp, Homo sapiens
gcagcccacaccactctgctca

SEQ ID NO: 8459689 - DNA, 22 bp, Homo sapiens
gcagcccaagcctgagcatcct

SEQ ID NO: 8459690 - DNA, 22 bp, Homo sapiens
gcagcccaatggactgagacag

SEQ ID NO: 8459691 - DNA, 22 bp, Homo sapiens
gcagccaggaagcccaggacac

SEQ ID NO: 8459692 - DNA, 22 bp, Homo sapiens
gcagcccaaaaaagaggtagat

SEQ ID NO: 8459693 - DNA, 22 bp, Homo sapiens
gcccggccaggaacagagtata

SEQ ID NO: 8459694 - DNA, 22 bp, Homo sapiens
gcccgcgccagcctctccatct

SEQ ID NO: 8459695 - DNA, 22 bp, Homo sapiens
gccctagcgccagctcagcacc

SEQ ID NO: 8459696 - DNA, 22 bp, Homo sapiens
gcccgtgtgcagagtgggagct

SEQ ID NO: 8459697 - DNA, 22 bp, Homo sapiens
gccctacctcagtccagatctg

SEQ ID NO: 8459698 - DNA, 22 bp, Homo sapiens
gccctcagaggacagctgactt

SEQ ID NO: 8459699 - DNA, 22 bp, Homo sapiens
gccctcagaggacagctgactt

SEQ ID NO: 8459700 - DNA, 22 bp, Homo sapiens
gccctcagagttccccacagtg

SEQ ID NO: 8459701 - DNA, 22 bp, Homo sapiens
gccctcagaggacagctgactt

SEQ ID NO: 8459702 - DNA, 22 bp, Homo sapiens
gccctgagtggtacctgtgggt

SEQ ID NO: 8459703 - DNA, 19 bp, Homo sapiens
gccctgagtaagctaggag

SEQ ID NO: 8459704 - DNA, 22 bp, Homo sapiens
gccctgagtgcctgtgtaagaa

SEQ ID NO: 8459705 - DNA, 22 bp, Homo sapiens
gccctcagaatgggctctaatc

SEQ ID NO: 8459706 - DNA, 22 bp, Homo sapiens
gccctcagaggacagctgactt

SEQ ID NO: 8459707 - DNA, 21 bp, Homo sapiens
gccctaggctacctggagcgc

SEQ ID NO: 8459708 - DNA, 22 bp, Homo sapiens
gcccacagaggcaccaccaggc

SEQ ID NO: 8459709 - DNA, 22 bp, Homo sapiens
gccccaggggaggtgccctgca

SEQ ID NO: 8459710 - DNA, 22 bp, Homo sapiens
gcccacaggggacctggtggct

SEQ ID NO: 8459711 - DNA, 22 bp, Homo sapiens
gcccaaggtcccatggcagcac

SEQ ID NO: 8459712 - DNA, 22 bp, Homo sapiens
gcccctcccagtcaggagcact

SEQ ID NO: 8459713 - DNA, 22 bp, Homo sapiens
gcccctcccagtcaggagcact

SEQ ID NO: 8459714 - DNA, 22 bp, Homo sapiens
gccccaggttgcctgtcccagg

SEQ ID NO: 8459715 - DNA, 22 bp, Homo sapiens
gcccctgcctttgaacctggag

SEQ ID NO: 8459716 - DNA, 22 bp, Homo sapiens
gcccctggctggccagctcctc

SEQ ID NO: 8459717 - DNA, 23 bp, Homo sapiens
gcctccaaacctctaggctggtg

SEQ ID NO: 8459718 - DNA, 20 bp, Homo sapiens
gcctccacactcacccctta

SEQ ID NO: 8459719 - DNA, 22 bp, Homo sapiens
gcctcagtaaccttaggggata

SEQ ID NO: 8459720 - DNA, 22 bp, Homo sapiens
gcctcaggtgcatctctcattc

SEQ ID NO: 8459721 - DNA, 22 bp, Homo sapiens
gcctcagtgatatgtgggacaa

SEQ ID NO: 8459722 - DNA, 22 bp, Homo sapiens
gcctcagtctcccgagtagctg

SEQ ID NO: 8459723 - DNA, 22 bp, Homo sapiens
gcctcatgagggatctgccctc

SEQ ID NO: 8459724 - DNA, 22 bp, Homo sapiens
gcctcagggggagaggccagct

SEQ ID NO: 8459725 - DNA, 22 bp, Homo sapiens
gcctcagggggagaggccagct

SEQ ID NO: 8459726 - DNA, 22 bp, Homo sapiens
gccctggagagggatatggcat

SEQ ID NO: 8459727 - DNA, 22 bp, Homo sapiens
gcctcaggtaaaacttgagttt

SEQ ID NO: 8459728 - DNA, 22 bp, Homo sapiens
gcctcaggtgcatctctcattc

SEQ ID NO: 8459729 - DNA, 22 bp, Homo sapiens
gccctgcttggtcatggccttc

SEQ ID NO: 8459730 - DNA, 22 bp, Homo sapiens
gccctggaatctctccatggga

SEQ ID NO: 8459731 - DNA, 22 bp, Homo sapiens
gccctgcttctggcatgcagaa

SEQ ID NO: 8459732 - DNA, 17 bp, Homo sapiens
gccctgcctgctgccct

SEQ ID NO: 8459733 - DNA, 17 bp, Homo sapiens
gccctgcctgctgccct

SEQ ID NO: 8459734 - DNA, 22 bp, Homo sapiens
gccctgcctgtctgctgggagg

SEQ ID NO: 8459735 - DNA, 22 bp, Homo sapiens
gccctgctcatttcacgtgttt

SEQ ID NO: 8459736 - DNA, 22 bp, Homo sapiens
gccctgctctggtctctgcccg

SEQ ID NO: 8459737 - DNA, 22 bp, Homo sapiens
gccctgctctggtctctgcccg

SEQ ID NO: 8459738 - DNA, 22 bp, Homo sapiens
gccctgctgagtccggctcaga

SEQ ID NO: 8459739 - DNA, 23 bp, Homo sapiens
gccctgctgggacctcctgctac

SEQ ID NO: 8459740 - DNA, 22 bp, Homo sapiens
gccctgctgctggcagaggcgc

SEQ ID NO: 8459741 - DNA, 22 bp, Homo sapiens
gccctgctgtttagagagctac

SEQ ID NO: 8459742 - DNA, 22 bp, Homo sapiens
gccctgctgtttagagagctac

SEQ ID NO: 8459743 - DNA, 22 bp, Homo sapiens
gccctgcttctggcatgcagaa

SEQ ID NO: 8459744 - DNA, 22 bp, Homo sapiens
gccctgctgtcttcagagtata

SEQ ID NO: 8459745 - DNA, 23 bp, Homo sapiens
gccctgctgggacctcctgctac

SEQ ID NO: 8459746 - DNA, 22 bp, Homo sapiens
gcctgcagttctgtgctaggca

SEQ ID NO: 8459747 - DNA, 22 bp, Homo sapiens
gcctgcagtgagtgcagaaggt

SEQ ID NO: 8459748 - DNA, 20 bp, Homo sapiens
gcctgcaggttggatgggat

SEQ ID NO: 8459749 - DNA, 22 bp, Homo sapiens
gcctgcagggtgatgggctgcc

SEQ ID NO: 8459750 - DNA, 22 bp, Homo sapiens
gcctgcagggtgatgggctgcc

SEQ ID NO: 8459751 - DNA, 22 bp, Homo sapiens
gcctgcagggcctgggcctacc

SEQ ID NO: 8459752 - DNA, 22 bp, Homo sapiens
gcctggagaaaggaaggtggga

SEQ ID NO: 8459753 - DNA, 22 bp, Homo sapiens
gcctggagaagatggaactagc

SEQ ID NO: 8459754 - DNA, 22 bp, Homo sapiens
gcctggagacagcagaggcggc

SEQ ID NO: 8459755 - DNA, 22 bp, Homo sapiens
gcctggagacaaggacaaaggg

SEQ ID NO: 8459756 - DNA, 22 bp, Homo sapiens
gcctggagaattaaaaggaagg

SEQ ID NO: 8459757 - DNA, 22 bp, Homo sapiens
gcctggagaggaagccggtgga

SEQ ID NO: 8459758 - DNA, 22 bp, Homo sapiens
gcctggagacagcagaggcggc

SEQ ID NO: 8459759 - DNA, 22 bp, Homo sapiens
gcctgcagggcccttgtgggtc

SEQ ID NO: 8459760 - DNA, 17 bp, Homo sapiens
gcctgcaggcccgcaga

SEQ ID NO: 8459761 - DNA, 18 bp, Homo sapiens
gcctgcaggcacgggggt

SEQ ID NO: 8459762 - DNA, 22 bp, Homo sapiens
gcctgcagctgcttccacacac

SEQ ID NO: 8459763 - DNA, 22 bp, Homo sapiens
gcctgcagcccctctgcagtag

SEQ ID NO: 8459764 - DNA, 22 bp, Homo sapiens
gcctgcagcctcaagggctgag

SEQ ID NO: 8459765 - DNA, 22 bp, Homo sapiens
gcctgcagatatataggatggt

SEQ ID NO: 8459766 - DNA, 22 bp, Homo sapiens
gcctgcagaggtgctgctagct

SEQ ID NO: 8459767 - DNA, 22 bp, Homo sapiens
gcctgcagccagggagttctct

SEQ ID NO: 8459768 - DNA, 22 bp, Homo sapiens
gcctgcagcatgctaggtcttg

SEQ ID NO: 8459769 - DNA, 22 bp, Homo sapiens
gcctgatgagcttccagctgag

SEQ ID NO: 8459770 - DNA, 22 bp, Homo sapiens
gcctgcactcaaacactctctt

SEQ ID NO: 8459771 - DNA, 22 bp, Homo sapiens
gcctgcactcaaacactctctt

SEQ ID NO: 8459772 - DNA, 19 bp, Homo sapiens
gcctgcagaaaaggcaggg

SEQ ID NO: 8459773 - DNA, 22 bp, Homo sapiens
gcctgcagaactgtgaggcaat

SEQ ID NO: 8459774 - DNA, 20 bp, Homo sapiens
gcctgcagagaaggtcagag

SEQ ID NO: 8459775 - DNA, 20 bp, Homo sapiens
gcctgcagagaaggtcagag

SEQ ID NO: 8459776 - DNA, 22 bp, Homo sapiens
gcctgcagaggtgctgctagct

SEQ ID NO: 8459777 - DNA, 22 bp, Homo sapiens
gcctgcagaggtgctgctagct

SEQ ID NO: 8459778 - DNA, 18 bp, Homo sapiens
gcctgagggtcaagtgtg

SEQ ID NO: 8459779 - DNA, 22 bp, Homo sapiens
gcctgagggctcctagcaggct

SEQ ID NO: 8459780 - DNA, 22 bp, Homo sapiens
gcctgaggaattgagggggtaa

SEQ ID NO: 8459781 - DNA, 18 bp, Homo sapiens
gcctccctggctacactt

SEQ ID NO: 8459782 - DNA, 22 bp, Homo sapiens
gcctccctgttcttccacaata

SEQ ID NO: 8459783 - DNA, 22 bp, Homo sapiens
gcctccctgtttcctgctccaa

SEQ ID NO: 8459784 - DNA, 22 bp, Homo sapiens
gcctccctccaccactgcaggt

SEQ ID NO: 8459785 - DNA, 22 bp, Homo sapiens
gcctccctccaccactgcaggt

SEQ ID NO: 8459786 - DNA, 22 bp, Homo sapiens
gcctcccctgcaattgtccttg

SEQ ID NO: 8459787 - DNA, 22 bp, Homo sapiens
gcctcccctgcaattgtccttg

SEQ ID NO: 8459788 - DNA, 22 bp, Homo sapiens
gcctccctggcccacagcagcg

SEQ ID NO: 8459789 - DNA, 22 bp, Homo sapiens
gcctccaccgaacgctctcttg

SEQ ID NO: 8459790 - DNA, 22 bp, Homo sapiens
gcctccccaggggtgtcatgag

SEQ ID NO: 8459791 - DNA, 22 bp, Homo sapiens
gcctccccaggggtgtcatgag

SEQ ID NO: 8459792 - DNA, 23 bp, Homo sapiens
gcagttagtccactttgcagaga

SEQ ID NO: 8459793 - DNA, 22 bp, Homo sapiens
gcagttcctacagtggaaagcg

SEQ ID NO: 8459794 - DNA, 17 bp, Homo sapiens
gcagttaaattaagatg

SEQ ID NO: 8459795 - DNA, 22 bp, Homo sapiens
gcattcttcacagtattcctcc

SEQ ID NO: 8459796 - DNA, 21 bp, Homo sapiens
gcattcttcatgtgattcaga

SEQ ID NO: 8459797 - DNA, 22 bp, Homo sapiens
gcagttttattatgatggaaat

SEQ ID NO: 8459798 - DNA, 22 bp, Homo sapiens
gcagtttgaggttttctgatgt

SEQ ID NO: 8459799 - DNA, 22 bp, Homo sapiens
gcattacagcagttcaacttgg

SEQ ID NO: 8459800 - DNA, 22 bp, Homo sapiens
gcattagaagggacctctgggg

SEQ ID NO: 8459801 - DNA, 22 bp, Homo sapiens
gcattacaggctgtaagatgca

SEQ ID NO: 8459802 - DNA, 19 bp, Homo sapiens
gcataaaatgtcaatgtgt

SEQ ID NO: 8459803 - DNA, 22 bp, Homo sapiens
gcattaatgtaagacccactcc

SEQ ID NO: 8459804 - DNA, 22 bp, Homo sapiens
gccactgtggtcctcccatgat

SEQ ID NO: 8459805 - DNA, 22 bp, Homo sapiens
gccactgttccaccatcttgat

SEQ ID NO: 8459806 - DNA, 22 bp, Homo sapiens
gccactgttgctcctcaggaaa

SEQ ID NO: 8459807 - DNA, 20 bp, Homo sapiens
gccactgtgcttacactgct

SEQ ID NO: 8459808 - DNA, 22 bp, Homo sapiens
gccacctgtttcagatgtggtt

SEQ ID NO: 8459809 - DNA, 22 bp, Homo sapiens
gccacctggactcagagccagg

SEQ ID NO: 8459810 - DNA, 22 bp, Homo sapiens
gccacctgcgggccgtggtgga

SEQ ID NO: 8459811 - DNA, 22 bp, Homo sapiens
gccacctgccaacttgctggaa

SEQ ID NO: 8459812 - DNA, 22 bp, Homo sapiens
gccacctctttgtctctgccgc

SEQ ID NO: 8459813 - DNA, 22 bp, Homo sapiens
gccacctccttattccacctgt

SEQ ID NO: 8459814 - DNA, 22 bp, Homo sapiens
gcatttaaatttgaacttcaga

SEQ ID NO: 8459815 - DNA, 22 bp, Homo sapiens
gcatttacatggagctatctaa

SEQ ID NO: 8459816 - DNA, 22 bp, Homo sapiens
gccaggcattattccgatccct

SEQ ID NO: 8459817 - DNA, 22 bp, Homo sapiens
gccaggcgggtctcaaactcct

SEQ ID NO: 8459818 - DNA, 22 bp, Homo sapiens
gccaggctcagcagtcaacctg

SEQ ID NO: 8459819 - DNA, 22 bp, Homo sapiens
gccaggctcagtagcgattcct

SEQ ID NO: 8459820 - DNA, 22 bp, Homo sapiens
gccaggctaagaaaggtgtgat

SEQ ID NO: 8459821 - DNA, 22 bp, Homo sapiens
gccaggctaagaaaggtgtgat

SEQ ID NO: 8459822 - DNA, 23 bp, Homo sapiens
gccaggctccggtctgtggccac

SEQ ID NO: 8459823 - DNA, 22 bp, Homo sapiens
gccaggctccccggatccctgg

SEQ ID NO: 8459824 - DNA, 19 bp, Homo sapiens
gccaggctccatagccggc

SEQ ID NO: 8459825 - DNA, 22 bp, Homo sapiens
gccaggctccaggccctcctga

SEQ ID NO: 8459826 - DNA, 22 bp, Homo sapiens
gccaggctccaggccctcctga

SEQ ID NO: 8459827 - DNA, 23 bp, Homo sapiens
gccaggctccggtctgtggccac

SEQ ID NO: 8459828 - DNA, 22 bp, Homo sapiens
gccaggctctcagtgactgccc

SEQ ID NO: 8459829 - DNA, 22 bp, Homo sapiens
gcccaagcagcttcccgagctt

SEQ ID NO: 8459830 - DNA, 20 bp, Homo sapiens
gcccaagcgccggccgcaga

SEQ ID NO: 8459831 - DNA, 22 bp, Homo sapiens
gcccaagctccgcctcctgtcg

SEQ ID NO: 8459832 - DNA, 22 bp, Homo sapiens
gcccaagctccgcctcctgtcg

SEQ ID NO: 8459833 - DNA, 22 bp, Homo sapiens
gcccaagccgccttccagagac

SEQ ID NO: 8459834 - DNA, 20 bp, Homo sapiens
gcccaagcgccggccgcaga

SEQ ID NO: 8459835 - DNA, 22 bp, Homo sapiens
gcccaaggtatatcagagacag

SEQ ID NO: 8459836 - DNA, 22 bp, Homo sapiens
gcccaagggcatcaagttctac

SEQ ID NO: 8459837 - DNA, 20 bp, Homo sapiens
gcccaaggtccagaaggggg

SEQ ID NO: 8459838 - DNA, 22 bp, Homo sapiens
gccaggaaagggaattccctga

SEQ ID NO: 8459839 - DNA, 22 bp, Homo sapiens
gccaggaaagggaattccctga

SEQ ID NO: 8459840 - DNA, 22 bp, Homo sapiens
gccaggaaattcatgccagatc

SEQ ID NO: 8459841 - DNA, 22 bp, Homo sapiens
gccaggaagcagttagatgggt

SEQ ID NO: 8459842 - DNA, 22 bp, Homo sapiens
gccaggaaggctgaagccagaa

SEQ ID NO: 8459843 - DNA, 22 bp, Homo sapiens
gccagctgtctaagagagtaaa

SEQ ID NO: 8459844 - DNA, 22 bp, Homo sapiens
gccagctgttcagacattcttt

SEQ ID NO: 8459845 - DNA, 22 bp, Homo sapiens
gccaggaaagccactggcatac

SEQ ID NO: 8459846 - DNA, 22 bp, Homo sapiens
gccaggaaaaacgtggtgggag

SEQ ID NO: 8459847 - DNA, 23 bp, Homo sapiens
gccagctttggtctgtctcctag

SEQ ID NO: 8459848 - DNA, 22 bp, Homo sapiens
gccagacactcccctgggcagg

SEQ ID NO: 8459849 - DNA, 22 bp, Homo sapiens
gccagctgaggccgtgcaggct

SEQ ID NO: 8459850 - DNA, 22 bp, Homo sapiens
gccagaagactggagtcagctg

SEQ ID NO: 8459851 - DNA, 22 bp, Homo sapiens
gccagaaacatacacatcactt

SEQ ID NO: 8459852 - DNA, 22 bp, Homo sapiens
gccagctggtaggcacctagcc

SEQ ID NO: 8459853 - DNA, 21 bp, Homo sapiens
gccagctgggtcttgcaggag

SEQ ID NO: 8459854 - DNA, 22 bp, Homo sapiens
gccagctgaggccgtgcaggct

SEQ ID NO: 8459855 - DNA, 22 bp, Homo sapiens
gccagctgggccttagggctgg

SEQ ID NO: 8459856 - DNA, 22 bp, Homo sapiens
gccagctgtaagcagtgattct

SEQ ID NO: 8459857 - DNA, 18 bp, Homo sapiens
ggagaagaacagatgtgg

SEQ ID NO: 8459858 - DNA, 22 bp, Homo sapiens
ggagaagaggagctggaagcct

SEQ ID NO: 8459859 - DNA, 22 bp, Homo sapiens
ggagaagaggagctggaagcct

SEQ ID NO: 8459860 - DNA, 22 bp, Homo sapiens
ggagaagaggagctggaagcct

SEQ ID NO: 8459861 - DNA, 22 bp, Homo sapiens
ggagaagaggagctggaagcct

SEQ ID NO: 8459862 - DNA, 22 bp, Homo sapiens
ggagaaagggactgatctgctc

SEQ ID NO: 8459863 - DNA, 17 bp, Homo sapiens
ggagccaggagcccacc

SEQ ID NO: 8459864 - DNA, 17 bp, Homo sapiens
ggagccaggagcccacc

SEQ ID NO: 8459865 - DNA, 22 bp, Homo sapiens
ggagccaggcaatctgtacttt

SEQ ID NO: 8459866 - DNA, 22 bp, Homo sapiens
ggagccaggcaatctgtacttt

SEQ ID NO: 8459867 - DNA, 22 bp, Homo sapiens
ggagccagggaagctgcttcct

SEQ ID NO: 8459868 - DNA, 22 bp, Homo sapiens
ggagccagtatttagtggtctt

SEQ ID NO: 8459869 - DNA, 22 bp, Homo sapiens
ggagccagtatttagtggtctt

SEQ ID NO: 8459870 - DNA, 22 bp, Homo sapiens
ggagccagggaagctgcttcct

SEQ ID NO: 8459871 - DNA, 18 bp, Homo sapiens
ggagccagtctgtctctg

SEQ ID NO: 8459872 - DNA, 22 bp, Homo sapiens
ggagccagtgccctctggtgga

SEQ ID NO: 8459873 - DNA, 22 bp, Homo sapiens
ggagccagtatttagtggtctt

SEQ ID NO: 8459874 - DNA, 18 bp, Homo sapiens
ggagccagtctgtctctg

SEQ ID NO: 8459875 - DNA, 22 bp, Homo sapiens
ggagcccaagtctgcactcggc

SEQ ID NO: 8459876 - DNA, 22 bp, Homo sapiens
ggagcccaagtctgcactcggc

SEQ ID NO: 8459877 - DNA, 18 bp, Homo sapiens
ggagcccacggcgtccca

SEQ ID NO: 8459878 - DNA, 18 bp, Homo sapiens
ggagcccacggcgtccca

SEQ ID NO: 8459879 - DNA, 18 bp, Homo sapiens
ggagcccagaggacagga

SEQ ID NO: 8459880 - DNA, 18 bp, Homo sapiens
ggagcccagaggtgagtt

SEQ ID NO: 8459881 - DNA, 22 bp, Homo sapiens
ggagccctcaccggcgagtgcc

SEQ ID NO: 8459882 - DNA, 22 bp, Homo sapiens
ggagccctcaccggcgagtgcc

SEQ ID NO: 8459883 - DNA, 22 bp, Homo sapiens
ggagccctcaccggcgagtgcc

SEQ ID NO: 8459884 - DNA, 22 bp, Homo sapiens
ggagcctggcccggcccttggc

SEQ ID NO: 8459885 - DNA, 22 bp, Homo sapiens
ggagcctggcccggcccttggc

SEQ ID NO: 8459886 - DNA, 21 bp, Homo sapiens
ggaggaaaaaggaatgacttg

SEQ ID NO: 8459887 - DNA, 22 bp, Homo sapiens
ggagctgttgattgtttgagga

SEQ ID NO: 8459888 - DNA, 22 bp, Homo sapiens
ggagctggtcagccttgagcat

SEQ ID NO: 8459889 - DNA, 22 bp, Homo sapiens
ggagctggtcagccttgagcat

SEQ ID NO: 8459890 - DNA, 22 bp, Homo sapiens
ggagctggggttggcatcttcc

SEQ ID NO: 8459891 - DNA, 21 bp, Homo sapiens
ggagctggggagctggcccca

SEQ ID NO: 8459892 - DNA, 21 bp, Homo sapiens
ggagctggggagctggcccca

SEQ ID NO: 8459893 - DNA, 22 bp, Homo sapiens
ggagctgtgctgggtgatcagg

SEQ ID NO: 8459894 - DNA, 22 bp, Homo sapiens
ggagctgtgcagtgactacaga

SEQ ID NO: 8459895 - DNA, 22 bp, Homo sapiens
ggagcctgggcctcctgccctt

SEQ ID NO: 8459896 - DNA, 22 bp, Homo sapiens
ggagcctgggcctcctgccctt

SEQ ID NO: 8459897 - DNA, 22 bp, Homo sapiens
ggagctggctacagagaactcc

SEQ ID NO: 8459898 - DNA, 21 bp, Homo sapiens
ggagctgcaggagccgaaggc

SEQ ID NO: 8459899 - DNA, 20 bp, Homo sapiens
ggagctgccctgggctggag

SEQ ID NO: 8459900 - DNA, 22 bp, Homo sapiens
ggagctggccgcctatgtgcag

SEQ ID NO: 8459901 - DNA, 22 bp, Homo sapiens
ggagctgggaactatgtagtat

SEQ ID NO: 8459902 - DNA, 22 bp, Homo sapiens
ggagctgggaattggatcatct

SEQ ID NO: 8459903 - DNA, 22 bp, Homo sapiens
ggagctgggaccctgtcatctg

SEQ ID NO: 8459904 - DNA, 22 bp, Homo sapiens
ggagctgggaccctgtcatctg

SEQ ID NO: 8459905 - DNA, 18 bp, Homo sapiens
ggagctgggcctggttcc

SEQ ID NO: 8459906 - DNA, 22 bp, Homo sapiens
ggagaaaggcatagcagaacct

SEQ ID NO: 8459907 - DNA, 22 bp, Homo sapiens
ggagaaaggcatagcagaacct

SEQ ID NO: 8459908 - DNA, 22 bp, Homo sapiens
ggagaaaggcatagcagaacct

SEQ ID NO: 8459909 - DNA, 22 bp, Homo sapiens
ggagaaaggataggaatgtgct

SEQ ID NO: 8459910 - DNA, 22 bp, Homo sapiens
ggacttggggaaggcacagtta

SEQ ID NO: 8459911 - DNA, 22 bp, Homo sapiens
ggacttctggggactgtagatt

SEQ ID NO: 8459912 - DNA, 22 bp, Homo sapiens
ggacttctggggactgtagatt

SEQ ID NO: 8459913 - DNA, 21 bp, Homo sapiens
ggacttggatggtggcagtag

SEQ ID NO: 8459914 - DNA, 22 bp, Homo sapiens
ggactggccggcgctgaggccc

SEQ ID NO: 8459915 - DNA, 22 bp, Homo sapiens
ggactgggaatcagggagatgc

SEQ ID NO: 8459916 - DNA, 22 bp, Homo sapiens
ggacaggctgcatctgagcatg

SEQ ID NO: 8459917 - DNA, 22 bp, Homo sapiens
ggacaggctgcatctgagcatg

SEQ ID NO: 8459918 - DNA, 22 bp, Homo sapiens
ggacaggcgcagggccaaggaa

SEQ ID NO: 8459919 - DNA, 22 bp, Homo sapiens
ggacaggcctggcacagtactg

SEQ ID NO: 8459920 - DNA, 22 bp, Homo sapiens
ggacaggcaggtgatttccaga

SEQ ID NO: 8459921 - DNA, 22 bp, Homo sapiens
ggacaggcccggggagcctgga

SEQ ID NO: 8459922 - DNA, 22 bp, Homo sapiens
ggacaggccatatggaatacat

SEQ ID NO: 8459923 - DNA, 22 bp, Homo sapiens
ggacaggcccggggagcctgga

SEQ ID NO: 8459924 - DNA, 22 bp, Homo sapiens
ggacaggggcgtggggattgtt

SEQ ID NO: 8459925 - DNA, 22 bp, Homo sapiens
ggacagggatcattatctgagc

SEQ ID NO: 8459926 - DNA, 22 bp, Homo sapiens
ggaaaaacagtctttattattt

SEQ ID NO: 8459927 - DNA, 22 bp, Homo sapiens
ggaaaaacagtctttattattt

SEQ ID NO: 8459928 - DNA, 23 bp, Homo sapiens
ggaaaaacactgtgtcttggcag

SEQ ID NO: 8459929 - DNA, 23 bp, Homo sapiens
ggaaaaacactgtgtcttggcag

SEQ ID NO: 8459930 - DNA, 22 bp, Homo sapiens
ggaaaaatgacacatatctcaa

SEQ ID NO: 8459931 - DNA, 22 bp, Homo sapiens
ggaaggaattccaagactaaag

SEQ ID NO: 8459932 - DNA, 22 bp, Homo sapiens
ggaaggaattccaagactaaag

SEQ ID NO: 8459933 - DNA, 19 bp, Homo sapiens
ggaaggagagaaatgcatg

SEQ ID NO: 8459934 - DNA, 22 bp, Homo sapiens
ggaaggaggggcaaagcagttc

SEQ ID NO: 8459935 - DNA, 22 bp, Homo sapiens
ggaaggaggggcaaagcagttc

SEQ ID NO: 8459936 - DNA, 22 bp, Homo sapiens
ggaaggagggcggcaatgatga

SEQ ID NO: 8459937 - DNA, 22 bp, Homo sapiens
ggaaggctccacccaaggcgag

SEQ ID NO: 8459938 - DNA, 21 bp, Homo sapiens
ggaaggctatggtgtattttt

SEQ ID NO: 8459939 - DNA, 22 bp, Homo sapiens
ggaaggctacaggaatccagcg

SEQ ID NO: 8459940 - DNA, 22 bp, Homo sapiens
ggaaggctccatacacaaagca

SEQ ID NO: 8459941 - DNA, 22 bp, Homo sapiens
ggaaggctgtgcagtgtttgca

SEQ ID NO: 8459942 - DNA, 22 bp, Homo sapiens
ggaaggctcgaggatgcttctg

SEQ ID NO: 8459943 - DNA, 22 bp, Homo sapiens
ggaaggctctgttccttgactt

SEQ ID NO: 8459944 - DNA, 22 bp, Homo sapiens
ggaaggctgtgccagaagaact

SEQ ID NO: 8459945 - DNA, 22 bp, Homo sapiens
ggaaggctgtgcagtgtttgca

SEQ ID NO: 8459946 - DNA, 20 bp, Homo sapiens
ggaaggctgtttttccacca

SEQ ID NO: 8459947 - DNA, 22 bp, Homo sapiens
ggaaggctgttcactaacatgt

SEQ ID NO: 8459948 - DNA, 20 bp, Homo sapiens
ggaaggcttgaagtttacat

SEQ ID NO: 8459949 - DNA, 22 bp, Homo sapiens
ggaaggcttgagttcccaggtc

SEQ ID NO: 8459950 - DNA, 22 bp, Homo sapiens
ggaaggctttctgttctgtgac

SEQ ID NO: 8459951 - DNA, 22 bp, Homo sapiens
ggaaggctttaagcaccaaagc

SEQ ID NO: 8459952 - DNA, 22 bp, Homo sapiens
ggaaggctttgaggggtgctgg

SEQ ID NO: 8459953 - DNA, 19 bp, Homo sapiens
ggaaggccacggcaggctt

SEQ ID NO: 8459954 - DNA, 22 bp, Homo sapiens
ggaaggctaataatgcaagaaa

SEQ ID NO: 8459955 - DNA, 22 bp, Homo sapiens
ggaaggcagaggtgtcgtgggg

SEQ ID NO: 8459956 - DNA, 22 bp, Homo sapiens
ggacagagggttgacagagtat

SEQ ID NO: 8459957 - DNA, 22 bp, Homo sapiens
ggacagagggttgacagagtat

SEQ ID NO: 8459958 - DNA, 22 bp, Homo sapiens
ggaaggctttgtagaagtgcca

SEQ ID NO: 8459959 - DNA, 22 bp, Homo sapiens
gcttggcagcaacaggcatccc

SEQ ID NO: 8459960 - DNA, 22 bp, Homo sapiens
gcttgtcatagttgttacaaat

SEQ ID NO: 8459961 - DNA, 22 bp, Homo sapiens
gcttggtttctaacttttcata

SEQ ID NO: 8459962 - DNA, 20 bp, Homo sapiens
gcttggaccttctgctctgt

SEQ ID NO: 8459963 - DNA, 22 bp, Homo sapiens
gctttaaatggcttgcccaagt

SEQ ID NO: 8459964 - DNA, 22 bp, Homo sapiens
gctttaaacctctactctgtcc

SEQ ID NO: 8459965 - DNA, 22 bp, Homo sapiens
gctttaatgaagtcacgcaaag

SEQ ID NO: 8459966 - DNA, 22 bp, Homo sapiens
gcttgtctgctgagccacctgt

SEQ ID NO: 8459967 - DNA, 22 bp, Homo sapiens
gcttgtttgtgatttctccaga

SEQ ID NO: 8459968 - DNA, 22 bp, Homo sapiens
gcttgtttgtgcctctgcagaa

SEQ ID NO: 8459969 - DNA, 22 bp, Homo sapiens
gctgtgtgttcaataatgtgat

SEQ ID NO: 8459970 - DNA, 22 bp, Homo sapiens
gctgtgtgctgggcatggcact

SEQ ID NO: 8459971 - DNA, 22 bp, Homo sapiens
gctgtgtgctcacgtagtggaa

SEQ ID NO: 8459972 - DNA, 22 bp, Homo sapiens
gcttttcctgactttccattag

SEQ ID NO: 8459973 - DNA, 22 bp, Homo sapiens
gcttttaattagttgcttccat

SEQ ID NO: 8459974 - DNA, 22 bp, Homo sapiens
gctttgtgtagaaggaggatgg

SEQ ID NO: 8459975 - DNA, 23 bp, Homo sapiens
gcttttaaacctgtgactgccgc

SEQ ID NO: 8459976 - DNA, 22 bp, Homo sapiens
gctttttcaaatgaaagctggt

SEQ ID NO: 8459977 - DNA, 22 bp, Homo sapiens
gcttttgtcattcaaatgctct

SEQ ID NO: 8459978 - DNA, 22 bp, Homo sapiens
gcttttgcctacatcttggtct

SEQ ID NO: 8459979 - DNA, 22 bp, Homo sapiens
gcttttcttcagcagcctgatg

SEQ ID NO: 8459980 - DNA, 22 bp, Homo sapiens
gcttttgtgagattaagctact

SEQ ID NO: 8459981 - DNA, 22 bp, Homo sapiens
gctttgtgaattattactcaca

SEQ ID NO: 8459982 - DNA, 22 bp, Homo sapiens
gctttagagaagaaaggttgct

SEQ ID NO: 8459983 - DNA, 22 bp, Homo sapiens
gctttagaaatgtaggagatac

SEQ ID NO: 8459984 - DNA, 22 bp, Homo sapiens
gctttagacataaagttcttca

SEQ ID NO: 8459985 - DNA, 22 bp, Homo sapiens
gctttagaagacactctgtttt

SEQ ID NO: 8459986 - DNA, 22 bp, Homo sapiens
gctttagaaatatcactgtgga

SEQ ID NO: 8459987 - DNA, 22 bp, Homo sapiens
gctttagaaatgagtaaattag

SEQ ID NO: 8459988 - DNA, 22 bp, Homo sapiens
gctttagatactcccaatgtcc

SEQ ID NO: 8459989 - DNA, 22 bp, Homo sapiens
gctttagagcccagcttggtgg

SEQ ID NO: 8459990 - DNA, 21 bp, Homo sapiens
gctttagatttagtgagccag

SEQ ID NO: 8459991 - DNA, 22 bp, Homo sapiens
gctttagatctgactttctgtg

SEQ ID NO: 8459992 - DNA, 22 bp, Homo sapiens
gctttagatagatttagtcttt

SEQ ID NO: 8459993 - DNA, 22 bp, Homo sapiens
gctttatagccctattacatga

SEQ ID NO: 8459994 - DNA, 22 bp, Homo sapiens
gctttatagccctattacatga

SEQ ID NO: 8459995 - DNA, 23 bp, Homo sapiens
gctttatagttctcccaacatta

SEQ ID NO: 8459996 - DNA, 23 bp, Homo sapiens
gctttatagttctcccaacatta

SEQ ID NO: 8459997 - DNA, 19 bp, Homo sapiens
gctgtattaaagatacatg

SEQ ID NO: 8459998 - DNA, 22 bp, Homo sapiens
gctgtattcaacagtgaaaaga

SEQ ID NO: 8459999 - DNA, 22 bp, Homo sapiens
gctgtatttatatgaaggcatg

SEQ ID NO: 8460000 - DNA, 22 bp, Homo sapiens
gctgtatttattttctagggtt

SEQ ID NO: 8460001 - DNA, 22 bp, Homo sapiens
gctgtaggtttttccaggagtt

SEQ ID NO: 8460002 - DNA, 22 bp, Homo sapiens
gctgtagggctgagctggaccg

SEQ ID NO: 8460003 - DNA, 22 bp, Homo sapiens
gctgtagggtgtcatatgaagc

SEQ ID NO: 8460004 - DNA, 22 bp, Homo sapiens
gctgtaggtaaggatggcaaag

SEQ ID NO: 8460005 - DNA, 22 bp, Homo sapiens
gctgtaggtcatttaatcacct

SEQ ID NO: 8460006 - DNA, 22 bp, Homo sapiens
gctgtaggaagacagaatgcag

SEQ ID NO: 8460007 - DNA, 22 bp, Homo sapiens
gctgtaggaatgacatgtacct

SEQ ID NO: 8460008 - DNA, 22 bp, Homo sapiens
gctgtaggttcagtctccatgc

SEQ ID NO: 8460009 - DNA, 22 bp, Homo sapiens
gctgtagtgaatggccgcgttc

SEQ ID NO: 8460010 - DNA, 22 bp, Homo sapiens
gctgtagtgaatggccgcgttc

SEQ ID NO: 8460011 - DNA, 22 bp, Homo sapiens
gctggccagccctcttcctcca

SEQ ID NO: 8460012 - DNA, 19 bp, Homo sapiens
gctggccacgccccagttg

SEQ ID NO: 8460013 - DNA, 22 bp, Homo sapiens
gctggccacagatccccaggga

SEQ ID NO: 8460014 - DNA, 22 bp, Homo sapiens
gctggccacagatccccaggga

SEQ ID NO: 8460015 - DNA, 22 bp, Homo sapiens
gctggccacagatccccaggga

SEQ ID NO: 8460016 - DNA, 22 bp, Homo sapiens
gctggccacactgctgatggag

SEQ ID NO: 8460017 - DNA, 22 bp, Homo sapiens
gctggccaaagtgtacctggag

SEQ ID NO: 8460018 - DNA, 22 bp, Homo sapiens
gctggccacactgctgatggag

SEQ ID NO: 8460019 - DNA, 22 bp, Homo sapiens
gctggccaggaagagtctcaga

SEQ ID NO: 8460020 - DNA, 22 bp, Homo sapiens
gctggtcagagagaaaggaggc

SEQ ID NO: 8460021 - DNA, 22 bp, Homo sapiens
gctggtccattggcactgctca

SEQ ID NO: 8460022 - DNA, 22 bp, Homo sapiens
gctggtcccaatgtgtttcctt

SEQ ID NO: 8460023 - DNA, 22 bp, Homo sapiens
gctgtacatcacaatttgctgt

SEQ ID NO: 8460024 - DNA, 22 bp, Homo sapiens
gctgtacattctgtgggtttgg

SEQ ID NO: 8460025 - DNA, 22 bp, Homo sapiens
gctgtcctcgtctctcacgcaa

SEQ ID NO: 8460026 - DNA, 22 bp, Homo sapiens
gctgtctgctgggtcgctcagg

SEQ ID NO: 8460027 - DNA, 22 bp, Homo sapiens
gctgtcccgaacccctggtaat

SEQ ID NO: 8460028 - DNA, 22 bp, Homo sapiens
gctgtccacggggttggtagag

SEQ ID NO: 8460029 - DNA, 22 bp, Homo sapiens
gctgtccagagcatgggagcaa

SEQ ID NO: 8460030 - DNA, 22 bp, Homo sapiens
gctgtcagttttacccacagac

SEQ ID NO: 8460031 - DNA, 22 bp, Homo sapiens
gctgtccaggttgtggagcaac

SEQ ID NO: 8460032 - DNA, 22 bp, Homo sapiens
gctgtccaggagtgcagagatt

SEQ ID NO: 8460033 - DNA, 22 bp, Homo sapiens
gctgtgtgacctgggcaagtct

SEQ ID NO: 8460034 - DNA, 19 bp, Homo sapiens
gctgtgtgaccttgggcaa

SEQ ID NO: 8460035 - DNA, 22 bp, Homo sapiens
gctgtgtgactgagagcctggc

SEQ ID NO: 8460036 - DNA, 19 bp, Homo sapiens
gctgtgtgaccttgggcaa

SEQ ID NO: 8460037 - DNA, 22 bp, Homo sapiens
gctgtgtgctaggatatgtttt

SEQ ID NO: 8460038 - DNA, 22 bp, Homo sapiens
gctgtctgctgtgcactgagca

SEQ ID NO: 8460039 - DNA, 22 bp, Homo sapiens
gctgtctgggatgtcactgctg

SEQ ID NO: 8460040 - DNA, 22 bp, Homo sapiens
gctgtctgggaggcctccactt

SEQ ID NO: 8460041 - DNA, 22 bp, Homo sapiens
gctgtctgtcttcacatctcgc

SEQ ID NO: 8460042 - DNA, 22 bp, Homo sapiens
gctgtctgtggtgtcagctgac

SEQ ID NO: 8460043 - DNA, 22 bp, Homo sapiens
gctgtgtgaccctagccagtag

SEQ ID NO: 8460044 - DNA, 23 bp, Homo sapiens
gctgtctgtcatctctgcgggag

SEQ ID NO: 8460045 - DNA, 22 bp, Homo sapiens
gctctcccgcagcctggtgggc

SEQ ID NO: 8460046 - DNA, 22 bp, Homo sapiens
gctctcccgcagcctggtgggc

SEQ ID NO: 8460047 - DNA, 22 bp, Homo sapiens
gctctctgaggtgctggcagag

SEQ ID NO: 8460048 - DNA, 22 bp, Homo sapiens
gctctctgcaagtcagcagcct

SEQ ID NO: 8460049 - DNA, 22 bp, Homo sapiens
gctctctgcaagtcagcagcct

SEQ ID NO: 8460050 - DNA, 22 bp, Homo sapiens
gctctctgcagcctccttggag

SEQ ID NO: 8460051 - DNA, 22 bp, Homo sapiens
gctctctcgtgaacaggtggtt

SEQ ID NO: 8460052 - DNA, 22 bp, Homo sapiens
gctctctcttggggattcagca

SEQ ID NO: 8460053 - DNA, 22 bp, Homo sapiens
gctccccttggtcctcctggga

SEQ ID NO: 8460054 - DNA, 22 bp, Homo sapiens
gctcccaggatgaggagccagg

SEQ ID NO: 8460055 - DNA, 22 bp, Homo sapiens
gctccccattgatctgcaggct

SEQ ID NO: 8460056 - DNA, 22 bp, Homo sapiens
gctccccattgatctgcaggct

SEQ ID NO: 8460057 - DNA, 20 bp, Homo sapiens
gctcccagcctgcagtcccc

SEQ ID NO: 8460058 - DNA, 22 bp, Homo sapiens
gctcccagcattgctgctgaat

SEQ ID NO: 8460059 - DNA, 20 bp, Homo sapiens
gctcccagcctgcagtcccc

SEQ ID NO: 8460060 - DNA, 22 bp, Homo sapiens
gctcccaggatgaggagccagg

SEQ ID NO: 8460061 - DNA, 22 bp, Homo sapiens
gctcccaggaagagaagggcca

SEQ ID NO: 8460062 - DNA, 22 bp, Homo sapiens
gctcccaggaagagaagggcca

SEQ ID NO: 8460063 - DNA, 22 bp, Homo sapiens
gctctgggtagccactgcctgg

SEQ ID NO: 8460064 - DNA, 22 bp, Homo sapiens
gctctgtacctgcggagatgag

SEQ ID NO: 8460065 - DNA, 22 bp, Homo sapiens
gctctgtaaagaagagaaatgc

SEQ ID NO: 8460066 - DNA, 22 bp, Homo sapiens
gctctgtacgcaggatgagggg

SEQ ID NO: 8460067 - DNA, 22 bp, Homo sapiens
gctctgtatcttacaacagggt

SEQ ID NO: 8460068 - DNA, 22 bp, Homo sapiens
gctctgtatctgtggggcttcc

SEQ ID NO: 8460069 - DNA, 22 bp, Homo sapiens
gctctgtagtgggcatgtgatt

SEQ ID NO: 8460070 - DNA, 21 bp, Homo sapiens
gctctgtacgttggtgccttc

SEQ ID NO: 8460071 - DNA, 22 bp, Homo sapiens
gctctgtagtatttagtaaata

SEQ ID NO: 8460072 - DNA, 22 bp, Homo sapiens
gctctggggttggaaagtgatc

SEQ ID NO: 8460073 - DNA, 22 bp, Homo sapiens
gctctggggttggaaagtgatc

SEQ ID NO: 8460074 - DNA, 22 bp, Homo sapiens
gctctctggaggccatggacag

SEQ ID NO: 8460075 - DNA, 22 bp, Homo sapiens
gctctctgccatatgaggatac

SEQ ID NO: 8460076 - DNA, 22 bp, Homo sapiens
gctctctgggtggtgggcaaca

SEQ ID NO: 8460077 - DNA, 22 bp, Homo sapiens
gctctctggttccagtcaggaa

SEQ ID NO: 8460078 - DNA, 22 bp, Homo sapiens
gctctctggttccagtcaggaa

SEQ ID NO: 8460079 - DNA, 22 bp, Homo sapiens
gctctctgggtgtgtctagata

SEQ ID NO: 8460080 - DNA, 22 bp, Homo sapiens
gctctctggaggccatggacag

SEQ ID NO: 8460081 - DNA, 22 bp, Homo sapiens
gctctgtgctagaactaagaat

SEQ ID NO: 8460082 - DNA, 19 bp, Homo sapiens
gctctgtgatgctgagggg

SEQ ID NO: 8460083 - DNA, 19 bp, Homo sapiens
gctctgtgatgctgagggg

SEQ ID NO: 8460084 - DNA, 22 bp, Homo sapiens
gctctgtgccacatgcagtgtt

SEQ ID NO: 8460085 - DNA, 22 bp, Homo sapiens
gctctgtatgtagttcttgctt

SEQ ID NO: 8460086 - DNA, 22 bp, Homo sapiens
gctctgtatgagggtgagagat

SEQ ID NO: 8460087 - DNA, 22 bp, Homo sapiens
gctagaatattgggtaggcaag

SEQ ID NO: 8460088 - DNA, 22 bp, Homo sapiens
gctagagaccagaggccttgaa

SEQ ID NO: 8460089 - DNA, 22 bp, Homo sapiens
gctagcctgcagtggctatggt

SEQ ID NO: 8460090 - DNA, 22 bp, Homo sapiens
gctagcctgcagtggctatggt

SEQ ID NO: 8460091 - DNA, 22 bp, Homo sapiens
gctaggagccgctgcactaggt

SEQ ID NO: 8460092 - DNA, 17 bp, Homo sapiens
gctaggagagggaggag

SEQ ID NO: 8460093 - DNA, 22 bp, Homo sapiens
gctaggagattgagctctgaag

SEQ ID NO: 8460094 - DNA, 17 bp, Homo sapiens
gctaggagagggaggag

SEQ ID NO: 8460095 - DNA, 22 bp, Homo sapiens
gctaggctcggaagcagcaggg

SEQ ID NO: 8460096 - DNA, 22 bp, Homo sapiens
gctaggctcttccatcagggca

SEQ ID NO: 8460097 - DNA, 22 bp, Homo sapiens
gctaggagtggtgggtcaagga

SEQ ID NO: 8460098 - DNA, 20 bp, Homo sapiens
gctaggctgtgtcctgccca

SEQ ID NO: 8460099 - DNA, 18 bp, Homo sapiens
gctagggcatgcatggtg

SEQ ID NO: 8460100 - DNA, 22 bp, Homo sapiens
gctagggatctgatttgctgtt

SEQ ID NO: 8460101 - DNA, 22 bp, Homo sapiens
gcctggcagattgacatagcca

SEQ ID NO: 8460102 - DNA, 22 bp, Homo sapiens
gcctggcaggcctcatgagggg

SEQ ID NO: 8460103 - DNA, 22 bp, Homo sapiens
gcctggcaggcctcatgagggg

SEQ ID NO: 8460104 - DNA, 22 bp, Homo sapiens
gcctggcagcctccaaccttca

SEQ ID NO: 8460105 - DNA, 22 bp, Homo sapiens
gcctggagttcagccaagtccc

SEQ ID NO: 8460106 - DNA, 22 bp, Homo sapiens
gcctggagtggtcctgctgccc

SEQ ID NO: 8460107 - DNA, 22 bp, Homo sapiens
gcctggagtggtcctgctgccc

SEQ ID NO: 8460108 - DNA, 22 bp, Homo sapiens
gctcagggagagagggcagccg

SEQ ID NO: 8460109 - DNA, 22 bp, Homo sapiens
gctcagggagtttcacagtgta

SEQ ID NO: 8460110 - DNA, 20 bp, Homo sapiens
gctcagggcctgggtctgga

SEQ ID NO: 8460111 - DNA, 20 bp, Homo sapiens
gctcagggcctgggtctgga

SEQ ID NO: 8460112 - DNA, 22 bp, Homo sapiens
gctcagggccatggaccagcag

SEQ ID NO: 8460113 - DNA, 22 bp, Homo sapiens
gctcagggcctggctgcggact

SEQ ID NO: 8460114 - DNA, 22 bp, Homo sapiens
gctcagggcctggctgcggact

SEQ ID NO: 8460115 - DNA, 22 bp, Homo sapiens
gctagtccacagccatccaggc

SEQ ID NO: 8460116 - DNA, 22 bp, Homo sapiens
gctaggttggggaagttctcct

SEQ ID NO: 8460117 - DNA, 22 bp, Homo sapiens
gctcagggagagagggcagccg

SEQ ID NO: 8460118 - DNA, 22 bp, Homo sapiens
gctcagggaactttttgcaggc

SEQ ID NO: 8460119 - DNA, 22 bp, Homo sapiens
gctcagggaaggccacgtgaga

SEQ ID NO: 8460120 - DNA, 22 bp, Homo sapiens
gctcagggaatgagaagatgtt

SEQ ID NO: 8460121 - DNA, 22 bp, Homo sapiens
gctcccagactgaccagaggtg

SEQ ID NO: 8460122 - DNA, 22 bp, Homo sapiens
gctcccagactgaccagaggtg

SEQ ID NO: 8460123 - DNA, 22 bp, Homo sapiens
gctcccagcaattgaggcagcc

SEQ ID NO: 8460124 - DNA, 22 bp, Homo sapiens
gctcccagcaattgaggcagcc

SEQ ID NO: 8460125 - DNA, 22 bp, Homo sapiens
gctcagggcgcgagggacgtgg

SEQ ID NO: 8460126 - DNA, 20 bp, Homo sapiens
gctcagtggagaaatgcacc

SEQ ID NO: 8460127 - DNA, 22 bp, Homo sapiens
gctcagtgtgttcaagggctca

SEQ ID NO: 8460128 - DNA, 22 bp, Homo sapiens
gctcagtgtttctggtagaaaa

SEQ ID NO: 8460129 - DNA, 22 bp, Homo sapiens
gctgaggttttctgcctgctca

SEQ ID NO: 8460130 - DNA, 22 bp, Homo sapiens
gctgaggtttcaggagtggcag

SEQ ID NO: 8460131 - DNA, 22 bp, Homo sapiens
gctgaggtggctgccttagtaa

SEQ ID NO: 8460132 - DNA, 22 bp, Homo sapiens
gctctgtggtggggcagagttt

SEQ ID NO: 8460133 - DNA, 22 bp, Homo sapiens
gctctgtgtaaatgtagggtcc

SEQ ID NO: 8460134 - DNA, 20 bp, Homo sapiens
gctgaggggtctatggcata

SEQ ID NO: 8460135 - DNA, 22 bp, Homo sapiens
gctgagggtctgttcatgttgc

SEQ ID NO: 8460136 - DNA, 22 bp, Homo sapiens
gctgagggtctgttcatgttgc

SEQ ID NO: 8460137 - DNA, 22 bp, Homo sapiens
gctgagggggaaggaaagctga

SEQ ID NO: 8460138 - DNA, 22 bp, Homo sapiens
gctgagtcttgcctgtgctgtc

SEQ ID NO: 8460139 - DNA, 22 bp, Homo sapiens
gctgagtgaggtccagagcttg

SEQ ID NO: 8460140 - DNA, 22 bp, Homo sapiens
gctgagtgaggtccagagcttg

SEQ ID NO: 8460141 - DNA, 22 bp, Homo sapiens
gctgcaggcattttcctgggca

SEQ ID NO: 8460142 - DNA, 22 bp, Homo sapiens
gctgcaggcagaatctcccaat

SEQ ID NO: 8460143 - DNA, 22 bp, Homo sapiens
gctgcaggcgcctgcggtctct

SEQ ID NO: 8460144 - DNA, 22 bp, Homo sapiens
gctgcaggcgcctgcggtctct

SEQ ID NO: 8460145 - DNA, 18 bp, Homo sapiens
gctgcaggcgcctgcggt

SEQ ID NO: 8460146 - DNA, 18 bp, Homo sapiens
gctgcaggcgcctgcggt

SEQ ID NO: 8460147 - DNA, 22 bp, Homo sapiens
gctgatagactgaatgttggga

SEQ ID NO: 8460148 - DNA, 22 bp, Homo sapiens
gctgcaggcattttcctgggca

SEQ ID NO: 8460149 - DNA, 22 bp, Homo sapiens
gctgcaggcattttcctgggca

SEQ ID NO: 8460150 - DNA, 18 bp, Homo sapiens
gctgcaggccctccgagg

SEQ ID NO: 8460151 - DNA, 18 bp, Homo sapiens
gctgcaggccctccgagg

SEQ ID NO: 8460152 - DNA, 22 bp, Homo sapiens
gctgcagggagctggaaggctc

SEQ ID NO: 8460153 - DNA, 22 bp, Homo sapiens
gctgcagggagctggaaggctc

SEQ ID NO: 8460154 - DNA, 22 bp, Homo sapiens
gctgcagggagctggaaggctc

SEQ ID NO: 8460155 - DNA, 21 bp, Homo sapiens
gctgcagggcccagggcaccc

SEQ ID NO: 8460156 - DNA, 21 bp, Homo sapiens
gctgcagggcccagggcaccc

SEQ ID NO: 8460157 - DNA, 22 bp, Homo sapiens
gctgcagggctctcacaggggg

SEQ ID NO: 8460158 - DNA, 22 bp, Homo sapiens
gctgcagggctctcacaggggg

SEQ ID NO: 8460159 - DNA, 22 bp, Homo sapiens
gctgcagggctctcacaggggg

SEQ ID NO: 8460160 - DNA, 22 bp, Homo sapiens
gctgcaggggggtctggacttg

SEQ ID NO: 8460161 - DNA, 22 bp, Homo sapiens
gctgcaggggggtctggacttg

SEQ ID NO: 8460162 - DNA, 22 bp, Homo sapiens
gctgcaggggggtctggacttg

SEQ ID NO: 8460163 - DNA, 22 bp, Homo sapiens
gctgcagggagctggaaggctc

SEQ ID NO: 8460164 - DNA, 22 bp, Homo sapiens
gctgcagggaatgtatggattt

SEQ ID NO: 8460165 - DNA, 22 bp, Homo sapiens
gctgcaggctgtggcaggggag

SEQ ID NO: 8460166 - DNA, 22 bp, Homo sapiens
gctgcaggctgtggcaggggag

SEQ ID NO: 8460167 - DNA, 22 bp, Homo sapiens
gctgcagggaatgtatggattt

SEQ ID NO: 8460168 - DNA, 22 bp, Homo sapiens
gctgcaggctgtggcaggggag

SEQ ID NO: 8460169 - DNA, 22 bp, Homo sapiens
gctgcaggctctgcaggaattg

SEQ ID NO: 8460170 - DNA, 22 bp, Homo sapiens
gctgcaggcggccgtggtggcg

SEQ ID NO: 8460171 - DNA, 22 bp, Homo sapiens
gctgcaggcggccgtggtggcg

SEQ ID NO: 8460172 - DNA, 22 bp, Homo sapiens
gctgcaggcggccgtggtggcg

SEQ ID NO: 8460173 - DNA, 22 bp, Homo sapiens
gctgcctctgcacagctcactc

SEQ ID NO: 8460174 - DNA, 22 bp, Homo sapiens
gctgcctctgcgactctgggcg

SEQ ID NO: 8460175 - DNA, 22 bp, Homo sapiens
gctgcctctgcgactctgggcg

SEQ ID NO: 8460176 - DNA, 22 bp, Homo sapiens
gctgcctcctgagatttgggca

SEQ ID NO: 8460177 - DNA, 22 bp, Homo sapiens
gctgcctcccccatggctggaa

SEQ ID NO: 8460178 - DNA, 22 bp, Homo sapiens
gctgcctcccccatggctggaa

SEQ ID NO: 8460179 - DNA, 23 bp, Homo sapiens
gctgcctcctacaaaagcccagc

SEQ ID NO: 8460180 - DNA, 22 bp, Homo sapiens
gctgcctccgccggctccacag

SEQ ID NO: 8460181 - DNA, 22 bp, Homo sapiens
gctgcctccactggctcccagt

SEQ ID NO: 8460182 - DNA, 22 bp, Homo sapiens
gctgcctccactggctcccagt

SEQ ID NO: 8460183 - DNA, 22 bp, Homo sapiens
gctgcctcccagagccctgcag

SEQ ID NO: 8460184 - DNA, 22 bp, Homo sapiens
gctggagcttgagaggacaggg

SEQ ID NO: 8460185 - DNA, 22 bp, Homo sapiens
gctggagctgcagcctgggcct

SEQ ID NO: 8460186 - DNA, 22 bp, Homo sapiens
gctgctgtcagcaggccttgtt

SEQ ID NO: 8460187 - DNA, 22 bp, Homo sapiens
gctgctggtcctcagagctcat

SEQ ID NO: 8460188 - DNA, 22 bp, Homo sapiens
gctgctgggtccctctgtgcca

SEQ ID NO: 8460189 - DNA, 22 bp, Homo sapiens
gctgctgggtccctctgtgcca

SEQ ID NO: 8460190 - DNA, 22 bp, Homo sapiens
gctgctggggtggagaaacgct

SEQ ID NO: 8460191 - DNA, 19 bp, Homo sapiens
gctgctggctctggctgga

SEQ ID NO: 8460192 - DNA, 19 bp, Homo sapiens
gctgctggctctggctgga

SEQ ID NO: 8460193 - DNA, 22 bp, Homo sapiens
gctgctgggaatgaacagtgtt

SEQ ID NO: 8460194 - DNA, 22 bp, Homo sapiens
gctgctggcttcctgctgtttt

SEQ ID NO: 8460195 - DNA, 22 bp, Homo sapiens
gctgctgggatcctgggtctca

SEQ ID NO: 8460196 - DNA, 22 bp, Homo sapiens
gctgctggggtcacatggtaag

SEQ ID NO: 8460197 - DNA, 22 bp, Homo sapiens
gctgcctctgtagctttggacc

SEQ ID NO: 8460198 - DNA, 22 bp, Homo sapiens
gctgctggaagcatgcgatgaa

SEQ ID NO: 8460199 - DNA, 22 bp, Homo sapiens
gctgctggaacaaatcacccca

SEQ ID NO: 8460200 - DNA, 22 bp, Homo sapiens
gctggaggtagggaggtcctgt

SEQ ID NO: 8460201 - DNA, 22 bp, Homo sapiens
gctggaggtttcacctgagttt

SEQ ID NO: 8460202 - DNA, 22 bp, Homo sapiens
gctggagtccagtggcatgatc

SEQ ID NO: 8460203 - DNA, 22 bp, Homo sapiens
gctggagtgctggagtgcagtg

SEQ ID NO: 8460204 - DNA, 22 bp, Homo sapiens
gctggagttaggtgggcttgaa

SEQ ID NO: 8460205 - DNA, 22 bp, Homo sapiens
gctggagttagaactagcctgg

SEQ ID NO: 8460206 - DNA, 22 bp, Homo sapiens
gctggagtgcagttgcacagtc

SEQ ID NO: 8460207 - DNA, 22 bp, Homo sapiens
gctggagtgatgcctgtgtctc

SEQ ID NO: 8460208 - DNA, 22 bp, Homo sapiens
gctggagtgctgaggtgcagtg

SEQ ID NO: 8460209 - DNA, 22 bp, Homo sapiens
gctggagtgctgaggtgcagtg

SEQ ID NO: 8460210 - DNA, 22 bp, Homo sapiens
gctggagtctggaggtgtgcca

SEQ ID NO: 8460211 - DNA, 22 bp, Homo sapiens
gctggcaggtaaagccccgggg

SEQ ID NO: 8460212 - DNA, 22 bp, Homo sapiens
gctggcaggtaaagccccgggg

SEQ ID NO: 8460213 - DNA, 22 bp, Homo sapiens
gctggcagggttctcactgaaa

SEQ ID NO: 8460214 - DNA, 22 bp, Homo sapiens
gctggcaggtccaagatagagc

SEQ ID NO: 8460215 - DNA, 22 bp, Homo sapiens
gctggcagggtggttgagagag

SEQ ID NO: 8460216 - DNA, 22 bp, Homo sapiens
gctggagttggcaaggcatgta

SEQ ID NO: 8460217 - DNA, 22 bp, Homo sapiens
gctggcagtcccatcagctggg

SEQ ID NO: 8460218 - DNA, 22 bp, Homo sapiens
gctggcagtaaagggtttggca

SEQ ID NO: 8460219 - DNA, 22 bp, Homo sapiens
gctggcagtaaagggtttggca

SEQ ID NO: 8460220 - DNA, 22 bp, Homo sapiens
gctggcagtttcctcaccgagg

SEQ ID NO: 8460221 - DNA, 22 bp, Homo sapiens
gctggcagtgtgaatgacaagc

SEQ ID NO: 8460222 - DNA, 22 bp, Homo sapiens
gctggcagtgtattgttagctg

SEQ ID NO: 8460223 - DNA, 22 bp, Homo sapiens
gctggcattacaggagagaacc

SEQ ID NO: 8460224 - DNA, 19 bp, Homo sapiens
ggggagaactagagacagc

SEQ ID NO: 8460225 - DNA, 22 bp, Homo sapiens
gggcttctgttcctttcacttg

SEQ ID NO: 8460226 - DNA, 22 bp, Homo sapiens
gggcttctgtacctacctggaa

SEQ ID NO: 8460227 - DNA, 22 bp, Homo sapiens
ggggagaataaatcagatttta

SEQ ID NO: 8460228 - DNA, 22 bp, Homo sapiens
ggggagaattaccaaaagcgct

SEQ ID NO: 8460229 - DNA, 22 bp, Homo sapiens
ggggagaattacatggcgtgga

SEQ ID NO: 8460230 - DNA, 22 bp, Homo sapiens
ggggaggaagctggaacacggg

SEQ ID NO: 8460231 - DNA, 22 bp, Homo sapiens
ggggaggacctttccaaggctt

SEQ ID NO: 8460232 - DNA, 22 bp, Homo sapiens
ggggaggacctttccaaggctt

SEQ ID NO: 8460233 - DNA, 22 bp, Homo sapiens
ggggaggagccatgtaactagt

SEQ ID NO: 8460234 - DNA, 22 bp, Homo sapiens
ggggaggagtgtacaggtttat

SEQ ID NO: 8460235 - DNA, 22 bp, Homo sapiens
ggggaggagtgtacaggtttat

SEQ ID NO: 8460236 - DNA, 22 bp, Homo sapiens
ggggaggctgatgtgggcaaag

SEQ ID NO: 8460237 - DNA, 22 bp, Homo sapiens
ggggcagggaggttatcgccga

SEQ ID NO: 8460238 - DNA, 22 bp, Homo sapiens
ggggccactggcaggaccttgg

SEQ ID NO: 8460239 - DNA, 21 bp, Homo sapiens
ggggatgcgaccacaggctcc

SEQ ID NO: 8460240 - DNA, 22 bp, Homo sapiens
ggggagtgttttcatgggcttg

SEQ ID NO: 8460241 - DNA, 22 bp, Homo sapiens
gggcttctattcaagtctgttt

SEQ ID NO: 8460242 - DNA, 22 bp, Homo sapiens
gggcttctagaatttctgatat

SEQ ID NO: 8460243 - DNA, 22 bp, Homo sapiens
gggcttctaagtgaaagtgtaa

SEQ ID NO: 8460244 - DNA, 22 bp, Homo sapiens
gggcttctacttgcaaaggata

SEQ ID NO: 8460245 - DNA, 22 bp, Homo sapiens
gggcttctctgatcaatatttc

SEQ ID NO: 8460246 - DNA, 22 bp, Homo sapiens
gggcttctattctggcacaaga

SEQ ID NO: 8460247 - DNA, 22 bp, Homo sapiens
gggcttctagaccagcagtgag

SEQ ID NO: 8460248 - DNA, 22 bp, Homo sapiens
gggcttctattctggcacaaga

SEQ ID NO: 8460249 - DNA, 22 bp, Homo sapiens
gggcttctcagagaggctttag

SEQ ID NO: 8460250 - DNA, 22 bp, Homo sapiens
gggcttctccctaaggactctg

SEQ ID NO: 8460251 - DNA, 22 bp, Homo sapiens
gggcttctccctaaggactctg

SEQ ID NO: 8460252 - DNA, 22 bp, Homo sapiens
gggcttctctcaggggcatgag

SEQ ID NO: 8460253 - DNA, 22 bp, Homo sapiens
gggcttctctcagaaactatca

SEQ ID NO: 8460254 - DNA, 22 bp, Homo sapiens
gggcttctgctcttttggtgct

SEQ ID NO: 8460255 - DNA, 22 bp, Homo sapiens
gggcttctctttagtgagctga

SEQ ID NO: 8460256 - DNA, 22 bp, Homo sapiens
gggcttctctgggagtcctggt

SEQ ID NO: 8460257 - DNA, 22 bp, Homo sapiens
gggcttctcttatgctaactgg

SEQ ID NO: 8460258 - DNA, 22 bp, Homo sapiens
gggcttctggctactgtatgag

SEQ ID NO: 8460259 - DNA, 22 bp, Homo sapiens
gggcttctggtcattcctcatc

SEQ ID NO: 8460260 - DNA, 19 bp, Homo sapiens
gggcttctgggatcaagag

SEQ ID NO: 8460261 - DNA, 22 bp, Homo sapiens
gggcttctgggcaccactccct

SEQ ID NO: 8460262 - DNA, 16 bp, Homo sapiens
gggctgggggattctg

SEQ ID NO: 8460263 - DNA, 22 bp, Homo sapiens
gggctctggggtgccctggcat

SEQ ID NO: 8460264 - DNA, 22 bp, Homo sapiens
gggctctggggtcagacagcct

SEQ ID NO: 8460265 - DNA, 22 bp, Homo sapiens
gggctgtgttaggtgcggttac

SEQ ID NO: 8460266 - DNA, 19 bp, Homo sapiens
gggctctggcctcagtggg

SEQ ID NO: 8460267 - DNA, 22 bp, Homo sapiens
gggctctgggatgctcttagag

SEQ ID NO: 8460268 - DNA, 22 bp, Homo sapiens
gggctctgggattcagagcaag

SEQ ID NO: 8460269 - DNA, 22 bp, Homo sapiens
gggctctgggattcagagcaag

SEQ ID NO: 8460270 - DNA, 22 bp, Homo sapiens
gggtggtgtattagagctgcag

SEQ ID NO: 8460271 - DNA, 22 bp, Homo sapiens
gggtgaggagctgccagtcatg

SEQ ID NO: 8460272 - DNA, 20 bp, Homo sapiens
gggtgaggatggagaatttg

SEQ ID NO: 8460273 - DNA, 22 bp, Homo sapiens
gggtgcagcagagctcctctgt

SEQ ID NO: 8460274 - DNA, 18 bp, Homo sapiens
gggtgctggggccccttg

SEQ ID NO: 8460275 - DNA, 21 bp, Homo sapiens
gggtgctgtggtcatgcagga

SEQ ID NO: 8460276 - DNA, 22 bp, Homo sapiens
gggtgctgggaggctgacatct

SEQ ID NO: 8460277 - DNA, 22 bp, Homo sapiens
ggggtggcctgtaggcagcatg

SEQ ID NO: 8460278 - DNA, 19 bp, Homo sapiens
ggggtggctggggctccag

SEQ ID NO: 8460279 - DNA, 22 bp, Homo sapiens
ggggtgggagtgccatccttga

SEQ ID NO: 8460280 - DNA, 22 bp, Homo sapiens
ggggtgggcgtgcagggacacc

SEQ ID NO: 8460281 - DNA, 22 bp, Homo sapiens
ggggtgggagtgccatccttga

SEQ ID NO: 8460282 - DNA, 22 bp, Homo sapiens
ggggcccagggcagcagtgcag

SEQ ID NO: 8460283 - DNA, 22 bp, Homo sapiens
ggggccagcttcgcgtgctctt

SEQ ID NO: 8460284 - DNA, 22 bp, Homo sapiens
ggggccaggtccagcttccaaa

SEQ ID NO: 8460285 - DNA, 22 bp, Homo sapiens
ggggccagtaggagtgatgtac

SEQ ID NO: 8460286 - DNA, 22 bp, Homo sapiens
ggtggagtaattcgcagaggtt

SEQ ID NO: 8460287 - DNA, 22 bp, Homo sapiens
ggtggatggactctcgggggcc

SEQ ID NO: 8460288 - DNA, 22 bp, Homo sapiens
ggtggatgctgactgttctgct

SEQ ID NO: 8460289 - DNA, 22 bp, Homo sapiens
ggtggcaccttgatcttggact

SEQ ID NO: 8460290 - DNA, 22 bp, Homo sapiens
ggtggcaccttaccctgcgcag

SEQ ID NO: 8460291 - DNA, 22 bp, Homo sapiens
ggtggcacactggggagctcgg

SEQ ID NO: 8460292 - DNA, 22 bp, Homo sapiens
ggtggagagctggatgagaggt

SEQ ID NO: 8460293 - DNA, 22 bp, Homo sapiens
ggtgggcaggcgaggcccaggt

SEQ ID NO: 8460294 - DNA, 22 bp, Homo sapiens
ggtggcagagacataggacata

SEQ ID NO: 8460295 - DNA, 22 bp, Homo sapiens
ggtggcagagacataggacata

SEQ ID NO: 8460296 - DNA, 22 bp, Homo sapiens
ggtggcactcattatcaggtgc

SEQ ID NO: 8460297 - DNA, 22 bp, Homo sapiens
ggtggcaccttgatcttggact

SEQ ID NO: 8460298 - DNA, 22 bp, Homo sapiens
ggtggcactcaaccttttatta

SEQ ID NO: 8460299 - DNA, 22 bp, Homo sapiens
ggtggcagaataattgaaggtc

SEQ ID NO: 8460300 - DNA, 22 bp, Homo sapiens
ggtggggagtcaggcattcttg

SEQ ID NO: 8460301 - DNA, 22 bp, Homo sapiens
ggtggggcccaggcatctgatg

SEQ ID NO: 8460302 - DNA, 22 bp, Homo sapiens
ggtggggccagggctccaacct

SEQ ID NO: 8460303 - DNA, 22 bp, Homo sapiens
ggtggtggagccagctgggagt

SEQ ID NO: 8460304 - DNA, 22 bp, Homo sapiens
ggttagagggcatgcgatcttt

SEQ ID NO: 8460305 - DNA, 22 bp, Homo sapiens
ggttactcaagcctgccttctc

SEQ ID NO: 8460306 - DNA, 19 bp, Homo sapiens
ggttatttgagggttaaga

SEQ ID NO: 8460307 - DNA, 23 bp, Homo sapiens
ggttatttgcatcctgtaattat

SEQ ID NO: 8460308 - DNA, 22 bp, Homo sapiens
ggtttaaaagccatgcatgggg

SEQ ID NO: 8460309 - DNA, 22 bp, Homo sapiens
gtaattacatgagtactgtaag

SEQ ID NO: 8460310 - DNA, 22 bp, Homo sapiens
gtaattacattagggtaaataa

SEQ ID NO: 8460311 - DNA, 22 bp, Homo sapiens
ggttggggcgagctggaggccc

SEQ ID NO: 8460312 - DNA, 22 bp, Homo sapiens
ggttggggcgagctggaggccc

SEQ ID NO: 8460313 - DNA, 22 bp, Homo sapiens
ggttcagtttacattaaaatct

SEQ ID NO: 8460314 - DNA, 22 bp, Homo sapiens
gggtttcatggttctcacaatg

SEQ ID NO: 8460315 - DNA, 19 bp, Homo sapiens
gggttgtgtggaaggtatc

SEQ ID NO: 8460316 - DNA, 22 bp, Homo sapiens
ggtcccagctggtcactgtcag

SEQ ID NO: 8460317 - DNA, 22 bp, Homo sapiens
ggtcccagctggtcactgtcag

SEQ ID NO: 8460318 - DNA, 22 bp, Homo sapiens
gggttggattacttagggagaa

SEQ ID NO: 8460319 - DNA, 22 bp, Homo sapiens
gggttggatcctggtggctgcc

SEQ ID NO: 8460320 - DNA, 22 bp, Homo sapiens
gggtgtccagggcgtgtctgga

SEQ ID NO: 8460321 - DNA, 22 bp, Homo sapiens
gggtgtccagggcgtgtctgga

SEQ ID NO: 8460322 - DNA, 22 bp, Homo sapiens
gggttgaggcggatgtcggcgg

SEQ ID NO: 8460323 - DNA, 22 bp, Homo sapiens
ggtcccagttgcccaggtcagg

SEQ ID NO: 8460324 - DNA, 23 bp, Homo sapiens
ggtcccagtggagaggcctcacc

SEQ ID NO: 8460325 - DNA, 23 bp, Homo sapiens
ggtcccagtggagaggcctcacc

SEQ ID NO: 8460326 - DNA, 22 bp, Homo sapiens
ggtccccccatggtgagcactg

SEQ ID NO: 8460327 - DNA, 22 bp, Homo sapiens
ggtcccatgactgacacagcag

SEQ ID NO: 8460328 - DNA, 23 bp, Homo sapiens
ggtcccagtggagaggcctcacc

SEQ ID NO: 8460329 - DNA, 22 bp, Homo sapiens
ggtcccagtcctctccctgcta

SEQ ID NO: 8460330 - DNA, 22 bp, Homo sapiens
ggtcccaggattggttgcgcag

SEQ ID NO: 8460331 - DNA, 22 bp, Homo sapiens
ggtccctgaagatgcctgagga

SEQ ID NO: 8460332 - DNA, 23 bp, Homo sapiens
ggtccctgacagcgggcaagttg

SEQ ID NO: 8460333 - DNA, 22 bp, Homo sapiens
ggtgagggagtggaacgaggtg

SEQ ID NO: 8460334 - DNA, 22 bp, Homo sapiens
ggtgctcaaggtgacaggacat

SEQ ID NO: 8460335 - DNA, 21 bp, Homo sapiens
ggtgctcgctgatgaggagtg

SEQ ID NO: 8460336 - DNA, 22 bp, Homo sapiens
ggtggacagtgttagctctggg

SEQ ID NO: 8460337 - DNA, 22 bp, Homo sapiens
ggtgagggacatcactcagcca

SEQ ID NO: 8460338 - DNA, 18 bp, Homo sapiens
ggtgagggagctggaagc

SEQ ID NO: 8460339 - DNA, 22 bp, Homo sapiens
ggtgagagtcttgtggtcccag

SEQ ID NO: 8460340 - DNA, 22 bp, Homo sapiens
ggtgagcaaagcttcatctgta

SEQ ID NO: 8460341 - DNA, 22 bp, Homo sapiens
ggtgacagcgggtcaagaggag

SEQ ID NO: 8460342 - DNA, 21 bp, Homo sapiens
ggtgacacgtggccccgctct

SEQ ID NO: 8460343 - DNA, 22 bp, Homo sapiens
ggtgacagccgcttgccctgta

SEQ ID NO: 8460344 - DNA, 22 bp, Homo sapiens
ggtgagcagctgtctgtatgga

SEQ ID NO: 8460345 - DNA, 22 bp, Homo sapiens
ggtgagcactgccctgggtctc

SEQ ID NO: 8460346 - DNA, 22 bp, Homo sapiens
ggtgagcactgccctgggtctc

SEQ ID NO: 8460347 - DNA, 22 bp, Homo sapiens
ggtgaggcagagggagtaacct

SEQ ID NO: 8460348 - DNA, 22 bp, Homo sapiens
ggtgaggaaagatggtgacagt

SEQ ID NO: 8460349 - DNA, 22 bp, Homo sapiens
gtagttattgctgtttacttct

SEQ ID NO: 8460350 - DNA, 22 bp, Homo sapiens
gtataaggtatgtaaactattt

SEQ ID NO: 8460351 - DNA, 22 bp, Homo sapiens
gtatacaactattgttgggtaa

SEQ ID NO: 8460352 - DNA, 22 bp, Homo sapiens
gtataagcccattctcagagac

SEQ ID NO: 8460353 - DNA, 19 bp, Homo sapiens
gtataacttacaccagcaa

SEQ ID NO: 8460354 - DNA, 22 bp, Homo sapiens
gtataactgctaccacctgatg

SEQ ID NO: 8460355 - DNA, 22 bp, Homo sapiens
gtataaagtataagcttgtttt

SEQ ID NO: 8460356 - DNA, 22 bp, Homo sapiens
gtataaaggcacaggttttctg

SEQ ID NO: 8460357 - DNA, 22 bp, Homo sapiens
gtatacactggtaagatttgtc

SEQ ID NO: 8460358 - DNA, 22 bp, Homo sapiens
gtatacaatacacaatgctctg

SEQ ID NO: 8460359 - DNA, 22 bp, Homo sapiens
gtattttatggcctggggccta

SEQ ID NO: 8460360 - DNA, 22 bp, Homo sapiens
gtattttatggcatgcagtggc

SEQ ID NO: 8460361 - DNA, 22 bp, Homo sapiens
gtcaaacaaattaacatatcca

SEQ ID NO: 8460362 - DNA, 20 bp, Homo sapiens
gtcaaactactggcagtgcc

SEQ ID NO: 8460363 - DNA, 22 bp, Homo sapiens
gtcaaatgcacagaaccattaa

SEQ ID NO: 8460364 - DNA, 22 bp, Homo sapiens
gtcaacaaagaaaattgttaat

SEQ ID NO: 8460365 - DNA, 22 bp, Homo sapiens
gtcaacaaggtttgcttatctt

SEQ ID NO: 8460366 - DNA, 22 bp, Homo sapiens
gtcaaatatactaagaggtaaa

SEQ ID NO: 8460367 - DNA, 22 bp, Homo sapiens
gtcaaatattatgcagcttgga

SEQ ID NO: 8460368 - DNA, 22 bp, Homo sapiens
gtcaaatatatgcaaaactatt

SEQ ID NO: 8460369 - DNA, 22 bp, Homo sapiens
gtatttttaggtaaggaaagta

SEQ ID NO: 8460370 - DNA, 22 bp, Homo sapiens
gtatttttagtagagtcggggt

SEQ ID NO: 8460371 - DNA, 22 bp, Homo sapiens
gtatttttcagttaggagctta

SEQ ID NO: 8460372 - DNA, 22 bp, Homo sapiens
gtatttttcattccaagtgaga

SEQ ID NO: 8460373 - DNA, 22 bp, Homo sapiens
gtcaaaaagtagtcatttctgt

SEQ ID NO: 8460374 - DNA, 22 bp, Homo sapiens
gtcaaaaagtagtcatttctgt

SEQ ID NO: 8460375 - DNA, 22 bp, Homo sapiens
gtacaattatttaaatggtgaa

SEQ ID NO: 8460376 - DNA, 22 bp, Homo sapiens
gtacaattaagtgcacaaatag

SEQ ID NO: 8460377 - DNA, 22 bp, Homo sapiens
gtaggggatggttccctagaaa

SEQ ID NO: 8460378 - DNA, 22 bp, Homo sapiens
gtagggcatgtaagtcaccata

SEQ ID NO: 8460379 - DNA, 22 bp, Homo sapiens
gtagggcatagagatgttggca

SEQ ID NO: 8460380 - DNA, 22 bp, Homo sapiens
gtagggcagaagttcaatgtgg

SEQ ID NO: 8460381 - DNA, 22 bp, Homo sapiens
gtaggagctcatggggccagga

SEQ ID NO: 8460382 - DNA, 18 bp, Homo sapiens
gtaggtcagtaccaagca

SEQ ID NO: 8460383 - DNA, 22 bp, Homo sapiens
gtaggtcttctgaaaaccaaaa

SEQ ID NO: 8460384 - DNA, 22 bp, Homo sapiens
gtagtctgaacagtaattttgt

SEQ ID NO: 8460385 - DNA, 22 bp, Homo sapiens
gtagtctgaacagtaattttgt

SEQ ID NO: 8460386 - DNA, 22 bp, Homo sapiens
gtagtcttggattttaaaaagt

SEQ ID NO: 8460387 - DNA, 22 bp, Homo sapiens
gtacaaattaggaagctttgtg

SEQ ID NO: 8460388 - DNA, 22 bp, Homo sapiens
gtacaaatgtacacttgtataa

SEQ ID NO: 8460389 - DNA, 22 bp, Homo sapiens
gtacaaatgcaggtttgttaca

SEQ ID NO: 8460390 - DNA, 22 bp, Homo sapiens
gtacaaatgcaggtttgttaca

SEQ ID NO: 8460391 - DNA, 22 bp, Homo sapiens
gtacaaatgagagttctgtttt

SEQ ID NO: 8460392 - DNA, 22 bp, Homo sapiens
gtacaaatgaaaatagaccact

SEQ ID NO: 8460393 - DNA, 22 bp, Homo sapiens
gtacaaatacattctgaaggta

SEQ ID NO: 8460394 - DNA, 22 bp, Homo sapiens
gtacaaatacattctgaaggta

SEQ ID NO: 8460395 - DNA, 22 bp, Homo sapiens
gtacaaaagttattgcggtttt

SEQ ID NO: 8460396 - DNA, 22 bp, Homo sapiens
gtacaaattgatacagatttga

SEQ ID NO: 8460397 - DNA, 22 bp, Homo sapiens
gtacaaattgatacaggttttc

SEQ ID NO: 8460398 - DNA, 22 bp, Homo sapiens
gtacaaattttgacatctagga

SEQ ID NO: 8460399 - DNA, 22 bp, Homo sapiens
gtacaacaggattgatgtacca

SEQ ID NO: 8460400 - DNA, 19 bp, Homo sapiens
gtacaacaatgctgagcat

SEQ ID NO: 8460401 - DNA, 22 bp, Homo sapiens
gtacaataactagtcttatagt

SEQ ID NO: 8460402 - DNA, 22 bp, Homo sapiens
gtacaacatgattttactctct

SEQ ID NO: 8460403 - DNA, 22 bp, Homo sapiens
gtccagagagatcttctgatag

SEQ ID NO: 8460404 - DNA, 21 bp, Homo sapiens
gtccagagagccggctcctga

SEQ ID NO: 8460405 - DNA, 21 bp, Homo sapiens
gtccagagagccggctcctga

SEQ ID NO: 8460406 - DNA, 21 bp, Homo sapiens
gtccagagagccggctcctga

SEQ ID NO: 8460407 - DNA, 22 bp, Homo sapiens
gtccagaagctcaagttgaact

SEQ ID NO: 8460408 - DNA, 22 bp, Homo sapiens
gtccagaaggaggtcaagttgg

SEQ ID NO: 8460409 - DNA, 22 bp, Homo sapiens
gtcagagcactgagttgtgggc

SEQ ID NO: 8460410 - DNA, 22 bp, Homo sapiens
gtcagagcccccagcggcgcgg

SEQ ID NO: 8460411 - DNA, 22 bp, Homo sapiens
gtcagagcactgagttgtgggc

SEQ ID NO: 8460412 - DNA, 22 bp, Homo sapiens
gtcagagctggaggcaagttct

SEQ ID NO: 8460413 - DNA, 22 bp, Homo sapiens
gtcagagctggaggcaagttct

SEQ ID NO: 8460414 - DNA, 22 bp, Homo sapiens
gtcagagcccttccctgatttt

SEQ ID NO: 8460415 - DNA, 22 bp, Homo sapiens
gtcagagcccccagcggcgcgg

SEQ ID NO: 8460416 - DNA, 22 bp, Homo sapiens
gtcagagcccttccctgatttt

SEQ ID NO: 8460417 - DNA, 21 bp, Homo sapiens
gtcagagatgcccaactgcct

SEQ ID NO: 8460418 - DNA, 20 bp, Homo sapiens
gtcagaggaccctagagcga

SEQ ID NO: 8460419 - DNA, 22 bp, Homo sapiens
gtcagagctgtgcaaggctgag

SEQ ID NO: 8460420 - DNA, 22 bp, Homo sapiens
gtcagagctgtgcaaggctgag

SEQ ID NO: 8460421 - DNA, 22 bp, Homo sapiens
gtccagcccgggctccgccagc

SEQ ID NO: 8460422 - DNA, 22 bp, Homo sapiens
gtccagcccgggctccgccagc

SEQ ID NO: 8460423 - DNA, 22 bp, Homo sapiens
gtccagccaggctgcagcaccc

SEQ ID NO: 8460424 - DNA, 22 bp, Homo sapiens
gtccagccctctgcctccaggt

SEQ ID NO: 8460425 - DNA, 22 bp, Homo sapiens
gtccagccctctgcctccaggt

SEQ ID NO: 8460426 - DNA, 22 bp, Homo sapiens
gtccagccctctgcctccaggt

SEQ ID NO: 8460427 - DNA, 22 bp, Homo sapiens
gtccagcccttgcagcttcttt

SEQ ID NO: 8460428 - DNA, 22 bp, Homo sapiens
gtccagccctctgcctccaggt

SEQ ID NO: 8460429 - DNA, 22 bp, Homo sapiens
gtccagccaggctgcagcaccc

SEQ ID NO: 8460430 - DNA, 22 bp, Homo sapiens
gtccagccaggcctgtctctgg

SEQ ID NO: 8460431 - DNA, 22 bp, Homo sapiens
gtccagccaggcctgtctctgg

SEQ ID NO: 8460432 - DNA, 22 bp, Homo sapiens
gtccagcccctgactcccaggc

SEQ ID NO: 8460433 - DNA, 22 bp, Homo sapiens
gtccagcccctgactcccaggc

SEQ ID NO: 8460434 - DNA, 22 bp, Homo sapiens
gtccagcccctgactcccaggc

SEQ ID NO: 8460435 - DNA, 22 bp, Homo sapiens
gtccagctgggccagggcactc

SEQ ID NO: 8460436 - DNA, 22 bp, Homo sapiens
gtccagctccagggaggcaggc

SEQ ID NO: 8460437 - DNA, 22 bp, Homo sapiens
gtccagcccttgcagcttcttt

SEQ ID NO: 8460438 - DNA, 22 bp, Homo sapiens
gtccagcctgaagagtgggggc

SEQ ID NO: 8460439 - DNA, 22 bp, Homo sapiens
gtccagcctgaagagtgggggc

SEQ ID NO: 8460440 - DNA, 22 bp, Homo sapiens
gtcactgcctcttaactttttc

SEQ ID NO: 8460441 - DNA, 22 bp, Homo sapiens
gtcacctctcatcacatgctac

SEQ ID NO: 8460442 - DNA, 22 bp, Homo sapiens
gtcacctcgctgtcttcctgag

SEQ ID NO: 8460443 - DNA, 22 bp, Homo sapiens
gtcacctgaggggaggtgacag

SEQ ID NO: 8460444 - DNA, 22 bp, Homo sapiens
gtcagaagcatttgtggctgaa

SEQ ID NO: 8460445 - DNA, 22 bp, Homo sapiens
gtcagacacatttctttcagtg

SEQ ID NO: 8460446 - DNA, 22 bp, Homo sapiens
gtcagaagcatttgtggctgaa

SEQ ID NO: 8460447 - DNA, 22 bp, Homo sapiens
gtcctggcttagttcgctgtaa

SEQ ID NO: 8460448 - DNA, 22 bp, Homo sapiens
gtcctggctgtgtttggtttct

SEQ ID NO: 8460449 - DNA, 22 bp, Homo sapiens
gtcctggctgtcttatgttgaa

SEQ ID NO: 8460450 - DNA, 22 bp, Homo sapiens
gtcctgggaactggacagctaa

SEQ ID NO: 8460451 - DNA, 22 bp, Homo sapiens
gtcctggcacctcactggctac

SEQ ID NO: 8460452 - DNA, 22 bp, Homo sapiens
gtcctggcccactggcaggctg

SEQ ID NO: 8460453 - DNA, 22 bp, Homo sapiens
gtcctggcccactggcaggctg

SEQ ID NO: 8460454 - DNA, 19 bp, Homo sapiens
gtcctggcgccgccacacc

SEQ ID NO: 8460455 - DNA, 22 bp, Homo sapiens
gtcctggctggttctgtggggc

SEQ ID NO: 8460456 - DNA, 22 bp, Homo sapiens
gtcctggctagtcgtccgcgac

SEQ ID NO: 8460457 - DNA, 22 bp, Homo sapiens
gtcctggcccaggagtacacat

SEQ ID NO: 8460458 - DNA, 22 bp, Homo sapiens
gtcctggcctctgggggtatgg

SEQ ID NO: 8460459 - DNA, 22 bp, Homo sapiens
gtcctggagtggcatggcatgg

SEQ ID NO: 8460460 - DNA, 22 bp, Homo sapiens
gtccaggctgcccagggtcctg

SEQ ID NO: 8460461 - DNA, 22 bp, Homo sapiens
gtccaggctgacccctagagga

SEQ ID NO: 8460462 - DNA, 22 bp, Homo sapiens
gtccaggctgacccctagagga

SEQ ID NO: 8460463 - DNA, 22 bp, Homo sapiens
gtcctctgcttcatgccctgat

SEQ ID NO: 8460464 - DNA, 22 bp, Homo sapiens
gtcctctggcctttcccaggac

SEQ ID NO: 8460465 - DNA, 22 bp, Homo sapiens
gtccaggaatcaaaagatggaa

SEQ ID NO: 8460466 - DNA, 20 bp, Homo sapiens
gtccaggacccagcaggagg

SEQ ID NO: 8460467 - DNA, 19 bp, Homo sapiens
gtccaggcattgggttggt

SEQ ID NO: 8460468 - DNA, 22 bp, Homo sapiens
gtccaggagctcagggcttatt

SEQ ID NO: 8460469 - DNA, 22 bp, Homo sapiens
gtccaggcacctcccttgtgct

SEQ ID NO: 8460470 - DNA, 22 bp, Homo sapiens
gtccaggcacctcccttgtgct

SEQ ID NO: 8460471 - DNA, 22 bp, Homo sapiens
gtccaggctcaaaaggttgtta

SEQ ID NO: 8460472 - DNA, 22 bp, Homo sapiens
gtccaggctaagtcccttctgc

SEQ ID NO: 8460473 - DNA, 22 bp, Homo sapiens
gtccaggctcaaaaggttgtta

SEQ ID NO: 8460474 - DNA, 22 bp, Homo sapiens
gtccaggccatggtggacacag

SEQ ID NO: 8460475 - DNA, 22 bp, Homo sapiens
gtccaggccatggtggacacag

SEQ ID NO: 8460476 - DNA, 22 bp, Homo sapiens
gtccaggccccagggattcttg

SEQ ID NO: 8460477 - DNA, 22 bp, Homo sapiens
gtccaggcctgcctctgaggag

SEQ ID NO: 8460478 - DNA, 22 bp, Homo sapiens
gtccaggccccagggattcttg

SEQ ID NO: 8460479 - DNA, 22 bp, Homo sapiens
gtccaggcctgcctctgaggag

SEQ ID NO: 8460480 - DNA, 22 bp, Homo sapiens
gtgcccagcagcagcgtccccg

SEQ ID NO: 8460481 - DNA, 22 bp, Homo sapiens
gtgcccagctccacctcacaga

SEQ ID NO: 8460482 - DNA, 22 bp, Homo sapiens
gtgcccagctccacctcacaga

SEQ ID NO: 8460483 - DNA, 22 bp, Homo sapiens
gtgcccagctccacctcacaga

SEQ ID NO: 8460484 - DNA, 22 bp, Homo sapiens
gtgcccagcagcagcgtccccg

SEQ ID NO: 8460485 - DNA, 22 bp, Homo sapiens
gtgccagggagtggaggagctt

SEQ ID NO: 8460486 - DNA, 18 bp, Homo sapiens
gtgccaggaggcgcagcc

SEQ ID NO: 8460487 - DNA, 22 bp, Homo sapiens
gtgccagctctccccacatctg

SEQ ID NO: 8460488 - DNA, 22 bp, Homo sapiens
gtgccagccgcaccccaggaga

SEQ ID NO: 8460489 - DNA, 22 bp, Homo sapiens
gtgctggcacccctctccagtt

SEQ ID NO: 8460490 - DNA, 22 bp, Homo sapiens
gtgctggccctgtcctcgagct

SEQ ID NO: 8460491 - DNA, 22 bp, Homo sapiens
gtgctggcacccctctccagtt

SEQ ID NO: 8460492 - DNA, 22 bp, Homo sapiens
gtgctggcacccctctccagtt

SEQ ID NO: 8460493 - DNA, 22 bp, Homo sapiens
gtgctggccctgtcctcgagct

SEQ ID NO: 8460494 - DNA, 22 bp, Homo sapiens
gtgctgctcaagggacaggaca

SEQ ID NO: 8460495 - DNA, 22 bp, Homo sapiens
gtgctgagtgcagagtgcagag

SEQ ID NO: 8460496 - DNA, 22 bp, Homo sapiens
gtgcccaggcccaaggcaccac

SEQ ID NO: 8460497 - DNA, 22 bp, Homo sapiens
gtgctgacaggagcctggcggt

SEQ ID NO: 8460498 - DNA, 22 bp, Homo sapiens
gtgctgacaggagcctggcggt

SEQ ID NO: 8460499 - DNA, 22 bp, Homo sapiens
gtgcaggggatcaggttgcagc

SEQ ID NO: 8460500 - DNA, 22 bp, Homo sapiens
gtgcaggggatcaggttgcagc

SEQ ID NO: 8460501 - DNA, 22 bp, Homo sapiens
gtgcagggctggcaccggaggc

SEQ ID NO: 8460502 - DNA, 22 bp, Homo sapiens
gtgcagggctggcaccggaggc

SEQ ID NO: 8460503 - DNA, 22 bp, Homo sapiens
gtgcagggctggcaccggaggc

SEQ ID NO: 8460504 - DNA, 22 bp, Homo sapiens
gtgcagggccctcctaacatct

SEQ ID NO: 8460505 - DNA, 22 bp, Homo sapiens
gtgcagggccctcctaacatct

SEQ ID NO: 8460506 - DNA, 22 bp, Homo sapiens
gtgcagggcaggtgtccttcca

SEQ ID NO: 8460507 - DNA, 22 bp, Homo sapiens
gtgcagggcaggtgtccttcca

SEQ ID NO: 8460508 - DNA, 22 bp, Homo sapiens
gtgcagggcaggtgtccttcca

SEQ ID NO: 8460509 - DNA, 22 bp, Homo sapiens
gtgcagggcagccgaatgggct

SEQ ID NO: 8460510 - DNA, 22 bp, Homo sapiens
gtgcagggcagccgaatgggct

SEQ ID NO: 8460511 - DNA, 22 bp, Homo sapiens
gtgcagggcagccgaatgggct

SEQ ID NO: 8460512 - DNA, 22 bp, Homo sapiens
gtgcagggcagccgaatgggct

SEQ ID NO: 8460513 - DNA, 17 bp, Homo sapiens
gtgcagggatgaaggat

SEQ ID NO: 8460514 - DNA, 17 bp, Homo sapiens
gtgcagggatgaaggat

SEQ ID NO: 8460515 - DNA, 17 bp, Homo sapiens
gtgcagggatgaaggat

SEQ ID NO: 8460516 - DNA, 22 bp, Homo sapiens
gtgcagggtagcgacggcagga

SEQ ID NO: 8460517 - DNA, 22 bp, Homo sapiens
gtgcagggtagcgacggcagga

SEQ ID NO: 8460518 - DNA, 22 bp, Homo sapiens
gtgcagggtagcgacggcagga

SEQ ID NO: 8460519 - DNA, 22 bp, Homo sapiens
gtgcaggggcctccccttgctg

SEQ ID NO: 8460520 - DNA, 22 bp, Homo sapiens
gtgcaggggcctccccttgctg

SEQ ID NO: 8460521 - DNA, 22 bp, Homo sapiens
gtgcaggggcctccccttgctg

SEQ ID NO: 8460522 - DNA, 22 bp, Homo sapiens
gtgcaggggatcaggttgcagc

SEQ ID NO: 8460523 - DNA, 22 bp, Homo sapiens
gtgccagagatgacaggcctgc

SEQ ID NO: 8460524 - DNA, 17 bp, Homo sapiens
gtgcagggatgaaggat

SEQ ID NO: 8460525 - DNA, 22 bp, Homo sapiens
gtgcagggagcccagaaggtcc

SEQ ID NO: 8460526 - DNA, 22 bp, Homo sapiens
gtgcaggctctcgttcttgaca

SEQ ID NO: 8460527 - DNA, 22 bp, Homo sapiens
gtgcagggagcccagaaggtcc

SEQ ID NO: 8460528 - DNA, 22 bp, Homo sapiens
gtgcagggagcccagaaggtcc

SEQ ID NO: 8460529 - DNA, 22 bp, Homo sapiens
gtgcagggagcccagaaggtcc

SEQ ID NO: 8460530 - DNA, 22 bp, Homo sapiens
gtgcaggctagatccttcctac

SEQ ID NO: 8460531 - DNA, 22 bp, Homo sapiens
gtgcaggcaaaagggccaggcc

SEQ ID NO: 8460532 - DNA, 19 bp, Homo sapiens
gtgaggagtgtttacagaa

SEQ ID NO: 8460533 - DNA, 22 bp, Homo sapiens
gtgaggcagaagttccctttta

SEQ ID NO: 8460534 - DNA, 22 bp, Homo sapiens
gtgaggcagagatgccaaaact

SEQ ID NO: 8460535 - DNA, 22 bp, Homo sapiens
gtgaggcaagggcatactaggc

SEQ ID NO: 8460536 - DNA, 22 bp, Homo sapiens
gtgaggcagcaggagcctctgt

SEQ ID NO: 8460537 - DNA, 22 bp, Homo sapiens
gtgaggcagcaggagcctctgt

SEQ ID NO: 8460538 - DNA, 22 bp, Homo sapiens
gtgaggcagaagttccctttta

SEQ ID NO: 8460539 - DNA, 22 bp, Homo sapiens
gtgaggcaggcattctcctttc

SEQ ID NO: 8460540 - DNA, 22 bp, Homo sapiens
gtgaggcaggcattctcctttc

SEQ ID NO: 8460541 - DNA, 22 bp, Homo sapiens
gtgcagcaaagtttgagatata

SEQ ID NO: 8460542 - DNA, 22 bp, Homo sapiens
gtgaggagggctggtcccaggc

SEQ ID NO: 8460543 - DNA, 22 bp, Homo sapiens
gtgaggagtctgaagcacataa

SEQ ID NO: 8460544 - DNA, 22 bp, Homo sapiens
gtgaggagtctgaagcacataa

SEQ ID NO: 8460545 - DNA, 22 bp, Homo sapiens
gtgaggagctgacactggggtg

SEQ ID NO: 8460546 - DNA, 22 bp, Homo sapiens
gtgaggagctctttgactcacg

SEQ ID NO: 8460547 - DNA, 22 bp, Homo sapiens
gtgagctgttttggacccatct

SEQ ID NO: 8460548 - DNA, 19 bp, Homo sapiens
gtgagcttcttgtaagagg

SEQ ID NO: 8460549 - DNA, 22 bp, Homo sapiens
gtgagcttctgacagatgcacc

SEQ ID NO: 8460550 - DNA, 22 bp, Homo sapiens
gtgagcttctgcctctcagtcc

SEQ ID NO: 8460551 - DNA, 22 bp, Homo sapiens
gtgagctggaatagtggagaaa

SEQ ID NO: 8460552 - DNA, 22 bp, Homo sapiens
gtgagctgggtgaatggtaggg

SEQ ID NO: 8460553 - DNA, 21 bp, Homo sapiens
gtcttttaagtgaagagaggc

SEQ ID NO: 8460554 - DNA, 21 bp, Homo sapiens
gtcttttaagtgaagagaggc

SEQ ID NO: 8460555 - DNA, 22 bp, Homo sapiens
gtctttctatgcatagagcaga

SEQ ID NO: 8460556 - DNA, 22 bp, Homo sapiens
gtctttctatgcatagagcaga

SEQ ID NO: 8460557 - DNA, 22 bp, Homo sapiens
gtctttctatgatgaactgttg

SEQ ID NO: 8460558 - DNA, 21 bp, Homo sapiens
gtctttctacctctatgtggc

SEQ ID NO: 8460559 - DNA, 22 bp, Homo sapiens
gtctttattacaaatccttttc

SEQ ID NO: 8460560 - DNA, 16 bp, Homo sapiens
gtctttattcacttag

SEQ ID NO: 8460561 - DNA, 22 bp, Homo sapiens
gtctttatttgagattgtcatt

SEQ ID NO: 8460562 - DNA, 22 bp, Homo sapiens
gtgaaaaatcatcatgacttga

SEQ ID NO: 8460563 - DNA, 22 bp, Homo sapiens
gtgagcagggcaggactgggga

SEQ ID NO: 8460564 - DNA, 22 bp, Homo sapiens
gtgaaaaatgatttgttaactg

SEQ ID NO: 8460565 - DNA, 20 bp, Homo sapiens
gtctttatgttttatgacct

SEQ ID NO: 8460566 - DNA, 22 bp, Homo sapiens
gtctttatggtatgaaaactga

SEQ ID NO: 8460567 - DNA, 20 bp, Homo sapiens
gtctttatgttttatgacct

SEQ ID NO: 8460568 - DNA, 22 bp, Homo sapiens
gtctttatggtatgaaaactga

SEQ ID NO: 8460569 - DNA, 22 bp, Homo sapiens
gtctttatctttgaaattagtc

SEQ ID NO: 8460570 - DNA, 22 bp, Homo sapiens
gtctttatctttgaaattagtc

SEQ ID NO: 8460571 - DNA, 22 bp, Homo sapiens
gtctttatatttactaaagaat

SEQ ID NO: 8460572 - DNA, 23 bp, Homo sapiens
gtctttatagtggggcactttgt

SEQ ID NO: 8460573 - DNA, 22 bp, Homo sapiens
gtctttagttgaaacatgtggt

SEQ ID NO: 8460574 - DNA, 19 bp, Homo sapiens
gtcttgtaacacataagtg

SEQ ID NO: 8460575 - DNA, 22 bp, Homo sapiens
gtctccagggacacactagccg

SEQ ID NO: 8460576 - DNA, 22 bp, Homo sapiens
gtctccagggctgctggcgcct

SEQ ID NO: 8460577 - DNA, 22 bp, Homo sapiens
gtctccagggctgctggcgcct

SEQ ID NO: 8460578 - DNA, 22 bp, Homo sapiens
gtctccagggctgctggcgcct

SEQ ID NO: 8460579 - DNA, 22 bp, Homo sapiens
gtctccagttacagcagccagg

SEQ ID NO: 8460580 - DNA, 22 bp, Homo sapiens
gtctccagtgttcaggtgactg

SEQ ID NO: 8460581 - DNA, 22 bp, Homo sapiens
gtctccagtgttcaggtgactg

SEQ ID NO: 8460582 - DNA, 22 bp, Homo sapiens
gtcttgatctcctgaccttgtg

SEQ ID NO: 8460583 - DNA, 22 bp, Homo sapiens
gtctccagaggttacatcctgt

SEQ ID NO: 8460584 - DNA, 22 bp, Homo sapiens
gtctccagaattcttgggaggg

SEQ ID NO: 8460585 - DNA, 22 bp, Homo sapiens
gtctccagaattcttgggaggg

SEQ ID NO: 8460586 - DNA, 22 bp, Homo sapiens
gtctccagatatcctacacaac

SEQ ID NO: 8460587 - DNA, 22 bp, Homo sapiens
gtctccagatatcctacacaac

SEQ ID NO: 8460588 - DNA, 22 bp, Homo sapiens
gtctccagcccactctagatat

SEQ ID NO: 8460589 - DNA, 22 bp, Homo sapiens
gtctccagcccactctagatat

SEQ ID NO: 8460590 - DNA, 22 bp, Homo sapiens
gtctccagccattctctgatca

SEQ ID NO: 8460591 - DNA, 22 bp, Homo sapiens
gtctagagcctgatgaggatga

SEQ ID NO: 8460592 - DNA, 22 bp, Homo sapiens
gtctagagtgcttcctagtcat

SEQ ID NO: 8460593 - DNA, 22 bp, Homo sapiens
gtctagagtgcttcctagtcat

SEQ ID NO: 8460594 - DNA, 22 bp, Homo sapiens
gtctaaagcccttagaatagta

SEQ ID NO: 8460595 - DNA, 20 bp, Homo sapiens
gtctacacgggcagtgtaga

SEQ ID NO: 8460596 - DNA, 22 bp, Homo sapiens
gtctacactgaatttccacaga

SEQ ID NO: 8460597 - DNA, 22 bp, Homo sapiens
gtctagaaataggtttcagaaa

SEQ ID NO: 8460598 - DNA, 22 bp, Homo sapiens
gtctagaaatcatgtactgtga

SEQ ID NO: 8460599 - DNA, 22 bp, Homo sapiens
gtctagaaaatgccgagggatg

SEQ ID NO: 8460600 - DNA, 22 bp, Homo sapiens
gtctagaaatgttctcaggggt

SEQ ID NO: 8460601 - DNA, 22 bp, Homo sapiens
gtctagaaatgccatacgtgcc

SEQ ID NO: 8460602 - DNA, 22 bp, Homo sapiens
gtctagaattgcttggcagatg

SEQ ID NO: 8460603 - DNA, 19 bp, Homo sapiens
gtctagaccaggctcctta

SEQ ID NO: 8460604 - DNA, 19 bp, Homo sapiens
gtctagaacattgtaggtg

SEQ ID NO: 8460605 - DNA, 22 bp, Homo sapiens
gtctagaatatctagaaagatc

SEQ ID NO: 8460606 - DNA, 22 bp, Homo sapiens
gtctagaatggatgagcatttt

SEQ ID NO: 8460607 - DNA, 22 bp, Homo sapiens
gtctagaatggatgagcatttt

SEQ ID NO: 8460608 - DNA, 22 bp, Homo sapiens
ggctggagatatgtctggaaca

SEQ ID NO: 8460609 - DNA, 22 bp, Homo sapiens
ggctggagacaacgtcctgccc

SEQ ID NO: 8460610 - DNA, 22 bp, Homo sapiens
ggctggagacaacgtcctgccc

SEQ ID NO: 8460611 - DNA, 22 bp, Homo sapiens
ggctggagacaacgtcctgccc

SEQ ID NO: 8460612 - DNA, 22 bp, Homo sapiens
ggctggaggagaatgggtgtga

SEQ ID NO: 8460613 - DNA, 17 bp, Homo sapiens
ggctggagcagctcccc

SEQ ID NO: 8460614 - DNA, 17 bp, Homo sapiens
ggctggagcagctcccc

SEQ ID NO: 8460615 - DNA, 17 bp, Homo sapiens
ggctggagcagctcccc

SEQ ID NO: 8460616 - DNA, 22 bp, Homo sapiens
ggctgcctgaggcagtgagaga

SEQ ID NO: 8460617 - DNA, 22 bp, Homo sapiens
ggctgcctgaactttggggaaa

SEQ ID NO: 8460618 - DNA, 22 bp, Homo sapiens
ggctgcctctatttaggatcaa

SEQ ID NO: 8460619 - DNA, 22 bp, Homo sapiens
ggctgcctgaggctgaggcccg

SEQ ID NO: 8460620 - DNA, 22 bp, Homo sapiens
ggctggagtgggctccagagtt

SEQ ID NO: 8460621 - DNA, 19 bp, Homo sapiens
ggctggagtggccatctgt

SEQ ID NO: 8460622 - DNA, 22 bp, Homo sapiens
ggctggagtgggctccagagtt

SEQ ID NO: 8460623 - DNA, 22 bp, Homo sapiens
ggctggaggagaatgggtgtga

SEQ ID NO: 8460624 - DNA, 17 bp, Homo sapiens
ggctggaggggacccgg

SEQ ID NO: 8460625 - DNA, 19 bp, Homo sapiens
ggctggagtggccatctgt

SEQ ID NO: 8460626 - DNA, 22 bp, Homo sapiens
ggctggcaggcacagtatgcaa

SEQ ID NO: 8460627 - DNA, 22 bp, Homo sapiens
ggctggcagcttcatcccagat

SEQ ID NO: 8460628 - DNA, 22 bp, Homo sapiens
ggctggcagaagtgtgctggct

SEQ ID NO: 8460629 - DNA, 22 bp, Homo sapiens
ggctggcaggggatgtcagatg

SEQ ID NO: 8460630 - DNA, 22 bp, Homo sapiens
ggctggcagtgtgagagaggga

SEQ ID NO: 8460631 - DNA, 22 bp, Homo sapiens
ggctggcagtgtgagagaggga

SEQ ID NO: 8460632 - DNA, 22 bp, Homo sapiens
ggctgccaggagaagctcagtg

SEQ ID NO: 8460633 - DNA, 22 bp, Homo sapiens
ggctgccagcactggtgtagag

SEQ ID NO: 8460634 - DNA, 22 bp, Homo sapiens
ggctgcagttgtgtgaaggccg

SEQ ID NO: 8460635 - DNA, 22 bp, Homo sapiens
ggctgcagttgtgtgaaggccg

SEQ ID NO: 8460636 - DNA, 22 bp, Homo sapiens
ggctgcctcagatttgctgact

SEQ ID NO: 8460637 - DNA, 22 bp, Homo sapiens
ggctgcctcagatttgctgact

SEQ ID NO: 8460638 - DNA, 22 bp, Homo sapiens
ggctgcctcccaggagaatctg

SEQ ID NO: 8460639 - DNA, 22 bp, Homo sapiens
ggctgcctcctcgagacaggat

SEQ ID NO: 8460640 - DNA, 22 bp, Homo sapiens
ggctgcctctatttaggatcaa

SEQ ID NO: 8460641 - DNA, 19 bp, Homo sapiens
ggctgcctcctgggagatt

SEQ ID NO: 8460642 - DNA, 22 bp, Homo sapiens
ggctgcctcctgctgggctgga

SEQ ID NO: 8460643 - DNA, 22 bp, Homo sapiens
ggctgcaggcttccctccagca

SEQ ID NO: 8460644 - DNA, 22 bp, Homo sapiens
ggctgcaggcttccctccagca

SEQ ID NO: 8460645 - DNA, 22 bp, Homo sapiens
ggctgcaggcttccctccagca

SEQ ID NO: 8460646 - DNA, 21 bp, Homo sapiens
ggctgcagggagccctggggt

SEQ ID NO: 8460647 - DNA, 22 bp, Homo sapiens
ggctgcaggcttccctccagca

SEQ ID NO: 8460648 - DNA, 22 bp, Homo sapiens
ggctctgcggcgtgtgcgcagg

SEQ ID NO: 8460649 - DNA, 22 bp, Homo sapiens
ggctgcaggttggttggcagct

SEQ ID NO: 8460650 - DNA, 22 bp, Homo sapiens
ggctgcaggttggttggcagct

SEQ ID NO: 8460651 - DNA, 22 bp, Homo sapiens
ggctgcagggcagctggtgtgg

SEQ ID NO: 8460652 - DNA, 17 bp, Homo sapiens
ggctgcagtccaggagg

SEQ ID NO: 8460653 - DNA, 20 bp, Homo sapiens
ggctgcagtgcacctcatct

SEQ ID NO: 8460654 - DNA, 20 bp, Homo sapiens
ggctgcagtgcacctcatct

SEQ ID NO: 8460655 - DNA, 22 bp, Homo sapiens
gggagccatgctggtcttcttt

SEQ ID NO: 8460656 - DNA, 22 bp, Homo sapiens
gggagccagccatccagaacct

SEQ ID NO: 8460657 - DNA, 22 bp, Homo sapiens
gggagccagcctttgcctataa

SEQ ID NO: 8460658 - DNA, 22 bp, Homo sapiens
gggagccagccatccagaacct

SEQ ID NO: 8460659 - DNA, 22 bp, Homo sapiens
gggagccatgctggtcttcttt

SEQ ID NO: 8460660 - DNA, 22 bp, Homo sapiens
gggagccactcagctgagagtt

SEQ ID NO: 8460661 - DNA, 22 bp, Homo sapiens
gggagccactcagctgagagtt

SEQ ID NO: 8460662 - DNA, 22 bp, Homo sapiens
gggagccagcagggcatggagc

SEQ ID NO: 8460663 - DNA, 22 bp, Homo sapiens
gggagccagagtcacctagaga

SEQ ID NO: 8460664 - DNA, 22 bp, Homo sapiens
gggagccacagtagcagctact

SEQ ID NO: 8460665 - DNA, 22 bp, Homo sapiens
gggagccacagtagcagctact

SEQ ID NO: 8460666 - DNA, 23 bp, Homo sapiens
gggagatgggaaatgaaggctct

SEQ ID NO: 8460667 - DNA, 22 bp, Homo sapiens
gggagccacagtgaggtgcatg

SEQ ID NO: 8460668 - DNA, 22 bp, Homo sapiens
gggagccacagtgaggtgcatg

SEQ ID NO: 8460669 - DNA, 22 bp, Homo sapiens
gggaaggccggtccagtcaggt

SEQ ID NO: 8460670 - DNA, 22 bp, Homo sapiens
gggaagagtgtcggttgaagtg

SEQ ID NO: 8460671 - DNA, 22 bp, Homo sapiens
gggaagagtaactagcccatgt

SEQ ID NO: 8460672 - DNA, 22 bp, Homo sapiens
gggaagatagtgttgagggccc

SEQ ID NO: 8460673 - DNA, 22 bp, Homo sapiens
gggaagcaggtgcagctcgcct

SEQ ID NO: 8460674 - DNA, 22 bp, Homo sapiens
gggaagccctgtgcttgcctgg

SEQ ID NO: 8460675 - DNA, 22 bp, Homo sapiens
gggaagccctgtgcttgcctgg

SEQ ID NO: 8460676 - DNA, 21 bp, Homo sapiens
ggctgtggagccatgactcac

SEQ ID NO: 8460677 - DNA, 22 bp, Homo sapiens
ggctgtggcagctggaagtggt

SEQ ID NO: 8460678 - DNA, 22 bp, Homo sapiens
ggctgtggacactgagctcaga

SEQ ID NO: 8460679 - DNA, 22 bp, Homo sapiens
ggctggcatttacacaatgcat

SEQ ID NO: 8460680 - DNA, 22 bp, Homo sapiens
ggctggccagggccctcgctgg

SEQ ID NO: 8460681 - DNA, 22 bp, Homo sapiens
ggctgtggtctgggtgctcccc

SEQ ID NO: 8460682 - DNA, 22 bp, Homo sapiens
ggctgtgggtgtgacaggcctc

SEQ ID NO: 8460683 - DNA, 22 bp, Homo sapiens
ggctgtgggtgtgacaggcctc

SEQ ID NO: 8460684 - DNA, 22 bp, Homo sapiens
ggctgtggtcattaggaggttg

SEQ ID NO: 8460685 - DNA, 22 bp, Homo sapiens
gggaagagggagctggaatgat

SEQ ID NO: 8460686 - DNA, 22 bp, Homo sapiens
gggaagagggagctggaatgat

SEQ ID NO: 8460687 - DNA, 22 bp, Homo sapiens
ggctgtgggatgcataggagct

SEQ ID NO: 8460688 - DNA, 22 bp, Homo sapiens
ggctgtggccagcggggctgag

SEQ ID NO: 8460689 - DNA, 22 bp, Homo sapiens
ggctgtggggggagcctgcccg

SEQ ID NO: 8460690 - DNA, 22 bp, Homo sapiens
ggctgtggggaccaacaggact

SEQ ID NO: 8460691 - DNA, 22 bp, Homo sapiens
ggctgtggggaccaacaggact

SEQ ID NO: 8460692 - DNA, 22 bp, Homo sapiens
ggctgtgggccagctagaccct

SEQ ID NO: 8460693 - DNA, 22 bp, Homo sapiens
gggccctgggattcagagcaag

SEQ ID NO: 8460694 - DNA, 22 bp, Homo sapiens
gggccctgggattcagagcaag

SEQ ID NO: 8460695 - DNA, 22 bp, Homo sapiens
gggccctctgcagctgcccagg

SEQ ID NO: 8460696 - DNA, 22 bp, Homo sapiens
gggccctcagtcccaggccttc

SEQ ID NO: 8460697 - DNA, 22 bp, Homo sapiens
gggccctctgcagctgcccagg

SEQ ID NO: 8460698 - DNA, 22 bp, Homo sapiens
gggctaggtctgatcagagaag

SEQ ID NO: 8460699 - DNA, 22 bp, Homo sapiens
gggccggagctgggtcccgcgc

SEQ ID NO: 8460700 - DNA, 22 bp, Homo sapiens
gggcaggtgtgcagagctgttg

SEQ ID NO: 8460701 - DNA, 22 bp, Homo sapiens
gggcccagtaccctctgccaag

SEQ ID NO: 8460702 - DNA, 22 bp, Homo sapiens
gggcccaggcctccttccttcc

SEQ ID NO: 8460703 - DNA, 22 bp, Homo sapiens
gggccccagtcctcccacgtgg

SEQ ID NO: 8460704 - DNA, 22 bp, Homo sapiens
gggctctgagctctgggaatta

SEQ ID NO: 8460705 - DNA, 22 bp, Homo sapiens
gggctctggaaatgggagctcc

SEQ ID NO: 8460706 - DNA, 22 bp, Homo sapiens
gggctctggaaatgggagctcc

SEQ ID NO: 8460707 - DNA, 22 bp, Homo sapiens
gggctctggacccaggcaagag

SEQ ID NO: 8460708 - DNA, 22 bp, Homo sapiens
gggctctggacccaggcaagag

SEQ ID NO: 8460709 - DNA, 22 bp, Homo sapiens
gggctctggatggagcctgcag

SEQ ID NO: 8460710 - DNA, 22 bp, Homo sapiens
gggctctggagttctagaaaga

SEQ ID NO: 8460711 - DNA, 22 bp, Homo sapiens
gggctccaaaatctatgtcttc

SEQ ID NO: 8460712 - DNA, 22 bp, Homo sapiens
gggctcattcatctgggcttgg

SEQ ID NO: 8460713 - DNA, 22 bp, Homo sapiens
gggctccaacggtgagcatgga

SEQ ID NO: 8460714 - DNA, 22 bp, Homo sapiens
gggctccaacggtgagcatgga

SEQ ID NO: 8460715 - DNA, 22 bp, Homo sapiens
gggctccaacggtgagcatgga

SEQ ID NO: 8460716 - DNA, 22 bp, Homo sapiens
gggctccaacggtgagcatgga

SEQ ID NO: 8460717 - DNA, 22 bp, Homo sapiens
gggctccaactacatcagcctt

SEQ ID NO: 8460718 - DNA, 22 bp, Homo sapiens
gggctccaaggaggccagcctg

SEQ ID NO: 8460719 - DNA, 22 bp, Homo sapiens
gggctctgaatcccaggtctgc

SEQ ID NO: 8460720 - DNA, 22 bp, Homo sapiens
gggctctgagctctgggaatta

SEQ ID NO: 8460721 - DNA, 22 bp, Homo sapiens
gggctcagcctcctcacttcga

SEQ ID NO: 8460722 - DNA, 22 bp, Homo sapiens
gggctcagaggagtggcctggg

SEQ ID NO: 8460723 - DNA, 22 bp, Homo sapiens
gggctcatggacagctctccag

SEQ ID NO: 8460724 - DNA, 22 bp, Homo sapiens
gggctcatgatgtaggctggta

SEQ ID NO: 8460725 - DNA, 22 bp, Homo sapiens
gggcaggtctgggtcagcctga

SEQ ID NO: 8460726 - DNA, 17 bp, Homo sapiens
gggcagggactcctggg

SEQ ID NO: 8460727 - DNA, 21 bp, Homo sapiens
gggcagaggggcctcctgggt

SEQ ID NO: 8460728 - DNA, 21 bp, Homo sapiens
gggcagaggggcctcctgggt

SEQ ID NO: 8460729 - DNA, 21 bp, Homo sapiens
gggcagaggggcctcctgggt

SEQ ID NO: 8460730 - DNA, 22 bp, Homo sapiens
gggcagagagctggaactcctt

SEQ ID NO: 8460731 - DNA, 22 bp, Homo sapiens
gggcagagactcagaaacagaa

SEQ ID NO: 8460732 - DNA, 22 bp, Homo sapiens
gggatccatccgtgcagcagag

SEQ ID NO: 8460733 - DNA, 22 bp, Homo sapiens
gggatccatccgtgcagcagag

SEQ ID NO: 8460734 - DNA, 22 bp, Homo sapiens
gggagtggagagcaatggatga

SEQ ID NO: 8460735 - DNA, 22 bp, Homo sapiens
gggaggttgaggctgcagtgag

SEQ ID NO: 8460736 - DNA, 22 bp, Homo sapiens
gggagctgaatggcaatggaga

SEQ ID NO: 8460737 - DNA, 22 bp, Homo sapiens
gggaggttgaggctgcagtgag

SEQ ID NO: 8460738 - DNA, 22 bp, Homo sapiens
gggagccttgggagtgccagcc

SEQ ID NO: 8460739 - DNA, 22 bp, Homo sapiens
gggagccttgggagtgccagcc

SEQ ID NO: 8460740 - DNA, 22 bp, Homo sapiens
gggagcgggactgcgcaggctt

SEQ ID NO: 8460741 - DNA, 22 bp, Homo sapiens
gggagcgggactgcgcaggctt

SEQ ID NO: 8460742 - DNA, 22 bp, Homo sapiens
gggagctctccctgaggcctgg

SEQ ID NO: 8460743 - DNA, 22 bp, Homo sapiens
gggagctcgtgcgcccaggtgc

SEQ ID NO: 8460744 - DNA, 22 bp, Homo sapiens
gggagctccactgcctctcatt

SEQ ID NO: 8460745 - DNA, 22 bp, Homo sapiens
gggataggagattgggagtgtt

SEQ ID NO: 8460746 - DNA, 22 bp, Homo sapiens
gggataggtttggaagaggtgg

SEQ ID NO: 8460747 - DNA, 22 bp, Homo sapiens
gggagtgggtttggcctaggcc

SEQ ID NO: 8460748 - DNA, 22 bp, Homo sapiens
gggagtggtcctttcctatctg

SEQ ID NO: 8460749 - DNA, 22 bp, Homo sapiens
gggagtggttgatggtgaaaat

SEQ ID NO: 8460750 - DNA, 22 bp, Homo sapiens
gggagtggttgatggtgaaaat

SEQ ID NO: 8460751 - DNA, 22 bp, Homo sapiens
ggctctgcaaaagtagatactt

SEQ ID NO: 8460752 - DNA, 22 bp, Homo sapiens
ggctctgcagtgacttgagggg

SEQ ID NO: 8460753 - DNA, 22 bp, Homo sapiens
ggctctgcagagggcccagctt

SEQ ID NO: 8460754 - DNA, 22 bp, Homo sapiens
ggctctgccacttcttggctgt

SEQ ID NO: 8460755 - DNA, 22 bp, Homo sapiens
ggctctgccatttcctagctgc

SEQ ID NO: 8460756 - DNA, 22 bp, Homo sapiens
ggctctgcccgcggctgcccac

SEQ ID NO: 8460757 - DNA, 22 bp, Homo sapiens
ggctctgcccgcggctgcccac

SEQ ID NO: 8460758 - DNA, 22 bp, Homo sapiens
ggctctgcgcctgcggggactt

SEQ ID NO: 8460759 - DNA, 22 bp, Homo sapiens
ggctctgccgtgtgctcacatg

SEQ ID NO: 8460760 - DNA, 22 bp, Homo sapiens
ggctctgccgtgtgctcacatg

SEQ ID NO: 8460761 - DNA, 22 bp, Homo sapiens
ggctctgcctgcccagcagcac

SEQ ID NO: 8460762 - DNA, 22 bp, Homo sapiens
ggctctgaaggagacagctgct

SEQ ID NO: 8460763 - DNA, 17 bp, Homo sapiens
ggctctcttccagactt

SEQ ID NO: 8460764 - DNA, 22 bp, Homo sapiens
ggctctctggaggagctcaccc

SEQ ID NO: 8460765 - DNA, 22 bp, Homo sapiens
ggctctctggaggagctcaccc

SEQ ID NO: 8460766 - DNA, 22 bp, Homo sapiens
ggctctctggaggagctcaccc

SEQ ID NO: 8460767 - DNA, 22 bp, Homo sapiens
ggctctcttaactggccatcct

SEQ ID NO: 8460768 - DNA, 17 bp, Homo sapiens
ggctctcttccagactt

SEQ ID NO: 8460769 - DNA, 22 bp, Homo sapiens
ggctcagagttaggacccatgt

SEQ ID NO: 8460770 - DNA, 22 bp, Homo sapiens
ggctcagcaatgatgagcccct

SEQ ID NO: 8460771 - DNA, 22 bp, Homo sapiens
ggctcagcaatgatgagcccct

SEQ ID NO: 8460772 - DNA, 22 bp, Homo sapiens
ggctcagcacagggctggcatc

SEQ ID NO: 8460773 - DNA, 22 bp, Homo sapiens
ggctcagacctcccagctccag

SEQ ID NO: 8460774 - DNA, 22 bp, Homo sapiens
ggctcactgcaacttccgcctc

SEQ ID NO: 8460775 - DNA, 22 bp, Homo sapiens
ggctcagaaactaaaggcgctg

SEQ ID NO: 8460776 - DNA, 23 bp, Homo sapiens
ggctcagaaaaagtcctggcctc

SEQ ID NO: 8460777 - DNA, 22 bp, Homo sapiens
ggctcagaaacctctggtgtct

SEQ ID NO: 8460778 - DNA, 22 bp, Homo sapiens
ggctcacgcaattatcccggcc

SEQ ID NO: 8460779 - DNA, 22 bp, Homo sapiens
ggctcactgcaacttccgcctc

SEQ ID NO: 8460780 - DNA, 22 bp, Homo sapiens
ggctcaccattttcactctctg

SEQ ID NO: 8460781 - DNA, 22 bp, Homo sapiens
ggctcaccatggcctccctgct

SEQ ID NO: 8460782 - DNA, 23 bp, Homo sapiens
ggctcacacggagtgcctccacc

SEQ ID NO: 8460783 - DNA, 22 bp, Homo sapiens
ggcctctggcaggcaggccctc

SEQ ID NO: 8460784 - DNA, 18 bp, Homo sapiens
ggcctctggactggcagc

SEQ ID NO: 8460785 - DNA, 22 bp, Homo sapiens
ggcctctgcttatgctgatgac

SEQ ID NO: 8460786 - DNA, 22 bp, Homo sapiens
ggcctctggggtcctgagccca

SEQ ID NO: 8460787 - DNA, 22 bp, Homo sapiens
ggcctctggggtcctgagccca

SEQ ID NO: 8460788 - DNA, 22 bp, Homo sapiens
ggcctctggtcaagacaagcat

SEQ ID NO: 8460789 - DNA, 22 bp, Homo sapiens
ggcctctcttgggacagctgtc

SEQ ID NO: 8460790 - DNA, 22 bp, Homo sapiens
ggcctctctggcatggctgccc

SEQ ID NO: 8460791 - DNA, 22 bp, Homo sapiens
ggcctctctggcatggctgccc

SEQ ID NO: 8460792 - DNA, 20 bp, Homo sapiens
ggcctctgaggacaaggaga

SEQ ID NO: 8460793 - DNA, 22 bp, Homo sapiens
ggcctctgaggacagccttggc

SEQ ID NO: 8460794 - DNA, 22 bp, Homo sapiens
ggcctcctcaccctgctcaggc

SEQ ID NO: 8460795 - DNA, 22 bp, Homo sapiens
ggcctccatcttatcttactct

SEQ ID NO: 8460796 - DNA, 22 bp, Homo sapiens
ggcctccaggcctactcagggc

SEQ ID NO: 8460797 - DNA, 22 bp, Homo sapiens
ggcctccatcttatcttactct

SEQ ID NO: 8460798 - DNA, 21 bp, Homo sapiens
ggcctctgccttgccccactc

SEQ ID NO: 8460799 - DNA, 21 bp, Homo sapiens
ggcctctgccttgccccactc

SEQ ID NO: 8460800 - DNA, 22 bp, Homo sapiens
ggcctctgccctcactcctgtc

SEQ ID NO: 8460801 - DNA, 22 bp, Homo sapiens
ggcctctgccccagccacacct

SEQ ID NO: 8460802 - DNA, 22 bp, Homo sapiens
ggcctctgccccagccacacct

SEQ ID NO: 8460803 - DNA, 19 bp, Homo sapiens
ggcctctgcaggccgcccc

SEQ ID NO: 8460804 - DNA, 22 bp, Homo sapiens
ggccagctgctcagtgtctctg

SEQ ID NO: 8460805 - DNA, 22 bp, Homo sapiens
ggccagctgggccaccaggtgc

SEQ ID NO: 8460806 - DNA, 22 bp, Homo sapiens
ggcccagctctattgaattaca

SEQ ID NO: 8460807 - DNA, 22 bp, Homo sapiens
ggccagcccagtggtcctctct

SEQ ID NO: 8460808 - DNA, 19 bp, Homo sapiens
ggccagccacctcgcctgg

SEQ ID NO: 8460809 - DNA, 19 bp, Homo sapiens
ggccagccacctcgcctgg

SEQ ID NO: 8460810 - DNA, 22 bp, Homo sapiens
ggccagcagtcacagggtcaga

SEQ ID NO: 8460811 - DNA, 22 bp, Homo sapiens
ggccagcatatagagtgaagta

SEQ ID NO: 8460812 - DNA, 22 bp, Homo sapiens
ggccagcagtatatagctaatt

SEQ ID NO: 8460813 - DNA, 22 bp, Homo sapiens
ggccagcagtcacagggtcaga

SEQ ID NO: 8460814 - DNA, 22 bp, Homo sapiens
ggcccagctgtatattacagtt

SEQ ID NO: 8460815 - DNA, 22 bp, Homo sapiens
ggcccagctgggcggggacacg

SEQ ID NO: 8460816 - DNA, 22 bp, Homo sapiens
ggcccagctgtgcttccagccc

SEQ ID NO: 8460817 - DNA, 22 bp, Homo sapiens
ggcccagctttcattccttgct

SEQ ID NO: 8460818 - DNA, 22 bp, Homo sapiens
ggcccaggatgcaagaactgaa

SEQ ID NO: 8460819 - DNA, 22 bp, Homo sapiens
ggcccaggatgcaagaactgaa

SEQ ID NO: 8460820 - DNA, 22 bp, Homo sapiens
ggcccaggctggagtgcagtgg

SEQ ID NO: 8460821 - DNA, 22 bp, Homo sapiens
ggcccaggctggagtgcagtgg

SEQ ID NO: 8460822 - DNA, 20 bp, Homo sapiens
ggcccagtgaaccaggacgg

SEQ ID NO: 8460823 - DNA, 22 bp, Homo sapiens
ggcccagtgctgttcacccagt

SEQ ID NO: 8460824 - DNA, 22 bp, Homo sapiens
ggcccaggctggagtgcggtgg

SEQ ID NO: 8460825 - DNA, 22 bp, Homo sapiens
ggcccagtgtaccccaggcagt

SEQ ID NO: 8460826 - DNA, 22 bp, Homo sapiens
ggcccatgaccctagccaactg

SEQ ID NO: 8460827 - DNA, 22 bp, Homo sapiens
ggcccatctcttgctctgggtt

SEQ ID NO: 8460828 - DNA, 22 bp, Homo sapiens
ggcagtggcatgtgggtagtgg

SEQ ID NO: 8460829 - DNA, 22 bp, Homo sapiens
ggcagtggctgtagtctcttgg

SEQ ID NO: 8460830 - DNA, 22 bp, Homo sapiens
ggcagtgggaaataagtgagaa

SEQ ID NO: 8460831 - DNA, 17 bp, Homo sapiens
ggccacagagcttgggg

SEQ ID NO: 8460832 - DNA, 17 bp, Homo sapiens
ggccacagagcttgggg

SEQ ID NO: 8460833 - DNA, 17 bp, Homo sapiens
ggccacagagcttgggg

SEQ ID NO: 8460834 - DNA, 22 bp, Homo sapiens
ggccacagcagatgcttcagat

SEQ ID NO: 8460835 - DNA, 22 bp, Homo sapiens
ggccacagcagatgcttcagat

SEQ ID NO: 8460836 - DNA, 22 bp, Homo sapiens
ggccacagcaatgctgtgatgt

SEQ ID NO: 8460837 - DNA, 20 bp, Homo sapiens
ggccacagggtgctggtgga

SEQ ID NO: 8460838 - DNA, 21 bp, Homo sapiens
ggccacagttagggctcagga

SEQ ID NO: 8460839 - DNA, 21 bp, Homo sapiens
ggccacagttagggctcagga

SEQ ID NO: 8460840 - DNA, 21 bp, Homo sapiens
ggccacagttagggctcagga

SEQ ID NO: 8460841 - DNA, 22 bp, Homo sapiens
ggccacagtgggaaatcctggg

SEQ ID NO: 8460842 - DNA, 22 bp, Homo sapiens
ggccacagtgggaaatcctggg

SEQ ID NO: 8460843 - DNA, 22 bp, Homo sapiens
ggccacatgtggctgctcgtat

SEQ ID NO: 8460844 - DNA, 22 bp, Homo sapiens
ggccaccaaagtcctgtggctt

SEQ ID NO: 8460845 - DNA, 22 bp, Homo sapiens
ggccaccaaagtcctgtggctt

SEQ ID NO: 8460846 - DNA, 22 bp, Homo sapiens
ggccaccagtcctctggcaggg

SEQ ID NO: 8460847 - DNA, 22 bp, Homo sapiens
ggccagagttgatggcatcttg

SEQ ID NO: 8460848 - DNA, 22 bp, Homo sapiens
ggccagagttgatggcatcttg

SEQ ID NO: 8460849 - DNA, 22 bp, Homo sapiens
ggccagcagacctcagggactc

SEQ ID NO: 8460850 - DNA, 22 bp, Homo sapiens
ggccagcagacctcagggactc

SEQ ID NO: 8460851 - DNA, 21 bp, Homo sapiens
ggccagcagcgtccactgtgg

SEQ ID NO: 8460852 - DNA, 22 bp, Homo sapiens
ggccagcagacctcagggactc

SEQ ID NO: 8460853 - DNA, 22 bp, Homo sapiens
ggccagagtctatatgcagaca

SEQ ID NO: 8460854 - DNA, 22 bp, Homo sapiens
ggccagagtctatatgcagaca

SEQ ID NO: 8460855 - DNA, 22 bp, Homo sapiens
ggcagggactttgcaaatcttt

SEQ ID NO: 8460856 - DNA, 22 bp, Homo sapiens
ggcagggagagcatgctgataa

SEQ ID NO: 8460857 - DNA, 22 bp, Homo sapiens
ggcaggggtcctggtgttgact

SEQ ID NO: 8460858 - DNA, 22 bp, Homo sapiens
ggcagtgagaggtctcctggtc

SEQ ID NO: 8460859 - DNA, 22 bp, Homo sapiens
ggcagtgagaggtctcctggtc

SEQ ID NO: 8460860 - DNA, 22 bp, Homo sapiens
ggcagtgcaaggcagcctggat

SEQ ID NO: 8460861 - DNA, 22 bp, Homo sapiens
ggcagtgcaaggcagcctggat

SEQ ID NO: 8460862 - DNA, 17 bp, Homo sapiens
ggcagtggaggaagaga

SEQ ID NO: 8460863 - DNA, 17 bp, Homo sapiens
ggcagtggaggaagaga

SEQ ID NO: 8460864 - DNA, 18 bp, Homo sapiens
ggcagtgcagtctcaggg

SEQ ID NO: 8460865 - DNA, 22 bp, Homo sapiens
ggcagtgccactaagctctgct

SEQ ID NO: 8460866 - DNA, 22 bp, Homo sapiens
ggcagtgcccggtgcctcctct

SEQ ID NO: 8460867 - DNA, 22 bp, Homo sapiens
ggcagtgcctgatgctgcagga

SEQ ID NO: 8460868 - DNA, 22 bp, Homo sapiens
ggcaggctttgagaaagagcat

SEQ ID NO: 8460869 - DNA, 22 bp, Homo sapiens
ggcaggctttgagaaagagcat

SEQ ID NO: 8460870 - DNA, 22 bp, Homo sapiens
ggcaggctttcagcatcaagtc

SEQ ID NO: 8460871 - DNA, 22 bp, Homo sapiens
ggcaggctttcagcatcaagtc

SEQ ID NO: 8460872 - DNA, 20 bp, Homo sapiens
ggcaggctttatatggaggg

SEQ ID NO: 8460873 - DNA, 22 bp, Homo sapiens
ggcaggctgttcacctgctttt

SEQ ID NO: 8460874 - DNA, 22 bp, Homo sapiens
ggcaggctgttcacctgctttt

SEQ ID NO: 8460875 - DNA, 22 bp, Homo sapiens
ggcaggcttgatatggggggac

SEQ ID NO: 8460876 - DNA, 22 bp, Homo sapiens
ggcaggcttgatatggggggac

SEQ ID NO: 8460877 - DNA, 22 bp, Homo sapiens
ggcaggcttggtggcaccggtt

SEQ ID NO: 8460878 - DNA, 22 bp, Homo sapiens
ggcaggcttggtggcaccggtt

SEQ ID NO: 8460879 - DNA, 22 bp, Homo sapiens
ggcagctcctctcagcaaaaga

SEQ ID NO: 8460880 - DNA, 22 bp, Homo sapiens
ggcagctcgatgacttctgcat

SEQ ID NO: 8460881 - DNA, 22 bp, Homo sapiens
ggcagctcctcaaaaaattaaa

SEQ ID NO: 8460882 - DNA, 22 bp, Homo sapiens
ggcagctcacgggcatggggtg

SEQ ID NO: 8460883 - DNA, 22 bp, Homo sapiens
ggcagctcacgggcatggggtg

SEQ ID NO: 8460884 - DNA, 22 bp, Homo sapiens
ggcagctcactgattagcaatt

SEQ ID NO: 8460885 - DNA, 22 bp, Homo sapiens
ggcagccttgagggaggcctgg

SEQ ID NO: 8460886 - DNA, 22 bp, Homo sapiens
ggcagccttgagggaggcctgg

SEQ ID NO: 8460887 - DNA, 22 bp, Homo sapiens
ggcagctcacctctggtccagg

SEQ ID NO: 8460888 - DNA, 22 bp, Homo sapiens
ggcagccatgtgggcagcgagt

SEQ ID NO: 8460889 - DNA, 22 bp, Homo sapiens
ggcagcccaccagcccacgtct

SEQ ID NO: 8460890 - DNA, 22 bp, Homo sapiens
ggcagccccatcagagacgctg

SEQ ID NO: 8460891 - DNA, 17 bp, Homo sapiens
ggcagcctcaggcgttt

SEQ ID NO: 8460892 - DNA, 22 bp, Homo sapiens
ggcagcctcaggttttctttga

SEQ ID NO: 8460893 - DNA, 18 bp, Homo sapiens
ggcagcctacccacttgt

SEQ ID NO: 8460894 - DNA, 21 bp, Homo sapiens
ggcagcccgccctctcctggc

SEQ ID NO: 8460895 - DNA, 21 bp, Homo sapiens
ggcagcccgccctctcctggc

SEQ ID NO: 8460896 - DNA, 22 bp, Homo sapiens
ggcagccctgtggagaggccca

SEQ ID NO: 8460897 - DNA, 18 bp, Homo sapiens
ggcagcctggacatgctc

SEQ ID NO: 8460898 - DNA, 22 bp, Homo sapiens
ggcagccttctctcataggtga

SEQ ID NO: 8460899 - DNA, 22 bp, Homo sapiens
ggcagcctggagactttgtgaa

SEQ ID NO: 8460900 - DNA, 18 bp, Homo sapiens
ggcagcctacccacttgt

SEQ ID NO: 8460901 - DNA, 21 bp, Homo sapiens
ggcagcctgacccccagagag

SEQ ID NO: 8460902 - DNA, 21 bp, Homo sapiens
ggcagcctgacccccagagag

SEQ ID NO: 8460903 - DNA, 22 bp, Homo sapiens
ggcagcctccagggcactggtg

SEQ ID NO: 8460904 - DNA, 23 bp, Homo sapiens
ggcagcctctgactctgctttgc

SEQ ID NO: 8460905 - DNA, 23 bp, Homo sapiens
ggcagcctctgactctgctttgc

SEQ ID NO: 8460906 - DNA, 23 bp, Homo sapiens
ggcagatttggtttgttttaata

SEQ ID NO: 8460907 - DNA, 22 bp, Homo sapiens
ggcagcaaaaagcctggttgaa

SEQ ID NO: 8460908 - DNA, 22 bp, Homo sapiens
ggcagcaagtggtgggagactt

SEQ ID NO: 8460909 - DNA, 22 bp, Homo sapiens
ggcagcaactcggagagaagag

SEQ ID NO: 8460910 - DNA, 22 bp, Homo sapiens
ggcagcactgcagcttgttggg

SEQ ID NO: 8460911 - DNA, 22 bp, Homo sapiens
ggcagcagaactggccctgtat

SEQ ID NO: 8460912 - DNA, 22 bp, Homo sapiens
ggcagcactgcagcttgttggg

SEQ ID NO: 8460913 - DNA, 22 bp, Homo sapiens
ggcacgtgcctaaggagcaggc

SEQ ID NO: 8460914 - DNA, 22 bp, Homo sapiens
ggcactaggagacctgggggtc

SEQ ID NO: 8460915 - DNA, 22 bp, Homo sapiens
ggcactgacactagcatggcac

SEQ ID NO: 8460916 - DNA, 22 bp, Homo sapiens
ggcagaggtgacagtgtctttt

SEQ ID NO: 8460917 - DNA, 22 bp, Homo sapiens
ggcactgagctgccttggggca

SEQ ID NO: 8460918 - DNA, 22 bp, Homo sapiens
ggcactgattccattcatgaag

SEQ ID NO: 8460919 - DNA, 22 bp, Homo sapiens
ggaggcacacctcagactggga

SEQ ID NO: 8460920 - DNA, 23 bp, Homo sapiens
ggaggcacttaggcagagcagag

SEQ ID NO: 8460921 - DNA, 22 bp, Homo sapiens
ggaggcaaagcactttgcttgg

SEQ ID NO: 8460922 - DNA, 22 bp, Homo sapiens
ggaggcaaagcactttgcttgg

SEQ ID NO: 8460923 - DNA, 17 bp, Homo sapiens
ggaggcaacagacaggg

SEQ ID NO: 8460924 - DNA, 22 bp, Homo sapiens
ggaggatgccaagctgtgcaca

SEQ ID NO: 8460925 - DNA, 22 bp, Homo sapiens
ggaggatgagctacgaggagct

SEQ ID NO: 8460926 - DNA, 22 bp, Homo sapiens
ggaggagtcagttgggctgctt

SEQ ID NO: 8460927 - DNA, 22 bp, Homo sapiens
ggaggaggtgggttaagttgta

SEQ ID NO: 8460928 - DNA, 22 bp, Homo sapiens
ggcacccttggggggccacagc

SEQ ID NO: 8460929 - DNA, 18 bp, Homo sapiens
ggcacctctcttgcctta

SEQ ID NO: 8460930 - DNA, 22 bp, Homo sapiens
ggcaccagggcaagggtctttc

SEQ ID NO: 8460931 - DNA, 22 bp, Homo sapiens
ggcaccaggggatgtaatgtcc

SEQ ID NO: 8460932 - DNA, 22 bp, Homo sapiens
ggcaccagggaaggaaggctgg

SEQ ID NO: 8460933 - DNA, 22 bp, Homo sapiens
ggcaccagggacaatcctcttc

SEQ ID NO: 8460934 - DNA, 22 bp, Homo sapiens
ggaggcacttcatgctgacccg

SEQ ID NO: 8460935 - DNA, 22 bp, Homo sapiens
ggaggcacttcccgtctcagcc

SEQ ID NO: 8460936 - DNA, 22 bp, Homo sapiens
ggcaccaggctgggcataggcc

SEQ ID NO: 8460937 - DNA, 22 bp, Homo sapiens
ggaggcagaacttcccgtcagt

SEQ ID NO: 8460938 - DNA, 16 bp, Homo sapiens
ggcaccagtgaacaca

SEQ ID NO: 8460939 - DNA, 19 bp, Homo sapiens
ggcaccttggctatgcctg

SEQ ID NO: 8460940 - DNA, 22 bp, Homo sapiens
ggcacctgtgtaagatctggaa

SEQ ID NO: 8460941 - DNA, 19 bp, Homo sapiens
ggcacctttctgctgtgtc

SEQ ID NO: 8460942 - DNA, 19 bp, Homo sapiens
ggcaccttggtcttggact

SEQ ID NO: 8460943 - DNA, 22 bp, Homo sapiens
ggcacctggtaagtgctcagta

SEQ ID NO: 8460944 - DNA, 22 bp, Homo sapiens
ggcacctggtaagtgctcagta

SEQ ID NO: 8460945 - DNA, 22 bp, Homo sapiens
ttctggaacatagcaagaagtt

SEQ ID NO: 8460946 - DNA, 21 bp, Homo sapiens
ttctctggtcaagcacacata

SEQ ID NO: 8460947 - DNA, 22 bp, Homo sapiens
ttctggaaatgcacaactaatt

SEQ ID NO: 8460948 - DNA, 21 bp, Homo sapiens
ttctctggtcaagcacacata

SEQ ID NO: 8460949 - DNA, 22 bp, Homo sapiens
ttctggaagttggaaatagcag

SEQ ID NO: 8460950 - DNA, 22 bp, Homo sapiens
ttctggaagtgttagaatctgg

SEQ ID NO: 8460951 - DNA, 22 bp, Homo sapiens
ttctctgggacaggaacagttt

SEQ ID NO: 8460952 - DNA, 22 bp, Homo sapiens
ttctctgggatctggcaaaagg

SEQ ID NO: 8460953 - DNA, 22 bp, Homo sapiens
ttctctggggactgtctctatt

SEQ ID NO: 8460954 - DNA, 22 bp, Homo sapiens
ttctctgggcttttcggatccg

SEQ ID NO: 8460955 - DNA, 22 bp, Homo sapiens
ttctctggacagtgaagagagg

SEQ ID NO: 8460956 - DNA, 22 bp, Homo sapiens
ttctctgggacaggaacagttt

SEQ ID NO: 8460957 - DNA, 22 bp, Homo sapiens
ttctctggggttcagtatctct

SEQ ID NO: 8460958 - DNA, 22 bp, Homo sapiens
ttctctggggacttggttggag

SEQ ID NO: 8460959 - DNA, 16 bp, Homo sapiens
ttctctggggttgtgc

SEQ ID NO: 8460960 - DNA, 22 bp, Homo sapiens
ttctctgggttaggggaactat

SEQ ID NO: 8460961 - DNA, 22 bp, Homo sapiens
ttctctggtaaacacatgcgta

SEQ ID NO: 8460962 - DNA, 22 bp, Homo sapiens
ttctggaatcctcaaaacatga

SEQ ID NO: 8460963 - DNA, 22 bp, Homo sapiens
ttctgtgcgtaggcgatgcagt

SEQ ID NO: 8460964 - DNA, 17 bp, Homo sapiens
ttctgtgcttcctggct

SEQ ID NO: 8460965 - DNA, 22 bp, Homo sapiens
ttctgtgattcctccagccagc

SEQ ID NO: 8460966 - DNA, 22 bp, Homo sapiens
ttctgtgattcctccagccagc

SEQ ID NO: 8460967 - DNA, 22 bp, Homo sapiens
ttctgtgaggacttctcaagga

SEQ ID NO: 8460968 - DNA, 22 bp, Homo sapiens
ttctgtgactcctcagagattt

SEQ ID NO: 8460969 - DNA, 22 bp, Homo sapiens
ttctgtggctgggagcctggct

SEQ ID NO: 8460970 - DNA, 22 bp, Homo sapiens
ttctgtggcagtttgggaggtg

SEQ ID NO: 8460971 - DNA, 22 bp, Homo sapiens
ttctgtggaggtttggaacatt

SEQ ID NO: 8460972 - DNA, 22 bp, Homo sapiens
ttctgtggaatatgaactagca

SEQ ID NO: 8460973 - DNA, 22 bp, Homo sapiens
ttctgtgggtaatacctcatac

SEQ ID NO: 8460974 - DNA, 22 bp, Homo sapiens
ttctgtggtctcccatgtctgt

SEQ ID NO: 8460975 - DNA, 22 bp, Homo sapiens
ttctgtgtcttcttgttctgtg

SEQ ID NO: 8460976 - DNA, 22 bp, Homo sapiens
ttctgtggttgaaaggagagat

SEQ ID NO: 8460977 - DNA, 22 bp, Homo sapiens
ttctgtctgtaaacttctcaat

SEQ ID NO: 8460978 - DNA, 22 bp, Homo sapiens
ttctgtctgtaaacttctcaat

SEQ ID NO: 8460979 - DNA, 23 bp, Homo sapiens
ttctgtcttgctgtcagctttct

SEQ ID NO: 8460980 - DNA, 23 bp, Homo sapiens
ttctgtcttgctgtcagctttct

SEQ ID NO: 8460981 - DNA, 22 bp, Homo sapiens
ttctgtcttctcggttgtttac

SEQ ID NO: 8460982 - DNA, 22 bp, Homo sapiens
ttctgtcttctcggttgtttac

SEQ ID NO: 8460983 - DNA, 22 bp, Homo sapiens
ttctgtcttctcggttgtttac

SEQ ID NO: 8460984 - DNA, 22 bp, Homo sapiens
ttctgtcttcccactgaggagc

SEQ ID NO: 8460985 - DNA, 22 bp, Homo sapiens
ttctgtctctgtgtttacatta

SEQ ID NO: 8460986 - DNA, 22 bp, Homo sapiens
ttctgtctgatggtgccagaac

SEQ ID NO: 8460987 - DNA, 22 bp, Homo sapiens
ttctgtaccctcgcgattctcc

SEQ ID NO: 8460988 - DNA, 22 bp, Homo sapiens
ttctgtacccaacatttttact

SEQ ID NO: 8460989 - DNA, 22 bp, Homo sapiens
ttctgtacaagttgtggctgct

SEQ ID NO: 8460990 - DNA, 22 bp, Homo sapiens
ttctgtgtgtctcagcaagctg

SEQ ID NO: 8460991 - DNA, 22 bp, Homo sapiens
ttctgtgtgggtagctcctgtt

SEQ ID NO: 8460992 - DNA, 22 bp, Homo sapiens
ttctgtgtgtctcagcaagctg

SEQ ID NO: 8460993 - DNA, 22 bp, Homo sapiens
ttctgtgtgccagagttgtgct

SEQ ID NO: 8460994 - DNA, 22 bp, Homo sapiens
ttctgtgttctgtgcaatgagc

SEQ ID NO: 8460995 - DNA, 22 bp, Homo sapiens
ttcttacattactttacatgtg

SEQ ID NO: 8460996 - DNA, 22 bp, Homo sapiens
ttcttataagttaatatttcca

SEQ ID NO: 8460997 - DNA, 22 bp, Homo sapiens
ttcttagagatggttaaaaata

SEQ ID NO: 8460998 - DNA, 22 bp, Homo sapiens
ttcttagatgattaatgatggg

SEQ ID NO: 8460999 - DNA, 22 bp, Homo sapiens
ttcttagaagaaacatctaaaa

SEQ ID NO: 8461000 - DNA, 22 bp, Homo sapiens
ttcttactatgatttgagcctc

SEQ ID NO: 8461001 - DNA, 22 bp, Homo sapiens
ttcttagtggtagtcatctttg

SEQ ID NO: 8461002 - DNA, 22 bp, Homo sapiens
ttctttggtgggagattgaggt

SEQ ID NO: 8461003 - DNA, 22 bp, Homo sapiens
ttcttcaaccatctacataaac

SEQ ID NO: 8461004 - DNA, 22 bp, Homo sapiens
ttcttattcttgaaatgtggga

SEQ ID NO: 8461005 - DNA, 22 bp, Homo sapiens
ttcttattcttgaaatgtggga

SEQ ID NO: 8461006 - DNA, 22 bp, Homo sapiens
ttcttcaaaatccagcatgatt

SEQ ID NO: 8461007 - DNA, 22 bp, Homo sapiens
ttcttttaaaagagagcagaaa

SEQ ID NO: 8461008 - DNA, 22 bp, Homo sapiens
ttcttttaatagagatcctgtg

SEQ ID NO: 8461009 - DNA, 22 bp, Homo sapiens
ttcttttaatagagatcctgtg

SEQ ID NO: 8461010 - DNA, 22 bp, Homo sapiens
ttcttttaatgttctgaagttt

SEQ ID NO: 8461011 - DNA, 22 bp, Homo sapiens
ttcttttaatgttctgaagttt

SEQ ID NO: 8461012 - DNA, 22 bp, Homo sapiens
ttcttttaatgtctggctttca

SEQ ID NO: 8461013 - DNA, 22 bp, Homo sapiens
ttcttttaatgtctggctttca

SEQ ID NO: 8461014 - DNA, 22 bp, Homo sapiens
ttcttttaatgtctggctttca

SEQ ID NO: 8461015 - DNA, 22 bp, Homo sapiens
ttcttttaatgttctgaagttt

SEQ ID NO: 8461016 - DNA, 22 bp, Homo sapiens
ttcttttaattgtgggggagtg

SEQ ID NO: 8461017 - DNA, 22 bp, Homo sapiens
ttcttttaattgtgggggagtg

SEQ ID NO: 8461018 - DNA, 22 bp, Homo sapiens
ttcttttaatgttctgaagttt

SEQ ID NO: 8461019 - DNA, 17 bp, Homo sapiens
ttcttttctgagccttg

SEQ ID NO: 8461020 - DNA, 23 bp, Homo sapiens
ttctttgtggataatctccagtg

SEQ ID NO: 8461021 - DNA, 19 bp, Homo sapiens
ttctttggtggtggtgacc

SEQ ID NO: 8461022 - DNA, 19 bp, Homo sapiens
ttctttggtggtggtgacc

SEQ ID NO: 8461023 - DNA, 22 bp, Homo sapiens
ttctttggtgttacccagctca

SEQ ID NO: 8461024 - DNA, 22 bp, Homo sapiens
ttctttgttgtactttcctaca

SEQ ID NO: 8461025 - DNA, 17 bp, Homo sapiens
ttgaactgctgagtcag

SEQ ID NO: 8461026 - DNA, 23 bp, Homo sapiens
ttgaatttctcttgcaatattta

SEQ ID NO: 8461027 - DNA, 22 bp, Homo sapiens
ttgaatttagattgtatgttga

SEQ ID NO: 8461028 - DNA, 22 bp, Homo sapiens
ttgaaattgggtgtggctgtca

SEQ ID NO: 8461029 - DNA, 19 bp, Homo sapiens
ttgaaattgtttgatatgg

SEQ ID NO: 8461030 - DNA, 22 bp, Homo sapiens
ttgaaatggcagcagctgacct

SEQ ID NO: 8461031 - DNA, 22 bp, Homo sapiens
ttgaacattaacttcagtctat

SEQ ID NO: 8461032 - DNA, 22 bp, Homo sapiens
ttgaaattttaggccttgcaat

SEQ ID NO: 8461033 - DNA, 22 bp, Homo sapiens
ttgaaatcaccactagcatttg

SEQ ID NO: 8461034 - DNA, 22 bp, Homo sapiens
ttgaaatcttccacagcccaag

SEQ ID NO: 8461035 - DNA, 22 bp, Homo sapiens
ttgaaatatggattgaccttga

SEQ ID NO: 8461036 - DNA, 22 bp, Homo sapiens
ttcttttgcaagactattgatt

SEQ ID NO: 8461037 - DNA, 22 bp, Homo sapiens
ttcttttggactcaaagagaac

SEQ ID NO: 8461038 - DNA, 22 bp, Homo sapiens
ttcttttctttaggcattgtgt

SEQ ID NO: 8461039 - DNA, 22 bp, Homo sapiens
ttcttttctttaggcattgtgt

SEQ ID NO: 8461040 - DNA, 22 bp, Homo sapiens
ttcttttcttggcaggagtaga

SEQ ID NO: 8461041 - DNA, 22 bp, Homo sapiens
ttcttttgggaattacgtatgc

SEQ ID NO: 8461042 - DNA, 22 bp, Homo sapiens
ttctttttaaagtgtgtatgca

SEQ ID NO: 8461043 - DNA, 22 bp, Homo sapiens
ttctttttaaagtgtgtatgca

SEQ ID NO: 8461044 - DNA, 22 bp, Homo sapiens
ttctctaggttttagatgaaga

SEQ ID NO: 8461045 - DNA, 22 bp, Homo sapiens
ttctctagcaaaaccagctagt

SEQ ID NO: 8461046 - DNA, 20 bp, Homo sapiens
ttctctagccttcccctggg

SEQ ID NO: 8461047 - DNA, 22 bp, Homo sapiens
ttctctctgagagcatctggaa

SEQ ID NO: 8461048 - DNA, 22 bp, Homo sapiens
ttctctcccatgaagcttctat

SEQ ID NO: 8461049 - DNA, 22 bp, Homo sapiens
ttctctgaaggccatgctcact

SEQ ID NO: 8461050 - DNA, 22 bp, Homo sapiens
ttctctcttactgccatgctgt

SEQ ID NO: 8461051 - DNA, 22 bp, Homo sapiens
ttctctggaaggctctacggga

SEQ ID NO: 8461052 - DNA, 22 bp, Homo sapiens
ttctctggaactgaaacaagat

SEQ ID NO: 8461053 - DNA, 22 bp, Homo sapiens
ttctctggaactgaaacaagat

SEQ ID NO: 8461054 - DNA, 22 bp, Homo sapiens
ttctctgctctcacatacagaa

SEQ ID NO: 8461055 - DNA, 22 bp, Homo sapiens
ttctctgcagcttaggcccagt

SEQ ID NO: 8461056 - DNA, 22 bp, Homo sapiens
ttctctgcagcttaggcccagt

SEQ ID NO: 8461057 - DNA, 22 bp, Homo sapiens
ttctctgagtcttggtttctta

SEQ ID NO: 8461058 - DNA, 17 bp, Homo sapiens
ttctctgagctgtattg

SEQ ID NO: 8461059 - DNA, 21 bp, Homo sapiens
ttctcagatcgagtagtgaga

SEQ ID NO: 8461060 - DNA, 22 bp, Homo sapiens
ttctcaggctctgagaccctat

SEQ ID NO: 8461061 - DNA, 22 bp, Homo sapiens
ttctcaggcctttgggatggga

SEQ ID NO: 8461062 - DNA, 22 bp, Homo sapiens
ttctcaggcccctgcctggact

SEQ ID NO: 8461063 - DNA, 22 bp, Homo sapiens
ttctcagggtctggatggcctg

SEQ ID NO: 8461064 - DNA, 22 bp, Homo sapiens
ttctcagggtagaggtgacact

SEQ ID NO: 8461065 - DNA, 22 bp, Homo sapiens
ttctcagggtctggatggcctg

SEQ ID NO: 8461066 - DNA, 22 bp, Homo sapiens
ttctcaggcccctgcctggact

SEQ ID NO: 8461067 - DNA, 22 bp, Homo sapiens
ttctcaggactcctgcctgctt

SEQ ID NO: 8461068 - DNA, 22 bp, Homo sapiens
ttctcagatgattcagataaac

SEQ ID NO: 8461069 - DNA, 23 bp, Homo sapiens
ttctcctgaggaagcagggactg

SEQ ID NO: 8461070 - DNA, 22 bp, Homo sapiens
ttctcctgagttcccaggtcta

SEQ ID NO: 8461071 - DNA, 23 bp, Homo sapiens
ttctcctgaggaagcagggactg

SEQ ID NO: 8461072 - DNA, 22 bp, Homo sapiens
ttctccagaccctcctgcagac

SEQ ID NO: 8461073 - DNA, 22 bp, Homo sapiens
ttctccagaggtggctagagtt

SEQ ID NO: 8461074 - DNA, 22 bp, Homo sapiens
ttctccagagggctctgcagga

SEQ ID NO: 8461075 - DNA, 22 bp, Homo sapiens
ttctccagagggctctgcagga

SEQ ID NO: 8461076 - DNA, 22 bp, Homo sapiens
ttctccagaccttgtgactatg

SEQ ID NO: 8461077 - DNA, 22 bp, Homo sapiens
ttctccagaccctcctgcagac

SEQ ID NO: 8461078 - DNA, 22 bp, Homo sapiens
ttctccagaccctcctgcagac

SEQ ID NO: 8461079 - DNA, 22 bp, Homo sapiens
ttctccagaccctcctgcagac

SEQ ID NO: 8461080 - DNA, 22 bp, Homo sapiens
ttctccagaccactgcctctgt

SEQ ID NO: 8461081 - DNA, 22 bp, Homo sapiens
ttctccagaccactgcctctgt

SEQ ID NO: 8461082 - DNA, 22 bp, Homo sapiens
ttctccagacaggcagagggaa

SEQ ID NO: 8461083 - DNA, 22 bp, Homo sapiens
ttctcaggtcaccagggtgcca

SEQ ID NO: 8461084 - DNA, 22 bp, Homo sapiens
ttctcagggtttgtgcaggctt

SEQ ID NO: 8461085 - DNA, 22 bp, Homo sapiens
ttctcagggtcttgtgcaaggg

SEQ ID NO: 8461086 - DNA, 22 bp, Homo sapiens
ttctccagacacaaaatctaag

SEQ ID NO: 8461087 - DNA, 18 bp, Homo sapiens
ttctccagaaaacatagc

SEQ ID NO: 8461088 - DNA, 22 bp, Homo sapiens
ttctccagacaacagagggtga

SEQ ID NO: 8461089 - DNA, 22 bp, Homo sapiens
ttcctgagaacatggcagctta

SEQ ID NO: 8461090 - DNA, 22 bp, Homo sapiens
ttcctgagaaatttgtacctgg

SEQ ID NO: 8461091 - DNA, 22 bp, Homo sapiens
ttcctgaattgagctttagaaa

SEQ ID NO: 8461092 - DNA, 22 bp, Homo sapiens
ttcctgaatgctgttgtgctgt

SEQ ID NO: 8461093 - DNA, 22 bp, Homo sapiens
ttccagttctggctttgccact

SEQ ID NO: 8461094 - DNA, 22 bp, Homo sapiens
ttcctgagggacttttgagatt

SEQ ID NO: 8461095 - DNA, 22 bp, Homo sapiens
ttcctgagggccccagaggagg

SEQ ID NO: 8461096 - DNA, 22 bp, Homo sapiens
ttcctgaggaggaccaggacca

SEQ ID NO: 8461097 - DNA, 22 bp, Homo sapiens
ttcctgaggctcatcggagtcg

SEQ ID NO: 8461098 - DNA, 23 bp, Homo sapiens
ttcctgagtgctggagagagtgc

SEQ ID NO: 8461099 - DNA, 22 bp, Homo sapiens
ttcctgagtcgccgagtctatg

SEQ ID NO: 8461100 - DNA, 22 bp, Homo sapiens
ttcctggagagttttcccaaag

SEQ ID NO: 8461101 - DNA, 22 bp, Homo sapiens
ttcctggcaccctggacccggc

SEQ ID NO: 8461102 - DNA, 22 bp, Homo sapiens
ttcctggcaccaccacttctag

SEQ ID NO: 8461103 - DNA, 22 bp, Homo sapiens
ttcctggcacatagttagtgct

SEQ ID NO: 8461104 - DNA, 22 bp, Homo sapiens
ttcctggcacactcctgaatgt

SEQ ID NO: 8461105 - DNA, 22 bp, Homo sapiens
ttcctggcaaagtgagcatcac

SEQ ID NO: 8461106 - DNA, 22 bp, Homo sapiens
ttcctggaaattatgctcacct

SEQ ID NO: 8461107 - DNA, 22 bp, Homo sapiens
ttcctggggcgactgtatctga

SEQ ID NO: 8461108 - DNA, 22 bp, Homo sapiens
ttcctggctcacagcagtgggg

SEQ ID NO: 8461109 - DNA, 21 bp, Homo sapiens
ttcctggggacttccgtggga

SEQ ID NO: 8461110 - DNA, 22 bp, Homo sapiens
ttcctggcctctctctgagcag

SEQ ID NO: 8461111 - DNA, 22 bp, Homo sapiens
ttcctggcctctctctgagcag

SEQ ID NO: 8461112 - DNA, 22 bp, Homo sapiens
ttcctggcctaaggtaggtgac

SEQ ID NO: 8461113 - DNA, 22 bp, Homo sapiens
ttcctggcctcttccaccacca

SEQ ID NO: 8461114 - DNA, 22 bp, Homo sapiens
ttcctggcgccacggagccggt

SEQ ID NO: 8461115 - DNA, 21 bp, Homo sapiens
ttcctggcggcagaaacgtga

SEQ ID NO: 8461116 - DNA, 22 bp, Homo sapiens
ttcctggccaagcagagtggaa

SEQ ID NO: 8461117 - DNA, 22 bp, Homo sapiens
ttcctggccccatccatcttca

SEQ ID NO: 8461118 - DNA, 22 bp, Homo sapiens
ttcctggccagctgtggtgagt

SEQ ID NO: 8461119 - DNA, 22 bp, Homo sapiens
ttcctggccccacccctggaga

SEQ ID NO: 8461120 - DNA, 22 bp, Homo sapiens
ttcctggcattatgggaggctg

SEQ ID NO: 8461121 - DNA, 22 bp, Homo sapiens
ttcctggcatgaaaaatatcac

SEQ ID NO: 8461122 - DNA, 22 bp, Homo sapiens
ttcctggcatagagagggcaca

SEQ ID NO: 8461123 - DNA, 23 bp, Homo sapiens
ttcctggcaggtacaacttttac

SEQ ID NO: 8461124 - DNA, 22 bp, Homo sapiens
ttcctggcagaggccccgacag

SEQ ID NO: 8461125 - DNA, 22 bp, Homo sapiens
ttcctggcacccttgttagcct

SEQ ID NO: 8461126 - DNA, 22 bp, Homo sapiens
ttcctggcactgcagtggttga

SEQ ID NO: 8461127 - DNA, 22 bp, Homo sapiens
ttcctgggtggtcctggtagag

SEQ ID NO: 8461128 - DNA, 22 bp, Homo sapiens
ttcctgggtggtcctggtagag

SEQ ID NO: 8461129 - DNA, 19 bp, Homo sapiens
ttcctggggttccattgtg

SEQ ID NO: 8461130 - DNA, 22 bp, Homo sapiens
ttcctgggtttacgtattgggt

SEQ ID NO: 8461131 - DNA, 22 bp, Homo sapiens
ttcctgggttgtgcattgtaca

SEQ ID NO: 8461132 - DNA, 22 bp, Homo sapiens
ttcctgggttccctctcattct

SEQ ID NO: 8461133 - DNA, 22 bp, Homo sapiens
ttcctgggggcagcagtcttga

SEQ ID NO: 8461134 - DNA, 22 bp, Homo sapiens
ttcctggggcttagcaatggag

SEQ ID NO: 8461135 - DNA, 22 bp, Homo sapiens
ttcctggggcttagcaatggag

SEQ ID NO: 8461136 - DNA, 22 bp, Homo sapiens
ttcctggggctccagctaccag

SEQ ID NO: 8461137 - DNA, 22 bp, Homo sapiens
ttcctggggtgaagatattttt

SEQ ID NO: 8461138 - DNA, 22 bp, Homo sapiens
ttcctggggggatagatttcac

SEQ ID NO: 8461139 - DNA, 22 bp, Homo sapiens
ttcctggggtactggagaaaat

SEQ ID NO: 8461140 - DNA, 22 bp, Homo sapiens
ttcctggtagtaagacatctgg

SEQ ID NO: 8461141 - DNA, 22 bp, Homo sapiens
ttcctggtaaattatgtccagg

SEQ ID NO: 8461142 - DNA, 22 bp, Homo sapiens
ttcctggtctatttagaattgc

SEQ ID NO: 8461143 - DNA, 22 bp, Homo sapiens
ttcctggtctatttagaattgc

SEQ ID NO: 8461144 - DNA, 22 bp, Homo sapiens
ttcctggtcctattatatacac

SEQ ID NO: 8461145 - DNA, 22 bp, Homo sapiens
ttcctggtggctttgccaactg

SEQ ID NO: 8461146 - DNA, 22 bp, Homo sapiens
ttcctggtggtggtgacagcac

SEQ ID NO: 8461147 - DNA, 22 bp, Homo sapiens
ttcctggtgacctcactggtag

SEQ ID NO: 8461148 - DNA, 22 bp, Homo sapiens
ttcctggtttgcctggaatcca

SEQ ID NO: 8461149 - DNA, 22 bp, Homo sapiens
ttcctggtttatggaaagcatg

SEQ ID NO: 8461150 - DNA, 22 bp, Homo sapiens
ttcctggtttatggaaagcatg

SEQ ID NO: 8461151 - DNA, 22 bp, Homo sapiens
ttcctggttggattctgattaa

SEQ ID NO: 8461152 - DNA, 22 bp, Homo sapiens
ttcctggtttatacctgtatca

SEQ ID NO: 8461153 - DNA, 22 bp, Homo sapiens
ttccttgaaagtttgaactgac

SEQ ID NO: 8461154 - DNA, 22 bp, Homo sapiens
ttccttgagatgactgtcttgt

SEQ ID NO: 8461155 - DNA, 18 bp, Homo sapiens
ttccttctgatgtatatg

SEQ ID NO: 8461156 - DNA, 22 bp, Homo sapiens
ttattacaatgcagaaaataga

SEQ ID NO: 8461157 - DNA, 22 bp, Homo sapiens
ttattacaatgcagaaaataga

SEQ ID NO: 8461158 - DNA, 22 bp, Homo sapiens
ttattaagtgcgtactgtatgc

SEQ ID NO: 8461159 - DNA, 22 bp, Homo sapiens
ttattaagtgcgtactgtatgc

SEQ ID NO: 8461160 - DNA, 22 bp, Homo sapiens
ttatatctttttacatctctcc

SEQ ID NO: 8461161 - DNA, 20 bp, Homo sapiens
ttatatcataatgtgccaat

SEQ ID NO: 8461162 - DNA, 22 bp, Homo sapiens
ttattaaaatgcggatttggct

SEQ ID NO: 8461163 - DNA, 22 bp, Homo sapiens
ttatatatatgtagaggtcacg

SEQ ID NO: 8461164 - DNA, 22 bp, Homo sapiens
ttatatatcttgatttgttcca

SEQ ID NO: 8461165 - DNA, 22 bp, Homo sapiens
ttattctttaaacatatatgtt

SEQ ID NO: 8461166 - DNA, 22 bp, Homo sapiens
ttattctttaaacatatatgtt

SEQ ID NO: 8461167 - DNA, 22 bp, Homo sapiens
ttattacactgaaagaattgcg

SEQ ID NO: 8461168 - DNA, 22 bp, Homo sapiens
ttattacactgaaagaattgcg

SEQ ID NO: 8461169 - DNA, 22 bp, Homo sapiens
ttattacagtcccagggagtag

SEQ ID NO: 8461170 - DNA, 22 bp, Homo sapiens
ttattagtgttgatattaggat

SEQ ID NO: 8461171 - DNA, 22 bp, Homo sapiens
ttcaaacctatctaagaaatag

SEQ ID NO: 8461172 - DNA, 22 bp, Homo sapiens
ttcaaaccttcacttgcagagt

SEQ ID NO: 8461173 - DNA, 22 bp, Homo sapiens
ttcaaacagttgcacaacttat

SEQ ID NO: 8461174 - DNA, 22 bp, Homo sapiens
ttcaaacagtgtagaatatatg

SEQ ID NO: 8461175 - DNA, 22 bp, Homo sapiens
ttattgttaggcttttggaatt

SEQ ID NO: 8461176 - DNA, 22 bp, Homo sapiens
ttattgaaggaactgaaataaa

SEQ ID NO: 8461177 - DNA, 22 bp, Homo sapiens
ttattgaaggaactgaaataaa

SEQ ID NO: 8461178 - DNA, 18 bp, Homo sapiens
ttattggtgctgctgttc

SEQ ID NO: 8461179 - DNA, 22 bp, Homo sapiens
ttattgagcacctactatgtgt

SEQ ID NO: 8461180 - DNA, 22 bp, Homo sapiens
ttagcgcacatcacagggggaa

SEQ ID NO: 8461181 - DNA, 22 bp, Homo sapiens
ttagccttagaagcttagcaaa

SEQ ID NO: 8461182 - DNA, 22 bp, Homo sapiens
ttagctctttgtagctatttct

SEQ ID NO: 8461183 - DNA, 22 bp, Homo sapiens
ttagctgtggaagcttcagcca

SEQ ID NO: 8461184 - DNA, 22 bp, Homo sapiens
ttagccattctgataggtatgt

SEQ ID NO: 8461185 - DNA, 22 bp, Homo sapiens
ttaggaaaggaacattgaaacg

SEQ ID NO: 8461186 - DNA, 22 bp, Homo sapiens
ttaggaaagcattgtgtaaaag

SEQ ID NO: 8461187 - DNA, 22 bp, Homo sapiens
ttaggaaacgctgctattgact

SEQ ID NO: 8461188 - DNA, 22 bp, Homo sapiens
ttaggaaagaagcagctaggag

SEQ ID NO: 8461189 - DNA, 22 bp, Homo sapiens
ttaggaaagtctcttggctggg

SEQ ID NO: 8461190 - DNA, 22 bp, Homo sapiens
ttaggaaagtctcttggctggg

SEQ ID NO: 8461191 - DNA, 22 bp, Homo sapiens
ttaggaaaggaacattgaaacg

SEQ ID NO: 8461192 - DNA, 22 bp, Homo sapiens
ttatacagtttatacttagaat

SEQ ID NO: 8461193 - DNA, 22 bp, Homo sapiens
ttatacatgtttataaggttga

SEQ ID NO: 8461194 - DNA, 22 bp, Homo sapiens
ttaggaaacagtagcctttgct

SEQ ID NO: 8461195 - DNA, 22 bp, Homo sapiens
ttaggaaaatggagtcctttta

SEQ ID NO: 8461196 - DNA, 22 bp, Homo sapiens
ttaggaaaatgaaattacctgt

SEQ ID NO: 8461197 - DNA, 21 bp, Homo sapiens
ttagctttctagaatctttgt

SEQ ID NO: 8461198 - DNA, 22 bp, Homo sapiens
ttataggaaaagttctagaaaa

SEQ ID NO: 8461199 - DNA, 22 bp, Homo sapiens
ttatataactcaggtgggctca

SEQ ID NO: 8461200 - DNA, 22 bp, Homo sapiens
ttatataaagataacttttctt

SEQ ID NO: 8461201 - DNA, 22 bp, Homo sapiens
ttatataactcaggtgggctca

SEQ ID NO: 8461202 - DNA, 22 bp, Homo sapiens
ttatataaagataacttttctt

SEQ ID NO: 8461203 - DNA, 22 bp, Homo sapiens
ttatataaagataacttttctt

SEQ ID NO: 8461204 - DNA, 22 bp, Homo sapiens
ttatagaatccagttgttgtat

SEQ ID NO: 8461205 - DNA, 22 bp, Homo sapiens
ttatactttatactacatcatt

SEQ ID NO: 8461206 - DNA, 22 bp, Homo sapiens
ttatactaaaacgcattgaatt

SEQ ID NO: 8461207 - DNA, 22 bp, Homo sapiens
ttatagaaggagcattcactta

SEQ ID NO: 8461208 - DNA, 20 bp, Homo sapiens
ttcaaagaccctcaggtcca

SEQ ID NO: 8461209 - DNA, 22 bp, Homo sapiens
ttcacaatctggcttagcattg

SEQ ID NO: 8461210 - DNA, 23 bp, Homo sapiens
ttcaaagcttaagctctttccac

SEQ ID NO: 8461211 - DNA, 23 bp, Homo sapiens
ttcaaagatcttctgaaatctgt

SEQ ID NO: 8461212 - DNA, 22 bp, Homo sapiens
ttcaaagcagagggtcaataca

SEQ ID NO: 8461213 - DNA, 22 bp, Homo sapiens
ttcaaagcaagacacaattcct

SEQ ID NO: 8461214 - DNA, 21 bp, Homo sapiens
ttcacagatgggaaaactgag

SEQ ID NO: 8461215 - DNA, 22 bp, Homo sapiens
ttcacagagagtatgcagagaa

SEQ ID NO: 8461216 - DNA, 22 bp, Homo sapiens
ttcacagataacacaggcaaat

SEQ ID NO: 8461217 - DNA, 22 bp, Homo sapiens
ttcagtgtgaagcttctgaaag

SEQ ID NO: 8461218 - DNA, 22 bp, Homo sapiens
ttcagtgtgcctaagtcagttg

SEQ ID NO: 8461219 - DNA, 22 bp, Homo sapiens
ttcagtgtccctagtagaagtt

SEQ ID NO: 8461220 - DNA, 22 bp, Homo sapiens
ttcagagcttagaatggactac

SEQ ID NO: 8461221 - DNA, 22 bp, Homo sapiens
ttcagagcttagaatggactac

SEQ ID NO: 8461222 - DNA, 22 bp, Homo sapiens
ttcagagctggtgtctacagct

SEQ ID NO: 8461223 - DNA, 22 bp, Homo sapiens
ttcagagccagcaacactaggc

SEQ ID NO: 8461224 - DNA, 22 bp, Homo sapiens
ttcagagccagcaacactaggc

SEQ ID NO: 8461225 - DNA, 22 bp, Homo sapiens
ttcagagcccaaatggagatta

SEQ ID NO: 8461226 - DNA, 22 bp, Homo sapiens
ttcagagcagatattgaagggt

SEQ ID NO: 8461227 - DNA, 22 bp, Homo sapiens
ttcagagccagcaacactaggc

SEQ ID NO: 8461228 - DNA, 22 bp, Homo sapiens
ttcagagccacttcaagtctaa

SEQ ID NO: 8461229 - DNA, 22 bp, Homo sapiens
ttcagagcatctctaaagccag

SEQ ID NO: 8461230 - DNA, 22 bp, Homo sapiens
ttcagagccacttcaagtctaa

SEQ ID NO: 8461231 - DNA, 22 bp, Homo sapiens
ttcagagcccaaatggagatta

SEQ ID NO: 8461232 - DNA, 16 bp, Homo sapiens
ttcagagcggctcata

SEQ ID NO: 8461233 - DNA, 22 bp, Homo sapiens
ttcagagctcagaaaagtgtct

SEQ ID NO: 8461234 - DNA, 22 bp, Homo sapiens
ttcagagctcagaaaagtgtct

SEQ ID NO: 8461235 - DNA, 22 bp, Homo sapiens
ttcagagctggtgtctacagct

SEQ ID NO: 8461236 - DNA, 16 bp, Homo sapiens
ttcagagcggctcata

SEQ ID NO: 8461237 - DNA, 22 bp, Homo sapiens
ttcagagctggtgtctacagct

SEQ ID NO: 8461238 - DNA, 22 bp, Homo sapiens
ttcagagaacttcatggaagag

SEQ ID NO: 8461239 - DNA, 22 bp, Homo sapiens
ttcagagcagatattgaagggt

SEQ ID NO: 8461240 - DNA, 22 bp, Homo sapiens
ttcagagcagatattgaagggt

SEQ ID NO: 8461241 - DNA, 22 bp, Homo sapiens
ttcagagcatctctaaagccag

SEQ ID NO: 8461242 - DNA, 22 bp, Homo sapiens
ttcagagagtttgtgagtcctt

SEQ ID NO: 8461243 - DNA, 22 bp, Homo sapiens
ttcagagaagtgcacaaaatca

SEQ ID NO: 8461244 - DNA, 22 bp, Homo sapiens
ttcagagagaaaccagtgggaa

SEQ ID NO: 8461245 - DNA, 22 bp, Homo sapiens
ttccaggaagctctcggcctct

SEQ ID NO: 8461246 - DNA, 22 bp, Homo sapiens
ttccaggaagctctcggcctct

SEQ ID NO: 8461247 - DNA, 22 bp, Homo sapiens
ttccaggaagcagttagcagcc

SEQ ID NO: 8461248 - DNA, 22 bp, Homo sapiens
ttccaggaagacatctcaggaa

SEQ ID NO: 8461249 - DNA, 22 bp, Homo sapiens
ttccaggaacactctgtgtccc

SEQ ID NO: 8461250 - DNA, 22 bp, Homo sapiens
ttccagtctagtacctggatgc

SEQ ID NO: 8461251 - DNA, 22 bp, Homo sapiens
ttccagtgtgcttttatgttag

SEQ ID NO: 8461252 - DNA, 22 bp, Homo sapiens
ttccaggctcctgcagtttcta

SEQ ID NO: 8461253 - DNA, 22 bp, Homo sapiens
ttccaggctattccctttggag

SEQ ID NO: 8461254 - DNA, 19 bp, Homo sapiens
ttccaggtgctgtggggag

SEQ ID NO: 8461255 - DNA, 22 bp, Homo sapiens
ttcagttttgcttttaatcatg

SEQ ID NO: 8461256 - DNA, 22 bp, Homo sapiens
ttcagttttctttagaatgtag

SEQ ID NO: 8461257 - DNA, 22 bp, Homo sapiens
ttcagttttccctcctgcaggt

SEQ ID NO: 8461258 - DNA, 22 bp, Homo sapiens
ttcagttttccctcctgcaggt

SEQ ID NO: 8461259 - DNA, 22 bp, Homo sapiens
ttcagtttgtttgactgttaga

SEQ ID NO: 8461260 - DNA, 22 bp, Homo sapiens
ttcagtttgctacaagcaacat

SEQ ID NO: 8461261 - DNA, 22 bp, Homo sapiens
ttcagttccatttcaggtgggt

SEQ ID NO: 8461262 - DNA, 22 bp, Homo sapiens
ttcagtgtttgtagagataact

SEQ ID NO: 8461263 - DNA, 22 bp, Homo sapiens
ttcagtgttaaattcaaagagt

SEQ ID NO: 8461264 - DNA, 22 bp, Homo sapiens
ttcagtgttaatcttgggagaa

SEQ ID NO: 8461265 - DNA, 22 bp, Homo sapiens
ttcagtgttcttttctgttagc

SEQ ID NO: 8461266 - DNA, 22 bp, Homo sapiens
ttcagtgtggcccatgaagagg

SEQ ID NO: 8461267 - DNA, 22 bp, Homo sapiens
ttcagtgtggaatgtgaactgc

SEQ ID NO: 8461268 - DNA, 22 bp, Homo sapiens
ttcagtgtgcctaagtcagttg

SEQ ID NO: 8461269 - DNA, 22 bp, Homo sapiens
ttcagtgtgcttcaggacgtta

SEQ ID NO: 8461270 - DNA, 22 bp, Homo sapiens
ttcagtgtgcttcaggacgtta

SEQ ID NO: 8461271 - DNA, 22 bp, Homo sapiens
ttcagtgtggtgcacagttttg

SEQ ID NO: 8461272 - DNA, 22 bp, Homo sapiens
ttcagtgtgtgatacctgctgt

SEQ ID NO: 8461273 - DNA, 22 bp, Homo sapiens
ttcattgatttccttggaataa

SEQ ID NO: 8461274 - DNA, 22 bp, Homo sapiens
ttcattgatttccttggaataa

SEQ ID NO: 8461275 - DNA, 22 bp, Homo sapiens
ttcattgtactttaagagatgc

SEQ ID NO: 8461276 - DNA, 22 bp, Homo sapiens
ttcatttaatcagaatctctaa

SEQ ID NO: 8461277 - DNA, 22 bp, Homo sapiens
ttcatttagcatgctaaacctg

SEQ ID NO: 8461278 - DNA, 22 bp, Homo sapiens
ttcatttaatttgtgtattaac

SEQ ID NO: 8461279 - DNA, 23 bp, Homo sapiens
ttcatttaggagttcataagagc

SEQ ID NO: 8461280 - DNA, 23 bp, Homo sapiens
ttcatttaggagttcataagagc

SEQ ID NO: 8461281 - DNA, 22 bp, Homo sapiens
ttcatttattcagcaggtattt

SEQ ID NO: 8461282 - DNA, 20 bp, Homo sapiens
tttattcacagagaagagtt

SEQ ID NO: 8461283 - DNA, 20 bp, Homo sapiens
tttattcacagagaagagtt

SEQ ID NO: 8461284 - DNA, 22 bp, Homo sapiens
tttattcaagatgaggttcatg

SEQ ID NO: 8461285 - DNA, 20 bp, Homo sapiens
tttattcacagagaagagtt

SEQ ID NO: 8461286 - DNA, 22 bp, Homo sapiens
tttattctagctcagaatagtt

SEQ ID NO: 8461287 - DNA, 22 bp, Homo sapiens
tttattctataggcattaagca

SEQ ID NO: 8461288 - DNA, 22 bp, Homo sapiens
tttattctgtgctacatgaaga

SEQ ID NO: 8461289 - DNA, 22 bp, Homo sapiens
tttattgacttcagtgagtctt

SEQ ID NO: 8461290 - DNA, 22 bp, Homo sapiens
tttcaacagctctcaaatgatc

SEQ ID NO: 8461291 - DNA, 22 bp, Homo sapiens
tttcaacatcacctagcagttc

SEQ ID NO: 8461292 - DNA, 22 bp, Homo sapiens
tttcaagactcattgagtattg

SEQ ID NO: 8461293 - DNA, 20 bp, Homo sapiens
tttcacaatgaacatgtctc

SEQ ID NO: 8461294 - DNA, 22 bp, Homo sapiens
tttcacagagaaatataacagg

SEQ ID NO: 8461295 - DNA, 22 bp, Homo sapiens
tttccccaggtagatagataat

SEQ ID NO: 8461296 - DNA, 19 bp, Homo sapiens
tttcccagtcccaggagtg

SEQ ID NO: 8461297 - DNA, 19 bp, Homo sapiens
tttcccagtcccaggagtg

SEQ ID NO: 8461298 - DNA, 22 bp, Homo sapiens
tttcccagttagtgaagacatg

SEQ ID NO: 8461299 - DNA, 22 bp, Homo sapiens
tttcccaggctggaatgcagtg

SEQ ID NO: 8461300 - DNA, 22 bp, Homo sapiens
tttcccagcctcctttgcagct

SEQ ID NO: 8461301 - DNA, 22 bp, Homo sapiens
tttcccagcctcagctcagcag

SEQ ID NO: 8461302 - DNA, 19 bp, Homo sapiens
tttcccagcccttgctgtg

SEQ ID NO: 8461303 - DNA, 21 bp, Homo sapiens
tttcccagcagagatagctgg

SEQ ID NO: 8461304 - DNA, 19 bp, Homo sapiens
tttcccagcccttgctgtg

SEQ ID NO: 8461305 - DNA, 22 bp, Homo sapiens
tttcattgatgggtgatagaaa

SEQ ID NO: 8461306 - DNA, 22 bp, Homo sapiens
tttcattattcatgctagttat

SEQ ID NO: 8461307 - DNA, 22 bp, Homo sapiens
tttcattcattatacagtagag

SEQ ID NO: 8461308 - DNA, 22 bp, Homo sapiens
tttcatggctaggactagagtg

SEQ ID NO: 8461309 - DNA, 22 bp, Homo sapiens
tttcatgcctcttgagaaagat

SEQ ID NO: 8461310 - DNA, 22 bp, Homo sapiens
tttcatgcacaaatgagcaagg

SEQ ID NO: 8461311 - DNA, 22 bp, Homo sapiens
tttcatgaggctgcataaggag

SEQ ID NO: 8461312 - DNA, 22 bp, Homo sapiens
tttcattatacagcttcataaa

SEQ ID NO: 8461313 - DNA, 22 bp, Homo sapiens
tttcatgttacagtgtaaaagt

SEQ ID NO: 8461314 - DNA, 22 bp, Homo sapiens
tttcatgtggcgatgtctctgg

SEQ ID NO: 8461315 - DNA, 22 bp, Homo sapiens
tttcatgtcattccatttcaga

SEQ ID NO: 8461316 - DNA, 22 bp, Homo sapiens
tttcatgtacttttttgataga

SEQ ID NO: 8461317 - DNA, 22 bp, Homo sapiens
tttcatgtaatcatttaggtgg

SEQ ID NO: 8461318 - DNA, 22 bp, Homo sapiens
tttcagaaatcaaaaccagggt

SEQ ID NO: 8461319 - DNA, 22 bp, Homo sapiens
tttcagaaagctgaacatatga

SEQ ID NO: 8461320 - DNA, 22 bp, Homo sapiens
tttcagacaggacttcatatgt

SEQ ID NO: 8461321 - DNA, 22 bp, Homo sapiens
tttcagaaatggcactgaaatc

SEQ ID NO: 8461322 - DNA, 22 bp, Homo sapiens
tttcagaaagcatcatcaaagt

SEQ ID NO: 8461323 - DNA, 22 bp, Homo sapiens
tttcagaaacgattatgaacac

SEQ ID NO: 8461324 - DNA, 22 bp, Homo sapiens
tttcagaaacgattatgaacac

SEQ ID NO: 8461325 - DNA, 22 bp, Homo sapiens
tttcagaaacgattatgaacac

SEQ ID NO: 8461326 - DNA, 22 bp, Homo sapiens
tttcagaaaacttatcatcagt

SEQ ID NO: 8461327 - DNA, 21 bp, Homo sapiens
tttcagacctatctttgaagg

SEQ ID NO: 8461328 - DNA, 22 bp, Homo sapiens
tttcagagaaagcccaaagact

SEQ ID NO: 8461329 - DNA, 22 bp, Homo sapiens
tttcagactgctgtgtgaaact

SEQ ID NO: 8461330 - DNA, 22 bp, Homo sapiens
tttcagactccaaattcataag

SEQ ID NO: 8461331 - DNA, 22 bp, Homo sapiens
tttcactggaattttaacattt

SEQ ID NO: 8461332 - DNA, 20 bp, Homo sapiens
tttcaccatcttggccaggc

SEQ ID NO: 8461333 - DNA, 22 bp, Homo sapiens
tttcacagatgttttggagtct

SEQ ID NO: 8461334 - DNA, 22 bp, Homo sapiens
tttcacagctagtgagcttcta

SEQ ID NO: 8461335 - DNA, 22 bp, Homo sapiens
tttagagcagggtgtggcacat

SEQ ID NO: 8461336 - DNA, 22 bp, Homo sapiens
tttagagagtgtaaaaatatat

SEQ ID NO: 8461337 - DNA, 22 bp, Homo sapiens
tttagagagtgtaaaaatatat

SEQ ID NO: 8461338 - DNA, 22 bp, Homo sapiens
tttagagctgtgctgccacatg

SEQ ID NO: 8461339 - DNA, 22 bp, Homo sapiens
tttagagcccatgtgagtgtga

SEQ ID NO: 8461340 - DNA, 22 bp, Homo sapiens
tttagagaggctctgtaaaatg

SEQ ID NO: 8461341 - DNA, 17 bp, Homo sapiens
tttagaatacaatgttt

SEQ ID NO: 8461342 - DNA, 22 bp, Homo sapiens
tttagcaagatgccctggcttt

SEQ ID NO: 8461343 - DNA, 22 bp, Homo sapiens
tttacagtgtcttgttgactgt

SEQ ID NO: 8461344 - DNA, 22 bp, Homo sapiens
tttacagtgagagcttagtgag

SEQ ID NO: 8461345 - DNA, 22 bp, Homo sapiens
tttacagtgagagcttagtgag

SEQ ID NO: 8461346 - DNA, 22 bp, Homo sapiens
tttacagtgagagcttagtgag

SEQ ID NO: 8461347 - DNA, 20 bp, Homo sapiens
tttacattttgaaacagtga

SEQ ID NO: 8461348 - DNA, 22 bp, Homo sapiens
tttaccaaatagattatgtcag

SEQ ID NO: 8461349 - DNA, 20 bp, Homo sapiens
tttacattttgaaacagtga

SEQ ID NO: 8461350 - DNA, 20 bp, Homo sapiens
tttacattttgaaacagtga

SEQ ID NO: 8461351 - DNA, 20 bp, Homo sapiens
tttacattttgaaacagtga

SEQ ID NO: 8461352 - DNA, 23 bp, Homo sapiens
tttaccagaatagcaggggagag

SEQ ID NO: 8461353 - DNA, 22 bp, Homo sapiens
tttagaagacagatgcacagcc

SEQ ID NO: 8461354 - DNA, 22 bp, Homo sapiens
tttagaagttcacacatttaaa

SEQ ID NO: 8461355 - DNA, 22 bp, Homo sapiens
tttagaagttcacacatttaaa

SEQ ID NO: 8461356 - DNA, 19 bp, Homo sapiens
tttagaagttgaaactctg

SEQ ID NO: 8461357 - DNA, 22 bp, Homo sapiens
tttaccacagaaaaaagtaact

SEQ ID NO: 8461358 - DNA, 22 bp, Homo sapiens
tttaccacaattttaaacaatg

SEQ ID NO: 8461359 - DNA, 22 bp, Homo sapiens
tttatcagaagttagagaaaga

SEQ ID NO: 8461360 - DNA, 21 bp, Homo sapiens
tttatcatcacgagcttgagc

SEQ ID NO: 8461361 - DNA, 22 bp, Homo sapiens
tttatcatcttgtttttaaagc

SEQ ID NO: 8461362 - DNA, 22 bp, Homo sapiens
tttatctgacctcacttcttaa

SEQ ID NO: 8461363 - DNA, 22 bp, Homo sapiens
tttatctgaaaaaactcttgga

SEQ ID NO: 8461364 - DNA, 22 bp, Homo sapiens
tttatattgggagtcgttttga

SEQ ID NO: 8461365 - DNA, 22 bp, Homo sapiens
tttatattgggagtcgttttga

SEQ ID NO: 8461366 - DNA, 22 bp, Homo sapiens
tttatattgtaaaaatggttct

SEQ ID NO: 8461367 - DNA, 22 bp, Homo sapiens
tttatattgtaaaaatggttct

SEQ ID NO: 8461368 - DNA, 22 bp, Homo sapiens
tttatatttcccaggattggcc

SEQ ID NO: 8461369 - DNA, 22 bp, Homo sapiens
tttatatttcccaggattggcc

SEQ ID NO: 8461370 - DNA, 22 bp, Homo sapiens
tttatatttcccaggattggcc

SEQ ID NO: 8461371 - DNA, 23 bp, Homo sapiens
tttatattcctaatgtcttgagc

SEQ ID NO: 8461372 - DNA, 22 bp, Homo sapiens
tttatatagagatttgtgcatg

SEQ ID NO: 8461373 - DNA, 22 bp, Homo sapiens
tttagcatatttaaggaatgat

SEQ ID NO: 8461374 - DNA, 22 bp, Homo sapiens
tttagcatcgaagtaaatttag

SEQ ID NO: 8461375 - DNA, 22 bp, Homo sapiens
tttagcagcaaataagtagtgc

SEQ ID NO: 8461376 - DNA, 22 bp, Homo sapiens
tttacagtccccaggtgaggat

SEQ ID NO: 8461377 - DNA, 22 bp, Homo sapiens
tttacagtcaccaaactttgct

SEQ ID NO: 8461378 - DNA, 22 bp, Homo sapiens
tttacagtatagtaggactcat

SEQ ID NO: 8461379 - DNA, 22 bp, Homo sapiens
tttacagtaaggtggatggtac

SEQ ID NO: 8461380 - DNA, 22 bp, Homo sapiens
tttacagtaaggtggatggtac

SEQ ID NO: 8461381 - DNA, 22 bp, Homo sapiens
tttacagtaaggtggatggtac

SEQ ID NO: 8461382 - DNA, 22 bp, Homo sapiens
tttacagtctctatagtcaaaa

SEQ ID NO: 8461383 - DNA, 22 bp, Homo sapiens
tttacagtctatgttgaattaa

SEQ ID NO: 8461384 - DNA, 22 bp, Homo sapiens
tttacagtctatgttgaattaa

SEQ ID NO: 8461385 - DNA, 22 bp, Homo sapiens
tttacagtctatgttgaattaa

SEQ ID NO: 8461386 - DNA, 22 bp, Homo sapiens
tttacagtctgtctagcaatgt

SEQ ID NO: 8461387 - DNA, 22 bp, Homo sapiens
tttacagtctgtctagcaatgt

SEQ ID NO: 8461388 - DNA, 22 bp, Homo sapiens
tttacagtctctatagtcaaaa

SEQ ID NO: 8461389 - DNA, 22 bp, Homo sapiens
tttaatgtagcgtgaaatgatt

SEQ ID NO: 8461390 - DNA, 22 bp, Homo sapiens
tttaatgtattctttggaacca

SEQ ID NO: 8461391 - DNA, 22 bp, Homo sapiens
tttaatgtgacatcttttagag

SEQ ID NO: 8461392 - DNA, 22 bp, Homo sapiens
tttaatgtgagtccctttcaag

SEQ ID NO: 8461393 - DNA, 22 bp, Homo sapiens
tttaatgtgacatcttttagag

SEQ ID NO: 8461394 - DNA, 19 bp, Homo sapiens
tttacagggaatggagacc

SEQ ID NO: 8461395 - DNA, 22 bp, Homo sapiens
tttaagctgtggcattaattct

SEQ ID NO: 8461396 - DNA, 22 bp, Homo sapiens
tttaagctaatgtcataattag

SEQ ID NO: 8461397 - DNA, 22 bp, Homo sapiens
tttaaatgtttatagagagtac

SEQ ID NO: 8461398 - DNA, 22 bp, Homo sapiens
tttaaatgtgttcttagtagct

SEQ ID NO: 8461399 - DNA, 22 bp, Homo sapiens
tttaaatgtgttcttagtagct

SEQ ID NO: 8461400 - DNA, 22 bp, Homo sapiens
tttaaatgtgttcttagtagct

SEQ ID NO: 8461401 - DNA, 22 bp, Homo sapiens
tttaaataggactcctgggggt

SEQ ID NO: 8461402 - DNA, 22 bp, Homo sapiens
tttaaagtttttgcacattctg

SEQ ID NO: 8461403 - DNA, 22 bp, Homo sapiens
tttaaagtgctgctcctatcct

SEQ ID NO: 8461404 - DNA, 19 bp, Homo sapiens
tttaaagtgactggtattt

SEQ ID NO: 8461405 - DNA, 22 bp, Homo sapiens
tttaaatgcagacgttgattca

SEQ ID NO: 8461406 - DNA, 22 bp, Homo sapiens
tttaaatgcagacgttgattca

SEQ ID NO: 8461407 - DNA, 22 bp, Homo sapiens
tttaaacatatctgttgaggga

SEQ ID NO: 8461408 - DNA, 22 bp, Homo sapiens
ttgtgtgtagactcagccattg

SEQ ID NO: 8461409 - DNA, 22 bp, Homo sapiens
ttgtgtggtagcttcattgaac

SEQ ID NO: 8461410 - DNA, 22 bp, Homo sapiens
ttgtgtggataatattacttga

SEQ ID NO: 8461411 - DNA, 22 bp, Homo sapiens
tttaaagaaattcctcatcttt

SEQ ID NO: 8461412 - DNA, 22 bp, Homo sapiens
tttaaaggccttgctgagccac

SEQ ID NO: 8461413 - DNA, 17 bp, Homo sapiens
tttaaactactacaagg

SEQ ID NO: 8461414 - DNA, 17 bp, Homo sapiens
tttaaactactacaagg

SEQ ID NO: 8461415 - DNA, 22 bp, Homo sapiens
ttggaaatacagcagttacttt

SEQ ID NO: 8461416 - DNA, 22 bp, Homo sapiens
ttggaaatacgagtagtatcat

SEQ ID NO: 8461417 - DNA, 22 bp, Homo sapiens
ttggaaatacagcagttacttt

SEQ ID NO: 8461418 - DNA, 22 bp, Homo sapiens
ttggaaatgcaaatatattgaa

SEQ ID NO: 8461419 - DNA, 22 bp, Homo sapiens
ttggaaatgatttctattatta

SEQ ID NO: 8461420 - DNA, 22 bp, Homo sapiens
ttggaaatggctgtagttatga

SEQ ID NO: 8461421 - DNA, 22 bp, Homo sapiens
ttggaacaatcacatccttgct

SEQ ID NO: 8461422 - DNA, 22 bp, Homo sapiens
ttggaaattgcaagtgatttgc

SEQ ID NO: 8461423 - DNA, 21 bp, Homo sapiens
ttggaatttgggagctatgtg

SEQ ID NO: 8461424 - DNA, 22 bp, Homo sapiens
ttggaattgtgaactaagtgat

SEQ ID NO: 8461425 - DNA, 22 bp, Homo sapiens
ttggaattgaggatttacatag

SEQ ID NO: 8461426 - DNA, 22 bp, Homo sapiens
ttggaacacagcagctgatttt

SEQ ID NO: 8461427 - DNA, 22 bp, Homo sapiens
ttggaattcctgttgtttcgtc

SEQ ID NO: 8461428 - DNA, 22 bp, Homo sapiens
ttggaaaatgtatttctagaag

SEQ ID NO: 8461429 - DNA, 22 bp, Homo sapiens
ttggaaaatgaggcacagagag

SEQ ID NO: 8461430 - DNA, 22 bp, Homo sapiens
ttggaaaccaggctttgagacg

SEQ ID NO: 8461431 - DNA, 22 bp, Homo sapiens
ttggaaaatgtatttctagaag

SEQ ID NO: 8461432 - DNA, 22 bp, Homo sapiens
ttgcttatttgattaaatgtct

SEQ ID NO: 8461433 - DNA, 22 bp, Homo sapiens
ttgctttatttggcatgccact

SEQ ID NO: 8461434 - DNA, 22 bp, Homo sapiens
ttggaaactttcaagcataatg

SEQ ID NO: 8461435 - DNA, 22 bp, Homo sapiens
ttggaaagaccgaattcctgtt

SEQ ID NO: 8461436 - DNA, 22 bp, Homo sapiens
ttggaaagaagggctgagcaag

SEQ ID NO: 8461437 - DNA, 22 bp, Homo sapiens
ttggaaagtctcacccagttga

SEQ ID NO: 8461438 - DNA, 22 bp, Homo sapiens
ttggaaaggagattctattgtg

SEQ ID NO: 8461439 - DNA, 22 bp, Homo sapiens
ttgcattgtaggatgttagaag

SEQ ID NO: 8461440 - DNA, 21 bp, Homo sapiens
ttgcattcctgttagtataag

SEQ ID NO: 8461441 - DNA, 22 bp, Homo sapiens
ttgcattcccagccaagttagt

SEQ ID NO: 8461442 - DNA, 22 bp, Homo sapiens
ttgcattccatggttttccttc

SEQ ID NO: 8461443 - DNA, 22 bp, Homo sapiens
ttgcattacatttgctcagtct

SEQ ID NO: 8461444 - DNA, 22 bp, Homo sapiens
ttgctctgaaccacaccatcac

SEQ ID NO: 8461445 - DNA, 22 bp, Homo sapiens
ttgctctccagaggctcacagc

SEQ ID NO: 8461446 - DNA, 22 bp, Homo sapiens
ttgctcatttgcctttaggttt

SEQ ID NO: 8461447 - DNA, 22 bp, Homo sapiens
ttgctcatatttgcatgtgttt

SEQ ID NO: 8461448 - DNA, 22 bp, Homo sapiens
ttgctctgcagtccagacagta

SEQ ID NO: 8461449 - DNA, 22 bp, Homo sapiens
ttgctcttgaaaattgatgctg

SEQ ID NO: 8461450 - DNA, 22 bp, Homo sapiens
ttgctctgtccagccagcaggt

SEQ ID NO: 8461451 - DNA, 22 bp, Homo sapiens
ttgcttagagccaatcttgatt

SEQ ID NO: 8461452 - DNA, 22 bp, Homo sapiens
ttgcttatttgattaaatgtct

SEQ ID NO: 8461453 - DNA, 21 bp, Homo sapiens
ttgctgttttcccaatgcagt

SEQ ID NO: 8461454 - DNA, 22 bp, Homo sapiens
ttgctgttacaattatttaccc

SEQ ID NO: 8461455 - DNA, 22 bp, Homo sapiens
ttgcagggtcccagaggcctgg

SEQ ID NO: 8461456 - DNA, 22 bp, Homo sapiens
ttgcagggtacattcttagaat

SEQ ID NO: 8461457 - DNA, 22 bp, Homo sapiens
ttgcagggtcctgtggctctcc

SEQ ID NO: 8461458 - DNA, 22 bp, Homo sapiens
ttgcagggtcctgtggctctcc

SEQ ID NO: 8461459 - DNA, 22 bp, Homo sapiens
ttgcaggggagaggaacaaaca

SEQ ID NO: 8461460 - DNA, 22 bp, Homo sapiens
ttgcaggggagaggaacaaaca

SEQ ID NO: 8461461 - DNA, 22 bp, Homo sapiens
ttgcaggggaaggagcagagct

SEQ ID NO: 8461462 - DNA, 22 bp, Homo sapiens
ttgcagggcatctatgtctggt

SEQ ID NO: 8461463 - DNA, 22 bp, Homo sapiens
ttgcagggcatcgcgtacttct

SEQ ID NO: 8461464 - DNA, 22 bp, Homo sapiens
ttgcagggcaggaccatggaca

SEQ ID NO: 8461465 - DNA, 22 bp, Homo sapiens
ttgcagggcaggaccatggaca

SEQ ID NO: 8461466 - DNA, 22 bp, Homo sapiens
ttgcaggggaaggagcagagct

SEQ ID NO: 8461467 - DNA, 22 bp, Homo sapiens
ttgcagggcttggggattacag

SEQ ID NO: 8461468 - DNA, 22 bp, Homo sapiens
ttgcagggctggaacatggaat

SEQ ID NO: 8461469 - DNA, 22 bp, Homo sapiens
ttgcagggctggaacatggaat

SEQ ID NO: 8461470 - DNA, 22 bp, Homo sapiens
ttgcagggccttggcttcttcc

SEQ ID NO: 8461471 - DNA, 22 bp, Homo sapiens
ttgcagggttaaagtaaggtag

SEQ ID NO: 8461472 - DNA, 22 bp, Homo sapiens
ttgcagggttgacactgcctgc

SEQ ID NO: 8461473 - DNA, 22 bp, Homo sapiens
ttgcagggttgacactgcctgc

SEQ ID NO: 8461474 - DNA, 22 bp, Homo sapiens
ttgcagggttgaccaataggct

SEQ ID NO: 8461475 - DNA, 22 bp, Homo sapiens
ttgcagggttgaccaataggct

SEQ ID NO: 8461476 - DNA, 22 bp, Homo sapiens
ttgcatggaggaacatggccca

SEQ ID NO: 8461477 - DNA, 22 bp, Homo sapiens
ttgcatgtacgtacagagagag

SEQ ID NO: 8461478 - DNA, 22 bp, Homo sapiens
ttgcagctgcagtaaatgttca

SEQ ID NO: 8461479 - DNA, 22 bp, Homo sapiens
ttgcagctgtgagctttacacg

SEQ ID NO: 8461480 - DNA, 22 bp, Homo sapiens
ttgcagctgttgcaaagtctct

SEQ ID NO: 8461481 - DNA, 22 bp, Homo sapiens
ttgcagcttagtgatgttatct

SEQ ID NO: 8461482 - DNA, 22 bp, Homo sapiens
ttgcagcttcaagcaggttgac

SEQ ID NO: 8461483 - DNA, 22 bp, Homo sapiens
ttgcagctgaggaaattgaagc

SEQ ID NO: 8461484 - DNA, 22 bp, Homo sapiens
ttgcagctctgatccagggacc

SEQ ID NO: 8461485 - DNA, 22 bp, Homo sapiens
ttgcagggcaaatggtcagata

SEQ ID NO: 8461486 - DNA, 22 bp, Homo sapiens
ttgcagggcaaatggtcagata

SEQ ID NO: 8461487 - DNA, 22 bp, Homo sapiens
ttgcagggattaccttattttt

SEQ ID NO: 8461488 - DNA, 23 bp, Homo sapiens
ttgcagggatggagttcaaaatg

SEQ ID NO: 8461489 - DNA, 22 bp, Homo sapiens
ttgcagggaaatcagtgaggat

SEQ ID NO: 8461490 - DNA, 22 bp, Homo sapiens
ttgcagggacctgcagaaagct

SEQ ID NO: 8461491 - DNA, 22 bp, Homo sapiens
ttgcagggacctgcagaaagct

SEQ ID NO: 8461492 - DNA, 22 bp, Homo sapiens
ttgcagggataaaacaagtgaa

SEQ ID NO: 8461493 - DNA, 22 bp, Homo sapiens
ttgcagggataaaacaagtgaa

SEQ ID NO: 8461494 - DNA, 22 bp, Homo sapiens
ttgcagcttctaccactgtttc

SEQ ID NO: 8461495 - DNA, 22 bp, Homo sapiens
ttgcagcttcttgcatcagaaa

SEQ ID NO: 8461496 - DNA, 22 bp, Homo sapiens
ttgcagggaaatagaaataaac

SEQ ID NO: 8461497 - DNA, 22 bp, Homo sapiens
ttgcagggaaacagtttaggaa

SEQ ID NO: 8461498 - DNA, 22 bp, Homo sapiens
ttgacaagtggagatatttaag

SEQ ID NO: 8461499 - DNA, 22 bp, Homo sapiens
ttgacaagtggagatatttaag

SEQ ID NO: 8461500 - DNA, 22 bp, Homo sapiens
ttgacaagtggagatatttaag

SEQ ID NO: 8461501 - DNA, 22 bp, Homo sapiens
ttgacacagatcaatattcaac

SEQ ID NO: 8461502 - DNA, 22 bp, Homo sapiens
ttgacaaaaacctcatttcacc

SEQ ID NO: 8461503 - DNA, 22 bp, Homo sapiens
ttgacagggccaagaatggacc

SEQ ID NO: 8461504 - DNA, 22 bp, Homo sapiens
ttgcaattagttacaaaagtgg

SEQ ID NO: 8461505 - DNA, 22 bp, Homo sapiens
ttgacaggaaaaagtttaggat

SEQ ID NO: 8461506 - DNA, 21 bp, Homo sapiens
ttgacaggaaagaggggagat

SEQ ID NO: 8461507 - DNA, 22 bp, Homo sapiens
ttgacaggagccaaaataggat

SEQ ID NO: 8461508 - DNA, 22 bp, Homo sapiens
ttgcaattgctatggagagcgt

SEQ ID NO: 8461509 - DNA, 22 bp, Homo sapiens
ttgcaattgctatggagagcgt

SEQ ID NO: 8461510 - DNA, 22 bp, Homo sapiens
ttgacagctacggagcagctgt

SEQ ID NO: 8461511 - DNA, 22 bp, Homo sapiens
ttgcagaacttaaagacagagt

SEQ ID NO: 8461512 - DNA, 21 bp, Homo sapiens
ttgcacagaaaaccatagaga

SEQ ID NO: 8461513 - DNA, 22 bp, Homo sapiens
ttgcagacattccagagctttt

SEQ ID NO: 8461514 - DNA, 22 bp, Homo sapiens
ttgtaaatagtagtaagatgcc

SEQ ID NO: 8461515 - DNA, 20 bp, Homo sapiens
ttgggcctgtcagcactccc

SEQ ID NO: 8461516 - DNA, 22 bp, Homo sapiens
ttgggcctctcaaagtgctggg

SEQ ID NO: 8461517 - DNA, 22 bp, Homo sapiens
ttgggcctggggtagtgtcgga

SEQ ID NO: 8461518 - DNA, 22 bp, Homo sapiens
ttgtaacaggtactaaataact

SEQ ID NO: 8461519 - DNA, 22 bp, Homo sapiens
ttgtacagaaaaaattcttggt

SEQ ID NO: 8461520 - DNA, 22 bp, Homo sapiens
ttgtacagaaactgcatttgga

SEQ ID NO: 8461521 - DNA, 22 bp, Homo sapiens
ttgtacagaccctgaaaagctc

SEQ ID NO: 8461522 - DNA, 22 bp, Homo sapiens
ttgtacagattttcctcggtct

SEQ ID NO: 8461523 - DNA, 19 bp, Homo sapiens
ttgtacagcaaccaaccct

SEQ ID NO: 8461524 - DNA, 22 bp, Homo sapiens
ttgtacagggaagtaatacaag

SEQ ID NO: 8461525 - DNA, 23 bp, Homo sapiens
ttgtacagcccagattcctcttc

SEQ ID NO: 8461526 - DNA, 22 bp, Homo sapiens
ttgtacagtttaagtgggtgaa

SEQ ID NO: 8461527 - DNA, 22 bp, Homo sapiens
ttgtacagggaagtaatacaag

SEQ ID NO: 8461528 - DNA, 22 bp, Homo sapiens
ttgtacaggttcctagggtgga

SEQ ID NO: 8461529 - DNA, 22 bp, Homo sapiens
ttgtacattctgaatctgtcct

SEQ ID NO: 8461530 - DNA, 22 bp, Homo sapiens
ttgtattttttcctggcggtgg

SEQ ID NO: 8461531 - DNA, 22 bp, Homo sapiens
ttgtatttctccactttctgtt

SEQ ID NO: 8461532 - DNA, 22 bp, Homo sapiens
ttgtatttcgatgcacgtgtag

SEQ ID NO: 8461533 - DNA, 22 bp, Homo sapiens
ttgtgtccctgtaagacaaagc

SEQ ID NO: 8461534 - DNA, 22 bp, Homo sapiens
ttgtgtcctgatttgacacaat

SEQ ID NO: 8461535 - DNA, 22 bp, Homo sapiens
ttgtggcatgtgagaactagaa

SEQ ID NO: 8461536 - DNA, 22 bp, Homo sapiens
ttgtcctgtttagggataagga

SEQ ID NO: 8461537 - DNA, 22 bp, Homo sapiens
ttgtcattggggttatttgtta

SEQ ID NO: 8461538 - DNA, 22 bp, Homo sapiens
ttgtcaagtaaggctgacattt

SEQ ID NO: 8461539 - DNA, 22 bp, Homo sapiens
ttgtcaaggcttttaatattct

SEQ ID NO: 8461540 - DNA, 22 bp, Homo sapiens
ttgtcaagattgagagatgact

SEQ ID NO: 8461541 - DNA, 22 bp, Homo sapiens
ttgtcaagaaaaatggatgaag

SEQ ID NO: 8461542 - DNA, 22 bp, Homo sapiens
ttgtccagcgaccaggctctgt

SEQ ID NO: 8461543 - DNA, 22 bp, Homo sapiens
ttgtccagagccaggctgtcgg

SEQ ID NO: 8461544 - DNA, 22 bp, Homo sapiens
ttgtccgtggtgagttcgcatt

SEQ ID NO: 8461545 - DNA, 22 bp, Homo sapiens
ttggaggaaattgcttttgtgg

SEQ ID NO: 8461546 - DNA, 22 bp, Homo sapiens
ttggcagggcatcagacacgtg

SEQ ID NO: 8461547 - DNA, 22 bp, Homo sapiens
ttggcagtagtggtagtacatt

SEQ ID NO: 8461548 - DNA, 22 bp, Homo sapiens
ttggagaatgttttcctgcagt

SEQ ID NO: 8461549 - DNA, 22 bp, Homo sapiens
ttggagagaggctgctcaggct

SEQ ID NO: 8461550 - DNA, 18 bp, Homo sapiens
ttggacctgtgtcagggc

SEQ ID NO: 8461551 - DNA, 22 bp, Homo sapiens
ttggagccctgaggatctggat

SEQ ID NO: 8461552 - DNA, 22 bp, Homo sapiens
ttggagagatttaggtctcagt

SEQ ID NO: 8461553 - DNA, 22 bp, Homo sapiens
ttggagagttaattgacagtta

SEQ ID NO: 8461554 - DNA, 23 bp, Homo sapiens
ttggagagggtgagtagtgtcag

SEQ ID NO: 8461555 - DNA, 22 bp, Homo sapiens
ttgggagctggaagcaaggcct

SEQ ID NO: 8461556 - DNA, 22 bp, Homo sapiens
ttgggagatattgttctttaca

SEQ ID NO: 8461557 - DNA, 22 bp, Homo sapiens
ttggccatctaagcccagccac

SEQ ID NO: 8461558 - DNA, 22 bp, Homo sapiens
ttggccagtggaaagaggagga

SEQ ID NO: 8461559 - DNA, 22 bp, Homo sapiens
ttggccagtggaaagaggagga

SEQ ID NO: 8461560 - DNA, 22 bp, Homo sapiens
ttggccagtgcttgtgattttc

SEQ ID NO: 8461561 - DNA, 22 bp, Homo sapiens
ttggccagcagctctggcttag

SEQ ID NO: 8461562 - DNA, 22 bp, Homo sapiens
ttgggacagcaaccatctgcta

SEQ ID NO: 8461563 - DNA, 22 bp, Homo sapiens
ttgggaagaggcccctggattc

SEQ ID NO: 8461564 - DNA, 22 bp, Homo sapiens
ttgggaaggcgtggaagcagaa

SEQ ID NO: 8461565 - DNA, 22 bp, Homo sapiens
ttgggaagtaatatggtggtct

SEQ ID NO: 8461566 - DNA, 22 bp, Homo sapiens
ttggcccactctcagaatgtgg

SEQ ID NO: 8461567 - DNA, 22 bp, Homo sapiens
ttggcccacagtaccatgctgt

SEQ ID NO: 8461568 - DNA, 22 bp, Homo sapiens
ttggccatctaagcccagccac

SEQ ID NO: 8461569 - DNA, 22 bp, Homo sapiens
tttctttgttgttatcacatca

SEQ ID NO: 8461570 - DNA, 22 bp, Homo sapiens
tttcttttacagtgtggctatt

SEQ ID NO: 8461571 - DNA, 21 bp, Homo sapiens
tttctttctggctctcacagt

SEQ ID NO: 8461572 - DNA, 22 bp, Homo sapiens
tttcctctccggggcctccagg

SEQ ID NO: 8461573 - DNA, 18 bp, Homo sapiens
tttctttctgcctggggc

SEQ ID NO: 8461574 - DNA, 21 bp, Homo sapiens
tttctttctggctctcacagt

SEQ ID NO: 8461575 - DNA, 22 bp, Homo sapiens
tttctttgagtctcagtttgct

SEQ ID NO: 8461576 - DNA, 22 bp, Homo sapiens
tttcttttgaatagtgtgtggt

SEQ ID NO: 8461577 - DNA, 22 bp, Homo sapiens
tttcttttgaatagtgtgtggt

SEQ ID NO: 8461578 - DNA, 22 bp, Homo sapiens
tttcttttccaatatccctact

SEQ ID NO: 8461579 - DNA, 22 bp, Homo sapiens
tttcttttgccctgtgggttag

SEQ ID NO: 8461580 - DNA, 22 bp, Homo sapiens
tttcctctaaacgcatttgctt

SEQ ID NO: 8461581 - DNA, 22 bp, Homo sapiens
tttcctcacttcatgagagttt

SEQ ID NO: 8461582 - DNA, 22 bp, Homo sapiens
tttcctcagaagtgtctactat

SEQ ID NO: 8461583 - DNA, 22 bp, Homo sapiens
tttcctcatttatctgctggga

SEQ ID NO: 8461584 - DNA, 22 bp, Homo sapiens
tttcctctgagtgagctgggag

SEQ ID NO: 8461585 - DNA, 22 bp, Homo sapiens
tttcccttctttcctgagtaat

SEQ ID NO: 8461586 - DNA, 22 bp, Homo sapiens
tttgaaaggaattaggatgaca

SEQ ID NO: 8461587 - DNA, 21 bp, Homo sapiens
tttgaaagctacatctatagc

SEQ ID NO: 8461588 - DNA, 22 bp, Homo sapiens
tttgaaaaaggcctttggtatg

SEQ ID NO: 8461589 - DNA, 22 bp, Homo sapiens
tttgaatatacttcaaacaaag

SEQ ID NO: 8461590 - DNA, 22 bp, Homo sapiens
tttgaagcaccaaaggagaaaa

SEQ ID NO: 8461591 - DNA, 22 bp, Homo sapiens
tttgaagataaatatggagaaa

SEQ ID NO: 8461592 - DNA, 22 bp, Homo sapiens
tttgaaaggtgtcgagatgtgt

SEQ ID NO: 8461593 - DNA, 22 bp, Homo sapiens
tttgaaagggttatgagactga

SEQ ID NO: 8461594 - DNA, 22 bp, Homo sapiens
tttggaaagtgtgatttcaagg

SEQ ID NO: 8461595 - DNA, 22 bp, Homo sapiens
tttggaaagttgtcactttaga

SEQ ID NO: 8461596 - DNA, 22 bp, Homo sapiens
tttggaaatacgcgtaggcaga

SEQ ID NO: 8461597 - DNA, 22 bp, Homo sapiens
tttgcttttgtgctctagtggt

SEQ ID NO: 8461598 - DNA, 22 bp, Homo sapiens
tttgctttgtttaaaagtggta

SEQ ID NO: 8461599 - DNA, 22 bp, Homo sapiens
tttgctttgtttaaaagtggta

SEQ ID NO: 8461600 - DNA, 22 bp, Homo sapiens
tttggaaactgcctcagctctt

SEQ ID NO: 8461601 - DNA, 17 bp, Homo sapiens
tttggtaatatattaag

SEQ ID NO: 8461602 - DNA, 22 bp, Homo sapiens
tttggtcaaatattatcctgag

SEQ ID NO: 8461603 - DNA, 22 bp, Homo sapiens
tttggtaagtacccacctgggt

SEQ ID NO: 8461604 - DNA, 22 bp, Homo sapiens
tttggtcagggtaggacagttg

SEQ ID NO: 8461605 - DNA, 22 bp, Homo sapiens
tttgtaaaagcccaagctgtag

SEQ ID NO: 8461606 - DNA, 22 bp, Homo sapiens
tttggtttttacctgctgagag

SEQ ID NO: 8461607 - DNA, 22 bp, Homo sapiens
tttggtgagctgcgagtgagga

SEQ ID NO: 8461608 - DNA, 22 bp, Homo sapiens
tttggtgagctgcgagtgagga

SEQ ID NO: 8461609 - DNA, 22 bp, Homo sapiens
tttggttaatttaggcttgcat

SEQ ID NO: 8461610 - DNA, 22 bp, Homo sapiens
tttggtttagggtcatttaaca

SEQ ID NO: 8461611 - DNA, 22 bp, Homo sapiens
tttgaggttagctagcagatca

SEQ ID NO: 8461612 - DNA, 22 bp, Homo sapiens
tttgagtagtgagactaggcag

SEQ ID NO: 8461613 - DNA, 19 bp, Homo sapiens
tttgatagggcataatata

SEQ ID NO: 8461614 - DNA, 22 bp, Homo sapiens
tttgatatcctatacaagtaaa

SEQ ID NO: 8461615 - DNA, 17 bp, Homo sapiens
tttgatagaatcagagt

SEQ ID NO: 8461616 - DNA, 17 bp, Homo sapiens
tttgatagaatcagagt

SEQ ID NO: 8461617 - DNA, 22 bp, Homo sapiens
tttgataattaaaaattgtagt

SEQ ID NO: 8461618 - DNA, 22 bp, Homo sapiens
tttgataattaaaaattgtagt

SEQ ID NO: 8461619 - DNA, 22 bp, Homo sapiens
tttgatccgttgctggtgagga

SEQ ID NO: 8461620 - DNA, 22 bp, Homo sapiens
tttgatatcttggtatacagat

SEQ ID NO: 8461621 - DNA, 22 bp, Homo sapiens
tttgctttcccttgtagaaagt

SEQ ID NO: 8461622 - DNA, 22 bp, Homo sapiens
tttgctttcccttgtagaaagt

SEQ ID NO: 8461623 - DNA, 22 bp, Homo sapiens
tttgctttctgttgaacagagt

SEQ ID NO: 8461624 - DNA, 22 bp, Homo sapiens
tttgctttctgttgaacagagt

SEQ ID NO: 8461625 - DNA, 22 bp, Homo sapiens
tttgctttgactgtcagcaagt

SEQ ID NO: 8461626 - DNA, 22 bp, Homo sapiens
tttgctttcttgattcagatta

SEQ ID NO: 8461627 - DNA, 22 bp, Homo sapiens
tttgctttgactgtcagcaagt

SEQ ID NO: 8461628 - DNA, 22 bp, Homo sapiens
tttgctttctgttgaacagagt

SEQ ID NO: 8461629 - DNA, 22 bp, Homo sapiens
tttgattctgtaaaataacagg

SEQ ID NO: 8461630 - DNA, 22 bp, Homo sapiens
ttttaaaggatagctctggttg

SEQ ID NO: 8461631 - DNA, 22 bp, Homo sapiens
ttttaaactgcagaatttagaa

SEQ ID NO: 8461632 - DNA, 21 bp, Homo sapiens
ttttaacaaggatttccctag

SEQ ID NO: 8461633 - DNA, 22 bp, Homo sapiens
ttttaacactcagcactatctc

SEQ ID NO: 8461634 - DNA, 22 bp, Homo sapiens
ttttaaatctccagttgacccc

SEQ ID NO: 8461635 - DNA, 22 bp, Homo sapiens
ttttaaatctccagttgacccc

SEQ ID NO: 8461636 - DNA, 22 bp, Homo sapiens
ttttaatgggcgactattatgg

SEQ ID NO: 8461637 - DNA, 22 bp, Homo sapiens
ttttaattcaaagtgaatagtg

SEQ ID NO: 8461638 - DNA, 22 bp, Homo sapiens
ttttaagaaatgtatgactgtc

SEQ ID NO: 8461639 - DNA, 22 bp, Homo sapiens
ttttaagaaatgtatgactgtc

SEQ ID NO: 8461640 - DNA, 22 bp, Homo sapiens
ttttaatcatgcttctatgtcc

SEQ ID NO: 8461641 - DNA, 22 bp, Homo sapiens
ttttaatcatgcttctatgtcc

SEQ ID NO: 8461642 - DNA, 22 bp, Homo sapiens
ttttaatcctcttggtatctta

SEQ ID NO: 8461643 - DNA, 22 bp, Homo sapiens
ttttaatcctcttggtatctta

SEQ ID NO: 8461644 - DNA, 22 bp, Homo sapiens
ttttaatccatctggtaaacct

SEQ ID NO: 8461645 - DNA, 22 bp, Homo sapiens
ttttaatccatctggtaaacct

SEQ ID NO: 8461646 - DNA, 20 bp, Homo sapiens
ttttatgtcaccttcctgtc

SEQ ID NO: 8461647 - DNA, 22 bp, Homo sapiens
ttttatgtaatccttactgtcg

SEQ ID NO: 8461648 - DNA, 22 bp, Homo sapiens
tttgttcaacaggtgaaataga

SEQ ID NO: 8461649 - DNA, 22 bp, Homo sapiens
tttgttacattaaaaagtaggt

SEQ ID NO: 8461650 - DNA, 22 bp, Homo sapiens
tttgtgttttcactagcagtgt

SEQ ID NO: 8461651 - DNA, 22 bp, Homo sapiens
tttgtgttttcccatactattg

SEQ ID NO: 8461652 - DNA, 22 bp, Homo sapiens
tttgtgttttagctggtgaggc

SEQ ID NO: 8461653 - DNA, 22 bp, Homo sapiens
tttgtgttggaagaaatgctac

SEQ ID NO: 8461654 - DNA, 22 bp, Homo sapiens
tttgtgttggaagaaatgctac

SEQ ID NO: 8461655 - DNA, 22 bp, Homo sapiens
tttgtgttaaatgttaaattca

SEQ ID NO: 8461656 - DNA, 22 bp, Homo sapiens
tttgtgtttgtacaatgcacta

SEQ ID NO: 8461657 - DNA, 22 bp, Homo sapiens
tttgtgttgttttaagccacta

SEQ ID NO: 8461658 - DNA, 22 bp, Homo sapiens
tttgtaaaaggaggaagcatgg

SEQ ID NO: 8461659 - DNA, 22 bp, Homo sapiens
tttgtaaaggcctgaatttcag

SEQ ID NO: 8461660 - DNA, 22 bp, Homo sapiens
tttgtgtggatggaaggcagta

SEQ ID NO: 8461661 - DNA, 22 bp, Homo sapiens
tttgtgtggcgttggccggcgg

SEQ ID NO: 8461662 - DNA, 22 bp, Homo sapiens
ttttatgttcctgaagctatct

SEQ ID NO: 8461663 - DNA, 22 bp, Homo sapiens
ttttatgttcctctttatgcga

SEQ ID NO: 8461664 - DNA, 22 bp, Homo sapiens
ttttatgttcctctttatgcga

SEQ ID NO: 8461665 - DNA, 22 bp, Homo sapiens
ttttatgtgtgaaatgctgtct

SEQ ID NO: 8461666 - DNA, 22 bp, Homo sapiens
ttttattgcaataaagtgtgta

SEQ ID NO: 8461667 - DNA, 22 bp, Homo sapiens
ttttcattgtaaatcaggaaac

SEQ ID NO: 8461668 - DNA, 22 bp, Homo sapiens
ttttcattgttactatgagcta

SEQ ID NO: 8461669 - DNA, 22 bp, Homo sapiens
ttttcattgttactatgagcta

SEQ ID NO: 8461670 - DNA, 22 bp, Homo sapiens
ttttcattgttactatgagcta

SEQ ID NO: 8461671 - DNA, 22 bp, Homo sapiens
ttttcattgttcctcgagcatt

SEQ ID NO: 8461672 - DNA, 22 bp, Homo sapiens
ttttcattgttcctcgagcatt

SEQ ID NO: 8461673 - DNA, 22 bp, Homo sapiens
ttttcattgttcctcgagcatt

SEQ ID NO: 8461674 - DNA, 22 bp, Homo sapiens
ttttcattgttactatgagcta

SEQ ID NO: 8461675 - DNA, 22 bp, Homo sapiens
ttttcattagaatgactgagaa

SEQ ID NO: 8461676 - DNA, 22 bp, Homo sapiens
ttttcattagaatgactgagaa

SEQ ID NO: 8461677 - DNA, 22 bp, Homo sapiens
ttttcattgagcacctgagtaa

SEQ ID NO: 8461678 - DNA, 22 bp, Homo sapiens
ttttcattgagcacctgagtaa

SEQ ID NO: 8461679 - DNA, 22 bp, Homo sapiens
ttttcattgagcacctgagtaa

SEQ ID NO: 8461680 - DNA, 22 bp, Homo sapiens
ttttattggagtgataccaagc

SEQ ID NO: 8461681 - DNA, 22 bp, Homo sapiens
ttttcatttttgtagatgcaag

SEQ ID NO: 8461682 - DNA, 22 bp, Homo sapiens
ttttcatttttgtagatgcaag

SEQ ID NO: 8461683 - DNA, 22 bp, Homo sapiens
ttttcattgttcctcgagcatt

SEQ ID NO: 8461684 - DNA, 22 bp, Homo sapiens
ttttcatttacattagggaaga

SEQ ID NO: 8461685 - DNA, 22 bp, Homo sapiens
ttttcatttacattagggaaga

SEQ ID NO: 8461686 - DNA, 22 bp, Homo sapiens
ttttctattcattgtctatggt

SEQ ID NO: 8461687 - DNA, 22 bp, Homo sapiens
ttttctcttgttaatgtactga

SEQ ID NO: 8461688 - DNA, 19 bp, Homo sapiens
ttttctcagcttctagcgg

SEQ ID NO: 8461689 - DNA, 22 bp, Homo sapiens
ttttctgtaagaggactttaat

SEQ ID NO: 8461690 - DNA, 22 bp, Homo sapiens
ttttctgtattattgtgcttca

SEQ ID NO: 8461691 - DNA, 22 bp, Homo sapiens
ttttctgtgtgtccctcgacag

SEQ ID NO: 8461692 - DNA, 22 bp, Homo sapiens
ttttctgttacaaagtacagcg

SEQ ID NO: 8461693 - DNA, 20 bp, Homo sapiens
ttttctgtgccaagaaaact

SEQ ID NO: 8461694 - DNA, 22 bp, Homo sapiens
tttttacacttagcattgagcg

SEQ ID NO: 8461695 - DNA, 22 bp, Homo sapiens
tttttacacttagcattgagcg

SEQ ID NO: 8461696 - DNA, 19 bp, Homo sapiens
tttttacaagtaggtgtga

SEQ ID NO: 8461697 - DNA, 22 bp, Homo sapiens
tttttacagtcatggtcactca

SEQ ID NO: 8461698 - DNA, 22 bp, Homo sapiens
tttttacagtcatggtcactca

SEQ ID NO: 8461699 - DNA, 22 bp, Homo sapiens
tttttacacttagcattgagcg

SEQ ID NO: 8461700 - DNA, 22 bp, Homo sapiens
ttttgtttaaaatcctggatgg

SEQ ID NO: 8461701 - DNA, 22 bp, Homo sapiens
ttttgtttgtgtccactgcagt

SEQ ID NO: 8461702 - DNA, 22 bp, Homo sapiens
tttttacagtcatggtcactca

SEQ ID NO: 8461703 - DNA, 22 bp, Homo sapiens
tttttagagtgttaccagtata

SEQ ID NO: 8461704 - DNA, 22 bp, Homo sapiens
tttttagagtgttaccagtata

SEQ ID NO: 8461705 - DNA, 22 bp, Homo sapiens
tttttagattactcagccacca

SEQ ID NO: 8461706 - DNA, 22 bp, Homo sapiens
tttttataccacctctcactta

SEQ ID NO: 8461707 - DNA, 22 bp, Homo sapiens
tttttataactcttttgtgaca

SEQ ID NO: 8461708 - DNA, 22 bp, Homo sapiens
tttttcatattcccctctctgg

SEQ ID NO: 8461709 - DNA, 22 bp, Homo sapiens
tttttatactttgctcaagatt

SEQ ID NO: 8461710 - DNA, 22 bp, Homo sapiens
tttttataccacctctcactta

SEQ ID NO: 8461711 - DNA, 22 bp, Homo sapiens
tttttatatgaaggatagtgcg

SEQ ID NO: 8461712 - DNA, 22 bp, Homo sapiens
tttttataggtcagggcaagtc

SEQ ID NO: 8461713 - DNA, 22 bp, Homo sapiens
tttttatctacagattctcagc

SEQ ID NO: 8461714 - DNA, 22 bp, Homo sapiens
tttttatcttgtatgtgtctct

SEQ ID NO: 8461715 - DNA, 22 bp, Homo sapiens
agaacgtggaatgtggctcctt

SEQ ID NO: 8461716 - DNA, 22 bp, Homo sapiens
agaacgctattcagaacactgg

SEQ ID NO: 8461717 - DNA, 22 bp, Homo sapiens
agaactattgcaataacaagaa

SEQ ID NO: 8461718 - DNA, 22 bp, Homo sapiens
agaacaattgccccaaagcttg

SEQ ID NO: 8461719 - DNA, 21 bp, Homo sapiens
agaactgattaaataagcagt

SEQ ID NO: 8461720 - DNA, 22 bp, Homo sapiens
agaactctttatctgtggaatg

SEQ ID NO: 8461721 - DNA, 22 bp, Homo sapiens
agaactctgaacactgtctgga

SEQ ID NO: 8461722 - DNA, 22 bp, Homo sapiens
agaactctcgctggatcagact

SEQ ID NO: 8461723 - DNA, 22 bp, Homo sapiens
agaactctatattcatgaacaa

SEQ ID NO: 8461724 - DNA, 22 bp, Homo sapiens
agaactctaggattggctggat

SEQ ID NO: 8461725 - DNA, 17 bp, Homo sapiens
agaactgtagtagctcc

SEQ ID NO: 8461726 - DNA, 22 bp, Homo sapiens
agaactgtccttggaggagagt

SEQ ID NO: 8461727 - DNA, 22 bp, Homo sapiens
agaactgtgaagtatgtgaaat

SEQ ID NO: 8461728 - DNA, 22 bp, Homo sapiens
agaacttaggaacaacagctta

SEQ ID NO: 8461729 - DNA, 22 bp, Homo sapiens
agaacttttggagacttttagt

SEQ ID NO: 8461730 - DNA, 22 bp, Homo sapiens
aatgaagaaatggacatcttta

SEQ ID NO: 8461731 - DNA, 22 bp, Homo sapiens
agaagaaactgtcggggatatt

SEQ ID NO: 8461732 - DNA, 22 bp, Homo sapiens
agaagaaagattgaaggttcct

SEQ ID NO: 8461733 - DNA, 22 bp, Homo sapiens
agaagcagctttcaaggtgatt

SEQ ID NO: 8461734 - DNA, 22 bp, Homo sapiens
agaagcagctttcaaggtgatt

SEQ ID NO: 8461735 - DNA, 22 bp, Homo sapiens
agaagccactgctcccagtgag

SEQ ID NO: 8461736 - DNA, 22 bp, Homo sapiens
aatgccaacttggatatacatt

SEQ ID NO: 8461737 - DNA, 22 bp, Homo sapiens
aatgccatccctctgtcaccaa

SEQ ID NO: 8461738 - DNA, 22 bp, Homo sapiens
aatgccaatgggcagaactaga

SEQ ID NO: 8461739 - DNA, 22 bp, Homo sapiens
aatgccatctggtgatgtatta

SEQ ID NO: 8461740 - DNA, 19 bp, Homo sapiens
aatgcatggaagttggaga

SEQ ID NO: 8461741 - DNA, 22 bp, Homo sapiens
aatgcacaaaggtgtctattgc

SEQ ID NO: 8461742 - DNA, 22 bp, Homo sapiens
aatgcattctcggtttgtgtgt

SEQ ID NO: 8461743 - DNA, 22 bp, Homo sapiens
agaaggaagccaggagggtgca

SEQ ID NO: 8461744 - DNA, 22 bp, Homo sapiens
agaaggaagccaggagggtgca

SEQ ID NO: 8461745 - DNA, 22 bp, Homo sapiens
agaaggaaggaagcattctgtt

SEQ ID NO: 8461746 - DNA, 22 bp, Homo sapiens
agaaggaaggaagcattctgtt

SEQ ID NO: 8461747 - DNA, 22 bp, Homo sapiens
agaaggaaggctgagtgctgat

SEQ ID NO: 8461748 - DNA, 22 bp, Homo sapiens
agaaggaaggctgagtgctgat

SEQ ID NO: 8461749 - DNA, 22 bp, Homo sapiens
agaagccagtcgctctcccgca

SEQ ID NO: 8461750 - DNA, 22 bp, Homo sapiens
agaagccagcttcagctgcccg

SEQ ID NO: 8461751 - DNA, 22 bp, Homo sapiens
agaagcttgaaggagcagtgac

SEQ ID NO: 8461752 - DNA, 22 bp, Homo sapiens
agaagccagccttgcctccttt

SEQ ID NO: 8461753 - DNA, 22 bp, Homo sapiens
aatagtacaatctacagacata

SEQ ID NO: 8461754 - DNA, 22 bp, Homo sapiens
aatagtaaaagatacagctaat

SEQ ID NO: 8461755 - DNA, 22 bp, Homo sapiens
aataggctgagccatttcaagt

SEQ ID NO: 8461756 - DNA, 22 bp, Homo sapiens
aataggcagcttagcaggggct

SEQ ID NO: 8461757 - DNA, 22 bp, Homo sapiens
aataggaaaatatttaacaaga

SEQ ID NO: 8461758 - DNA, 22 bp, Homo sapiens
aatagcttttgtatgatgaaat

SEQ ID NO: 8461759 - DNA, 22 bp, Homo sapiens
aatagctttctcatgacttcac

SEQ ID NO: 8461760 - DNA, 22 bp, Homo sapiens
aatagcttggacccattgcttt

SEQ ID NO: 8461761 - DNA, 22 bp, Homo sapiens
aatagctttggtcaccatctgg

SEQ ID NO: 8461762 - DNA, 22 bp, Homo sapiens
aatagctttggtcaccatctgg

SEQ ID NO: 8461763 - DNA, 22 bp, Homo sapiens
aatagcttattgacagtgaatt

SEQ ID NO: 8461764 - DNA, 22 bp, Homo sapiens
aatagcttgcctaatcctcatg

SEQ ID NO: 8461765 - DNA, 22 bp, Homo sapiens
aatagcttattgacagtgaatt

SEQ ID NO: 8461766 - DNA, 22 bp, Homo sapiens
aatagcttggacccattgcttt

SEQ ID NO: 8461767 - DNA, 22 bp, Homo sapiens
aatagcttagtcctgattctgt

SEQ ID NO: 8461768 - DNA, 22 bp, Homo sapiens
aatagcatgttcatgataaaat

SEQ ID NO: 8461769 - DNA, 21 bp, Homo sapiens
aatagcattcaggatgggctc

SEQ ID NO: 8461770 - DNA, 22 bp, Homo sapiens
aatagcatgttaataaccagag

SEQ ID NO: 8461771 - DNA, 22 bp, Homo sapiens
actttgtttggctattagagtc

SEQ ID NO: 8461772 - DNA, 22 bp, Homo sapiens
acttttaaatgagtttcagttg

SEQ ID NO: 8461773 - DNA, 22 bp, Homo sapiens
actttgatagtttaatctagga

SEQ ID NO: 8461774 - DNA, 22 bp, Homo sapiens
actttgcaaaaggaaatcacct

SEQ ID NO: 8461775 - DNA, 22 bp, Homo sapiens
acttttaaggggccttgattta

SEQ ID NO: 8461776 - DNA, 22 bp, Homo sapiens
aatcaagagttgtgtaatattt

SEQ ID NO: 8461777 - DNA, 22 bp, Homo sapiens
aatcaatgttagtcatgaattt

SEQ ID NO: 8461778 - DNA, 22 bp, Homo sapiens
aatcacaaatgcaagttgtcac

SEQ ID NO: 8461779 - DNA, 22 bp, Homo sapiens
aatcacaaatgcaagttgtcac

SEQ ID NO: 8461780 - DNA, 22 bp, Homo sapiens
aatcacaattacttttgcacca

SEQ ID NO: 8461781 - DNA, 22 bp, Homo sapiens
aatcacagagtccagcagatga

SEQ ID NO: 8461782 - DNA, 22 bp, Homo sapiens
agaaaggcaatattaactacac

SEQ ID NO: 8461783 - DNA, 22 bp, Homo sapiens
agaaagcttatgaatgggcaag

SEQ ID NO: 8461784 - DNA, 22 bp, Homo sapiens
agaaactgacaggaaatgaatt

SEQ ID NO: 8461785 - DNA, 22 bp, Homo sapiens
agaaagggatgaggtagctgct

SEQ ID NO: 8461786 - DNA, 22 bp, Homo sapiens
aatcgcttggtaattttaaaag

SEQ ID NO: 8461787 - DNA, 22 bp, Homo sapiens
aatccttactgaatgagaaaaa

SEQ ID NO: 8461788 - DNA, 22 bp, Homo sapiens
agaaagggagagccagcacacg

SEQ ID NO: 8461789 - DNA, 22 bp, Homo sapiens
aatctaaggacttagcattgct

SEQ ID NO: 8461790 - DNA, 22 bp, Homo sapiens
aatctaagggaaattggagatg

SEQ ID NO: 8461791 - DNA, 22 bp, Homo sapiens
aatctaagggaaattggagatg

SEQ ID NO: 8461792 - DNA, 22 bp, Homo sapiens
aatctacatagagatcaaatga

SEQ ID NO: 8461793 - DNA, 22 bp, Homo sapiens
aatctacatttcagttttgccc

SEQ ID NO: 8461794 - DNA, 19 bp, Homo sapiens
aatctagaaatatgtgttc

SEQ ID NO: 8461795 - DNA, 22 bp, Homo sapiens
aatctagagtgctaggtctgtg

SEQ ID NO: 8461796 - DNA, 22 bp, Homo sapiens
aatctagagtgctaggtctgtg

SEQ ID NO: 8461797 - DNA, 22 bp, Homo sapiens
aatctagagacaatttgaatat

SEQ ID NO: 8461798 - DNA, 22 bp, Homo sapiens
aatctagagaactgtggggcag

SEQ ID NO: 8461799 - DNA, 22 bp, Homo sapiens
aatctagaattttaggggtata

SEQ ID NO: 8461800 - DNA, 23 bp, Homo sapiens
aatctagaatgacctactcatct

SEQ ID NO: 8461801 - DNA, 22 bp, Homo sapiens
aatctagattcggatcaaaggg

SEQ ID NO: 8461802 - DNA, 22 bp, Homo sapiens
aatctagagttcccagcataaa

SEQ ID NO: 8461803 - DNA, 22 bp, Homo sapiens
aagtgtgggaagtaggtggcga

SEQ ID NO: 8461804 - DNA, 22 bp, Homo sapiens
aagtgtgggactagggctccag

SEQ ID NO: 8461805 - DNA, 22 bp, Homo sapiens
aagtgtggggtctcagagctga

SEQ ID NO: 8461806 - DNA, 22 bp, Homo sapiens
aagtgtgttgactgaattgggg

SEQ ID NO: 8461807 - DNA, 22 bp, Homo sapiens
aagtgtcttctgatggggtgtg

SEQ ID NO: 8461808 - DNA, 22 bp, Homo sapiens
acctgcctatggagccacatgg

SEQ ID NO: 8461809 - DNA, 22 bp, Homo sapiens
aagtgtttatggttattgttaa

SEQ ID NO: 8461810 - DNA, 22 bp, Homo sapiens
aagtgtttaaattatttgcagg

SEQ ID NO: 8461811 - DNA, 22 bp, Homo sapiens
aagtgtttaaattatttgcagg

SEQ ID NO: 8461812 - DNA, 22 bp, Homo sapiens
aagtgttatgtaggatttcaga

SEQ ID NO: 8461813 - DNA, 18 bp, Homo sapiens
actctgggacctgttatt

SEQ ID NO: 8461814 - DNA, 22 bp, Homo sapiens
actctgggaatcctcaccttcc

SEQ ID NO: 8461815 - DNA, 22 bp, Homo sapiens
actctggcttgaggaccaggtc

SEQ ID NO: 8461816 - DNA, 22 bp, Homo sapiens
actctttacttaaactctaagt

SEQ ID NO: 8461817 - DNA, 22 bp, Homo sapiens
actcttgtctcaacttttgtat

SEQ ID NO: 8461818 - DNA, 20 bp, Homo sapiens
aagttttctccaaatacagt

SEQ ID NO: 8461819 - DNA, 19 bp, Homo sapiens
actgcagggaggaggtgtg

SEQ ID NO: 8461820 - DNA, 19 bp, Homo sapiens
actgcagggaggaggtgtg

SEQ ID NO: 8461821 - DNA, 19 bp, Homo sapiens
actgcagggaggaggtgtg

SEQ ID NO: 8461822 - DNA, 22 bp, Homo sapiens
actgcagggcatcctggccaag

SEQ ID NO: 8461823 - DNA, 22 bp, Homo sapiens
actgcagggcatcctggccaag

SEQ ID NO: 8461824 - DNA, 22 bp, Homo sapiens
actgcaggccttggtgccagca

SEQ ID NO: 8461825 - DNA, 22 bp, Homo sapiens
actgcaggccttggtgccagca

SEQ ID NO: 8461826 - DNA, 22 bp, Homo sapiens
actgcaggccttggtgccagca

SEQ ID NO: 8461827 - DNA, 19 bp, Homo sapiens
actgcagggaggaggtgtg

SEQ ID NO: 8461828 - DNA, 22 bp, Homo sapiens
actgcaggtggatggcacttta

SEQ ID NO: 8461829 - DNA, 22 bp, Homo sapiens
actgcagccttgaactctgggc

SEQ ID NO: 8461830 - DNA, 22 bp, Homo sapiens
actgcactccagcctgggtgac

SEQ ID NO: 8461831 - DNA, 22 bp, Homo sapiens
aagttcctgggccaagtccagg

SEQ ID NO: 8461832 - DNA, 22 bp, Homo sapiens
actgcaggagacacagctgctg

SEQ ID NO: 8461833 - DNA, 22 bp, Homo sapiens
actgcaggagacacagctgctg

SEQ ID NO: 8461834 - DNA, 22 bp, Homo sapiens
actgcaggatgtgctcctattg

SEQ ID NO: 8461835 - DNA, 18 bp, Homo sapiens
actgcaggagaggtgagg

SEQ ID NO: 8461836 - DNA, 18 bp, Homo sapiens
actgcaggagaggtgagg

SEQ ID NO: 8461837 - DNA, 18 bp, Homo sapiens
actgcaggagaggtgagg

SEQ ID NO: 8461838 - DNA, 22 bp, Homo sapiens
actctttagaggtacatctctt

SEQ ID NO: 8461839 - DNA, 22 bp, Homo sapiens
actctttgtctgttgccgctta

SEQ ID NO: 8461840 - DNA, 22 bp, Homo sapiens
aagttcctaaagtcaggggtca

SEQ ID NO: 8461841 - DNA, 18 bp, Homo sapiens
aagttccacaagagatct

SEQ ID NO: 8461842 - DNA, 22 bp, Homo sapiens
aagttcctcttctctgcaggga

SEQ ID NO: 8461843 - DNA, 22 bp, Homo sapiens
aatagcaaatgctcatttgaaa

SEQ ID NO: 8461844 - DNA, 22 bp, Homo sapiens
aatagcatcctaaaacatactt

SEQ ID NO: 8461845 - DNA, 22 bp, Homo sapiens
aatagcatcctgtatctcttcc

SEQ ID NO: 8461846 - DNA, 22 bp, Homo sapiens
aatagcatcctaaaacatactt

SEQ ID NO: 8461847 - DNA, 22 bp, Homo sapiens
aatagcatagagttaaaatgca

SEQ ID NO: 8461848 - DNA, 22 bp, Homo sapiens
actgtccttttaatgcagccgt

SEQ ID NO: 8461849 - DNA, 22 bp, Homo sapiens
actgtctcctcatcatgcctgg

SEQ ID NO: 8461850 - DNA, 22 bp, Homo sapiens
actgtcctagaacctgcagctc

SEQ ID NO: 8461851 - DNA, 22 bp, Homo sapiens
actgtccataatattggtgaac

SEQ ID NO: 8461852 - DNA, 22 bp, Homo sapiens
actgtccaagcatgcctggctt

SEQ ID NO: 8461853 - DNA, 22 bp, Homo sapiens
actgtacacattcgtcaagact

SEQ ID NO: 8461854 - DNA, 22 bp, Homo sapiens
actgtacacattcgtcaagact

SEQ ID NO: 8461855 - DNA, 22 bp, Homo sapiens
actgtacacagtggtgtactgt

SEQ ID NO: 8461856 - DNA, 22 bp, Homo sapiens
actgtacaactgctgagcagaa

SEQ ID NO: 8461857 - DNA, 22 bp, Homo sapiens
actgtaaggtaaggataaaacc

SEQ ID NO: 8461858 - DNA, 22 bp, Homo sapiens
aataatagcagagtttacaatc

SEQ ID NO: 8461859 - DNA, 22 bp, Homo sapiens
aataatagcagagtttacaatc

SEQ ID NO: 8461860 - DNA, 22 bp, Homo sapiens
actggggaatggaactgggaat

SEQ ID NO: 8461861 - DNA, 22 bp, Homo sapiens
aataataagatactaagggagt

SEQ ID NO: 8461862 - DNA, 22 bp, Homo sapiens
aataatacatgagattaatgtt

SEQ ID NO: 8461863 - DNA, 22 bp, Homo sapiens
aataatacttcgtaaagttgtt

SEQ ID NO: 8461864 - DNA, 22 bp, Homo sapiens
aataatacatgagattaatgtt

SEQ ID NO: 8461865 - DNA, 19 bp, Homo sapiens
aataagcttgggtaaaact

SEQ ID NO: 8461866 - DNA, 22 bp, Homo sapiens
aataagctggagctatattgag

SEQ ID NO: 8461867 - DNA, 22 bp, Homo sapiens
aataagcaagcctgtgtgcaag

SEQ ID NO: 8461868 - DNA, 22 bp, Homo sapiens
actgggattacaggtgggagtc

SEQ ID NO: 8461869 - DNA, 22 bp, Homo sapiens
actgggattacaggtgggagtc

SEQ ID NO: 8461870 - DNA, 20 bp, Homo sapiens
aataaaagaagccttcaccc

SEQ ID NO: 8461871 - DNA, 22 bp, Homo sapiens
aataaaatgaactggtagagtt

SEQ ID NO: 8461872 - DNA, 22 bp, Homo sapiens
aataaaatgaactggtagagtt

SEQ ID NO: 8461873 - DNA, 22 bp, Homo sapiens
aagtttttgattctaagagaga

SEQ ID NO: 8461874 - DNA, 22 bp, Homo sapiens
aagtttttggtagagaaaagta

SEQ ID NO: 8461875 - DNA, 22 bp, Homo sapiens
aagtttttcacattgctgttgt

SEQ ID NO: 8461876 - DNA, 22 bp, Homo sapiens
actgggaggcaaagagcaagga

SEQ ID NO: 8461877 - DNA, 22 bp, Homo sapiens
actgggagtcatgaggaaggag

SEQ ID NO: 8461878 - DNA, 22 bp, Homo sapiens
actgggagtcatgaggaaggag

SEQ ID NO: 8461879 - DNA, 22 bp, Homo sapiens
actgggaggcatctggagctga

SEQ ID NO: 8461880 - DNA, 22 bp, Homo sapiens
actgggagggtcttgaagaggg

SEQ ID NO: 8461881 - DNA, 22 bp, Homo sapiens
actgggagggtcttgaagaggg

SEQ ID NO: 8461882 - DNA, 22 bp, Homo sapiens
aagtagttaggaacattctctc

SEQ ID NO: 8461883 - DNA, 22 bp, Homo sapiens
aagtagtgtgctccagcggtga

SEQ ID NO: 8461884 - DNA, 22 bp, Homo sapiens
aagtagttggaaataagacaga

SEQ ID NO: 8461885 - DNA, 22 bp, Homo sapiens
aagtagttggaaataagacaga

SEQ ID NO: 8461886 - DNA, 22 bp, Homo sapiens
aagtagttagtccgcctgctct

SEQ ID NO: 8461887 - DNA, 22 bp, Homo sapiens
aagtagttgtccctgaggaacg

SEQ ID NO: 8461888 - DNA, 22 bp, Homo sapiens
aagtatatactaaatgttaatc

SEQ ID NO: 8461889 - DNA, 22 bp, Homo sapiens
aagtagcattttcaaaatgtat

SEQ ID NO: 8461890 - DNA, 22 bp, Homo sapiens
aagtccagtgatactggcagga

SEQ ID NO: 8461891 - DNA, 22 bp, Homo sapiens
aagtatcaaatggtagcatatg

SEQ ID NO: 8461892 - DNA, 22 bp, Homo sapiens
aagtcagtgctagctaatggct

SEQ ID NO: 8461893 - DNA, 22 bp, Homo sapiens
aagtcatagtcgggaaagacat

SEQ ID NO: 8461894 - DNA, 22 bp, Homo sapiens
aagtcagtgaaaaggcatcatc

SEQ ID NO: 8461895 - DNA, 22 bp, Homo sapiens
aagtatatttagctgagcttgt

SEQ ID NO: 8461896 - DNA, 22 bp, Homo sapiens
aagtatatactaaatgttaatc

SEQ ID NO: 8461897 - DNA, 22 bp, Homo sapiens
aagtatatactaaatgttaatc

SEQ ID NO: 8461898 - DNA, 22 bp, Homo sapiens
aagtccttcccaagcatgtacc

SEQ ID NO: 8461899 - DNA, 22 bp, Homo sapiens
aagtcctgtgtgcttacacttg

SEQ ID NO: 8461900 - DNA, 22 bp, Homo sapiens
aagtccttggagaatagaaagg

SEQ ID NO: 8461901 - DNA, 22 bp, Homo sapiens
acctgcctatcagctgcctgct

SEQ ID NO: 8461902 - DNA, 22 bp, Homo sapiens
aagtccctttaatcagtgcctt

SEQ ID NO: 8461903 - DNA, 22 bp, Homo sapiens
aagtccctgtggggtggaggct

SEQ ID NO: 8461904 - DNA, 22 bp, Homo sapiens
aagtccctggttcctagcaaaa

SEQ ID NO: 8461905 - DNA, 17 bp, Homo sapiens
aagtcccagctaacaca

SEQ ID NO: 8461906 - DNA, 22 bp, Homo sapiens
aagtcccaaagtcactctgctt

SEQ ID NO: 8461907 - DNA, 20 bp, Homo sapiens
aagtccctaagtctctggcc

SEQ ID NO: 8461908 - DNA, 19 bp, Homo sapiens
acccaggggtttatgtgtg

SEQ ID NO: 8461909 - DNA, 22 bp, Homo sapiens
acccaggggcgaagctggccac

SEQ ID NO: 8461910 - DNA, 22 bp, Homo sapiens
acccagggtagaacctcagagc

SEQ ID NO: 8461911 - DNA, 22 bp, Homo sapiens
acccaggggcagccttgctgtg

SEQ ID NO: 8461912 - DNA, 21 bp, Homo sapiens
acccaggggaagcagaaactg

SEQ ID NO: 8461913 - DNA, 22 bp, Homo sapiens
acccagggcttaaggcggtgca

SEQ ID NO: 8461914 - DNA, 22 bp, Homo sapiens
acccagggctcaagcgtaggca

SEQ ID NO: 8461915 - DNA, 22 bp, Homo sapiens
acccagggcttaaggcggtgca

SEQ ID NO: 8461916 - DNA, 22 bp, Homo sapiens
acccagggagtgctcctgttct

SEQ ID NO: 8461917 - DNA, 22 bp, Homo sapiens
acccaggccattggcaagagtc

SEQ ID NO: 8461918 - DNA, 22 bp, Homo sapiens
acccaggccattggcaagagtc

SEQ ID NO: 8461919 - DNA, 22 bp, Homo sapiens
acccaggccattggcaagagtc

SEQ ID NO: 8461920 - DNA, 22 bp, Homo sapiens
acccagggccacagcccgcagt

SEQ ID NO: 8461921 - DNA, 22 bp, Homo sapiens
acccagggcagccagcggggag

SEQ ID NO: 8461922 - DNA, 22 bp, Homo sapiens
acctcctggtgcccaagtgttt

SEQ ID NO: 8461923 - DNA, 22 bp, Homo sapiens
acctcctggtgcccaagtgttt

SEQ ID NO: 8461924 - DNA, 22 bp, Homo sapiens
acctcctggcttatcatggaca

SEQ ID NO: 8461925 - DNA, 22 bp, Homo sapiens
acctcctggcttatcatggaca

SEQ ID NO: 8461926 - DNA, 22 bp, Homo sapiens
acctcctggctgctcatggaac

SEQ ID NO: 8461927 - DNA, 22 bp, Homo sapiens
acctcctggctgctcatggaac

SEQ ID NO: 8461928 - DNA, 20 bp, Homo sapiens
acctcctggcgggcatcctc

SEQ ID NO: 8461929 - DNA, 22 bp, Homo sapiens
acctcctggcctcaagcaatcc

SEQ ID NO: 8461930 - DNA, 20 bp, Homo sapiens
acctcctggaagcaggtgcc

SEQ ID NO: 8461931 - DNA, 20 bp, Homo sapiens
acctcctggaagcaggtgcc

SEQ ID NO: 8461932 - DNA, 21 bp, Homo sapiens
acctcctggcatcctgttccc

SEQ ID NO: 8461933 - DNA, 22 bp, Homo sapiens
acctctggacactgcatccttc

SEQ ID NO: 8461934 - DNA, 22 bp, Homo sapiens
aagggctggatctctctgagca

SEQ ID NO: 8461935 - DNA, 22 bp, Homo sapiens
aagggctggccacattctgggt

SEQ ID NO: 8461936 - DNA, 22 bp, Homo sapiens
aagggctggagaggaaaggttg

SEQ ID NO: 8461937 - DNA, 22 bp, Homo sapiens
aagggctggccctgggaagagt

SEQ ID NO: 8461938 - DNA, 18 bp, Homo sapiens
aagggctggcctttggag

SEQ ID NO: 8461939 - DNA, 19 bp, Homo sapiens
aagggctgggcacctcact

SEQ ID NO: 8461940 - DNA, 22 bp, Homo sapiens
aagggctgatctcactttcttt

SEQ ID NO: 8461941 - DNA, 22 bp, Homo sapiens
aagggctggagactgggtcttc

SEQ ID NO: 8461942 - DNA, 22 bp, Homo sapiens
acatttcagtgagctattgaag

SEQ ID NO: 8461943 - DNA, 22 bp, Homo sapiens
acatttcagtaagtgttaattt

SEQ ID NO: 8461944 - DNA, 22 bp, Homo sapiens
acatttcagtaagtgttaattt

SEQ ID NO: 8461945 - DNA, 22 bp, Homo sapiens
acatttcagattcatgaagtga

SEQ ID NO: 8461946 - DNA, 22 bp, Homo sapiens
aagggcagagggaatcccacat

SEQ ID NO: 8461947 - DNA, 22 bp, Homo sapiens
aagggcagagggaatcccacat

SEQ ID NO: 8461948 - DNA, 22 bp, Homo sapiens
acatttcagattcatgaagtga

SEQ ID NO: 8461949 - DNA, 22 bp, Homo sapiens
acatttcagatgtaatgtgatg

SEQ ID NO: 8461950 - DNA, 22 bp, Homo sapiens
aagggaggtaaagctatttaaa

SEQ ID NO: 8461951 - DNA, 22 bp, Homo sapiens
aagggatgcaggaaagaaggtt

SEQ ID NO: 8461952 - DNA, 22 bp, Homo sapiens
aagggagacagttgtgtgagga

SEQ ID NO: 8461953 - DNA, 20 bp, Homo sapiens
aagggagaataatgattgta

SEQ ID NO: 8461954 - DNA, 22 bp, Homo sapiens
aagggcacagggaaagagtgca

SEQ ID NO: 8461955 - DNA, 22 bp, Homo sapiens
aagggatgtaaacatgaataag

SEQ ID NO: 8461956 - DNA, 22 bp, Homo sapiens
accagagcttacatgctagaaa

SEQ ID NO: 8461957 - DNA, 20 bp, Homo sapiens
accagaggaaagagcagtga

SEQ ID NO: 8461958 - DNA, 22 bp, Homo sapiens
accagagctggctctgagcacc

SEQ ID NO: 8461959 - DNA, 22 bp, Homo sapiens
accagaggcagtttcggctggt

SEQ ID NO: 8461960 - DNA, 22 bp, Homo sapiens
accagaggaagggaatctcaag

SEQ ID NO: 8461961 - DNA, 22 bp, Homo sapiens
accagaggctctgccacctcca

SEQ ID NO: 8461962 - DNA, 22 bp, Homo sapiens
accagcaagattttgctttgca

SEQ ID NO: 8461963 - DNA, 22 bp, Homo sapiens
aagggggcacagtcactgtaat

SEQ ID NO: 8461964 - DNA, 22 bp, Homo sapiens
aagggggccacacctggtgtga

SEQ ID NO: 8461965 - DNA, 22 bp, Homo sapiens
aagggggcgaagacgtgattga

SEQ ID NO: 8461966 - DNA, 22 bp, Homo sapiens
aagggggcccagcactaagttg

SEQ ID NO: 8461967 - DNA, 22 bp, Homo sapiens
aagggggcggcagccagtggaa

SEQ ID NO: 8461968 - DNA, 22 bp, Homo sapiens
aagggggcggcagccagtggaa

SEQ ID NO: 8461969 - DNA, 22 bp, Homo sapiens
aagggtggtgtaggagatcaaa

SEQ ID NO: 8461970 - DNA, 22 bp, Homo sapiens
aagggtgggccctggcagccat

SEQ ID NO: 8461971 - DNA, 23 bp, Homo sapiens
aagggtccatagctatcattaca

SEQ ID NO: 8461972 - DNA, 22 bp, Homo sapiens
aagggtccagcacctcggctcc

SEQ ID NO: 8461973 - DNA, 22 bp, Homo sapiens
aagggtccaaggctttgcgttt

SEQ ID NO: 8461974 - DNA, 22 bp, Homo sapiens
acccaggcagcaggagctaaag

SEQ ID NO: 8461975 - DNA, 22 bp, Homo sapiens
aagggttggggaagagcaaatt

SEQ ID NO: 8461976 - DNA, 22 bp, Homo sapiens
aagggttgcaaggtcagaggaa

SEQ ID NO: 8461977 - DNA, 22 bp, Homo sapiens
acatgaaatgcagcctgtaacc

SEQ ID NO: 8461978 - DNA, 22 bp, Homo sapiens
acatctcagaactgagtaaccg

SEQ ID NO: 8461979 - DNA, 22 bp, Homo sapiens
acatctcagaactgagtaaccg

SEQ ID NO: 8461980 - DNA, 22 bp, Homo sapiens
acatgaaatgcagcctgtaacc

SEQ ID NO: 8461981 - DNA, 22 bp, Homo sapiens
acatgacaaaatgcacaggatt

SEQ ID NO: 8461982 - DNA, 22 bp, Homo sapiens
acatgacaaaatgcacaggatt

SEQ ID NO: 8461983 - DNA, 22 bp, Homo sapiens
acatgaatgcagccataacact

SEQ ID NO: 8461984 - DNA, 22 bp, Homo sapiens
acatgaatgaagactttacaat

SEQ ID NO: 8461985 - DNA, 22 bp, Homo sapiens
acatctagaagatctgggagat

SEQ ID NO: 8461986 - DNA, 22 bp, Homo sapiens
acatctagaagatctgggagat

SEQ ID NO: 8461987 - DNA, 22 bp, Homo sapiens
acatctaagccaattttgattt

SEQ ID NO: 8461988 - DNA, 22 bp, Homo sapiens
acatctagactcttgccctctt

SEQ ID NO: 8461989 - DNA, 22 bp, Homo sapiens
acatcctcccgatctactggct

SEQ ID NO: 8461990 - DNA, 22 bp, Homo sapiens
acatccctcagtcagactgtaa

SEQ ID NO: 8461991 - DNA, 22 bp, Homo sapiens
acatgacatagtagaaaagccc

SEQ ID NO: 8461992 - DNA, 22 bp, Homo sapiens
acatgactataattacttaaat

SEQ ID NO: 8461993 - DNA, 22 bp, Homo sapiens
acatgacagtgcttagcaaact

SEQ ID NO: 8461994 - DNA, 22 bp, Homo sapiens
acatgacacaggcctggccaat

SEQ ID NO: 8461995 - DNA, 22 bp, Homo sapiens
acatgacacctctggctgggtg

SEQ ID NO: 8461996 - DNA, 22 bp, Homo sapiens
acatgacaaggtttataaggct

SEQ ID NO: 8461997 - DNA, 19 bp, Homo sapiens
acatgacaacaggggaggc

SEQ ID NO: 8461998 - DNA, 22 bp, Homo sapiens
acatgacagggaatgaggtgaa

SEQ ID NO: 8461999 - DNA, 22 bp, Homo sapiens
acatgacagtgactttataaga

SEQ ID NO: 8462000 - DNA, 22 bp, Homo sapiens
acatgacagtgcttagcaaact

SEQ ID NO: 8462001 - DNA, 22 bp, Homo sapiens
aaggcaaggcttccagctcccc

SEQ ID NO: 8462002 - DNA, 22 bp, Homo sapiens
aaggcaatgagggagatagagt

SEQ ID NO: 8462003 - DNA, 22 bp, Homo sapiens
aaggcacagccacttgatcatc

SEQ ID NO: 8462004 - DNA, 22 bp, Homo sapiens
aaggcacagccacttgatcatc

SEQ ID NO: 8462005 - DNA, 22 bp, Homo sapiens
aaggcacagaggcagggcactt

SEQ ID NO: 8462006 - DNA, 22 bp, Homo sapiens
aaggccagccctaatgatgctc

SEQ ID NO: 8462007 - DNA, 22 bp, Homo sapiens
aaggccagccctaatgatgctc

SEQ ID NO: 8462008 - DNA, 22 bp, Homo sapiens
aaggccagccctaatgatgctc

SEQ ID NO: 8462009 - DNA, 22 bp, Homo sapiens
aaggccagcctgagagctaaca

SEQ ID NO: 8462010 - DNA, 22 bp, Homo sapiens
aaggccagccctaatgatgctc

SEQ ID NO: 8462011 - DNA, 22 bp, Homo sapiens
aaggccagccttggaaccctga

SEQ ID NO: 8462012 - DNA, 22 bp, Homo sapiens
aaggccagagttgaactgctcc

SEQ ID NO: 8462013 - DNA, 22 bp, Homo sapiens
aaggccagattcactttacaat

SEQ ID NO: 8462014 - DNA, 22 bp, Homo sapiens
aaggccagcagtttgagaccag

SEQ ID NO: 8462015 - DNA, 22 bp, Homo sapiens
aaggccagattctctctagggg

SEQ ID NO: 8462016 - DNA, 22 bp, Homo sapiens
aaggccagattctctctagggg

SEQ ID NO: 8462017 - DNA, 22 bp, Homo sapiens
aaggccagagtactagaggctg

SEQ ID NO: 8462018 - DNA, 22 bp, Homo sapiens
aaggccagagtactagaggctg

SEQ ID NO: 8462019 - DNA, 22 bp, Homo sapiens
aaggccagagtactagaggctg

SEQ ID NO: 8462020 - DNA, 22 bp, Homo sapiens
aaggccagagcgtgtcctgcct

SEQ ID NO: 8462021 - DNA, 22 bp, Homo sapiens
aaggccagagcgtgtcctgcct

SEQ ID NO: 8462022 - DNA, 22 bp, Homo sapiens
aaggccagagcagactggagtt

SEQ ID NO: 8462023 - DNA, 22 bp, Homo sapiens
aaggcattgctgatcctcaggt

SEQ ID NO: 8462024 - DNA, 22 bp, Homo sapiens
aaggcattgctgatcctcaggt

SEQ ID NO: 8462025 - DNA, 22 bp, Homo sapiens
aaggcatgtgtcctcagagaga

SEQ ID NO: 8462026 - DNA, 22 bp, Homo sapiens
aaggcattatgatttgagtacc

SEQ ID NO: 8462027 - DNA, 22 bp, Homo sapiens
aagctgttaatggcttgcagct

SEQ ID NO: 8462028 - DNA, 22 bp, Homo sapiens
aagctgttaatggcttgcagct

SEQ ID NO: 8462029 - DNA, 22 bp, Homo sapiens
acagctggaggtctgtgagcac

SEQ ID NO: 8462030 - DNA, 22 bp, Homo sapiens
acagctggaggggctgcagagg

SEQ ID NO: 8462031 - DNA, 22 bp, Homo sapiens
acagctggaggggctgcagagg

SEQ ID NO: 8462032 - DNA, 22 bp, Homo sapiens
aagcttaggtacagaagttaag

SEQ ID NO: 8462033 - DNA, 22 bp, Homo sapiens
aagctgttctctaagtttcatg

SEQ ID NO: 8462034 - DNA, 22 bp, Homo sapiens
aagctgttctctaagtttcatg

SEQ ID NO: 8462035 - DNA, 22 bp, Homo sapiens
aagctgttagggagtggtaggt

SEQ ID NO: 8462036 - DNA, 22 bp, Homo sapiens
aagctgttttggccttagttga

SEQ ID NO: 8462037 - DNA, 22 bp, Homo sapiens
aagctgttgccctgctctttct

SEQ ID NO: 8462038 - DNA, 22 bp, Homo sapiens
aagctgttgttcatcctgaatt

SEQ ID NO: 8462039 - DNA, 22 bp, Homo sapiens
aagctgttctgaatcagtaagt

SEQ ID NO: 8462040 - DNA, 22 bp, Homo sapiens
aagctgttggcagatagctctg

SEQ ID NO: 8462041 - DNA, 22 bp, Homo sapiens
aagctgttgaagtaattcagcc

SEQ ID NO: 8462042 - DNA, 22 bp, Homo sapiens
aagcttgtagagtttgacttcc

SEQ ID NO: 8462043 - DNA, 22 bp, Homo sapiens
aagcttgggaaccacggtaatc

SEQ ID NO: 8462044 - DNA, 21 bp, Homo sapiens
aagcttggctgatgttattgg

SEQ ID NO: 8462045 - DNA, 22 bp, Homo sapiens
aagcttggaagtcttcctttca

SEQ ID NO: 8462046 - DNA, 22 bp, Homo sapiens
aagcttgaatcaatggatatcc

SEQ ID NO: 8462047 - DNA, 21 bp, Homo sapiens
aagcttccaaactgctggact

SEQ ID NO: 8462048 - DNA, 22 bp, Homo sapiens
aaggattcaagaaatggtgtag

SEQ ID NO: 8462049 - DNA, 22 bp, Homo sapiens
aaggatttttggaatgagatgg

SEQ ID NO: 8462050 - DNA, 22 bp, Homo sapiens
aaggcaaaagaggtgtcatcac

SEQ ID NO: 8462051 - DNA, 19 bp, Homo sapiens
aaggacacaacagagatag

SEQ ID NO: 8462052 - DNA, 19 bp, Homo sapiens
aaggacacaacagagatag

SEQ ID NO: 8462053 - DNA, 22 bp, Homo sapiens
aaggacagagagccattccaga

SEQ ID NO: 8462054 - DNA, 22 bp, Homo sapiens
aaggacaggcacagtggtggag

SEQ ID NO: 8462055 - DNA, 22 bp, Homo sapiens
aaggacaggcacagtggtggag

SEQ ID NO: 8462056 - DNA, 22 bp, Homo sapiens
aaggaagatgctggcctgggga

SEQ ID NO: 8462057 - DNA, 22 bp, Homo sapiens
aaggaagcagccagagaccctc

SEQ ID NO: 8462058 - DNA, 22 bp, Homo sapiens
aaggaagcagcaatgcatgatt

SEQ ID NO: 8462059 - DNA, 21 bp, Homo sapiens
aattacagatggaattacaga

SEQ ID NO: 8462060 - DNA, 21 bp, Homo sapiens
aattacagatggaattacaga

SEQ ID NO: 8462061 - DNA, 22 bp, Homo sapiens
aattacagtcggagcagcactg

SEQ ID NO: 8462062 - DNA, 22 bp, Homo sapiens
agagcctggctcccagctaccg

SEQ ID NO: 8462063 - DNA, 23 bp, Homo sapiens
aattacaaccaagaactggaagg

SEQ ID NO: 8462064 - DNA, 22 bp, Homo sapiens
aattacaaatgtagactctcat

SEQ ID NO: 8462065 - DNA, 22 bp, Homo sapiens
aattaactaatttggtacaaga

SEQ ID NO: 8462066 - DNA, 22 bp, Homo sapiens
aattaagagagagttgaagcaa

SEQ ID NO: 8462067 - DNA, 22 bp, Homo sapiens
agagctggaatcagacctcagg

SEQ ID NO: 8462068 - DNA, 22 bp, Homo sapiens
agagctggaagctgctcttaga

SEQ ID NO: 8462069 - DNA, 22 bp, Homo sapiens
agagctggaagctgctcttaga

SEQ ID NO: 8462070 - DNA, 22 bp, Homo sapiens
aattcattgccagaatctatga

SEQ ID NO: 8462071 - DNA, 22 bp, Homo sapiens
aattcattgccagaatctatga

SEQ ID NO: 8462072 - DNA, 22 bp, Homo sapiens
aattcattgccagaatctatga

SEQ ID NO: 8462073 - DNA, 22 bp, Homo sapiens
aattccaaatcaactagtctag

SEQ ID NO: 8462074 - DNA, 22 bp, Homo sapiens
aattccaaatcaactagtctag

SEQ ID NO: 8462075 - DNA, 22 bp, Homo sapiens
aattcatgagtagaatctatat

SEQ ID NO: 8462076 - DNA, 22 bp, Homo sapiens
agagctgagaatgtggcttcct

SEQ ID NO: 8462077 - DNA, 22 bp, Homo sapiens
agagctgagcaccaagcatggt

SEQ ID NO: 8462078 - DNA, 22 bp, Homo sapiens
agagctgaatttgggtggtgga

SEQ ID NO: 8462079 - DNA, 22 bp, Homo sapiens
agagctgaggatccagctgagc

SEQ ID NO: 8462080 - DNA, 22 bp, Homo sapiens
aatttcaattacttttgcacca

SEQ ID NO: 8462081 - DNA, 22 bp, Homo sapiens
agaggattcactgcagaagaca

SEQ ID NO: 8462082 - DNA, 22 bp, Homo sapiens
agaggatgttctaggcactcat

SEQ ID NO: 8462083 - DNA, 22 bp, Homo sapiens
agaggatgttctaggcactcat

SEQ ID NO: 8462084 - DNA, 22 bp, Homo sapiens
agaggagtgggaagcagtgcaa

SEQ ID NO: 8462085 - DNA, 22 bp, Homo sapiens
agaggagtttgctggtgtgtgc

SEQ ID NO: 8462086 - DNA, 18 bp, Homo sapiens
agaggatgcatctaagag

SEQ ID NO: 8462087 - DNA, 22 bp, Homo sapiens
agaggacaaaatgagaagtgct

SEQ ID NO: 8462088 - DNA, 22 bp, Homo sapiens
agaggaatttctggaaggaggc

SEQ ID NO: 8462089 - DNA, 22 bp, Homo sapiens
agaggaggtggtgatgctttaa

SEQ ID NO: 8462090 - DNA, 21 bp, Homo sapiens
agaggaagtgattggtctggc

SEQ ID NO: 8462091 - DNA, 22 bp, Homo sapiens
agaggaatgtatttccctgcaa

SEQ ID NO: 8462092 - DNA, 22 bp, Homo sapiens
agaggaagtaatcaggacctgc

SEQ ID NO: 8462093 - DNA, 22 bp, Homo sapiens
agaggaagtaatcaggacctgc

SEQ ID NO: 8462094 - DNA, 22 bp, Homo sapiens
agaggaagtaatcaggacctgc

SEQ ID NO: 8462095 - DNA, 22 bp, Homo sapiens
agagctgggtggtggtgactca

SEQ ID NO: 8462096 - DNA, 22 bp, Homo sapiens
agagctgggtggtggtgactca

SEQ ID NO: 8462097 - DNA, 22 bp, Homo sapiens
agaggaaggatgcatatccaaa

SEQ ID NO: 8462098 - DNA, 22 bp, Homo sapiens
aattccaacagacaaagttaga

SEQ ID NO: 8462099 - DNA, 22 bp, Homo sapiens
aattccaagagcttcctaagtg

SEQ ID NO: 8462100 - DNA, 22 bp, Homo sapiens
aattccaagagcttcctaagtg

SEQ ID NO: 8462101 - DNA, 22 bp, Homo sapiens
aattccaagtagcatcccatca

SEQ ID NO: 8462102 - DNA, 22 bp, Homo sapiens
aattccacagatgtctatctgt

SEQ ID NO: 8462103 - DNA, 22 bp, Homo sapiens
agacatcctggggagggcaatg

SEQ ID NO: 8462104 - DNA, 21 bp, Homo sapiens
aatgctgcccagtaagatggc

SEQ ID NO: 8462105 - DNA, 22 bp, Homo sapiens
agacatcttgcacacatatact

SEQ ID NO: 8462106 - DNA, 22 bp, Homo sapiens
agacatctctatgcaggatctc

SEQ ID NO: 8462107 - DNA, 22 bp, Homo sapiens
agacatctctatgcaggatctc

SEQ ID NO: 8462108 - DNA, 22 bp, Homo sapiens
agacatctacctttcattcaaa

SEQ ID NO: 8462109 - DNA, 22 bp, Homo sapiens
agacatctcccatgcattttta

SEQ ID NO: 8462110 - DNA, 22 bp, Homo sapiens
agacatgcaataatgtgcactc

SEQ ID NO: 8462111 - DNA, 22 bp, Homo sapiens
agacatgccaagaaacccagtg

SEQ ID NO: 8462112 - DNA, 22 bp, Homo sapiens
aatgccttggagagcctagagg

SEQ ID NO: 8462113 - DNA, 22 bp, Homo sapiens
aatgctcaaaatgtttcatcta

SEQ ID NO: 8462114 - DNA, 22 bp, Homo sapiens
agacattatggctttcactggg

SEQ ID NO: 8462115 - DNA, 22 bp, Homo sapiens
agacatttatgtttctctagga

SEQ ID NO: 8462116 - DNA, 22 bp, Homo sapiens
agacatgtggtataatcagggg

SEQ ID NO: 8462117 - DNA, 22 bp, Homo sapiens
aatgtattatacataatttgtg

SEQ ID NO: 8462118 - DNA, 22 bp, Homo sapiens
aatgtattatacataatttgtg

SEQ ID NO: 8462119 - DNA, 23 bp, Homo sapiens
agagcaaggaaatgaggtgtgat

SEQ ID NO: 8462120 - DNA, 22 bp, Homo sapiens
agagatttgtcaatgatttcca

SEQ ID NO: 8462121 - DNA, 22 bp, Homo sapiens
agagcaaatagagaagccagct

SEQ ID NO: 8462122 - DNA, 19 bp, Homo sapiens
agagaaggatcctatggtt

SEQ ID NO: 8462123 - DNA, 21 bp, Homo sapiens
agagaagggactcttccagtc

SEQ ID NO: 8462124 - DNA, 21 bp, Homo sapiens
agagaagggactcttccagtc

SEQ ID NO: 8462125 - DNA, 21 bp, Homo sapiens
agagaagggattccaggccct

SEQ ID NO: 8462126 - DNA, 22 bp, Homo sapiens
agagaaggggtaaagagtcctg

SEQ ID NO: 8462127 - DNA, 22 bp, Homo sapiens
acaacattcttaaatacactga

SEQ ID NO: 8462128 - DNA, 22 bp, Homo sapiens
acaacattcttaaatacactga

SEQ ID NO: 8462129 - DNA, 22 bp, Homo sapiens
agcaaaagatagattaacaaga

SEQ ID NO: 8462130 - DNA, 22 bp, Homo sapiens
acaacagtttaggtatttgtag

SEQ ID NO: 8462131 - DNA, 22 bp, Homo sapiens
acaacattatacatagaaagct

SEQ ID NO: 8462132 - DNA, 22 bp, Homo sapiens
acaacagtccagtatagactgt

SEQ ID NO: 8462133 - DNA, 22 bp, Homo sapiens
acaacagtgtggtggaaggagc

SEQ ID NO: 8462134 - DNA, 19 bp, Homo sapiens
agcaaatacatcaaaattg

SEQ ID NO: 8462135 - DNA, 23 bp, Homo sapiens
agcaaagttgttgctaacctcat

SEQ ID NO: 8462136 - DNA, 22 bp, Homo sapiens
agcaaagttaaggtttctcttt

SEQ ID NO: 8462137 - DNA, 22 bp, Homo sapiens
agcaaagtggctttccaaacca

SEQ ID NO: 8462138 - DNA, 22 bp, Homo sapiens
agcaaagtggctttccaaacca

SEQ ID NO: 8462139 - DNA, 22 bp, Homo sapiens
agcaaagtatgtgctgggagct

SEQ ID NO: 8462140 - DNA, 22 bp, Homo sapiens
agcaaagtcagtggaaccatcc

SEQ ID NO: 8462141 - DNA, 22 bp, Homo sapiens
agcaaagtagctgctgttctta

SEQ ID NO: 8462142 - DNA, 22 bp, Homo sapiens
agcaaagtcagtggaaccatcc

SEQ ID NO: 8462143 - DNA, 22 bp, Homo sapiens
acaataacttctgtttccttgc

SEQ ID NO: 8462144 - DNA, 22 bp, Homo sapiens
agcaaatacttgaataaaaaga

SEQ ID NO: 8462145 - DNA, 22 bp, Homo sapiens
agcaaatacatttttagcataa

SEQ ID NO: 8462146 - DNA, 22 bp, Homo sapiens
acaatactcatgctctttttct

SEQ ID NO: 8462147 - DNA, 22 bp, Homo sapiens
acaatacttaccaatgtttttg

SEQ ID NO: 8462148 - DNA, 20 bp, Homo sapiens
acaatacaggttgtgtctga

SEQ ID NO: 8462149 - DNA, 22 bp, Homo sapiens
acaatacaggcttctggactta

SEQ ID NO: 8462150 - DNA, 22 bp, Homo sapiens
acacaagaagttaatgggcaaa

SEQ ID NO: 8462151 - DNA, 21 bp, Homo sapiens
acacaacaggcagtcattttc

SEQ ID NO: 8462152 - DNA, 22 bp, Homo sapiens
acacaacagaagagcaattgca

SEQ ID NO: 8462153 - DNA, 22 bp, Homo sapiens
acacaacagaagagcaattgca

SEQ ID NO: 8462154 - DNA, 22 bp, Homo sapiens
acacaaattgtaggataattgc

SEQ ID NO: 8462155 - DNA, 22 bp, Homo sapiens
acacaaattgtaggataattgc

SEQ ID NO: 8462156 - DNA, 22 bp, Homo sapiens
acaattttccccataggttatc

SEQ ID NO: 8462157 - DNA, 22 bp, Homo sapiens
acaattttccccataggttatc

SEQ ID NO: 8462158 - DNA, 22 bp, Homo sapiens
agcacagggcccagcctaggcc

SEQ ID NO: 8462159 - DNA, 22 bp, Homo sapiens
agcacagggcccagcctaggcc

SEQ ID NO: 8462160 - DNA, 22 bp, Homo sapiens
agcacaggacgtagagcttgga

SEQ ID NO: 8462161 - DNA, 22 bp, Homo sapiens
agcacacaggacttgattcatg

SEQ ID NO: 8462162 - DNA, 22 bp, Homo sapiens
agcacacaggccacctccactt

SEQ ID NO: 8462163 - DNA, 22 bp, Homo sapiens
agcacagaaagtattgactgaa

SEQ ID NO: 8462164 - DNA, 22 bp, Homo sapiens
agcacacaggacttgattcatg

SEQ ID NO: 8462165 - DNA, 22 bp, Homo sapiens
agcacacatcacttctgctcat

SEQ ID NO: 8462166 - DNA, 22 bp, Homo sapiens
agcacaggaacatggagatggg

SEQ ID NO: 8462167 - DNA, 22 bp, Homo sapiens
agcacagaatggcttggaagcc

SEQ ID NO: 8462168 - DNA, 22 bp, Homo sapiens
agcacagaatgaggtggaagtg

SEQ ID NO: 8462169 - DNA, 22 bp, Homo sapiens
aatttggagagaaacaagtagg

SEQ ID NO: 8462170 - DNA, 22 bp, Homo sapiens
aatttggagctttgtttctaga

SEQ ID NO: 8462171 - DNA, 18 bp, Homo sapiens
aatttctttgacaactta

SEQ ID NO: 8462172 - DNA, 22 bp, Homo sapiens
aatttgattcagcaaatgttca

SEQ ID NO: 8462173 - DNA, 22 bp, Homo sapiens
aatttcttcagctctaaaatgg

SEQ ID NO: 8462174 - DNA, 22 bp, Homo sapiens
aatttctgtatgaatagagaaa

SEQ ID NO: 8462175 - DNA, 22 bp, Homo sapiens
aatttcttcagctctaaaatgg

SEQ ID NO: 8462176 - DNA, 22 bp, Homo sapiens
aatttcttcagctctaaaatgg

SEQ ID NO: 8462177 - DNA, 22 bp, Homo sapiens
aatttcttcagctctaaaatgg

SEQ ID NO: 8462178 - DNA, 20 bp, Homo sapiens
agagtgggtgtcacaggctg

SEQ ID NO: 8462179 - DNA, 20 bp, Homo sapiens
agagtgggtgtcacaggctg

SEQ ID NO: 8462180 - DNA, 20 bp, Homo sapiens
agagtgggtgtcacaggctg

SEQ ID NO: 8462181 - DNA, 22 bp, Homo sapiens
agagtgggttataggcagactt

SEQ ID NO: 8462182 - DNA, 22 bp, Homo sapiens
aatttggcagtgtcttgaagta

SEQ ID NO: 8462183 - DNA, 22 bp, Homo sapiens
agagtgaagttcatcgtgcagc

SEQ ID NO: 8462184 - DNA, 22 bp, Homo sapiens
agagttactgcagagatgaata

SEQ ID NO: 8462185 - DNA, 21 bp, Homo sapiens
agagttactgtcatcctaggt

SEQ ID NO: 8462186 - DNA, 22 bp, Homo sapiens
agagttaaggccactgtcagta

SEQ ID NO: 8462187 - DNA, 22 bp, Homo sapiens
agagtgtttcagtcttcctaga

SEQ ID NO: 8462188 - DNA, 22 bp, Homo sapiens
agagtgtgttccccaagaaaga

SEQ ID NO: 8462189 - DNA, 22 bp, Homo sapiens
agagtgtaccaaatatcctaca

SEQ ID NO: 8462190 - DNA, 22 bp, Homo sapiens
agatctttagaagatagaatca

SEQ ID NO: 8462191 - DNA, 22 bp, Homo sapiens
agatctttagaagatagaatca

SEQ ID NO: 8462192 - DNA, 22 bp, Homo sapiens
agatctttagtgaagctaaatc

SEQ ID NO: 8462193 - DNA, 20 bp, Homo sapiens
agatcttttctatagaagtg

SEQ ID NO: 8462194 - DNA, 22 bp, Homo sapiens
agatctttagtgaagctaaatc

SEQ ID NO: 8462195 - DNA, 16 bp, Homo sapiens
acaaatacaactgctg

SEQ ID NO: 8462196 - DNA, 22 bp, Homo sapiens
acaaatagagattcaaataaag

SEQ ID NO: 8462197 - DNA, 22 bp, Homo sapiens
acaaatagagattcaaataaag

SEQ ID NO: 8462198 - DNA, 22 bp, Homo sapiens
acaaagttaacagttggatagt

SEQ ID NO: 8462199 - DNA, 22 bp, Homo sapiens
acaaagtgttttctgaaggcct

SEQ ID NO: 8462200 - DNA, 22 bp, Homo sapiens
acaaagtgtgcggagcccaggg

SEQ ID NO: 8462201 - DNA, 22 bp, Homo sapiens
acaaagtgtgcggagcccaggg

SEQ ID NO: 8462202 - DNA, 22 bp, Homo sapiens
acaaagttattctttcagagga

SEQ ID NO: 8462203 - DNA, 22 bp, Homo sapiens
acaaagtttgtggtattccaag

SEQ ID NO: 8462204 - DNA, 22 bp, Homo sapiens
acaaagtgcacaagatgagaac

SEQ ID NO: 8462205 - DNA, 19 bp, Homo sapiens
acaaagtgcgtgctctttt

SEQ ID NO: 8462206 - DNA, 22 bp, Homo sapiens
acaaagtatttttaggtttgta

SEQ ID NO: 8462207 - DNA, 22 bp, Homo sapiens
acaacagtaggaaaacatgtct

SEQ ID NO: 8462208 - DNA, 22 bp, Homo sapiens
acaacagtagcctttacaaggc

SEQ ID NO: 8462209 - DNA, 21 bp, Homo sapiens
agatgctgatgctgcaggtcc

SEQ ID NO: 8462210 - DNA, 22 bp, Homo sapiens
agatgctgattgaatagatttc

SEQ ID NO: 8462211 - DNA, 22 bp, Homo sapiens
agatgctgaagctgaggcaaca

SEQ ID NO: 8462212 - DNA, 22 bp, Homo sapiens
agatgctgctccacaggccagg

SEQ ID NO: 8462213 - DNA, 21 bp, Homo sapiens
agatgcagtttgcaggtgggt

SEQ ID NO: 8462214 - DNA, 22 bp, Homo sapiens
agatgcctgccagttatttagc

SEQ ID NO: 8462215 - DNA, 20 bp, Homo sapiens
agatcttttctatagaagtg

SEQ ID NO: 8462216 - DNA, 22 bp, Homo sapiens
agatgcagacttggttcaggca

SEQ ID NO: 8462217 - DNA, 22 bp, Homo sapiens
agatgcagagtttgctgtggac

SEQ ID NO: 8462218 - DNA, 21 bp, Homo sapiens
agatgcagtgacccactgggg

SEQ ID NO: 8462219 - DNA, 21 bp, Homo sapiens
agatgcagttatgagatgcag

SEQ ID NO: 8462220 - DNA, 22 bp, Homo sapiens
acacagtattgtgactataact

SEQ ID NO: 8462221 - DNA, 20 bp, Homo sapiens
acacagtgacaggaaagaga

SEQ ID NO: 8462222 - DNA, 22 bp, Homo sapiens
acacagtggtgagtctggacct

SEQ ID NO: 8462223 - DNA, 18 bp, Homo sapiens
acacagtggatgcctggt

SEQ ID NO: 8462224 - DNA, 18 bp, Homo sapiens
acacagtggatgcctggt

SEQ ID NO: 8462225 - DNA, 22 bp, Homo sapiens
acacagtggtgtttacaaaatt

SEQ ID NO: 8462226 - DNA, 22 bp, Homo sapiens
acacagtggtgtttacaaaatt

SEQ ID NO: 8462227 - DNA, 22 bp, Homo sapiens
acacagtgtccttctacttgcc

SEQ ID NO: 8462228 - DNA, 22 bp, Homo sapiens
acacacacaagcaggttgtgga

SEQ ID NO: 8462229 - DNA, 22 bp, Homo sapiens
acacacaattagttttatgctt

SEQ ID NO: 8462230 - DNA, 22 bp, Homo sapiens
acacaatgtgcaggacacctgt

SEQ ID NO: 8462231 - DNA, 22 bp, Homo sapiens
acacaagaataatgatgaaggt

SEQ ID NO: 8462232 - DNA, 20 bp, Homo sapiens
acacaagcacttctggtatt

SEQ ID NO: 8462233 - DNA, 19 bp, Homo sapiens
acacaatgacacatatata

SEQ ID NO: 8462234 - DNA, 22 bp, Homo sapiens
agcaggctttccacagaaggag

SEQ ID NO: 8462235 - DNA, 22 bp, Homo sapiens
agcaggcttgttatgtctgaga

SEQ ID NO: 8462236 - DNA, 21 bp, Homo sapiens
agcaggctttggagtggggct

SEQ ID NO: 8462237 - DNA, 22 bp, Homo sapiens
agcaggctttccacagaaggag

SEQ ID NO: 8462238 - DNA, 22 bp, Homo sapiens
agcaggctttccacagaaggag

SEQ ID NO: 8462239 - DNA, 22 bp, Homo sapiens
agcaggcttggtccccagcctc

SEQ ID NO: 8462240 - DNA, 19 bp, Homo sapiens
agcaggccacagggccagc

SEQ ID NO: 8462241 - DNA, 22 bp, Homo sapiens
acacagtttttcagacagagat

SEQ ID NO: 8462242 - DNA, 22 bp, Homo sapiens
agcagggactgagccagtggga

SEQ ID NO: 8462243 - DNA, 22 bp, Homo sapiens
acacatattcatatgtacttac

SEQ ID NO: 8462244 - DNA, 22 bp, Homo sapiens
acacatatgtcattgaaaaatc

SEQ ID NO: 8462245 - DNA, 22 bp, Homo sapiens
acacatatgtggcaactgtaga

SEQ ID NO: 8462246 - DNA, 22 bp, Homo sapiens
acacatctatattgcatctgca

SEQ ID NO: 8462247 - DNA, 22 bp, Homo sapiens
acacatctcaggggacactctc

SEQ ID NO: 8462248 - DNA, 22 bp, Homo sapiens
acacatctatctctacacaagg

SEQ ID NO: 8462249 - DNA, 22 bp, Homo sapiens
agcaggtgagcacagccaggct

SEQ ID NO: 8462250 - DNA, 22 bp, Homo sapiens
acacatctccagaagtgggctg

SEQ ID NO: 8462251 - DNA, 22 bp, Homo sapiens
agcaggtgagcacagccaggct

SEQ ID NO: 8462252 - DNA, 22 bp, Homo sapiens
acacatctcaggggacactctc

SEQ ID NO: 8462253 - DNA, 22 bp, Homo sapiens
agccagagattgagatgcaggc

SEQ ID NO: 8462254 - DNA, 22 bp, Homo sapiens
agccagaggaagcctggccctc

SEQ ID NO: 8462255 - DNA, 22 bp, Homo sapiens
agccagagatccatccctagga

SEQ ID NO: 8462256 - DNA, 22 bp, Homo sapiens
agccagagattgagatgcaggc

SEQ ID NO: 8462257 - DNA, 22 bp, Homo sapiens
acactgtgtttacatagagaat

SEQ ID NO: 8462258 - DNA, 22 bp, Homo sapiens
acactgttctttgcactgagaa

SEQ ID NO: 8462259 - DNA, 22 bp, Homo sapiens
acactgttctttgcactgagaa

SEQ ID NO: 8462260 - DNA, 20 bp, Homo sapiens
acactgttcttcacacattt

SEQ ID NO: 8462261 - DNA, 22 bp, Homo sapiens
acacttatttttgtccacttcc

SEQ ID NO: 8462262 - DNA, 22 bp, Homo sapiens
agccagctgtgggctcaggcgg

SEQ ID NO: 8462263 - DNA, 19 bp, Homo sapiens
agccagagtggcccagggg

SEQ ID NO: 8462264 - DNA, 22 bp, Homo sapiens
agccagctggagaccactgttt

SEQ ID NO: 8462265 - DNA, 22 bp, Homo sapiens
agccagagggatctttctaaga

SEQ ID NO: 8462266 - DNA, 22 bp, Homo sapiens
agccagaggccagcctgcctca

SEQ ID NO: 8462267 - DNA, 22 bp, Homo sapiens
acacccagagcgccagtgccga

SEQ ID NO: 8462268 - DNA, 21 bp, Homo sapiens
agcaggtgtaaaggaggaaat

SEQ ID NO: 8462269 - DNA, 22 bp, Homo sapiens
agcaggtggtaggcagtcagca

SEQ ID NO: 8462270 - DNA, 22 bp, Homo sapiens
agcaggtggtaggcagtcagca

SEQ ID NO: 8462271 - DNA, 22 bp, Homo sapiens
agcaggtggtaggcagtcagca

SEQ ID NO: 8462272 - DNA, 22 bp, Homo sapiens
acacccagctgggccacctcca

SEQ ID NO: 8462273 - DNA, 22 bp, Homo sapiens
acacccagattatgcacacaaa

SEQ ID NO: 8462274 - DNA, 22 bp, Homo sapiens
agccaagggtcagctgcacaga

SEQ ID NO: 8462275 - DNA, 22 bp, Homo sapiens
acactgtgtgacttctgagact

SEQ ID NO: 8462276 - DNA, 22 bp, Homo sapiens
acagagctgtacatgtgccatg

SEQ ID NO: 8462277 - DNA, 22 bp, Homo sapiens
acagagctgtacatgtgccatg

SEQ ID NO: 8462278 - DNA, 22 bp, Homo sapiens
acagagctgtacatgtgccatg

SEQ ID NO: 8462279 - DNA, 22 bp, Homo sapiens
acagaattaaagtgtttgtgga

SEQ ID NO: 8462280 - DNA, 22 bp, Homo sapiens
acagaattaacatttgatgaat

SEQ ID NO: 8462281 - DNA, 22 bp, Homo sapiens
acagaggcagtgtgagatactg

SEQ ID NO: 8462282 - DNA, 17 bp, Homo sapiens
acagaggcaggagtgga

SEQ ID NO: 8462283 - DNA, 22 bp, Homo sapiens
acagaggccatgagctgccacc

SEQ ID NO: 8462284 - DNA, 22 bp, Homo sapiens
acagaggccatgagctgccacc

SEQ ID NO: 8462285 - DNA, 22 bp, Homo sapiens
acagaggccatgagctgccacc

SEQ ID NO: 8462286 - DNA, 22 bp, Homo sapiens
acagaatattgtaagtgccact

SEQ ID NO: 8462287 - DNA, 22 bp, Homo sapiens
acagaatattggttactgttgc

SEQ ID NO: 8462288 - DNA, 22 bp, Homo sapiens
acagaatattttatttagatca

SEQ ID NO: 8462289 - DNA, 22 bp, Homo sapiens
acagaatatttggcatgcgtct

SEQ ID NO: 8462290 - DNA, 22 bp, Homo sapiens
acagaatgcgtagtgcatgttg

SEQ ID NO: 8462291 - DNA, 22 bp, Homo sapiens
acagaataggtacagtcagtca

SEQ ID NO: 8462292 - DNA, 22 bp, Homo sapiens
acagaatactcataagaagggg

SEQ ID NO: 8462293 - DNA, 22 bp, Homo sapiens
acagaatagagactgcctgctc

SEQ ID NO: 8462294 - DNA, 22 bp, Homo sapiens
acagaatagttggccctgctat

SEQ ID NO: 8462295 - DNA, 22 bp, Homo sapiens
acagaatagtcagctgtaggcc

SEQ ID NO: 8462296 - DNA, 22 bp, Homo sapiens
acagaatagtagcttaaagtca

SEQ ID NO: 8462297 - DNA, 20 bp, Homo sapiens
acagaatatgctggttgtgg

SEQ ID NO: 8462298 - DNA, 22 bp, Homo sapiens
acagaagtgtctttttcattca

SEQ ID NO: 8462299 - DNA, 21 bp, Homo sapiens
acagaagtggcttggtctcag

SEQ ID NO: 8462300 - DNA, 22 bp, Homo sapiens
acagaagtggcttcaaagagca

SEQ ID NO: 8462301 - DNA, 22 bp, Homo sapiens
acagaagtgtgtgtgtaggaat

SEQ ID NO: 8462302 - DNA, 22 bp, Homo sapiens
acagaataactcttgcttgagt

SEQ ID NO: 8462303 - DNA, 22 bp, Homo sapiens
acagaatactacagactggtta

SEQ ID NO: 8462304 - DNA, 23 bp, Homo sapiens
acagaataccattgactaggtgt

SEQ ID NO: 8462305 - DNA, 22 bp, Homo sapiens
acagaataaggtttatctctcc

SEQ ID NO: 8462306 - DNA, 22 bp, Homo sapiens
acagaagtgacaatttcttggg

SEQ ID NO: 8462307 - DNA, 22 bp, Homo sapiens
acagaagctcaagagagcagtg

SEQ ID NO: 8462308 - DNA, 22 bp, Homo sapiens
acagaacttccagggaacatac

SEQ ID NO: 8462309 - DNA, 22 bp, Homo sapiens
acagaacttccagggaacatac

SEQ ID NO: 8462310 - DNA, 22 bp, Homo sapiens
agcggctggaccagcgttcaag

SEQ ID NO: 8462311 - DNA, 22 bp, Homo sapiens
agcggctgctcttttcagatcc

SEQ ID NO: 8462312 - DNA, 22 bp, Homo sapiens
agcggctgctccgcaggctggc

SEQ ID NO: 8462313 - DNA, 22 bp, Homo sapiens
agccttcactgggaccttggat

SEQ ID NO: 8462314 - DNA, 22 bp, Homo sapiens
agccttagggattgaggttgct

SEQ ID NO: 8462315 - DNA, 22 bp, Homo sapiens
agccttcaacctagctagagca

SEQ ID NO: 8462316 - DNA, 16 bp, Homo sapiens
agccttaggaacagcc

SEQ ID NO: 8462317 - DNA, 22 bp, Homo sapiens
agccttagatttgggcaagaac

SEQ ID NO: 8462318 - DNA, 22 bp, Homo sapiens
agcggtcaggagaaataagcat

SEQ ID NO: 8462319 - DNA, 22 bp, Homo sapiens
agcgggtctgcaagccttccct

SEQ ID NO: 8462320 - DNA, 22 bp, Homo sapiens
agctaaatgtgaaatgtcaacc

SEQ ID NO: 8462321 - DNA, 22 bp, Homo sapiens
acagataattagcataaatgct

SEQ ID NO: 8462322 - DNA, 22 bp, Homo sapiens
agcgtgaattagttggtacaca

SEQ ID NO: 8462323 - DNA, 21 bp, Homo sapiens
agcgtcaatatcgtcaacagg

SEQ ID NO: 8462324 - DNA, 22 bp, Homo sapiens
agcgtatgaatatttgaagaga

SEQ ID NO: 8462325 - DNA, 19 bp, Homo sapiens
acagagggcaactgagaaa

SEQ ID NO: 8462326 - DNA, 22 bp, Homo sapiens
acagagggtctgggcacaggac

SEQ ID NO: 8462327 - DNA, 23 bp, Homo sapiens
acagaggcttaaatgagtggcag

SEQ ID NO: 8462328 - DNA, 22 bp, Homo sapiens
acagaggcctcgtaggtacaac

SEQ ID NO: 8462329 - DNA, 22 bp, Homo sapiens
acagaggctgatcttcaagccc

SEQ ID NO: 8462330 - DNA, 22 bp, Homo sapiens
acagaggccgcctctctcacgg

SEQ ID NO: 8462331 - DNA, 22 bp, Homo sapiens
acagaggccgcctctctcacgg

SEQ ID NO: 8462332 - DNA, 22 bp, Homo sapiens
acagaggccccgtgggagagcc

SEQ ID NO: 8462333 - DNA, 22 bp, Homo sapiens
acagaggcctcgtaggtacaac

SEQ ID NO: 8462334 - DNA, 22 bp, Homo sapiens
acagaggcctcggcctgcccag

SEQ ID NO: 8462335 - DNA, 22 bp, Homo sapiens
agctgaggttagtataaatgtg

SEQ ID NO: 8462336 - DNA, 22 bp, Homo sapiens
agctgaggttagtataaatgtg

SEQ ID NO: 8462337 - DNA, 23 bp, Homo sapiens
agctgaggtgcagatccaaagaa

SEQ ID NO: 8462338 - DNA, 21 bp, Homo sapiens
agctgaggtaaggcaagagag

SEQ ID NO: 8462339 - DNA, 22 bp, Homo sapiens
agctgaggttgaagagtgaacg

SEQ ID NO: 8462340 - DNA, 22 bp, Homo sapiens
agctgagggttcggtgtccaca

SEQ ID NO: 8462341 - DNA, 18 bp, Homo sapiens
agctgaggggactgaaga

SEQ ID NO: 8462342 - DNA, 22 bp, Homo sapiens
agctgagattatgctcttctca

SEQ ID NO: 8462343 - DNA, 22 bp, Homo sapiens
agctgagcacattcaaacaggt

SEQ ID NO: 8462344 - DNA, 22 bp, Homo sapiens
agctgagcacattcaaacaggt

SEQ ID NO: 8462345 - DNA, 22 bp, Homo sapiens
acagcagccttgttggtttcga

SEQ ID NO: 8462346 - DNA, 21 bp, Homo sapiens
acagcagggctggcatgacag

SEQ ID NO: 8462347 - DNA, 22 bp, Homo sapiens
acagcaggttattgttatggca

SEQ ID NO: 8462348 - DNA, 18 bp, Homo sapiens
acagcaggtttcattctt

SEQ ID NO: 8462349 - DNA, 22 bp, Homo sapiens
acagcaggttttaactttgaag

SEQ ID NO: 8462350 - DNA, 22 bp, Homo sapiens
acagcaggttttaactttgaag

SEQ ID NO: 8462351 - DNA, 22 bp, Homo sapiens
acagcagggaatatgggaattg

SEQ ID NO: 8462352 - DNA, 22 bp, Homo sapiens
acagcagggaatatgggaattg

SEQ ID NO: 8462353 - DNA, 19 bp, Homo sapiens
acagcagggatttttggag

SEQ ID NO: 8462354 - DNA, 17 bp, Homo sapiens
acagcagggaagtgttg

SEQ ID NO: 8462355 - DNA, 17 bp, Homo sapiens
acagcagggaagtgttg

SEQ ID NO: 8462356 - DNA, 17 bp, Homo sapiens
acagcaggcccggaggg

SEQ ID NO: 8462357 - DNA, 22 bp, Homo sapiens
acagcaggcccatactggaagg

SEQ ID NO: 8462358 - DNA, 22 bp, Homo sapiens
acagcagccagccactgtgagc

SEQ ID NO: 8462359 - DNA, 22 bp, Homo sapiens
acagcagcatcctatttcactc

SEQ ID NO: 8462360 - DNA, 22 bp, Homo sapiens
acagcagcaatagcagtgacat

SEQ ID NO: 8462361 - DNA, 22 bp, Homo sapiens
acagcagatttccctgggctcc

SEQ ID NO: 8462362 - DNA, 22 bp, Homo sapiens
acagcagatctgtggagcttat

SEQ ID NO: 8462363 - DNA, 22 bp, Homo sapiens
acagatattatggtttctcctt

SEQ ID NO: 8462364 - DNA, 22 bp, Homo sapiens
acagatacaaatatacaaatac

SEQ ID NO: 8462365 - DNA, 22 bp, Homo sapiens
acagcagagtgtgagatagcca

SEQ ID NO: 8462366 - DNA, 22 bp, Homo sapiens
acagcagagtgtgagatagcca

SEQ ID NO: 8462367 - DNA, 22 bp, Homo sapiens
acagcagagtggagatgagcac

SEQ ID NO: 8462368 - DNA, 22 bp, Homo sapiens
acagcagaccccagtgccatgg

SEQ ID NO: 8462369 - DNA, 22 bp, Homo sapiens
acagcagagttgagtagttgca

SEQ ID NO: 8462370 - DNA, 22 bp, Homo sapiens
acagcagatctggctacaggtt

SEQ ID NO: 8462371 - DNA, 23 bp, Homo sapiens
aaatgacatatggtttctgaagg

SEQ ID NO: 8462372 - DNA, 22 bp, Homo sapiens
aaatgagtagcgatgcacatta

SEQ ID NO: 8462373 - DNA, 22 bp, Homo sapiens
aaatgaggttaatacagtgctt

SEQ ID NO: 8462374 - DNA, 23 bp, Homo sapiens
aaatgactaaatgttcttataga

SEQ ID NO: 8462375 - DNA, 22 bp, Homo sapiens
aaatgagtttgcctctagatag

SEQ ID NO: 8462376 - DNA, 23 bp, Homo sapiens
aaatgacatatggtttctgaagg

SEQ ID NO: 8462377 - DNA, 22 bp, Homo sapiens
aaatcaaaagacatgtgtttta

SEQ ID NO: 8462378 - DNA, 22 bp, Homo sapiens
aaatcaaaagacatgtgtttta

SEQ ID NO: 8462379 - DNA, 22 bp, Homo sapiens
aaatcaaaagacatgtgtttta

SEQ ID NO: 8462380 - DNA, 22 bp, Homo sapiens
aaatatttgtctgaggcggttg

SEQ ID NO: 8462381 - DNA, 22 bp, Homo sapiens
aaatcaaaagacatgtgtttta

SEQ ID NO: 8462382 - DNA, 22 bp, Homo sapiens
aaatattggtaggatgcttgtt

SEQ ID NO: 8462383 - DNA, 23 bp, Homo sapiens
aaatattcttttttagtaagtgc

SEQ ID NO: 8462384 - DNA, 22 bp, Homo sapiens
aaatcacagggtctctaagtat

SEQ ID NO: 8462385 - DNA, 22 bp, Homo sapiens
aaatcacagggtctctaagtat

SEQ ID NO: 8462386 - DNA, 22 bp, Homo sapiens
aaatcagaaaatatggagagga

SEQ ID NO: 8462387 - DNA, 22 bp, Homo sapiens
aaatcactgttattgatcttaa

SEQ ID NO: 8462388 - DNA, 22 bp, Homo sapiens
aaatcactgattaaagttagaa

SEQ ID NO: 8462389 - DNA, 22 bp, Homo sapiens
aaatgatggaaatgaggctgaa

SEQ ID NO: 8462390 - DNA, 20 bp, Homo sapiens
aaatgatgggaataatctat

SEQ ID NO: 8462391 - DNA, 22 bp, Homo sapiens
aaatgcaaggattttgttaggc

SEQ ID NO: 8462392 - DNA, 22 bp, Homo sapiens
aaatgcaaggcacattcctttt

SEQ ID NO: 8462393 - DNA, 22 bp, Homo sapiens
aaatgcaaggccatgtgaagga

SEQ ID NO: 8462394 - DNA, 22 bp, Homo sapiens
aaatgccaaggagagactgtta

SEQ ID NO: 8462395 - DNA, 22 bp, Homo sapiens
aaatgcaattcaggaagacaag

SEQ ID NO: 8462396 - DNA, 21 bp, Homo sapiens
aaatgctttgtatatatctgt

SEQ ID NO: 8462397 - DNA, 22 bp, Homo sapiens
aaatgctttggtgctggtacag

SEQ ID NO: 8462398 - DNA, 22 bp, Homo sapiens
aaatgcttgctcttgattattt

SEQ ID NO: 8462399 - DNA, 22 bp, Homo sapiens
aaatgcttgcaacatcccaggt

SEQ ID NO: 8462400 - DNA, 22 bp, Homo sapiens
aaatgcttcacctcattaaact

SEQ ID NO: 8462401 - DNA, 22 bp, Homo sapiens
aaatgcttcacctcattaaact

SEQ ID NO: 8462402 - DNA, 21 bp, Homo sapiens
aaatgctttgtatatatctgt

SEQ ID NO: 8462403 - DNA, 20 bp, Homo sapiens
aaatgcttttgacacatatt

SEQ ID NO: 8462404 - DNA, 19 bp, Homo sapiens
aaatgctgtggagggctcc

SEQ ID NO: 8462405 - DNA, 22 bp, Homo sapiens
aaatgctgttcttttaggtaga

SEQ ID NO: 8462406 - DNA, 22 bp, Homo sapiens
aaatgcttattagtgtcacaaa

SEQ ID NO: 8462407 - DNA, 22 bp, Homo sapiens
aaatgcttattagtgtcacaaa

SEQ ID NO: 8462408 - DNA, 22 bp, Homo sapiens
aaatgcttagaggtgttcaaat

SEQ ID NO: 8462409 - DNA, 22 bp, Homo sapiens
aaatgctgcagctagtgtgttt

SEQ ID NO: 8462410 - DNA, 22 bp, Homo sapiens
aaatgctgggaaccattggatc

SEQ ID NO: 8462411 - DNA, 22 bp, Homo sapiens
aaatgctgtcagtgttattgga

SEQ ID NO: 8462412 - DNA, 22 bp, Homo sapiens
aaatgctgtagatcagtgagtt

SEQ ID NO: 8462413 - DNA, 22 bp, Homo sapiens
aaatacatacactgtacgtggc

SEQ ID NO: 8462414 - DNA, 22 bp, Homo sapiens
aaatacatacactgtacgtggc

SEQ ID NO: 8462415 - DNA, 22 bp, Homo sapiens
aaatacataaaggttgtaccag

SEQ ID NO: 8462416 - DNA, 22 bp, Homo sapiens
aaatacataaaggttgtaccag

SEQ ID NO: 8462417 - DNA, 22 bp, Homo sapiens
aaatacatacactgtacgtggc

SEQ ID NO: 8462418 - DNA, 22 bp, Homo sapiens
aaatacattagacggagagtta

SEQ ID NO: 8462419 - DNA, 22 bp, Homo sapiens
aaatacagtgtgtgttctttga

SEQ ID NO: 8462420 - DNA, 22 bp, Homo sapiens
aaatacagtgtgtgttctttga

SEQ ID NO: 8462421 - DNA, 22 bp, Homo sapiens
aaatacagtggcagcagataat

SEQ ID NO: 8462422 - DNA, 22 bp, Homo sapiens
aagaagttaaataaatggacca

SEQ ID NO: 8462423 - DNA, 22 bp, Homo sapiens
aaatacaaaaattagccaggca

SEQ ID NO: 8462424 - DNA, 22 bp, Homo sapiens
aaatacaaaaattagccaggca

SEQ ID NO: 8462425 - DNA, 22 bp, Homo sapiens
aaatacaaaaattagccaggca

SEQ ID NO: 8462426 - DNA, 22 bp, Homo sapiens
aagaagtctggagcaatgcaat

SEQ ID NO: 8462427 - DNA, 19 bp, Homo sapiens
aaatacagcagctgtttcc

SEQ ID NO: 8462428 - DNA, 22 bp, Homo sapiens
aaatacagattctgactcagag

SEQ ID NO: 8462429 - DNA, 19 bp, Homo sapiens
aaagttgagaaacaatgga

SEQ ID NO: 8462430 - DNA, 19 bp, Homo sapiens
aaagttgagaaacaatgga

SEQ ID NO: 8462431 - DNA, 22 bp, Homo sapiens
aaagttctttttctataaatcc

SEQ ID NO: 8462432 - DNA, 22 bp, Homo sapiens
aaagttgaccgaaagattttga

SEQ ID NO: 8462433 - DNA, 22 bp, Homo sapiens
aaagttctttttctataaatcc

SEQ ID NO: 8462434 - DNA, 22 bp, Homo sapiens
aaagttgttcagtaagaaactc

SEQ ID NO: 8462435 - DNA, 22 bp, Homo sapiens
aagaagcagctgccaggccagt

SEQ ID NO: 8462436 - DNA, 22 bp, Homo sapiens
aagaagcagctgccaggccagt

SEQ ID NO: 8462437 - DNA, 22 bp, Homo sapiens
aagaagcagagctgtgggtgtt

SEQ ID NO: 8462438 - DNA, 22 bp, Homo sapiens
aagaagcatggctgtagattcc

SEQ ID NO: 8462439 - DNA, 22 bp, Homo sapiens
aagaagcattctttcattggtt

SEQ ID NO: 8462440 - DNA, 22 bp, Homo sapiens
aagaagctaagactatctgggt

SEQ ID NO: 8462441 - DNA, 22 bp, Homo sapiens
aagaagcaggtcacagacaggg

SEQ ID NO: 8462442 - DNA, 22 bp, Homo sapiens
aagaagcagctgccaggccagt

SEQ ID NO: 8462443 - DNA, 22 bp, Homo sapiens
aaatatagtgacacttatagtc

SEQ ID NO: 8462444 - DNA, 22 bp, Homo sapiens
aagagtttctgggtcaaggatt

SEQ ID NO: 8462445 - DNA, 22 bp, Homo sapiens
aagagtttcttactggcatcta

SEQ ID NO: 8462446 - DNA, 22 bp, Homo sapiens
aagagtttctttattaaccttt

SEQ ID NO: 8462447 - DNA, 22 bp, Homo sapiens
aagagtttctgattcagtaggt

SEQ ID NO: 8462448 - DNA, 22 bp, Homo sapiens
aagagtttccatgctctgtgct

SEQ ID NO: 8462449 - DNA, 22 bp, Homo sapiens
aagagtttgggcaagtcataaa

SEQ ID NO: 8462450 - DNA, 22 bp, Homo sapiens
aagagtttgtcagatctgcacg

SEQ ID NO: 8462451 - DNA, 22 bp, Homo sapiens
aagagtttgacctgtgccatcc

SEQ ID NO: 8462452 - DNA, 22 bp, Homo sapiens
aagagtttgacctgtgccatcc

SEQ ID NO: 8462453 - DNA, 22 bp, Homo sapiens
aagagtttgtcagatctgcacg

SEQ ID NO: 8462454 - DNA, 22 bp, Homo sapiens
aagagttttctataatcttggc

SEQ ID NO: 8462455 - DNA, 22 bp, Homo sapiens
aagagtttttggagtgtgagtt

SEQ ID NO: 8462456 - DNA, 22 bp, Homo sapiens
aagagtttttggagtgtgagtt

SEQ ID NO: 8462457 - DNA, 22 bp, Homo sapiens
aagagttttctctgatggcatt

SEQ ID NO: 8462458 - DNA, 22 bp, Homo sapiens
aagagttttctctgatggcatt

SEQ ID NO: 8462459 - DNA, 22 bp, Homo sapiens
aaatagtaaagtggtagccatc

SEQ ID NO: 8462460 - DNA, 22 bp, Homo sapiens
aaatagtaaagtggtagccatc

SEQ ID NO: 8462461 - DNA, 22 bp, Homo sapiens
aaatagtcctgggaatagtact

SEQ ID NO: 8462462 - DNA, 22 bp, Homo sapiens
aaatataccagttgcctgcatc

SEQ ID NO: 8462463 - DNA, 22 bp, Homo sapiens
aaatatacggtccctaacagtc

SEQ ID NO: 8462464 - DNA, 22 bp, Homo sapiens
aagagagacaataggtagcatt

SEQ ID NO: 8462465 - DNA, 22 bp, Homo sapiens
aagagagacaataggtagcatt

SEQ ID NO: 8462466 - DNA, 22 bp, Homo sapiens
aaataggggaccaggaaaggag

SEQ ID NO: 8462467 - DNA, 22 bp, Homo sapiens
aacttctgccaaacagctgtta

SEQ ID NO: 8462468 - DNA, 22 bp, Homo sapiens
aacttctgccaaacagctgtta

SEQ ID NO: 8462469 - DNA, 22 bp, Homo sapiens
aacttctgccaaacagctgtta

SEQ ID NO: 8462470 - DNA, 22 bp, Homo sapiens
aacttctggatgtttcaaatgt

SEQ ID NO: 8462471 - DNA, 22 bp, Homo sapiens
aacttctgggctgtccaaaact

SEQ ID NO: 8462472 - DNA, 22 bp, Homo sapiens
aacttctgacctcaagaactgt

SEQ ID NO: 8462473 - DNA, 22 bp, Homo sapiens
aacttctaatctgtacagtttt

SEQ ID NO: 8462474 - DNA, 22 bp, Homo sapiens
aacttgaaactgttccagaaaa

SEQ ID NO: 8462475 - DNA, 22 bp, Homo sapiens
aacttgaaactgttccagaaaa

SEQ ID NO: 8462476 - DNA, 22 bp, Homo sapiens
aacttgaaaacctcatgaattg

SEQ ID NO: 8462477 - DNA, 22 bp, Homo sapiens
aacttctttgagctccagtttt

SEQ ID NO: 8462478 - DNA, 22 bp, Homo sapiens
aacttgaaccacagaagctgcc

SEQ ID NO: 8462479 - DNA, 22 bp, Homo sapiens
aaagttctctatggtgtaaaaa

SEQ ID NO: 8462480 - DNA, 22 bp, Homo sapiens
aaagttctggagaaaataatga

SEQ ID NO: 8462481 - DNA, 22 bp, Homo sapiens
aaagtcctgtttgaaggacctg

SEQ ID NO: 8462482 - DNA, 22 bp, Homo sapiens
aaagtcctttttgccatgcaag

SEQ ID NO: 8462483 - DNA, 22 bp, Homo sapiens
aaagtcctagcgatccacagaa

SEQ ID NO: 8462484 - DNA, 22 bp, Homo sapiens
aaagtcttgttacgttccattg

SEQ ID NO: 8462485 - DNA, 20 bp, Homo sapiens
aaagtcttatggttaatttt

SEQ ID NO: 8462486 - DNA, 22 bp, Homo sapiens
aaagtctttctcattggccatg

SEQ ID NO: 8462487 - DNA, 22 bp, Homo sapiens
aaagtctttattttgtatcttt

SEQ ID NO: 8462488 - DNA, 22 bp, Homo sapiens
aacttccttctagttcatatgt

SEQ ID NO: 8462489 - DNA, 22 bp, Homo sapiens
aaaggcatgcatggtctgctcc

SEQ ID NO: 8462490 - DNA, 22 bp, Homo sapiens
aaaggctatgagatagaagata

SEQ ID NO: 8462491 - DNA, 22 bp, Homo sapiens
aacatgagtgataaaattacct

SEQ ID NO: 8462492 - DNA, 22 bp, Homo sapiens
aaaggctgccaggtaaaatatt

SEQ ID NO: 8462493 - DNA, 22 bp, Homo sapiens
aaaggctattgctgataatgtt

SEQ ID NO: 8462494 - DNA, 22 bp, Homo sapiens
aaaggctatttcagggtcagta

SEQ ID NO: 8462495 - DNA, 22 bp, Homo sapiens
aaaggctatttttagatgtttg

SEQ ID NO: 8462496 - DNA, 22 bp, Homo sapiens
aaaggctatgagatagaagata

SEQ ID NO: 8462497 - DNA, 22 bp, Homo sapiens
aaaggctattcagggacttgcc

SEQ ID NO: 8462498 - DNA, 22 bp, Homo sapiens
aaaggctatgatagtccagtgg

SEQ ID NO: 8462499 - DNA, 22 bp, Homo sapiens
aaaggctggggactgaggaagg

SEQ ID NO: 8462500 - DNA, 22 bp, Homo sapiens
aaaggctggggactgaggaagg

SEQ ID NO: 8462501 - DNA, 22 bp, Homo sapiens
aaaggcttaacagaagaccttt

SEQ ID NO: 8462502 - DNA, 22 bp, Homo sapiens
aaaggcttcggatcagaaggta

SEQ ID NO: 8462503 - DNA, 22 bp, Homo sapiens
aaaggcttctattggacgttgc

SEQ ID NO: 8462504 - DNA, 22 bp, Homo sapiens
aaaggcttagacacagaactgt

SEQ ID NO: 8462505 - DNA, 22 bp, Homo sapiens
aaaggcttcagtgagtgggtat

SEQ ID NO: 8462506 - DNA, 22 bp, Homo sapiens
aaaggcttcacttatttatttt

SEQ ID NO: 8462507 - DNA, 22 bp, Homo sapiens
aaaggcttaatgttgttgtaat

SEQ ID NO: 8462508 - DNA, 22 bp, Homo sapiens
aaaggcttgtacagcagccttc

SEQ ID NO: 8462509 - DNA, 22 bp, Homo sapiens
aaaggctttaaaatgtacatat

SEQ ID NO: 8462510 - DNA, 22 bp, Homo sapiens
aaaggcttgtccagtaagggga

SEQ ID NO: 8462511 - DNA, 22 bp, Homo sapiens
aaaggcttgtttgaggactggt

SEQ ID NO: 8462512 - DNA, 22 bp, Homo sapiens
aaaggcttggttctttgatgac

SEQ ID NO: 8462513 - DNA, 22 bp, Homo sapiens
aaaggcttctttgctccatgtc

SEQ ID NO: 8462514 - DNA, 22 bp, Homo sapiens
aaaggcttctcagaaaggcctt

SEQ ID NO: 8462515 - DNA, 22 bp, Homo sapiens
aaaggcttggtattttggagtt

SEQ ID NO: 8462516 - DNA, 22 bp, Homo sapiens
aaaggcttgcgattccttgtaa

SEQ ID NO: 8462517 - DNA, 22 bp, Homo sapiens
aaaggcttgagcatttgttgaa

SEQ ID NO: 8462518 - DNA, 22 bp, Homo sapiens
aaaggcttgactagaagggaga

SEQ ID NO: 8462519 - DNA, 22 bp, Homo sapiens
aaagggcagagttcactagaaa

SEQ ID NO: 8462520 - DNA, 22 bp, Homo sapiens
aaagtcacatataacaagggca

SEQ ID NO: 8462521 - DNA, 22 bp, Homo sapiens
aaagggagcatggctgcaggga

SEQ ID NO: 8462522 - DNA, 22 bp, Homo sapiens
aaagggaagttgcacatgttcc

SEQ ID NO: 8462523 - DNA, 22 bp, Homo sapiens
aaaggcttttggtatataggag

SEQ ID NO: 8462524 - DNA, 22 bp, Homo sapiens
aaaggctttgagaagtcctgca

SEQ ID NO: 8462525 - DNA, 22 bp, Homo sapiens
aaaggctttccagcgcgcggac

SEQ ID NO: 8462526 - DNA, 22 bp, Homo sapiens
aaaggctttaaagaaccagaac

SEQ ID NO: 8462527 - DNA, 22 bp, Homo sapiens
aaaggcagagtgctcagctggc

SEQ ID NO: 8462528 - DNA, 22 bp, Homo sapiens
aacatgaaacccaaacagaata

SEQ ID NO: 8462529 - DNA, 22 bp, Homo sapiens
aaaggattaaataaatgtgctg

SEQ ID NO: 8462530 - DNA, 22 bp, Homo sapiens
aaaggataaggttatcaatttt

SEQ ID NO: 8462531 - DNA, 22 bp, Homo sapiens
aaaggataaggttatcaatttt

SEQ ID NO: 8462532 - DNA, 22 bp, Homo sapiens
aaaggcaagcatttatatagga

SEQ ID NO: 8462533 - DNA, 22 bp, Homo sapiens
aaaggcaagcatttatatagga

SEQ ID NO: 8462534 - DNA, 23 bp, Homo sapiens
aaagccaagtcagtctactggaa

SEQ ID NO: 8462535 - DNA, 22 bp, Homo sapiens
aaagcatttcatgtctagaaag

SEQ ID NO: 8462536 - DNA, 22 bp, Homo sapiens
aaagccaagctgggaaggcagg

SEQ ID NO: 8462537 - DNA, 22 bp, Homo sapiens
aaagcattattctgtggaaaaa

SEQ ID NO: 8462538 - DNA, 22 bp, Homo sapiens
aaagcatgttgggtccctcttt

SEQ ID NO: 8462539 - DNA, 22 bp, Homo sapiens
aaagcattactagactggattt

SEQ ID NO: 8462540 - DNA, 20 bp, Homo sapiens
aaagcatttacttgtgattg

SEQ ID NO: 8462541 - DNA, 22 bp, Homo sapiens
aaagcatggcatgaagaacatg

SEQ ID NO: 8462542 - DNA, 22 bp, Homo sapiens
aaagcatgattagatagatgat

SEQ ID NO: 8462543 - DNA, 22 bp, Homo sapiens
aaagcatgttctgggaatagta

SEQ ID NO: 8462544 - DNA, 22 bp, Homo sapiens
aaagcatcagatctgacacttc

SEQ ID NO: 8462545 - DNA, 21 bp, Homo sapiens
aaagcatcacgaacatttggg

SEQ ID NO: 8462546 - DNA, 22 bp, Homo sapiens
aaagcatagttcatctgtccat

SEQ ID NO: 8462547 - DNA, 21 bp, Homo sapiens
aaagcagttcttcctgcctct

SEQ ID NO: 8462548 - DNA, 22 bp, Homo sapiens
aaagcagtgctgtgagaacact

SEQ ID NO: 8462549 - DNA, 19 bp, Homo sapiens
aaagcagtgcatcctcttt

SEQ ID NO: 8462550 - DNA, 22 bp, Homo sapiens
aaagcagtgctgtgagaacact

SEQ ID NO: 8462551 - DNA, 22 bp, Homo sapiens
aaagcaggttgcaattacagtg

SEQ ID NO: 8462552 - DNA, 22 bp, Homo sapiens
aaagcagtagttttcaaatagt

SEQ ID NO: 8462553 - DNA, 22 bp, Homo sapiens
aaagcagtatgaaaggcaataa

SEQ ID NO: 8462554 - DNA, 22 bp, Homo sapiens
aaagcagtatattggtagttgt

SEQ ID NO: 8462555 - DNA, 22 bp, Homo sapiens
aaagcagtatagtggaagggct

SEQ ID NO: 8462556 - DNA, 22 bp, Homo sapiens
aaagcagtataagtaacggaag

SEQ ID NO: 8462557 - DNA, 22 bp, Homo sapiens
aaagcagtctgttttaacctga

SEQ ID NO: 8462558 - DNA, 22 bp, Homo sapiens
aaagcagtctcagacttaagca

SEQ ID NO: 8462559 - DNA, 22 bp, Homo sapiens
aaagcagtctcagacttaagca

SEQ ID NO: 8462560 - DNA, 22 bp, Homo sapiens
aaagcagtgcaccttaattgat

SEQ ID NO: 8462561 - DNA, 19 bp, Homo sapiens
aaagcagtgcatcctcttt

SEQ ID NO: 8462562 - DNA, 22 bp, Homo sapiens
aaagcagtgcaccttaattgat

SEQ ID NO: 8462563 - DNA, 22 bp, Homo sapiens
aaagcagtcactccagtgtgat

SEQ ID NO: 8462564 - DNA, 20 bp, Homo sapiens
aaagcagtatgcaagtagag

SEQ ID NO: 8462565 - DNA, 22 bp, Homo sapiens
aaagcagtatgaaaggcaataa

SEQ ID NO: 8462566 - DNA, 22 bp, Homo sapiens
aaagcagtcactccagtgtgat

SEQ ID NO: 8462567 - DNA, 22 bp, Homo sapiens
aaagcagtccttcccttaaggt

SEQ ID NO: 8462568 - DNA, 22 bp, Homo sapiens
aaagcagtctcagacttaagca

SEQ ID NO: 8462569 - DNA, 22 bp, Homo sapiens
aaagcagtccttcccttaaggt

SEQ ID NO: 8462570 - DNA, 22 bp, Homo sapiens
aaattgtaatgacttcacttga

SEQ ID NO: 8462571 - DNA, 22 bp, Homo sapiens
aaattgtaggatcacatgacct

SEQ ID NO: 8462572 - DNA, 22 bp, Homo sapiens
aaattgtatattccatttgtat

SEQ ID NO: 8462573 - DNA, 22 bp, Homo sapiens
aaattcatatgttgaaatgcta

SEQ ID NO: 8462574 - DNA, 22 bp, Homo sapiens
aaattcatttttcttagtgtgc

SEQ ID NO: 8462575 - DNA, 22 bp, Homo sapiens
aaattagatcagtggattttct

SEQ ID NO: 8462576 - DNA, 22 bp, Homo sapiens
aaattagatcagtggattttct

SEQ ID NO: 8462577 - DNA, 22 bp, Homo sapiens
aaattagatatgtgtgagactc

SEQ ID NO: 8462578 - DNA, 22 bp, Homo sapiens
aaattagaccagttcaggtcca

SEQ ID NO: 8462579 - DNA, 22 bp, Homo sapiens
aaattagaccagttcaggtcca

SEQ ID NO: 8462580 - DNA, 22 bp, Homo sapiens
aaattagatatgtgtgagactc

SEQ ID NO: 8462581 - DNA, 22 bp, Homo sapiens
aaattccattatgataatttcg

SEQ ID NO: 8462582 - DNA, 22 bp, Homo sapiens
aaattccattatgataatttcg

SEQ ID NO: 8462583 - DNA, 22 bp, Homo sapiens
aaattccattaggaaacttcca

SEQ ID NO: 8462584 - DNA, 22 bp, Homo sapiens
aaattccattaggaaacttcca

SEQ ID NO: 8462585 - DNA, 22 bp, Homo sapiens
aaattccagttcttttacctgc

SEQ ID NO: 8462586 - DNA, 22 bp, Homo sapiens
aaattccagaaactcagtatat

SEQ ID NO: 8462587 - DNA, 22 bp, Homo sapiens
aaattccagaaactcagtatat

SEQ ID NO: 8462588 - DNA, 22 bp, Homo sapiens
aaattccattttgtgactattc

SEQ ID NO: 8462589 - DNA, 22 bp, Homo sapiens
aaaagttacctctgtaatataa

SEQ ID NO: 8462590 - DNA, 22 bp, Homo sapiens
aaaagttacctctgtaatataa

SEQ ID NO: 8462591 - DNA, 22 bp, Homo sapiens
aaaagttaactgtgttcatgca

SEQ ID NO: 8462592 - DNA, 22 bp, Homo sapiens
aaaagttagctattagtaggtg

SEQ ID NO: 8462593 - DNA, 22 bp, Homo sapiens
aaaagttacctctgtaatataa

SEQ ID NO: 8462594 - DNA, 22 bp, Homo sapiens
aaaagttattgatgcaggacaa

SEQ ID NO: 8462595 - DNA, 22 bp, Homo sapiens
aaaagtttaagactcattctag

SEQ ID NO: 8462596 - DNA, 22 bp, Homo sapiens
aaaagtttaagactcattctag

SEQ ID NO: 8462597 - DNA, 21 bp, Homo sapiens
aaaagtttgacaggaaaggga

SEQ ID NO: 8462598 - DNA, 21 bp, Homo sapiens
aaaagtttgacaggaaaggga

SEQ ID NO: 8462599 - DNA, 19 bp, Homo sapiens
aaaaggaatattctttggg

SEQ ID NO: 8462600 - DNA, 22 bp, Homo sapiens
aaaagctctttctgctgtagat

SEQ ID NO: 8462601 - DNA, 22 bp, Homo sapiens
aaaagtattttgagcactttat

SEQ ID NO: 8462602 - DNA, 22 bp, Homo sapiens
aaaagtattttgagcactttat

SEQ ID NO: 8462603 - DNA, 22 bp, Homo sapiens
aaaaggacaagctttggagtta

SEQ ID NO: 8462604 - DNA, 22 bp, Homo sapiens
aaaagtatttatggctatgtaa

SEQ ID NO: 8462605 - DNA, 19 bp, Homo sapiens
aaaaggaatattctttggg

SEQ ID NO: 8462606 - DNA, 22 bp, Homo sapiens
aaaatactactgtcttcttccc

SEQ ID NO: 8462607 - DNA, 22 bp, Homo sapiens
aaaatactactgtcttcttccc

SEQ ID NO: 8462608 - DNA, 22 bp, Homo sapiens
aaaatactactgtcttcttccc

SEQ ID NO: 8462609 - DNA, 22 bp, Homo sapiens
aaaatacacatactaggggaaa

SEQ ID NO: 8462610 - DNA, 22 bp, Homo sapiens
aaaatactgtggagtgttgaaa

SEQ ID NO: 8462611 - DNA, 22 bp, Homo sapiens
aaaatactactgtcttcttccc

SEQ ID NO: 8462612 - DNA, 22 bp, Homo sapiens
aaaatgagacacatgtgactcc

SEQ ID NO: 8462613 - DNA, 18 bp, Homo sapiens
aaaataacaaagttggct

SEQ ID NO: 8462614 - DNA, 22 bp, Homo sapiens
aaaagtttgtgcaaacactcag

SEQ ID NO: 8462615 - DNA, 22 bp, Homo sapiens
aaaataacttctactatttgca

SEQ ID NO: 8462616 - DNA, 22 bp, Homo sapiens
aaaataacttctactatttgca

SEQ ID NO: 8462617 - DNA, 22 bp, Homo sapiens
aaaataacttctactatttgca

SEQ ID NO: 8462618 - DNA, 22 bp, Homo sapiens
aaaatgatgctgtaatttggca

SEQ ID NO: 8462619 - DNA, 22 bp, Homo sapiens
aaaatgatgctgtaatttggca

SEQ ID NO: 8462620 - DNA, 22 bp, Homo sapiens
aaaatgatgctgtaatttggca

SEQ ID NO: 8462621 - DNA, 20 bp, Homo sapiens
aaaatgatgggcagggcagg

SEQ ID NO: 8462622 - DNA, 22 bp, Homo sapiens
aaaatgaggtcaatatcctttt

SEQ ID NO: 8462623 - DNA, 22 bp, Homo sapiens
aaaatgatatcctgacttttat

SEQ ID NO: 8462624 - DNA, 22 bp, Homo sapiens
aaaatgaggtcaatatcctttt

SEQ ID NO: 8462625 - DNA, 22 bp, Homo sapiens
aaaatgaggaacggatcatggc

SEQ ID NO: 8462626 - DNA, 22 bp, Homo sapiens
aaaatgagccatgaaccaacca

SEQ ID NO: 8462627 - DNA, 22 bp, Homo sapiens
aaaatgcatgagaatgtgctcg

SEQ ID NO: 8462628 - DNA, 18 bp, Homo sapiens
aaaatgcaggcgacatgg

SEQ ID NO: 8462629 - DNA, 22 bp, Homo sapiens
aaaatgctatttcatggaggag

SEQ ID NO: 8462630 - DNA, 22 bp, Homo sapiens
aaaatgtaaagcttgagtgtag

SEQ ID NO: 8462631 - DNA, 22 bp, Homo sapiens
aaagcagggatgaggctagagg

SEQ ID NO: 8462632 - DNA, 22 bp, Homo sapiens
aaagcagggtccaaggagatgt

SEQ ID NO: 8462633 - DNA, 22 bp, Homo sapiens
aaaattgtaggaactgaatcaa

SEQ ID NO: 8462634 - DNA, 22 bp, Homo sapiens
aaagcaggcagcaggctggatt

SEQ ID NO: 8462635 - DNA, 22 bp, Homo sapiens
aaaatgtctgctgttggtttat

SEQ ID NO: 8462636 - DNA, 22 bp, Homo sapiens
aaagcaatggcacatgatggta

SEQ ID NO: 8462637 - DNA, 22 bp, Homo sapiens
aaagcagcagaatctctcaggg

SEQ ID NO: 8462638 - DNA, 22 bp, Homo sapiens
aaagcagcagcacgtggaagag

SEQ ID NO: 8462639 - DNA, 22 bp, Homo sapiens
aaaaatgaaacggctggttggc

SEQ ID NO: 8462640 - DNA, 22 bp, Homo sapiens
aaaaatgaaacggctggttggc

SEQ ID NO: 8462641 - DNA, 22 bp, Homo sapiens
aaaacacaagaagcagggtaca

SEQ ID NO: 8462642 - DNA, 22 bp, Homo sapiens
aaaacacaagaagcagggtaca

SEQ ID NO: 8462643 - DNA, 22 bp, Homo sapiens
aaaacacaagaagcagggtaca

SEQ ID NO: 8462644 - DNA, 22 bp, Homo sapiens
aaaaattgctgagaacggaatt

SEQ ID NO: 8462645 - DNA, 20 bp, Homo sapiens
aaaaattgatatcgcttcct

SEQ ID NO: 8462646 - DNA, 22 bp, Homo sapiens
aaaaatctatgactgcttctcc

SEQ ID NO: 8462647 - DNA, 22 bp, Homo sapiens
aaaagcaagttgcctaggttga

SEQ ID NO: 8462648 - DNA, 22 bp, Homo sapiens
aaaagcaagttgcctaggttga

SEQ ID NO: 8462649 - DNA, 22 bp, Homo sapiens
aaaagcaaggcagtctgtctga

SEQ ID NO: 8462650 - DNA, 22 bp, Homo sapiens
aaaagcaaggcagtctgtctga

SEQ ID NO: 8462651 - DNA, 22 bp, Homo sapiens
aaaagcaaggcagtctgtctga

SEQ ID NO: 8462652 - DNA, 22 bp, Homo sapiens
aaaagcaagaggctggattaaa

SEQ ID NO: 8462653 - DNA, 22 bp, Homo sapiens
aaaagcaagaggctggattaaa

SEQ ID NO: 8462654 - DNA, 22 bp, Homo sapiens
aaaagagtgtttcaactttggc

SEQ ID NO: 8462655 - DNA, 22 bp, Homo sapiens
aaaagattgttagggagaatgt

SEQ ID NO: 8462656 - DNA, 22 bp, Homo sapiens
aaaagcaagaggctggattaaa

SEQ ID NO: 8462657 - DNA, 22 bp, Homo sapiens
aaaagagtgactgataagtata

SEQ ID NO: 8462658 - DNA, 22 bp, Homo sapiens
aaaaccacagttacttttgcac

SEQ ID NO: 8462659 - DNA, 22 bp, Homo sapiens
aaaaccacttccttgctattgg

SEQ ID NO: 8462660 - DNA, 22 bp, Homo sapiens
aaaaccacaattacttttgcac

SEQ ID NO: 8462661 - DNA, 22 bp, Homo sapiens
aaaaccacaatgacttttgcac

SEQ ID NO: 8462662 - DNA, 22 bp, Homo sapiens
aaaaccacaatgacttttgcag

SEQ ID NO: 8462663 - DNA, 22 bp, Homo sapiens
aaaacattctgtgaactctcaa

SEQ ID NO: 8462664 - DNA, 22 bp, Homo sapiens
aaaacatgtccatacagaaact

SEQ ID NO: 8462665 - DNA, 22 bp, Homo sapiens
aaaacatgtccatacagaaact

SEQ ID NO: 8462666 - DNA, 23 bp, Homo sapiens
aaaacagcttcctccagtggctc

SEQ ID NO: 8462667 - DNA, 22 bp, Homo sapiens
aaaacagacagccagtgtagag

SEQ ID NO: 8462668 - DNA, 22 bp, Homo sapiens
aaaacactgcaaagctgattgg

SEQ ID NO: 8462669 - DNA, 22 bp, Homo sapiens
aaaacacaagaagcagggtaca

SEQ ID NO: 8462670 - DNA, 22 bp, Homo sapiens
aaaacacactggaccaatttaa

SEQ ID NO: 8462671 - DNA, 22 bp, Homo sapiens
aaaacaggagttttggtaggct

SEQ ID NO: 8462672 - DNA, 22 bp, Homo sapiens
aaaacaggtgtcagcaaactat

SEQ ID NO: 8462673 - DNA, 22 bp, Homo sapiens
aaaacagtttaggcatcacagt

SEQ ID NO: 8462674 - DNA, 22 bp, Homo sapiens
aaaagcaattgcagttcttgcc

SEQ ID NO: 8462675 - DNA, 22 bp, Homo sapiens
aaaagcaagttgcctaggttga

SEQ ID NO: 8462676 - DNA, 22 bp, Homo sapiens
aaaagcaagttgcctaggttga

SEQ ID NO: 8462677 - DNA, 22 bp, Homo sapiens
aaaagcaattgcgggttttgcc

SEQ ID NO: 8462678 - DNA, 22 bp, Homo sapiens
aaaagcaattgcagttcttgcc

SEQ ID NO: 8462679 - DNA, 22 bp, Homo sapiens
aaaagcaattgcagttcttgcc

SEQ ID NO: 8462680 - DNA, 22 bp, Homo sapiens
aaaagcaattgcgggttttgcc

SEQ ID NO: 8462681 - DNA, 22 bp, Homo sapiens
aaaagcaattgcagttcttgcc

SEQ ID NO: 8462682 - DNA, 22 bp, Homo sapiens
aaaagcagaccacgctttgtgg

SEQ ID NO: 8462683 - DNA, 22 bp, Homo sapiens
aaaagcactacaatttcgcttc

SEQ ID NO: 8462684 - DNA, 22 bp, Homo sapiens
aaaagccatgcatacctaagag

SEQ ID NO: 8462685 - DNA, 22 bp, Homo sapiens
aaaagcctggatactatcatta

SEQ ID NO: 8462686 - DNA, 22 bp, Homo sapiens
aaaagctagtcaatgatgtatt

SEQ ID NO: 8462687 - DNA, 22 bp, Homo sapiens
aaaagctagtcaatgatgtatt

SEQ ID NO: 8462688 - DNA, 22 bp, Homo sapiens
aaaagccaaggtcctcttcaga

SEQ ID NO: 8462689 - DNA, 22 bp, Homo sapiens
aaaagcatctcaaaggagcttc

SEQ ID NO: 8462690 - DNA, 22 bp, Homo sapiens
aaaagcatctcaaaggagcttc

SEQ ID NO: 8462691 - DNA, 22 bp, Homo sapiens
aaaagcatctcaaaggagcttc

SEQ ID NO: 8462692 - DNA, 19 bp, Homo sapiens
aaagttttattctcatttg

SEQ ID NO: 8462693 - DNA, 22 bp, Homo sapiens
aaagttttattcaagcattagt

SEQ ID NO: 8462694 - DNA, 22 bp, Homo sapiens
aaagttttattcaagcattagt

SEQ ID NO: 8462695 - DNA, 22 bp, Homo sapiens
aaagttctaaaactctttgtga

SEQ ID NO: 8462696 - DNA, 22 bp, Homo sapiens
aaagttttctgccttcattaga

SEQ ID NO: 8462697 - DNA, 22 bp, Homo sapiens
aaagttttgttgattgtggaat

SEQ ID NO: 8462698 - DNA, 22 bp, Homo sapiens
aaagtttttaagcaagaccctt

SEQ ID NO: 8462699 - DNA, 22 bp, Homo sapiens
aaataaactgaagcacagagag

SEQ ID NO: 8462700 - DNA, 22 bp, Homo sapiens
aaataaactgaagcacagagag

SEQ ID NO: 8462701 - DNA, 22 bp, Homo sapiens
aaagtcatgtttttgtttagca

SEQ ID NO: 8462702 - DNA, 22 bp, Homo sapiens
aaagtcatctaggagcagattt

SEQ ID NO: 8462703 - DNA, 22 bp, Homo sapiens
aaagtcagttggccagatcact

SEQ ID NO: 8462704 - DNA, 22 bp, Homo sapiens
aaagtcagttggccagatcact

SEQ ID NO: 8462705 - DNA, 22 bp, Homo sapiens
aaagtcatacatggtgcttact

SEQ ID NO: 8462706 - DNA, 22 bp, Homo sapiens
aaagtacatgcaattcttctga

SEQ ID NO: 8462707 - DNA, 22 bp, Homo sapiens
aaagtacatgcaattcttctga

SEQ ID NO: 8462708 - DNA, 22 bp, Homo sapiens
aaagccagggacagtgtgcatg

SEQ ID NO: 8462709 - DNA, 22 bp, Homo sapiens
aaaattttcagcttgacttgat

SEQ ID NO: 8462710 - DNA, 22 bp, Homo sapiens
aaagctcacagtaatacaaggc

SEQ ID NO: 8462711 - DNA, 22 bp, Homo sapiens
aaaggacatgtcaatatcaggc

SEQ ID NO: 8462712 - DNA, 22 bp, Homo sapiens
aaaggacacacaggaggtgtct

SEQ ID NO: 8462713 - DNA, 22 bp, Homo sapiens
aaaggagaaaacatacaggact

SEQ ID NO: 8462714 - DNA, 22 bp, Homo sapiens
aaaggactggatattaaagagt

SEQ ID NO: 8462715 - DNA, 22 bp, Homo sapiens
aaaggactgatgctgagtacct

SEQ ID NO: 8462716 - DNA, 22 bp, Homo sapiens
aaaggactcagactgaagggag

SEQ ID NO: 8462717 - DNA, 22 bp, Homo sapiens
aaacttcagactccccacttct

SEQ ID NO: 8462718 - DNA, 22 bp, Homo sapiens
aaagacatcagaaccagctgag

SEQ ID NO: 8462719 - DNA, 22 bp, Homo sapiens
aaagacatatttctaagtttat

SEQ ID NO: 8462720 - DNA, 22 bp, Homo sapiens
aaagacatatttctaagtttat

SEQ ID NO: 8462721 - DNA, 22 bp, Homo sapiens
aaagacagtggattcaaaatcc

SEQ ID NO: 8462722 - DNA, 22 bp, Homo sapiens
aaagacagatggcaaggatgat

SEQ ID NO: 8462723 - DNA, 22 bp, Homo sapiens
aaagacacatgtctcttagatt

SEQ ID NO: 8462724 - DNA, 22 bp, Homo sapiens
aaagacacatatgcttaaccca

SEQ ID NO: 8462725 - DNA, 22 bp, Homo sapiens
aaagacacatgtctcttagatt

SEQ ID NO: 8462726 - DNA, 22 bp, Homo sapiens
aaagacagagctgtaggggaaa

SEQ ID NO: 8462727 - DNA, 22 bp, Homo sapiens
aaagacacacagccagcaagtg

SEQ ID NO: 8462728 - DNA, 22 bp, Homo sapiens
aaagacacacagtgcttcagtt

SEQ ID NO: 8462729 - DNA, 22 bp, Homo sapiens
aaagacacacagccagcaagtg

SEQ ID NO: 8462730 - DNA, 22 bp, Homo sapiens
aaatacaatttcaggctgtaat

SEQ ID NO: 8462731 - DNA, 22 bp, Homo sapiens
aaatacacgtacatgtgtaaaa

SEQ ID NO: 8462732 - DNA, 22 bp, Homo sapiens
aaatacacgtacatgtgtaaaa

SEQ ID NO: 8462733 - DNA, 22 bp, Homo sapiens
aaatacaatttcaggctgtaat

SEQ ID NO: 8462734 - DNA, 22 bp, Homo sapiens
aaatacaatttcaggctgtaat

SEQ ID NO: 8462735 - DNA, 22 bp, Homo sapiens
aaataacagtcagggacaacat

SEQ ID NO: 8462736 - DNA, 22 bp, Homo sapiens
aaataacagtcagggacaacat

SEQ ID NO: 8462737 - DNA, 22 bp, Homo sapiens
aaataacagtcagggacaacat

SEQ ID NO: 8462738 - DNA, 21 bp, Homo sapiens
aaatacagatgcaaatctgtt

SEQ ID NO: 8462739 - DNA, 21 bp, Homo sapiens
aaatacagaaacttgttttca

SEQ ID NO: 8462740 - DNA, 22 bp, Homo sapiens
aaatgacaataaaagtccatgc

SEQ ID NO: 8462741 - DNA, 22 bp, Homo sapiens
aaatgacactaggctttttgca

SEQ ID NO: 8462742 - DNA, 22 bp, Homo sapiens
aaatgacactcattcagtgtca

SEQ ID NO: 8462743 - DNA, 23 bp, Homo sapiens
aaatgacatatggtttctgaagg

SEQ ID NO: 8462744 - DNA, 22 bp, Homo sapiens
aaactgttatagcagaaaggac

SEQ ID NO: 8462745 - DNA, 22 bp, Homo sapiens
aaatgacactcattcagtgtca

SEQ ID NO: 8462746 - DNA, 22 bp, Homo sapiens
aaatgacactcattcagtgtca

SEQ ID NO: 8462747 - DNA, 22 bp, Homo sapiens
aaatgacagagtaagctgttta

SEQ ID NO: 8462748 - DNA, 22 bp, Homo sapiens
aagttaacccagtatttctttt

SEQ ID NO: 8462749 - DNA, 22 bp, Homo sapiens
aagttacaagactaaatggaag

SEQ ID NO: 8462750 - DNA, 22 bp, Homo sapiens
aagttacacattttcattgtaa

SEQ ID NO: 8462751 - DNA, 22 bp, Homo sapiens
aagttacagattgggagcagag

SEQ ID NO: 8462752 - DNA, 22 bp, Homo sapiens
aagttacacattttcattgtaa

SEQ ID NO: 8462753 - DNA, 22 bp, Homo sapiens
aagttacaggagaaagagatca

SEQ ID NO: 8462754 - DNA, 22 bp, Homo sapiens
aagttacaggagaaagagatca

SEQ ID NO: 8462755 - DNA, 22 bp, Homo sapiens
aagttacagattgggagcagag

SEQ ID NO: 8462756 - DNA, 22 bp, Homo sapiens
aagttacaagactaaatggaag

SEQ ID NO: 8462757 - DNA, 22 bp, Homo sapiens
aagttacacattttcattgtaa

SEQ ID NO: 8462758 - DNA, 22 bp, Homo sapiens
aagttacacagagttggaggct

SEQ ID NO: 8462759 - DNA, 22 bp, Homo sapiens
aagttacacagagttggaggct

SEQ ID NO: 8462760 - DNA, 22 bp, Homo sapiens
aagttacagttattatttaaaa

SEQ ID NO: 8462761 - DNA, 22 bp, Homo sapiens
aagttacagttattatttaaaa

SEQ ID NO: 8462762 - DNA, 22 bp, Homo sapiens
aagttacagttattatttaaaa

SEQ ID NO: 8462763 - DNA, 22 bp, Homo sapiens
aagttacagttggaactgtgaa

SEQ ID NO: 8462764 - DNA, 22 bp, Homo sapiens
aagttacagttattatttaaaa

SEQ ID NO: 8462765 - DNA, 22 bp, Homo sapiens
aagttacagttggaactgtgaa

SEQ ID NO: 8462766 - DNA, 22 bp, Homo sapiens
aagttacagttggaactgtgaa

SEQ ID NO: 8462767 - DNA, 22 bp, Homo sapiens
aagttacataaatgtcctctag

SEQ ID NO: 8462768 - DNA, 22 bp, Homo sapiens
aagttacataaatgtcctctag

SEQ ID NO: 8462769 - DNA, 22 bp, Homo sapiens
aagttacataaatgtcctctag

SEQ ID NO: 8462770 - DNA, 22 bp, Homo sapiens
aagttacatattcttgggctat

SEQ ID NO: 8462771 - DNA, 22 bp, Homo sapiens
aagttacatattcttgggctat

SEQ ID NO: 8462772 - DNA, 20 bp, Homo sapiens
aagttacattgtattgtacc

SEQ ID NO: 8462773 - DNA, 22 bp, Homo sapiens
aataagaacttgtctctggcag

SEQ ID NO: 8462774 - DNA, 22 bp, Homo sapiens
aagttacagttatgaaactcac

SEQ ID NO: 8462775 - DNA, 22 bp, Homo sapiens
aagttacagttatgaaactcac

SEQ ID NO: 8462776 - DNA, 22 bp, Homo sapiens
aagttacagttacagaatggag

SEQ ID NO: 8462777 - DNA, 22 bp, Homo sapiens
aagttacagttaggggtgatga

SEQ ID NO: 8462778 - DNA, 22 bp, Homo sapiens
aagttacagttacagaatggag

SEQ ID NO: 8462779 - DNA, 22 bp, Homo sapiens
aagttacagttatgaaactcac

SEQ ID NO: 8462780 - DNA, 22 bp, Homo sapiens
aagttacagttaggggtgatga

SEQ ID NO: 8462781 - DNA, 22 bp, Homo sapiens
aagttacagtcagaggttaaca

SEQ ID NO: 8462782 - DNA, 22 bp, Homo sapiens
aagttacaggagaaagagatca

SEQ ID NO: 8462783 - DNA, 22 bp, Homo sapiens
aagttacagtcagaggttaaca

SEQ ID NO: 8462784 - DNA, 22 bp, Homo sapiens
aagttacagtcagaggttaaca

SEQ ID NO: 8462785 - DNA, 22 bp, Homo sapiens
aagttacagttacagaatggag

SEQ ID NO: 8462786 - DNA, 22 bp, Homo sapiens
aagttacagtctgcttgctgac

SEQ ID NO: 8462787 - DNA, 22 bp, Homo sapiens
aagttacagttacagaatggag

SEQ ID NO: 8462788 - DNA, 22 bp, Homo sapiens
aagttacagtctgcttgctgac

SEQ ID NO: 8462789 - DNA, 22 bp, Homo sapiens
aatacagaggggtcacaattca

SEQ ID NO: 8462790 - DNA, 22 bp, Homo sapiens
aatacagaggggtcacaattca

SEQ ID NO: 8462791 - DNA, 22 bp, Homo sapiens
aataatgtctgctattttaaaa

SEQ ID NO: 8462792 - DNA, 22 bp, Homo sapiens
aataatgtaggatgataaatga

SEQ ID NO: 8462793 - DNA, 22 bp, Homo sapiens
aataatgtacatacatatttcg

SEQ ID NO: 8462794 - DNA, 22 bp, Homo sapiens
aataatattcctctgtgtgcgt

SEQ ID NO: 8462795 - DNA, 22 bp, Homo sapiens
aataatattcctctgtgtgcgt

SEQ ID NO: 8462796 - DNA, 22 bp, Homo sapiens
aataatattcctctgtgtgcgt

SEQ ID NO: 8462797 - DNA, 22 bp, Homo sapiens
aataatctccctttttgtatgt

SEQ ID NO: 8462798 - DNA, 22 bp, Homo sapiens
aataatcttgactactgaatca

SEQ ID NO: 8462799 - DNA, 22 bp, Homo sapiens
aataatatttgaagcttcaaag

SEQ ID NO: 8462800 - DNA, 22 bp, Homo sapiens
aataatgagacagcttatttaa

SEQ ID NO: 8462801 - DNA, 22 bp, Homo sapiens
aataatgagacagcttatttaa

SEQ ID NO: 8462802 - DNA, 22 bp, Homo sapiens
aataatgaacatttaaaacctg

SEQ ID NO: 8462803 - DNA, 22 bp, Homo sapiens
aataatgataatggttatagct

SEQ ID NO: 8462804 - DNA, 22 bp, Homo sapiens
aatatccaggtagatgtcttct

SEQ ID NO: 8462805 - DNA, 22 bp, Homo sapiens
aatatccaggtagatgtcttct

SEQ ID NO: 8462806 - DNA, 22 bp, Homo sapiens
aatatccattgggagcaaatgg

SEQ ID NO: 8462807 - DNA, 22 bp, Homo sapiens
aatatctcaccatgacaaagca

SEQ ID NO: 8462808 - DNA, 23 bp, Homo sapiens
aatatctgcagctcctggggagg

SEQ ID NO: 8462809 - DNA, 22 bp, Homo sapiens
aatatccacttcaatacaggca

SEQ ID NO: 8462810 - DNA, 22 bp, Homo sapiens
aatacagtcttactagaaaatc

SEQ ID NO: 8462811 - DNA, 22 bp, Homo sapiens
aatacagtgaaagtgagcaagg

SEQ ID NO: 8462812 - DNA, 22 bp, Homo sapiens
aatacagtaattttgatgagtt

SEQ ID NO: 8462813 - DNA, 22 bp, Homo sapiens
aatacagcagatggagacaaat

SEQ ID NO: 8462814 - DNA, 22 bp, Homo sapiens
aatacataataagttttgtctg

SEQ ID NO: 8462815 - DNA, 21 bp, Homo sapiens
aatacagtgaagaatttcttt

SEQ ID NO: 8462816 - DNA, 19 bp, Homo sapiens
aatacagtgttatagaatt

SEQ ID NO: 8462817 - DNA, 22 bp, Homo sapiens
aatatctgttgttctaagccac

SEQ ID NO: 8462818 - DNA, 22 bp, Homo sapiens
aatatctggagatgctttttgt

SEQ ID NO: 8462819 - DNA, 22 bp, Homo sapiens
aatatctgtggccatacaattt

SEQ ID NO: 8462820 - DNA, 22 bp, Homo sapiens
aatatctgtctctaatgcatat

SEQ ID NO: 8462821 - DNA, 22 bp, Homo sapiens
aatatttatatttctcttccct

SEQ ID NO: 8462822 - DNA, 22 bp, Homo sapiens
aatccagatgagcaatcatact

SEQ ID NO: 8462823 - DNA, 22 bp, Homo sapiens
aatccagatgagcaatcatact

SEQ ID NO: 8462824 - DNA, 22 bp, Homo sapiens
aatatttcaaaaggaaacacag

SEQ ID NO: 8462825 - DNA, 22 bp, Homo sapiens
aatctggtttgacaacttttgt

SEQ ID NO: 8462826 - DNA, 22 bp, Homo sapiens
aatctggaatatttgcattgta

SEQ ID NO: 8462827 - DNA, 22 bp, Homo sapiens
aatctggaatatttgcattgta

SEQ ID NO: 8462828 - DNA, 22 bp, Homo sapiens
aatctggacttgtctgtgaaga

SEQ ID NO: 8462829 - DNA, 22 bp, Homo sapiens
aatctggagagtcatctctgac

SEQ ID NO: 8462830 - DNA, 22 bp, Homo sapiens
aatgaaactgtatatagactgt

SEQ ID NO: 8462831 - DNA, 22 bp, Homo sapiens
aatctgcacaattcagtttcag

SEQ ID NO: 8462832 - DNA, 22 bp, Homo sapiens
aatctgagggaacttgaactcc

SEQ ID NO: 8462833 - DNA, 17 bp, Homo sapiens
aatctcagtggcttaag

SEQ ID NO: 8462834 - DNA, 17 bp, Homo sapiens
aatctcagtggcttaag

SEQ ID NO: 8462835 - DNA, 22 bp, Homo sapiens
aatctcagagatatctgtgtcc

SEQ ID NO: 8462836 - DNA, 22 bp, Homo sapiens
aatctcagctcatgcaattcca

SEQ ID NO: 8462837 - DNA, 22 bp, Homo sapiens
aatctcagaaactggtggattt

SEQ ID NO: 8462838 - DNA, 22 bp, Homo sapiens
aatgcagaccagtatgaaaaac

SEQ ID NO: 8462839 - DNA, 22 bp, Homo sapiens
aatgcacatgttgtaataaata

SEQ ID NO: 8462840 - DNA, 22 bp, Homo sapiens
aatgcacatatatttccttatt

SEQ ID NO: 8462841 - DNA, 22 bp, Homo sapiens
aatgcacatatatgtgtataca

SEQ ID NO: 8462842 - DNA, 22 bp, Homo sapiens
aatgcacatgccacatgtggta

SEQ ID NO: 8462843 - DNA, 22 bp, Homo sapiens
aatgcacacatttggtactgaa

SEQ ID NO: 8462844 - DNA, 22 bp, Homo sapiens
aatgcacagctaaagtggttcc

SEQ ID NO: 8462845 - DNA, 22 bp, Homo sapiens
aatgatgaactcagagggaacc

SEQ ID NO: 8462846 - DNA, 21 bp, Homo sapiens
aatgatgaaagatgacagagt

SEQ ID NO: 8462847 - DNA, 22 bp, Homo sapiens
aatgctgtccaataggaacata

SEQ ID NO: 8462848 - DNA, 22 bp, Homo sapiens
aatgcttatacctaatgatctt

SEQ ID NO: 8462849 - DNA, 22 bp, Homo sapiens
aatgcttataacgttagaatgt

SEQ ID NO: 8462850 - DNA, 22 bp, Homo sapiens
aatgctttaattgcatgtagtg

SEQ ID NO: 8462851 - DNA, 22 bp, Homo sapiens
aatgctttaaatcctagtgtaa

SEQ ID NO: 8462852 - DNA, 22 bp, Homo sapiens
aatgcttatgggttccataata

SEQ ID NO: 8462853 - DNA, 22 bp, Homo sapiens
aatgctttagcagtgattagtg

SEQ ID NO: 8462854 - DNA, 22 bp, Homo sapiens
aacttcattcctttttatgact

SEQ ID NO: 8462855 - DNA, 22 bp, Homo sapiens
aacttggtaaattgtgtcagat

SEQ ID NO: 8462856 - DNA, 22 bp, Homo sapiens
aatgtacaaaccttctttgtag

SEQ ID NO: 8462857 - DNA, 22 bp, Homo sapiens
aatgtacaaaccttctttgtag

SEQ ID NO: 8462858 - DNA, 22 bp, Homo sapiens
aatgtacaaaagtcagccaact

SEQ ID NO: 8462859 - DNA, 22 bp, Homo sapiens
aatgtaaagttgggcacaaatg

SEQ ID NO: 8462860 - DNA, 22 bp, Homo sapiens
aagggctggaatatctcttaga

SEQ ID NO: 8462861 - DNA, 21 bp, Homo sapiens
aaggtctgtaaagtgacagga

SEQ ID NO: 8462862 - DNA, 22 bp, Homo sapiens
aaggtctggatgatgggtgtgc

SEQ ID NO: 8462863 - DNA, 22 bp, Homo sapiens
aaggtctgtattagagtttcat

SEQ ID NO: 8462864 - DNA, 22 bp, Homo sapiens
aaggtgtgaagagatgggaaga

SEQ ID NO: 8462865 - DNA, 22 bp, Homo sapiens
aagggctgcatttgatgtgtca

SEQ ID NO: 8462866 - DNA, 22 bp, Homo sapiens
aagggctgccagggggtgccag

SEQ ID NO: 8462867 - DNA, 22 bp, Homo sapiens
aagggctgctgtagaagcagag

SEQ ID NO: 8462868 - DNA, 22 bp, Homo sapiens
aagggctgcaatccaaaacact

SEQ ID NO: 8462869 - DNA, 22 bp, Homo sapiens
aagggcagggagtttgtgtcta

SEQ ID NO: 8462870 - DNA, 22 bp, Homo sapiens
aagtaagtcttacattcacatt

SEQ ID NO: 8462871 - DNA, 22 bp, Homo sapiens
aaggtgttatagctgaggaata

SEQ ID NO: 8462872 - DNA, 22 bp, Homo sapiens
aagtaacatgggaacatctgaa

SEQ ID NO: 8462873 - DNA, 23 bp, Homo sapiens
aaggtgttctgtatttaactcag

SEQ ID NO: 8462874 - DNA, 22 bp, Homo sapiens
aaggtgttcaggttttcccatt

SEQ ID NO: 8462875 - DNA, 22 bp, Homo sapiens
aagtaacatctgaacatgatgt

SEQ ID NO: 8462876 - DNA, 22 bp, Homo sapiens
aagtaacatctgaacatgatgt

SEQ ID NO: 8462877 - DNA, 22 bp, Homo sapiens
aagtaatctggaatttggtttt

SEQ ID NO: 8462878 - DNA, 22 bp, Homo sapiens
aagtaatggttaaataattcta

SEQ ID NO: 8462879 - DNA, 21 bp, Homo sapiens
aagtaatgtgtctcttctacc

SEQ ID NO: 8462880 - DNA, 22 bp, Homo sapiens
aagtccagtgatactggcagga

SEQ ID NO: 8462881 - DNA, 22 bp, Homo sapiens
aagtctgagtgtcagtgcaagt

SEQ ID NO: 8462882 - DNA, 22 bp, Homo sapiens
aagtgctgtacagtgtgtaaat

SEQ ID NO: 8462883 - DNA, 22 bp, Homo sapiens
aagtgctgggattacaggcgtg

SEQ ID NO: 8462884 - DNA, 22 bp, Homo sapiens
aagtgctgggattacaggcgtc

SEQ ID NO: 8462885 - DNA, 22 bp, Homo sapiens
aagtgctgagactacaggcatg

SEQ ID NO: 8462886 - DNA, 22 bp, Homo sapiens
aagtgctgaatgaagacacaaa

SEQ ID NO: 8462887 - DNA, 22 bp, Homo sapiens
aagtgctgggattacaagcgtg

SEQ ID NO: 8462888 - DNA, 22 bp, Homo sapiens
aagtgctgggattacaggcatg

SEQ ID NO: 8462889 - DNA, 22 bp, Homo sapiens
aacagtaacgagatgtcctaac

SEQ ID NO: 8462890 - DNA, 22 bp, Homo sapiens
aacagtaagagatgttttatct

SEQ ID NO: 8462891 - DNA, 22 bp, Homo sapiens
aacagtgatatcaagacagaca

SEQ ID NO: 8462892 - DNA, 17 bp, Homo sapiens
aacagtaagccctgttt

SEQ ID NO: 8462893 - DNA, 22 bp, Homo sapiens
aacagtaaagacagaatttatc

SEQ ID NO: 8462894 - DNA, 22 bp, Homo sapiens
aacagtaaagacagaatttatc

SEQ ID NO: 8462895 - DNA, 22 bp, Homo sapiens
aacagtgtgtacacatcatagg

SEQ ID NO: 8462896 - DNA, 22 bp, Homo sapiens
aacagtgtcaggattacagata

SEQ ID NO: 8462897 - DNA, 22 bp, Homo sapiens
aacagtgtctgtggttaaaggt

SEQ ID NO: 8462898 - DNA, 21 bp, Homo sapiens
aacagtgcttagtagatgttc

SEQ ID NO: 8462899 - DNA, 22 bp, Homo sapiens
aacagtgctgcattcattgagc

SEQ ID NO: 8462900 - DNA, 22 bp, Homo sapiens
aacagtgctgttataaatgtac

SEQ ID NO: 8462901 - DNA, 22 bp, Homo sapiens
aacagttacccttaagatcttt

SEQ ID NO: 8462902 - DNA, 22 bp, Homo sapiens
aagtgccatcatagcatggctg

SEQ ID NO: 8462903 - DNA, 21 bp, Homo sapiens
aagtgccacccacagatgcat

SEQ ID NO: 8462904 - DNA, 22 bp, Homo sapiens
aagtctttttgaatctataact

SEQ ID NO: 8462905 - DNA, 22 bp, Homo sapiens
aagtcttttgttcaggctggca

SEQ ID NO: 8462906 - DNA, 22 bp, Homo sapiens
aagtctttttgaatctataact

SEQ ID NO: 8462907 - DNA, 22 bp, Homo sapiens
aagtgcatcactactcattaca

SEQ ID NO: 8462908 - DNA, 22 bp, Homo sapiens
aagtgcatatttttgttgtaga

SEQ ID NO: 8462909 - DNA, 22 bp, Homo sapiens
aagtgcatggtatggtctccat

SEQ ID NO: 8462910 - DNA, 22 bp, Homo sapiens
aagtgcattagatagaatgatg

SEQ ID NO: 8462911 - DNA, 22 bp, Homo sapiens
aagtcttaaccaaataaatgtt

SEQ ID NO: 8462912 - DNA, 22 bp, Homo sapiens
aagtctggtgctgtcctcaccc

SEQ ID NO: 8462913 - DNA, 21 bp, Homo sapiens
aagtctggttgattcctttgc

SEQ ID NO: 8462914 - DNA, 21 bp, Homo sapiens
aagtctggttgattcctttgc

SEQ ID NO: 8462915 - DNA, 22 bp, Homo sapiens
aagtctgcctaaccttcatgtt

SEQ ID NO: 8462916 - DNA, 18 bp, Homo sapiens
aagtctggcagctttccc

SEQ ID NO: 8462917 - DNA, 22 bp, Homo sapiens
aagtctggaagtctcagttttc

SEQ ID NO: 8462918 - DNA, 22 bp, Homo sapiens
aagtctggaacctcatgctggc

SEQ ID NO: 8462919 - DNA, 22 bp, Homo sapiens
aagtctggggagaaaaggctaa

SEQ ID NO: 8462920 - DNA, 22 bp, Homo sapiens
aagtctgggcctccttcccaga

SEQ ID NO: 8462921 - DNA, 22 bp, Homo sapiens
aagtctgggccagggcacagcc

SEQ ID NO: 8462922 - DNA, 22 bp, Homo sapiens
aagtcttacagacaagctgaag

SEQ ID NO: 8462923 - DNA, 22 bp, Homo sapiens
aagtcttttgctaagagtaatg

SEQ ID NO: 8462924 - DNA, 22 bp, Homo sapiens
aagtcttttgctgtcataggtg

SEQ ID NO: 8462925 - DNA, 22 bp, Homo sapiens
aagtcttttgttcaggctggca

SEQ ID NO: 8462926 - DNA, 22 bp, Homo sapiens
aagtctttcataagtctcttat

SEQ ID NO: 8462927 - DNA, 22 bp, Homo sapiens
aaggccagtggataaaacctct

SEQ ID NO: 8462928 - DNA, 22 bp, Homo sapiens
aaggccaggtccctgcagtgca

SEQ ID NO: 8462929 - DNA, 22 bp, Homo sapiens
aaggccaggtccctgcagtgca

SEQ ID NO: 8462930 - DNA, 23 bp, Homo sapiens
aaggccagagagaggctagtgtc

SEQ ID NO: 8462931 - DNA, 22 bp, Homo sapiens
aaggctgaattcaagggtaggc

SEQ ID NO: 8462932 - DNA, 22 bp, Homo sapiens
aagggcaggcacccaccctcac

SEQ ID NO: 8462933 - DNA, 22 bp, Homo sapiens
aagggaggggatgtaagcctgg

SEQ ID NO: 8462934 - DNA, 22 bp, Homo sapiens
aaggctgaattcaagggtaggc

SEQ ID NO: 8462935 - DNA, 22 bp, Homo sapiens
aaggctgaccagtttacacttt

SEQ ID NO: 8462936 - DNA, 22 bp, Homo sapiens
aaggctgaccagtttacacttt

SEQ ID NO: 8462937 - DNA, 21 bp, Homo sapiens
aaggctgagacaactcaggag

SEQ ID NO: 8462938 - DNA, 22 bp, Homo sapiens
aaggctgactcaacagggggcc

SEQ ID NO: 8462939 - DNA, 22 bp, Homo sapiens
aaggctgacgtttgtgtttatt

SEQ ID NO: 8462940 - DNA, 22 bp, Homo sapiens
aaggctgacgtttgtgtttatt

SEQ ID NO: 8462941 - DNA, 22 bp, Homo sapiens
aaggctgactcaacagggggcc

SEQ ID NO: 8462942 - DNA, 22 bp, Homo sapiens
aaggctgagacagcacaggtcc

SEQ ID NO: 8462943 - DNA, 22 bp, Homo sapiens
aagggaggccagaggttttgca

SEQ ID NO: 8462944 - DNA, 22 bp, Homo sapiens
aaggctgagagtcacagtccta

SEQ ID NO: 8462945 - DNA, 22 bp, Homo sapiens
aaggagggttcccaggtcctgg

SEQ ID NO: 8462946 - DNA, 22 bp, Homo sapiens
aaatggcactttgacagcctgc

SEQ ID NO: 8462947 - DNA, 22 bp, Homo sapiens
aaatggatggaattgacattta

SEQ ID NO: 8462948 - DNA, 22 bp, Homo sapiens
aaatggcaacagaagggagttc

SEQ ID NO: 8462949 - DNA, 22 bp, Homo sapiens
aaatggactgtgatatttacat

SEQ ID NO: 8462950 - DNA, 22 bp, Homo sapiens
aaggagtgatatatgggtgcta

SEQ ID NO: 8462951 - DNA, 22 bp, Homo sapiens
aaggataaaaaccacttctaat

SEQ ID NO: 8462952 - DNA, 22 bp, Homo sapiens
aaggaggttatcccagtggact

SEQ ID NO: 8462953 - DNA, 22 bp, Homo sapiens
aaggagtctgggccattcagag

SEQ ID NO: 8462954 - DNA, 22 bp, Homo sapiens
aaggagtctgggccattcagag

SEQ ID NO: 8462955 - DNA, 22 bp, Homo sapiens
aaggagtctgggccattcagag

SEQ ID NO: 8462956 - DNA, 22 bp, Homo sapiens
aaggcactcattcaaggagata

SEQ ID NO: 8462957 - DNA, 22 bp, Homo sapiens
acacttctctttgaagaacaat

SEQ ID NO: 8462958 - DNA, 22 bp, Homo sapiens
acacttctcatttgatactaac

SEQ ID NO: 8462959 - DNA, 22 bp, Homo sapiens
acacttctattccctgcacaaa

SEQ ID NO: 8462960 - DNA, 22 bp, Homo sapiens
acactgtaaacatctcaagcac

SEQ ID NO: 8462961 - DNA, 20 bp, Homo sapiens
acacttgacaccagaaatgg

SEQ ID NO: 8462962 - DNA, 22 bp, Homo sapiens
acacttgaggaatgtggtgatt

SEQ ID NO: 8462963 - DNA, 22 bp, Homo sapiens
acacttgaggtttttaggtgcg

SEQ ID NO: 8462964 - DNA, 22 bp, Homo sapiens
acacttgataggtcaaatcagt

SEQ ID NO: 8462965 - DNA, 22 bp, Homo sapiens
acactttaagcatttcacactg

SEQ ID NO: 8462966 - DNA, 22 bp, Homo sapiens
acacttggagcaacacttatgg

SEQ ID NO: 8462967 - DNA, 22 bp, Homo sapiens
acagaaagatgatttgaaatgg

SEQ ID NO: 8462968 - DNA, 22 bp, Homo sapiens
acagaaagatgatttgaaatgg

SEQ ID NO: 8462969 - DNA, 23 bp, Homo sapiens
acagaaagttctgctggacagag

SEQ ID NO: 8462970 - DNA, 22 bp, Homo sapiens
aagatacatatttgttctagtg

SEQ ID NO: 8462971 - DNA, 22 bp, Homo sapiens
aagatacatatttgttctagtg

SEQ ID NO: 8462972 - DNA, 22 bp, Homo sapiens
aagatacacgttgtattgaata

SEQ ID NO: 8462973 - DNA, 22 bp, Homo sapiens
acacatataccactgtaaatga

SEQ ID NO: 8462974 - DNA, 22 bp, Homo sapiens
acacataagcctaatcatctcc

SEQ ID NO: 8462975 - DNA, 22 bp, Homo sapiens
acacatataccactgtaaatga

SEQ ID NO: 8462976 - DNA, 22 bp, Homo sapiens
acagactggagcccttttgccc

SEQ ID NO: 8462977 - DNA, 22 bp, Homo sapiens
acagacctctagattacatttg

SEQ ID NO: 8462978 - DNA, 22 bp, Homo sapiens
acagactggagtgagagaaata

SEQ ID NO: 8462979 - DNA, 22 bp, Homo sapiens
acagaaatgatgtttggcaata

SEQ ID NO: 8462980 - DNA, 23 bp, Homo sapiens
acagacattccataatgtacacc

SEQ ID NO: 8462981 - DNA, 23 bp, Homo sapiens
acagacattgtacatcttgtttt

SEQ ID NO: 8462982 - DNA, 22 bp, Homo sapiens
acagacatttaataaatgctga

SEQ ID NO: 8462983 - DNA, 22 bp, Homo sapiens
aagcagtttagataggcaaagg

SEQ ID NO: 8462984 - DNA, 22 bp, Homo sapiens
aagcataaaacgttacaacatg

SEQ ID NO: 8462985 - DNA, 22 bp, Homo sapiens
acagcaggaagctggagggaaa

SEQ ID NO: 8462986 - DNA, 22 bp, Homo sapiens
acagcaggaagctggagggaaa

SEQ ID NO: 8462987 - DNA, 22 bp, Homo sapiens
aagcagtgttcccagctggccc

SEQ ID NO: 8462988 - DNA, 22 bp, Homo sapiens
aagcagtttagataggcaaagg

SEQ ID NO: 8462989 - DNA, 22 bp, Homo sapiens
aagcagttactatttactatta

SEQ ID NO: 8462990 - DNA, 22 bp, Homo sapiens
acagcaggtagctttgtgcctc

SEQ ID NO: 8462991 - DNA, 22 bp, Homo sapiens
acagcaggggtggaataaacgt

SEQ ID NO: 8462992 - DNA, 22 bp, Homo sapiens
acagcagggtcacattccctct

SEQ ID NO: 8462993 - DNA, 22 bp, Homo sapiens
acagcagggggagctgttggac

SEQ ID NO: 8462994 - DNA, 22 bp, Homo sapiens
acagcagggggagctgttggac

SEQ ID NO: 8462995 - DNA, 21 bp, Homo sapiens
aagcaggctgtaatcatgtgg

SEQ ID NO: 8462996 - DNA, 22 bp, Homo sapiens
aagcaggcttggtgtggccgct

SEQ ID NO: 8462997 - DNA, 22 bp, Homo sapiens
aagcaggctcacgccaggcagt

SEQ ID NO: 8462998 - DNA, 21 bp, Homo sapiens
aagcaggctgtaatcatgtgg

SEQ ID NO: 8462999 - DNA, 22 bp, Homo sapiens
aagcaggagagcctgggcgagc

SEQ ID NO: 8463000 - DNA, 21 bp, Homo sapiens
aagcaggacatatgatgccct

SEQ ID NO: 8463001 - DNA, 22 bp, Homo sapiens
aagcaggcgagggcctggagca

SEQ ID NO: 8463002 - DNA, 22 bp, Homo sapiens
aagcagggctccctggggactc

SEQ ID NO: 8463003 - DNA, 22 bp, Homo sapiens
aagcagtagaatgcattgcttt

SEQ ID NO: 8463004 - DNA, 22 bp, Homo sapiens
aagcaggtgtgagccagtgggc

SEQ ID NO: 8463005 - DNA, 22 bp, Homo sapiens
aagccctcatccccatgggcgt

SEQ ID NO: 8463006 - DNA, 22 bp, Homo sapiens
aagccctcagagcctctttgac

SEQ ID NO: 8463007 - DNA, 22 bp, Homo sapiens
aagccctgacctgagagtccgt

SEQ ID NO: 8463008 - DNA, 22 bp, Homo sapiens
aagccctccgtacgtgctagct

SEQ ID NO: 8463009 - DNA, 22 bp, Homo sapiens
aagccctcattagccatagccc

SEQ ID NO: 8463010 - DNA, 22 bp, Homo sapiens
aagcccagcatccctgcaccag

SEQ ID NO: 8463011 - DNA, 22 bp, Homo sapiens
aagcccagcatccctgcaccag

SEQ ID NO: 8463012 - DNA, 22 bp, Homo sapiens
aagcccaggtaagtggctcatg

SEQ ID NO: 8463013 - DNA, 22 bp, Homo sapiens
aagcccataaaaagaggtccct

SEQ ID NO: 8463014 - DNA, 22 bp, Homo sapiens
aagcccagtttcacactgagac

SEQ ID NO: 8463015 - DNA, 22 bp, Homo sapiens
aagcccagtaccttcagtgagg

SEQ ID NO: 8463016 - DNA, 22 bp, Homo sapiens
acagccaggaattctggagaag

SEQ ID NO: 8463017 - DNA, 22 bp, Homo sapiens
acagccagcagagctgtttcct

SEQ ID NO: 8463018 - DNA, 21 bp, Homo sapiens
acagccaggaacatgaggggc

SEQ ID NO: 8463019 - DNA, 19 bp, Homo sapiens
acagcaggtgtggggataa

SEQ ID NO: 8463020 - DNA, 19 bp, Homo sapiens
acagcaggtgtggggataa

SEQ ID NO: 8463021 - DNA, 22 bp, Homo sapiens
acagcaggttacagtggcacag

SEQ ID NO: 8463022 - DNA, 22 bp, Homo sapiens
acagcaggttacagtggcacag

SEQ ID NO: 8463023 - DNA, 22 bp, Homo sapiens
acagccagatctgagagatctt

SEQ ID NO: 8463024 - DNA, 22 bp, Homo sapiens
acagccaggagccatgggcagg

SEQ ID NO: 8463025 - DNA, 22 bp, Homo sapiens
acagccaggaggaactcagtga

SEQ ID NO: 8463026 - DNA, 22 bp, Homo sapiens
aagcccagatgtgagaactgag

SEQ ID NO: 8463027 - DNA, 22 bp, Homo sapiens
aagccaggttccatggaggagc

SEQ ID NO: 8463028 - DNA, 22 bp, Homo sapiens
acagccaggcccagcacgcagg

SEQ ID NO: 8463029 - DNA, 22 bp, Homo sapiens
aagaactgagtacgttaataaa

SEQ ID NO: 8463030 - DNA, 18 bp, Homo sapiens
aagaactgaggtcctaga

SEQ ID NO: 8463031 - DNA, 22 bp, Homo sapiens
aagaactggttatgttatcttg

SEQ ID NO: 8463032 - DNA, 23 bp, Homo sapiens
aagaactgcgaatggagaaagta

SEQ ID NO: 8463033 - DNA, 23 bp, Homo sapiens
aagaactgcgaatggagaaagta

SEQ ID NO: 8463034 - DNA, 22 bp, Homo sapiens
aagaactgagtacgttaataaa

SEQ ID NO: 8463035 - DNA, 22 bp, Homo sapiens
aagaactagtcttacagcctca

SEQ ID NO: 8463036 - DNA, 22 bp, Homo sapiens
aagaacctatatgctgatgaat

SEQ ID NO: 8463037 - DNA, 22 bp, Homo sapiens
aagaacattttgtagaatgaca

SEQ ID NO: 8463038 - DNA, 22 bp, Homo sapiens
aagaacattgatattgtctatg

SEQ ID NO: 8463039 - DNA, 22 bp, Homo sapiens
aagaacatttatgatggcattt

SEQ ID NO: 8463040 - DNA, 22 bp, Homo sapiens
aagaacattttgtagaatgaca

SEQ ID NO: 8463041 - DNA, 22 bp, Homo sapiens
aagaacattgatattgtctatg

SEQ ID NO: 8463042 - DNA, 22 bp, Homo sapiens
aagaacattgatattgtctatg

SEQ ID NO: 8463043 - DNA, 22 bp, Homo sapiens
aatgtacaataagacaaagagg

SEQ ID NO: 8463044 - DNA, 22 bp, Homo sapiens
aatgtacaataagacaaagagg

SEQ ID NO: 8463045 - DNA, 22 bp, Homo sapiens
aatgtacaagggttccagtttt

SEQ ID NO: 8463046 - DNA, 22 bp, Homo sapiens
aatgtacaagggttccagtttt

SEQ ID NO: 8463047 - DNA, 22 bp, Homo sapiens
aatgtacaagggttccagtttt

SEQ ID NO: 8463048 - DNA, 22 bp, Homo sapiens
aagaactgtttacaattttcac

SEQ ID NO: 8463049 - DNA, 22 bp, Homo sapiens
aagaactgtgctccaggctcca

SEQ ID NO: 8463050 - DNA, 22 bp, Homo sapiens
aagaactgtatcaagatgtagt

SEQ ID NO: 8463051 - DNA, 22 bp, Homo sapiens
aagaacttcctaatatattttc

SEQ ID NO: 8463052 - DNA, 22 bp, Homo sapiens
aagaactttgatttcattgcat

SEQ ID NO: 8463053 - DNA, 22 bp, Homo sapiens
aagaactttaaagcacttatga

SEQ ID NO: 8463054 - DNA, 22 bp, Homo sapiens
aagaagaagtgttatttttaga

SEQ ID NO: 8463055 - DNA, 22 bp, Homo sapiens
aagaagaagtgttatttttaga

SEQ ID NO: 8463056 - DNA, 23 bp, Homo sapiens
aagaactttggtcctgcagagtc

SEQ ID NO: 8463057 - DNA, 22 bp, Homo sapiens
aagaacttttggcaagtgttat

SEQ ID NO: 8463058 - DNA, 22 bp, Homo sapiens
aagaagagaaatgtgctgctgg

SEQ ID NO: 8463059 - DNA, 22 bp, Homo sapiens
aagaagatggttaactttcagt

SEQ ID NO: 8463060 - DNA, 19 bp, Homo sapiens
aagaagcaataagctgtga

SEQ ID NO: 8463061 - DNA, 22 bp, Homo sapiens
acaaaacagtgttcctgcccct

SEQ ID NO: 8463062 - DNA, 22 bp, Homo sapiens
aagaatctatggtacatccaag

SEQ ID NO: 8463063 - DNA, 23 bp, Homo sapiens
aagaatctcagaattagaaatac

SEQ ID NO: 8463064 - DNA, 23 bp, Homo sapiens
aagaatctcagaattagaaatac

SEQ ID NO: 8463065 - DNA, 22 bp, Homo sapiens
aagaatctccatctgattcact

SEQ ID NO: 8463066 - DNA, 15 bp, Homo sapiens
aagaatctgaagctt

SEQ ID NO: 8463067 - DNA, 22 bp, Homo sapiens
aagaatctctgatcaggcttta

SEQ ID NO: 8463068 - DNA, 22 bp, Homo sapiens
aagaatctctcaagtgtgacaa

SEQ ID NO: 8463069 - DNA, 18 bp, Homo sapiens
aagaatctctgactcttt

SEQ ID NO: 8463070 - DNA, 22 bp, Homo sapiens
aagaatctctctactttattac

SEQ ID NO: 8463071 - DNA, 22 bp, Homo sapiens
aagaatctccattcctgtttta

SEQ ID NO: 8463072 - DNA, 22 bp, Homo sapiens
aagaatctccatctgattcact

SEQ ID NO: 8463073 - DNA, 22 bp, Homo sapiens
acaaatatttactgaatccact

SEQ ID NO: 8463074 - DNA, 22 bp, Homo sapiens
acaaatatttactgaatccact

SEQ ID NO: 8463075 - DNA, 22 bp, Homo sapiens
acaaatatttactgaatccact

SEQ ID NO: 8463076 - DNA, 22 bp, Homo sapiens
acaaagctagagaagagaattg

SEQ ID NO: 8463077 - DNA, 22 bp, Homo sapiens
aagaatctgacataatttcctg

SEQ ID NO: 8463078 - DNA, 22 bp, Homo sapiens
acaaatgaacatataagcttga

SEQ ID NO: 8463079 - DNA, 19 bp, Homo sapiens
acaaattgtcctcatcaag

SEQ ID NO: 8463080 - DNA, 22 bp, Homo sapiens
acaaaagtgtaggaattcctta

SEQ ID NO: 8463081 - DNA, 22 bp, Homo sapiens
acaaaagtgtaggaattcctta

SEQ ID NO: 8463082 - DNA, 22 bp, Homo sapiens
acaaaagtgtaggaattcctta

SEQ ID NO: 8463083 - DNA, 22 bp, Homo sapiens
acaaaagtgtaggaattcctta

SEQ ID NO: 8463084 - DNA, 22 bp, Homo sapiens
acaaaagtgtaggaattcctta

SEQ ID NO: 8463085 - DNA, 22 bp, Homo sapiens
acaaaagtgagtgtgtctcaga

SEQ ID NO: 8463086 - DNA, 22 bp, Homo sapiens
acaaaagcttttggagggttgt

SEQ ID NO: 8463087 - DNA, 22 bp, Homo sapiens
acaaaagcttttggagggttgt

SEQ ID NO: 8463088 - DNA, 22 bp, Homo sapiens
acaaaagcactgcagagtaagc

SEQ ID NO: 8463089 - DNA, 22 bp, Homo sapiens
acaaaacagtgttcctgcccct

SEQ ID NO: 8463090 - DNA, 22 bp, Homo sapiens
acaaaagcactgcagagtaagc

SEQ ID NO: 8463091 - DNA, 22 bp, Homo sapiens
acaaaatagagttctcccctgg

SEQ ID NO: 8463092 - DNA, 22 bp, Homo sapiens
aagaatatagattttttgaagt

SEQ ID NO: 8463093 - DNA, 22 bp, Homo sapiens
acaaatttgaatcctgacttct

SEQ ID NO: 8463094 - DNA, 22 bp, Homo sapiens
acaaatttgaatcctgacttct

SEQ ID NO: 8463095 - DNA, 22 bp, Homo sapiens
acaaatttggtgagagtaaata

SEQ ID NO: 8463096 - DNA, 22 bp, Homo sapiens
acaaatttggtgagagtaaata

SEQ ID NO: 8463097 - DNA, 22 bp, Homo sapiens
acaaatttgtgtagttatggca

SEQ ID NO: 8463098 - DNA, 22 bp, Homo sapiens
acaaatttgtgtagttatggca

SEQ ID NO: 8463099 - DNA, 22 bp, Homo sapiens
acaaatttggtgagagtaaata

SEQ ID NO: 8463100 - DNA, 22 bp, Homo sapiens
acaaatttattgaagggcatat

SEQ ID NO: 8463101 - DNA, 22 bp, Homo sapiens
acaaatttattgaagggcatat

SEQ ID NO: 8463102 - DNA, 21 bp, Homo sapiens
acaaattgtttatataggaag

SEQ ID NO: 8463103 - DNA, 22 bp, Homo sapiens
acaaattgttgcttcatgaatg

SEQ ID NO: 8463104 - DNA, 22 bp, Homo sapiens
acaaatttcataggcaaatttt

SEQ ID NO: 8463105 - DNA, 22 bp, Homo sapiens
acaaatttcataggcaaatttt

SEQ ID NO: 8463106 - DNA, 22 bp, Homo sapiens
acaaatttcataggcaaatttt

SEQ ID NO: 8463107 - DNA, 22 bp, Homo sapiens
acaatagtcaatgcacgtcatt

SEQ ID NO: 8463108 - DNA, 22 bp, Homo sapiens
acaatagagttctcataggaca

SEQ ID NO: 8463109 - DNA, 22 bp, Homo sapiens
acaaggcttatagttgcttttt

SEQ ID NO: 8463110 - DNA, 22 bp, Homo sapiens
acaacaaaatcactagtcttcc

SEQ ID NO: 8463111 - DNA, 22 bp, Homo sapiens
acaacaaaatcactagtcttcc

SEQ ID NO: 8463112 - DNA, 22 bp, Homo sapiens
acaaggcttatagttgcttttt

SEQ ID NO: 8463113 - DNA, 20 bp, Homo sapiens
acaatatgtagatgaatagc

SEQ ID NO: 8463114 - DNA, 22 bp, Homo sapiens
acaatattgtacccagaagttt

SEQ ID NO: 8463115 - DNA, 22 bp, Homo sapiens
acaatatagtccatgagcatgc

SEQ ID NO: 8463116 - DNA, 22 bp, Homo sapiens
acaatatgggatatacatttta

SEQ ID NO: 8463117 - DNA, 22 bp, Homo sapiens
acaatatagtccatgagcatgc

SEQ ID NO: 8463118 - DNA, 21 bp, Homo sapiens
acaatgtcaaggtcagacatt

SEQ ID NO: 8463119 - DNA, 23 bp, Homo sapiens
acaatgtctgttcataaaatacc

SEQ ID NO: 8463120 - DNA, 22 bp, Homo sapiens
acaatgtcacctctcatgtttt

SEQ ID NO: 8463121 - DNA, 22 bp, Homo sapiens
acaatgtctcatattcgtgttc

SEQ ID NO: 8463122 - DNA, 22 bp, Homo sapiens
aagataatattcattaactaga

SEQ ID NO: 8463123 - DNA, 22 bp, Homo sapiens
aagataatattcattaactaga

SEQ ID NO: 8463124 - DNA, 22 bp, Homo sapiens
aagataatattcattaactaga

SEQ ID NO: 8463125 - DNA, 22 bp, Homo sapiens
aagagtttccagttgtggctca

SEQ ID NO: 8463126 - DNA, 22 bp, Homo sapiens
aagagtttccagttgtggctca

SEQ ID NO: 8463127 - DNA, 22 bp, Homo sapiens
aagataatgtgtctgtctttgc

SEQ ID NO: 8463128 - DNA, 22 bp, Homo sapiens
aagataatgttctagctgtcag

SEQ ID NO: 8463129 - DNA, 22 bp, Homo sapiens
aagataatgtgtctgtctttgc

SEQ ID NO: 8463130 - DNA, 22 bp, Homo sapiens
acacagccccacggtgagcaaa

SEQ ID NO: 8463131 - DNA, 17 bp, Homo sapiens
acacagccaggttctcc

SEQ ID NO: 8463132 - DNA, 22 bp, Homo sapiens
acacagccagggtagtaaggct

SEQ ID NO: 8463133 - DNA, 22 bp, Homo sapiens
acacagcaaggtctgactttgg

SEQ ID NO: 8463134 - DNA, 22 bp, Homo sapiens
acacagcaaggtctgactttgg

SEQ ID NO: 8463135 - DNA, 22 bp, Homo sapiens
acacagcttcaaagtctaattc

SEQ ID NO: 8463136 - DNA, 22 bp, Homo sapiens
acacagctagtgagtggcagag

SEQ ID NO: 8463137 - DNA, 22 bp, Homo sapiens
acacagctagtgagtggcagag

SEQ ID NO: 8463138 - DNA, 22 bp, Homo sapiens
acacagctatggggtaggaaac

SEQ ID NO: 8463139 - DNA, 22 bp, Homo sapiens
acacagctcagtgcctccaaga

SEQ ID NO: 8463140 - DNA, 20 bp, Homo sapiens
acacagactcagcttggatg

SEQ ID NO: 8463141 - DNA, 17 bp, Homo sapiens
acacagagattaacaca

SEQ ID NO: 8463142 - DNA, 22 bp, Homo sapiens
acacagaagctttttctattcc

SEQ ID NO: 8463143 - DNA, 22 bp, Homo sapiens
acacacatgcctttcctaagta

SEQ ID NO: 8463144 - DNA, 22 bp, Homo sapiens
acacagaagatctcttaatgct

SEQ ID NO: 8463145 - DNA, 22 bp, Homo sapiens
acacacatgcctttcctaagta

SEQ ID NO: 8463146 - DNA, 22 bp, Homo sapiens
acacagaagctttttctattcc

SEQ ID NO: 8463147 - DNA, 22 bp, Homo sapiens
acacagagctggaactgcttca

SEQ ID NO: 8463148 - DNA, 22 bp, Homo sapiens
acacagagccagggaatacagt

SEQ ID NO: 8463149 - DNA, 22 bp, Homo sapiens
acacagagcaaatcatgacaga

SEQ ID NO: 8463150 - DNA, 22 bp, Homo sapiens
acacagagctggaactgcttca

SEQ ID NO: 8463151 - DNA, 22 bp, Homo sapiens
acacagagctggaactgcttca

SEQ ID NO: 8463152 - DNA, 22 bp, Homo sapiens
acacagcaacttgcagtatgga

SEQ ID NO: 8463153 - DNA, 22 bp, Homo sapiens
acacagcaacttgcagtatgga

SEQ ID NO: 8463154 - DNA, 22 bp, Homo sapiens
cactaagttggtgttaattagt

SEQ ID NO: 8463155 - DNA, 22 bp, Homo sapiens
cactaaatgtttcaatgtggga

SEQ ID NO: 8463156 - DNA, 22 bp, Homo sapiens
cactagaaccaatgacatttct

SEQ ID NO: 8463157 - DNA, 22 bp, Homo sapiens
cactagagaaacgcccaggctc

SEQ ID NO: 8463158 - DNA, 22 bp, Homo sapiens
cacctgcagggggagtcaagag

SEQ ID NO: 8463159 - DNA, 22 bp, Homo sapiens
cacgggagacgtgatcttggac

SEQ ID NO: 8463160 - DNA, 22 bp, Homo sapiens
cacatttaagtgcttgttcaga

SEQ ID NO: 8463161 - DNA, 22 bp, Homo sapiens
cactaaaactacattggaaaca

SEQ ID NO: 8463162 - DNA, 22 bp, Homo sapiens
cacgttaacagctaacagatga

SEQ ID NO: 8463163 - DNA, 22 bp, Homo sapiens
cacgttaacagctaacagatga

SEQ ID NO: 8463164 - DNA, 22 bp, Homo sapiens
cacgtgcaggtcttaggagaca

SEQ ID NO: 8463165 - DNA, 22 bp, Homo sapiens
cacgggcagtgagcacagcctg

SEQ ID NO: 8463166 - DNA, 22 bp, Homo sapiens
cacatttaagcagatgtggacc

SEQ ID NO: 8463167 - DNA, 22 bp, Homo sapiens
cacatttaaaggttgaagctga

SEQ ID NO: 8463168 - DNA, 22 bp, Homo sapiens
cacattgtagagattagaaaga

SEQ ID NO: 8463169 - DNA, 22 bp, Homo sapiens
cacaggctccggccttgcagcc

SEQ ID NO: 8463170 - DNA, 22 bp, Homo sapiens
cacaggctccggccttgcagcc

SEQ ID NO: 8463171 - DNA, 22 bp, Homo sapiens
cacaggctccggccttgcagcc

SEQ ID NO: 8463172 - DNA, 20 bp, Homo sapiens
cacaggctatatgagagcca

SEQ ID NO: 8463173 - DNA, 18 bp, Homo sapiens
cacaggctcccagtgagg

SEQ ID NO: 8463174 - DNA, 22 bp, Homo sapiens
agcaggctaggaacctcactgc

SEQ ID NO: 8463175 - DNA, 22 bp, Homo sapiens
agcaggctactcctgtgttcgt

SEQ ID NO: 8463176 - DNA, 19 bp, Homo sapiens
agcaggctaggctgcctct

SEQ ID NO: 8463177 - DNA, 19 bp, Homo sapiens
agcaggctaggctgcctct

SEQ ID NO: 8463178 - DNA, 20 bp, Homo sapiens
cacaggctatatgagagcca

SEQ ID NO: 8463179 - DNA, 20 bp, Homo sapiens
agcaggccttggggagagga

SEQ ID NO: 8463180 - DNA, 22 bp, Homo sapiens
agcaggcctgccacctcggggt

SEQ ID NO: 8463181 - DNA, 22 bp, Homo sapiens
agcaggctaatcttgctgaaca

SEQ ID NO: 8463182 - DNA, 22 bp, Homo sapiens
agcaggctaagggacctgttta

SEQ ID NO: 8463183 - DNA, 21 bp, Homo sapiens
agcaggcccaatggagggggc

SEQ ID NO: 8463184 - DNA, 22 bp, Homo sapiens
agcaggcctcatgcaccagcta

SEQ ID NO: 8463185 - DNA, 22 bp, Homo sapiens
agcaggcccaagctggggggaa

SEQ ID NO: 8463186 - DNA, 19 bp, Homo sapiens
agcaggccaggcaggtggc

SEQ ID NO: 8463187 - DNA, 17 bp, Homo sapiens
cacatgtctacatggat

SEQ ID NO: 8463188 - DNA, 22 bp, Homo sapiens
cacattctttcacagttctgaa

SEQ ID NO: 8463189 - DNA, 22 bp, Homo sapiens
cacatgtagtaagcaggcaatg

SEQ ID NO: 8463190 - DNA, 22 bp, Homo sapiens
cacatgtcctggcgctgagccc

SEQ ID NO: 8463191 - DNA, 22 bp, Homo sapiens
cacatggcctgtgtggccagac

SEQ ID NO: 8463192 - DNA, 22 bp, Homo sapiens
cacatgcttagatttcagtgga

SEQ ID NO: 8463193 - DNA, 22 bp, Homo sapiens
cacaggctcttctcacttgatt

SEQ ID NO: 8463194 - DNA, 22 bp, Homo sapiens
cacaggctgcccgcagctggga

SEQ ID NO: 8463195 - DNA, 22 bp, Homo sapiens
cacatgaacatgctggaaaagc

SEQ ID NO: 8463196 - DNA, 22 bp, Homo sapiens
cacaggctcttctcacttgatt

SEQ ID NO: 8463197 - DNA, 22 bp, Homo sapiens
cacaggctctccagggcctgga

SEQ ID NO: 8463198 - DNA, 22 bp, Homo sapiens
cactggtacactgaatggcgtt

SEQ ID NO: 8463199 - DNA, 21 bp, Homo sapiens
cactggtagatggcccgcagg

SEQ ID NO: 8463200 - DNA, 22 bp, Homo sapiens
cactggtagagagaagacaagg

SEQ ID NO: 8463201 - DNA, 22 bp, Homo sapiens
cactggtacgtaggttggggca

SEQ ID NO: 8463202 - DNA, 22 bp, Homo sapiens
cactgggtaaatttgaggctga

SEQ ID NO: 8463203 - DNA, 22 bp, Homo sapiens
cactgggtcaggatagagccca

SEQ ID NO: 8463204 - DNA, 22 bp, Homo sapiens
cactggggtgggcctggtagag

SEQ ID NO: 8463205 - DNA, 23 bp, Homo sapiens
cactgggggctgctacagagagg

SEQ ID NO: 8463206 - DNA, 22 bp, Homo sapiens
cactggtagcagttaagttagg

SEQ ID NO: 8463207 - DNA, 22 bp, Homo sapiens
cactggtagtttcagcaaccag

SEQ ID NO: 8463208 - DNA, 22 bp, Homo sapiens
cactggtatttgaaaatagatg

SEQ ID NO: 8463209 - DNA, 22 bp, Homo sapiens
cactggtcagcatggtagacca

SEQ ID NO: 8463210 - DNA, 22 bp, Homo sapiens
cactggtcagtcggtcagtctc

SEQ ID NO: 8463211 - DNA, 22 bp, Homo sapiens
agcattttctgagagtatagat

SEQ ID NO: 8463212 - DNA, 22 bp, Homo sapiens
cactgggctttgtagttagcat

SEQ ID NO: 8463213 - DNA, 23 bp, Homo sapiens
cactgggcccagggtgtggaggc

SEQ ID NO: 8463214 - DNA, 22 bp, Homo sapiens
cagaaactagatttagacacaa

SEQ ID NO: 8463215 - DNA, 22 bp, Homo sapiens
cagaaaccaaatgggatgggga

SEQ ID NO: 8463216 - DNA, 22 bp, Homo sapiens
cagaaacctccctgaatatttt

SEQ ID NO: 8463217 - DNA, 22 bp, Homo sapiens
cagaaacctccctgaatatttt

SEQ ID NO: 8463218 - DNA, 22 bp, Homo sapiens
cagaaacctgtctggagtggga

SEQ ID NO: 8463219 - DNA, 22 bp, Homo sapiens
cagaaacctgtctggagtggga

SEQ ID NO: 8463220 - DNA, 22 bp, Homo sapiens
cagaaacatgtataaagttgta

SEQ ID NO: 8463221 - DNA, 22 bp, Homo sapiens
cagaaaccaaatgggatgggga

SEQ ID NO: 8463222 - DNA, 21 bp, Homo sapiens
cagaaacttgctttgccttct

SEQ ID NO: 8463223 - DNA, 22 bp, Homo sapiens
cagaaactgcttgtggtcatct

SEQ ID NO: 8463224 - DNA, 20 bp, Homo sapiens
cagaaagaaggtagattttt

SEQ ID NO: 8463225 - DNA, 22 bp, Homo sapiens
agccaacacatgtaaatgcacc

SEQ ID NO: 8463226 - DNA, 22 bp, Homo sapiens
agccaacagccagcatcaacca

SEQ ID NO: 8463227 - DNA, 22 bp, Homo sapiens
agccaaagtccaaatgcagtgt

SEQ ID NO: 8463228 - DNA, 22 bp, Homo sapiens
agccaaagatcagtgtgcaagt

SEQ ID NO: 8463229 - DNA, 22 bp, Homo sapiens
cagaaagacctgattggcagtt

SEQ ID NO: 8463230 - DNA, 20 bp, Homo sapiens
cagaaagaaggtagattttt

SEQ ID NO: 8463231 - DNA, 22 bp, Homo sapiens
cagaaagacctgattggcagtt

SEQ ID NO: 8463232 - DNA, 22 bp, Homo sapiens
cactgcactccatcctgggaaa

SEQ ID NO: 8463233 - DNA, 22 bp, Homo sapiens
cactgcactccatcctgggaaa

SEQ ID NO: 8463234 - DNA, 22 bp, Homo sapiens
cactgcactccagcccgggcaa

SEQ ID NO: 8463235 - DNA, 22 bp, Homo sapiens
cactgcacaatgtagcaaagaa

SEQ ID NO: 8463236 - DNA, 22 bp, Homo sapiens
cactgcactccagcactccagc

SEQ ID NO: 8463237 - DNA, 22 bp, Homo sapiens
agcattcaagtaattcacttgg

SEQ ID NO: 8463238 - DNA, 21 bp, Homo sapiens
agcattcaaaagatgccataa

SEQ ID NO: 8463239 - DNA, 22 bp, Homo sapiens
cactgcacttcagcctgggtga

SEQ ID NO: 8463240 - DNA, 22 bp, Homo sapiens
cactgcacttcagcctgggtga

SEQ ID NO: 8463241 - DNA, 22 bp, Homo sapiens
agcattaggtgtgtttcagagg

SEQ ID NO: 8463242 - DNA, 22 bp, Homo sapiens
agcatttaggagaatttgagaa

SEQ ID NO: 8463243 - DNA, 22 bp, Homo sapiens
agcatttagttagtaaatgttt

SEQ ID NO: 8463244 - DNA, 22 bp, Homo sapiens
caattacatttattgagcattc

SEQ ID NO: 8463245 - DNA, 22 bp, Homo sapiens
caattacatttattgagcattc

SEQ ID NO: 8463246 - DNA, 22 bp, Homo sapiens
caattactggtccacagaaatt

SEQ ID NO: 8463247 - DNA, 21 bp, Homo sapiens
caattacagatggctcagggg

SEQ ID NO: 8463248 - DNA, 21 bp, Homo sapiens
caattacagatggctcagggg

SEQ ID NO: 8463249 - DNA, 21 bp, Homo sapiens
caattacagatggctcagggg

SEQ ID NO: 8463250 - DNA, 22 bp, Homo sapiens
caattacatttattgagcattc

SEQ ID NO: 8463251 - DNA, 21 bp, Homo sapiens
caattacagatggctcagggg

SEQ ID NO: 8463252 - DNA, 22 bp, Homo sapiens
caattatatttagaatgataca

SEQ ID NO: 8463253 - DNA, 22 bp, Homo sapiens
caattatatttagaatgataca

SEQ ID NO: 8463254 - DNA, 22 bp, Homo sapiens
caattacttttgcaccaatata

SEQ ID NO: 8463255 - DNA, 22 bp, Homo sapiens
caattagaggaggaagctcata

SEQ ID NO: 8463256 - DNA, 22 bp, Homo sapiens
caattagacatttattggccag

SEQ ID NO: 8463257 - DNA, 22 bp, Homo sapiens
caattattcagtgacttaagag

SEQ ID NO: 8463258 - DNA, 22 bp, Homo sapiens
caatgtttttccttccttaata

SEQ ID NO: 8463259 - DNA, 22 bp, Homo sapiens
caatgatagattttacaaatta

SEQ ID NO: 8463260 - DNA, 22 bp, Homo sapiens
caagtctgtctgctcctgtgtg

SEQ ID NO: 8463261 - DNA, 22 bp, Homo sapiens
caagtctgtctgctcctgtgtg

SEQ ID NO: 8463262 - DNA, 22 bp, Homo sapiens
caagtccttagatggttctttg

SEQ ID NO: 8463263 - DNA, 22 bp, Homo sapiens
caagtccttttcttggctcagg

SEQ ID NO: 8463264 - DNA, 22 bp, Homo sapiens
caagtcctcaaagggctctgct

SEQ ID NO: 8463265 - DNA, 22 bp, Homo sapiens
caagtcctcgcttctagctgtg

SEQ ID NO: 8463266 - DNA, 22 bp, Homo sapiens
caagtccttttcttggctcagg

SEQ ID NO: 8463267 - DNA, 22 bp, Homo sapiens
caagtccttttcttggctcagg

SEQ ID NO: 8463268 - DNA, 22 bp, Homo sapiens
caagtccttttcttggctcagg

SEQ ID NO: 8463269 - DNA, 22 bp, Homo sapiens
caagtcattgtttagtcatgtt

SEQ ID NO: 8463270 - DNA, 22 bp, Homo sapiens
caagtcccccaagaacagaacc

SEQ ID NO: 8463271 - DNA, 22 bp, Homo sapiens
caagggctcacggtctgctggg

SEQ ID NO: 8463272 - DNA, 22 bp, Homo sapiens
caagggccatctgagggcactg

SEQ ID NO: 8463273 - DNA, 22 bp, Homo sapiens
caagggcagatagctggtccaa

SEQ ID NO: 8463274 - DNA, 22 bp, Homo sapiens
caagggaaggctaagggcaaca

SEQ ID NO: 8463275 - DNA, 22 bp, Homo sapiens
caagctggtatcagctagagcg

SEQ ID NO: 8463276 - DNA, 22 bp, Homo sapiens
caagctgggtgcgggcagtata

SEQ ID NO: 8463277 - DNA, 22 bp, Homo sapiens
caagctttatccgccatgtagg

SEQ ID NO: 8463278 - DNA, 22 bp, Homo sapiens
caaggaaaaagcgagctcgggg

SEQ ID NO: 8463279 - DNA, 22 bp, Homo sapiens
agcaattatgataaggccgctg

SEQ ID NO: 8463280 - DNA, 22 bp, Homo sapiens
agcaattatggagttgttgacg

SEQ ID NO: 8463281 - DNA, 22 bp, Homo sapiens
agcaattattgtataagaacaa

SEQ ID NO: 8463282 - DNA, 22 bp, Homo sapiens
agcaattattgtataagaacaa

SEQ ID NO: 8463283 - DNA, 22 bp, Homo sapiens
caagctggaggttggagctact

SEQ ID NO: 8463284 - DNA, 22 bp, Homo sapiens
caagctggaggttggagctact

SEQ ID NO: 8463285 - DNA, 22 bp, Homo sapiens
caagcagatattttagtcaaga

SEQ ID NO: 8463286 - DNA, 22 bp, Homo sapiens
caagcagaggtttatgtattag

SEQ ID NO: 8463287 - DNA, 22 bp, Homo sapiens
caagcagagaggttagaacaca

SEQ ID NO: 8463288 - DNA, 22 bp, Homo sapiens
caagctgggtcccaacaattac

SEQ ID NO: 8463289 - DNA, 22 bp, Homo sapiens
caagctggctgggagaggcacg

SEQ ID NO: 8463290 - DNA, 22 bp, Homo sapiens
caagctggctcttatgcaaaaa

SEQ ID NO: 8463291 - DNA, 22 bp, Homo sapiens
caagctggagttcctcagagtg

SEQ ID NO: 8463292 - DNA, 22 bp, Homo sapiens
agcagagaccatatagcccaga

SEQ ID NO: 8463293 - DNA, 22 bp, Homo sapiens
caaggccaaagggccactgtca

SEQ ID NO: 8463294 - DNA, 22 bp, Homo sapiens
agcagacatatctcatgtcaca

SEQ ID NO: 8463295 - DNA, 22 bp, Homo sapiens
caaggaagttttaggagaggaa

SEQ ID NO: 8463296 - DNA, 20 bp, Homo sapiens
cacaggaaagctactcagtt

SEQ ID NO: 8463297 - DNA, 20 bp, Homo sapiens
cacaggaaagctactcagtt

SEQ ID NO: 8463298 - DNA, 22 bp, Homo sapiens
cacagctggggaagctgaggcc

SEQ ID NO: 8463299 - DNA, 22 bp, Homo sapiens
cacagctggggaagctgaggcc

SEQ ID NO: 8463300 - DNA, 22 bp, Homo sapiens
cacagctggaatggggtacctg

SEQ ID NO: 8463301 - DNA, 22 bp, Homo sapiens
cacaggaaatattaggagggat

SEQ ID NO: 8463302 - DNA, 22 bp, Homo sapiens
agcaggcaggcccagcggctgg

SEQ ID NO: 8463303 - DNA, 22 bp, Homo sapiens
agcaggcaggcccagcggctgg

SEQ ID NO: 8463304 - DNA, 22 bp, Homo sapiens
agcaggccactgcagctggagc

SEQ ID NO: 8463305 - DNA, 22 bp, Homo sapiens
cacagaaatattgtgtcccttg

SEQ ID NO: 8463306 - DNA, 20 bp, Homo sapiens
cacagaacaaattgcaggac

SEQ ID NO: 8463307 - DNA, 22 bp, Homo sapiens
cacagaaattattaggatgctt

SEQ ID NO: 8463308 - DNA, 22 bp, Homo sapiens
cacagaaaggctcaaatcccaa

SEQ ID NO: 8463309 - DNA, 22 bp, Homo sapiens
cacagctgaccaccctgctccc

SEQ ID NO: 8463310 - DNA, 22 bp, Homo sapiens
cacagctgaccaccctgctccc

SEQ ID NO: 8463311 - DNA, 22 bp, Homo sapiens
cacagaacaccaaagaaccttc

SEQ ID NO: 8463312 - DNA, 22 bp, Homo sapiens
cacagctgccatggctgcactt

SEQ ID NO: 8463313 - DNA, 22 bp, Homo sapiens
cacagctgccatggctgcactt

SEQ ID NO: 8463314 - DNA, 22 bp, Homo sapiens
cacagctgccatgcagtcagtg

SEQ ID NO: 8463315 - DNA, 22 bp, Homo sapiens
cacagctgccatgcagtcagtg

SEQ ID NO: 8463316 - DNA, 22 bp, Homo sapiens
cacagctgccctactccatgtg

SEQ ID NO: 8463317 - DNA, 22 bp, Homo sapiens
cacagctgccctactccatgtg

SEQ ID NO: 8463318 - DNA, 22 bp, Homo sapiens
cacagctgccctaactgtactc

SEQ ID NO: 8463319 - DNA, 22 bp, Homo sapiens
cacagctgccctaactgtactc

SEQ ID NO: 8463320 - DNA, 22 bp, Homo sapiens
cacacttttggcatgtttggtt

SEQ ID NO: 8463321 - DNA, 22 bp, Homo sapiens
cacagaaaaaggcttgaaaatc

SEQ ID NO: 8463322 - DNA, 22 bp, Homo sapiens
cacagaaaaaggcttgaaaatc

SEQ ID NO: 8463323 - DNA, 22 bp, Homo sapiens
cacactgttgaggacgagatgt

SEQ ID NO: 8463324 - DNA, 22 bp, Homo sapiens
cacacttgtgaccgatataatg

SEQ ID NO: 8463325 - DNA, 22 bp, Homo sapiens
cacacttgcttcagagtcaagt

SEQ ID NO: 8463326 - DNA, 22 bp, Homo sapiens
cacactgttgaggacgagatgt

SEQ ID NO: 8463327 - DNA, 22 bp, Homo sapiens
cacacatgtctctccatgctct

SEQ ID NO: 8463328 - DNA, 22 bp, Homo sapiens
cacacatgtgggatccgcaggg

SEQ ID NO: 8463329 - DNA, 22 bp, Homo sapiens
cacacatgacccacttttaccg

SEQ ID NO: 8463330 - DNA, 22 bp, Homo sapiens
cacacatgacccacttttaccg

SEQ ID NO: 8463331 - DNA, 22 bp, Homo sapiens
cacacatggctgccagggaggt

SEQ ID NO: 8463332 - DNA, 22 bp, Homo sapiens
cacacatgaatccctagtacct

SEQ ID NO: 8463333 - DNA, 22 bp, Homo sapiens
cacacatgaatccctagtacct

SEQ ID NO: 8463334 - DNA, 22 bp, Homo sapiens
cacacatgaatccctagtacct

SEQ ID NO: 8463335 - DNA, 22 bp, Homo sapiens
cacacatggtagcaggtacaag

SEQ ID NO: 8463336 - DNA, 22 bp, Homo sapiens
cacacatggtagcaggtacaag

SEQ ID NO: 8463337 - DNA, 22 bp, Homo sapiens
cacacatggtagcaggtacaag

SEQ ID NO: 8463338 - DNA, 22 bp, Homo sapiens
cacacatggtagcaggtacaag

SEQ ID NO: 8463339 - DNA, 22 bp, Homo sapiens
cacacatggttccgcaggatgc

SEQ ID NO: 8463340 - DNA, 22 bp, Homo sapiens
caattttattggtccaaataca

SEQ ID NO: 8463341 - DNA, 22 bp, Homo sapiens
caatttttaaactatgaagttg

SEQ ID NO: 8463342 - DNA, 22 bp, Homo sapiens
caattttcaattccttcagata

SEQ ID NO: 8463343 - DNA, 22 bp, Homo sapiens
caatttttgtacttatagtact

SEQ ID NO: 8463344 - DNA, 22 bp, Homo sapiens
cacacatcttatcccagttatt

SEQ ID NO: 8463345 - DNA, 18 bp, Homo sapiens
caattttacccagtccct

SEQ ID NO: 8463346 - DNA, 22 bp, Homo sapiens
caattcaagttgagtacagctt

SEQ ID NO: 8463347 - DNA, 22 bp, Homo sapiens
caattcaatggcaaagtattgt

SEQ ID NO: 8463348 - DNA, 22 bp, Homo sapiens
caattcaaatgcatagttcaca

SEQ ID NO: 8463349 - DNA, 22 bp, Homo sapiens
agcctaatgcttttcccaaagt

SEQ ID NO: 8463350 - DNA, 22 bp, Homo sapiens
agcctacagagggcaggtggag

SEQ ID NO: 8463351 - DNA, 22 bp, Homo sapiens
agcctagaagaagtggctactt

SEQ ID NO: 8463352 - DNA, 22 bp, Homo sapiens
agccggccatgtggtcttgtgc

SEQ ID NO: 8463353 - DNA, 22 bp, Homo sapiens
agcctagggggtcctgggccac

SEQ ID NO: 8463354 - DNA, 22 bp, Homo sapiens
agcccttagtacatttctcaag

SEQ ID NO: 8463355 - DNA, 22 bp, Homo sapiens
agcccttgagtgtatctcaaat

SEQ ID NO: 8463356 - DNA, 22 bp, Homo sapiens
agcccttggtattttccgatcc

SEQ ID NO: 8463357 - DNA, 23 bp, Homo sapiens
agcccttgataataaagcaccag

SEQ ID NO: 8463358 - DNA, 22 bp, Homo sapiens
agcccttgcagactgtcagcat

SEQ ID NO: 8463359 - DNA, 22 bp, Homo sapiens
agcctattccaggatgagctca

SEQ ID NO: 8463360 - DNA, 22 bp, Homo sapiens
agcctaggtctgggtctagcag

SEQ ID NO: 8463361 - DNA, 22 bp, Homo sapiens
cagatatgtggattctattagc

SEQ ID NO: 8463362 - DNA, 22 bp, Homo sapiens
agcctattccaggatgagctca

SEQ ID NO: 8463363 - DNA, 23 bp, Homo sapiens
cagatcatatatccagctgtaag

SEQ ID NO: 8463364 - DNA, 22 bp, Homo sapiens
agcctgagctgcctgccgcctc

SEQ ID NO: 8463365 - DNA, 22 bp, Homo sapiens
agcctgcttgagagtcctggct

SEQ ID NO: 8463366 - DNA, 22 bp, Homo sapiens
cagatcttgtactcattattga

SEQ ID NO: 8463367 - DNA, 22 bp, Homo sapiens
cagagtggcgaccccctcagct

SEQ ID NO: 8463368 - DNA, 18 bp, Homo sapiens
cagagtgggccaagagac

SEQ ID NO: 8463369 - DNA, 22 bp, Homo sapiens
cagagtggcgaccccctcagct

SEQ ID NO: 8463370 - DNA, 22 bp, Homo sapiens
agccctcctcacatcagcgtcc

SEQ ID NO: 8463371 - DNA, 22 bp, Homo sapiens
agccctcctttgttcatgctgc

SEQ ID NO: 8463372 - DNA, 22 bp, Homo sapiens
agccctcgtttctgcatcctgt

SEQ ID NO: 8463373 - DNA, 22 bp, Homo sapiens
agccctcctttgttcatgctgc

SEQ ID NO: 8463374 - DNA, 22 bp, Homo sapiens
cagagtggcagtcccaggccca

SEQ ID NO: 8463375 - DNA, 22 bp, Homo sapiens
cagagtggagatgtgtgtggaa

SEQ ID NO: 8463376 - DNA, 22 bp, Homo sapiens
cagagtggagatgtgtgtggaa

SEQ ID NO: 8463377 - DNA, 22 bp, Homo sapiens
cagagtggcactctgctggatg

SEQ ID NO: 8463378 - DNA, 22 bp, Homo sapiens
agccctgggctgtagataagca

SEQ ID NO: 8463379 - DNA, 22 bp, Homo sapiens
agccctgggctgtagataagca

SEQ ID NO: 8463380 - DNA, 22 bp, Homo sapiens
agccctcttccagccagcacag

SEQ ID NO: 8463381 - DNA, 22 bp, Homo sapiens
agccctcttcccagatgcctca

SEQ ID NO: 8463382 - DNA, 22 bp, Homo sapiens
agccctgaagctggccatgtcc

SEQ ID NO: 8463383 - DNA, 22 bp, Homo sapiens
agccctgagccagcctggtcag

SEQ ID NO: 8463384 - DNA, 22 bp, Homo sapiens
cagaggaggccaccgcataggc

SEQ ID NO: 8463385 - DNA, 22 bp, Homo sapiens
cagaggaggccaccgcataggc

SEQ ID NO: 8463386 - DNA, 17 bp, Homo sapiens
cagaggagctttggggg

SEQ ID NO: 8463387 - DNA, 22 bp, Homo sapiens
cagaggagaattgcgggatcat

SEQ ID NO: 8463388 - DNA, 22 bp, Homo sapiens
cagagcttcctgctgggcttct

SEQ ID NO: 8463389 - DNA, 22 bp, Homo sapiens
cagagtgatggcacctgctggg

SEQ ID NO: 8463390 - DNA, 22 bp, Homo sapiens
cagagtggagaaagcatttagt

SEQ ID NO: 8463391 - DNA, 22 bp, Homo sapiens
cagagtgcatggtgctgttcat

SEQ ID NO: 8463392 - DNA, 22 bp, Homo sapiens
cagagctgttactattcatgaa

SEQ ID NO: 8463393 - DNA, 22 bp, Homo sapiens
cagagctgttactattcatgaa

SEQ ID NO: 8463394 - DNA, 22 bp, Homo sapiens
cagagccatggtatgggcttgt

SEQ ID NO: 8463395 - DNA, 22 bp, Homo sapiens
cagagctgtcatttgccagtga

SEQ ID NO: 8463396 - DNA, 22 bp, Homo sapiens
cagagccatccaggtgcctgtt

SEQ ID NO: 8463397 - DNA, 22 bp, Homo sapiens
cagagccatcccagcctgtggt

SEQ ID NO: 8463398 - DNA, 22 bp, Homo sapiens
cagagccaggcctgccctcttt

SEQ ID NO: 8463399 - DNA, 22 bp, Homo sapiens
cagagcagtctggagatccagc

SEQ ID NO: 8463400 - DNA, 22 bp, Homo sapiens
cagagccagggctaggaactgg

SEQ ID NO: 8463401 - DNA, 19 bp, Homo sapiens
cagagccaggcctttggcc

SEQ ID NO: 8463402 - DNA, 20 bp, Homo sapiens
cagagccagggttttgtttt

SEQ ID NO: 8463403 - DNA, 22 bp, Homo sapiens
cagagccaggtcttgaactcag

SEQ ID NO: 8463404 - DNA, 22 bp, Homo sapiens
cagagccaggtctaggagtctc

SEQ ID NO: 8463405 - DNA, 22 bp, Homo sapiens
cagagccaggtggtgttggggc

SEQ ID NO: 8463406 - DNA, 22 bp, Homo sapiens
cagagccagtcagtcagaaact

SEQ ID NO: 8463407 - DNA, 22 bp, Homo sapiens
cagagcagtaaatctggggcac

SEQ ID NO: 8463408 - DNA, 18 bp, Homo sapiens
cagagcagtatgaatgtt

SEQ ID NO: 8463409 - DNA, 22 bp, Homo sapiens
cagagcagtccttgtcaatcag

SEQ ID NO: 8463410 - DNA, 22 bp, Homo sapiens
agccaactccctctcattgagc

SEQ ID NO: 8463411 - DNA, 16 bp, Homo sapiens
agccaggctgcctcgg

SEQ ID NO: 8463412 - DNA, 22 bp, Homo sapiens
cagagcaccagtgggagacaag

SEQ ID NO: 8463413 - DNA, 22 bp, Homo sapiens
cagagcaggggtttcccaggtt

SEQ ID NO: 8463414 - DNA, 22 bp, Homo sapiens
cagagcagggtgcaccttgggc

SEQ ID NO: 8463415 - DNA, 22 bp, Homo sapiens
cagagcaggtatctttggtgaa

SEQ ID NO: 8463416 - DNA, 22 bp, Homo sapiens
cagcagaaaatacctgtaactc

SEQ ID NO: 8463417 - DNA, 22 bp, Homo sapiens
cagcagaaaatacctgtaactc

SEQ ID NO: 8463418 - DNA, 22 bp, Homo sapiens
cagcagaaacccagcaaagcca

SEQ ID NO: 8463419 - DNA, 22 bp, Homo sapiens
cagcatcagcctggctcaggcc

SEQ ID NO: 8463420 - DNA, 22 bp, Homo sapiens
cagcatcatactacctaaatga

SEQ ID NO: 8463421 - DNA, 22 bp, Homo sapiens
cagcatggagacaaagtgggca

SEQ ID NO: 8463422 - DNA, 22 bp, Homo sapiens
cagcatggacccatcgctgagt

SEQ ID NO: 8463423 - DNA, 22 bp, Homo sapiens
cagcatggccatttctcgctgc

SEQ ID NO: 8463424 - DNA, 22 bp, Homo sapiens
cagcacttcagcattcagattt

SEQ ID NO: 8463425 - DNA, 22 bp, Homo sapiens
cagcactgttcccagaccactg

SEQ ID NO: 8463426 - DNA, 22 bp, Homo sapiens
cagcactttgagggctcttaat

SEQ ID NO: 8463427 - DNA, 22 bp, Homo sapiens
cagcactttagcggaggcatca

SEQ ID NO: 8463428 - DNA, 22 bp, Homo sapiens
cagcacttggtgccattgagtg

SEQ ID NO: 8463429 - DNA, 22 bp, Homo sapiens
cagcacttgagctttcatgtaa

SEQ ID NO: 8463430 - DNA, 22 bp, Homo sapiens
cagcactgtgataactgagcca

SEQ ID NO: 8463431 - DNA, 22 bp, Homo sapiens
cagcactggggccactggagtt

SEQ ID NO: 8463432 - DNA, 22 bp, Homo sapiens
cagcactggggccactggagtt

SEQ ID NO: 8463433 - DNA, 22 bp, Homo sapiens
agcgccactgcactccagcctg

SEQ ID NO: 8463434 - DNA, 22 bp, Homo sapiens
agcgcaggaacacgtctgcctt

SEQ ID NO: 8463435 - DNA, 22 bp, Homo sapiens
agcgccactgcactccagcctg

SEQ ID NO: 8463436 - DNA, 22 bp, Homo sapiens
agcgcctgcggtgtgagcctgc

SEQ ID NO: 8463437 - DNA, 22 bp, Homo sapiens
agcgctggctggcgctccttcc

SEQ ID NO: 8463438 - DNA, 22 bp, Homo sapiens
cagcatggtgccagtgagtcca

SEQ ID NO: 8463439 - DNA, 22 bp, Homo sapiens
cagcatggcttgagtgtttcct

SEQ ID NO: 8463440 - DNA, 22 bp, Homo sapiens
agcgacagaaaccaaggacaag

SEQ ID NO: 8463441 - DNA, 22 bp, Homo sapiens
cagcatggttgggttctgggga

SEQ ID NO: 8463442 - DNA, 22 bp, Homo sapiens
cagcatggtggagctgctcttt

SEQ ID NO: 8463443 - DNA, 22 bp, Homo sapiens
cagcatggtgccagtgagtcca

SEQ ID NO: 8463444 - DNA, 22 bp, Homo sapiens
cagcccagagaaggggcccgtg

SEQ ID NO: 8463445 - DNA, 22 bp, Homo sapiens
cagcccagagaaggggcccgtg

SEQ ID NO: 8463446 - DNA, 22 bp, Homo sapiens
cagcccagaactcacgtctcca

SEQ ID NO: 8463447 - DNA, 22 bp, Homo sapiens
cagcccacttcccagcacctac

SEQ ID NO: 8463448 - DNA, 22 bp, Homo sapiens
cagccagtgtgaccgaggagga

SEQ ID NO: 8463449 - DNA, 22 bp, Homo sapiens
agcgctgtgggcgtgcgaggag

SEQ ID NO: 8463450 - DNA, 22 bp, Homo sapiens
cagcccacgtcagggccactca

SEQ ID NO: 8463451 - DNA, 22 bp, Homo sapiens
cagccatcccagcctgtggttc

SEQ ID NO: 8463452 - DNA, 22 bp, Homo sapiens
cagccatcagtaaagacagctt

SEQ ID NO: 8463453 - DNA, 22 bp, Homo sapiens
cagcccagtaccaagcagttgg

SEQ ID NO: 8463454 - DNA, 22 bp, Homo sapiens
cagccccacacggtctagctct

SEQ ID NO: 8463455 - DNA, 22 bp, Homo sapiens
cagccctggtgaggttggctat

SEQ ID NO: 8463456 - DNA, 22 bp, Homo sapiens
cagcctctctgtatctcaggat

SEQ ID NO: 8463457 - DNA, 22 bp, Homo sapiens
cagcctctctgtatctcaggat

SEQ ID NO: 8463458 - DNA, 22 bp, Homo sapiens
cagcctcctgggacactcaccg

SEQ ID NO: 8463459 - DNA, 22 bp, Homo sapiens
cagcctcctgggacactcaccg

SEQ ID NO: 8463460 - DNA, 22 bp, Homo sapiens
cagctggcagccctggccctgc

SEQ ID NO: 8463461 - DNA, 22 bp, Homo sapiens
cagctggcatacctgggcccgg

SEQ ID NO: 8463462 - DNA, 22 bp, Homo sapiens
cagctggcatacctgggcccgg

SEQ ID NO: 8463463 - DNA, 22 bp, Homo sapiens
cagctgggtggctcttctgctc

SEQ ID NO: 8463464 - DNA, 22 bp, Homo sapiens
cagctgggtggctcttctgctc

SEQ ID NO: 8463465 - DNA, 22 bp, Homo sapiens
cagctggcaagtggagcagggt

SEQ ID NO: 8463466 - DNA, 22 bp, Homo sapiens
cagctggcaagtggagcagggt

SEQ ID NO: 8463467 - DNA, 22 bp, Homo sapiens
cagctggcagaacctgcatcca

SEQ ID NO: 8463468 - DNA, 20 bp, Homo sapiens
agctgaggcacctgaggtta

SEQ ID NO: 8463469 - DNA, 23 bp, Homo sapiens
agctgaggcagaggggcattctc

SEQ ID NO: 8463470 - DNA, 22 bp, Homo sapiens
cagctgctttcagcaggaggga

SEQ ID NO: 8463471 - DNA, 22 bp, Homo sapiens
cagctggatccctgcagaactt

SEQ ID NO: 8463472 - DNA, 22 bp, Homo sapiens
agctgaggaggaatgatgggta

SEQ ID NO: 8463473 - DNA, 22 bp, Homo sapiens
agctgaggacgtgaagggcggc

SEQ ID NO: 8463474 - DNA, 22 bp, Homo sapiens
agctgaggaataataacaaggt

SEQ ID NO: 8463475 - DNA, 22 bp, Homo sapiens
agctgagctgcagatgactgta

SEQ ID NO: 8463476 - DNA, 22 bp, Homo sapiens
agctgagccagcagcaacagga

SEQ ID NO: 8463477 - DNA, 21 bp, Homo sapiens
agctgagcccagaagactggt

SEQ ID NO: 8463478 - DNA, 22 bp, Homo sapiens
agctgagccagcagcaacagga

SEQ ID NO: 8463479 - DNA, 22 bp, Homo sapiens
agctgagcatttgatccacctc

SEQ ID NO: 8463480 - DNA, 22 bp, Homo sapiens
agctctgggagtagttccacct

SEQ ID NO: 8463481 - DNA, 22 bp, Homo sapiens
agctctggaataatgatgtgat

SEQ ID NO: 8463482 - DNA, 22 bp, Homo sapiens
cagctgccccgctggctgacca

SEQ ID NO: 8463483 - DNA, 22 bp, Homo sapiens
cagctgccccgctggctgacca

SEQ ID NO: 8463484 - DNA, 22 bp, Homo sapiens
cagctgccagcttctctccatc

SEQ ID NO: 8463485 - DNA, 22 bp, Homo sapiens
cagctgccatgacatgtcctgc

SEQ ID NO: 8463486 - DNA, 22 bp, Homo sapiens
cagctgagcatcactagtctgg

SEQ ID NO: 8463487 - DNA, 18 bp, Homo sapiens
cagctgccagctcatgga

SEQ ID NO: 8463488 - DNA, 18 bp, Homo sapiens
cagctgccagctcatgga

SEQ ID NO: 8463489 - DNA, 22 bp, Homo sapiens
cagcctcttgcactttgaaggc

SEQ ID NO: 8463490 - DNA, 18 bp, Homo sapiens
cagcctctgattggttgc

SEQ ID NO: 8463491 - DNA, 22 bp, Homo sapiens
cagcctctgtggctgccacacc

SEQ ID NO: 8463492 - DNA, 22 bp, Homo sapiens
cagcctctgtggctgccacacc

SEQ ID NO: 8463493 - DNA, 22 bp, Homo sapiens
cagcctctgagccttggcagat

SEQ ID NO: 8463494 - DNA, 22 bp, Homo sapiens
cagcctctgagccttggcagat

SEQ ID NO: 8463495 - DNA, 22 bp, Homo sapiens
cagcgcaggcgtgtgaaggcgc

SEQ ID NO: 8463496 - DNA, 22 bp, Homo sapiens
cagcggaggacagatgggagct

SEQ ID NO: 8463497 - DNA, 22 bp, Homo sapiens
cagcgtctcgttgtgggcctcg

SEQ ID NO: 8463498 - DNA, 22 bp, Homo sapiens
agataaattcctaagatttcag

SEQ ID NO: 8463499 - DNA, 22 bp, Homo sapiens
agataaattcctaagatttcag

SEQ ID NO: 8463500 - DNA, 22 bp, Homo sapiens
agataaattcctaagatttcag

SEQ ID NO: 8463501 - DNA, 22 bp, Homo sapiens
agataattatttacttcaaagt

SEQ ID NO: 8463502 - DNA, 22 bp, Homo sapiens
agataattatttacttcaaagt

SEQ ID NO: 8463503 - DNA, 22 bp, Homo sapiens
agataatttgagtaaattaatt

SEQ ID NO: 8463504 - DNA, 22 bp, Homo sapiens
agatacaaaggcctacagagca

SEQ ID NO: 8463505 - DNA, 22 bp, Homo sapiens
agatacaactgtttaaacatta

SEQ ID NO: 8463506 - DNA, 22 bp, Homo sapiens
agatacaactgtttaaacatta

SEQ ID NO: 8463507 - DNA, 22 bp, Homo sapiens
agatacaactgtttaaacatta

SEQ ID NO: 8463508 - DNA, 22 bp, Homo sapiens
atttacagacgtggattagtgc

SEQ ID NO: 8463509 - DNA, 22 bp, Homo sapiens
agatacagcctgccaggttctt

SEQ ID NO: 8463510 - DNA, 22 bp, Homo sapiens
attgtatttgtacaagacatgt

SEQ ID NO: 8463511 - DNA, 22 bp, Homo sapiens
attgtattataattaggccaaa

SEQ ID NO: 8463512 - DNA, 22 bp, Homo sapiens
attgtattcagttacaggtctt

SEQ ID NO: 8463513 - DNA, 22 bp, Homo sapiens
attgtggtgtcagttataggca

SEQ ID NO: 8463514 - DNA, 22 bp, Homo sapiens
attgagaaaataagtatggata

SEQ ID NO: 8463515 - DNA, 22 bp, Homo sapiens
attgaaatacataaaattgcca

SEQ ID NO: 8463516 - DNA, 22 bp, Homo sapiens
attgaaaataaggccagaaaca

SEQ ID NO: 8463517 - DNA, 22 bp, Homo sapiens
attgaaaaattcacaattctgg

SEQ ID NO: 8463518 - DNA, 22 bp, Homo sapiens
attgaaaaattcacaattctgg

SEQ ID NO: 8463519 - DNA, 22 bp, Homo sapiens
attgaaaatgacatttgtgccc

SEQ ID NO: 8463520 - DNA, 22 bp, Homo sapiens
attgagatctgcatcataagct

SEQ ID NO: 8463521 - DNA, 22 bp, Homo sapiens
attgagaatgcaatctactatg

SEQ ID NO: 8463522 - DNA, 23 bp, Homo sapiens
attgagaaggatacattgttctc

SEQ ID NO: 8463523 - DNA, 22 bp, Homo sapiens
attgagaatattgtgacagtgt

SEQ ID NO: 8463524 - DNA, 22 bp, Homo sapiens
attggtctgtgagctgttgaca

SEQ ID NO: 8463525 - DNA, 22 bp, Homo sapiens
attaataaaataccactttgtt

SEQ ID NO: 8463526 - DNA, 22 bp, Homo sapiens
attaataaaataccactttgtt

SEQ ID NO: 8463527 - DNA, 22 bp, Homo sapiens
agagcttttgggaattcaggta

SEQ ID NO: 8463528 - DNA, 22 bp, Homo sapiens
agagcttttctgtaataacatc

SEQ ID NO: 8463529 - DNA, 22 bp, Homo sapiens
agagcttttacttacattctat

SEQ ID NO: 8463530 - DNA, 22 bp, Homo sapiens
agagctttgtttgattgtcaga

SEQ ID NO: 8463531 - DNA, 23 bp, Homo sapiens
agagctttctaaaatgtaaatct

SEQ ID NO: 8463532 - DNA, 23 bp, Homo sapiens
agagctttccagtttcttggtga

SEQ ID NO: 8463533 - DNA, 22 bp, Homo sapiens
agagctttgggacatttgctag

SEQ ID NO: 8463534 - DNA, 22 bp, Homo sapiens
agagctttagctgctggtctgg

SEQ ID NO: 8463535 - DNA, 22 bp, Homo sapiens
agaggaacccagacagggcttt

SEQ ID NO: 8463536 - DNA, 22 bp, Homo sapiens
agaggccagggacactgctcaa

SEQ ID NO: 8463537 - DNA, 22 bp, Homo sapiens
agaggccagggacactgctcaa

SEQ ID NO: 8463538 - DNA, 22 bp, Homo sapiens
agaggaacccagacagggcttt

SEQ ID NO: 8463539 - DNA, 22 bp, Homo sapiens
agagctttttgacatctctcta

SEQ ID NO: 8463540 - DNA, 22 bp, Homo sapiens
agaggccggccgagcccatggg

SEQ ID NO: 8463541 - DNA, 22 bp, Homo sapiens
agaggccggccgagcccatggg

SEQ ID NO: 8463542 - DNA, 22 bp, Homo sapiens
agaggcctaattgctacccttt

SEQ ID NO: 8463543 - DNA, 22 bp, Homo sapiens
agaggcctaaccaagatgtcct

SEQ ID NO: 8463544 - DNA, 19 bp, Homo sapiens
agaggcctcagcagctggc

SEQ ID NO: 8463545 - DNA, 22 bp, Homo sapiens
agaggcctccctcccagctggt

SEQ ID NO: 8463546 - DNA, 22 bp, Homo sapiens
attatttctcactcacataata

SEQ ID NO: 8463547 - DNA, 22 bp, Homo sapiens
agaggcctccctcccagctggt

SEQ ID NO: 8463548 - DNA, 22 bp, Homo sapiens
agaggcctctttgcaagtaggt

SEQ ID NO: 8463549 - DNA, 22 bp, Homo sapiens
agaggcctctgttgttcagacg

SEQ ID NO: 8463550 - DNA, 22 bp, Homo sapiens
agaggcctctgttgttcagacg

SEQ ID NO: 8463551 - DNA, 22 bp, Homo sapiens
agaggcctctagggcccctcag

SEQ ID NO: 8463552 - DNA, 22 bp, Homo sapiens
attcaaaagaccatgcagactc

SEQ ID NO: 8463553 - DNA, 22 bp, Homo sapiens
attcaaacaggccaattgacct

SEQ ID NO: 8463554 - DNA, 22 bp, Homo sapiens
attctaaatcagagagctctgt

SEQ ID NO: 8463555 - DNA, 22 bp, Homo sapiens
attctaaagcttgtggagctta

SEQ ID NO: 8463556 - DNA, 22 bp, Homo sapiens
attctaaatgtaatttagaatt

SEQ ID NO: 8463557 - DNA, 22 bp, Homo sapiens
attctaaagcttgtggagctta

SEQ ID NO: 8463558 - DNA, 22 bp, Homo sapiens
attctaaatgtaatttagaatt

SEQ ID NO: 8463559 - DNA, 22 bp, Homo sapiens
attctaagtcttgttcacattc

SEQ ID NO: 8463560 - DNA, 22 bp, Homo sapiens
attctctgtctttttgaaaaca

SEQ ID NO: 8463561 - DNA, 21 bp, Homo sapiens
attctctgtgatgggattagg

SEQ ID NO: 8463562 - DNA, 22 bp, Homo sapiens
attctctgtgcagatttaagac

SEQ ID NO: 8463563 - DNA, 22 bp, Homo sapiens
attctctgtacagaaggtaccg

SEQ ID NO: 8463564 - DNA, 22 bp, Homo sapiens
attctctgtagatggcttgaga

SEQ ID NO: 8463565 - DNA, 22 bp, Homo sapiens
attgaaaaatgactattgctta

SEQ ID NO: 8463566 - DNA, 22 bp, Homo sapiens
attctctggctaaaacctgaag

SEQ ID NO: 8463567 - DNA, 22 bp, Homo sapiens
attctctgggttccagtaaatg

SEQ ID NO: 8463568 - DNA, 22 bp, Homo sapiens
attctctgggttccagtaaatg

SEQ ID NO: 8463569 - DNA, 19 bp, Homo sapiens
attctctggtttgctggct

SEQ ID NO: 8463570 - DNA, 22 bp, Homo sapiens
attctctggtcattgagcatat

SEQ ID NO: 8463571 - DNA, 22 bp, Homo sapiens
attctctggtcattgagtataa

SEQ ID NO: 8463572 - DNA, 22 bp, Homo sapiens
attctctgaagtcaatggaaat

SEQ ID NO: 8463573 - DNA, 22 bp, Homo sapiens
attctctgaagtcaatggaaat

SEQ ID NO: 8463574 - DNA, 20 bp, Homo sapiens
attctctgacaccgcccccg

SEQ ID NO: 8463575 - DNA, 22 bp, Homo sapiens
attctctgatgcaggtggaaga

SEQ ID NO: 8463576 - DNA, 22 bp, Homo sapiens
attctctgaagtctttcagggc

SEQ ID NO: 8463577 - DNA, 22 bp, Homo sapiens
attctctgccattgcggtggat

SEQ ID NO: 8463578 - DNA, 22 bp, Homo sapiens
attctctgctgcactgataaca

SEQ ID NO: 8463579 - DNA, 22 bp, Homo sapiens
attctctggctaaaacctgaag

SEQ ID NO: 8463580 - DNA, 20 bp, Homo sapiens
attctctgctcaagtggcac

SEQ ID NO: 8463581 - DNA, 22 bp, Homo sapiens
attctctggaagaagataaaaa

SEQ ID NO: 8463582 - DNA, 22 bp, Homo sapiens
attctacaacccaataataatt

SEQ ID NO: 8463583 - DNA, 22 bp, Homo sapiens
attctacaatcatgtagatcct

SEQ ID NO: 8463584 - DNA, 22 bp, Homo sapiens
attctccttattctgaaaaaag

SEQ ID NO: 8463585 - DNA, 22 bp, Homo sapiens
agcaagatgcattatttcttat

SEQ ID NO: 8463586 - DNA, 22 bp, Homo sapiens
agcaagatgcaaacatccgtcc

SEQ ID NO: 8463587 - DNA, 22 bp, Homo sapiens
agcaagatgaaggattcaagac

SEQ ID NO: 8463588 - DNA, 22 bp, Homo sapiens
attttttcccagttagccagga

SEQ ID NO: 8463589 - DNA, 22 bp, Homo sapiens
attttttctgtaaactggcctt

SEQ ID NO: 8463590 - DNA, 22 bp, Homo sapiens
attttttctgtaaactggcctt

SEQ ID NO: 8463591 - DNA, 23 bp, Homo sapiens
attttttgtctttgtaactagat

SEQ ID NO: 8463592 - DNA, 23 bp, Homo sapiens
agcaataagaagggatacatgtg

SEQ ID NO: 8463593 - DNA, 22 bp, Homo sapiens
agcaagtagtaccaagtagctc

SEQ ID NO: 8463594 - DNA, 17 bp, Homo sapiens
agcaaggcttaagtaaa

SEQ ID NO: 8463595 - DNA, 22 bp, Homo sapiens
attttttatataccaaggtggg

SEQ ID NO: 8463596 - DNA, 22 bp, Homo sapiens
attttttcagattgagtgttaa

SEQ ID NO: 8463597 - DNA, 22 bp, Homo sapiens
attttttcagattgagtgttaa

SEQ ID NO: 8463598 - DNA, 22 bp, Homo sapiens
attttgttgatggtggagtagc

SEQ ID NO: 8463599 - DNA, 22 bp, Homo sapiens
attttttagccaagactctgca

SEQ ID NO: 8463600 - DNA, 22 bp, Homo sapiens
attttgtgaaccctcaagcaat

SEQ ID NO: 8463601 - DNA, 21 bp, Homo sapiens
attttgtacatagaatttgtc

SEQ ID NO: 8463602 - DNA, 22 bp, Homo sapiens
attttgtggcagatgcagaacc

SEQ ID NO: 8463603 - DNA, 22 bp, Homo sapiens
agcaatcagcttctttgtgttt

SEQ ID NO: 8463604 - DNA, 22 bp, Homo sapiens
caaacattgctaccagaggttt

SEQ ID NO: 8463605 - DNA, 22 bp, Homo sapiens
caaagggctctagactcagcag

SEQ ID NO: 8463606 - DNA, 22 bp, Homo sapiens
caaagtgctgggattacaggct

SEQ ID NO: 8463607 - DNA, 22 bp, Homo sapiens
caaagtgctgggattacaggtg

SEQ ID NO: 8463608 - DNA, 22 bp, Homo sapiens
caaataattactatcctcactt

SEQ ID NO: 8463609 - DNA, 22 bp, Homo sapiens
caaataattactatcctcactt

SEQ ID NO: 8463610 - DNA, 23 bp, Homo sapiens
agcaatctgtgtttcagcaagcc

SEQ ID NO: 8463611 - DNA, 22 bp, Homo sapiens
agcaatgatgttttcaagtagg

SEQ ID NO: 8463612 - DNA, 23 bp, Homo sapiens
agcaatgctgggagactctgtaa

SEQ ID NO: 8463613 - DNA, 19 bp, Homo sapiens
agcaattaagactgtgggc

SEQ ID NO: 8463614 - DNA, 22 bp, Homo sapiens
agcaatgcttattgctgactat

SEQ ID NO: 8463615 - DNA, 22 bp, Homo sapiens
caaagtttaaagtagatttcag

SEQ ID NO: 8463616 - DNA, 22 bp, Homo sapiens
caaagtttggctctcatgacat

SEQ ID NO: 8463617 - DNA, 22 bp, Homo sapiens
caaagttatgaatgataagatt

SEQ ID NO: 8463618 - DNA, 22 bp, Homo sapiens
caaagtttaaagtagatttcag

SEQ ID NO: 8463619 - DNA, 22 bp, Homo sapiens
caaagttatcaactgcaacatt

SEQ ID NO: 8463620 - DNA, 22 bp, Homo sapiens
caaagttttagtaaacatatat

SEQ ID NO: 8463621 - DNA, 22 bp, Homo sapiens
caaagttttagtaaacatatat

SEQ ID NO: 8463622 - DNA, 22 bp, Homo sapiens
caaagttttagtaaacatatat

SEQ ID NO: 8463623 - DNA, 22 bp, Homo sapiens
caaataagcaattccattcttc

SEQ ID NO: 8463624 - DNA, 23 bp, Homo sapiens
atttacagctgtgtgagcaagtt

SEQ ID NO: 8463625 - DNA, 22 bp, Homo sapiens
atttacagccttgaaaacagca

SEQ ID NO: 8463626 - DNA, 22 bp, Homo sapiens
atttacaggtagaattttaagt

SEQ ID NO: 8463627 - DNA, 22 bp, Homo sapiens
atttacaggacagcttggcatt

SEQ ID NO: 8463628 - DNA, 23 bp, Homo sapiens
atttacagctgtgtgagcaagtt

SEQ ID NO: 8463629 - DNA, 22 bp, Homo sapiens
atttcttttcaagagggtgctt

SEQ ID NO: 8463630 - DNA, 22 bp, Homo sapiens
atttctttctggccacggtttt

SEQ ID NO: 8463631 - DNA, 22 bp, Homo sapiens
atttctttctggccacggtttt

SEQ ID NO: 8463632 - DNA, 22 bp, Homo sapiens
atttcttgtgggaaatgcagca

SEQ ID NO: 8463633 - DNA, 21 bp, Homo sapiens
agatgaggatactgaggccta

SEQ ID NO: 8463634 - DNA, 21 bp, Homo sapiens
agatgaggatactgaggccta

SEQ ID NO: 8463635 - DNA, 23 bp, Homo sapiens
agatgaggcttctccatgttggt

SEQ ID NO: 8463636 - DNA, 22 bp, Homo sapiens
agatgagtaaatggagtcttcc

SEQ ID NO: 8463637 - DNA, 22 bp, Homo sapiens
agatgaggggtagaaaggactt

SEQ ID NO: 8463638 - DNA, 22 bp, Homo sapiens
agatgagaatttttagagtgct

SEQ ID NO: 8463639 - DNA, 19 bp, Homo sapiens
atttgaaagctgtgcttgc

SEQ ID NO: 8463640 - DNA, 22 bp, Homo sapiens
atttgaaccactcagaactcat

SEQ ID NO: 8463641 - DNA, 22 bp, Homo sapiens
atttgaagaaagttttctagat

SEQ ID NO: 8463642 - DNA, 22 bp, Homo sapiens
agatgagtgagagcatcaactt

SEQ ID NO: 8463643 - DNA, 22 bp, Homo sapiens
agatgagtaggtagcattagta

SEQ ID NO: 8463644 - DNA, 22 bp, Homo sapiens
agatgagtacagagctgtactc

SEQ ID NO: 8463645 - DNA, 21 bp, Homo sapiens
agatgtttcccccttggcttc

SEQ ID NO: 8463646 - DNA, 22 bp, Homo sapiens
agatgtttgtgttatctccatt

SEQ ID NO: 8463647 - DNA, 22 bp, Homo sapiens
agattcattattaatgtgatct

SEQ ID NO: 8463648 - DNA, 22 bp, Homo sapiens
agattctactctagatccatgg

SEQ ID NO: 8463649 - DNA, 22 bp, Homo sapiens
agattggggtccagactcctga

SEQ ID NO: 8463650 - DNA, 22 bp, Homo sapiens
agatttatgtggtcacactcag

SEQ ID NO: 8463651 - DNA, 22 bp, Homo sapiens
agatttcaatgtgagcattagt

SEQ ID NO: 8463652 - DNA, 23 bp, Homo sapiens
agattgttattcccagttcatgt

SEQ ID NO: 8463653 - DNA, 22 bp, Homo sapiens
agatttactgagaactgattac

SEQ ID NO: 8463654 - DNA, 22 bp, Homo sapiens
agatttactggagtctttggtg

SEQ ID NO: 8463655 - DNA, 22 bp, Homo sapiens
agatttacaaaggatttgcttt

SEQ ID NO: 8463656 - DNA, 19 bp, Homo sapiens
agatttacctcatatagtt

SEQ ID NO: 8463657 - DNA, 20 bp, Homo sapiens
agatttacctttgagccttc

SEQ ID NO: 8463658 - DNA, 22 bp, Homo sapiens
agatttactccctgcttccgcc

SEQ ID NO: 8463659 - DNA, 22 bp, Homo sapiens
agatttactcagctcctggaaa

SEQ ID NO: 8463660 - DNA, 22 bp, Homo sapiens
atgtagttagaagattcaaaca

SEQ ID NO: 8463661 - DNA, 22 bp, Homo sapiens
atgtagttgaagtgctataaag

SEQ ID NO: 8463662 - DNA, 22 bp, Homo sapiens
atgtagtctctttgggaaactc

SEQ ID NO: 8463663 - DNA, 22 bp, Homo sapiens
agagatggcgtctcagagcctg

SEQ ID NO: 8463664 - DNA, 22 bp, Homo sapiens
agagatggtagaacagtcataa

SEQ ID NO: 8463665 - DNA, 22 bp, Homo sapiens
agagactgctttatattgtact

SEQ ID NO: 8463666 - DNA, 22 bp, Homo sapiens
atgggctcggcgctgctgggat

SEQ ID NO: 8463667 - DNA, 22 bp, Homo sapiens
atgggctctatgtctaggagat

SEQ ID NO: 8463668 - DNA, 22 bp, Homo sapiens
atgtacatactgcattttcaaa

SEQ ID NO: 8463669 - DNA, 22 bp, Homo sapiens
atgtagggaactaaattcactg

SEQ ID NO: 8463670 - DNA, 22 bp, Homo sapiens
atgtaggattgagtgatagagg

SEQ ID NO: 8463671 - DNA, 21 bp, Homo sapiens
agagactgtcactgcagtacc

SEQ ID NO: 8463672 - DNA, 22 bp, Homo sapiens
agagacttctgccttagcaaga

SEQ ID NO: 8463673 - DNA, 22 bp, Homo sapiens
atgggcagtaacagtggcagtc

SEQ ID NO: 8463674 - DNA, 22 bp, Homo sapiens
atggacaggtactgcagtgggt

SEQ ID NO: 8463675 - DNA, 22 bp, Homo sapiens
atggacaggcttataacagcaa

SEQ ID NO: 8463676 - DNA, 22 bp, Homo sapiens
agagaacagtgttttgaaggag

SEQ ID NO: 8463677 - DNA, 22 bp, Homo sapiens
atggaatttgcaataacaggat

SEQ ID NO: 8463678 - DNA, 22 bp, Homo sapiens
atggacaatgtgaaactacaag

SEQ ID NO: 8463679 - DNA, 22 bp, Homo sapiens
atggacaatgtgaaactacaag

SEQ ID NO: 8463680 - DNA, 22 bp, Homo sapiens
atggaattgaagacagcatagg

SEQ ID NO: 8463681 - DNA, 22 bp, Homo sapiens
atggaattaaaagtcaagtaat

SEQ ID NO: 8463682 - DNA, 22 bp, Homo sapiens
atggacagagctgagctccacc

SEQ ID NO: 8463683 - DNA, 22 bp, Homo sapiens
atggacagcaactggaagcttc

SEQ ID NO: 8463684 - DNA, 22 bp, Homo sapiens
agagccagcatttgggccctgc

SEQ ID NO: 8463685 - DNA, 22 bp, Homo sapiens
agagccagcatttgacactggc

SEQ ID NO: 8463686 - DNA, 22 bp, Homo sapiens
agagccagcatttgacactggc

SEQ ID NO: 8463687 - DNA, 22 bp, Homo sapiens
atgtgcatgcacttacatgtgt

SEQ ID NO: 8463688 - DNA, 22 bp, Homo sapiens
atgttacagaaagcaaagatga

SEQ ID NO: 8463689 - DNA, 22 bp, Homo sapiens
agagccaggactgtgtctcact

SEQ ID NO: 8463690 - DNA, 22 bp, Homo sapiens
agagccaggactgtgtctcact

SEQ ID NO: 8463691 - DNA, 22 bp, Homo sapiens
agagccaggactgtgtctcact

SEQ ID NO: 8463692 - DNA, 23 bp, Homo sapiens
atgtgcaaagtgctacagtatag

SEQ ID NO: 8463693 - DNA, 23 bp, Homo sapiens
atgtgcaaagtgctacagtatag

SEQ ID NO: 8463694 - DNA, 22 bp, Homo sapiens
atgtgcaaagtaaagtaatttt

SEQ ID NO: 8463695 - DNA, 22 bp, Homo sapiens
atgtgcaatggtgtcaccacat

SEQ ID NO: 8463696 - DNA, 22 bp, Homo sapiens
atgtgcaacttttctgtctttt

SEQ ID NO: 8463697 - DNA, 22 bp, Homo sapiens
atgtgcataaacatattgttgg

SEQ ID NO: 8463698 - DNA, 22 bp, Homo sapiens
agagatgtagcaaagaaccaca

SEQ ID NO: 8463699 - DNA, 22 bp, Homo sapiens
agagattaagtcacttggtcag

SEQ ID NO: 8463700 - DNA, 18 bp, Homo sapiens
agagatggtgtagagttt

SEQ ID NO: 8463701 - DNA, 18 bp, Homo sapiens
attaaggctttgatagta

SEQ ID NO: 8463702 - DNA, 22 bp, Homo sapiens
attaaggtgtcaatgtatttgg

SEQ ID NO: 8463703 - DNA, 22 bp, Homo sapiens
attaagtgactaaagtaatgct

SEQ ID NO: 8463704 - DNA, 22 bp, Homo sapiens
attaagtgactaaagtaatgct

SEQ ID NO: 8463705 - DNA, 22 bp, Homo sapiens
attaagtgtgacatgctgctct

SEQ ID NO: 8463706 - DNA, 22 bp, Homo sapiens
agagctctcttcataacggcct

SEQ ID NO: 8463707 - DNA, 22 bp, Homo sapiens
agagctcctgcattcttccctg

SEQ ID NO: 8463708 - DNA, 22 bp, Homo sapiens
attaaatactgcaggctaagca

SEQ ID NO: 8463709 - DNA, 22 bp, Homo sapiens
attaagctccaagttgctctga

SEQ ID NO: 8463710 - DNA, 22 bp, Homo sapiens
agagctcaagacgctcacagta

SEQ ID NO: 8463711 - DNA, 22 bp, Homo sapiens
agagctcaagacgctcacagta

SEQ ID NO: 8463712 - DNA, 21 bp, Homo sapiens
agagctcaaggcaaaaataat

SEQ ID NO: 8463713 - DNA, 22 bp, Homo sapiens
agagctcagtgtgttatggtta

SEQ ID NO: 8463714 - DNA, 22 bp, Homo sapiens
agagcctgttttgtgggagatg

SEQ ID NO: 8463715 - DNA, 22 bp, Homo sapiens
agagccttgaagatctggaaaa

SEQ ID NO: 8463716 - DNA, 22 bp, Homo sapiens
atgttctatatcattattgtga

SEQ ID NO: 8463717 - DNA, 22 bp, Homo sapiens
atgttctaatccctgctatgta

SEQ ID NO: 8463718 - DNA, 22 bp, Homo sapiens
atgttctacagatggaaagggg

SEQ ID NO: 8463719 - DNA, 23 bp, Homo sapiens
agagccttttcacacttcaatgt

SEQ ID NO: 8463720 - DNA, 22 bp, Homo sapiens
agagcctttggagctgctatta

SEQ ID NO: 8463721 - DNA, 22 bp, Homo sapiens
agagccttgctctaaatttctc

SEQ ID NO: 8463722 - DNA, 22 bp, Homo sapiens
agagccttgaagatctggaaaa

SEQ ID NO: 8463723 - DNA, 22 bp, Homo sapiens
agagccttgcctggggccctgt

SEQ ID NO: 8463724 - DNA, 22 bp, Homo sapiens
agagctaagaaacagaattgct

SEQ ID NO: 8463725 - DNA, 22 bp, Homo sapiens
atgttcaaactttttacacacc

SEQ ID NO: 8463726 - DNA, 18 bp, Homo sapiens
atgttcatatttttaggg

SEQ ID NO: 8463727 - DNA, 22 bp, Homo sapiens
atgttcatccatgtcgtagcag

SEQ ID NO: 8463728 - DNA, 22 bp, Homo sapiens
atgttcatttgacaagtagtga

SEQ ID NO: 8463729 - DNA, 22 bp, Homo sapiens
atgttcattagtcaacatttct

SEQ ID NO: 8463730 - DNA, 22 bp, Homo sapiens
atgttcattagtcaacatttct

SEQ ID NO: 8463731 - DNA, 18 bp, Homo sapiens
atgcttctgatagaagca

SEQ ID NO: 8463732 - DNA, 22 bp, Homo sapiens
atgcttctgtgtatgtttcagg

SEQ ID NO: 8463733 - DNA, 22 bp, Homo sapiens
atgcttctggtataagaaaaat

SEQ ID NO: 8463734 - DNA, 22 bp, Homo sapiens
agagaaaagagttcaggctttg

SEQ ID NO: 8463735 - DNA, 22 bp, Homo sapiens
agagaaaagccatcccagccaa

SEQ ID NO: 8463736 - DNA, 22 bp, Homo sapiens
agagaaaagccatcccagccaa

SEQ ID NO: 8463737 - DNA, 22 bp, Homo sapiens
agagaacagacagatgcaatga

SEQ ID NO: 8463738 - DNA, 22 bp, Homo sapiens
atgctgaattgatgcgagggag

SEQ ID NO: 8463739 - DNA, 18 bp, Homo sapiens
atgctgccctctgagggt

SEQ ID NO: 8463740 - DNA, 22 bp, Homo sapiens
atgcttaggttaaatttgtaat

SEQ ID NO: 8463741 - DNA, 22 bp, Homo sapiens
atgcttaggttaaatttgtaat

SEQ ID NO: 8463742 - DNA, 22 bp, Homo sapiens
agacataggattccacatagca

SEQ ID NO: 8463743 - DNA, 22 bp, Homo sapiens
atgctgaagagagaactactca

SEQ ID NO: 8463744 - DNA, 22 bp, Homo sapiens
atgctgaagaatcacagggact

SEQ ID NO: 8463745 - DNA, 22 bp, Homo sapiens
atgctgaaccttaacttggagc

SEQ ID NO: 8463746 - DNA, 22 bp, Homo sapiens
atgctgaatagttcactcttct

SEQ ID NO: 8463747 - DNA, 22 bp, Homo sapiens
atgctgaatgaaagaaattagt

SEQ ID NO: 8463748 - DNA, 22 bp, Homo sapiens
atgctgaagagttcatgattat

SEQ ID NO: 8463749 - DNA, 22 bp, Homo sapiens
agacagtgctatcccatctgtg

SEQ ID NO: 8463750 - DNA, 22 bp, Homo sapiens
atgccattgtatattcattgat

SEQ ID NO: 8463751 - DNA, 22 bp, Homo sapiens
atgccagggtcccttcagagat

SEQ ID NO: 8463752 - DNA, 22 bp, Homo sapiens
atgccaggctgtttggcctcag

SEQ ID NO: 8463753 - DNA, 22 bp, Homo sapiens
agacatagataggcactgattg

SEQ ID NO: 8463754 - DNA, 22 bp, Homo sapiens
agacataagtgctatgacattg

SEQ ID NO: 8463755 - DNA, 22 bp, Homo sapiens
agacatagaaaatcattaggaa

SEQ ID NO: 8463756 - DNA, 22 bp, Homo sapiens
agacagtgtgagttcagggtgg

SEQ ID NO: 8463757 - DNA, 22 bp, Homo sapiens
atgcaacaaattgtgtgcaata

SEQ ID NO: 8463758 - DNA, 22 bp, Homo sapiens
atgcaacaaattgtgtgcaata

SEQ ID NO: 8463759 - DNA, 22 bp, Homo sapiens
atgcaacaaatgctacgaatcg

SEQ ID NO: 8463760 - DNA, 22 bp, Homo sapiens
atgcaacaaatgctacgaatcg

SEQ ID NO: 8463761 - DNA, 19 bp, Homo sapiens
atgcaacaaaagtgtaaga

SEQ ID NO: 8463762 - DNA, 19 bp, Homo sapiens
atgcaacaaaagtgtaaga

SEQ ID NO: 8463763 - DNA, 22 bp, Homo sapiens
atgcaaattctttgcttcttct

SEQ ID NO: 8463764 - DNA, 22 bp, Homo sapiens
atgcaacagagaaaatattgag

SEQ ID NO: 8463765 - DNA, 22 bp, Homo sapiens
atgcaacagagaaaatattgag

SEQ ID NO: 8463766 - DNA, 22 bp, Homo sapiens
atgcaacagaaaattgcctggg

SEQ ID NO: 8463767 - DNA, 22 bp, Homo sapiens
atgcaacacccctatggatgga

SEQ ID NO: 8463768 - DNA, 22 bp, Homo sapiens
atgcaacagaaaattgcctggg

SEQ ID NO: 8463769 - DNA, 22 bp, Homo sapiens
atgcaacaatgtatttatgtat

SEQ ID NO: 8463770 - DNA, 22 bp, Homo sapiens
atgcaacacatttgatgagcga

SEQ ID NO: 8463771 - DNA, 22 bp, Homo sapiens
atgcaacacccctatggatgga

SEQ ID NO: 8463772 - DNA, 22 bp, Homo sapiens
atgcaacaatgtatttatgtat

SEQ ID NO: 8463773 - DNA, 22 bp, Homo sapiens
atgcaacacatttgatgagcga

SEQ ID NO: 8463774 - DNA, 22 bp, Homo sapiens
atgcaacagtcagtacatccgg

SEQ ID NO: 8463775 - DNA, 22 bp, Homo sapiens
atgcaacagggttgggaggcgg

SEQ ID NO: 8463776 - DNA, 22 bp, Homo sapiens
atgcaacaggtcagccaggaag

SEQ ID NO: 8463777 - DNA, 22 bp, Homo sapiens
atgcaacagttcatagttttat

SEQ ID NO: 8463778 - DNA, 22 bp, Homo sapiens
atgcaacagtcagtacatccgg

SEQ ID NO: 8463779 - DNA, 22 bp, Homo sapiens
atgcaacaggtcagccaggaag

SEQ ID NO: 8463780 - DNA, 22 bp, Homo sapiens
atgcaacagggttgggaggcgg

SEQ ID NO: 8463781 - DNA, 22 bp, Homo sapiens
atgcaacagctgggaatatgta

SEQ ID NO: 8463782 - DNA, 22 bp, Homo sapiens
atgcaacagctgggaatatgta

SEQ ID NO: 8463783 - DNA, 22 bp, Homo sapiens
atgccagaccatccagttggga

SEQ ID NO: 8463784 - DNA, 22 bp, Homo sapiens
atgccaggccccacgctgggca

SEQ ID NO: 8463785 - DNA, 23 bp, Homo sapiens
atgccaggctgcctggccagcct

SEQ ID NO: 8463786 - DNA, 22 bp, Homo sapiens
atgccagaagagtctgcaggga

SEQ ID NO: 8463787 - DNA, 22 bp, Homo sapiens
atgccactgcactccagcctag

SEQ ID NO: 8463788 - DNA, 22 bp, Homo sapiens
atgccacataattacaaataga

SEQ ID NO: 8463789 - DNA, 22 bp, Homo sapiens
atgcaacagttcatagttttat

SEQ ID NO: 8463790 - DNA, 22 bp, Homo sapiens
atgaccagccgagataaacaga

SEQ ID NO: 8463791 - DNA, 22 bp, Homo sapiens
atgactctaagaattctagatg

SEQ ID NO: 8463792 - DNA, 22 bp, Homo sapiens
atgactcaaaattattgttttg

SEQ ID NO: 8463793 - DNA, 22 bp, Homo sapiens
atcttagaagtttgataaaatc

SEQ ID NO: 8463794 - DNA, 22 bp, Homo sapiens
atcttagaagtttgataaaatc

SEQ ID NO: 8463795 - DNA, 22 bp, Homo sapiens
atcttagacccttggtagaaaa

SEQ ID NO: 8463796 - DNA, 22 bp, Homo sapiens
atcttagagagtcgtgttttgt

SEQ ID NO: 8463797 - DNA, 23 bp, Homo sapiens
atcttagcatagacttgagtccc

SEQ ID NO: 8463798 - DNA, 22 bp, Homo sapiens
atgacaatacttcaataagctg

SEQ ID NO: 8463799 - DNA, 22 bp, Homo sapiens
atgacaatacttcaataagctg

SEQ ID NO: 8463800 - DNA, 22 bp, Homo sapiens
atcttacagcagcaaggaagta

SEQ ID NO: 8463801 - DNA, 22 bp, Homo sapiens
atcttacacgataactgttagt

SEQ ID NO: 8463802 - DNA, 22 bp, Homo sapiens
atctgtttaattcattttcaca

SEQ ID NO: 8463803 - DNA, 22 bp, Homo sapiens
atctgggggagctgctcatgga

SEQ ID NO: 8463804 - DNA, 22 bp, Homo sapiens
atctgggtcacagtggcatcta

SEQ ID NO: 8463805 - DNA, 22 bp, Homo sapiens
atctgggctcgaatcctagctc

SEQ ID NO: 8463806 - DNA, 22 bp, Homo sapiens
atctgggcctgttccctcacct

SEQ ID NO: 8463807 - DNA, 22 bp, Homo sapiens
atctgggcgtataggtgcaagt

SEQ ID NO: 8463808 - DNA, 22 bp, Homo sapiens
atctgggcgtataggtgcaagt

SEQ ID NO: 8463809 - DNA, 22 bp, Homo sapiens
atctgggctcgaatcctagctc

SEQ ID NO: 8463810 - DNA, 23 bp, Homo sapiens
atctgggcatctggagtggtcct

SEQ ID NO: 8463811 - DNA, 23 bp, Homo sapiens
atctgggcatctggagtggtcct

SEQ ID NO: 8463812 - DNA, 22 bp, Homo sapiens
atctgggcatggaggaaagaga

SEQ ID NO: 8463813 - DNA, 22 bp, Homo sapiens
atctgggccaatcctagtacca

SEQ ID NO: 8463814 - DNA, 22 bp, Homo sapiens
atctgggcatggaggaaagaga

SEQ ID NO: 8463815 - DNA, 22 bp, Homo sapiens
atctgggccagccccaagagac

SEQ ID NO: 8463816 - DNA, 22 bp, Homo sapiens
atctgggccaatcctagtacca

SEQ ID NO: 8463817 - DNA, 22 bp, Homo sapiens
atctgggccagccccaagagac

SEQ ID NO: 8463818 - DNA, 22 bp, Homo sapiens
atctgggcctgttccctcacct

SEQ ID NO: 8463819 - DNA, 22 bp, Homo sapiens
atctgggcagggcagcaaggcg

SEQ ID NO: 8463820 - DNA, 20 bp, Homo sapiens
atctgggcatcaattttgtg

SEQ ID NO: 8463821 - DNA, 22 bp, Homo sapiens
atctgggcagggcagcaaggcg

SEQ ID NO: 8463822 - DNA, 20 bp, Homo sapiens
atctgggcatcaattttgtg

SEQ ID NO: 8463823 - DNA, 22 bp, Homo sapiens
atctggctgactttgtgggaca

SEQ ID NO: 8463824 - DNA, 22 bp, Homo sapiens
atctggcttacctagggtgcct

SEQ ID NO: 8463825 - DNA, 22 bp, Homo sapiens
atctggctgagcgaggcccaca

SEQ ID NO: 8463826 - DNA, 22 bp, Homo sapiens
atctggcttacctagggtgcct

SEQ ID NO: 8463827 - DNA, 22 bp, Homo sapiens
atctggcttacgaagcactggt

SEQ ID NO: 8463828 - DNA, 22 bp, Homo sapiens
atgattctcattttataaactt

SEQ ID NO: 8463829 - DNA, 22 bp, Homo sapiens
atgattctcattttataaactt

SEQ ID NO: 8463830 - DNA, 21 bp, Homo sapiens
atgattctgcaaatgagtagt

SEQ ID NO: 8463831 - DNA, 21 bp, Homo sapiens
atgattctgcaaatgagtagt

SEQ ID NO: 8463832 - DNA, 22 bp, Homo sapiens
atgattctcattttataaactt

SEQ ID NO: 8463833 - DNA, 22 bp, Homo sapiens
atgattctaggcattgaagata

SEQ ID NO: 8463834 - DNA, 22 bp, Homo sapiens
atgattgaaaatgacattgcca

SEQ ID NO: 8463835 - DNA, 22 bp, Homo sapiens
atgattcttttggatagatgat

SEQ ID NO: 8463836 - DNA, 22 bp, Homo sapiens
atgattcttttggatagatgat

SEQ ID NO: 8463837 - DNA, 22 bp, Homo sapiens
atgattctggtgagaatgagga

SEQ ID NO: 8463838 - DNA, 22 bp, Homo sapiens
atgattctggggcaaaagctgg

SEQ ID NO: 8463839 - DNA, 22 bp, Homo sapiens
atgattctggggcaaaagctgg

SEQ ID NO: 8463840 - DNA, 22 bp, Homo sapiens
atgattctggcaaatttattat

SEQ ID NO: 8463841 - DNA, 22 bp, Homo sapiens
atgattctggcaaatttattat

SEQ ID NO: 8463842 - DNA, 22 bp, Homo sapiens
atgcaaatgctagagaatgttg

SEQ ID NO: 8463843 - DNA, 22 bp, Homo sapiens
atgcaaatgtcaccacttctaa

SEQ ID NO: 8463844 - DNA, 22 bp, Homo sapiens
atgcaaattaacatatagtaga

SEQ ID NO: 8463845 - DNA, 22 bp, Homo sapiens
atgatttgttaacagacttaat

SEQ ID NO: 8463846 - DNA, 22 bp, Homo sapiens
atgattgaccatctgctgggct

SEQ ID NO: 8463847 - DNA, 22 bp, Homo sapiens
atgatttaaagtcattgtgaac

SEQ ID NO: 8463848 - DNA, 22 bp, Homo sapiens
atgaggagaccaaggcctgatg

SEQ ID NO: 8463849 - DNA, 22 bp, Homo sapiens
atgaggagccctcatttaggtt

SEQ ID NO: 8463850 - DNA, 22 bp, Homo sapiens
atgaggaggtcaggccttacaa

SEQ ID NO: 8463851 - DNA, 22 bp, Homo sapiens
atgaggagtcaaggagtcggag

SEQ ID NO: 8463852 - DNA, 22 bp, Homo sapiens
atgaggaggccagtaagagcct

SEQ ID NO: 8463853 - DNA, 22 bp, Homo sapiens
atgaggagctgttttaactgct

SEQ ID NO: 8463854 - DNA, 22 bp, Homo sapiens
atgaggagctccttgaaatgag

SEQ ID NO: 8463855 - DNA, 22 bp, Homo sapiens
atgacttcgttttctctctgca

SEQ ID NO: 8463856 - DNA, 22 bp, Homo sapiens
atgaggcaaggctggccgtgtt

SEQ ID NO: 8463857 - DNA, 22 bp, Homo sapiens
atgaggcaaaggtggaggtggg

SEQ ID NO: 8463858 - DNA, 22 bp, Homo sapiens
atgaggcaaggatcaggtaagg

SEQ ID NO: 8463859 - DNA, 22 bp, Homo sapiens
atgaggcaaaggtggaggtggg

SEQ ID NO: 8463860 - DNA, 22 bp, Homo sapiens
atgaggatgttagtggactgga

SEQ ID NO: 8463861 - DNA, 22 bp, Homo sapiens
atgaggatgggaagggagccaa

SEQ ID NO: 8463862 - DNA, 22 bp, Homo sapiens
atgaggatgttagtggactgga

SEQ ID NO: 8463863 - DNA, 22 bp, Homo sapiens
atgaggataccgcagggggcag

SEQ ID NO: 8463864 - DNA, 22 bp, Homo sapiens
atgaggcacatcacagccaatg

SEQ ID NO: 8463865 - DNA, 22 bp, Homo sapiens
atgaggcaatagaatattgaat

SEQ ID NO: 8463866 - DNA, 22 bp, Homo sapiens
atgaggcacagagatgttaatg

SEQ ID NO: 8463867 - DNA, 22 bp, Homo sapiens
atgaggcaatcatggtccagtt

SEQ ID NO: 8463868 - DNA, 22 bp, Homo sapiens
atagttacaaagactttttaaa

SEQ ID NO: 8463869 - DNA, 22 bp, Homo sapiens
atagtgttgtatgtacagtctg

SEQ ID NO: 8463870 - DNA, 22 bp, Homo sapiens
atagttacatacagaaatattt

SEQ ID NO: 8463871 - DNA, 22 bp, Homo sapiens
ataggagccataaataaaatct

SEQ ID NO: 8463872 - DNA, 22 bp, Homo sapiens
ataggacagcagacaattagta

SEQ ID NO: 8463873 - DNA, 22 bp, Homo sapiens
atagctttttgtcatagagtct

SEQ ID NO: 8463874 - DNA, 22 bp, Homo sapiens
atagctgactccagacatagct

SEQ ID NO: 8463875 - DNA, 22 bp, Homo sapiens
agaaaagaggctttctaagcat

SEQ ID NO: 8463876 - DNA, 17 bp, Homo sapiens
agaaaagagaccagcag

SEQ ID NO: 8463877 - DNA, 23 bp, Homo sapiens
agaaaagcttggacacatggcct

SEQ ID NO: 8463878 - DNA, 20 bp, Homo sapiens
agaaaaagtgtggaaatttc

SEQ ID NO: 8463879 - DNA, 22 bp, Homo sapiens
atagttcactaatagcaaaagc

SEQ ID NO: 8463880 - DNA, 22 bp, Homo sapiens
atagttggtccatgaaaaaagt

SEQ ID NO: 8463881 - DNA, 22 bp, Homo sapiens
atacacttgacctggagtgaag

SEQ ID NO: 8463882 - DNA, 20 bp, Homo sapiens
atacacttgcccagcttgtg

SEQ ID NO: 8463883 - DNA, 20 bp, Homo sapiens
atacacttgcccagcttgtg

SEQ ID NO: 8463884 - DNA, 22 bp, Homo sapiens
atactgttggctttggtgatgg

SEQ ID NO: 8463885 - DNA, 22 bp, Homo sapiens
atactgttttgtgacttatctt

SEQ ID NO: 8463886 - DNA, 22 bp, Homo sapiens
atacacttccaaatattgatta

SEQ ID NO: 8463887 - DNA, 22 bp, Homo sapiens
atacacttcatgttttcatctg

SEQ ID NO: 8463888 - DNA, 23 bp, Homo sapiens
atagaagattattgcaacagtcc

SEQ ID NO: 8463889 - DNA, 22 bp, Homo sapiens
atagaagctgataaactacttc

SEQ ID NO: 8463890 - DNA, 22 bp, Homo sapiens
atagaagcaagaacagaatgga

SEQ ID NO: 8463891 - DNA, 20 bp, Homo sapiens
atagaagtattatgtaatgt

SEQ ID NO: 8463892 - DNA, 22 bp, Homo sapiens
atagaaccacccagagcctttt

SEQ ID NO: 8463893 - DNA, 22 bp, Homo sapiens
atagaaccacccagagcctttt

SEQ ID NO: 8463894 - DNA, 22 bp, Homo sapiens
atagaacctgttgtgaaattca

SEQ ID NO: 8463895 - DNA, 19 bp, Homo sapiens
atagaacctgcagtttcaa

SEQ ID NO: 8463896 - DNA, 19 bp, Homo sapiens
atagaacctgcagtttcaa

SEQ ID NO: 8463897 - DNA, 22 bp, Homo sapiens
atagaacctgttgtgaaattca

SEQ ID NO: 8463898 - DNA, 22 bp, Homo sapiens
actttactacatccacagatgg

SEQ ID NO: 8463899 - DNA, 22 bp, Homo sapiens
actttacaggcacttcaagtat

SEQ ID NO: 8463900 - DNA, 22 bp, Homo sapiens
actttagaaaagcatccataga

SEQ ID NO: 8463901 - DNA, 22 bp, Homo sapiens
actttagaaaagcatccataga

SEQ ID NO: 8463902 - DNA, 22 bp, Homo sapiens
actttactccccaacataaatg

SEQ ID NO: 8463903 - DNA, 22 bp, Homo sapiens
actttagaccatcttccacagt

SEQ ID NO: 8463904 - DNA, 22 bp, Homo sapiens
actttagagaaatgtagaagta

SEQ ID NO: 8463905 - DNA, 22 bp, Homo sapiens
actttagaagtaaggatgagtt

SEQ ID NO: 8463906 - DNA, 22 bp, Homo sapiens
actttagaaaaggaacagagga

SEQ ID NO: 8463907 - DNA, 22 bp, Homo sapiens
atagatgtacgtatgtaaatca

SEQ ID NO: 8463908 - DNA, 23 bp, Homo sapiens
actttagataaattatgtgcaca

SEQ ID NO: 8463909 - DNA, 22 bp, Homo sapiens
actttagatattcctctgtaca

SEQ ID NO: 8463910 - DNA, 22 bp, Homo sapiens
atagcatataagttataaaact

SEQ ID NO: 8463911 - DNA, 22 bp, Homo sapiens
atagatgtcattgtcatccatc

SEQ ID NO: 8463912 - DNA, 22 bp, Homo sapiens
agttcagagtaaatgttgaagg

SEQ ID NO: 8463913 - DNA, 22 bp, Homo sapiens
agttcacagccatgttcatgtg

SEQ ID NO: 8463914 - DNA, 22 bp, Homo sapiens
agttcttttaccaaggcaaatg

SEQ ID NO: 8463915 - DNA, 22 bp, Homo sapiens
agttcttttgtgaacatatgct

SEQ ID NO: 8463916 - DNA, 22 bp, Homo sapiens
agttctttgtgagtaatacaga

SEQ ID NO: 8463917 - DNA, 22 bp, Homo sapiens
agttgcagacgcagagatgttg

SEQ ID NO: 8463918 - DNA, 22 bp, Homo sapiens
ataacagacttagagttacaag

SEQ ID NO: 8463919 - DNA, 22 bp, Homo sapiens
ataacagaataagtcattaccg

SEQ ID NO: 8463920 - DNA, 22 bp, Homo sapiens
ataacactaaatgtatgtaaca

SEQ ID NO: 8463921 - DNA, 22 bp, Homo sapiens
ataaatttataattgtttcctg

SEQ ID NO: 8463922 - DNA, 22 bp, Homo sapiens
ataaattttcttgctgtactta

SEQ ID NO: 8463923 - DNA, 19 bp, Homo sapiens
atacactaatataaaccac

SEQ ID NO: 8463924 - DNA, 19 bp, Homo sapiens
atacacgtgtatacataca

SEQ ID NO: 8463925 - DNA, 22 bp, Homo sapiens
atacactaatcatgtgctcagt

SEQ ID NO: 8463926 - DNA, 22 bp, Homo sapiens
atacacatttgctagagatggg

SEQ ID NO: 8463927 - DNA, 22 bp, Homo sapiens
atacaatcatcattatattccc

SEQ ID NO: 8463928 - DNA, 22 bp, Homo sapiens
atacaatgattggttctcaccc

SEQ ID NO: 8463929 - DNA, 22 bp, Homo sapiens
atacacacaatcaggttttgta

SEQ ID NO: 8463930 - DNA, 22 bp, Homo sapiens
ataaggtataaggcctattttt

SEQ ID NO: 8463931 - DNA, 22 bp, Homo sapiens
ataaggcatctctcagttagca

SEQ ID NO: 8463932 - DNA, 22 bp, Homo sapiens
ataaggcagtcccttaacaagg

SEQ ID NO: 8463933 - DNA, 22 bp, Homo sapiens
atacaagttgtgataatgtaaa

SEQ ID NO: 8463934 - DNA, 22 bp, Homo sapiens
ataaggaaatgaaactctaata

SEQ ID NO: 8463935 - DNA, 22 bp, Homo sapiens
ataagctgaatagtcaacacaa

SEQ ID NO: 8463936 - DNA, 22 bp, Homo sapiens
ataagctttgctggagagacct

SEQ ID NO: 8463937 - DNA, 22 bp, Homo sapiens
ataaggcacacatagatagggt

SEQ ID NO: 8463938 - DNA, 22 bp, Homo sapiens
ataaggcaagctgtcagtttgt

SEQ ID NO: 8463939 - DNA, 22 bp, Homo sapiens
ataaggcacacatagatagggt

SEQ ID NO: 8463940 - DNA, 22 bp, Homo sapiens
atattaattatttacacatgag

SEQ ID NO: 8463941 - DNA, 22 bp, Homo sapiens
atattacacacggtatcacggg

SEQ ID NO: 8463942 - DNA, 22 bp, Homo sapiens
atattacacacggtatcacggg

SEQ ID NO: 8463943 - DNA, 22 bp, Homo sapiens
agaaatatgctgattagatgaa

SEQ ID NO: 8463944 - DNA, 22 bp, Homo sapiens
agaaatatgctgattagatgaa

SEQ ID NO: 8463945 - DNA, 22 bp, Homo sapiens
agaaatatgctgattagatgaa

SEQ ID NO: 8463946 - DNA, 22 bp, Homo sapiens
agaaatagtcacattggaggaa

SEQ ID NO: 8463947 - DNA, 22 bp, Homo sapiens
agaaatagtcacattggaggaa

SEQ ID NO: 8463948 - DNA, 22 bp, Homo sapiens
agaaatcacttagaggaagtga

SEQ ID NO: 8463949 - DNA, 20 bp, Homo sapiens
agaaatattgagttcagagg

SEQ ID NO: 8463950 - DNA, 22 bp, Homo sapiens
agaaatcaatatctatatgttg

SEQ ID NO: 8463951 - DNA, 22 bp, Homo sapiens
agaaatcttggagtctgtggta

SEQ ID NO: 8463952 - DNA, 22 bp, Homo sapiens
agaaatctttcctgaagtgttt

SEQ ID NO: 8463953 - DNA, 22 bp, Homo sapiens
atcaattcttaggaaaatagct

SEQ ID NO: 8463954 - DNA, 22 bp, Homo sapiens
atcaatgcttgccaaatggaag

SEQ ID NO: 8463955 - DNA, 22 bp, Homo sapiens
atcaatatcagatcagacagga

SEQ ID NO: 8463956 - DNA, 22 bp, Homo sapiens
atcaatatcagatcagacagga

SEQ ID NO: 8463957 - DNA, 22 bp, Homo sapiens
atcaatgctctgtacccagaat

SEQ ID NO: 8463958 - DNA, 22 bp, Homo sapiens
atcaagcagtgaaaaatgctag

SEQ ID NO: 8463959 - DNA, 22 bp, Homo sapiens
atcaagagaaggggaagatgaa

SEQ ID NO: 8463960 - DNA, 22 bp, Homo sapiens
atcaagagtattgacaagacca

SEQ ID NO: 8463961 - DNA, 22 bp, Homo sapiens
atattaatgagcaagtaagtga

SEQ ID NO: 8463962 - DNA, 22 bp, Homo sapiens
atattaatgggatttagtcagg

SEQ ID NO: 8463963 - DNA, 22 bp, Homo sapiens
atattaatgggatttagtcagg

SEQ ID NO: 8463964 - DNA, 22 bp, Homo sapiens
atattaaatggattttgggagc

SEQ ID NO: 8463965 - DNA, 22 bp, Homo sapiens
atattaaaactatggttttcag

SEQ ID NO: 8463966 - DNA, 22 bp, Homo sapiens
agaaagaacgcacttgtgctgc

SEQ ID NO: 8463967 - DNA, 22 bp, Homo sapiens
agaaagaacgttggttatctta

SEQ ID NO: 8463968 - DNA, 22 bp, Homo sapiens
agaaagagctcgggattaacag

SEQ ID NO: 8463969 - DNA, 22 bp, Homo sapiens
atatagtaagcagtctgtaaat

SEQ ID NO: 8463970 - DNA, 20 bp, Homo sapiens
agaaacatttcttgagaact

SEQ ID NO: 8463971 - DNA, 20 bp, Homo sapiens
agaaacatttcttgagaact

SEQ ID NO: 8463972 - DNA, 20 bp, Homo sapiens
agaaacatttcttgagaact

SEQ ID NO: 8463973 - DNA, 22 bp, Homo sapiens
agaaacttcagctattcttttg

SEQ ID NO: 8463974 - DNA, 22 bp, Homo sapiens
atcctgaggaaggtgcagagat

SEQ ID NO: 8463975 - DNA, 22 bp, Homo sapiens
atcctgaggtactgcagggccg

SEQ ID NO: 8463976 - DNA, 22 bp, Homo sapiens
atcctggcaagcagaggagaac

SEQ ID NO: 8463977 - DNA, 22 bp, Homo sapiens
atcctggacagtttcccctatt

SEQ ID NO: 8463978 - DNA, 22 bp, Homo sapiens
atcctgggaagctgacattgaa

SEQ ID NO: 8463979 - DNA, 22 bp, Homo sapiens
atcctggctttaggtcagaggc

SEQ ID NO: 8463980 - DNA, 22 bp, Homo sapiens
atcctggcgccacacggctcta

SEQ ID NO: 8463981 - DNA, 22 bp, Homo sapiens
atcctggcgggggaactgccca

SEQ ID NO: 8463982 - DNA, 22 bp, Homo sapiens
atcctggcccaggtgtggaggg

SEQ ID NO: 8463983 - DNA, 22 bp, Homo sapiens
atcctggccctcatgacccctt

SEQ ID NO: 8463984 - DNA, 22 bp, Homo sapiens
agaagccatggggtcaccagag

SEQ ID NO: 8463985 - DNA, 22 bp, Homo sapiens
agaagccaccagctgaggaaga

SEQ ID NO: 8463986 - DNA, 22 bp, Homo sapiens
atcctgggaagtggcctcctcc

SEQ ID NO: 8463987 - DNA, 22 bp, Homo sapiens
atcctgggaatgggagggtcat

SEQ ID NO: 8463988 - DNA, 22 bp, Homo sapiens
agaagctgcgtttatttaaatc

SEQ ID NO: 8463989 - DNA, 22 bp, Homo sapiens
agaagctgcctacatgaccagc

SEQ ID NO: 8463990 - DNA, 22 bp, Homo sapiens
agaagctgcctacatgaccagc

SEQ ID NO: 8463991 - DNA, 20 bp, Homo sapiens
agaagctgatactgatggaa

SEQ ID NO: 8463992 - DNA, 22 bp, Homo sapiens
agaagctaattcatgtcttatg

SEQ ID NO: 8463993 - DNA, 22 bp, Homo sapiens
agaagctactgggatattaatt

SEQ ID NO: 8463994 - DNA, 22 bp, Homo sapiens
agaagctaattcatgtcttatg

SEQ ID NO: 8463995 - DNA, 22 bp, Homo sapiens
agaagctgacagatgcagcagg

SEQ ID NO: 8463996 - DNA, 22 bp, Homo sapiens
agaagctgacagatgcagcagg

SEQ ID NO: 8463997 - DNA, 22 bp, Homo sapiens
agaagccattgaagcagacctc

SEQ ID NO: 8463998 - DNA, 19 bp, Homo sapiens
agaagcccagatcccagcc

SEQ ID NO: 8463999 - DNA, 22 bp, Homo sapiens
agaagcctcatcctctctagtg

SEQ ID NO: 8464000 - DNA, 19 bp, Homo sapiens
agaagcccagatcccagcc

SEQ ID NO: 8464001 - DNA, 21 bp, Homo sapiens
agaagcctggggaatgtggct

SEQ ID NO: 8464002 - DNA, 22 bp, Homo sapiens
agaagcctgttgagagggccgt

SEQ ID NO: 8464003 - DNA, 21 bp, Homo sapiens
agaagcctgatgaggtctgct

SEQ ID NO: 8464004 - DNA, 18 bp, Homo sapiens
agaagcctgcctcaatgc

SEQ ID NO: 8464005 - DNA, 18 bp, Homo sapiens
agaagcctgcctcaatgc

SEQ ID NO: 8464006 - DNA, 22 bp, Homo sapiens
agaagcccagcatggaaccagc

SEQ ID NO: 8464007 - DNA, 22 bp, Homo sapiens
agaagcctcatcctctctagtg

SEQ ID NO: 8464008 - DNA, 22 bp, Homo sapiens
agaagccaaatgccagtgacct

SEQ ID NO: 8464009 - DNA, 22 bp, Homo sapiens
agaagccaaaggggccagatat

SEQ ID NO: 8464010 - DNA, 22 bp, Homo sapiens
atcctgaaaattgaatggaagg

SEQ ID NO: 8464011 - DNA, 22 bp, Homo sapiens
agaaattaggaaagtaacactt

SEQ ID NO: 8464012 - DNA, 22 bp, Homo sapiens
agaagcagggcagggaaaagca

SEQ ID NO: 8464013 - DNA, 22 bp, Homo sapiens
agaagcaggcctcacagatctg

SEQ ID NO: 8464014 - DNA, 22 bp, Homo sapiens
agaagcagggcagggaaaagca

SEQ ID NO: 8464015 - DNA, 22 bp, Homo sapiens
agttacaaacactatcagttct

SEQ ID NO: 8464016 - DNA, 22 bp, Homo sapiens
agttacaaacactatcagttct

SEQ ID NO: 8464017 - DNA, 22 bp, Homo sapiens
actggtgttgatttggaagggg

SEQ ID NO: 8464018 - DNA, 22 bp, Homo sapiens
actggtggtttctccccagaga

SEQ ID NO: 8464019 - DNA, 22 bp, Homo sapiens
actggtggccctcagtgttctc

SEQ ID NO: 8464020 - DNA, 22 bp, Homo sapiens
actggtggctttcagacagaaa

SEQ ID NO: 8464021 - DNA, 20 bp, Homo sapiens
actggtggactgttcattga

SEQ ID NO: 8464022 - DNA, 22 bp, Homo sapiens
actgggctgcctggttcttcta

SEQ ID NO: 8464023 - DNA, 22 bp, Homo sapiens
actggggcagtgggcagtggtt

SEQ ID NO: 8464024 - DNA, 23 bp, Homo sapiens
actgggtctatctccagagaaga

SEQ ID NO: 8464025 - DNA, 22 bp, Homo sapiens
actggggcctcctccatgctct

SEQ ID NO: 8464026 - DNA, 22 bp, Homo sapiens
agttacagtgttctattactct

SEQ ID NO: 8464027 - DNA, 22 bp, Homo sapiens
agttacagtgttctattactct

SEQ ID NO: 8464028 - DNA, 22 bp, Homo sapiens
agttacagtgaccatttattta

SEQ ID NO: 8464029 - DNA, 22 bp, Homo sapiens
agttacagcactcaaagttttc

SEQ ID NO: 8464030 - DNA, 22 bp, Homo sapiens
agttacatataagaagacagac

SEQ ID NO: 8464031 - DNA, 22 bp, Homo sapiens
agttacatctgttatgtgtgtt

SEQ ID NO: 8464032 - DNA, 22 bp, Homo sapiens
agttacaaccatgacacaagca

SEQ ID NO: 8464033 - DNA, 20 bp, Homo sapiens
agttacgctattactctcct

SEQ ID NO: 8464034 - DNA, 22 bp, Homo sapiens
agttattttggaaaatgagtca

SEQ ID NO: 8464035 - DNA, 19 bp, Homo sapiens
agttatttctaaatttacc

SEQ ID NO: 8464036 - DNA, 22 bp, Homo sapiens
agtgtcttactccctcaggcac

SEQ ID NO: 8464037 - DNA, 22 bp, Homo sapiens
agtgtggggtcaccggcccagg

SEQ ID NO: 8464038 - DNA, 22 bp, Homo sapiens
agtgtgggtgagggaggccctc

SEQ ID NO: 8464039 - DNA, 22 bp, Homo sapiens
agtgtgggtgagggaggccctc

SEQ ID NO: 8464040 - DNA, 22 bp, Homo sapiens
agtgtgtaagggatcaaagagt

SEQ ID NO: 8464041 - DNA, 22 bp, Homo sapiens
agtgtgtaagggatcaaagagt

SEQ ID NO: 8464042 - DNA, 22 bp, Homo sapiens
agtgtgggttttatggagccct

SEQ ID NO: 8464043 - DNA, 23 bp, Homo sapiens
actgggctgaaattaaaggtgtc

SEQ ID NO: 8464044 - DNA, 22 bp, Homo sapiens
agtgtgtcttatcctgggagaa

SEQ ID NO: 8464045 - DNA, 23 bp, Homo sapiens
actgggctgaaatttttcatggc

SEQ ID NO: 8464046 - DNA, 23 bp, Homo sapiens
actgggctgaaatttttcatggc

SEQ ID NO: 8464047 - DNA, 23 bp, Homo sapiens
actgggctgaaattaaaggtgtc

SEQ ID NO: 8464048 - DNA, 22 bp, Homo sapiens
agtgtgtctgatcacttgtgag

SEQ ID NO: 8464049 - DNA, 17 bp, Homo sapiens
agtgtgtgaaatggtgg

SEQ ID NO: 8464050 - DNA, 19 bp, Homo sapiens
agtgtgtactgaaagcact

SEQ ID NO: 8464051 - DNA, 22 bp, Homo sapiens
agtggggccggtgaggccgagg

SEQ ID NO: 8464052 - DNA, 22 bp, Homo sapiens
agtggggcggacaggaccagga

SEQ ID NO: 8464053 - DNA, 22 bp, Homo sapiens
agtgggggctggctctgtctgt

SEQ ID NO: 8464054 - DNA, 21 bp, Homo sapiens
agtggggtctctgtggaggcc

SEQ ID NO: 8464055 - DNA, 22 bp, Homo sapiens
agtgggggccaacgagggcagc

SEQ ID NO: 8464056 - DNA, 22 bp, Homo sapiens
agtgggggccaacgagggcagc

SEQ ID NO: 8464057 - DNA, 22 bp, Homo sapiens
agtgggggccaacgagggcagc

SEQ ID NO: 8464058 - DNA, 22 bp, Homo sapiens
agtgggggccaacgagggcagc

SEQ ID NO: 8464059 - DNA, 22 bp, Homo sapiens
agtgtctgttacgcttgcagaa

SEQ ID NO: 8464060 - DNA, 22 bp, Homo sapiens
agtgtctggtctctgaactaaa

SEQ ID NO: 8464061 - DNA, 22 bp, Homo sapiens
agtgctgaagactggctaggga

SEQ ID NO: 8464062 - DNA, 22 bp, Homo sapiens
agtgctgtccagtttcacaggt

SEQ ID NO: 8464063 - DNA, 22 bp, Homo sapiens
agtgcaacagcagttctcttta

SEQ ID NO: 8464064 - DNA, 22 bp, Homo sapiens
agtgcaacttcacgtagagtac

SEQ ID NO: 8464065 - DNA, 20 bp, Homo sapiens
agtgcaagaaagcacagctg

SEQ ID NO: 8464066 - DNA, 22 bp, Homo sapiens
agtgcaacagaagcaggctggc

SEQ ID NO: 8464067 - DNA, 22 bp, Homo sapiens
agtgatttgcagtatttactaa

SEQ ID NO: 8464068 - DNA, 22 bp, Homo sapiens
agtgatttgggtgtcagaaagt

SEQ ID NO: 8464069 - DNA, 22 bp, Homo sapiens
agtgattttatcaatttactca

SEQ ID NO: 8464070 - DNA, 20 bp, Homo sapiens
agtgatttgttagtacattg

SEQ ID NO: 8464071 - DNA, 20 bp, Homo sapiens
agtgatttgttagtacattg

SEQ ID NO: 8464072 - DNA, 22 bp, Homo sapiens
agtgcaaaattcagaagcaatt

SEQ ID NO: 8464073 - DNA, 22 bp, Homo sapiens
agtgaggcaaagtgagaggcag

SEQ ID NO: 8464074 - DNA, 19 bp, Homo sapiens
agtgagcatccagagaggt

SEQ ID NO: 8464075 - DNA, 22 bp, Homo sapiens
agtgagcatcttcaggagccaa

SEQ ID NO: 8464076 - DNA, 22 bp, Homo sapiens
agtgagcatcttcaggagccaa

SEQ ID NO: 8464077 - DNA, 22 bp, Homo sapiens
agtgaatgtccccgcgggtcag

SEQ ID NO: 8464078 - DNA, 22 bp, Homo sapiens
agtcctttgggaaaaatgacta

SEQ ID NO: 8464079 - DNA, 17 bp, Homo sapiens
agtgagaatgtcatgta

SEQ ID NO: 8464080 - DNA, 22 bp, Homo sapiens
agtgagagtattaatgtgaact

SEQ ID NO: 8464081 - DNA, 22 bp, Homo sapiens
agtggcagagccaagtagagcc

SEQ ID NO: 8464082 - DNA, 22 bp, Homo sapiens
agtggctggaattgcaggtgcg

SEQ ID NO: 8464083 - DNA, 20 bp, Homo sapiens
agtgggagagggcagactgc

SEQ ID NO: 8464084 - DNA, 22 bp, Homo sapiens
agtgggagccagcagcttgggg

SEQ ID NO: 8464085 - DNA, 20 bp, Homo sapiens
agtgggagagggcagactgc

SEQ ID NO: 8464086 - DNA, 22 bp, Homo sapiens
agtggctggaattgcaggtgcg

SEQ ID NO: 8464087 - DNA, 22 bp, Homo sapiens
agtggctggaattgcaggtgcg

SEQ ID NO: 8464088 - DNA, 22 bp, Homo sapiens
agtgggagcggcagtcggggac

SEQ ID NO: 8464089 - DNA, 22 bp, Homo sapiens
agtgggagccagcagcttgggg

SEQ ID NO: 8464090 - DNA, 22 bp, Homo sapiens
agtgggagccagcagcttgggg

SEQ ID NO: 8464091 - DNA, 22 bp, Homo sapiens
agtgggagcggcagtcggggac

SEQ ID NO: 8464092 - DNA, 22 bp, Homo sapiens
agtggggccgcggtcctgccct

SEQ ID NO: 8464093 - DNA, 16 bp, Homo sapiens
agtgggaggagaaaga

SEQ ID NO: 8464094 - DNA, 22 bp, Homo sapiens
agtgggaggcggctgacgggcg

SEQ ID NO: 8464095 - DNA, 22 bp, Homo sapiens
agtgctttggtatagaactatt

SEQ ID NO: 8464096 - DNA, 22 bp, Homo sapiens
agtgctttgagcgtttgaaaag

SEQ ID NO: 8464097 - DNA, 22 bp, Homo sapiens
agtggcagacacaatgtgggca

SEQ ID NO: 8464098 - DNA, 22 bp, Homo sapiens
agtggcagacacaatgtgggca

SEQ ID NO: 8464099 - DNA, 22 bp, Homo sapiens
agtggcagacacaatgtgggca

SEQ ID NO: 8464100 - DNA, 22 bp, Homo sapiens
agtggcagacagagacagtacc

SEQ ID NO: 8464101 - DNA, 22 bp, Homo sapiens
agtggcagacagagacagtacc

SEQ ID NO: 8464102 - DNA, 22 bp, Homo sapiens
agtggcagagcaggtgctggaa

SEQ ID NO: 8464103 - DNA, 22 bp, Homo sapiens
agtggcagagaccccagccagc

SEQ ID NO: 8464104 - DNA, 22 bp, Homo sapiens
agtggcagagaccccagccagc

SEQ ID NO: 8464105 - DNA, 22 bp, Homo sapiens
agtgcttggcaaccttctgacc

SEQ ID NO: 8464106 - DNA, 20 bp, Homo sapiens
agtgctgtggctgaataaga

SEQ ID NO: 8464107 - DNA, 22 bp, Homo sapiens
agtgctttagcatccaactgtc

SEQ ID NO: 8464108 - DNA, 22 bp, Homo sapiens
actctgggattgtttctggtat

SEQ ID NO: 8464109 - DNA, 22 bp, Homo sapiens
actctgggattgtttctggtat

SEQ ID NO: 8464110 - DNA, 22 bp, Homo sapiens
actctgggatgagaaaagggtt

SEQ ID NO: 8464111 - DNA, 22 bp, Homo sapiens
actctgggcccaccctcagagt

SEQ ID NO: 8464112 - DNA, 22 bp, Homo sapiens
actctgggcccaccctcagagt

SEQ ID NO: 8464113 - DNA, 22 bp, Homo sapiens
actctgggagaggacaaacaaa

SEQ ID NO: 8464114 - DNA, 22 bp, Homo sapiens
actctgggatcttgaaaagagt

SEQ ID NO: 8464115 - DNA, 21 bp, Homo sapiens
agtccaggcctgcccacttcc

SEQ ID NO: 8464116 - DNA, 21 bp, Homo sapiens
agtccaggcctgcccacttcc

SEQ ID NO: 8464117 - DNA, 21 bp, Homo sapiens
agtccaggcctgcccacttcc

SEQ ID NO: 8464118 - DNA, 22 bp, Homo sapiens
agtccaggcctccctctcctgc

SEQ ID NO: 8464119 - DNA, 22 bp, Homo sapiens
agtccaggcctccctctcctgc

SEQ ID NO: 8464120 - DNA, 22 bp, Homo sapiens
agtccaggcctcctcttttcct

SEQ ID NO: 8464121 - DNA, 22 bp, Homo sapiens
agtccaggcctcctcttttcct

SEQ ID NO: 8464122 - DNA, 22 bp, Homo sapiens
agtccaggcctccctctcctgc

SEQ ID NO: 8464123 - DNA, 22 bp, Homo sapiens
agtccaggcattccagccattc

SEQ ID NO: 8464124 - DNA, 22 bp, Homo sapiens
agtccaggcattccagccattc

SEQ ID NO: 8464125 - DNA, 22 bp, Homo sapiens
agtccagaccccggcagctggt

SEQ ID NO: 8464126 - DNA, 22 bp, Homo sapiens
agtccaggaaaataagctaggt

SEQ ID NO: 8464127 - DNA, 22 bp, Homo sapiens
agtccaggaaaataagctaggt

SEQ ID NO: 8464128 - DNA, 22 bp, Homo sapiens
agtccaggaagcatcatggtct

SEQ ID NO: 8464129 - DNA, 22 bp, Homo sapiens
agtccaggaagcatcatggtct

SEQ ID NO: 8464130 - DNA, 22 bp, Homo sapiens
agtccaggactgtttcagctga

SEQ ID NO: 8464131 - DNA, 22 bp, Homo sapiens
agtccaggactgtttcagctga

SEQ ID NO: 8464132 - DNA, 21 bp, Homo sapiens
agtccaggagtcacccaagcc

SEQ ID NO: 8464133 - DNA, 21 bp, Homo sapiens
agtccaggagtcacccaagcc

SEQ ID NO: 8464134 - DNA, 21 bp, Homo sapiens
agtccaggagtcacccaagcc

SEQ ID NO: 8464135 - DNA, 21 bp, Homo sapiens
agtccaggaggaggccaggtt

SEQ ID NO: 8464136 - DNA, 21 bp, Homo sapiens
agtccaggaggaggccaggtt

SEQ ID NO: 8464137 - DNA, 21 bp, Homo sapiens
agtccaggaggaggccaggtt

SEQ ID NO: 8464138 - DNA, 22 bp, Homo sapiens
agtccaggagttgggtgacatt

SEQ ID NO: 8464139 - DNA, 22 bp, Homo sapiens
agtccaggagttgggtgacatt

SEQ ID NO: 8464140 - DNA, 22 bp, Homo sapiens
agtccaggcattccagccattc

SEQ ID NO: 8464141 - DNA, 22 bp, Homo sapiens
agtccaggcattccagccattc

SEQ ID NO: 8464142 - DNA, 22 bp, Homo sapiens
agtccaggcaagttgttgtgta

SEQ ID NO: 8464143 - DNA, 22 bp, Homo sapiens
agtccaggcaagttgttgtgta

SEQ ID NO: 8464144 - DNA, 22 bp, Homo sapiens
actctgggctttgatttgttac

SEQ ID NO: 8464145 - DNA, 22 bp, Homo sapiens
actctgggctttgatttgttac

SEQ ID NO: 8464146 - DNA, 22 bp, Homo sapiens
actctgggctgttaggagctgt

SEQ ID NO: 8464147 - DNA, 22 bp, Homo sapiens
actctggggcgctactccaact

SEQ ID NO: 8464148 - DNA, 22 bp, Homo sapiens
actctgggctgttaggagctgt

SEQ ID NO: 8464149 - DNA, 22 bp, Homo sapiens
actctgggccccaggtggagct

SEQ ID NO: 8464150 - DNA, 22 bp, Homo sapiens
actctgggccccaggtggagct

SEQ ID NO: 8464151 - DNA, 22 bp, Homo sapiens
actctgggtcctgccattcact

SEQ ID NO: 8464152 - DNA, 22 bp, Homo sapiens
actctggggtgatgtctctgag

SEQ ID NO: 8464153 - DNA, 20 bp, Homo sapiens
actctggggctcattagggg

SEQ ID NO: 8464154 - DNA, 22 bp, Homo sapiens
agtcctgggtgtgcaaggcaga

SEQ ID NO: 8464155 - DNA, 22 bp, Homo sapiens
actctgtaattctatatgcagt

SEQ ID NO: 8464156 - DNA, 22 bp, Homo sapiens
actctgtaaagcataacgtttg

SEQ ID NO: 8464157 - DNA, 22 bp, Homo sapiens
actctgggttctttcacttgac

SEQ ID NO: 8464158 - DNA, 22 bp, Homo sapiens
actctgggttctttcacttgac

SEQ ID NO: 8464159 - DNA, 22 bp, Homo sapiens
agtcctgggtgtgcaaggcaga

SEQ ID NO: 8464160 - DNA, 22 bp, Homo sapiens
agtcctgggtgtgcaaggcaga

SEQ ID NO: 8464161 - DNA, 22 bp, Homo sapiens
agtcctggtgacactcctcttc

SEQ ID NO: 8464162 - DNA, 22 bp, Homo sapiens
agtcctggttctgattctgaca

SEQ ID NO: 8464163 - DNA, 22 bp, Homo sapiens
agtcctgtctctcccagggcca

SEQ ID NO: 8464164 - DNA, 22 bp, Homo sapiens
agtcctggtgacactcctcttc

SEQ ID NO: 8464165 - DNA, 22 bp, Homo sapiens
agtcctggtgacactcctcttc

SEQ ID NO: 8464166 - DNA, 22 bp, Homo sapiens
agtccttccggcagatttcact

SEQ ID NO: 8464167 - DNA, 22 bp, Homo sapiens
agtccttagaacactgtatctg

SEQ ID NO: 8464168 - DNA, 22 bp, Homo sapiens
agtcctgtgcaaatgcatctga

SEQ ID NO: 8464169 - DNA, 22 bp, Homo sapiens
agtaagttccagtttcattatg

SEQ ID NO: 8464170 - DNA, 22 bp, Homo sapiens
agtaagtgagtcactgtgctgg

SEQ ID NO: 8464171 - DNA, 22 bp, Homo sapiens
agtcacttgattctcctgagct

SEQ ID NO: 8464172 - DNA, 22 bp, Homo sapiens
agtcacttctattctattaagt

SEQ ID NO: 8464173 - DNA, 22 bp, Homo sapiens
agtcagggttgtaggctcaccc

SEQ ID NO: 8464174 - DNA, 22 bp, Homo sapiens
agtcaggggatctagacttgaa

SEQ ID NO: 8464175 - DNA, 22 bp, Homo sapiens
agtcagtcaccatttaagaaca

SEQ ID NO: 8464176 - DNA, 23 bp, Homo sapiens
agtcagtgcgggatggtcagggg

SEQ ID NO: 8464177 - DNA, 22 bp, Homo sapiens
agtcagtgacttttgctgagag

SEQ ID NO: 8464178 - DNA, 22 bp, Homo sapiens
agtcagtgggcttggcacagaa

SEQ ID NO: 8464179 - DNA, 22 bp, Homo sapiens
agtcagtggatttaccatgcgt

SEQ ID NO: 8464180 - DNA, 22 bp, Homo sapiens
agtaacatgagtttttctaatg

SEQ ID NO: 8464181 - DNA, 23 bp, Homo sapiens
agtaacatgcaaataacagtctg

SEQ ID NO: 8464182 - DNA, 23 bp, Homo sapiens
agtaacatgcaaataacagtctg

SEQ ID NO: 8464183 - DNA, 22 bp, Homo sapiens
agtaacatgagtttttctaatg

SEQ ID NO: 8464184 - DNA, 22 bp, Homo sapiens
agtaacatctttgacatttgtt

SEQ ID NO: 8464185 - DNA, 22 bp, Homo sapiens
agtaactctcctttgacatatt

SEQ ID NO: 8464186 - DNA, 22 bp, Homo sapiens
agtaactcatgtaaacctcaca

SEQ ID NO: 8464187 - DNA, 22 bp, Homo sapiens
agtaagcaatagagtgagaatt

SEQ ID NO: 8464188 - DNA, 22 bp, Homo sapiens
actcagagcttggctccttgct

SEQ ID NO: 8464189 - DNA, 22 bp, Homo sapiens
actcagagcttggctccttgct

SEQ ID NO: 8464190 - DNA, 22 bp, Homo sapiens
actcagaggaaaccctcctagg

SEQ ID NO: 8464191 - DNA, 22 bp, Homo sapiens
actcagagcttggctccttgct

SEQ ID NO: 8464192 - DNA, 22 bp, Homo sapiens
actcagaggaccaaaaggaaag

SEQ ID NO: 8464193 - DNA, 22 bp, Homo sapiens
actcagaggaaagttgagattg

SEQ ID NO: 8464194 - DNA, 22 bp, Homo sapiens
actcagaggaaagttgagattg

SEQ ID NO: 8464195 - DNA, 22 bp, Homo sapiens
actcagaggaaagttgagattg

SEQ ID NO: 8464196 - DNA, 22 bp, Homo sapiens
actcagagtctgagataaatct

SEQ ID NO: 8464197 - DNA, 22 bp, Homo sapiens
actcagagtcaatgttaatggc

SEQ ID NO: 8464198 - DNA, 22 bp, Homo sapiens
actcagagtagaaaataggttc

SEQ ID NO: 8464199 - DNA, 22 bp, Homo sapiens
actcagaggggactggtgtggt

SEQ ID NO: 8464200 - DNA, 22 bp, Homo sapiens
actcagagtagaaaataggttc

SEQ ID NO: 8464201 - DNA, 22 bp, Homo sapiens
actcagagtagaaaataggttc

SEQ ID NO: 8464202 - DNA, 22 bp, Homo sapiens
actcagaggctggaaatcaaag

SEQ ID NO: 8464203 - DNA, 22 bp, Homo sapiens
actcagaggcagctgctcaccc

SEQ ID NO: 8464204 - DNA, 22 bp, Homo sapiens
actcagaggcagctgctcaccc

SEQ ID NO: 8464205 - DNA, 22 bp, Homo sapiens
actcagaggcagctgctcaccc

SEQ ID NO: 8464206 - DNA, 22 bp, Homo sapiens
actcagaggaccaaaaggaaag

SEQ ID NO: 8464207 - DNA, 22 bp, Homo sapiens
actcagagtgcatctcctattt

SEQ ID NO: 8464208 - DNA, 22 bp, Homo sapiens
actcagagtgcatctcctattt

SEQ ID NO: 8464209 - DNA, 22 bp, Homo sapiens
actcagagtctgtttggtacct

SEQ ID NO: 8464210 - DNA, 22 bp, Homo sapiens
actcagagtctgtttggtacct

SEQ ID NO: 8464211 - DNA, 22 bp, Homo sapiens
actcagagttcctgtgcatagt

SEQ ID NO: 8464212 - DNA, 22 bp, Homo sapiens
actcagagttcctgtgcatagt

SEQ ID NO: 8464213 - DNA, 22 bp, Homo sapiens
actcagagtttgcgttccatac

SEQ ID NO: 8464214 - DNA, 22 bp, Homo sapiens
actcagagttttacccagagac

SEQ ID NO: 8464215 - DNA, 22 bp, Homo sapiens
actcagagttttacccagagac

SEQ ID NO: 8464216 - DNA, 22 bp, Homo sapiens
actcagagtctgtttggtacct

SEQ ID NO: 8464217 - DNA, 22 bp, Homo sapiens
actcagctaaactcagtctatg

SEQ ID NO: 8464218 - DNA, 22 bp, Homo sapiens
actcagcacagcactgggaacc

SEQ ID NO: 8464219 - DNA, 22 bp, Homo sapiens
actcagcatatggggccgcttg

SEQ ID NO: 8464220 - DNA, 22 bp, Homo sapiens
actcaccacacccttgcacttg

SEQ ID NO: 8464221 - DNA, 22 bp, Homo sapiens
actcagagcctcgagggactgc

SEQ ID NO: 8464222 - DNA, 22 bp, Homo sapiens
actcagagcctcgagggactgc

SEQ ID NO: 8464223 - DNA, 22 bp, Homo sapiens
actcacagtccctgtaggagtg

SEQ ID NO: 8464224 - DNA, 22 bp, Homo sapiens
aggttcttggtgagcatttggt

SEQ ID NO: 8464225 - DNA, 22 bp, Homo sapiens
aggttctgtttggctgaggatc

SEQ ID NO: 8464226 - DNA, 22 bp, Homo sapiens
aggttctggtaagctgttgctt

SEQ ID NO: 8464227 - DNA, 22 bp, Homo sapiens
aggttcttgactctaccttcca

SEQ ID NO: 8464228 - DNA, 22 bp, Homo sapiens
aggttctggcattgctcagtaa

SEQ ID NO: 8464229 - DNA, 18 bp, Homo sapiens
aggttctgacagtccaaa

SEQ ID NO: 8464230 - DNA, 22 bp, Homo sapiens
aggttctccttatcaatgaaga

SEQ ID NO: 8464231 - DNA, 22 bp, Homo sapiens
aggttctcacacgtctacaccc

SEQ ID NO: 8464232 - DNA, 23 bp, Homo sapiens
aggttcccccgccaggaccctgc

SEQ ID NO: 8464233 - DNA, 22 bp, Homo sapiens
aggttcctcttcctctggcctg

SEQ ID NO: 8464234 - DNA, 22 bp, Homo sapiens
aggttccatcacctgcagtgga

SEQ ID NO: 8464235 - DNA, 22 bp, Homo sapiens
aggttccaggttcgaatcccat

SEQ ID NO: 8464236 - DNA, 22 bp, Homo sapiens
aggttccagggattaggatgtg

SEQ ID NO: 8464237 - DNA, 22 bp, Homo sapiens
aggttccaggtctgggttatgt

SEQ ID NO: 8464238 - DNA, 20 bp, Homo sapiens
aggttccagccacaaccagc

SEQ ID NO: 8464239 - DNA, 21 bp, Homo sapiens
aggttccagcagccagagaat

SEQ ID NO: 8464240 - DNA, 22 bp, Homo sapiens
aggtgggttcccgactctggct

SEQ ID NO: 8464241 - DNA, 17 bp, Homo sapiens
aggtgggtggatcacct

SEQ ID NO: 8464242 - DNA, 22 bp, Homo sapiens
aggtgcatctcgtagctcttct

SEQ ID NO: 8464243 - DNA, 23 bp, Homo sapiens
aggtgccaactgagagctgagag

SEQ ID NO: 8464244 - DNA, 22 bp, Homo sapiens
aggtgccacctctggtgctgtc

SEQ ID NO: 8464245 - DNA, 22 bp, Homo sapiens
aggtgaggataggtggccaagg

SEQ ID NO: 8464246 - DNA, 22 bp, Homo sapiens
agggtgcagtcacaggaaatgt

SEQ ID NO: 8464247 - DNA, 22 bp, Homo sapiens
agggtgcctgctgcaggttcag

SEQ ID NO: 8464248 - DNA, 22 bp, Homo sapiens
aggtgcaggagctgtgcaggga

SEQ ID NO: 8464249 - DNA, 22 bp, Homo sapiens
agggtccacttggacattgatc

SEQ ID NO: 8464250 - DNA, 22 bp, Homo sapiens
agggtccaactgaggctgaact

SEQ ID NO: 8464251 - DNA, 19 bp, Homo sapiens
agggtccaggccctgtgga

SEQ ID NO: 8464252 - DNA, 23 bp, Homo sapiens
agggtccagggatcaccaggtgt

SEQ ID NO: 8464253 - DNA, 19 bp, Homo sapiens
agggtccagggagcggctc

SEQ ID NO: 8464254 - DNA, 22 bp, Homo sapiens
agggtccagtaacagatgccag

SEQ ID NO: 8464255 - DNA, 22 bp, Homo sapiens
agggtccagtaacagatgccag

SEQ ID NO: 8464256 - DNA, 22 bp, Homo sapiens
agggtccagtaacagatgccag

SEQ ID NO: 8464257 - DNA, 22 bp, Homo sapiens
agggtccatcaaggactgcaca

SEQ ID NO: 8464258 - DNA, 22 bp, Homo sapiens
agggtccatcaaggactgcaca

SEQ ID NO: 8464259 - DNA, 22 bp, Homo sapiens
agggtccattctttgccttttc

SEQ ID NO: 8464260 - DNA, 22 bp, Homo sapiens
agggtccatgtttccagttaat

SEQ ID NO: 8464261 - DNA, 22 bp, Homo sapiens
agggtgagggtctggccttgag

SEQ ID NO: 8464262 - DNA, 22 bp, Homo sapiens
agggtcctaagcctcagataag

SEQ ID NO: 8464263 - DNA, 22 bp, Homo sapiens
agggtgcaaaagcaaggacagt

SEQ ID NO: 8464264 - DNA, 22 bp, Homo sapiens
agggtgagggtctggccttgag

SEQ ID NO: 8464265 - DNA, 20 bp, Homo sapiens
accagagctctcagtatgtg

SEQ ID NO: 8464266 - DNA, 22 bp, Homo sapiens
accagagcccatctgctcctag

SEQ ID NO: 8464267 - DNA, 20 bp, Homo sapiens
accagagctctcagtatgtg

SEQ ID NO: 8464268 - DNA, 22 bp, Homo sapiens
agggagctgactggctgccatt

SEQ ID NO: 8464269 - DNA, 22 bp, Homo sapiens
agggagctgactggctgccatt

SEQ ID NO: 8464270 - DNA, 22 bp, Homo sapiens
agggaggatagtagtcagttta

SEQ ID NO: 8464271 - DNA, 22 bp, Homo sapiens
agggaggatctgctccttgtct

SEQ ID NO: 8464272 - DNA, 20 bp, Homo sapiens
accagagactggggacaagt

SEQ ID NO: 8464273 - DNA, 20 bp, Homo sapiens
accagagatagcaatagtgc

SEQ ID NO: 8464274 - DNA, 22 bp, Homo sapiens
agggcacatctgctgggaatgg

SEQ ID NO: 8464275 - DNA, 22 bp, Homo sapiens
agggcacaagactctgagcccc

SEQ ID NO: 8464276 - DNA, 22 bp, Homo sapiens
agggcacagcctaaagcctatg

SEQ ID NO: 8464277 - DNA, 22 bp, Homo sapiens
agggcacaggctccgggtccag

SEQ ID NO: 8464278 - DNA, 19 bp, Homo sapiens
agggcacagggacagaagg

SEQ ID NO: 8464279 - DNA, 22 bp, Homo sapiens
agggatgttgtcaaggatgtgg

SEQ ID NO: 8464280 - DNA, 22 bp, Homo sapiens
agggatgttagttgtgagctca

SEQ ID NO: 8464281 - DNA, 22 bp, Homo sapiens
agggatgttcattttgtggctg

SEQ ID NO: 8464282 - DNA, 20 bp, Homo sapiens
agggaggtgctgggcctgag

SEQ ID NO: 8464283 - DNA, 20 bp, Homo sapiens
agggaggtgctgggcctgag

SEQ ID NO: 8464284 - DNA, 22 bp, Homo sapiens
agggaggcattagctactgcga

SEQ ID NO: 8464285 - DNA, 22 bp, Homo sapiens
agggccagttctacctctgaat

SEQ ID NO: 8464286 - DNA, 22 bp, Homo sapiens
agggccagttctacctctgaat

SEQ ID NO: 8464287 - DNA, 22 bp, Homo sapiens
agggccagttctacctctgaat

SEQ ID NO: 8464288 - DNA, 22 bp, Homo sapiens
agggcctggttctgtgtaggga

SEQ ID NO: 8464289 - DNA, 22 bp, Homo sapiens
agggcctggttctgtgtaggga

SEQ ID NO: 8464290 - DNA, 22 bp, Homo sapiens
agggcctgtcagcggtgtcctg

SEQ ID NO: 8464291 - DNA, 22 bp, Homo sapiens
agggctcaccactgtgcactcc

SEQ ID NO: 8464292 - DNA, 22 bp, Homo sapiens
agggctcaccactgtgcactcc

SEQ ID NO: 8464293 - DNA, 21 bp, Homo sapiens
agggctcaaatgtgcttgctg

SEQ ID NO: 8464294 - DNA, 22 bp, Homo sapiens
agggccagtattaaggtaatta

SEQ ID NO: 8464295 - DNA, 22 bp, Homo sapiens
agggccagtaaatgtttcctca

SEQ ID NO: 8464296 - DNA, 22 bp, Homo sapiens
agggccagtcgtgtattactgt

SEQ ID NO: 8464297 - DNA, 22 bp, Homo sapiens
agggccagatgaagccacaagc

SEQ ID NO: 8464298 - DNA, 21 bp, Homo sapiens
agggccagatcaccaaggagc

SEQ ID NO: 8464299 - DNA, 22 bp, Homo sapiens
agggcatgctggaggagagaca

SEQ ID NO: 8464300 - DNA, 21 bp, Homo sapiens
agggccagatcaccaaggagc

SEQ ID NO: 8464301 - DNA, 22 bp, Homo sapiens
agggcactggcttgcaaactca

SEQ ID NO: 8464302 - DNA, 22 bp, Homo sapiens
agggccagccaggccctacaaa

SEQ ID NO: 8464303 - DNA, 22 bp, Homo sapiens
agggccagccaggccctacaaa

SEQ ID NO: 8464304 - DNA, 22 bp, Homo sapiens
agggccagcactcctggcagga

SEQ ID NO: 8464305 - DNA, 22 bp, Homo sapiens
agggccagcactcctggcagga

SEQ ID NO: 8464306 - DNA, 22 bp, Homo sapiens
agggccagcactcctggcagga

SEQ ID NO: 8464307 - DNA, 22 bp, Homo sapiens
agggccagcactcctggcagga

SEQ ID NO: 8464308 - DNA, 22 bp, Homo sapiens
acctcagattgtggctccgctg

SEQ ID NO: 8464309 - DNA, 22 bp, Homo sapiens
acctcagagggatgttacaggc

SEQ ID NO: 8464310 - DNA, 22 bp, Homo sapiens
acctcagaggccagggatctag

SEQ ID NO: 8464311 - DNA, 22 bp, Homo sapiens
acctcagagacctctcaggtgc

SEQ ID NO: 8464312 - DNA, 22 bp, Homo sapiens
acctcagattgtggctccgctg

SEQ ID NO: 8464313 - DNA, 22 bp, Homo sapiens
acctcagctatttcaaaacaga

SEQ ID NO: 8464314 - DNA, 22 bp, Homo sapiens
acctccaggaagctcttggtac

SEQ ID NO: 8464315 - DNA, 22 bp, Homo sapiens
acctccagctttttagagacat

SEQ ID NO: 8464316 - DNA, 22 bp, Homo sapiens
acctcagttcaattcagttaga

SEQ ID NO: 8464317 - DNA, 22 bp, Homo sapiens
acctcacaagtctctgtcagct

SEQ ID NO: 8464318 - DNA, 22 bp, Homo sapiens
acctcaagtgatccactcacct

SEQ ID NO: 8464319 - DNA, 22 bp, Homo sapiens
acctcagagatacaaaccatgg

SEQ ID NO: 8464320 - DNA, 22 bp, Homo sapiens
acctcagaggaggctcctggct

SEQ ID NO: 8464321 - DNA, 22 bp, Homo sapiens
acctcagaacggcgttcttgaa

SEQ ID NO: 8464322 - DNA, 22 bp, Homo sapiens
acctcagagacctctcaggtgc

SEQ ID NO: 8464323 - DNA, 22 bp, Homo sapiens
accctttgtccaatagaaatga

SEQ ID NO: 8464324 - DNA, 22 bp, Homo sapiens
aggggccacctgtggcaccctg

SEQ ID NO: 8464325 - DNA, 22 bp, Homo sapiens
accctttcttactcacacgctc

SEQ ID NO: 8464326 - DNA, 22 bp, Homo sapiens
acctcccagaaagttttgcagg

SEQ ID NO: 8464327 - DNA, 22 bp, Homo sapiens
aggggtgacacatatcagtgca

SEQ ID NO: 8464328 - DNA, 16 bp, Homo sapiens
acctccagtcaagggt

SEQ ID NO: 8464329 - DNA, 22 bp, Homo sapiens
aggggtgatttgggacaggaca

SEQ ID NO: 8464330 - DNA, 22 bp, Homo sapiens
aggggtggagagtgttgccagt

SEQ ID NO: 8464331 - DNA, 22 bp, Homo sapiens
aggggtggagagtgttgccagt

SEQ ID NO: 8464332 - DNA, 22 bp, Homo sapiens
aggggttggatttggcctagag

SEQ ID NO: 8464333 - DNA, 22 bp, Homo sapiens
agggtagctacccaactccaga

SEQ ID NO: 8464334 - DNA, 23 bp, Homo sapiens
aggggtggtcagtacccgcagtg

SEQ ID NO: 8464335 - DNA, 23 bp, Homo sapiens
aggggtggtcagtacccgcagtg

SEQ ID NO: 8464336 - DNA, 22 bp, Homo sapiens
aggggtgtgcatcctggaggat

SEQ ID NO: 8464337 - DNA, 22 bp, Homo sapiens
aggggagcttgcctggtcaccc

SEQ ID NO: 8464338 - DNA, 22 bp, Homo sapiens
aggggagctaacaccagagccc

SEQ ID NO: 8464339 - DNA, 22 bp, Homo sapiens
aggggagctaacaccagagccc

SEQ ID NO: 8464340 - DNA, 22 bp, Homo sapiens
aggggagccgaggggcatctgt

SEQ ID NO: 8464341 - DNA, 22 bp, Homo sapiens
aggggcaggtgctgcacttaga

SEQ ID NO: 8464342 - DNA, 22 bp, Homo sapiens
aggggcagttccaagttttgtg

SEQ ID NO: 8464343 - DNA, 22 bp, Homo sapiens
aggggcagttccaagttttgtg

SEQ ID NO: 8464344 - DNA, 22 bp, Homo sapiens
agggctttctttgtaaaagaag

SEQ ID NO: 8464345 - DNA, 22 bp, Homo sapiens
aggggagcaaggccgtggtgta

SEQ ID NO: 8464346 - DNA, 22 bp, Homo sapiens
aggggagcccctggtcctggtg

SEQ ID NO: 8464347 - DNA, 22 bp, Homo sapiens
aggggagccgaggggcatctgt

SEQ ID NO: 8464348 - DNA, 22 bp, Homo sapiens
agggctgacagtaaaagtatga

SEQ ID NO: 8464349 - DNA, 22 bp, Homo sapiens
agggctcagcatctcattctgt

SEQ ID NO: 8464350 - DNA, 22 bp, Homo sapiens
acatttctcaggtaagtcattt

SEQ ID NO: 8464351 - DNA, 22 bp, Homo sapiens
acatttctcaggtaagtcattt

SEQ ID NO: 8464352 - DNA, 22 bp, Homo sapiens
acatttctcataggagagccac

SEQ ID NO: 8464353 - DNA, 18 bp, Homo sapiens
acatttctccttctgacc

SEQ ID NO: 8464354 - DNA, 22 bp, Homo sapiens
acatttctccctgcatgcctgc

SEQ ID NO: 8464355 - DNA, 22 bp, Homo sapiens
aggctggccagtgctgcagtgg

SEQ ID NO: 8464356 - DNA, 22 bp, Homo sapiens
aggctggccagtgctgcagtgg

SEQ ID NO: 8464357 - DNA, 18 bp, Homo sapiens
acatttctccttctgacc

SEQ ID NO: 8464358 - DNA, 22 bp, Homo sapiens
aggctggcatacatttgttctt

SEQ ID NO: 8464359 - DNA, 23 bp, Homo sapiens
aggctggcttcaggagcctctcc

SEQ ID NO: 8464360 - DNA, 23 bp, Homo sapiens
aggctggcttcaggagcctctcc

SEQ ID NO: 8464361 - DNA, 23 bp, Homo sapiens
aggctggcttcaggagcctctcc

SEQ ID NO: 8464362 - DNA, 23 bp, Homo sapiens
aggctggcttcaggagcctctcc

SEQ ID NO: 8464363 - DNA, 22 bp, Homo sapiens
aggctggcttcccaagcgtcct

SEQ ID NO: 8464364 - DNA, 22 bp, Homo sapiens
aggctggcttggctctcctgtg

SEQ ID NO: 8464365 - DNA, 22 bp, Homo sapiens
aggctggcttggctctcctgtg

SEQ ID NO: 8464366 - DNA, 22 bp, Homo sapiens
aggctgctgccttggagagtgt

SEQ ID NO: 8464367 - DNA, 22 bp, Homo sapiens
aggctgctggaggatttatgcc

SEQ ID NO: 8464368 - DNA, 21 bp, Homo sapiens
aggctgctggctcagggtcct

SEQ ID NO: 8464369 - DNA, 22 bp, Homo sapiens
aggctgctggcaggcgtggacg

SEQ ID NO: 8464370 - DNA, 22 bp, Homo sapiens
aggctgcttcagctgcagggag

SEQ ID NO: 8464371 - DNA, 17 bp, Homo sapiens
aggctgctgggccaggg

SEQ ID NO: 8464372 - DNA, 23 bp, Homo sapiens
aggctgcttactggtatcagagc

SEQ ID NO: 8464373 - DNA, 21 bp, Homo sapiens
aggctgctctttcttgtggta

SEQ ID NO: 8464374 - DNA, 21 bp, Homo sapiens
aggctgctctttcttgtggta

SEQ ID NO: 8464375 - DNA, 21 bp, Homo sapiens
aggctgctctttcttgtggta

SEQ ID NO: 8464376 - DNA, 22 bp, Homo sapiens
aggctgctgccttggagagtgt

SEQ ID NO: 8464377 - DNA, 22 bp, Homo sapiens
aggctctggcaacagctggtgt

SEQ ID NO: 8464378 - DNA, 22 bp, Homo sapiens
aggctgtgagaggtggctccca

SEQ ID NO: 8464379 - DNA, 22 bp, Homo sapiens
aggctgtgagaggtggctccca

SEQ ID NO: 8464380 - DNA, 22 bp, Homo sapiens
aggctgtgagaagtccttcagt

SEQ ID NO: 8464381 - DNA, 22 bp, Homo sapiens
aggctgtgagaagtccttcagt

SEQ ID NO: 8464382 - DNA, 19 bp, Homo sapiens
aggctgtgagggaggactc

SEQ ID NO: 8464383 - DNA, 22 bp, Homo sapiens
aggctgtgagttttgtctcaga

SEQ ID NO: 8464384 - DNA, 22 bp, Homo sapiens
aggctgtgagttttgtctcaga

SEQ ID NO: 8464385 - DNA, 22 bp, Homo sapiens
aggctgggaaatgtagtcttcc

SEQ ID NO: 8464386 - DNA, 22 bp, Homo sapiens
aggctgggaaatgtattccagc

SEQ ID NO: 8464387 - DNA, 22 bp, Homo sapiens
aggctggctttggtagcatggt

SEQ ID NO: 8464388 - DNA, 22 bp, Homo sapiens
aggctggctttggtagcatggt

SEQ ID NO: 8464389 - DNA, 22 bp, Homo sapiens
aggctggctttggtagcatggt

SEQ ID NO: 8464390 - DNA, 22 bp, Homo sapiens
accactgtctacacattgactc

SEQ ID NO: 8464391 - DNA, 22 bp, Homo sapiens
accactgggcgggcagcctgct

SEQ ID NO: 8464392 - DNA, 22 bp, Homo sapiens
accagaaaggaataatagaatt

SEQ ID NO: 8464393 - DNA, 22 bp, Homo sapiens
accagaaaggatgcctccttcc

SEQ ID NO: 8464394 - DNA, 22 bp, Homo sapiens
accagaaggaccagaggcaagg

SEQ ID NO: 8464395 - DNA, 22 bp, Homo sapiens
accactgcccatggtgaaaact

SEQ ID NO: 8464396 - DNA, 22 bp, Homo sapiens
aggctgtgatgagcctcatgga

SEQ ID NO: 8464397 - DNA, 22 bp, Homo sapiens
aggctgtgatgagcctcatgga

SEQ ID NO: 8464398 - DNA, 22 bp, Homo sapiens
accacaggacccatgagtcagt

SEQ ID NO: 8464399 - DNA, 22 bp, Homo sapiens
aggctctgacccatgggaccca

SEQ ID NO: 8464400 - DNA, 22 bp, Homo sapiens
aggctctggacagtgaggagtt

SEQ ID NO: 8464401 - DNA, 22 bp, Homo sapiens
aggctctggagttagccaggca

SEQ ID NO: 8464402 - DNA, 22 bp, Homo sapiens
aggctctggagtgtggtgctgg

SEQ ID NO: 8464403 - DNA, 22 bp, Homo sapiens
aggctctcagatcagccacatt

SEQ ID NO: 8464404 - DNA, 22 bp, Homo sapiens
aggctctccagagagctgcttt

SEQ ID NO: 8464405 - DNA, 22 bp, Homo sapiens
aggctctcactatcctcctagc

SEQ ID NO: 8464406 - DNA, 22 bp, Homo sapiens
aggctctcaatatgatccagtc

SEQ ID NO: 8464407 - DNA, 22 bp, Homo sapiens
aggctctcctccccaggaccat

SEQ ID NO: 8464408 - DNA, 22 bp, Homo sapiens
aggctctctctgccagccgtgc

SEQ ID NO: 8464409 - DNA, 22 bp, Homo sapiens
aggctctgaaggagaacctgtt

SEQ ID NO: 8464410 - DNA, 22 bp, Homo sapiens
acattaaatttcatagtgatta

SEQ ID NO: 8464411 - DNA, 22 bp, Homo sapiens
acattaaatttcatagtgatta

SEQ ID NO: 8464412 - DNA, 22 bp, Homo sapiens
acattaaagagtaaggttagtt

SEQ ID NO: 8464413 - DNA, 22 bp, Homo sapiens
aggctccagtctcctctggcag

SEQ ID NO: 8464414 - DNA, 22 bp, Homo sapiens
acattaaatttcatagtgatta

SEQ ID NO: 8464415 - DNA, 22 bp, Homo sapiens
acattaaaaaatgttgcatgaa

SEQ ID NO: 8464416 - DNA, 22 bp, Homo sapiens
acatgttttgtgccttgactag

SEQ ID NO: 8464417 - DNA, 22 bp, Homo sapiens
acattaaaaaatgttgcatgaa

SEQ ID NO: 8464418 - DNA, 22 bp, Homo sapiens
acattaaaatggagaattttga

SEQ ID NO: 8464419 - DNA, 22 bp, Homo sapiens
acattaaacttgcttggctgta

SEQ ID NO: 8464420 - DNA, 22 bp, Homo sapiens
acattaaaattgggtggggtaa

SEQ ID NO: 8464421 - DNA, 20 bp, Homo sapiens
aggctcagggtgtttaggaa

SEQ ID NO: 8464422 - DNA, 22 bp, Homo sapiens
aggctcaggtctcaggtctggc

SEQ ID NO: 8464423 - DNA, 22 bp, Homo sapiens
aggctcaggtctcaggtctggc

SEQ ID NO: 8464424 - DNA, 22 bp, Homo sapiens
aggctcaggtctcaggtctggc

SEQ ID NO: 8464425 - DNA, 22 bp, Homo sapiens
acatgtgggttttattttgcat

SEQ ID NO: 8464426 - DNA, 22 bp, Homo sapiens
acatgtgctcttgctgtacagc

SEQ ID NO: 8464427 - DNA, 22 bp, Homo sapiens
acatgtgcagacagcaagcagg

SEQ ID NO: 8464428 - DNA, 22 bp, Homo sapiens
acatgtgcagacagcaagcagg

SEQ ID NO: 8464429 - DNA, 23 bp, Homo sapiens
acatgtggagagaacagatatct

SEQ ID NO: 8464430 - DNA, 22 bp, Homo sapiens
acatgtgctcttgctgtacagc

SEQ ID NO: 8464431 - DNA, 22 bp, Homo sapiens
acatgtctcttctgaaagacaa

SEQ ID NO: 8464432 - DNA, 22 bp, Homo sapiens
acatgtgaggtgtgagtgatac

SEQ ID NO: 8464433 - DNA, 22 bp, Homo sapiens
aggctcaggaggagctgccgga

SEQ ID NO: 8464434 - DNA, 22 bp, Homo sapiens
aggctcagggacggggcccctt

SEQ ID NO: 8464435 - DNA, 20 bp, Homo sapiens
aggctcagctgagctcttgg

SEQ ID NO: 8464436 - DNA, 20 bp, Homo sapiens
aggctcagctgagctcttgg

SEQ ID NO: 8464437 - DNA, 22 bp, Homo sapiens
aggctcagctggtggtgatcgc

SEQ ID NO: 8464438 - DNA, 21 bp, Homo sapiens
acatgtaagagagtttcaaga

SEQ ID NO: 8464439 - DNA, 20 bp, Homo sapiens
acatgtacagacaggtttct

SEQ ID NO: 8464440 - DNA, 22 bp, Homo sapiens
acatgtatacaatgtgtaatga

SEQ ID NO: 8464441 - DNA, 22 bp, Homo sapiens
acatgtcaatttagtactctta

SEQ ID NO: 8464442 - DNA, 22 bp, Homo sapiens
acatgtctaagtactcaacaaa

SEQ ID NO: 8464443 - DNA, 22 bp, Homo sapiens
acatgtctaagtactcaacaaa

SEQ ID NO: 8464444 - DNA, 22 bp, Homo sapiens
acatgtctacacattctgcaat

SEQ ID NO: 8464445 - DNA, 22 bp, Homo sapiens
acatgtattgacattatattct

SEQ ID NO: 8464446 - DNA, 22 bp, Homo sapiens
acatgtaaaagataaattaaca

SEQ ID NO: 8464447 - DNA, 22 bp, Homo sapiens
acatggctcagtctcatgacag

SEQ ID NO: 8464448 - DNA, 22 bp, Homo sapiens
acatggctaaattagctttact

SEQ ID NO: 8464449 - DNA, 20 bp, Homo sapiens
acatggcattcccacgtggt

SEQ ID NO: 8464450 - DNA, 22 bp, Homo sapiens
acatgtaaaaggaacatgcatg

SEQ ID NO: 8464451 - DNA, 22 bp, Homo sapiens
acatgtaaacatttacagtatt

SEQ ID NO: 8464452 - DNA, 22 bp, Homo sapiens
acatgtaacatatatgtagcat

SEQ ID NO: 8464453 - DNA, 22 bp, Homo sapiens
acatgtaagactagcttaaagt

SEQ ID NO: 8464454 - DNA, 22 bp, Homo sapiens
acatgtaagactagcttaaagt

SEQ ID NO: 8464455 - DNA, 22 bp, Homo sapiens
acatctgattacatgagaatat

SEQ ID NO: 8464456 - DNA, 22 bp, Homo sapiens
acatctggaaagttacttgaga

SEQ ID NO: 8464457 - DNA, 22 bp, Homo sapiens
acatctgattacatgagaatat

SEQ ID NO: 8464458 - DNA, 22 bp, Homo sapiens
acatctgacatgatcttcagta

SEQ ID NO: 8464459 - DNA, 22 bp, Homo sapiens
acatctctccaaaggaaggtgc

SEQ ID NO: 8464460 - DNA, 22 bp, Homo sapiens
acatctctgggtcctccatgca

SEQ ID NO: 8464461 - DNA, 22 bp, Homo sapiens
acatctcttcttaaggctccag

SEQ ID NO: 8464462 - DNA, 22 bp, Homo sapiens
acatctcttataaactctctga

SEQ ID NO: 8464463 - DNA, 22 bp, Homo sapiens
acatatattactagtaaagaca

SEQ ID NO: 8464464 - DNA, 22 bp, Homo sapiens
acatatattactagtaaagaca

SEQ ID NO: 8464465 - DNA, 22 bp, Homo sapiens
acatatatgtaaagtactttgt

SEQ ID NO: 8464466 - DNA, 22 bp, Homo sapiens
acatctttatactagtccttga

SEQ ID NO: 8464467 - DNA, 22 bp, Homo sapiens
acatcttcactggtttctggaa

SEQ ID NO: 8464468 - DNA, 22 bp, Homo sapiens
acatcttcccacacttgcaaaa

SEQ ID NO: 8464469 - DNA, 22 bp, Homo sapiens
aggcagtggtgtttgctggtgg

SEQ ID NO: 8464470 - DNA, 22 bp, Homo sapiens
acatctgtcctctgcagagctc

SEQ ID NO: 8464471 - DNA, 22 bp, Homo sapiens
aggcagtgtattgctagcggct

SEQ ID NO: 8464472 - DNA, 20 bp, Homo sapiens
aggcagtgtagagatgagta

SEQ ID NO: 8464473 - DNA, 22 bp, Homo sapiens
aggcagtgtgtagctggaagag

SEQ ID NO: 8464474 - DNA, 22 bp, Homo sapiens
aggcagtgtgtagctggaagag

SEQ ID NO: 8464475 - DNA, 22 bp, Homo sapiens
aggcagtgtggagggctgttgc

SEQ ID NO: 8464476 - DNA, 22 bp, Homo sapiens
aggcagatgtgattaatttcct

SEQ ID NO: 8464477 - DNA, 22 bp, Homo sapiens
aggcagatatttcagttcacat

SEQ ID NO: 8464478 - DNA, 22 bp, Homo sapiens
aggcagagaaaaaccagatatg

SEQ ID NO: 8464479 - DNA, 22 bp, Homo sapiens
aggcagaaccagctgggacttt

SEQ ID NO: 8464480 - DNA, 21 bp, Homo sapiens
aggcagaaagagcccaggctg

SEQ ID NO: 8464481 - DNA, 22 bp, Homo sapiens
aggcagaagccagccagggtcc

SEQ ID NO: 8464482 - DNA, 22 bp, Homo sapiens
aggcagaagccagccagggtcc

SEQ ID NO: 8464483 - DNA, 22 bp, Homo sapiens
aggcagaatgttggaaaggaag

SEQ ID NO: 8464484 - DNA, 22 bp, Homo sapiens
aggcagacaaggacacagtggg

SEQ ID NO: 8464485 - DNA, 22 bp, Homo sapiens
aggcagacaagtccagaactgg

SEQ ID NO: 8464486 - DNA, 22 bp, Homo sapiens
aggcaggtgttaaccctctgag

SEQ ID NO: 8464487 - DNA, 22 bp, Homo sapiens
aggcaggtgttgggagacacca

SEQ ID NO: 8464488 - DNA, 22 bp, Homo sapiens
aggcagattttctttactcagt

SEQ ID NO: 8464489 - DNA, 22 bp, Homo sapiens
aggcagaaaatagtcatccaaa

SEQ ID NO: 8464490 - DNA, 22 bp, Homo sapiens
aggcactggtccattttctgca

SEQ ID NO: 8464491 - DNA, 22 bp, Homo sapiens
aggcaccttgcggtccagtgaa

SEQ ID NO: 8464492 - DNA, 22 bp, Homo sapiens
aggcacagcacacctggccccc

SEQ ID NO: 8464493 - DNA, 22 bp, Homo sapiens
aggcacagcacacctggccccc

SEQ ID NO: 8464494 - DNA, 22 bp, Homo sapiens
acagtggcctcaaagaaagaga

SEQ ID NO: 8464495 - DNA, 22 bp, Homo sapiens
acagtggcatctacttaatctg

SEQ ID NO: 8464496 - DNA, 22 bp, Homo sapiens
acagtggcagtcgtgttctcta

SEQ ID NO: 8464497 - DNA, 22 bp, Homo sapiens
acagtggcagtcgtgttctcta

SEQ ID NO: 8464498 - DNA, 22 bp, Homo sapiens
acagtggctcatgcctgtcatc

SEQ ID NO: 8464499 - DNA, 22 bp, Homo sapiens
acagtggctcatgcctgtcatc

SEQ ID NO: 8464500 - DNA, 22 bp, Homo sapiens
acagtggcttttgtgtctgcag

SEQ ID NO: 8464501 - DNA, 17 bp, Homo sapiens
aggcacctcttcctgct

SEQ ID NO: 8464502 - DNA, 17 bp, Homo sapiens
aggcacctcttcctgct

SEQ ID NO: 8464503 - DNA, 22 bp, Homo sapiens
acagtggcagtattagggcaga

SEQ ID NO: 8464504 - DNA, 22 bp, Homo sapiens
acagtggcagtattagggcaga

SEQ ID NO: 8464505 - DNA, 22 bp, Homo sapiens
acagtgcagggcgggaagaagg

SEQ ID NO: 8464506 - DNA, 22 bp, Homo sapiens
acagtgcagggcgggaagaagg

SEQ ID NO: 8464507 - DNA, 22 bp, Homo sapiens
acagtgcagggtgggaagaagg

SEQ ID NO: 8464508 - DNA, 22 bp, Homo sapiens
acagtgcagggtgggaagaagg

SEQ ID NO: 8464509 - DNA, 22 bp, Homo sapiens
acagtgctgtctatctcactaa

SEQ ID NO: 8464510 - DNA, 22 bp, Homo sapiens
aggaggccctagagctctagag

SEQ ID NO: 8464511 - DNA, 17 bp, Homo sapiens
aggaggccctggcgttt

SEQ ID NO: 8464512 - DNA, 22 bp, Homo sapiens
acagtgcttctgatatgatgcc

SEQ ID NO: 8464513 - DNA, 22 bp, Homo sapiens
acagtgcttttgttcctctcct

SEQ ID NO: 8464514 - DNA, 19 bp, Homo sapiens
acagtgcttctgagtgagg

SEQ ID NO: 8464515 - DNA, 22 bp, Homo sapiens
acagtgcttagcacagagtaga

SEQ ID NO: 8464516 - DNA, 22 bp, Homo sapiens
acagtgctgtgcagtctgccct

SEQ ID NO: 8464517 - DNA, 21 bp, Homo sapiens
aggaggccagtactgctgaac

SEQ ID NO: 8464518 - DNA, 22 bp, Homo sapiens
aggaggccattctctcagtagc

SEQ ID NO: 8464519 - DNA, 22 bp, Homo sapiens
aggaggcccctcctgggttgct

SEQ ID NO: 8464520 - DNA, 22 bp, Homo sapiens
aggaggcagtctgtcccttagc

SEQ ID NO: 8464521 - DNA, 20 bp, Homo sapiens
aggaggcatgaggggattta

SEQ ID NO: 8464522 - DNA, 22 bp, Homo sapiens
aggaggccaggccctcaagcct

SEQ ID NO: 8464523 - DNA, 22 bp, Homo sapiens
acagtgaaaataatatcttcaa

SEQ ID NO: 8464524 - DNA, 22 bp, Homo sapiens
acaggactctctgaaaatgtac

SEQ ID NO: 8464525 - DNA, 22 bp, Homo sapiens
acaggactgtggaaggatctct

SEQ ID NO: 8464526 - DNA, 22 bp, Homo sapiens
acaggactgtgatccagtaacc

SEQ ID NO: 8464527 - DNA, 22 bp, Homo sapiens
acaggactagatgataaaatgt

SEQ ID NO: 8464528 - DNA, 22 bp, Homo sapiens
acaggactgtgatccagtaacc

SEQ ID NO: 8464529 - DNA, 22 bp, Homo sapiens
acaggacagggaattcgaaatt

SEQ ID NO: 8464530 - DNA, 22 bp, Homo sapiens
acaggacagtctagtaacagta

SEQ ID NO: 8464531 - DNA, 22 bp, Homo sapiens
acaggacatggcttctgtgacg

SEQ ID NO: 8464532 - DNA, 22 bp, Homo sapiens
agcttcttgaccaagcctgtaa

SEQ ID NO: 8464533 - DNA, 21 bp, Homo sapiens
agcttccagagcacattccat

SEQ ID NO: 8464534 - DNA, 22 bp, Homo sapiens
agcttccacatctgtcttcagt

SEQ ID NO: 8464535 - DNA, 22 bp, Homo sapiens
acaggagaaatctggtcaaaag

SEQ ID NO: 8464536 - DNA, 22 bp, Homo sapiens
acaggagaaatctggtcaaaag

SEQ ID NO: 8464537 - DNA, 22 bp, Homo sapiens
acaggcaacttcaaatctcact

SEQ ID NO: 8464538 - DNA, 22 bp, Homo sapiens
acaggcaagaggaaagcaagta

SEQ ID NO: 8464539 - DNA, 22 bp, Homo sapiens
acaggcaacttcaaatctcact

SEQ ID NO: 8464540 - DNA, 22 bp, Homo sapiens
aggaaagaagtacattctcatg

SEQ ID NO: 8464541 - DNA, 18 bp, Homo sapiens
aggaaagaaaggcaggtg

SEQ ID NO: 8464542 - DNA, 18 bp, Homo sapiens
aggaaagaaaggcaggtg

SEQ ID NO: 8464543 - DNA, 22 bp, Homo sapiens
acaggcaattagcaagctgtta

SEQ ID NO: 8464544 - DNA, 22 bp, Homo sapiens
acaggatggagataatagaaaa

SEQ ID NO: 8464545 - DNA, 20 bp, Homo sapiens
acaggatgcctgccatttca

SEQ ID NO: 8464546 - DNA, 21 bp, Homo sapiens
acaggatgatttttccttatg

SEQ ID NO: 8464547 - DNA, 22 bp, Homo sapiens
acaggatgataaaggatggcca

SEQ ID NO: 8464548 - DNA, 22 bp, Homo sapiens
agcttctttaattcagcatgat

SEQ ID NO: 8464549 - DNA, 22 bp, Homo sapiens
agcttcttgtagaactcaaaag

SEQ ID NO: 8464550 - DNA, 22 bp, Homo sapiens
acagcattgctccatctcaaga

SEQ ID NO: 8464551 - DNA, 22 bp, Homo sapiens
acagcattgctccatctcaaga

SEQ ID NO: 8464552 - DNA, 22 bp, Homo sapiens
acagcatttaaagaaaatgaac

SEQ ID NO: 8464553 - DNA, 22 bp, Homo sapiens
acagcattcaataaataataac

SEQ ID NO: 8464554 - DNA, 22 bp, Homo sapiens
acagcattccctttggctgctt

SEQ ID NO: 8464555 - DNA, 22 bp, Homo sapiens
acagccagaggagccaggctgg

SEQ ID NO: 8464556 - DNA, 22 bp, Homo sapiens
acagccaaggaattaggaaggg

SEQ ID NO: 8464557 - DNA, 22 bp, Homo sapiens
acagccaacgtctttcttactt

SEQ ID NO: 8464558 - DNA, 22 bp, Homo sapiens
acagccaagtcttctatttcag

SEQ ID NO: 8464559 - DNA, 22 bp, Homo sapiens
acagccagaagtcagggtggga

SEQ ID NO: 8464560 - DNA, 22 bp, Homo sapiens
acagccagaagtcagggtggga

SEQ ID NO: 8464561 - DNA, 22 bp, Homo sapiens
acagccactcaaagggccgaag

SEQ ID NO: 8464562 - DNA, 22 bp, Homo sapiens
acagcatcatatagtggaagaa

SEQ ID NO: 8464563 - DNA, 22 bp, Homo sapiens
acagcatctagtacagtctagt

SEQ ID NO: 8464564 - DNA, 20 bp, Homo sapiens
acagccagaggaggcagaca

SEQ ID NO: 8464565 - DNA, 22 bp, Homo sapiens
acaggaacgaatgtacattgtt

SEQ ID NO: 8464566 - DNA, 22 bp, Homo sapiens
acaggaagaaagtgcagtagat

SEQ ID NO: 8464567 - DNA, 22 bp, Homo sapiens
acaggaagtgggaagaaacagg

SEQ ID NO: 8464568 - DNA, 22 bp, Homo sapiens
acaggaagtgctggcacttaca

SEQ ID NO: 8464569 - DNA, 22 bp, Homo sapiens
acaggaagtgctggcacttaca

SEQ ID NO: 8464570 - DNA, 22 bp, Homo sapiens
acaggaagctggagacccttga

SEQ ID NO: 8464571 - DNA, 22 bp, Homo sapiens
acaggacaaggggaagaagata

SEQ ID NO: 8464572 - DNA, 22 bp, Homo sapiens
acaggacaggctgggctagact

SEQ ID NO: 8464573 - DNA, 22 bp, Homo sapiens
acaggaagtttggaaagcctca

SEQ ID NO: 8464574 - DNA, 22 bp, Homo sapiens
acaggacaaaaatctggatggc

SEQ ID NO: 8464575 - DNA, 18 bp, Homo sapiens
acaggctattgcaggaga

SEQ ID NO: 8464576 - DNA, 22 bp, Homo sapiens
acaggccttggtcctgacctaa

SEQ ID NO: 8464577 - DNA, 22 bp, Homo sapiens
acaggccttaggagagatgggg

SEQ ID NO: 8464578 - DNA, 22 bp, Homo sapiens
acaggcctggtgctgctgacag

SEQ ID NO: 8464579 - DNA, 22 bp, Homo sapiens
aggaaataagggacaagacaaa

SEQ ID NO: 8464580 - DNA, 23 bp, Homo sapiens
acagggcattgctggcctcgagg

SEQ ID NO: 8464581 - DNA, 22 bp, Homo sapiens
acagggcatgtgcaagagacat

SEQ ID NO: 8464582 - DNA, 22 bp, Homo sapiens
acagggcagtgtcttgaaaaat

SEQ ID NO: 8464583 - DNA, 22 bp, Homo sapiens
acaggctctctattgagtgcag

SEQ ID NO: 8464584 - DNA, 22 bp, Homo sapiens
acaggctctcagccagttggca

SEQ ID NO: 8464585 - DNA, 22 bp, Homo sapiens
acaggctcacagtcatttcatt

SEQ ID NO: 8464586 - DNA, 21 bp, Homo sapiens
acaggctcacgatccatttct

SEQ ID NO: 8464587 - DNA, 22 bp, Homo sapiens
acaggctcgtgcgcgcacgtgt

SEQ ID NO: 8464588 - DNA, 22 bp, Homo sapiens
acaggctcagttcactggattt

SEQ ID NO: 8464589 - DNA, 21 bp, Homo sapiens
acaggctacatgcaggagctg

SEQ ID NO: 8464590 - DNA, 22 bp, Homo sapiens
acagggcagtgtcttgaaaaat

SEQ ID NO: 8464591 - DNA, 21 bp, Homo sapiens
acaggctctggggatgctggg

SEQ ID NO: 8464592 - DNA, 19 bp, Homo sapiens
acagggcagcaataggata

SEQ ID NO: 8464593 - DNA, 22 bp, Homo sapiens
aggacagtggcaaggcaggaca

SEQ ID NO: 8464594 - DNA, 22 bp, Homo sapiens
aggacagttagttaggaagttt

SEQ ID NO: 8464595 - DNA, 23 bp, Homo sapiens
aggacagtggaatttagggattg

SEQ ID NO: 8464596 - DNA, 22 bp, Homo sapiens
aggacaggtgtagtgggctctg

SEQ ID NO: 8464597 - DNA, 22 bp, Homo sapiens
aggacagtataggctttaggag

SEQ ID NO: 8464598 - DNA, 22 bp, Homo sapiens
aggacaggtgtagtgggctctg

SEQ ID NO: 8464599 - DNA, 22 bp, Homo sapiens
aggacaggtgtagtgggctctg

SEQ ID NO: 8464600 - DNA, 22 bp, Homo sapiens
aggactggcagtgtgaggggtc

SEQ ID NO: 8464601 - DNA, 23 bp, Homo sapiens
aggactgctcacttgaggcttcc

SEQ ID NO: 8464602 - DNA, 22 bp, Homo sapiens
aggacacaggtaagccagtgga

SEQ ID NO: 8464603 - DNA, 22 bp, Homo sapiens
aggacacaggtaagccagtgga

SEQ ID NO: 8464604 - DNA, 22 bp, Homo sapiens
aggacacagtggtggggaaaag

SEQ ID NO: 8464605 - DNA, 22 bp, Homo sapiens
acagggccttatatccagaagg

SEQ ID NO: 8464606 - DNA, 22 bp, Homo sapiens
acagggcctcagccagggcaga

SEQ ID NO: 8464607 - DNA, 22 bp, Homo sapiens
acagggccattggaggattata

SEQ ID NO: 8464608 - DNA, 22 bp, Homo sapiens
cagggctggctcatgaaaagtt

SEQ ID NO: 8464609 - DNA, 22 bp, Homo sapiens
cagggctggatttcatttctag

SEQ ID NO: 8464610 - DNA, 22 bp, Homo sapiens
cagggctggctgtggcaatctc

SEQ ID NO: 8464611 - DNA, 22 bp, Homo sapiens
cagggctggctgtggcaatctc

SEQ ID NO: 8464612 - DNA, 22 bp, Homo sapiens
cagggctggctgtggcaatctc

SEQ ID NO: 8464613 - DNA, 22 bp, Homo sapiens
agctttgggcagaagaggattc

SEQ ID NO: 8464614 - DNA, 22 bp, Homo sapiens
agctttgaagtatttggtctcc

SEQ ID NO: 8464615 - DNA, 22 bp, Homo sapiens
agctttggagctgggtgaaaga

SEQ ID NO: 8464616 - DNA, 22 bp, Homo sapiens
agctttgcagctgtgggaggag

SEQ ID NO: 8464617 - DNA, 22 bp, Homo sapiens
cagggatgtgatgagctgagcc

SEQ ID NO: 8464618 - DNA, 22 bp, Homo sapiens
caggctgagctctggcctgggc

SEQ ID NO: 8464619 - DNA, 22 bp, Homo sapiens
caggctgagctctggcctgggc

SEQ ID NO: 8464620 - DNA, 22 bp, Homo sapiens
cagggatgtgatgagctgagcc

SEQ ID NO: 8464621 - DNA, 22 bp, Homo sapiens
cagggatgtgatgagctgagcc

SEQ ID NO: 8464622 - DNA, 22 bp, Homo sapiens
caggctcttttggtggcaagga

SEQ ID NO: 8464623 - DNA, 22 bp, Homo sapiens
caggctgaagtgcagtggtgtg

SEQ ID NO: 8464624 - DNA, 22 bp, Homo sapiens
caggctgacaactgagcatttt

SEQ ID NO: 8464625 - DNA, 22 bp, Homo sapiens
caggctgacaactgagcatttt

SEQ ID NO: 8464626 - DNA, 22 bp, Homo sapiens
caggctgaagtgcagtggtgtg

SEQ ID NO: 8464627 - DNA, 23 bp, Homo sapiens
cagggctgggcttggtgttaggc

SEQ ID NO: 8464628 - DNA, 23 bp, Homo sapiens
cagggctgggcttggtgttaggc

SEQ ID NO: 8464629 - DNA, 22 bp, Homo sapiens
cagggctggcttccaagttgtt

SEQ ID NO: 8464630 - DNA, 22 bp, Homo sapiens
cagggctggcttccaagttgtt

SEQ ID NO: 8464631 - DNA, 22 bp, Homo sapiens
cagggctggcttccaagttgtt

SEQ ID NO: 8464632 - DNA, 22 bp, Homo sapiens
aggaaaggattggcttctctgt

SEQ ID NO: 8464633 - DNA, 22 bp, Homo sapiens
cagggctgggttaaaagcaggg

SEQ ID NO: 8464634 - DNA, 21 bp, Homo sapiens
aggaaaggccagcacgtaggg

SEQ ID NO: 8464635 - DNA, 22 bp, Homo sapiens
aggaaaggcctcagcagaaacc

SEQ ID NO: 8464636 - DNA, 22 bp, Homo sapiens
aggaagaaacctactagagttt

SEQ ID NO: 8464637 - DNA, 22 bp, Homo sapiens
aggaagaaaactaattagatgg

SEQ ID NO: 8464638 - DNA, 22 bp, Homo sapiens
cagggctgttagctgctgctct

SEQ ID NO: 8464639 - DNA, 22 bp, Homo sapiens
cagggctgttagctgctgctct

SEQ ID NO: 8464640 - DNA, 22 bp, Homo sapiens
cagggctgttagctgctgctct

SEQ ID NO: 8464641 - DNA, 18 bp, Homo sapiens
cagggctgtggggtcact

SEQ ID NO: 8464642 - DNA, 18 bp, Homo sapiens
cagggctgtggggtcact

SEQ ID NO: 8464643 - DNA, 23 bp, Homo sapiens
aggaagaggcaatttctcttaga

SEQ ID NO: 8464644 - DNA, 22 bp, Homo sapiens
aggaagagctggaccagaggac

SEQ ID NO: 8464645 - DNA, 22 bp, Homo sapiens
aggaagagctggaccagaggac

SEQ ID NO: 8464646 - DNA, 22 bp, Homo sapiens
aggaagagctggaccagaggac

SEQ ID NO: 8464647 - DNA, 22 bp, Homo sapiens
aggaagagctggaccagaggac

SEQ ID NO: 8464648 - DNA, 22 bp, Homo sapiens
aggaagagctggaccagaggac

SEQ ID NO: 8464649 - DNA, 22 bp, Homo sapiens
aggaagagcccgggtgacataa

SEQ ID NO: 8464650 - DNA, 22 bp, Homo sapiens
aggaagagcccgggtgacataa

SEQ ID NO: 8464651 - DNA, 22 bp, Homo sapiens
aggaagagcccgggtgacataa

SEQ ID NO: 8464652 - DNA, 22 bp, Homo sapiens
cagtaacagtgatcacctgtgg

SEQ ID NO: 8464653 - DNA, 22 bp, Homo sapiens
cagtaacagtgatcacctgtgg

SEQ ID NO: 8464654 - DNA, 22 bp, Homo sapiens
cagtaacatgaagagacatgga

SEQ ID NO: 8464655 - DNA, 22 bp, Homo sapiens
cagtaaaggttttatggggctt

SEQ ID NO: 8464656 - DNA, 22 bp, Homo sapiens
cagtaaacagttactaagaaga

SEQ ID NO: 8464657 - DNA, 22 bp, Homo sapiens
cagtaaagagccttcattaaat

SEQ ID NO: 8464658 - DNA, 22 bp, Homo sapiens
cagtaaagcatgtatgtcttca

SEQ ID NO: 8464659 - DNA, 22 bp, Homo sapiens
cagtaaacactagcattcttgg

SEQ ID NO: 8464660 - DNA, 23 bp, Homo sapiens
aggacagcaaaccccgcctcccc

SEQ ID NO: 8464661 - DNA, 22 bp, Homo sapiens
aggacagagggaccagagccca

SEQ ID NO: 8464662 - DNA, 22 bp, Homo sapiens
aggacagagggaccagagccca

SEQ ID NO: 8464663 - DNA, 21 bp, Homo sapiens
aggacagatgtaggaataaag

SEQ ID NO: 8464664 - DNA, 22 bp, Homo sapiens
cagtaagtattcgagtctccat

SEQ ID NO: 8464665 - DNA, 22 bp, Homo sapiens
cagtatcttgcttatagacaca

SEQ ID NO: 8464666 - DNA, 22 bp, Homo sapiens
cagtatgtactcttatcatgta

SEQ ID NO: 8464667 - DNA, 22 bp, Homo sapiens
cagtatgttcttccaggacaga

SEQ ID NO: 8464668 - DNA, 22 bp, Homo sapiens
aggaatctgggcccaactgtgc

SEQ ID NO: 8464669 - DNA, 22 bp, Homo sapiens
aggaatctgtggttttaacagg

SEQ ID NO: 8464670 - DNA, 22 bp, Homo sapiens
aggacaagctaaaggacttcct

SEQ ID NO: 8464671 - DNA, 23 bp, Homo sapiens
aggaagttaaggcagacagacag

SEQ ID NO: 8464672 - DNA, 22 bp, Homo sapiens
aggacacatgcacaccctgcgt

SEQ ID NO: 8464673 - DNA, 18 bp, Homo sapiens
aggacacattcttccctc

SEQ ID NO: 8464674 - DNA, 22 bp, Homo sapiens
aggacagaatctatattcagtt

SEQ ID NO: 8464675 - DNA, 22 bp, Homo sapiens
aggacagagccctagtttcata

SEQ ID NO: 8464676 - DNA, 22 bp, Homo sapiens
aggacagacctaggactggagc

SEQ ID NO: 8464677 - DNA, 22 bp, Homo sapiens
aggacagagcctgtgcagaccg

SEQ ID NO: 8464678 - DNA, 21 bp, Homo sapiens
aggaagtggccagattgggaa

SEQ ID NO: 8464679 - DNA, 22 bp, Homo sapiens
aggaagtgcagggggaagtact

SEQ ID NO: 8464680 - DNA, 22 bp, Homo sapiens
cagctgtgtatgagagcatgct

SEQ ID NO: 8464681 - DNA, 22 bp, Homo sapiens
cagctgttaccaatcttagggc

SEQ ID NO: 8464682 - DNA, 22 bp, Homo sapiens
cagctgtgtatgagagcatgct

SEQ ID NO: 8464683 - DNA, 22 bp, Homo sapiens
cagctggtactcagttcttgtc

SEQ ID NO: 8464684 - DNA, 22 bp, Homo sapiens
cagctggttttagcacagttag

SEQ ID NO: 8464685 - DNA, 22 bp, Homo sapiens
cagctggttggaagggagctga

SEQ ID NO: 8464686 - DNA, 22 bp, Homo sapiens
cagctggttgaagaggagctgg

SEQ ID NO: 8464687 - DNA, 22 bp, Homo sapiens
cagctggtaggtagcagatttg

SEQ ID NO: 8464688 - DNA, 22 bp, Homo sapiens
cagctggtgtccagggaagtgg

SEQ ID NO: 8464689 - DNA, 22 bp, Homo sapiens
cagctggttatcagagaggcct

SEQ ID NO: 8464690 - DNA, 22 bp, Homo sapiens
cagctggttatcagagaggcct

SEQ ID NO: 8464691 - DNA, 22 bp, Homo sapiens
cagctggttatcagagaggcct

SEQ ID NO: 8464692 - DNA, 22 bp, Homo sapiens
caggactgatgttcctccagcc

SEQ ID NO: 8464693 - DNA, 22 bp, Homo sapiens
caggactgatgttcctccagcc

SEQ ID NO: 8464694 - DNA, 22 bp, Homo sapiens
caggactgaagggcacagggaa

SEQ ID NO: 8464695 - DNA, 22 bp, Homo sapiens
caggactggctcgcagtgggtg

SEQ ID NO: 8464696 - DNA, 22 bp, Homo sapiens
caggactggaagtctcaagaga

SEQ ID NO: 8464697 - DNA, 22 bp, Homo sapiens
caggagcaaggagcagtgggat

SEQ ID NO: 8464698 - DNA, 22 bp, Homo sapiens
caggagaaggtttggagtgcag

SEQ ID NO: 8464699 - DNA, 22 bp, Homo sapiens
caggactcttgtcatcatcagt

SEQ ID NO: 8464700 - DNA, 22 bp, Homo sapiens
caggactcacttctcacatccc

SEQ ID NO: 8464701 - DNA, 22 bp, Homo sapiens
caggactcacttctcacatccc

SEQ ID NO: 8464702 - DNA, 22 bp, Homo sapiens
caggacctggaatgcttgtgaa

SEQ ID NO: 8464703 - DNA, 22 bp, Homo sapiens
cagctgttgtcacctcacatcc

SEQ ID NO: 8464704 - DNA, 22 bp, Homo sapiens
cagctgttcggggctggcatgt

SEQ ID NO: 8464705 - DNA, 22 bp, Homo sapiens
caggatggccccggggctgtgc

SEQ ID NO: 8464706 - DNA, 22 bp, Homo sapiens
caggcacacagcacatggcctg

SEQ ID NO: 8464707 - DNA, 22 bp, Homo sapiens
caggatggtcagatgcattgtc

SEQ ID NO: 8464708 - DNA, 22 bp, Homo sapiens
caggcacaatgagcgccatctt

SEQ ID NO: 8464709 - DNA, 22 bp, Homo sapiens
caggatgggtgtcggccagcac

SEQ ID NO: 8464710 - DNA, 22 bp, Homo sapiens
caggatgggtgtcggccagcac

SEQ ID NO: 8464711 - DNA, 22 bp, Homo sapiens
caggcacacaggctccctgggc

SEQ ID NO: 8464712 - DNA, 22 bp, Homo sapiens
caggcacacatccgtgagagat

SEQ ID NO: 8464713 - DNA, 22 bp, Homo sapiens
caggcacacatccgtgagagat

SEQ ID NO: 8464714 - DNA, 22 bp, Homo sapiens
caggcagagttagagcaactgg

SEQ ID NO: 8464715 - DNA, 22 bp, Homo sapiens
caggagcccagagtcctcagct

SEQ ID NO: 8464716 - DNA, 22 bp, Homo sapiens
caggatggagagtgaggggtca

SEQ ID NO: 8464717 - DNA, 22 bp, Homo sapiens
caggatggcagagaaaagggtg

SEQ ID NO: 8464718 - DNA, 22 bp, Homo sapiens
caggatggcagagaaaagggtg

SEQ ID NO: 8464719 - DNA, 22 bp, Homo sapiens
caggatggagggagggctgtta

SEQ ID NO: 8464720 - DNA, 22 bp, Homo sapiens
caggagcagagggtggtcagca

SEQ ID NO: 8464721 - DNA, 22 bp, Homo sapiens
caggagcaaggagcagtgggat

SEQ ID NO: 8464722 - DNA, 22 bp, Homo sapiens
caggagccacattccaccttga

SEQ ID NO: 8464723 - DNA, 22 bp, Homo sapiens
caggagccagaggcggatggag

SEQ ID NO: 8464724 - DNA, 22 bp, Homo sapiens
caggagcatgctgatgccagaa

SEQ ID NO: 8464725 - DNA, 22 bp, Homo sapiens
caggagcatgctgatgccagaa

SEQ ID NO: 8464726 - DNA, 22 bp, Homo sapiens
agctgtctttctgcctcctgat

SEQ ID NO: 8464727 - DNA, 22 bp, Homo sapiens
agctgtctttctgcctcctgat

SEQ ID NO: 8464728 - DNA, 22 bp, Homo sapiens
agctgtctgtgaacacagcatt

SEQ ID NO: 8464729 - DNA, 22 bp, Homo sapiens
agctgtctgtctcctgaggaga

SEQ ID NO: 8464730 - DNA, 22 bp, Homo sapiens
caggcccagtgatcagggctct

SEQ ID NO: 8464731 - DNA, 22 bp, Homo sapiens
caggcccagtgatcagggctct

SEQ ID NO: 8464732 - DNA, 22 bp, Homo sapiens
caggcccatctgctcccaggct

SEQ ID NO: 8464733 - DNA, 22 bp, Homo sapiens
caggcccatgagggcagccaca

SEQ ID NO: 8464734 - DNA, 22 bp, Homo sapiens
caggcccatgagggcagccaca

SEQ ID NO: 8464735 - DNA, 22 bp, Homo sapiens
caggcccattctaggcttgcta

SEQ ID NO: 8464736 - DNA, 22 bp, Homo sapiens
caggcccattctaggcttgcta

SEQ ID NO: 8464737 - DNA, 22 bp, Homo sapiens
agcttagaagtgtgctgagagg

SEQ ID NO: 8464738 - DNA, 22 bp, Homo sapiens
agcttactgtaattaaaagact

SEQ ID NO: 8464739 - DNA, 22 bp, Homo sapiens
agcttagaatgtgttaggaaag

SEQ ID NO: 8464740 - DNA, 21 bp, Homo sapiens
caggctctgctagaggagcct

SEQ ID NO: 8464741 - DNA, 22 bp, Homo sapiens
agcttctcagcttcagaactgt

SEQ ID NO: 8464742 - DNA, 22 bp, Homo sapiens
agcttctcagcttcagaactgt

SEQ ID NO: 8464743 - DNA, 22 bp, Homo sapiens
agcttctcagatggactgttag

SEQ ID NO: 8464744 - DNA, 22 bp, Homo sapiens
agcttctcaagtgtttgcgggg

SEQ ID NO: 8464745 - DNA, 22 bp, Homo sapiens
agcttctcagaagagtcctgta

SEQ ID NO: 8464746 - DNA, 22 bp, Homo sapiens
agcttctcagaagagtcctgta

SEQ ID NO: 8464747 - DNA, 22 bp, Homo sapiens
caggctcttccatcctgctgag

SEQ ID NO: 8464748 - DNA, 22 bp, Homo sapiens
caggctcttccatcctgctgag

SEQ ID NO: 8464749 - DNA, 21 bp, Homo sapiens
caggctctgctgggtgctggg

SEQ ID NO: 8464750 - DNA, 22 bp, Homo sapiens
caggctctgctgctacagctgt

SEQ ID NO: 8464751 - DNA, 22 bp, Homo sapiens
agcttccttggcgctgaggcct

SEQ ID NO: 8464752 - DNA, 22 bp, Homo sapiens
agcttccttggcgctgaggcct

SEQ ID NO: 8464753 - DNA, 22 bp, Homo sapiens
agcttccttgaattctgtagaa

SEQ ID NO: 8464754 - DNA, 22 bp, Homo sapiens
agcttcctgtcttctgcacaaa

SEQ ID NO: 8464755 - DNA, 23 bp, Homo sapiens
agcttcctagtgacctggagtct

SEQ ID NO: 8464756 - DNA, 23 bp, Homo sapiens
agcttcctagtgacctggagtct

SEQ ID NO: 8464757 - DNA, 22 bp, Homo sapiens
agcttcctgactggtgctctta

SEQ ID NO: 8464758 - DNA, 22 bp, Homo sapiens
agcttcccaggagaatcaggga

SEQ ID NO: 8464759 - DNA, 22 bp, Homo sapiens
agcttcccggcaggcacgtcct

SEQ ID NO: 8464760 - DNA, 18 bp, Homo sapiens
agcttccctctgagaggg

SEQ ID NO: 8464761 - DNA, 22 bp, Homo sapiens
caggcagctcgatgccttgttg

SEQ ID NO: 8464762 - DNA, 22 bp, Homo sapiens
caggcagggagctggaaaggat

SEQ ID NO: 8464763 - DNA, 22 bp, Homo sapiens
caggcagctcaaccttgggagc

SEQ ID NO: 8464764 - DNA, 22 bp, Homo sapiens
caggcagctcaaccttgggagc

SEQ ID NO: 8464765 - DNA, 22 bp, Homo sapiens
caggcagggagctggaaaggat

SEQ ID NO: 8464766 - DNA, 22 bp, Homo sapiens
caggcagcgctcgtggcctggc

SEQ ID NO: 8464767 - DNA, 22 bp, Homo sapiens
caggcagcgctcgtggcctggc

SEQ ID NO: 8464768 - DNA, 22 bp, Homo sapiens
caggcagcgctcgtggcctggc

SEQ ID NO: 8464769 - DNA, 22 bp, Homo sapiens
caggcagcgtcctgcttcctgt

SEQ ID NO: 8464770 - DNA, 22 bp, Homo sapiens
caggcagcgtcctgcttcctgt

SEQ ID NO: 8464771 - DNA, 22 bp, Homo sapiens
agctggtggaagggagcccaaa

SEQ ID NO: 8464772 - DNA, 22 bp, Homo sapiens
agctggttcatggactgcctgg

SEQ ID NO: 8464773 - DNA, 22 bp, Homo sapiens
caggcagtgtcccaggaagcca

SEQ ID NO: 8464774 - DNA, 22 bp, Homo sapiens
caggcagtgtgacgctagggtt

SEQ ID NO: 8464775 - DNA, 22 bp, Homo sapiens
caggcaggtgcagattcctctt

SEQ ID NO: 8464776 - DNA, 22 bp, Homo sapiens
caggcaggtgcagattcctctt

SEQ ID NO: 8464777 - DNA, 22 bp, Homo sapiens
caggcaggtcagtgaagaagga

SEQ ID NO: 8464778 - DNA, 22 bp, Homo sapiens
agctgtctctctggtgtccata

SEQ ID NO: 8464779 - DNA, 22 bp, Homo sapiens
agctggtttaggaaaaggtagg

SEQ ID NO: 8464780 - DNA, 22 bp, Homo sapiens
agctgtatttgtgaatatttaa

SEQ ID NO: 8464781 - DNA, 22 bp, Homo sapiens
agctgtatgcccaagatgctat

SEQ ID NO: 8464782 - DNA, 22 bp, Homo sapiens
agctgtatgcccaagatgctat

SEQ ID NO: 8464783 - DNA, 22 bp, Homo sapiens
agctggttgtcattcagaattg

SEQ ID NO: 8464784 - DNA, 20 bp, Homo sapiens
catacactattctgtatagt

SEQ ID NO: 8464785 - DNA, 22 bp, Homo sapiens
catacaatcaagttctttatta

SEQ ID NO: 8464786 - DNA, 22 bp, Homo sapiens
aggaggcctgtgtttgtctgta

SEQ ID NO: 8464787 - DNA, 22 bp, Homo sapiens
aggaggcctgcagctgccattc

SEQ ID NO: 8464788 - DNA, 22 bp, Homo sapiens
aggaggctgcaaccctgaggcc

SEQ ID NO: 8464789 - DNA, 21 bp, Homo sapiens
catcttaggttgtacatatat

SEQ ID NO: 8464790 - DNA, 22 bp, Homo sapiens
catctcttcattagcattattg

SEQ ID NO: 8464791 - DNA, 22 bp, Homo sapiens
catctcttcattagcattattg

SEQ ID NO: 8464792 - DNA, 22 bp, Homo sapiens
catcttattttcttctagtgct

SEQ ID NO: 8464793 - DNA, 22 bp, Homo sapiens
catctctgtgtccccacaccca

SEQ ID NO: 8464794 - DNA, 22 bp, Homo sapiens
catctctgtgtccccagagctt

SEQ ID NO: 8464795 - DNA, 22 bp, Homo sapiens
catctctgtgtccccagagctt

SEQ ID NO: 8464796 - DNA, 22 bp, Homo sapiens
catctctggcttggattatggt

SEQ ID NO: 8464797 - DNA, 22 bp, Homo sapiens
catctctggttcagtctctgtg

SEQ ID NO: 8464798 - DNA, 22 bp, Homo sapiens
catctctgagacctcagctggg

SEQ ID NO: 8464799 - DNA, 22 bp, Homo sapiens
catctctgagacctcagctggg

SEQ ID NO: 8464800 - DNA, 19 bp, Homo sapiens
catctctgcaaggagctgc

SEQ ID NO: 8464801 - DNA, 22 bp, Homo sapiens
catctctccacggcagctctcg

SEQ ID NO: 8464802 - DNA, 22 bp, Homo sapiens
catccaaagcaaatatcttaaa

SEQ ID NO: 8464803 - DNA, 22 bp, Homo sapiens
catccaaactctcattatctgt

SEQ ID NO: 8464804 - DNA, 22 bp, Homo sapiens
catccaaactctcattatctgt

SEQ ID NO: 8464805 - DNA, 22 bp, Homo sapiens
catacatatgtggatgtcatat

SEQ ID NO: 8464806 - DNA, 22 bp, Homo sapiens
catacatatgtggatgtcatat

SEQ ID NO: 8464807 - DNA, 22 bp, Homo sapiens
catctcatcagtgagagtcagc

SEQ ID NO: 8464808 - DNA, 22 bp, Homo sapiens
catctcagtgtacagggagtct

SEQ ID NO: 8464809 - DNA, 22 bp, Homo sapiens
catccaaagcaaatatcttaaa

SEQ ID NO: 8464810 - DNA, 22 bp, Homo sapiens
catctcctggcagctgttagga

SEQ ID NO: 8464811 - DNA, 20 bp, Homo sapiens
catctcctgcctccatgttc

SEQ ID NO: 8464812 - DNA, 20 bp, Homo sapiens
catctcctgcctccatgttc

SEQ ID NO: 8464813 - DNA, 22 bp, Homo sapiens
catctcatgggcatgccaagct

SEQ ID NO: 8464814 - DNA, 22 bp, Homo sapiens
catctcatttattccaactcag

SEQ ID NO: 8464815 - DNA, 22 bp, Homo sapiens
catctccaggtttagggagcac

SEQ ID NO: 8464816 - DNA, 22 bp, Homo sapiens
catgagatctgcagggatgggc

SEQ ID NO: 8464817 - DNA, 22 bp, Homo sapiens
aggatgtgggttttcacattgt

SEQ ID NO: 8464818 - DNA, 22 bp, Homo sapiens
catgagaatgaagaagacttaa

SEQ ID NO: 8464819 - DNA, 22 bp, Homo sapiens
catgagcattttggtctagttt

SEQ ID NO: 8464820 - DNA, 22 bp, Homo sapiens
catgagctgctgggagcctgtc

SEQ ID NO: 8464821 - DNA, 22 bp, Homo sapiens
catgaggatccaggtgacaggc

SEQ ID NO: 8464822 - DNA, 22 bp, Homo sapiens
catgagatttgggaggggccag

SEQ ID NO: 8464823 - DNA, 23 bp, Homo sapiens
aggatgtaggatgtatggcagag

SEQ ID NO: 8464824 - DNA, 23 bp, Homo sapiens
aggatgtaggatgtatggcagag

SEQ ID NO: 8464825 - DNA, 22 bp, Homo sapiens
aggatgagaagattggaatctt

SEQ ID NO: 8464826 - DNA, 22 bp, Homo sapiens
catcttgaaggtttctttagct

SEQ ID NO: 8464827 - DNA, 22 bp, Homo sapiens
catcttctgggacttctcagtt

SEQ ID NO: 8464828 - DNA, 22 bp, Homo sapiens
catcttctgggacttctcagtt

SEQ ID NO: 8464829 - DNA, 22 bp, Homo sapiens
catcttgtgaatttctgattct

SEQ ID NO: 8464830 - DNA, 22 bp, Homo sapiens
catcttgtgaggaccttcttgc

SEQ ID NO: 8464831 - DNA, 22 bp, Homo sapiens
catcttgtgaatttctgattct

SEQ ID NO: 8464832 - DNA, 19 bp, Homo sapiens
catcttggagtactccttt

SEQ ID NO: 8464833 - DNA, 22 bp, Homo sapiens
cagtgtggtgagattccaggtg

SEQ ID NO: 8464834 - DNA, 21 bp, Homo sapiens
cagtgtggtgaccagggtctc

SEQ ID NO: 8464835 - DNA, 22 bp, Homo sapiens
cagtgttccctgaacatatgtt

SEQ ID NO: 8464836 - DNA, 22 bp, Homo sapiens
cagtgtttaatcattgtgaatt

SEQ ID NO: 8464837 - DNA, 21 bp, Homo sapiens
aggagccagcctgtcagtcta

SEQ ID NO: 8464838 - DNA, 22 bp, Homo sapiens
aggagccagcgttcctcaggat

SEQ ID NO: 8464839 - DNA, 22 bp, Homo sapiens
aggagccagaatccagactcgg

SEQ ID NO: 8464840 - DNA, 22 bp, Homo sapiens
aggagccaggaaacctgctctg

SEQ ID NO: 8464841 - DNA, 23 bp, Homo sapiens
aggagccaggaaccagcttcccc

SEQ ID NO: 8464842 - DNA, 22 bp, Homo sapiens
aggagccaggccccatggggct

SEQ ID NO: 8464843 - DNA, 22 bp, Homo sapiens
cagtccagagcccaccagagga

SEQ ID NO: 8464844 - DNA, 22 bp, Homo sapiens
cagtccagagcccaccagagga

SEQ ID NO: 8464845 - DNA, 22 bp, Homo sapiens
cagtccagccagtagggtgtgg

SEQ ID NO: 8464846 - DNA, 22 bp, Homo sapiens
cagtccaggcctggaggagcca

SEQ ID NO: 8464847 - DNA, 22 bp, Homo sapiens
cagtccagctcatcagtggcac

SEQ ID NO: 8464848 - DNA, 22 bp, Homo sapiens
cagtgtgctgcagagaacattt

SEQ ID NO: 8464849 - DNA, 22 bp, Homo sapiens
cagtgtgggtttgggaggagta

SEQ ID NO: 8464850 - DNA, 22 bp, Homo sapiens
aggagctggtagtctcattggg

SEQ ID NO: 8464851 - DNA, 22 bp, Homo sapiens
aggagctgtcagagtgccagag

SEQ ID NO: 8464852 - DNA, 22 bp, Homo sapiens
aggaggcagatgcttggctgta

SEQ ID NO: 8464853 - DNA, 22 bp, Homo sapiens
aggaggccgctgatgggctccc

SEQ ID NO: 8464854 - DNA, 22 bp, Homo sapiens
aggagctgtgaatgggaggggt

SEQ ID NO: 8464855 - DNA, 23 bp, Homo sapiens
aggaggcctgaaactgaggctga

SEQ ID NO: 8464856 - DNA, 22 bp, Homo sapiens
aggaggccgggattctggagat

SEQ ID NO: 8464857 - DNA, 22 bp, Homo sapiens
aggaggcctacgcacatgtcta

SEQ ID NO: 8464858 - DNA, 22 bp, Homo sapiens
cataactttaaagacagtgtgg

SEQ ID NO: 8464859 - DNA, 22 bp, Homo sapiens
cataacttggtgttggaaactg

SEQ ID NO: 8464860 - DNA, 22 bp, Homo sapiens
cataacttgctttggagcccgg

SEQ ID NO: 8464861 - DNA, 22 bp, Homo sapiens
cataatatactacattgatgaa

SEQ ID NO: 8464862 - DNA, 22 bp, Homo sapiens
cataatatactacattgatgaa

SEQ ID NO: 8464863 - DNA, 17 bp, Homo sapiens
aggagctgggggtggtg

SEQ ID NO: 8464864 - DNA, 22 bp, Homo sapiens
aggagccagtggagttcctgcc

SEQ ID NO: 8464865 - DNA, 22 bp, Homo sapiens
cagttttattggttgaaatctg

SEQ ID NO: 8464866 - DNA, 22 bp, Homo sapiens
cagttttatgtcgaatgtatac

SEQ ID NO: 8464867 - DNA, 22 bp, Homo sapiens
cataacattaagcctctatttc

SEQ ID NO: 8464868 - DNA, 22 bp, Homo sapiens
cataacatgtacatataaatgc

SEQ ID NO: 8464869 - DNA, 22 bp, Homo sapiens
cataacatgtacatataaatgc

SEQ ID NO: 8464870 - DNA, 22 bp, Homo sapiens
aggcaacttttggggatgatgg

SEQ ID NO: 8464871 - DNA, 22 bp, Homo sapiens
aggcaacttgcatctcggcaag

SEQ ID NO: 8464872 - DNA, 22 bp, Homo sapiens
aggcaactgacagcatatcctg

SEQ ID NO: 8464873 - DNA, 22 bp, Homo sapiens
aggcaactgacagtttctgctt

SEQ ID NO: 8464874 - DNA, 22 bp, Homo sapiens
aggcaagctgcagagagtcctt

SEQ ID NO: 8464875 - DNA, 23 bp, Homo sapiens
aggcaagggtgtaaaggaaatga

SEQ ID NO: 8464876 - DNA, 20 bp, Homo sapiens
aggcaaggtagatgtctgct

SEQ ID NO: 8464877 - DNA, 22 bp, Homo sapiens
aggcaagattaggaccagaaga

SEQ ID NO: 8464878 - DNA, 22 bp, Homo sapiens
aggcaagcattgggaacagggc

SEQ ID NO: 8464879 - DNA, 22 bp, Homo sapiens
aggcaagcccccagtgaggctc

SEQ ID NO: 8464880 - DNA, 22 bp, Homo sapiens
aggcaagccgtgcctgtctcaa

SEQ ID NO: 8464881 - DNA, 22 bp, Homo sapiens
aggcaagcccaggcacttggag

SEQ ID NO: 8464882 - DNA, 22 bp, Homo sapiens
aggcaaggtgctacagacagtg

SEQ ID NO: 8464883 - DNA, 22 bp, Homo sapiens
aggcaagtgcattagaagagca

SEQ ID NO: 8464884 - DNA, 22 bp, Homo sapiens
aggcaagtgcattagaagagca

SEQ ID NO: 8464885 - DNA, 22 bp, Homo sapiens
aggcaaggtgctcttgctctat

SEQ ID NO: 8464886 - DNA, 22 bp, Homo sapiens
cattgcaggagagtaaataaaa

SEQ ID NO: 8464887 - DNA, 22 bp, Homo sapiens
cattcggaggtagttgaggtta

SEQ ID NO: 8464888 - DNA, 22 bp, Homo sapiens
cattgcaggagagtaaataaaa

SEQ ID NO: 8464889 - DNA, 22 bp, Homo sapiens
catttcaagcattgacttctat

SEQ ID NO: 8464890 - DNA, 22 bp, Homo sapiens
catttcaattatttgctcttct

SEQ ID NO: 8464891 - DNA, 22 bp, Homo sapiens
catttattggcatgtagtaggt

SEQ ID NO: 8464892 - DNA, 22 bp, Homo sapiens
aggcacttgcattgatgaggtc

SEQ ID NO: 8464893 - DNA, 22 bp, Homo sapiens
aggcacttaataaggattcaat

SEQ ID NO: 8464894 - DNA, 22 bp, Homo sapiens
aggcacttctcaaattcatgcc

SEQ ID NO: 8464895 - DNA, 22 bp, Homo sapiens
cattggtcttctaacagagaga

SEQ ID NO: 8464896 - DNA, 22 bp, Homo sapiens
cattggccttttatcctagagg

SEQ ID NO: 8464897 - DNA, 22 bp, Homo sapiens
cattggaatgatcgttttgctg

SEQ ID NO: 8464898 - DNA, 22 bp, Homo sapiens
catttgaaaatactcttttcca

SEQ ID NO: 8464899 - DNA, 23 bp, Homo sapiens
catttctgggagatttataaaat

SEQ ID NO: 8464900 - DNA, 22 bp, Homo sapiens
ccacagagacagggtccttgct

SEQ ID NO: 8464901 - DNA, 22 bp, Homo sapiens
ccacagaattctgtctccagga

SEQ ID NO: 8464902 - DNA, 22 bp, Homo sapiens
ccacagaatgatgacacttcag

SEQ ID NO: 8464903 - DNA, 22 bp, Homo sapiens
ccacagaattctgtctccagga

SEQ ID NO: 8464904 - DNA, 22 bp, Homo sapiens
ccacagagagtgtcagcctttg

SEQ ID NO: 8464905 - DNA, 22 bp, Homo sapiens
ccacagagactctgcaggactg

SEQ ID NO: 8464906 - DNA, 22 bp, Homo sapiens
ccacagagagtgtcagcctttg

SEQ ID NO: 8464907 - DNA, 17 bp, Homo sapiens
aggcaggagattggaga

SEQ ID NO: 8464908 - DNA, 23 bp, Homo sapiens
ccacagagctgccaattcctgtg

SEQ ID NO: 8464909 - DNA, 23 bp, Homo sapiens
ccacagagctgccaattcctgtg

SEQ ID NO: 8464910 - DNA, 22 bp, Homo sapiens
aggcaggaaaatcgcttgaacc

SEQ ID NO: 8464911 - DNA, 22 bp, Homo sapiens
aggcaggaaaatcgcttgaacc

SEQ ID NO: 8464912 - DNA, 22 bp, Homo sapiens
aggcaggagtgaccctgacagg

SEQ ID NO: 8464913 - DNA, 22 bp, Homo sapiens
aggcaggagtgaccctgacagg

SEQ ID NO: 8464914 - DNA, 22 bp, Homo sapiens
aggcaggaggatcatggatgca

SEQ ID NO: 8464915 - DNA, 22 bp, Homo sapiens
aggcaggaggatcatggatgca

SEQ ID NO: 8464916 - DNA, 18 bp, Homo sapiens
aggcaggatcctggcctc

SEQ ID NO: 8464917 - DNA, 18 bp, Homo sapiens
aggcaggatcctggcctc

SEQ ID NO: 8464918 - DNA, 23 bp, Homo sapiens
ccacaggcacagaggcttgcatc

SEQ ID NO: 8464919 - DNA, 23 bp, Homo sapiens
ccacaggcacagaggcttgcatc

SEQ ID NO: 8464920 - DNA, 21 bp, Homo sapiens
ccaccaggtcttctgctcggg

SEQ ID NO: 8464921 - DNA, 22 bp, Homo sapiens
ccacatctaagccttcatgata

SEQ ID NO: 8464922 - DNA, 22 bp, Homo sapiens
ccacatctatctttagtatgaa

SEQ ID NO: 8464923 - DNA, 22 bp, Homo sapiens
ccaccaggcactcacagggaag

SEQ ID NO: 8464924 - DNA, 22 bp, Homo sapiens
ccacatctccctattgctcttt

SEQ ID NO: 8464925 - DNA, 22 bp, Homo sapiens
ccacatctcggtcccctctttg

SEQ ID NO: 8464926 - DNA, 22 bp, Homo sapiens
ccaccaggctctgtccgagcgg

SEQ ID NO: 8464927 - DNA, 22 bp, Homo sapiens
ccacagttattcatttgtgaca

SEQ ID NO: 8464928 - DNA, 22 bp, Homo sapiens
ccacgacgagtcatcagggcga

SEQ ID NO: 8464929 - DNA, 23 bp, Homo sapiens
ccacctggactctgggcaggtgc

SEQ ID NO: 8464930 - DNA, 20 bp, Homo sapiens
ccacctggccaaggctgtgc

SEQ ID NO: 8464931 - DNA, 22 bp, Homo sapiens
ccactcagcacagtggatgcag

SEQ ID NO: 8464932 - DNA, 22 bp, Homo sapiens
ccactcaggcctcctgctctcc

SEQ ID NO: 8464933 - DNA, 22 bp, Homo sapiens
ccacgtgtaggtggacaggatc

SEQ ID NO: 8464934 - DNA, 22 bp, Homo sapiens
ccacgagggaaccaggtggggt

SEQ ID NO: 8464935 - DNA, 20 bp, Homo sapiens
agggcctgttgcaagcgttt

SEQ ID NO: 8464936 - DNA, 22 bp, Homo sapiens
cctaaggaccagggcttccagc

SEQ ID NO: 8464937 - DNA, 20 bp, Homo sapiens
agggcctgttgcaagcgttt

SEQ ID NO: 8464938 - DNA, 22 bp, Homo sapiens
agggcctgtgcttcctgagata

SEQ ID NO: 8464939 - DNA, 22 bp, Homo sapiens
agggcctgtgctgagtagacga

SEQ ID NO: 8464940 - DNA, 22 bp, Homo sapiens
cctaattatctcccaaagatcc

SEQ ID NO: 8464941 - DNA, 22 bp, Homo sapiens
agggcctgtcagcggtgtcctg

SEQ ID NO: 8464942 - DNA, 22 bp, Homo sapiens
agggcctgtccgctcccgcccg

SEQ ID NO: 8464943 - DNA, 22 bp, Homo sapiens
agggcctgtctgtagaactgaa

SEQ ID NO: 8464944 - DNA, 22 bp, Homo sapiens
agggcctgtctgtagaactgaa

SEQ ID NO: 8464945 - DNA, 21 bp, Homo sapiens
agggcctgtgctctccaggtc

SEQ ID NO: 8464946 - DNA, 22 bp, Homo sapiens
agggcctgtctgtagaactgaa

SEQ ID NO: 8464947 - DNA, 22 bp, Homo sapiens
agggcctgtgaattctccctgc

SEQ ID NO: 8464948 - DNA, 19 bp, Homo sapiens
ccctggcaggcaagcctgg

SEQ ID NO: 8464949 - DNA, 22 bp, Homo sapiens
ccctggcagaatgtctctgggc

SEQ ID NO: 8464950 - DNA, 22 bp, Homo sapiens
ccctggcataaaacttctccag

SEQ ID NO: 8464951 - DNA, 22 bp, Homo sapiens
ccctggcatgcatgtccctggc

SEQ ID NO: 8464952 - DNA, 22 bp, Homo sapiens
agggcctggcttcactttctca

SEQ ID NO: 8464953 - DNA, 22 bp, Homo sapiens
ccctggcactagcgacggccat

SEQ ID NO: 8464954 - DNA, 22 bp, Homo sapiens
agggcccatgtgggagcacttg

SEQ ID NO: 8464955 - DNA, 22 bp, Homo sapiens
agggcccatgtgggagcacttg

SEQ ID NO: 8464956 - DNA, 22 bp, Homo sapiens
agggcccagtggagagctgagc

SEQ ID NO: 8464957 - DNA, 22 bp, Homo sapiens
agggctgaggcgagggagatgc

SEQ ID NO: 8464958 - DNA, 22 bp, Homo sapiens
agggctgagaatgacagggccg

SEQ ID NO: 8464959 - DNA, 19 bp, Homo sapiens
cctacatgagtaagcttgg

SEQ ID NO: 8464960 - DNA, 22 bp, Homo sapiens
cctacagttatattcttgattg

SEQ ID NO: 8464961 - DNA, 22 bp, Homo sapiens
cctacagttatattcttgattg

SEQ ID NO: 8464962 - DNA, 22 bp, Homo sapiens
cctaccagtaggaggccagaga

SEQ ID NO: 8464963 - DNA, 22 bp, Homo sapiens
agggctctttaggccgaggcca

SEQ ID NO: 8464964 - DNA, 19 bp, Homo sapiens
cctacttgtttgagggaag

SEQ ID NO: 8464965 - DNA, 22 bp, Homo sapiens
cctagaacacaacctatattag

SEQ ID NO: 8464966 - DNA, 22 bp, Homo sapiens
cctcaggtgtgggccagctgtc

SEQ ID NO: 8464967 - DNA, 22 bp, Homo sapiens
cctcaggtgtgggccagctgtc

SEQ ID NO: 8464968 - DNA, 22 bp, Homo sapiens
cctcagtctatttccagcaggt

SEQ ID NO: 8464969 - DNA, 22 bp, Homo sapiens
cctcagggtggcatcagatctt

SEQ ID NO: 8464970 - DNA, 22 bp, Homo sapiens
cctcagggtcatcctagtaata

SEQ ID NO: 8464971 - DNA, 22 bp, Homo sapiens
cctcctggtgacaaggcaaagc

SEQ ID NO: 8464972 - DNA, 22 bp, Homo sapiens
cctcctggtgacaaggcaaagc

SEQ ID NO: 8464973 - DNA, 22 bp, Homo sapiens
cctcctggtgacaaggcaaagc

SEQ ID NO: 8464974 - DNA, 21 bp, Homo sapiens
aggggaagtagagttttgatt

SEQ ID NO: 8464975 - DNA, 22 bp, Homo sapiens
aggggaaggccagcctgtagag

SEQ ID NO: 8464976 - DNA, 22 bp, Homo sapiens
aggggaagattatacttttgaa

SEQ ID NO: 8464977 - DNA, 22 bp, Homo sapiens
aggggaagagccctttacatgg

SEQ ID NO: 8464978 - DNA, 22 bp, Homo sapiens
cctcctggtgggcgcttctggc

SEQ ID NO: 8464979 - DNA, 22 bp, Homo sapiens
cctcctggtgggcgcttctggc

SEQ ID NO: 8464980 - DNA, 22 bp, Homo sapiens
cctcctggtgggcgcttctggc

SEQ ID NO: 8464981 - DNA, 22 bp, Homo sapiens
cctcctgtctccttcctatatt

SEQ ID NO: 8464982 - DNA, 22 bp, Homo sapiens
cctcctggttgcaatgaaatgg

SEQ ID NO: 8464983 - DNA, 22 bp, Homo sapiens
cctcctggttgcaatgaaatgg

SEQ ID NO: 8464984 - DNA, 22 bp, Homo sapiens
cctcctggtgggcgcttctggc

SEQ ID NO: 8464985 - DNA, 19 bp, Homo sapiens
cctcctgtggcgggtgggg

SEQ ID NO: 8464986 - DNA, 22 bp, Homo sapiens
cctcctgttgtcaccaggcgtg

SEQ ID NO: 8464987 - DNA, 22 bp, Homo sapiens
cctcctggtgggcgcttctggc

SEQ ID NO: 8464988 - DNA, 22 bp, Homo sapiens
cctcctgttgtcaccaggcgtg

SEQ ID NO: 8464989 - DNA, 22 bp, Homo sapiens
cctcctgttgtcctgctggggc

SEQ ID NO: 8464990 - DNA, 22 bp, Homo sapiens
cctccttcctgggacagagctg

SEQ ID NO: 8464991 - DNA, 22 bp, Homo sapiens
cctccttctggggccttctgct

SEQ ID NO: 8464992 - DNA, 22 bp, Homo sapiens
aggggctctgagtgggccagga

SEQ ID NO: 8464993 - DNA, 22 bp, Homo sapiens
aggggctgactggaaagtgcca

SEQ ID NO: 8464994 - DNA, 22 bp, Homo sapiens
aggggctcctttgtgctgcgtc

SEQ ID NO: 8464995 - DNA, 22 bp, Homo sapiens
aggggctcagttactttggcag

SEQ ID NO: 8464996 - DNA, 22 bp, Homo sapiens
aggggctccaaggaagtttggg

SEQ ID NO: 8464997 - DNA, 22 bp, Homo sapiens
aggggctcaaagtgtgcaggga

SEQ ID NO: 8464998 - DNA, 22 bp, Homo sapiens
aggggcggcctgcctgaagcag

SEQ ID NO: 8464999 - DNA, 18 bp, Homo sapiens
aggggcagcttgtgtgga

SEQ ID NO: 8465000 - DNA, 22 bp, Homo sapiens
cctgagtcccctcattcactct

SEQ ID NO: 8465001 - DNA, 22 bp, Homo sapiens
aggggtgaaggcccgataggag

SEQ ID NO: 8465002 - DNA, 20 bp, Homo sapiens
aggggtctagcagcagtgct

SEQ ID NO: 8465003 - DNA, 22 bp, Homo sapiens
agggggtgtctctgattgggtt

SEQ ID NO: 8465004 - DNA, 22 bp, Homo sapiens
agggggtgtctctgattgggtt

SEQ ID NO: 8465005 - DNA, 22 bp, Homo sapiens
agggggtgctacttccagagtt

SEQ ID NO: 8465006 - DNA, 22 bp, Homo sapiens
agggggtgggaagtctagaatc

SEQ ID NO: 8465007 - DNA, 22 bp, Homo sapiens
agggggtgggaagtctagaatc

SEQ ID NO: 8465008 - DNA, 22 bp, Homo sapiens
agggggtgatcaaggtgcggcg

SEQ ID NO: 8465009 - DNA, 22 bp, Homo sapiens
agggggtgcccagatgaaggat

SEQ ID NO: 8465010 - DNA, 22 bp, Homo sapiens
agggggctgccaaggaatgtaa

SEQ ID NO: 8465011 - DNA, 22 bp, Homo sapiens
agggggctgccaaggaatgtaa

SEQ ID NO: 8465012 - DNA, 22 bp, Homo sapiens
agggggtgaatgtctgtctaca

SEQ ID NO: 8465013 - DNA, 22 bp, Homo sapiens
agggggtgaatgtctgtctaca

SEQ ID NO: 8465014 - DNA, 22 bp, Homo sapiens
cctctgtgtgtgcatgcatgcg

SEQ ID NO: 8465015 - DNA, 22 bp, Homo sapiens
cctctgtgtgtgcatgcatgcg

SEQ ID NO: 8465016 - DNA, 22 bp, Homo sapiens
cctctgtgtcctggtcattgaa

SEQ ID NO: 8465017 - DNA, 22 bp, Homo sapiens
cccagatgcaggttcaagagta

SEQ ID NO: 8465018 - DNA, 22 bp, Homo sapiens
cccagatgcaggttcaagagta

SEQ ID NO: 8465019 - DNA, 20 bp, Homo sapiens
cccagaggttgcggcaggag

SEQ ID NO: 8465020 - DNA, 21 bp, Homo sapiens
agggaaagaaaatgagctaat

SEQ ID NO: 8465021 - DNA, 22 bp, Homo sapiens
agggaaaggtagtgaggtcaca

SEQ ID NO: 8465022 - DNA, 22 bp, Homo sapiens
agggaaaggctgatgctgtggg

SEQ ID NO: 8465023 - DNA, 22 bp, Homo sapiens
aggctttggggcattctgtgtt

SEQ ID NO: 8465024 - DNA, 22 bp, Homo sapiens
aggctttcctgtcactcatgct

SEQ ID NO: 8465025 - DNA, 22 bp, Homo sapiens
agggaaataatctattctgagg

SEQ ID NO: 8465026 - DNA, 22 bp, Homo sapiens
cccaggaacagcacagaacagc

SEQ ID NO: 8465027 - DNA, 22 bp, Homo sapiens
cccaggaacagggctcagaccc

SEQ ID NO: 8465028 - DNA, 22 bp, Homo sapiens
cccaggccagaacttggttgct

SEQ ID NO: 8465029 - DNA, 22 bp, Homo sapiens
cccaggccccagggcttgtcag

SEQ ID NO: 8465030 - DNA, 22 bp, Homo sapiens
agggacagttacatcatcagac

SEQ ID NO: 8465031 - DNA, 22 bp, Homo sapiens
agggacatctcacaaacaactt

SEQ ID NO: 8465032 - DNA, 22 bp, Homo sapiens
agggaccaatcaccgacaggct

SEQ ID NO: 8465033 - DNA, 22 bp, Homo sapiens
agggaccacatcccctctgtgg

SEQ ID NO: 8465034 - DNA, 22 bp, Homo sapiens
agggaccagcctgcccagggct

SEQ ID NO: 8465035 - DNA, 22 bp, Homo sapiens
agggaccaggggtagctgagat

SEQ ID NO: 8465036 - DNA, 22 bp, Homo sapiens
agggacagtctactgttcactg

SEQ ID NO: 8465037 - DNA, 22 bp, Homo sapiens
agggaatggatgatggcaggtt

SEQ ID NO: 8465038 - DNA, 22 bp, Homo sapiens
agggaatggatgatggcaggtt

SEQ ID NO: 8465039 - DNA, 22 bp, Homo sapiens
agggagccctgaaccagagggt

SEQ ID NO: 8465040 - DNA, 22 bp, Homo sapiens
agggagccctgaaccagagggt

SEQ ID NO: 8465041 - DNA, 22 bp, Homo sapiens
agggagctgactggctgccatt

SEQ ID NO: 8465042 - DNA, 22 bp, Homo sapiens
cccaggcctggtctgggccagt

SEQ ID NO: 8465043 - DNA, 22 bp, Homo sapiens
cccaggcctggtctgggccagt

SEQ ID NO: 8465044 - DNA, 22 bp, Homo sapiens
cccaggcctggtctgggccagt

SEQ ID NO: 8465045 - DNA, 22 bp, Homo sapiens
cccaggcctggtctgggccagt

SEQ ID NO: 8465046 - DNA, 22 bp, Homo sapiens
cccaggccctggcagagcttgt

SEQ ID NO: 8465047 - DNA, 22 bp, Homo sapiens
cccaggccctggcagagcttgt

SEQ ID NO: 8465048 - DNA, 22 bp, Homo sapiens
cccaggccctggcagagcttgt

SEQ ID NO: 8465049 - DNA, 17 bp, Homo sapiens
cccaggccgccgggagc

SEQ ID NO: 8465050 - DNA, 22 bp, Homo sapiens
agggagctgggccacactgatc

SEQ ID NO: 8465051 - DNA, 21 bp, Homo sapiens
agggagctgcgtcttgaaaga

SEQ ID NO: 8465052 - DNA, 22 bp, Homo sapiens
agggagctgctctgcttccgtg

SEQ ID NO: 8465053 - DNA, 22 bp, Homo sapiens
agggagcttccgaactacagct

SEQ ID NO: 8465054 - DNA, 22 bp, Homo sapiens
agggagcttctggcctcagcct

SEQ ID NO: 8465055 - DNA, 22 bp, Homo sapiens
agggccaagtccaggacctcgg

SEQ ID NO: 8465056 - DNA, 22 bp, Homo sapiens
agggccaagtccaggacctcgg

SEQ ID NO: 8465057 - DNA, 22 bp, Homo sapiens
agggccaccagagcagggcagt

SEQ ID NO: 8465058 - DNA, 22 bp, Homo sapiens
agggccacagtggggcctgaga

SEQ ID NO: 8465059 - DNA, 22 bp, Homo sapiens
ccctgaggatagggcaggaccc

SEQ ID NO: 8465060 - DNA, 22 bp, Homo sapiens
ccctgaggagagcgcttcccga

SEQ ID NO: 8465061 - DNA, 22 bp, Homo sapiens
agggccaccagggagtctcagg

SEQ ID NO: 8465062 - DNA, 22 bp, Homo sapiens
agggccaccagggagtctcagg

SEQ ID NO: 8465063 - DNA, 22 bp, Homo sapiens
agggcatgtgggagaggagcct

SEQ ID NO: 8465064 - DNA, 22 bp, Homo sapiens
cccctgtgttgttcaagggtca

SEQ ID NO: 8465065 - DNA, 22 bp, Homo sapiens
agggcagctgtgagccactgtg

SEQ ID NO: 8465066 - DNA, 20 bp, Homo sapiens
ccccttcatctacagcctga

SEQ ID NO: 8465067 - DNA, 22 bp, Homo sapiens
cccctgggtccaggcttctctg

SEQ ID NO: 8465068 - DNA, 22 bp, Homo sapiens
cccctggggatcagctggaatt

SEQ ID NO: 8465069 - DNA, 18 bp, Homo sapiens
ccctgaggctagcatgct

SEQ ID NO: 8465070 - DNA, 22 bp, Homo sapiens
ccctgaggggagtggtgaggtg

SEQ ID NO: 8465071 - DNA, 22 bp, Homo sapiens
ccctgaggggcttactttgccc

SEQ ID NO: 8465072 - DNA, 22 bp, Homo sapiens
ccctgaggcacaggccacgtat

SEQ ID NO: 8465073 - DNA, 22 bp, Homo sapiens
ccctgaggatgtctccttcctg

SEQ ID NO: 8465074 - DNA, 22 bp, Homo sapiens
ccctgaggcaaaggctagagtt

SEQ ID NO: 8465075 - DNA, 23 bp, Homo sapiens
agggcccaagcctggacagcagg

SEQ ID NO: 8465076 - DNA, 22 bp, Homo sapiens
ccctgatgacacgggcatcagg

SEQ ID NO: 8465077 - DNA, 22 bp, Homo sapiens
ccctgaggggcttactttgccc

SEQ ID NO: 8465078 - DNA, 22 bp, Homo sapiens
cccaggtgggttggcctctgtc

SEQ ID NO: 8465079 - DNA, 18 bp, Homo sapiens
cccaggttggcctacaga

SEQ ID NO: 8465080 - DNA, 22 bp, Homo sapiens
cccaggtgtttgtggcagaggt

SEQ ID NO: 8465081 - DNA, 22 bp, Homo sapiens
agggatggtggaggaatttcaa

SEQ ID NO: 8465082 - DNA, 22 bp, Homo sapiens
agggcagaaaccaccttgatgg

SEQ ID NO: 8465083 - DNA, 22 bp, Homo sapiens
cccaggtctgtgccagctctga

SEQ ID NO: 8465084 - DNA, 22 bp, Homo sapiens
agggagctttcaggtagcttaa

SEQ ID NO: 8465085 - DNA, 22 bp, Homo sapiens
agggagctttaccccagatcac

SEQ ID NO: 8465086 - DNA, 22 bp, Homo sapiens
cccaggtgctgaaggaggccgc

SEQ ID NO: 8465087 - DNA, 21 bp, Homo sapiens
cccctgggagccctgtcagta

SEQ ID NO: 8465088 - DNA, 22 bp, Homo sapiens
cccctgccatagtcaaatctaa

SEQ ID NO: 8465089 - DNA, 22 bp, Homo sapiens
cccctcttgtgggctcaggtca

SEQ ID NO: 8465090 - DNA, 22 bp, Homo sapiens
cccctgccagctatccctgaac

SEQ ID NO: 8465091 - DNA, 22 bp, Homo sapiens
cccctgccagctatccctgaac

SEQ ID NO: 8465092 - DNA, 22 bp, Homo sapiens
agggcagaccacgtgcaaggat

SEQ ID NO: 8465093 - DNA, 22 bp, Homo sapiens
agggcagactaggatggaagtg

SEQ ID NO: 8465094 - DNA, 22 bp, Homo sapiens
ccattttgtctgacttcttgct

SEQ ID NO: 8465095 - DNA, 22 bp, Homo sapiens
cccaagttaatttgtagctgaa

SEQ ID NO: 8465096 - DNA, 22 bp, Homo sapiens
cccaagtattcctcctctgccc

SEQ ID NO: 8465097 - DNA, 22 bp, Homo sapiens
cccaagttaaaattcagtgctc

SEQ ID NO: 8465098 - DNA, 22 bp, Homo sapiens
ccagtgtgaaaggtcatttatc

SEQ ID NO: 8465099 - DNA, 22 bp, Homo sapiens
ccagtgtctgtggtatagaaag

SEQ ID NO: 8465100 - DNA, 22 bp, Homo sapiens
cccacacatttttcacttaccg

SEQ ID NO: 8465101 - DNA, 18 bp, Homo sapiens
cccacacagcagtagctc

SEQ ID NO: 8465102 - DNA, 22 bp, Homo sapiens
cccacacacatttatgatagga

SEQ ID NO: 8465103 - DNA, 22 bp, Homo sapiens
cccacacaaatcatggggagaa

SEQ ID NO: 8465104 - DNA, 22 bp, Homo sapiens
aggctgccagaagccttcagga

SEQ ID NO: 8465105 - DNA, 23 bp, Homo sapiens
aggctgccagaaattgggtaagg

SEQ ID NO: 8465106 - DNA, 22 bp, Homo sapiens
aggctgcagtgcaggtaggatt

SEQ ID NO: 8465107 - DNA, 22 bp, Homo sapiens
aggctgcagaggtgctgccaga

SEQ ID NO: 8465108 - DNA, 22 bp, Homo sapiens
aggctgccctgccgccagtggg

SEQ ID NO: 8465109 - DNA, 22 bp, Homo sapiens
aggctgccctgccgccagtggg

SEQ ID NO: 8465110 - DNA, 19 bp, Homo sapiens
aggctgcccagtctctgcc

SEQ ID NO: 8465111 - DNA, 19 bp, Homo sapiens
aggctgcccagtctctgcc

SEQ ID NO: 8465112 - DNA, 20 bp, Homo sapiens
aggctgccaggtctcacatc

SEQ ID NO: 8465113 - DNA, 22 bp, Homo sapiens
ccagtgggtaggccatggtgag

SEQ ID NO: 8465114 - DNA, 22 bp, Homo sapiens
ccagtgggagggagctaggcca

SEQ ID NO: 8465115 - DNA, 22 bp, Homo sapiens
aggctgtggtgatgattgggtc

SEQ ID NO: 8465116 - DNA, 22 bp, Homo sapiens
aggctgtggtgctgaaggaggg

SEQ ID NO: 8465117 - DNA, 22 bp, Homo sapiens
cccagaggtgacatcccattct

SEQ ID NO: 8465118 - DNA, 22 bp, Homo sapiens
cccagaggttccttagggacca

SEQ ID NO: 8465119 - DNA, 22 bp, Homo sapiens
cccagaggttccttagggacca

SEQ ID NO: 8465120 - DNA, 22 bp, Homo sapiens
cccagaggtgcttcagaggtgc

SEQ ID NO: 8465121 - DNA, 22 bp, Homo sapiens
cccagaggtgcttcagaggtgc

SEQ ID NO: 8465122 - DNA, 22 bp, Homo sapiens
aggctgtgcgaggtctcagagt

SEQ ID NO: 8465123 - DNA, 22 bp, Homo sapiens
aggctgtgcgaggtctcagagt

SEQ ID NO: 8465124 - DNA, 22 bp, Homo sapiens
aggctgtgggaatggctgcttg

SEQ ID NO: 8465125 - DNA, 22 bp, Homo sapiens
aggctgtgggaatggctgcttg

SEQ ID NO: 8465126 - DNA, 22 bp, Homo sapiens
aggctgtgggagttgagagtct

SEQ ID NO: 8465127 - DNA, 22 bp, Homo sapiens
aggctgtgggagttgagagtct

SEQ ID NO: 8465128 - DNA, 22 bp, Homo sapiens
aggctgtgggacagttaggaga

SEQ ID NO: 8465129 - DNA, 22 bp, Homo sapiens
cccactccctacgacacgctcc

SEQ ID NO: 8465130 - DNA, 18 bp, Homo sapiens
cccacggtgctgtagggc

SEQ ID NO: 8465131 - DNA, 22 bp, Homo sapiens
cccacgtcgaacttgctccaga

SEQ ID NO: 8465132 - DNA, 22 bp, Homo sapiens
cccacgtcgaacttgctccaga

SEQ ID NO: 8465133 - DNA, 22 bp, Homo sapiens
cccaccctgggctacacatcca

SEQ ID NO: 8465134 - DNA, 22 bp, Homo sapiens
cccacctctcagagagccttgc

SEQ ID NO: 8465135 - DNA, 22 bp, Homo sapiens
cccacactctgagaaatgctga

SEQ ID NO: 8465136 - DNA, 22 bp, Homo sapiens
aggctgtgactacgcagggaag

SEQ ID NO: 8465137 - DNA, 22 bp, Homo sapiens
aggctgtgcattttggagggcc

SEQ ID NO: 8465138 - DNA, 22 bp, Homo sapiens
aggctgtgcattttggagggcc

SEQ ID NO: 8465139 - DNA, 22 bp, Homo sapiens
aggctgtgcacagggcacctgc

SEQ ID NO: 8465140 - DNA, 22 bp, Homo sapiens
cccactccctgcacgcctgccg

SEQ ID NO: 8465141 - DNA, 22 bp, Homo sapiens
cccactgctgcgccgggcgccg

SEQ ID NO: 8465142 - DNA, 22 bp, Homo sapiens
ccaggcctgtgttgtgtggagg

SEQ ID NO: 8465143 - DNA, 22 bp, Homo sapiens
ccaggcctgtgcaaggagggag

SEQ ID NO: 8465144 - DNA, 22 bp, Homo sapiens
ccaggcctcacctgcccaccta

SEQ ID NO: 8465145 - DNA, 20 bp, Homo sapiens
ccaggcctgggcctgctcta

SEQ ID NO: 8465146 - DNA, 22 bp, Homo sapiens
ccaggccttctgaggacactct

SEQ ID NO: 8465147 - DNA, 22 bp, Homo sapiens
ccaggccttctgaggacactct

SEQ ID NO: 8465148 - DNA, 22 bp, Homo sapiens
ccaggcctttcttcttggtctg

SEQ ID NO: 8465149 - DNA, 22 bp, Homo sapiens
aggctcagatccttgtgtcctg

SEQ ID NO: 8465150 - DNA, 22 bp, Homo sapiens
ccaggcctttcttcttggtctg

SEQ ID NO: 8465151 - DNA, 22 bp, Homo sapiens
aggctctggttcatcatgatgg

SEQ ID NO: 8465152 - DNA, 22 bp, Homo sapiens
aggctctgggaagcagtgagtt

SEQ ID NO: 8465153 - DNA, 22 bp, Homo sapiens
aggctctgggaagcagtgagtt

SEQ ID NO: 8465154 - DNA, 22 bp, Homo sapiens
aggctctgcttttctggatata

SEQ ID NO: 8465155 - DNA, 22 bp, Homo sapiens
aggctctgggaacagacgggtg

SEQ ID NO: 8465156 - DNA, 20 bp, Homo sapiens
aggctctgcctgcaggccca

SEQ ID NO: 8465157 - DNA, 22 bp, Homo sapiens
aggctcagcctgggcctagagc

SEQ ID NO: 8465158 - DNA, 22 bp, Homo sapiens
aggctcagcccctgggaggaga

SEQ ID NO: 8465159 - DNA, 21 bp, Homo sapiens
aggctcagcaggtgtataaag

SEQ ID NO: 8465160 - DNA, 22 bp, Homo sapiens
aggctcagcatctgattcatat

SEQ ID NO: 8465161 - DNA, 22 bp, Homo sapiens
aggctcagcccaaggtggagag

SEQ ID NO: 8465162 - DNA, 19 bp, Homo sapiens
aggctctgtaggagagggc

SEQ ID NO: 8465163 - DNA, 22 bp, Homo sapiens
aggctctgtcaggcggagcagc

SEQ ID NO: 8465164 - DNA, 22 bp, Homo sapiens
ccaggtgcctccagtcacagtg

SEQ ID NO: 8465165 - DNA, 22 bp, Homo sapiens
ccaggtgcctccagtcacagtg

SEQ ID NO: 8465166 - DNA, 22 bp, Homo sapiens
ccaggtggtgaaagtgggccct

SEQ ID NO: 8465167 - DNA, 18 bp, Homo sapiens
ccaggtggtgacagagat

SEQ ID NO: 8465168 - DNA, 22 bp, Homo sapiens
ccaggtggttcaggtcaccata

SEQ ID NO: 8465169 - DNA, 23 bp, Homo sapiens
ccagtagcacagttacccagtgg

SEQ ID NO: 8465170 - DNA, 22 bp, Homo sapiens
ccagtattcgatctggccagtt

SEQ ID NO: 8465171 - DNA, 22 bp, Homo sapiens
ccaggttggagttcagtggcgc

SEQ ID NO: 8465172 - DNA, 22 bp, Homo sapiens
ccaggttcaaatagctgtgtga

SEQ ID NO: 8465173 - DNA, 22 bp, Homo sapiens
ccaggttggagttcagtggcgc

SEQ ID NO: 8465174 - DNA, 22 bp, Homo sapiens
ccagtaaaaagcgacaggaagt

SEQ ID NO: 8465175 - DNA, 22 bp, Homo sapiens
ccagtaaaccaagtgtttacta

SEQ ID NO: 8465176 - DNA, 23 bp, Homo sapiens
ccagtaaacccttcctcagtgtc

SEQ ID NO: 8465177 - DNA, 22 bp, Homo sapiens
ccagtaaattacttgatgtcat

SEQ ID NO: 8465178 - DNA, 22 bp, Homo sapiens
ccaggcactgctcgaggtgcta

SEQ ID NO: 8465179 - DNA, 22 bp, Homo sapiens
ccaggcacggtggctcatgcct

SEQ ID NO: 8465180 - DNA, 22 bp, Homo sapiens
ccaggcactcacggggcactgg

SEQ ID NO: 8465181 - DNA, 22 bp, Homo sapiens
ccaggcaccatgttcttaggac

SEQ ID NO: 8465182 - DNA, 22 bp, Homo sapiens
ccaggcaccatgttcttaggac

SEQ ID NO: 8465183 - DNA, 22 bp, Homo sapiens
ccaggcacaggtgggcctcaga

SEQ ID NO: 8465184 - DNA, 22 bp, Homo sapiens
ccaggcacaggtgggcctcaga

SEQ ID NO: 8465185 - DNA, 20 bp, Homo sapiens
aggctcagatacccagggaa

SEQ ID NO: 8465186 - DNA, 22 bp, Homo sapiens
aggctcagaggtgagcatctgc

SEQ ID NO: 8465187 - DNA, 16 bp, Homo sapiens
aggctcagaggctgga

SEQ ID NO: 8465188 - DNA, 22 bp, Homo sapiens
aggcctgggtctcgtgcctacc

SEQ ID NO: 8465189 - DNA, 22 bp, Homo sapiens
aggcctgggtctcgtgcctacc

SEQ ID NO: 8465190 - DNA, 19 bp, Homo sapiens
aggcctggggttttgcact

SEQ ID NO: 8465191 - DNA, 22 bp, Homo sapiens
aggcctgggtctcgtgcctacc

SEQ ID NO: 8465192 - DNA, 22 bp, Homo sapiens
aggcctgggcaagaaggggcgt

SEQ ID NO: 8465193 - DNA, 22 bp, Homo sapiens
aggcctgggcaagaaggggcgt

SEQ ID NO: 8465194 - DNA, 22 bp, Homo sapiens
aggcctgggtgttcaccagaag

SEQ ID NO: 8465195 - DNA, 22 bp, Homo sapiens
aggcctggtgaatgaagtatct

SEQ ID NO: 8465196 - DNA, 22 bp, Homo sapiens
aggcctggtgaatgaagtatct

SEQ ID NO: 8465197 - DNA, 21 bp, Homo sapiens
aggctcagagatcaaacagta

SEQ ID NO: 8465198 - DNA, 22 bp, Homo sapiens
aggctcagagatgagtaagcac

SEQ ID NO: 8465199 - DNA, 22 bp, Homo sapiens
aggctcagagagctgtgtccat

SEQ ID NO: 8465200 - DNA, 22 bp, Homo sapiens
ccaggagggaggagttcctgag

SEQ ID NO: 8465201 - DNA, 22 bp, Homo sapiens
ccaggaggggtctctgtctccc

SEQ ID NO: 8465202 - DNA, 22 bp, Homo sapiens
ccaggaggggtctctgtctccc

SEQ ID NO: 8465203 - DNA, 22 bp, Homo sapiens
ccaggaggtctgagtgtggaca

SEQ ID NO: 8465204 - DNA, 22 bp, Homo sapiens
ccaggaggtgaaacttcaccag

SEQ ID NO: 8465205 - DNA, 22 bp, Homo sapiens
ccaggaggtggcaggacttgcc

SEQ ID NO: 8465206 - DNA, 22 bp, Homo sapiens
ccaggaggtggcaggacttgcc

SEQ ID NO: 8465207 - DNA, 22 bp, Homo sapiens
ccaggaggtgctggaagaaagc

SEQ ID NO: 8465208 - DNA, 22 bp, Homo sapiens
aggccctgctttccagagctca

SEQ ID NO: 8465209 - DNA, 22 bp, Homo sapiens
aggccctggacactcaagccgg

SEQ ID NO: 8465210 - DNA, 22 bp, Homo sapiens
aggccctgctgaggcctccctc

SEQ ID NO: 8465211 - DNA, 22 bp, Homo sapiens
aggccctgctgaggcctccctc

SEQ ID NO: 8465212 - DNA, 22 bp, Homo sapiens
aggccctgctttccagagctca

SEQ ID NO: 8465213 - DNA, 22 bp, Homo sapiens
aggccctgctttccagagctca

SEQ ID NO: 8465214 - DNA, 21 bp, Homo sapiens
aggccctggaggtcagagaaa

SEQ ID NO: 8465215 - DNA, 22 bp, Homo sapiens
ccagctccgggagttgctgctg

SEQ ID NO: 8465216 - DNA, 22 bp, Homo sapiens
ccagctcccgcaggctgcacag

SEQ ID NO: 8465217 - DNA, 22 bp, Homo sapiens
ccagctcccgcaggctgcacag

SEQ ID NO: 8465218 - DNA, 22 bp, Homo sapiens
ccagctcccctcagcaggtaat

SEQ ID NO: 8465219 - DNA, 22 bp, Homo sapiens
ccagctcccattcttcacctgt

SEQ ID NO: 8465220 - DNA, 22 bp, Homo sapiens
ccagccagatgataagctctat

SEQ ID NO: 8465221 - DNA, 22 bp, Homo sapiens
ccagccagatgataagctctat

SEQ ID NO: 8465222 - DNA, 22 bp, Homo sapiens
ccagccagcaagctcccagttc

SEQ ID NO: 8465223 - DNA, 22 bp, Homo sapiens
ccagccagcaagctcccagttc

SEQ ID NO: 8465224 - DNA, 22 bp, Homo sapiens
ccagccagaagtccgggcttct

SEQ ID NO: 8465225 - DNA, 22 bp, Homo sapiens
ccagcagggaaaaacccaccaa

SEQ ID NO: 8465226 - DNA, 22 bp, Homo sapiens
ccagccactgggccactgccag

SEQ ID NO: 8465227 - DNA, 22 bp, Homo sapiens
ccagagtctatgagtcctcatt

SEQ ID NO: 8465228 - DNA, 22 bp, Homo sapiens
ccagagtctatgagtcctcatt

SEQ ID NO: 8465229 - DNA, 22 bp, Homo sapiens
ccagccagctggttggacgcct

SEQ ID NO: 8465230 - DNA, 22 bp, Homo sapiens
ccagccagctggttggacgcct

SEQ ID NO: 8465231 - DNA, 22 bp, Homo sapiens
ccagccagccttgatctgagta

SEQ ID NO: 8465232 - DNA, 22 bp, Homo sapiens
ccagccagcaagctcccagttc

SEQ ID NO: 8465233 - DNA, 22 bp, Homo sapiens
ccagccaggctggctgtggagg

SEQ ID NO: 8465234 - DNA, 22 bp, Homo sapiens
ccagccagtatattccaaagcc

SEQ ID NO: 8465235 - DNA, 22 bp, Homo sapiens
ccagccagggaaactttttctt

SEQ ID NO: 8465236 - DNA, 23 bp, Homo sapiens
ccagccctccaccagctctaggc

SEQ ID NO: 8465237 - DNA, 23 bp, Homo sapiens
ccagccctccaccagctctaggc

SEQ ID NO: 8465238 - DNA, 22 bp, Homo sapiens
ccagccctcctccatcagagga

SEQ ID NO: 8465239 - DNA, 22 bp, Homo sapiens
ccagccctgaaccctgctgcat

SEQ ID NO: 8465240 - DNA, 22 bp, Homo sapiens
ccagccctgaaccctgctgcat

SEQ ID NO: 8465241 - DNA, 22 bp, Homo sapiens
ccagccctcggtagtcccatag

SEQ ID NO: 8465242 - DNA, 22 bp, Homo sapiens
ccagccctcggtagtcccatag

SEQ ID NO: 8465243 - DNA, 22 bp, Homo sapiens
aggccctgacctgggagatcta

SEQ ID NO: 8465244 - DNA, 22 bp, Homo sapiens
aggccctgcccagagctcctcg

SEQ ID NO: 8465245 - DNA, 22 bp, Homo sapiens
aggccctgcccagagctcctcg

SEQ ID NO: 8465246 - DNA, 22 bp, Homo sapiens
aggccctgcccagagctcctcg

SEQ ID NO: 8465247 - DNA, 18 bp, Homo sapiens
ccagccctgcagcacctg

SEQ ID NO: 8465248 - DNA, 18 bp, Homo sapiens
ccagccctgcagcacctg

SEQ ID NO: 8465249 - DNA, 23 bp, Homo sapiens
aggccctgcctgtccctcttttt

SEQ ID NO: 8465250 - DNA, 22 bp, Homo sapiens
aggccctgcccagtgccacaag

SEQ ID NO: 8465251 - DNA, 22 bp, Homo sapiens
aggccctgcccagtgccacaag

SEQ ID NO: 8465252 - DNA, 22 bp, Homo sapiens
aggccctgcccagtgccacaag

SEQ ID NO: 8465253 - DNA, 22 bp, Homo sapiens
aggcaggtcacatgcttggcga

SEQ ID NO: 8465254 - DNA, 22 bp, Homo sapiens
ccactcccttccggtccagggc

SEQ ID NO: 8465255 - DNA, 20 bp, Homo sapiens
ccagagctgatggctgcccg

SEQ ID NO: 8465256 - DNA, 20 bp, Homo sapiens
ccagagctgatggctgcccg

SEQ ID NO: 8465257 - DNA, 22 bp, Homo sapiens
ccagaggatcagtactggctgg

SEQ ID NO: 8465258 - DNA, 20 bp, Homo sapiens
ccagagctgatggctgcccg

SEQ ID NO: 8465259 - DNA, 19 bp, Homo sapiens
aggcaggtgcagaggtccc

SEQ ID NO: 8465260 - DNA, 22 bp, Homo sapiens
ccagaggcagacttacactcca

SEQ ID NO: 8465261 - DNA, 22 bp, Homo sapiens
ccagaggcatgttcaaagcaat

SEQ ID NO: 8465262 - DNA, 22 bp, Homo sapiens
ccagaggtggtggtgtctagaa

SEQ ID NO: 8465263 - DNA, 22 bp, Homo sapiens
ccagaggttactttgccttgga

SEQ ID NO: 8465264 - DNA, 22 bp, Homo sapiens
ccagaggttactttgccttgga

SEQ ID NO: 8465265 - DNA, 22 bp, Homo sapiens
ccagaggttccaggctagggag

SEQ ID NO: 8465266 - DNA, 19 bp, Homo sapiens
ccagaggtttgctgggcct

SEQ ID NO: 8465267 - DNA, 22 bp, Homo sapiens
ccagagtcaggagctcatgtga

SEQ ID NO: 8465268 - DNA, 19 bp, Homo sapiens
ccagagtcatgtctccccc

SEQ ID NO: 8465269 - DNA, 22 bp, Homo sapiens
ccagaggctggcaagggctcct

SEQ ID NO: 8465270 - DNA, 22 bp, Homo sapiens
ccagaggtgctgggagaggtct

SEQ ID NO: 8465271 - DNA, 23 bp, Homo sapiens
ataaattactatctccctagagc

SEQ ID NO: 8465272 - DNA, 23 bp, Homo sapiens
ataaattactatctccctagagc

SEQ ID NO: 8465273 - DNA, 22 bp, Homo sapiens
ataaatgtgaattagagctttg

SEQ ID NO: 8465274 - DNA, 22 bp, Homo sapiens
ataacagagttgggaagtgaaa

SEQ ID NO: 8465275 - DNA, 22 bp, Homo sapiens
ataacagagagctactgaactg

SEQ ID NO: 8465276 - DNA, 22 bp, Homo sapiens
ataaattatgaatggccctttt

SEQ ID NO: 8465277 - DNA, 22 bp, Homo sapiens
ataaattaggatctggggttcc

SEQ ID NO: 8465278 - DNA, 22 bp, Homo sapiens
ataacctgtttcagacatttgt

SEQ ID NO: 8465279 - DNA, 22 bp, Homo sapiens
ataacctggtagtattaaatgt

SEQ ID NO: 8465280 - DNA, 22 bp, Homo sapiens
ataacatgacctgtgcttcaca

SEQ ID NO: 8465281 - DNA, 22 bp, Homo sapiens
ataacatggagtttgtcattta

SEQ ID NO: 8465282 - DNA, 22 bp, Homo sapiens
ataacatggagtttgtcattta

SEQ ID NO: 8465283 - DNA, 22 bp, Homo sapiens
ataacagatgtgaagtgctaat

SEQ ID NO: 8465284 - DNA, 20 bp, Homo sapiens
ctgccgaccacagccatgga

SEQ ID NO: 8465285 - DNA, 22 bp, Homo sapiens
ctgcctctcagcctgaccgcca

SEQ ID NO: 8465286 - DNA, 22 bp, Homo sapiens
ctgcctctcaggtccctgagat

SEQ ID NO: 8465287 - DNA, 22 bp, Homo sapiens
ctgcctctccccagagtggccc

SEQ ID NO: 8465288 - DNA, 22 bp, Homo sapiens
ataaatgattcagcaggaaata

SEQ ID NO: 8465289 - DNA, 22 bp, Homo sapiens
ataaatggctttcattcctagg

SEQ ID NO: 8465290 - DNA, 22 bp, Homo sapiens
ctgcctctgcgtcccacagagt

SEQ ID NO: 8465291 - DNA, 22 bp, Homo sapiens
ataaatgaacattcacagagct

SEQ ID NO: 8465292 - DNA, 22 bp, Homo sapiens
atacaactttacatgcaattcc

SEQ ID NO: 8465293 - DNA, 22 bp, Homo sapiens
atacaactgctctcagataagt

SEQ ID NO: 8465294 - DNA, 22 bp, Homo sapiens
ctgctgaggtatactatgtgac

SEQ ID NO: 8465295 - DNA, 22 bp, Homo sapiens
ctgctgaggccttccctgtcct

SEQ ID NO: 8465296 - DNA, 22 bp, Homo sapiens
ctgctgaggccttccctgtcct

SEQ ID NO: 8465297 - DNA, 22 bp, Homo sapiens
ctgctgcaactctttagagggt

SEQ ID NO: 8465298 - DNA, 22 bp, Homo sapiens
ctgctgaggtccttgctcagac

SEQ ID NO: 8465299 - DNA, 22 bp, Homo sapiens
ctgctgaggtccttgctcagac

SEQ ID NO: 8465300 - DNA, 22 bp, Homo sapiens
atacaaatttatagatgcattt

SEQ ID NO: 8465301 - DNA, 22 bp, Homo sapiens
atacaaagtattgatcctgagt

SEQ ID NO: 8465302 - DNA, 22 bp, Homo sapiens
ataacttattagattggagctg

SEQ ID NO: 8465303 - DNA, 22 bp, Homo sapiens
ataacttagagtaggcaaaagt

SEQ ID NO: 8465304 - DNA, 22 bp, Homo sapiens
ataacttaatgggtcatgctct

SEQ ID NO: 8465305 - DNA, 22 bp, Homo sapiens
ataagacacgccccactcactc

SEQ ID NO: 8465306 - DNA, 22 bp, Homo sapiens
ataagagctacagccagttctg

SEQ ID NO: 8465307 - DNA, 22 bp, Homo sapiens
ataagatgagatcagctttctg

SEQ ID NO: 8465308 - DNA, 22 bp, Homo sapiens
ataagaggaattacagaagagg

SEQ ID NO: 8465309 - DNA, 22 bp, Homo sapiens
ataagcatgattaccgggagca

SEQ ID NO: 8465310 - DNA, 22 bp, Homo sapiens
agttatcatcccttacactttg

SEQ ID NO: 8465311 - DNA, 22 bp, Homo sapiens
agttatcaggtgttttcatgga

SEQ ID NO: 8465312 - DNA, 22 bp, Homo sapiens
agttattactctttaacatatt

SEQ ID NO: 8465313 - DNA, 22 bp, Homo sapiens
agttatgtcctcagcaaatcaa

SEQ ID NO: 8465314 - DNA, 22 bp, Homo sapiens
agttatttactcctttgtctct

SEQ ID NO: 8465315 - DNA, 22 bp, Homo sapiens
agttatttactcctttgtctct

SEQ ID NO: 8465316 - DNA, 22 bp, Homo sapiens
ctgaggagccccctctcagcat

SEQ ID NO: 8465317 - DNA, 22 bp, Homo sapiens
ctgaggagcgttggtcacgtgt

SEQ ID NO: 8465318 - DNA, 22 bp, Homo sapiens
ctgaggagctgaaggccctcca

SEQ ID NO: 8465319 - DNA, 22 bp, Homo sapiens
ctgaggagctgaaggccctcca

SEQ ID NO: 8465320 - DNA, 22 bp, Homo sapiens
agttatatgtgaaaacacgtat

SEQ ID NO: 8465321 - DNA, 22 bp, Homo sapiens
ctgaggagatccccccagaagt

SEQ ID NO: 8465322 - DNA, 22 bp, Homo sapiens
ctgaggagatgggctttttagg

SEQ ID NO: 8465323 - DNA, 22 bp, Homo sapiens
ctgaggagatgataatgtcatt

SEQ ID NO: 8465324 - DNA, 22 bp, Homo sapiens
ctgaggagcaaccccgtgccct

SEQ ID NO: 8465325 - DNA, 22 bp, Homo sapiens
ctgaggagcaaccccgtgccct

SEQ ID NO: 8465326 - DNA, 22 bp, Homo sapiens
ctgaggagcagctggcccgcta

SEQ ID NO: 8465327 - DNA, 22 bp, Homo sapiens
ctgcaaggctgaattcagctga

SEQ ID NO: 8465328 - DNA, 22 bp, Homo sapiens
ctgcaactctctccagaggctg

SEQ ID NO: 8465329 - DNA, 22 bp, Homo sapiens
ctgcaatatgatgtctgagaaa

SEQ ID NO: 8465330 - DNA, 22 bp, Homo sapiens
ctgcaatagtttagaataattg

SEQ ID NO: 8465331 - DNA, 22 bp, Homo sapiens
ctgcaatctccatgcttgattt

SEQ ID NO: 8465332 - DNA, 22 bp, Homo sapiens
ctgcaaggtatatgttatcata

SEQ ID NO: 8465333 - DNA, 22 bp, Homo sapiens
ctgatccagagccaaccaaggc

SEQ ID NO: 8465334 - DNA, 22 bp, Homo sapiens
ctgcaaataggggtgtgaataa

SEQ ID NO: 8465335 - DNA, 22 bp, Homo sapiens
ctgcaaatcaagttcttataat

SEQ ID NO: 8465336 - DNA, 22 bp, Homo sapiens
ctgcaaatcaagttcttataat

SEQ ID NO: 8465337 - DNA, 23 bp, Homo sapiens
ctgcaactcagtctggagcagtt

SEQ ID NO: 8465338 - DNA, 22 bp, Homo sapiens
ctgcagggtttttcaaggacaa

SEQ ID NO: 8465339 - DNA, 22 bp, Homo sapiens
ctgcagggtttttcaaggacaa

SEQ ID NO: 8465340 - DNA, 22 bp, Homo sapiens
ctgcagggtttttcaaggacaa

SEQ ID NO: 8465341 - DNA, 22 bp, Homo sapiens
ctgcagggttttaacaatggac

SEQ ID NO: 8465342 - DNA, 22 bp, Homo sapiens
ctgcagggttttaacaatggac

SEQ ID NO: 8465343 - DNA, 22 bp, Homo sapiens
ctgcagggttttaacaatggac

SEQ ID NO: 8465344 - DNA, 22 bp, Homo sapiens
ctgcagggttcggagagttccc

SEQ ID NO: 8465345 - DNA, 22 bp, Homo sapiens
ctgcagggtttcgccagttgtg

SEQ ID NO: 8465346 - DNA, 22 bp, Homo sapiens
ctgcagggtttcgccagttgtg

SEQ ID NO: 8465347 - DNA, 20 bp, Homo sapiens
ctgcagggttagaggctcca

SEQ ID NO: 8465348 - DNA, 22 bp, Homo sapiens
ctgcagggttcggagagttccc

SEQ ID NO: 8465349 - DNA, 22 bp, Homo sapiens
ctgcagggttcggagagttccc

SEQ ID NO: 8465350 - DNA, 21 bp, Homo sapiens
ctgcatctcatagaacatgtc

SEQ ID NO: 8465351 - DNA, 21 bp, Homo sapiens
ctgcatctgagtcattatgcc

SEQ ID NO: 8465352 - DNA, 22 bp, Homo sapiens
ctgcatctgcataatcaacttc

SEQ ID NO: 8465353 - DNA, 22 bp, Homo sapiens
ctgcatctgttagattatcacc

SEQ ID NO: 8465354 - DNA, 22 bp, Homo sapiens
ctgcatcttagtcaaaatctgt

SEQ ID NO: 8465355 - DNA, 22 bp, Homo sapiens
ctgcatcttagtcaaaatctgt

SEQ ID NO: 8465356 - DNA, 22 bp, Homo sapiens
ctgcatgtcactctgctgtccc

SEQ ID NO: 8465357 - DNA, 22 bp, Homo sapiens
ctgcaggggtgtcctgtattgg

SEQ ID NO: 8465358 - DNA, 22 bp, Homo sapiens
ctgcagggtgacgttgcccacc

SEQ ID NO: 8465359 - DNA, 22 bp, Homo sapiens
ctgcagggtgacgttgcccacc

SEQ ID NO: 8465360 - DNA, 20 bp, Homo sapiens
ctgcagggtgagtgggcgat

SEQ ID NO: 8465361 - DNA, 20 bp, Homo sapiens
ctgcagggtgagtgggcgat

SEQ ID NO: 8465362 - DNA, 20 bp, Homo sapiens
ctgcagggttagaggctcca

SEQ ID NO: 8465363 - DNA, 20 bp, Homo sapiens
ctgcagggttagaggctcca

SEQ ID NO: 8465364 - DNA, 20 bp, Homo sapiens
ctgcagggtgagtgggcgat

SEQ ID NO: 8465365 - DNA, 22 bp, Homo sapiens
ctgcagagatgaagaaggtggc

SEQ ID NO: 8465366 - DNA, 22 bp, Homo sapiens
ctgcaggggtgtcctgtattgg

SEQ ID NO: 8465367 - DNA, 23 bp, Homo sapiens
ctgcagagaactgagggacagcc

SEQ ID NO: 8465368 - DNA, 22 bp, Homo sapiens
ctgcagagaattgtggggcttc

SEQ ID NO: 8465369 - DNA, 22 bp, Homo sapiens
ctgcagagagtgccgggcagcc

SEQ ID NO: 8465370 - DNA, 22 bp, Homo sapiens
ctgcagagatgaagaaggtggc

SEQ ID NO: 8465371 - DNA, 22 bp, Homo sapiens
ctgcagagatgaagaaggtggc

SEQ ID NO: 8465372 - DNA, 22 bp, Homo sapiens
ctgcagagatgaagaaggtggc

SEQ ID NO: 8465373 - DNA, 22 bp, Homo sapiens
ctgcagagacctaggtcaggtt

SEQ ID NO: 8465374 - DNA, 22 bp, Homo sapiens
ctgcagagagtgccgggcagcc

SEQ ID NO: 8465375 - DNA, 22 bp, Homo sapiens
ctgcagagagtaactgaaatat

SEQ ID NO: 8465376 - DNA, 20 bp, Homo sapiens
atacagtaggtgctcaatat

SEQ ID NO: 8465377 - DNA, 22 bp, Homo sapiens
atacagtataactaataaaccc

SEQ ID NO: 8465378 - DNA, 22 bp, Homo sapiens
atacagtataactaataaaccc

SEQ ID NO: 8465379 - DNA, 22 bp, Homo sapiens
atacagtataactaataaaccc

SEQ ID NO: 8465380 - DNA, 17 bp, Homo sapiens
atacagtttattttaca

SEQ ID NO: 8465381 - DNA, 17 bp, Homo sapiens
atacagtttattttaca

SEQ ID NO: 8465382 - DNA, 22 bp, Homo sapiens
atacatagatagataatctggc

SEQ ID NO: 8465383 - DNA, 22 bp, Homo sapiens
atacatagcagggtagtagatc

SEQ ID NO: 8465384 - DNA, 17 bp, Homo sapiens
atacattgttaaagtat

SEQ ID NO: 8465385 - DNA, 22 bp, Homo sapiens
atacatgttcgtgtacatgttc

SEQ ID NO: 8465386 - DNA, 22 bp, Homo sapiens
atacgccataggctcctcactt

SEQ ID NO: 8465387 - DNA, 22 bp, Homo sapiens
atacctgtgtatccacaagcgt

SEQ ID NO: 8465388 - DNA, 22 bp, Homo sapiens
ataccatttccatgttacatta

SEQ ID NO: 8465389 - DNA, 22 bp, Homo sapiens
ataccatttccatgttacatta

SEQ ID NO: 8465390 - DNA, 22 bp, Homo sapiens
ataccatttccatgttacatta

SEQ ID NO: 8465391 - DNA, 22 bp, Homo sapiens
ctggagagaatgtggaatgatt

SEQ ID NO: 8465392 - DNA, 22 bp, Homo sapiens
ctggagacctctcctgagagtg

SEQ ID NO: 8465393 - DNA, 22 bp, Homo sapiens
ctggagacctctcctgagagtg

SEQ ID NO: 8465394 - DNA, 22 bp, Homo sapiens
atacagtaatttgtaactcatc

SEQ ID NO: 8465395 - DNA, 22 bp, Homo sapiens
atacagtaatttgtaactcatc

SEQ ID NO: 8465396 - DNA, 22 bp, Homo sapiens
atacagtaatttgtaactcatc

SEQ ID NO: 8465397 - DNA, 22 bp, Homo sapiens
atacagtagacaatctcatgaa

SEQ ID NO: 8465398 - DNA, 22 bp, Homo sapiens
atacagtagggaccatgtctga

SEQ ID NO: 8465399 - DNA, 22 bp, Homo sapiens
ctggaatctttggagaatgtgg

SEQ ID NO: 8465400 - DNA, 22 bp, Homo sapiens
ctgctgccaagggtgccacagg

SEQ ID NO: 8465401 - DNA, 22 bp, Homo sapiens
ctgctgccattagggcacagac

SEQ ID NO: 8465402 - DNA, 22 bp, Homo sapiens
ctgctgccattagggcacagac

SEQ ID NO: 8465403 - DNA, 22 bp, Homo sapiens
ctggaagactcaatggcctgcc

SEQ ID NO: 8465404 - DNA, 22 bp, Homo sapiens
atagcactggtttttcttggtt

SEQ ID NO: 8465405 - DNA, 22 bp, Homo sapiens
atagcacaatattacctttatg

SEQ ID NO: 8465406 - DNA, 22 bp, Homo sapiens
atagcaatttgcccaattacct

SEQ ID NO: 8465407 - DNA, 22 bp, Homo sapiens
atagcaaatattttaatgagca

SEQ ID NO: 8465408 - DNA, 22 bp, Homo sapiens
atagcaattaagctccagaatt

SEQ ID NO: 8465409 - DNA, 22 bp, Homo sapiens
ctggctggcagatgctcttgct

SEQ ID NO: 8465410 - DNA, 22 bp, Homo sapiens
ctggctggccatgcagcgccag

SEQ ID NO: 8465411 - DNA, 22 bp, Homo sapiens
ctggctggccatgcagcgccag

SEQ ID NO: 8465412 - DNA, 22 bp, Homo sapiens
ctggctggccatgtagagatga

SEQ ID NO: 8465413 - DNA, 22 bp, Homo sapiens
ctggctggccatgtagagatga

SEQ ID NO: 8465414 - DNA, 22 bp, Homo sapiens
ctggctgcagctccgaggaaga

SEQ ID NO: 8465415 - DNA, 19 bp, Homo sapiens
ctggctgcaatgccagggt

SEQ ID NO: 8465416 - DNA, 22 bp, Homo sapiens
ctggctggcaagtagaacacaa

SEQ ID NO: 8465417 - DNA, 22 bp, Homo sapiens
ctggctccattactcagcatct

SEQ ID NO: 8465418 - DNA, 22 bp, Homo sapiens
ctggctcccagctttcagggag

SEQ ID NO: 8465419 - DNA, 22 bp, Homo sapiens
ctggctcccgaagccctcagtg

SEQ ID NO: 8465420 - DNA, 22 bp, Homo sapiens
ctggctcccatgagctctcacg

SEQ ID NO: 8465421 - DNA, 22 bp, Homo sapiens
ctggctcccatgagctctcacg

SEQ ID NO: 8465422 - DNA, 22 bp, Homo sapiens
ctggctcccggggatcgagcac

SEQ ID NO: 8465423 - DNA, 22 bp, Homo sapiens
ctggctcccgtctggtggccat

SEQ ID NO: 8465424 - DNA, 22 bp, Homo sapiens
ctggctcccgtctggtggccat

SEQ ID NO: 8465425 - DNA, 22 bp, Homo sapiens
ctggctcccgaagccctcagtg

SEQ ID NO: 8465426 - DNA, 22 bp, Homo sapiens
ctggctccatcactgggtgatg

SEQ ID NO: 8465427 - DNA, 22 bp, Homo sapiens
ctggctccatcactgggtgatg

SEQ ID NO: 8465428 - DNA, 22 bp, Homo sapiens
ctggctcacctccgctccagca

SEQ ID NO: 8465429 - DNA, 22 bp, Homo sapiens
ctggctcacctccgctccagca

SEQ ID NO: 8465430 - DNA, 22 bp, Homo sapiens
ctggctccattactcagcatct

SEQ ID NO: 8465431 - DNA, 22 bp, Homo sapiens
ctggctccattactcagcatct

SEQ ID NO: 8465432 - DNA, 22 bp, Homo sapiens
ctggctccatctttgcttcctg

SEQ ID NO: 8465433 - DNA, 22 bp, Homo sapiens
ctggctccatctttgcttcctg

SEQ ID NO: 8465434 - DNA, 22 bp, Homo sapiens
ctggctccatccttgagctctg

SEQ ID NO: 8465435 - DNA, 22 bp, Homo sapiens
atagcaaactggagcttgcttt

SEQ ID NO: 8465436 - DNA, 22 bp, Homo sapiens
atagcaaactggcagcttgtgg

SEQ ID NO: 8465437 - DNA, 22 bp, Homo sapiens
atagcaaactggcagcttgtgg

SEQ ID NO: 8465438 - DNA, 22 bp, Homo sapiens
atagcaaactggcagcttgtgg

SEQ ID NO: 8465439 - DNA, 22 bp, Homo sapiens
atagcaaaaatgaacaaagctt

SEQ ID NO: 8465440 - DNA, 22 bp, Homo sapiens
atagcaaaaatgaacaaagctt

SEQ ID NO: 8465441 - DNA, 22 bp, Homo sapiens
atagcaaaacccactgcattac

SEQ ID NO: 8465442 - DNA, 22 bp, Homo sapiens
ctggcccagttctgcgttttgc

SEQ ID NO: 8465443 - DNA, 22 bp, Homo sapiens
atagcaaagatgtcaattcccc

SEQ ID NO: 8465444 - DNA, 22 bp, Homo sapiens
atagcaaagatcacttccttga

SEQ ID NO: 8465445 - DNA, 22 bp, Homo sapiens
atagcaaagatcacttccttga

SEQ ID NO: 8465446 - DNA, 20 bp, Homo sapiens
ctggcccatctaccgctctg

SEQ ID NO: 8465447 - DNA, 22 bp, Homo sapiens
ctggcccatggtgagctctggg

SEQ ID NO: 8465448 - DNA, 22 bp, Homo sapiens
ctggcccatggtgagctctggg

SEQ ID NO: 8465449 - DNA, 22 bp, Homo sapiens
ctggcccattgccttctctctc

SEQ ID NO: 8465450 - DNA, 22 bp, Homo sapiens
ctggcccatggtgagctctggg

SEQ ID NO: 8465451 - DNA, 22 bp, Homo sapiens
ctggccccaggcagcctgctgg

SEQ ID NO: 8465452 - DNA, 22 bp, Homo sapiens
ctggccccaggcagcctgctgg

SEQ ID NO: 8465453 - DNA, 22 bp, Homo sapiens
ctggccccaggcagcctgctgg

SEQ ID NO: 8465454 - DNA, 22 bp, Homo sapiens
atactacactatgcatggatgt

SEQ ID NO: 8465455 - DNA, 22 bp, Homo sapiens
atactacatttgaaaattgcag

SEQ ID NO: 8465456 - DNA, 21 bp, Homo sapiens
atactacatttctctgacttt

SEQ ID NO: 8465457 - DNA, 22 bp, Homo sapiens
atactacacattgactatattt

SEQ ID NO: 8465458 - DNA, 22 bp, Homo sapiens
atactacaatcataattgtaca

SEQ ID NO: 8465459 - DNA, 22 bp, Homo sapiens
atactacaatcataattgtaca

SEQ ID NO: 8465460 - DNA, 22 bp, Homo sapiens
atactacaatcataattgtaca

SEQ ID NO: 8465461 - DNA, 22 bp, Homo sapiens
atagatgttcaatcagatattt

SEQ ID NO: 8465462 - DNA, 22 bp, Homo sapiens
atagagctataagaattttgtg

SEQ ID NO: 8465463 - DNA, 22 bp, Homo sapiens
atagatgtgtgtaagtacataa

SEQ ID NO: 8465464 - DNA, 22 bp, Homo sapiens
atagatgttttagtaatactgt

SEQ ID NO: 8465465 - DNA, 22 bp, Homo sapiens
atagattagccctatagtttta

SEQ ID NO: 8465466 - DNA, 22 bp, Homo sapiens
atagattatttgctcattactt

SEQ ID NO: 8465467 - DNA, 22 bp, Homo sapiens
atagatttgaatttaagacttg

SEQ ID NO: 8465468 - DNA, 22 bp, Homo sapiens
atagcaaaaatgaacaaagctt

SEQ ID NO: 8465469 - DNA, 22 bp, Homo sapiens
atattaggtgctcaatacatgc

SEQ ID NO: 8465470 - DNA, 22 bp, Homo sapiens
atattaggcaaggagattattt

SEQ ID NO: 8465471 - DNA, 22 bp, Homo sapiens
atattagggtctctaaattcta

SEQ ID NO: 8465472 - DNA, 22 bp, Homo sapiens
atattataagttatttcaagtt

SEQ ID NO: 8465473 - DNA, 22 bp, Homo sapiens
atattagtttggagactacaat

SEQ ID NO: 8465474 - DNA, 22 bp, Homo sapiens
atattaggagttaaatgtatta

SEQ ID NO: 8465475 - DNA, 22 bp, Homo sapiens
atattactctgatttagtaaat

SEQ ID NO: 8465476 - DNA, 22 bp, Homo sapiens
atattacataaacatgagtgaa

SEQ ID NO: 8465477 - DNA, 22 bp, Homo sapiens
atattacataaacatgagtgaa

SEQ ID NO: 8465478 - DNA, 22 bp, Homo sapiens
atattacataaacatgagtgaa

SEQ ID NO: 8465479 - DNA, 22 bp, Homo sapiens
atatgtttttggaaagaacaca

SEQ ID NO: 8465480 - DNA, 19 bp, Homo sapiens
ctgggctgaggtctgcctt

SEQ ID NO: 8465481 - DNA, 22 bp, Homo sapiens
atattcactgggtactaaaaag

SEQ ID NO: 8465482 - DNA, 22 bp, Homo sapiens
ctgggctctgcggtgtcgctct

SEQ ID NO: 8465483 - DNA, 22 bp, Homo sapiens
ctgggctctgcggtgtcgctct

SEQ ID NO: 8465484 - DNA, 22 bp, Homo sapiens
ctgggctctgcggtgtcgctct

SEQ ID NO: 8465485 - DNA, 22 bp, Homo sapiens
ctgggctctgtgtttcagtttc

SEQ ID NO: 8465486 - DNA, 22 bp, Homo sapiens
ctgggctcttcccagatccaga

SEQ ID NO: 8465487 - DNA, 22 bp, Homo sapiens
ctgggctctggggtcccggtgc

SEQ ID NO: 8465488 - DNA, 22 bp, Homo sapiens
ctgggctcttctcaccctgttt

SEQ ID NO: 8465489 - DNA, 22 bp, Homo sapiens
ctgggctcacctgtggctggca

SEQ ID NO: 8465490 - DNA, 22 bp, Homo sapiens
ctgggctcacctgtggctggca

SEQ ID NO: 8465491 - DNA, 22 bp, Homo sapiens
ctgggctcacctgtggctggca

SEQ ID NO: 8465492 - DNA, 20 bp, Homo sapiens
ctgggctcaagtgatcctcc

SEQ ID NO: 8465493 - DNA, 20 bp, Homo sapiens
ctgggctcaagtgatcctcc

SEQ ID NO: 8465494 - DNA, 20 bp, Homo sapiens
ctgggctcaagtgatcctcc

SEQ ID NO: 8465495 - DNA, 22 bp, Homo sapiens
atatgcagtctcttgcccttct

SEQ ID NO: 8465496 - DNA, 22 bp, Homo sapiens
atatgcagtctcttgcccttct

SEQ ID NO: 8465497 - DNA, 22 bp, Homo sapiens
ctgggcctggggctgttgagag

SEQ ID NO: 8465498 - DNA, 22 bp, Homo sapiens
ctggcttctgggccagggcaga

SEQ ID NO: 8465499 - DNA, 22 bp, Homo sapiens
ctgggcctggtagggcttgaaa

SEQ ID NO: 8465500 - DNA, 22 bp, Homo sapiens
ctgggctcaagaagtcttccct

SEQ ID NO: 8465501 - DNA, 20 bp, Homo sapiens
ctgggctcaagtgagcctcc

SEQ ID NO: 8465502 - DNA, 20 bp, Homo sapiens
ctgggctcaagtgagcctcc

SEQ ID NO: 8465503 - DNA, 21 bp, Homo sapiens
ctgggctcaagcaatcctttc

SEQ ID NO: 8465504 - DNA, 22 bp, Homo sapiens
ctgggctcaagtgatccaccca

SEQ ID NO: 8465505 - DNA, 20 bp, Homo sapiens
ctgggctcaagtgatcctcc

SEQ ID NO: 8465506 - DNA, 22 bp, Homo sapiens
ctggctggccggagcgaggcgg

SEQ ID NO: 8465507 - DNA, 22 bp, Homo sapiens
ctggctggccggaggcatccct

SEQ ID NO: 8465508 - DNA, 22 bp, Homo sapiens
ctggctgggaagtagagtaggt

SEQ ID NO: 8465509 - DNA, 22 bp, Homo sapiens
ctggctggcgttttccaaaagc

SEQ ID NO: 8465510 - DNA, 22 bp, Homo sapiens
ctggctgggagcgagctgctca

SEQ ID NO: 8465511 - DNA, 22 bp, Homo sapiens
ctggctgtgtccacagagtaag

SEQ ID NO: 8465512 - DNA, 22 bp, Homo sapiens
ctggctgtggtcacaggtaact

SEQ ID NO: 8465513 - DNA, 22 bp, Homo sapiens
ctggctgggagcgagctgctca

SEQ ID NO: 8465514 - DNA, 22 bp, Homo sapiens
ctggctgggagcgagctgctca

SEQ ID NO: 8465515 - DNA, 22 bp, Homo sapiens
ctggcttccctgtcttatggaa

SEQ ID NO: 8465516 - DNA, 22 bp, Homo sapiens
ctggcttccctgtcttatggaa

SEQ ID NO: 8465517 - DNA, 22 bp, Homo sapiens
ctggcttccatgctgtagtggc

SEQ ID NO: 8465518 - DNA, 22 bp, Homo sapiens
ctggcttcctgagtccattacc

SEQ ID NO: 8465519 - DNA, 22 bp, Homo sapiens
ctggcttcctcaggagcagtgg

SEQ ID NO: 8465520 - DNA, 20 bp, Homo sapiens
ctggcttcgggaactagttt

SEQ ID NO: 8465521 - DNA, 22 bp, Homo sapiens
ctggcttccatgctgtagtggc

SEQ ID NO: 8465522 - DNA, 22 bp, Homo sapiens
ctggcttccaccatggcccctg

SEQ ID NO: 8465523 - DNA, 22 bp, Homo sapiens
ctggcttccaccatggcccctg

SEQ ID NO: 8465524 - DNA, 22 bp, Homo sapiens
ctggcttcagctgccatcaatg

SEQ ID NO: 8465525 - DNA, 19 bp, Homo sapiens
ctggcttcaagcagtcctc

SEQ ID NO: 8465526 - DNA, 19 bp, Homo sapiens
ctggcttcaagcagtcctc

SEQ ID NO: 8465527 - DNA, 22 bp, Homo sapiens
ctggctgtttcaggcagtgtcc

SEQ ID NO: 8465528 - DNA, 22 bp, Homo sapiens
ctggctgtgtcttggaggagct

SEQ ID NO: 8465529 - DNA, 22 bp, Homo sapiens
atcaaatcattgcattaatgtt

SEQ ID NO: 8465530 - DNA, 23 bp, Homo sapiens
atcaaatgattggccattcagtg

SEQ ID NO: 8465531 - DNA, 23 bp, Homo sapiens
atcaaatgattggccattcagtg

SEQ ID NO: 8465532 - DNA, 22 bp, Homo sapiens
atcaaataaaggtacctagctt

SEQ ID NO: 8465533 - DNA, 22 bp, Homo sapiens
atcaacatgaatttctctgaag

SEQ ID NO: 8465534 - DNA, 22 bp, Homo sapiens
atcacattgccagtgattaccc

SEQ ID NO: 8465535 - DNA, 22 bp, Homo sapiens
atcacattgccagtgattaccc

SEQ ID NO: 8465536 - DNA, 22 bp, Homo sapiens
atcagaaaggtgggcaagcaga

SEQ ID NO: 8465537 - DNA, 22 bp, Homo sapiens
atcagaaagttcatcatgtttg

SEQ ID NO: 8465538 - DNA, 22 bp, Homo sapiens
atcagaaatctaggattcagaa

SEQ ID NO: 8465539 - DNA, 22 bp, Homo sapiens
atcagaaatagtcatgttactt

SEQ ID NO: 8465540 - DNA, 22 bp, Homo sapiens
atcagaaaaacataatgttatt

SEQ ID NO: 8465541 - DNA, 22 bp, Homo sapiens
atcagaaaaacataatgttatt

SEQ ID NO: 8465542 - DNA, 22 bp, Homo sapiens
atatttaactggtcccaatata

SEQ ID NO: 8465543 - DNA, 22 bp, Homo sapiens
atcaaagtggttttctgtgctt

SEQ ID NO: 8465544 - DNA, 22 bp, Homo sapiens
atcaaagtgaaaagtgctgatg

SEQ ID NO: 8465545 - DNA, 22 bp, Homo sapiens
atcaaagtgatttgtaaacagg

SEQ ID NO: 8465546 - DNA, 22 bp, Homo sapiens
atcaaagtgatttgtaaacagg

SEQ ID NO: 8465547 - DNA, 22 bp, Homo sapiens
atcaaagtaattaacactgaga

SEQ ID NO: 8465548 - DNA, 20 bp, Homo sapiens
atcaaaggctgattcagtcc

SEQ ID NO: 8465549 - DNA, 22 bp, Homo sapiens
atatttaaacagggtaccaata

SEQ ID NO: 8465550 - DNA, 22 bp, Homo sapiens
atattgttagtaatatttcgaa

SEQ ID NO: 8465551 - DNA, 22 bp, Homo sapiens
atattgttgactataagagtaa

SEQ ID NO: 8465552 - DNA, 22 bp, Homo sapiens
atattgtactagggttacatgt

SEQ ID NO: 8465553 - DNA, 22 bp, Homo sapiens
atattgaaccctacagactgta

SEQ ID NO: 8465554 - DNA, 22 bp, Homo sapiens
atattgatcttggaactgattt

SEQ ID NO: 8465555 - DNA, 22 bp, Homo sapiens
cttagagccttactcttcttgt

SEQ ID NO: 8465556 - DNA, 22 bp, Homo sapiens
cttagagcttaggctagccatt

SEQ ID NO: 8465557 - DNA, 22 bp, Homo sapiens
cttagagcttaggctagccatt

SEQ ID NO: 8465558 - DNA, 22 bp, Homo sapiens
cttagagttatggaaatgttga

SEQ ID NO: 8465559 - DNA, 22 bp, Homo sapiens
cttagatgaagtcacagaaccc

SEQ ID NO: 8465560 - DNA, 22 bp, Homo sapiens
cttcattaatgtctataagttt

SEQ ID NO: 8465561 - DNA, 22 bp, Homo sapiens
cttcattaatgtctataagttt

SEQ ID NO: 8465562 - DNA, 22 bp, Homo sapiens
cttccaggtgctggcctggcct

SEQ ID NO: 8465563 - DNA, 22 bp, Homo sapiens
cttcattaactattggaatgca

SEQ ID NO: 8465564 - DNA, 22 bp, Homo sapiens
cttcattaaccaaaatgcaata

SEQ ID NO: 8465565 - DNA, 22 bp, Homo sapiens
cttagacatggcagctccaagt

SEQ ID NO: 8465566 - DNA, 22 bp, Homo sapiens
cttagaattttgcctactacaa

SEQ ID NO: 8465567 - DNA, 22 bp, Homo sapiens
cttagaataaaagggggctata

SEQ ID NO: 8465568 - DNA, 22 bp, Homo sapiens
cttagaagtgggctataattag

SEQ ID NO: 8465569 - DNA, 22 bp, Homo sapiens
cttagaatgtctactcttacca

SEQ ID NO: 8465570 - DNA, 22 bp, Homo sapiens
cttagaattttaatccagaaag

SEQ ID NO: 8465571 - DNA, 22 bp, Homo sapiens
cttagaatgggacccaatgggt

SEQ ID NO: 8465572 - DNA, 22 bp, Homo sapiens
atcctgtggctccagggagccg

SEQ ID NO: 8465573 - DNA, 22 bp, Homo sapiens
atcctgtgcaatgactgcatct

SEQ ID NO: 8465574 - DNA, 22 bp, Homo sapiens
atcctgtggggcggctgcaggg

SEQ ID NO: 8465575 - DNA, 22 bp, Homo sapiens
atcctgtggggcggctgcaggg

SEQ ID NO: 8465576 - DNA, 20 bp, Homo sapiens
cttagaaatttttaccctgg

SEQ ID NO: 8465577 - DNA, 20 bp, Homo sapiens
cttagaaatttttaccctgg

SEQ ID NO: 8465578 - DNA, 20 bp, Homo sapiens
cttagaaatttttaccctgg

SEQ ID NO: 8465579 - DNA, 22 bp, Homo sapiens
cttagaacagtgtctgccagag

SEQ ID NO: 8465580 - DNA, 22 bp, Homo sapiens
cttagaacatacttagtgtgat

SEQ ID NO: 8465581 - DNA, 22 bp, Homo sapiens
cttagaaattgttactcattca

SEQ ID NO: 8465582 - DNA, 22 bp, Homo sapiens
cttagaaattgttactcattca

SEQ ID NO: 8465583 - DNA, 22 bp, Homo sapiens
cttagaaattgttactcattca

SEQ ID NO: 8465584 - DNA, 22 bp, Homo sapiens
cttagaaattgttactcattca

SEQ ID NO: 8465585 - DNA, 20 bp, Homo sapiens
cttagaagggacatcctggg

SEQ ID NO: 8465586 - DNA, 22 bp, Homo sapiens
cttagaaggaacagtttagtgc

SEQ ID NO: 8465587 - DNA, 22 bp, Homo sapiens
cttagaagaatgcctaggacag

SEQ ID NO: 8465588 - DNA, 22 bp, Homo sapiens
cttagaacattctgcctgggaa

SEQ ID NO: 8465589 - DNA, 18 bp, Homo sapiens
cttagaacatcattcctt

SEQ ID NO: 8465590 - DNA, 17 bp, Homo sapiens
cttcccaccatctcctg

SEQ ID NO: 8465591 - DNA, 22 bp, Homo sapiens
cttcccaccaaagcccttgttg

SEQ ID NO: 8465592 - DNA, 22 bp, Homo sapiens
cttcccactaaagcccttgttg

SEQ ID NO: 8465593 - DNA, 22 bp, Homo sapiens
cttcccaagtaaatttgtattt

SEQ ID NO: 8465594 - DNA, 22 bp, Homo sapiens
cttccatacagacaatgcaatg

SEQ ID NO: 8465595 - DNA, 22 bp, Homo sapiens
cttccataatcttgtttattta

SEQ ID NO: 8465596 - DNA, 22 bp, Homo sapiens
cttccagtggcaccaacatgca

SEQ ID NO: 8465597 - DNA, 22 bp, Homo sapiens
cttccagtctagagctatctgt

SEQ ID NO: 8465598 - DNA, 22 bp, Homo sapiens
cttccagtagtatcattctcat

SEQ ID NO: 8465599 - DNA, 22 bp, Homo sapiens
cttccaggttctggttgggaag

SEQ ID NO: 8465600 - DNA, 22 bp, Homo sapiens
cttcctcatgtgcaatgcaagc

SEQ ID NO: 8465601 - DNA, 18 bp, Homo sapiens
cttcctcatcgctctccc

SEQ ID NO: 8465602 - DNA, 22 bp, Homo sapiens
cttcctcacggtgcaacaggaa

SEQ ID NO: 8465603 - DNA, 22 bp, Homo sapiens
cttcctcaggcattagctggac

SEQ ID NO: 8465604 - DNA, 22 bp, Homo sapiens
cttcccactagtatcacagagc

SEQ ID NO: 8465605 - DNA, 22 bp, Homo sapiens
cttcccagaacaatgtaggctt

SEQ ID NO: 8465606 - DNA, 22 bp, Homo sapiens
cttcccagaacaatgtaggctt

SEQ ID NO: 8465607 - DNA, 21 bp, Homo sapiens
atctgaagtttgagaggaaag

SEQ ID NO: 8465608 - DNA, 22 bp, Homo sapiens
atctgaaagctaggagttctca

SEQ ID NO: 8465609 - DNA, 21 bp, Homo sapiens
atctgaaaggttagtgttgag

SEQ ID NO: 8465610 - DNA, 22 bp, Homo sapiens
atctgaagaggtcatggctgac

SEQ ID NO: 8465611 - DNA, 23 bp, Homo sapiens
atctgaaaagcatttgcagtttg

SEQ ID NO: 8465612 - DNA, 22 bp, Homo sapiens
atctctgcgtccccagcatcga

SEQ ID NO: 8465613 - DNA, 22 bp, Homo sapiens
atctctgcatccctcaaggttg

SEQ ID NO: 8465614 - DNA, 22 bp, Homo sapiens
cttcctcccggcccatgctctg

SEQ ID NO: 8465615 - DNA, 22 bp, Homo sapiens
cttcttaatgacagattaaaat

SEQ ID NO: 8465616 - DNA, 21 bp, Homo sapiens
cttcttggggagcagctagac

SEQ ID NO: 8465617 - DNA, 22 bp, Homo sapiens
cttcttgtatctgccgccgagc

SEQ ID NO: 8465618 - DNA, 22 bp, Homo sapiens
atctgaggtatatgactggcta

SEQ ID NO: 8465619 - DNA, 22 bp, Homo sapiens
atctgagtctctgacagcatgt

SEQ ID NO: 8465620 - DNA, 22 bp, Homo sapiens
atctgcaggaatgtgtgcagag

SEQ ID NO: 8465621 - DNA, 22 bp, Homo sapiens
atctgattcattgaaatgggtg

SEQ ID NO: 8465622 - DNA, 19 bp, Homo sapiens
atctgaggcctcatctggg

SEQ ID NO: 8465623 - DNA, 19 bp, Homo sapiens
atctgagattataaacaga

SEQ ID NO: 8465624 - DNA, 22 bp, Homo sapiens
atctgagactgagtttggattt

SEQ ID NO: 8465625 - DNA, 22 bp, Homo sapiens
atctgagactgagtttggattt

SEQ ID NO: 8465626 - DNA, 22 bp, Homo sapiens
ctgtgggagaggtgcctggatt

SEQ ID NO: 8465627 - DNA, 22 bp, Homo sapiens
atccaggcctgagtctggtcct

SEQ ID NO: 8465628 - DNA, 22 bp, Homo sapiens
atccaggcattctgacttcaag

SEQ ID NO: 8465629 - DNA, 22 bp, Homo sapiens
atccaggcttaatgggagccac

SEQ ID NO: 8465630 - DNA, 22 bp, Homo sapiens
atccaggctgctatgaggatga

SEQ ID NO: 8465631 - DNA, 22 bp, Homo sapiens
atccaggctgctttctatgccc

SEQ ID NO: 8465632 - DNA, 22 bp, Homo sapiens
atccaggctgggtgtggctact

SEQ ID NO: 8465633 - DNA, 22 bp, Homo sapiens
atccagttccaaagatcattta

SEQ ID NO: 8465634 - DNA, 22 bp, Homo sapiens
atccagttctcagtgcttacag

SEQ ID NO: 8465635 - DNA, 22 bp, Homo sapiens
atccatataggcagatggcaca

SEQ ID NO: 8465636 - DNA, 22 bp, Homo sapiens
atccatatctggactctacccc

SEQ ID NO: 8465637 - DNA, 22 bp, Homo sapiens
atccagtgagtgcagctgttgt

SEQ ID NO: 8465638 - DNA, 22 bp, Homo sapiens
ctgtgtgctgaaatgcagtgag

SEQ ID NO: 8465639 - DNA, 22 bp, Homo sapiens
ctgtgtgcctagagggtggccg

SEQ ID NO: 8465640 - DNA, 22 bp, Homo sapiens
ctgtgtgtcctcggacgagttt

SEQ ID NO: 8465641 - DNA, 22 bp, Homo sapiens
ctgtgtgtcatttgtcaatcct

SEQ ID NO: 8465642 - DNA, 22 bp, Homo sapiens
atcctgtgaggataagcccttg

SEQ ID NO: 8465643 - DNA, 22 bp, Homo sapiens
atcctgggtttgtgagtttatg

SEQ ID NO: 8465644 - DNA, 19 bp, Homo sapiens
atcctgggtcctccagctg

SEQ ID NO: 8465645 - DNA, 22 bp, Homo sapiens
atcctgggctgcaccctcagcc

SEQ ID NO: 8465646 - DNA, 22 bp, Homo sapiens
atcctgggcctcagaggtgtgt

SEQ ID NO: 8465647 - DNA, 22 bp, Homo sapiens
atcctgggggcagctggaaaca

SEQ ID NO: 8465648 - DNA, 22 bp, Homo sapiens
atcctgggtaagttccttttaa

SEQ ID NO: 8465649 - DNA, 22 bp, Homo sapiens
atcctgggggcagctggaaaca

SEQ ID NO: 8465650 - DNA, 19 bp, Homo sapiens
atcctgggtcctccagctg

SEQ ID NO: 8465651 - DNA, 22 bp, Homo sapiens
atcctgggcagtgtgtcactct

SEQ ID NO: 8465652 - DNA, 22 bp, Homo sapiens
atcctgggcagttttgagtgct

SEQ ID NO: 8465653 - DNA, 18 bp, Homo sapiens
atcctgggccagtctttc

SEQ ID NO: 8465654 - DNA, 22 bp, Homo sapiens
atcctgggcaagtcaatgtccc

SEQ ID NO: 8465655 - DNA, 22 bp, Homo sapiens
ctgtggcttttccggggagcct

SEQ ID NO: 8465656 - DNA, 22 bp, Homo sapiens
ctgtggcttttccggggagcct

SEQ ID NO: 8465657 - DNA, 22 bp, Homo sapiens
ctgtggctttggggcggaggac

SEQ ID NO: 8465658 - DNA, 22 bp, Homo sapiens
ctgtggctttgcagggcttgtt

SEQ ID NO: 8465659 - DNA, 22 bp, Homo sapiens
ctgtggctaggaagctgtggga

SEQ ID NO: 8465660 - DNA, 22 bp, Homo sapiens
ctgtggctatggtgtacatact

SEQ ID NO: 8465661 - DNA, 22 bp, Homo sapiens
ctgtggctcaattgcctactga

SEQ ID NO: 8465662 - DNA, 22 bp, Homo sapiens
ctgtggctcaaaatcccatgat

SEQ ID NO: 8465663 - DNA, 22 bp, Homo sapiens
ctgtggctcaaaatcccatgat

SEQ ID NO: 8465664 - DNA, 22 bp, Homo sapiens
ctgtgggagaagttgctggagt

SEQ ID NO: 8465665 - DNA, 22 bp, Homo sapiens
ctgtgggagaagctagcacagg

SEQ ID NO: 8465666 - DNA, 22 bp, Homo sapiens
ctgtgggactctgaggaaaagc

SEQ ID NO: 8465667 - DNA, 22 bp, Homo sapiens
ctgtgggagaagctagcacagg

SEQ ID NO: 8465668 - DNA, 22 bp, Homo sapiens
ctgtgggaatactgcgagtgta

SEQ ID NO: 8465669 - DNA, 21 bp, Homo sapiens
ctgtgggaccaagcactggga

SEQ ID NO: 8465670 - DNA, 21 bp, Homo sapiens
ctgtgggaccaagcactggga

SEQ ID NO: 8465671 - DNA, 22 bp, Homo sapiens
ctgtgggaatactgcgagtgta

SEQ ID NO: 8465672 - DNA, 23 bp, Homo sapiens
ctgtgggaagtcggggagcgcgc

SEQ ID NO: 8465673 - DNA, 22 bp, Homo sapiens
ctgtgggaacactgaggacttc

SEQ ID NO: 8465674 - DNA, 22 bp, Homo sapiens
atcagagcaatggataaaatca

SEQ ID NO: 8465675 - DNA, 22 bp, Homo sapiens
atcagagcactgagcaggacac

SEQ ID NO: 8465676 - DNA, 22 bp, Homo sapiens
atcagagcaatggataaaatca

SEQ ID NO: 8465677 - DNA, 22 bp, Homo sapiens
atcagagcactgagcaggacac

SEQ ID NO: 8465678 - DNA, 22 bp, Homo sapiens
atcagagcaatggataaaatca

SEQ ID NO: 8465679 - DNA, 22 bp, Homo sapiens
ctgtggccttggaccagcatct

SEQ ID NO: 8465680 - DNA, 22 bp, Homo sapiens
ctgtggcctgtgccagaactgg

SEQ ID NO: 8465681 - DNA, 23 bp, Homo sapiens
ctgtggccctgcttcatgcagcc

SEQ ID NO: 8465682 - DNA, 22 bp, Homo sapiens
agtcttaggctccattagtaga

SEQ ID NO: 8465683 - DNA, 21 bp, Homo sapiens
agtcttaggcacagctgtgtc

SEQ ID NO: 8465684 - DNA, 22 bp, Homo sapiens
agtcttagattttattttggtc

SEQ ID NO: 8465685 - DNA, 22 bp, Homo sapiens
agtcttagagtctgtgtcatga

SEQ ID NO: 8465686 - DNA, 22 bp, Homo sapiens
agtcttagaactacagtgccta

SEQ ID NO: 8465687 - DNA, 22 bp, Homo sapiens
agtcttagtatggttttaggtt

SEQ ID NO: 8465688 - DNA, 22 bp, Homo sapiens
agtcttaggctccattagtaga

SEQ ID NO: 8465689 - DNA, 22 bp, Homo sapiens
agtcttatggttaaatagatgc

SEQ ID NO: 8465690 - DNA, 23 bp, Homo sapiens
agtcttcattgtatttccagacc

SEQ ID NO: 8465691 - DNA, 22 bp, Homo sapiens
agtcttcagcagccttctcagg

SEQ ID NO: 8465692 - DNA, 22 bp, Homo sapiens
agtcttatgtttgtgaagaact

SEQ ID NO: 8465693 - DNA, 22 bp, Homo sapiens
agtcttcactcttcactactat

SEQ ID NO: 8465694 - DNA, 22 bp, Homo sapiens
ctccagctgagtaagaacacta

SEQ ID NO: 8465695 - DNA, 22 bp, Homo sapiens
ctccagctcgcgagctctgctc

SEQ ID NO: 8465696 - DNA, 22 bp, Homo sapiens
agtcttctgaataagaatcact

SEQ ID NO: 8465697 - DNA, 22 bp, Homo sapiens
agtcttctgaataagaatcact

SEQ ID NO: 8465698 - DNA, 22 bp, Homo sapiens
agtcttctcatttcacatgctt

SEQ ID NO: 8465699 - DNA, 22 bp, Homo sapiens
agtcttctcatttcacatgctt

SEQ ID NO: 8465700 - DNA, 22 bp, Homo sapiens
ctccaggaaagcctgaggcccg

SEQ ID NO: 8465701 - DNA, 22 bp, Homo sapiens
ctccaggaaaatagggaatgag

SEQ ID NO: 8465702 - DNA, 22 bp, Homo sapiens
ctccagctttagctctccaggg

SEQ ID NO: 8465703 - DNA, 22 bp, Homo sapiens
ctccagctttttcccagttggc

SEQ ID NO: 8465704 - DNA, 22 bp, Homo sapiens
ctccagcttctgcccagagact

SEQ ID NO: 8465705 - DNA, 22 bp, Homo sapiens
ctccagctgctggtctgagact

SEQ ID NO: 8465706 - DNA, 22 bp, Homo sapiens
ctccaggctcgtccaagatcga

SEQ ID NO: 8465707 - DNA, 22 bp, Homo sapiens
ctccaggctggatccaagtcaa

SEQ ID NO: 8465708 - DNA, 22 bp, Homo sapiens
ctccaggctggatccaagtcaa

SEQ ID NO: 8465709 - DNA, 22 bp, Homo sapiens
ctccaggaaagtcaggcttaga

SEQ ID NO: 8465710 - DNA, 22 bp, Homo sapiens
ctccagggaaaggggcgtccgc

SEQ ID NO: 8465711 - DNA, 22 bp, Homo sapiens
ctccaggcttcaagggccggcc

SEQ ID NO: 8465712 - DNA, 22 bp, Homo sapiens
ctccaggctggggtgcaggttg

SEQ ID NO: 8465713 - DNA, 22 bp, Homo sapiens
ctccaggctggatccaagtcaa

SEQ ID NO: 8465714 - DNA, 22 bp, Homo sapiens
agtccctgtactttccactgcc

SEQ ID NO: 8465715 - DNA, 22 bp, Homo sapiens
agtcctagccctggatccatca

SEQ ID NO: 8465716 - DNA, 22 bp, Homo sapiens
agtcctggacttggagtcaggg

SEQ ID NO: 8465717 - DNA, 22 bp, Homo sapiens
agtcctgatgctctggcaggag

SEQ ID NO: 8465718 - DNA, 22 bp, Homo sapiens
agtcctggcatataggtcctca

SEQ ID NO: 8465719 - DNA, 22 bp, Homo sapiens
ctcatgtcggcaggactcgccc

SEQ ID NO: 8465720 - DNA, 22 bp, Homo sapiens
ctcatgtcaggggtgtcaatgt

SEQ ID NO: 8465721 - DNA, 22 bp, Homo sapiens
ctcatgtagctctcaggccaca

SEQ ID NO: 8465722 - DNA, 22 bp, Homo sapiens
ctcatggcagagtcacctgtcc

SEQ ID NO: 8465723 - DNA, 22 bp, Homo sapiens
agtcctgggtccagcaggtcct

SEQ ID NO: 8465724 - DNA, 22 bp, Homo sapiens
agtcctgggtccagcaggtcct

SEQ ID NO: 8465725 - DNA, 18 bp, Homo sapiens
ctcagtgtttgctgaaaa

SEQ ID NO: 8465726 - DNA, 22 bp, Homo sapiens
agtcctggctctacgggcttca

SEQ ID NO: 8465727 - DNA, 22 bp, Homo sapiens
agtcctggccccaaggaaggat

SEQ ID NO: 8465728 - DNA, 22 bp, Homo sapiens
agtcctggccccaaggaaggat

SEQ ID NO: 8465729 - DNA, 22 bp, Homo sapiens
ctcctaggacgccgctgctcct

SEQ ID NO: 8465730 - DNA, 22 bp, Homo sapiens
ctcctaggacgccgctgctcct

SEQ ID NO: 8465731 - DNA, 22 bp, Homo sapiens
ctcctaggacgccgctgctcct

SEQ ID NO: 8465732 - DNA, 19 bp, Homo sapiens
ctccggccagcaactgcat

SEQ ID NO: 8465733 - DNA, 22 bp, Homo sapiens
ctcctggctctctgtttagtgt

SEQ ID NO: 8465734 - DNA, 22 bp, Homo sapiens
ctcctggctctctgtttagtgt

SEQ ID NO: 8465735 - DNA, 22 bp, Homo sapiens
ctcctggctctgccacttacta

SEQ ID NO: 8465736 - DNA, 22 bp, Homo sapiens
ctcctggctctgccacttacta

SEQ ID NO: 8465737 - DNA, 19 bp, Homo sapiens
ctcctggctctgtcatttt

SEQ ID NO: 8465738 - DNA, 22 bp, Homo sapiens
ctcctcagactttccttgtccg

SEQ ID NO: 8465739 - DNA, 22 bp, Homo sapiens
ctcctcagaacagccttggctg

SEQ ID NO: 8465740 - DNA, 22 bp, Homo sapiens
ctcctcagaagagggtaacaca

SEQ ID NO: 8465741 - DNA, 20 bp, Homo sapiens
ctccagggaacagactggag

SEQ ID NO: 8465742 - DNA, 22 bp, Homo sapiens
ctcccaggttgattctttccct

SEQ ID NO: 8465743 - DNA, 22 bp, Homo sapiens
ctccctcaggccttagccctgc

SEQ ID NO: 8465744 - DNA, 22 bp, Homo sapiens
ctccctcatatacccagcgaga

SEQ ID NO: 8465745 - DNA, 22 bp, Homo sapiens
ctccctccaaataagactcggg

SEQ ID NO: 8465746 - DNA, 22 bp, Homo sapiens
ctccctcctcaaatatctttgt

SEQ ID NO: 8465747 - DNA, 22 bp, Homo sapiens
ctccctccctacgtgagctcac

SEQ ID NO: 8465748 - DNA, 22 bp, Homo sapiens
ctccctcctcaaatatctttgt

SEQ ID NO: 8465749 - DNA, 22 bp, Homo sapiens
ctcctgggaaaggctggacaca

SEQ ID NO: 8465750 - DNA, 22 bp, Homo sapiens
ctcctgggaaaggctggacaca

SEQ ID NO: 8465751 - DNA, 22 bp, Homo sapiens
ctcctgggaaaggctggacaca

SEQ ID NO: 8465752 - DNA, 18 bp, Homo sapiens
ctcctggctgatggtgag

SEQ ID NO: 8465753 - DNA, 22 bp, Homo sapiens
ctcctggcttctgaaatcgtgg

SEQ ID NO: 8465754 - DNA, 22 bp, Homo sapiens
ctcctggctttcccagaccagg

SEQ ID NO: 8465755 - DNA, 22 bp, Homo sapiens
ctcctggctttcccagaccagg

SEQ ID NO: 8465756 - DNA, 22 bp, Homo sapiens
ctcctgggaatttagttgtgag

SEQ ID NO: 8465757 - DNA, 20 bp, Homo sapiens
ctcctgggactgctggttat

SEQ ID NO: 8465758 - DNA, 22 bp, Homo sapiens
ctcctgggaaatgaaggggcag

SEQ ID NO: 8465759 - DNA, 22 bp, Homo sapiens
ctcctgggaatttagttgtgag

SEQ ID NO: 8465760 - DNA, 22 bp, Homo sapiens
ctcctgggaaatgaaggggcag

SEQ ID NO: 8465761 - DNA, 22 bp, Homo sapiens
ctcctggggccatggaaggaac

SEQ ID NO: 8465762 - DNA, 22 bp, Homo sapiens
ctcctggggccatggaaggaac

SEQ ID NO: 8465763 - DNA, 22 bp, Homo sapiens
ctcctggggccatggaaggaac

SEQ ID NO: 8465764 - DNA, 22 bp, Homo sapiens
ctcctggggcacttagaagcaa

SEQ ID NO: 8465765 - DNA, 22 bp, Homo sapiens
ctcctggggcacttagaagcaa

SEQ ID NO: 8465766 - DNA, 22 bp, Homo sapiens
ctcctgggggacagcggcaggg

SEQ ID NO: 8465767 - DNA, 22 bp, Homo sapiens
ctcctgggggacagcggcaggg

SEQ ID NO: 8465768 - DNA, 22 bp, Homo sapiens
ctcctgggggacagcggcaggg

SEQ ID NO: 8465769 - DNA, 22 bp, Homo sapiens
ctcctgggtcattgccagcaaa

SEQ ID NO: 8465770 - DNA, 22 bp, Homo sapiens
ctcctgggtcattgccagcaaa

SEQ ID NO: 8465771 - DNA, 22 bp, Homo sapiens
ctcctgggtcattgccagcaaa

SEQ ID NO: 8465772 - DNA, 22 bp, Homo sapiens
agtggcagagctgtgtcttgaa

SEQ ID NO: 8465773 - DNA, 20 bp, Homo sapiens
ctcctggtccaggagcctga

SEQ ID NO: 8465774 - DNA, 22 bp, Homo sapiens
ctcctggtgactcccagataaa

SEQ ID NO: 8465775 - DNA, 22 bp, Homo sapiens
ctcctggtgactcccagataaa

SEQ ID NO: 8465776 - DNA, 22 bp, Homo sapiens
agtggcagagtgcactcaggca

SEQ ID NO: 8465777 - DNA, 22 bp, Homo sapiens
agtggcagagtcagggtttgga

SEQ ID NO: 8465778 - DNA, 22 bp, Homo sapiens
agtggcagatctctggtctgga

SEQ ID NO: 8465779 - DNA, 22 bp, Homo sapiens
agtggcagagtgcactcaggca

SEQ ID NO: 8465780 - DNA, 22 bp, Homo sapiens
ctctcagaagtttatgtcagaa

SEQ ID NO: 8465781 - DNA, 22 bp, Homo sapiens
ctctcagaagtttatgtcagaa

SEQ ID NO: 8465782 - DNA, 22 bp, Homo sapiens
ctctcagaagtttatgtcagaa

SEQ ID NO: 8465783 - DNA, 22 bp, Homo sapiens
ctctcagaagtagcacgtgggc

SEQ ID NO: 8465784 - DNA, 22 bp, Homo sapiens
ctctcagaagtagcacgtgggc

SEQ ID NO: 8465785 - DNA, 22 bp, Homo sapiens
ctctcagcaggaaagcatgcaa

SEQ ID NO: 8465786 - DNA, 22 bp, Homo sapiens
ctctcagatggagtgtgaatgg

SEQ ID NO: 8465787 - DNA, 22 bp, Homo sapiens
ctctcagacacccatttggaaa

SEQ ID NO: 8465788 - DNA, 22 bp, Homo sapiens
agttagaatggatgttgagagc

SEQ ID NO: 8465789 - DNA, 22 bp, Homo sapiens
agttagaatataattatgttaa

SEQ ID NO: 8465790 - DNA, 22 bp, Homo sapiens
agttagaatggatgttgagagc

SEQ ID NO: 8465791 - DNA, 22 bp, Homo sapiens
agttagaatataattatgttaa

SEQ ID NO: 8465792 - DNA, 22 bp, Homo sapiens
agttagagacacatgcacatgc

SEQ ID NO: 8465793 - DNA, 22 bp, Homo sapiens
agttagcatctcctccagtcta

SEQ ID NO: 8465794 - DNA, 22 bp, Homo sapiens
agttagcagcttattagaaaca

SEQ ID NO: 8465795 - DNA, 22 bp, Homo sapiens
agttatataactatctagatgc

SEQ ID NO: 8465796 - DNA, 22 bp, Homo sapiens
agttaactctgaaaagacattt

SEQ ID NO: 8465797 - DNA, 22 bp, Homo sapiens
ctgagaaaggacctcaaacagg

SEQ ID NO: 8465798 - DNA, 22 bp, Homo sapiens
agttaagagtgtgaaaatgtta

SEQ ID NO: 8465799 - DNA, 22 bp, Homo sapiens
agttactcactgagggtttatt

SEQ ID NO: 8465800 - DNA, 22 bp, Homo sapiens
agttactcaaggctgatataag

SEQ ID NO: 8465801 - DNA, 22 bp, Homo sapiens
agttactgctttcaggaagttt

SEQ ID NO: 8465802 - DNA, 22 bp, Homo sapiens
agttagaagtgtgtcatctgtg

SEQ ID NO: 8465803 - DNA, 22 bp, Homo sapiens
agttagaagtgtgtcatctgtg

SEQ ID NO: 8465804 - DNA, 22 bp, Homo sapiens
agttagaatagtcagattgtag

SEQ ID NO: 8465805 - DNA, 18 bp, Homo sapiens
agttagaaatgaaggcca

SEQ ID NO: 8465806 - DNA, 22 bp, Homo sapiens
agttagaaagtaaatcatttga

SEQ ID NO: 8465807 - DNA, 17 bp, Homo sapiens
ctgaggagaacagaaag

SEQ ID NO: 8465808 - DNA, 22 bp, Homo sapiens
ctgaggagacagaagccaaata

SEQ ID NO: 8465809 - DNA, 22 bp, Homo sapiens
ctgaggagaacaatgagatcaa

SEQ ID NO: 8465810 - DNA, 22 bp, Homo sapiens
ctgaggagaacaatgagatcaa

SEQ ID NO: 8465811 - DNA, 22 bp, Homo sapiens
ctgagctgggactcagtagcaa

SEQ ID NO: 8465812 - DNA, 22 bp, Homo sapiens
ctgaggagagatcacgtggtgt

SEQ ID NO: 8465813 - DNA, 22 bp, Homo sapiens
ctgaggagaccatcaactaatt

SEQ ID NO: 8465814 - DNA, 22 bp, Homo sapiens
ctgaggagaggtggcctgtgtt

SEQ ID NO: 8465815 - DNA, 22 bp, Homo sapiens
ctgagcagatgaccagccccag

SEQ ID NO: 8465816 - DNA, 22 bp, Homo sapiens
ctgagcagcaacccagagcctc

SEQ ID NO: 8465817 - DNA, 22 bp, Homo sapiens
ctgagcagatgttgcccagaag

SEQ ID NO: 8465818 - DNA, 22 bp, Homo sapiens
ctgagcagatgttgcccagaag

SEQ ID NO: 8465819 - DNA, 22 bp, Homo sapiens
ctgagcagcaccttcaagaaac

SEQ ID NO: 8465820 - DNA, 22 bp, Homo sapiens
ctgagcagcaccttcaagaaac

SEQ ID NO: 8465821 - DNA, 22 bp, Homo sapiens
ctgagcagcacagggcgccagg

SEQ ID NO: 8465822 - DNA, 22 bp, Homo sapiens
ctgagcagcacagggcgccagg

SEQ ID NO: 8465823 - DNA, 22 bp, Homo sapiens
ctgagcagcaccttcaagaaac

SEQ ID NO: 8465824 - DNA, 22 bp, Homo sapiens
ctgagcagcacagggcgccagg

SEQ ID NO: 8465825 - DNA, 22 bp, Homo sapiens
ctgagcagcaattgctggccca

SEQ ID NO: 8465826 - DNA, 22 bp, Homo sapiens
ctgacaaaggcaaggcaggggg

SEQ ID NO: 8465827 - DNA, 22 bp, Homo sapiens
ctgaattatttaaggtgaaggg

SEQ ID NO: 8465828 - DNA, 18 bp, Homo sapiens
ctgaattatctcatcatt

SEQ ID NO: 8465829 - DNA, 21 bp, Homo sapiens
ctgaattatgtgcttaccttt

SEQ ID NO: 8465830 - DNA, 22 bp, Homo sapiens
ctgaattagatgaaaaaggctc

SEQ ID NO: 8465831 - DNA, 22 bp, Homo sapiens
ctgaattagatgaaaaaggctc

SEQ ID NO: 8465832 - DNA, 18 bp, Homo sapiens
ctgaattatctcatcatt

SEQ ID NO: 8465833 - DNA, 22 bp, Homo sapiens
ctgaattaatacacagaatggc

SEQ ID NO: 8465834 - DNA, 22 bp, Homo sapiens
ctgaattaatacacagaatggc

SEQ ID NO: 8465835 - DNA, 22 bp, Homo sapiens
ctgaattactgaaggtcaactt

SEQ ID NO: 8465836 - DNA, 22 bp, Homo sapiens
ctgaattacttattagtgggga

SEQ ID NO: 8465837 - DNA, 22 bp, Homo sapiens
ctgaattaagcattacatacat

SEQ ID NO: 8465838 - DNA, 22 bp, Homo sapiens
ctgactttagaacccaaaaagt

SEQ ID NO: 8465839 - DNA, 20 bp, Homo sapiens
ctgacagaaaatatttcatc

SEQ ID NO: 8465840 - DNA, 22 bp, Homo sapiens
ctgacttttccaaataatactt

SEQ ID NO: 8465841 - DNA, 22 bp, Homo sapiens
ctgactttgctcataggtcaaa

SEQ ID NO: 8465842 - DNA, 22 bp, Homo sapiens
agtgtctgctttgagtcaggtg

SEQ ID NO: 8465843 - DNA, 22 bp, Homo sapiens
ctgaaggaagcaggtggcctgt

SEQ ID NO: 8465844 - DNA, 20 bp, Homo sapiens
agtgtctgggcctcaggccc

SEQ ID NO: 8465845 - DNA, 22 bp, Homo sapiens
ctgaaattattgtttaatcaaa

SEQ ID NO: 8465846 - DNA, 22 bp, Homo sapiens
agtgtctgcgggcagaggagcg

SEQ ID NO: 8465847 - DNA, 22 bp, Homo sapiens
agtgtctgctaggttcatcaac

SEQ ID NO: 8465848 - DNA, 22 bp, Homo sapiens
agtgtctgcttatcagttcttg

SEQ ID NO: 8465849 - DNA, 22 bp, Homo sapiens
ctctgcaggcacccagggtggg

SEQ ID NO: 8465850 - DNA, 22 bp, Homo sapiens
ctctgcaggcacccagggtggg

SEQ ID NO: 8465851 - DNA, 22 bp, Homo sapiens
ctctgcaggcctgtgaagggtg

SEQ ID NO: 8465852 - DNA, 21 bp, Homo sapiens
ctctgcagccctgcttccagg

SEQ ID NO: 8465853 - DNA, 23 bp, Homo sapiens
ctctgcaggagagtgggcagggc

SEQ ID NO: 8465854 - DNA, 23 bp, Homo sapiens
ctctgcaggagagtgggcagggc

SEQ ID NO: 8465855 - DNA, 17 bp, Homo sapiens
ctctgcagtgcatggct

SEQ ID NO: 8465856 - DNA, 22 bp, Homo sapiens
ctctgcaggggaggcatgcact

SEQ ID NO: 8465857 - DNA, 17 bp, Homo sapiens
ctctgcagtgcatggct

SEQ ID NO: 8465858 - DNA, 22 bp, Homo sapiens
ctctgcaggccttgagtgtggt

SEQ ID NO: 8465859 - DNA, 22 bp, Homo sapiens
ctctgcaggggaggcatgcact

SEQ ID NO: 8465860 - DNA, 22 bp, Homo sapiens
ctctcagggtccctgcggagga

SEQ ID NO: 8465861 - DNA, 22 bp, Homo sapiens
ctctcagtcctgcgcgcctctg

SEQ ID NO: 8465862 - DNA, 22 bp, Homo sapiens
ctctcaggtagagcccaagaat

SEQ ID NO: 8465863 - DNA, 22 bp, Homo sapiens
ctctcagggacccagccagcct

SEQ ID NO: 8465864 - DNA, 22 bp, Homo sapiens
ctctcatgagcattcctaaggg

SEQ ID NO: 8465865 - DNA, 22 bp, Homo sapiens
ctctcagtgcctgccctaggct

SEQ ID NO: 8465866 - DNA, 22 bp, Homo sapiens
ctctcagtgcctgccctaggct

SEQ ID NO: 8465867 - DNA, 22 bp, Homo sapiens
ctctgagcccgctgcagcccca

SEQ ID NO: 8465868 - DNA, 22 bp, Homo sapiens
ctctgcctgtgtcgccaccaca

SEQ ID NO: 8465869 - DNA, 22 bp, Homo sapiens
ctctgcagtgtaacagcgcttg

SEQ ID NO: 8465870 - DNA, 22 bp, Homo sapiens
ctctgctgatctcagctgggct

SEQ ID NO: 8465871 - DNA, 22 bp, Homo sapiens
ctctgctgagccagagtcccca

SEQ ID NO: 8465872 - DNA, 21 bp, Homo sapiens
ctctgctgagctccattttca

SEQ ID NO: 8465873 - DNA, 22 bp, Homo sapiens
ctctgctactgttaaaccattt

SEQ ID NO: 8465874 - DNA, 22 bp, Homo sapiens
ctctttggtgcaccttgcagtc

SEQ ID NO: 8465875 - DNA, 22 bp, Homo sapiens
ctctgggcttgttgacctgcac

SEQ ID NO: 8465876 - DNA, 22 bp, Homo sapiens
ctgaaatattttaatctcagga

SEQ ID NO: 8465877 - DNA, 22 bp, Homo sapiens
ctctttggttaatcacacagat

SEQ ID NO: 8465878 - DNA, 22 bp, Homo sapiens
ctgaaaggcagtgggtagtgtg

SEQ ID NO: 8465879 - DNA, 23 bp, Homo sapiens
ctgaaataccagaaaatcagtgt

SEQ ID NO: 8465880 - DNA, 22 bp, Homo sapiens
ctctgggaccatggcaagtgcg

SEQ ID NO: 8465881 - DNA, 21 bp, Homo sapiens
ctctgggacatttcttagcag

SEQ ID NO: 8465882 - DNA, 22 bp, Homo sapiens
ctctgggctgccttttagctct

SEQ ID NO: 8465883 - DNA, 22 bp, Homo sapiens
ctctgggctgccttttagctct

SEQ ID NO: 8465884 - DNA, 19 bp, Homo sapiens
ctctgggctgcatcttggt

SEQ ID NO: 8465885 - DNA, 22 bp, Homo sapiens
ctctgggcttacctgcttcctg

SEQ ID NO: 8465886 - DNA, 20 bp, Homo sapiens
ctctgggctgcgttgcaaac

SEQ ID NO: 8465887 - DNA, 20 bp, Homo sapiens
ctctgggctgcgttgcaaac

SEQ ID NO: 8465888 - DNA, 22 bp, Homo sapiens
ctctgggcttgttgacctgcac

SEQ ID NO: 8465889 - DNA, 22 bp, Homo sapiens
ctctgggcttacctgcttcctg

SEQ ID NO: 8465890 - DNA, 22 bp, Homo sapiens
ctctgggcttcctttgtgggtt

SEQ ID NO: 8465891 - DNA, 22 bp, Homo sapiens
ctctgggcttcaagtcagattt

SEQ ID NO: 8465892 - DNA, 22 bp, Homo sapiens
ctctgggcttcctttgtgggtt

SEQ ID NO: 8465893 - DNA, 22 bp, Homo sapiens
ctctgggcttcaagtcagattt

SEQ ID NO: 8465894 - DNA, 22 bp, Homo sapiens
ctctgggaaagattgtgcaggc

SEQ ID NO: 8465895 - DNA, 22 bp, Homo sapiens
ctctgggaagtagatttggcct

SEQ ID NO: 8465896 - DNA, 22 bp, Homo sapiens
ctctgggaattctgagcaagca

SEQ ID NO: 8465897 - DNA, 22 bp, Homo sapiens
ctctgggaattctgagcaagca

SEQ ID NO: 8465898 - DNA, 22 bp, Homo sapiens
ctctggctttaaggatgccaca

SEQ ID NO: 8465899 - DNA, 19 bp, Homo sapiens
agtccatgaatggaggatg

SEQ ID NO: 8465900 - DNA, 22 bp, Homo sapiens
agtccatagtttacattacagc

SEQ ID NO: 8465901 - DNA, 22 bp, Homo sapiens
agtcccaacagcttacaaggaa

SEQ ID NO: 8465902 - DNA, 22 bp, Homo sapiens
agtcccagctactcaagaggct

SEQ ID NO: 8465903 - DNA, 22 bp, Homo sapiens
agtcccagctactcaagaggct

SEQ ID NO: 8465904 - DNA, 22 bp, Homo sapiens
ctagtacaattttagcaagatg

SEQ ID NO: 8465905 - DNA, 22 bp, Homo sapiens
ctagtatttaaaggctatgatt

SEQ ID NO: 8465906 - DNA, 22 bp, Homo sapiens
ctagaattgcattctatgaata

SEQ ID NO: 8465907 - DNA, 22 bp, Homo sapiens
agtccactgccccagctcctcg

SEQ ID NO: 8465908 - DNA, 22 bp, Homo sapiens
agtccaggctcttcctgaagaa

SEQ ID NO: 8465909 - DNA, 22 bp, Homo sapiens
agtccaggctcttcctgaagaa

SEQ ID NO: 8465910 - DNA, 22 bp, Homo sapiens
ctagaatctatgtcaggaactc

SEQ ID NO: 8465911 - DNA, 22 bp, Homo sapiens
ctagaatctccaagtttactca

SEQ ID NO: 8465912 - DNA, 22 bp, Homo sapiens
ctagaatctgggatttctgact

SEQ ID NO: 8465913 - DNA, 22 bp, Homo sapiens
ctagaatatcatatgaagagac

SEQ ID NO: 8465914 - DNA, 22 bp, Homo sapiens
ctagaatcccaaatggactggg

SEQ ID NO: 8465915 - DNA, 20 bp, Homo sapiens
ctagaactgagaaatttaaa

SEQ ID NO: 8465916 - DNA, 22 bp, Homo sapiens
ctagaactacatcttttaatag

SEQ ID NO: 8465917 - DNA, 22 bp, Homo sapiens
ctagaacagtcaaagtgagctc

SEQ ID NO: 8465918 - DNA, 20 bp, Homo sapiens
ctagaactgagaaatttaaa

SEQ ID NO: 8465919 - DNA, 22 bp, Homo sapiens
ctagaacagaaagtacaggaaa

SEQ ID NO: 8465920 - DNA, 22 bp, Homo sapiens
ctagaacctaggagtactaaag

SEQ ID NO: 8465921 - DNA, 20 bp, Homo sapiens
ctagaagtgcctcatctaga

SEQ ID NO: 8465922 - DNA, 22 bp, Homo sapiens
ctagaagttggggctagggata

SEQ ID NO: 8465923 - DNA, 22 bp, Homo sapiens
ctagaaggaagcccagcacttc

SEQ ID NO: 8465924 - DNA, 22 bp, Homo sapiens
agtccaggtggaccttggccag

SEQ ID NO: 8465925 - DNA, 22 bp, Homo sapiens
agtccaggtggaccttggccag

SEQ ID NO: 8465926 - DNA, 22 bp, Homo sapiens
agtccatacattgagaataaca

SEQ ID NO: 8465927 - DNA, 22 bp, Homo sapiens
agtccagggcttagtcagcggg

SEQ ID NO: 8465928 - DNA, 22 bp, Homo sapiens
agtccagggcttagtcagcggg

SEQ ID NO: 8465929 - DNA, 22 bp, Homo sapiens
agtccaggtctctgagtcacaa

SEQ ID NO: 8465930 - DNA, 22 bp, Homo sapiens
agtccaggtctctgagtcacaa

SEQ ID NO: 8465931 - DNA, 22 bp, Homo sapiens
agtccagggagcccaggctttg

SEQ ID NO: 8465932 - DNA, 22 bp, Homo sapiens
agtccagggagcccaggctttg

SEQ ID NO: 8465933 - DNA, 22 bp, Homo sapiens
agtccagggagcccaggctttg

SEQ ID NO: 8465934 - DNA, 22 bp, Homo sapiens
agtccagggctctctgtgggat

SEQ ID NO: 8465935 - DNA, 22 bp, Homo sapiens
ctagaaatctctgtttacatca

SEQ ID NO: 8465936 - DNA, 22 bp, Homo sapiens
ctacccagcacctaggctgcct

SEQ ID NO: 8465937 - DNA, 22 bp, Homo sapiens
ctagaaatgtagattcttagtg

SEQ ID NO: 8465938 - DNA, 22 bp, Homo sapiens
ctagaacaaattaggaggcata

SEQ ID NO: 8465939 - DNA, 22 bp, Homo sapiens
ctagaaattctgattcagtagg

SEQ ID NO: 8465940 - DNA, 22 bp, Homo sapiens
ctacatttcccagctgccttcc

SEQ ID NO: 8465941 - DNA, 22 bp, Homo sapiens
ctacattttgtgattatgaaat

SEQ ID NO: 8465942 - DNA, 22 bp, Homo sapiens
ctacattttgtgattatgaaat

SEQ ID NO: 8465943 - DNA, 22 bp, Homo sapiens
ctacattttaataagctgctta

SEQ ID NO: 8465944 - DNA, 22 bp, Homo sapiens
ctacatttgttctatagctttt

SEQ ID NO: 8465945 - DNA, 22 bp, Homo sapiens
ctacatttgttcaaataagctg

SEQ ID NO: 8465946 - DNA, 22 bp, Homo sapiens
agtatgcatatttcaaagtaag

SEQ ID NO: 8465947 - DNA, 22 bp, Homo sapiens
agtatgcaaatgtcataagcat

SEQ ID NO: 8465948 - DNA, 22 bp, Homo sapiens
agtatggggctgtgtgtgcaca

SEQ ID NO: 8465949 - DNA, 23 bp, Homo sapiens
agtattcaaaaggcaagctatat

SEQ ID NO: 8465950 - DNA, 22 bp, Homo sapiens
agtattcagcaaacgtgaacag

SEQ ID NO: 8465951 - DNA, 22 bp, Homo sapiens
agtatgttgacttattcttgga

SEQ ID NO: 8465952 - DNA, 22 bp, Homo sapiens
agtatttagctgactcgctaca

SEQ ID NO: 8465953 - DNA, 22 bp, Homo sapiens
agtatttagagacacaagatgg

SEQ ID NO: 8465954 - DNA, 22 bp, Homo sapiens
agtatttagagacacaagatgg

SEQ ID NO: 8465955 - DNA, 22 bp, Homo sapiens
ctaagaaatgttgtgaatgcca

SEQ ID NO: 8465956 - DNA, 22 bp, Homo sapiens
ctaagaaatgttgtgaatgcca

SEQ ID NO: 8465957 - DNA, 19 bp, Homo sapiens
ctaaacttatgtgaccaca

SEQ ID NO: 8465958 - DNA, 22 bp, Homo sapiens
ctaaacttcatatgttgcttta

SEQ ID NO: 8465959 - DNA, 22 bp, Homo sapiens
agtacaattatatttagatggt

SEQ ID NO: 8465960 - DNA, 22 bp, Homo sapiens
agtacaatttaatgaagatagc

SEQ ID NO: 8465961 - DNA, 22 bp, Homo sapiens
agtacacaagacacatttaaaa

SEQ ID NO: 8465962 - DNA, 22 bp, Homo sapiens
agtacacacagtagaatagagt

SEQ ID NO: 8465963 - DNA, 22 bp, Homo sapiens
agtacacacagtagaatagagt

SEQ ID NO: 8465964 - DNA, 17 bp, Homo sapiens
cgggcatggagggcagg

SEQ ID NO: 8465965 - DNA, 17 bp, Homo sapiens
cgggcatggagggcagg

SEQ ID NO: 8465966 - DNA, 17 bp, Homo sapiens
cgggcatggagggcagg

SEQ ID NO: 8465967 - DNA, 22 bp, Homo sapiens
cgggcacacacttgacaggttc

SEQ ID NO: 8465968 - DNA, 20 bp, Homo sapiens
agtacaatgtatgattcaga

SEQ ID NO: 8465969 - DNA, 22 bp, Homo sapiens
agtacaagtgatgtggtaaaaa

SEQ ID NO: 8465970 - DNA, 22 bp, Homo sapiens
agtacaacattagagtatctta

SEQ ID NO: 8465971 - DNA, 22 bp, Homo sapiens
agtacaagtagaatgctacaag

SEQ ID NO: 8465972 - DNA, 18 bp, Homo sapiens
cctgtgtgtgttgcaggc

SEQ ID NO: 8465973 - DNA, 19 bp, Homo sapiens
cctgttcttggctgaggct

SEQ ID NO: 8465974 - DNA, 22 bp, Homo sapiens
cctgttctgtggctctcaaagg

SEQ ID NO: 8465975 - DNA, 22 bp, Homo sapiens
cctgttctgttaattaaacttt

SEQ ID NO: 8465976 - DNA, 22 bp, Homo sapiens
cctgttctgtagtgagtttgag

SEQ ID NO: 8465977 - DNA, 22 bp, Homo sapiens
cgaggccatgcatgctgaggac

SEQ ID NO: 8465978 - DNA, 22 bp, Homo sapiens
cgcaggcaagagagtacagtta

SEQ ID NO: 8465979 - DNA, 22 bp, Homo sapiens
cgcaggctccggggtgccctgg

SEQ ID NO: 8465980 - DNA, 22 bp, Homo sapiens
cgcaggcacagagtggacagcg

SEQ ID NO: 8465981 - DNA, 19 bp, Homo sapiens
cgcaggagccgaggtgacc

SEQ ID NO: 8465982 - DNA, 22 bp, Homo sapiens
aggtttgggagtagaaatcaga

SEQ ID NO: 8465983 - DNA, 22 bp, Homo sapiens
aggtttctttatgctgctagaa

SEQ ID NO: 8465984 - DNA, 22 bp, Homo sapiens
cgcaggggaggaaggtacacct

SEQ ID NO: 8465985 - DNA, 22 bp, Homo sapiens
aggtttctgcactgtcactggt

SEQ ID NO: 8465986 - DNA, 22 bp, Homo sapiens
cgcaggctcggttcacagagca

SEQ ID NO: 8465987 - DNA, 22 bp, Homo sapiens
cgcaggctgcagccaagaagag

SEQ ID NO: 8465988 - DNA, 22 bp, Homo sapiens
cgcaggctggcgcggagtggca

SEQ ID NO: 8465989 - DNA, 22 bp, Homo sapiens
cgcaggctggcgcggagtggca

SEQ ID NO: 8465990 - DNA, 19 bp, Homo sapiens
cgcaggcttcgggtcgctc

SEQ ID NO: 8465991 - DNA, 19 bp, Homo sapiens
cgcaggcttcgggtcgctc

SEQ ID NO: 8465992 - DNA, 22 bp, Homo sapiens
aggtcctctgtgcctgctggcg

SEQ ID NO: 8465993 - DNA, 22 bp, Homo sapiens
aggtcctgagggttcgtctgca

SEQ ID NO: 8465994 - DNA, 22 bp, Homo sapiens
aggtcctgactccacgttctag

SEQ ID NO: 8465995 - DNA, 22 bp, Homo sapiens
aggtcctgactccacgttctag

SEQ ID NO: 8465996 - DNA, 22 bp, Homo sapiens
aggtcctgacgccctttgaaat

SEQ ID NO: 8465997 - DNA, 22 bp, Homo sapiens
aggtcctgaagattttactaga

SEQ ID NO: 8465998 - DNA, 22 bp, Homo sapiens
cctggctctgcagccactccag

SEQ ID NO: 8465999 - DNA, 22 bp, Homo sapiens
cctggctctgcagccactccag

SEQ ID NO: 8466000 - DNA, 22 bp, Homo sapiens
cctggctctgcagccactccag

SEQ ID NO: 8466001 - DNA, 22 bp, Homo sapiens
cctggctctgccgtaaccacca

SEQ ID NO: 8466002 - DNA, 22 bp, Homo sapiens
aggtccatcgtggatgaactgc

SEQ ID NO: 8466003 - DNA, 22 bp, Homo sapiens
aggtccctgcagcagactgcca

SEQ ID NO: 8466004 - DNA, 22 bp, Homo sapiens
cctggcaacatttcaaggtctt

SEQ ID NO: 8466005 - DNA, 22 bp, Homo sapiens
cctggcaagtgggctcccagat

SEQ ID NO: 8466006 - DNA, 23 bp, Homo sapiens
cctggcacacaaggggtgctgca

SEQ ID NO: 8466007 - DNA, 22 bp, Homo sapiens
cctggcacaagagcagcattgg

SEQ ID NO: 8466008 - DNA, 22 bp, Homo sapiens
cctggcacaagagcagcattgg

SEQ ID NO: 8466009 - DNA, 22 bp, Homo sapiens
cctggcacacggtggcattcaa

SEQ ID NO: 8466010 - DNA, 22 bp, Homo sapiens
aggtccagttttctgacaaggg

SEQ ID NO: 8466011 - DNA, 23 bp, Homo sapiens
cctgcagctgctggggctccacc

SEQ ID NO: 8466012 - DNA, 22 bp, Homo sapiens
cctgccagagcagcttgtcctc

SEQ ID NO: 8466013 - DNA, 22 bp, Homo sapiens
cctgccagatcccctgagctga

SEQ ID NO: 8466014 - DNA, 23 bp, Homo sapiens
cctgcagctgccacgccctgctc

SEQ ID NO: 8466015 - DNA, 22 bp, Homo sapiens
cctgccagcccgcgttcatgcc

SEQ ID NO: 8466016 - DNA, 22 bp, Homo sapiens
cctgccagccagatcactcgcc

SEQ ID NO: 8466017 - DNA, 22 bp, Homo sapiens
cctgccagcatcttcagcccct

SEQ ID NO: 8466018 - DNA, 22 bp, Homo sapiens
cctgcagagcaggagaggcatc

SEQ ID NO: 8466019 - DNA, 22 bp, Homo sapiens
cctgcagagccacgtgccagcg

SEQ ID NO: 8466020 - DNA, 22 bp, Homo sapiens
cctgcagagcaggagaggcatc

SEQ ID NO: 8466021 - DNA, 22 bp, Homo sapiens
cctgcagagggactggcaggaa

SEQ ID NO: 8466022 - DNA, 22 bp, Homo sapiens
cctgcagagggactggcaggaa

SEQ ID NO: 8466023 - DNA, 22 bp, Homo sapiens
cctgcagagggactggcaggaa

SEQ ID NO: 8466024 - DNA, 22 bp, Homo sapiens
cctgcagaggtcaggccagaaa

SEQ ID NO: 8466025 - DNA, 22 bp, Homo sapiens
cctgcagaggtcaggccagaaa

SEQ ID NO: 8466026 - DNA, 18 bp, Homo sapiens
cctgcagcccaggaggcc

SEQ ID NO: 8466027 - DNA, 22 bp, Homo sapiens
aggtagggctaggctgcgtctg

SEQ ID NO: 8466028 - DNA, 22 bp, Homo sapiens
aggtagggaagaaggcatgaaa

SEQ ID NO: 8466029 - DNA, 22 bp, Homo sapiens
aggtaggatgggtggagatgat

SEQ ID NO: 8466030 - DNA, 22 bp, Homo sapiens
cctgccagctgtgggccagcct

SEQ ID NO: 8466031 - DNA, 21 bp, Homo sapiens
cctgccaggaaactgagtgtc

SEQ ID NO: 8466032 - DNA, 21 bp, Homo sapiens
cctgccaggaaactgagtgtc

SEQ ID NO: 8466033 - DNA, 22 bp, Homo sapiens
cctgccagcgcttatctctcgg

SEQ ID NO: 8466034 - DNA, 22 bp, Homo sapiens
cctgtgactctgtctgatggtc

SEQ ID NO: 8466035 - DNA, 22 bp, Homo sapiens
cctgtgacttggcaaacctcca

SEQ ID NO: 8466036 - DNA, 22 bp, Homo sapiens
cctgtgaggtcatctgtggtaa

SEQ ID NO: 8466037 - DNA, 22 bp, Homo sapiens
cctgtgacgtgtctcctggcac

SEQ ID NO: 8466038 - DNA, 22 bp, Homo sapiens
cctgtgacccttccagtctact

SEQ ID NO: 8466039 - DNA, 19 bp, Homo sapiens
cctgtgactatctttgtaa

SEQ ID NO: 8466040 - DNA, 19 bp, Homo sapiens
cctgtgactatctttgtaa

SEQ ID NO: 8466041 - DNA, 22 bp, Homo sapiens
cctgtgacattagaatttcatt

SEQ ID NO: 8466042 - DNA, 22 bp, Homo sapiens
cctgtgaccactctggttctgc

SEQ ID NO: 8466043 - DNA, 22 bp, Homo sapiens
cctgtgcaatgttgaggtttca

SEQ ID NO: 8466044 - DNA, 19 bp, Homo sapiens
cctgtgcacatgtgtcctt

SEQ ID NO: 8466045 - DNA, 22 bp, Homo sapiens
cctgtgagtttacattctggcc

SEQ ID NO: 8466046 - DNA, 22 bp, Homo sapiens
cctgtgaggtcttgcatgtgaa

SEQ ID NO: 8466047 - DNA, 22 bp, Homo sapiens
cctgtgcaggctccataataga

SEQ ID NO: 8466048 - DNA, 22 bp, Homo sapiens
cctgtgcactatctgcattttt

SEQ ID NO: 8466049 - DNA, 22 bp, Homo sapiens
cctgtgcagcccttgccagttt

SEQ ID NO: 8466050 - DNA, 22 bp, Homo sapiens
cctgtgcagcccttgccagttt

SEQ ID NO: 8466051 - DNA, 22 bp, Homo sapiens
cctgtgcatccggtggtcattg

SEQ ID NO: 8466052 - DNA, 22 bp, Homo sapiens
cctgtgcatccggtggtcattg

SEQ ID NO: 8466053 - DNA, 20 bp, Homo sapiens
cctgtcatcccagcattttg

SEQ ID NO: 8466054 - DNA, 22 bp, Homo sapiens
cctgtcccctcacaatgccact

SEQ ID NO: 8466055 - DNA, 22 bp, Homo sapiens
cctgtcccctcacaatgccact

SEQ ID NO: 8466056 - DNA, 22 bp, Homo sapiens
cctgtcctccggagcgggctgt

SEQ ID NO: 8466057 - DNA, 20 bp, Homo sapiens
cctgtctcacgttccgcccc

SEQ ID NO: 8466058 - DNA, 22 bp, Homo sapiens
cctgtcctccaagagcacatct

SEQ ID NO: 8466059 - DNA, 22 bp, Homo sapiens
cctgtgcattgaccacactctc

SEQ ID NO: 8466060 - DNA, 22 bp, Homo sapiens
cctgtgcattgaccacactctc

SEQ ID NO: 8466061 - DNA, 22 bp, Homo sapiens
cctgtgcatgccagggtacacc

SEQ ID NO: 8466062 - DNA, 22 bp, Homo sapiens
cctgtgcatgccagggtacacc

SEQ ID NO: 8466063 - DNA, 22 bp, Homo sapiens
cctgtgccaaaaggctgcttat

SEQ ID NO: 8466064 - DNA, 22 bp, Homo sapiens
cctgtgcattgcagggtgttca

SEQ ID NO: 8466065 - DNA, 22 bp, Homo sapiens
cctgtgcattgagtttgcaccc

SEQ ID NO: 8466066 - DNA, 22 bp, Homo sapiens
aggtggggaggagtgtctcttt

SEQ ID NO: 8466067 - DNA, 22 bp, Homo sapiens
aggtggggaggagtgtctcttt

SEQ ID NO: 8466068 - DNA, 21 bp, Homo sapiens
aggtggggctgcacctctgct

SEQ ID NO: 8466069 - DNA, 20 bp, Homo sapiens
cctgggctccaggagccccg

SEQ ID NO: 8466070 - DNA, 20 bp, Homo sapiens
cctgggctccaggagccccg

SEQ ID NO: 8466071 - DNA, 20 bp, Homo sapiens
cctgggctccaggagccccg

SEQ ID NO: 8466072 - DNA, 22 bp, Homo sapiens
cctgggctcgcgcacttcaccc

SEQ ID NO: 8466073 - DNA, 22 bp, Homo sapiens
cctgggctcgcgcacttcaccc

SEQ ID NO: 8466074 - DNA, 22 bp, Homo sapiens
cctgggcttgcatctgtgctgg

SEQ ID NO: 8466075 - DNA, 22 bp, Homo sapiens
cctgggcttggttgttgagaac

SEQ ID NO: 8466076 - DNA, 22 bp, Homo sapiens
cctgggcttgcatctgtgctgg

SEQ ID NO: 8466077 - DNA, 22 bp, Homo sapiens
cctgggcttctgtctagatgtt

SEQ ID NO: 8466078 - DNA, 22 bp, Homo sapiens
cctgggctttcggcggcttcct

SEQ ID NO: 8466079 - DNA, 22 bp, Homo sapiens
cctgggctttcggcggcttcct

SEQ ID NO: 8466080 - DNA, 22 bp, Homo sapiens
cctgggctttcggcggcttcct

SEQ ID NO: 8466081 - DNA, 22 bp, Homo sapiens
cctgggctttcaaaaccagcct

SEQ ID NO: 8466082 - DNA, 22 bp, Homo sapiens
cctgggctttcaaaaccagcct

SEQ ID NO: 8466083 - DNA, 22 bp, Homo sapiens
cctgtcagggtttgcctcagaa

SEQ ID NO: 8466084 - DNA, 22 bp, Homo sapiens
cctgtcagttgctgtcagggat

SEQ ID NO: 8466085 - DNA, 22 bp, Homo sapiens
cctgtcagttgctgtcagggat

SEQ ID NO: 8466086 - DNA, 22 bp, Homo sapiens
cctggctctgggatcttcgctt

SEQ ID NO: 8466087 - DNA, 22 bp, Homo sapiens
cctggctctggggcggacagct

SEQ ID NO: 8466088 - DNA, 22 bp, Homo sapiens
cctggctctggggcggacagct

SEQ ID NO: 8466089 - DNA, 22 bp, Homo sapiens
cctggctctgcgtgcagctccg

SEQ ID NO: 8466090 - DNA, 22 bp, Homo sapiens
cctggctctgcgtgcagctccg

SEQ ID NO: 8466091 - DNA, 22 bp, Homo sapiens
cctggctctgcgtgcagctccg

SEQ ID NO: 8466092 - DNA, 22 bp, Homo sapiens
cctggctctgcgtgcagctccg

SEQ ID NO: 8466093 - DNA, 22 bp, Homo sapiens
cctggctctgcgtgcagctccg

SEQ ID NO: 8466094 - DNA, 22 bp, Homo sapiens
cctggctctggttccctcagct

SEQ ID NO: 8466095 - DNA, 22 bp, Homo sapiens
cctggctctggttccctcagct

SEQ ID NO: 8466096 - DNA, 22 bp, Homo sapiens
cctggctctggttccctcagct

SEQ ID NO: 8466097 - DNA, 22 bp, Homo sapiens
cctggctctgtcctcgcgcaaa

SEQ ID NO: 8466098 - DNA, 22 bp, Homo sapiens
cctgggcataaatcactccaag

SEQ ID NO: 8466099 - DNA, 22 bp, Homo sapiens
cctgggctcaagtgatggtccc

SEQ ID NO: 8466100 - DNA, 22 bp, Homo sapiens
cctgggctcaagtgatggtccc

SEQ ID NO: 8466101 - DNA, 22 bp, Homo sapiens
cctgggctcacagccaaggctc

SEQ ID NO: 8466102 - DNA, 22 bp, Homo sapiens
cctgggctcacagccaaggctc

SEQ ID NO: 8466103 - DNA, 22 bp, Homo sapiens
cctgggctcacagccaaggctc

SEQ ID NO: 8466104 - DNA, 22 bp, Homo sapiens
cctgggctcaccatgccttgga

SEQ ID NO: 8466105 - DNA, 22 bp, Homo sapiens
cctgggctccactccaagagca

SEQ ID NO: 8466106 - DNA, 22 bp, Homo sapiens
cctgggctcaggcttgggcagc

SEQ ID NO: 8466107 - DNA, 22 bp, Homo sapiens
cctgggctcaccatgccttgga

SEQ ID NO: 8466108 - DNA, 22 bp, Homo sapiens
cacagataaggatgttaatttt

SEQ ID NO: 8466109 - DNA, 20 bp, Homo sapiens
cacagatgggacaggaaagg

SEQ ID NO: 8466110 - DNA, 22 bp, Homo sapiens
cacagaggtctgggcccagcag

SEQ ID NO: 8466111 - DNA, 22 bp, Homo sapiens
cacagaggtctgggcccagcag

SEQ ID NO: 8466112 - DNA, 22 bp, Homo sapiens
cacagaggtgatagtggtcaag

SEQ ID NO: 8466113 - DNA, 22 bp, Homo sapiens
cacagaggtgatagtggtcaag

SEQ ID NO: 8466114 - DNA, 22 bp, Homo sapiens
ggagccctccatcccttgcggc

SEQ ID NO: 8466115 - DNA, 22 bp, Homo sapiens
ggagccctgccctaggcagctc

SEQ ID NO: 8466116 - DNA, 22 bp, Homo sapiens
ggagccctgccctaggcagctc

SEQ ID NO: 8466117 - DNA, 22 bp, Homo sapiens
ggagcccttggcacctagtagg

SEQ ID NO: 8466118 - DNA, 22 bp, Homo sapiens
ggagcccttggcacctagtagg

SEQ ID NO: 8466119 - DNA, 22 bp, Homo sapiens
ggagccctgctgacatgggtgt

SEQ ID NO: 8466120 - DNA, 22 bp, Homo sapiens
ggagccctgctgacatgggtgt

SEQ ID NO: 8466121 - DNA, 22 bp, Homo sapiens
ggagccctgccctaggcagctc

SEQ ID NO: 8466122 - DNA, 22 bp, Homo sapiens
ggagccctgccctaggcagctc

SEQ ID NO: 8466123 - DNA, 22 bp, Homo sapiens
ggagcccttctattccatggag

SEQ ID NO: 8466124 - DNA, 22 bp, Homo sapiens
ggagcccttgctgaccttccaa

SEQ ID NO: 8466125 - DNA, 22 bp, Homo sapiens
ggagcccttctattccatggag

SEQ ID NO: 8466126 - DNA, 22 bp, Homo sapiens
ggagcccttctattccatggag

SEQ ID NO: 8466127 - DNA, 22 bp, Homo sapiens
ggagctggcagcgcaacccaga

SEQ ID NO: 8466128 - DNA, 22 bp, Homo sapiens
ggagctggcagcgcaacccaga

SEQ ID NO: 8466129 - DNA, 23 bp, Homo sapiens
ggagcctccggtgtgtgagaggc

SEQ ID NO: 8466130 - DNA, 23 bp, Homo sapiens
ggagcctccggtgtgtgagaggc

SEQ ID NO: 8466131 - DNA, 22 bp, Homo sapiens
ggagcctgacagtgcccagcat

SEQ ID NO: 8466132 - DNA, 22 bp, Homo sapiens
ggagctgctcagagccagtccc

SEQ ID NO: 8466133 - DNA, 22 bp, Homo sapiens
ggagcctgcgggagctcccatt

SEQ ID NO: 8466134 - DNA, 20 bp, Homo sapiens
cacaggcttacagtttagat

SEQ ID NO: 8466135 - DNA, 22 bp, Homo sapiens
cacaggcttccagtccccagct

SEQ ID NO: 8466136 - DNA, 22 bp, Homo sapiens
cacaggcttccagtccccagct

SEQ ID NO: 8466137 - DNA, 22 bp, Homo sapiens
cacaggctgggaagcctaggcc

SEQ ID NO: 8466138 - DNA, 22 bp, Homo sapiens
cacaggcttttctgacataggc

SEQ ID NO: 8466139 - DNA, 22 bp, Homo sapiens
cacaggcttgtcagcatgaggc

SEQ ID NO: 8466140 - DNA, 21 bp, Homo sapiens
cacaggcttctatacacaatg

SEQ ID NO: 8466141 - DNA, 22 bp, Homo sapiens
cacaggcttgtcagcatgaggc

SEQ ID NO: 8466142 - DNA, 22 bp, Homo sapiens
cacaggcttgtcagcatgaggc

SEQ ID NO: 8466143 - DNA, 22 bp, Homo sapiens
ggaggcatctctgtggctgtct

SEQ ID NO: 8466144 - DNA, 22 bp, Homo sapiens
ggaggccaaagtgtgggcggct

SEQ ID NO: 8466145 - DNA, 22 bp, Homo sapiens
ggaggcattatggggaagactt

SEQ ID NO: 8466146 - DNA, 22 bp, Homo sapiens
ggaggccaaggaggagcttgcc

SEQ ID NO: 8466147 - DNA, 22 bp, Homo sapiens
ggaggccaaggaggagcttgcc

SEQ ID NO: 8466148 - DNA, 22 bp, Homo sapiens
ggaggccaaggcaggtggatca

SEQ ID NO: 8466149 - DNA, 22 bp, Homo sapiens
cacaggaatcgtcacttagcgc

SEQ ID NO: 8466150 - DNA, 22 bp, Homo sapiens
cacaggaagtggtcagtgccag

SEQ ID NO: 8466151 - DNA, 22 bp, Homo sapiens
cacagcttgtttagtgactcac

SEQ ID NO: 8466152 - DNA, 20 bp, Homo sapiens
ggagctggcatccagcctct

SEQ ID NO: 8466153 - DNA, 20 bp, Homo sapiens
ggagctggcatccagcctct

SEQ ID NO: 8466154 - DNA, 22 bp, Homo sapiens
cacaggactcgactgcagacag

SEQ ID NO: 8466155 - DNA, 22 bp, Homo sapiens
cacaggaatgaacagggaaaga

SEQ ID NO: 8466156 - DNA, 22 bp, Homo sapiens
cacaggagaaaggggaagctcg

SEQ ID NO: 8466157 - DNA, 22 bp, Homo sapiens
ggaggcagaatagagtgtgggt

SEQ ID NO: 8466158 - DNA, 22 bp, Homo sapiens
cacagacagtgtccctttgttg

SEQ ID NO: 8466159 - DNA, 22 bp, Homo sapiens
cacagactccccgccatagtgg

SEQ ID NO: 8466160 - DNA, 22 bp, Homo sapiens
cacagaattaagggagaaatat

SEQ ID NO: 8466161 - DNA, 22 bp, Homo sapiens
ggactgggagaatggaggcaag

SEQ ID NO: 8466162 - DNA, 22 bp, Homo sapiens
ggactgggagaatggaggcaag

SEQ ID NO: 8466163 - DNA, 22 bp, Homo sapiens
ggactgggattctggatctgct

SEQ ID NO: 8466164 - DNA, 22 bp, Homo sapiens
ggactgggagaatggaggcaag

SEQ ID NO: 8466165 - DNA, 22 bp, Homo sapiens
ggactgggattctggatctgct

SEQ ID NO: 8466166 - DNA, 22 bp, Homo sapiens
ggactgggcatgggtgctctgc

SEQ ID NO: 8466167 - DNA, 21 bp, Homo sapiens
cacagaggcgctgtatggctg

SEQ ID NO: 8466168 - DNA, 22 bp, Homo sapiens
cacagaggcatgaccctgccct

SEQ ID NO: 8466169 - DNA, 22 bp, Homo sapiens
cacagaggctcaaagccaggtg

SEQ ID NO: 8466170 - DNA, 22 bp, Homo sapiens
cacagaggctcaaagccaggtg

SEQ ID NO: 8466171 - DNA, 22 bp, Homo sapiens
cacagaggctcaaagccaggtg

SEQ ID NO: 8466172 - DNA, 22 bp, Homo sapiens
cacagaggatttttagggcagt

SEQ ID NO: 8466173 - DNA, 22 bp, Homo sapiens
cacagaggatttttagggcagt

SEQ ID NO: 8466174 - DNA, 22 bp, Homo sapiens
cacagaggatgcccaagcgatc

SEQ ID NO: 8466175 - DNA, 22 bp, Homo sapiens
cacagaggatgcccaagcgatc

SEQ ID NO: 8466176 - DNA, 22 bp, Homo sapiens
cacagaggatgcccaagcgatc

SEQ ID NO: 8466177 - DNA, 22 bp, Homo sapiens
cacagaggagtgcacactctct

SEQ ID NO: 8466178 - DNA, 22 bp, Homo sapiens
cacagagctggaaaggctgggc

SEQ ID NO: 8466179 - DNA, 22 bp, Homo sapiens
cacagagctgaacctgggtcat

SEQ ID NO: 8466180 - DNA, 22 bp, Homo sapiens
cacagagctggaaaggctgggc

SEQ ID NO: 8466181 - DNA, 22 bp, Homo sapiens
cacagagctggaaaggctgggc

SEQ ID NO: 8466182 - DNA, 22 bp, Homo sapiens
cacagagctgaacctgggtcat

SEQ ID NO: 8466183 - DNA, 22 bp, Homo sapiens
cacagagctgaacctgggtcat

SEQ ID NO: 8466184 - DNA, 22 bp, Homo sapiens
cacagaggactgtagcggggag

SEQ ID NO: 8466185 - DNA, 22 bp, Homo sapiens
cacagaggaatgcatcagcaga

SEQ ID NO: 8466186 - DNA, 22 bp, Homo sapiens
cacagaggaaaggcagttggta

SEQ ID NO: 8466187 - DNA, 21 bp, Homo sapiens
cacacagctgcccttaggtag

SEQ ID NO: 8466188 - DNA, 22 bp, Homo sapiens
cacacaggaaaattggaattaa

SEQ ID NO: 8466189 - DNA, 22 bp, Homo sapiens
cacacagctagtgacaggagaa

SEQ ID NO: 8466190 - DNA, 22 bp, Homo sapiens
cacacagatggtaagggaggga

SEQ ID NO: 8466191 - DNA, 22 bp, Homo sapiens
cacagaactggttaatagcaga

SEQ ID NO: 8466192 - DNA, 20 bp, Homo sapiens
ggaaggggcaaagtgtgtga

SEQ ID NO: 8466193 - DNA, 20 bp, Homo sapiens
ggaaggggcaaagtgtgtga

SEQ ID NO: 8466194 - DNA, 22 bp, Homo sapiens
ggaaggggagctggaaagggta

SEQ ID NO: 8466195 - DNA, 22 bp, Homo sapiens
ggaaggggagctggaaagggta

SEQ ID NO: 8466196 - DNA, 22 bp, Homo sapiens
ggaaggggagctggaaagggta

SEQ ID NO: 8466197 - DNA, 22 bp, Homo sapiens
ggaaggggagctggaaagggta

SEQ ID NO: 8466198 - DNA, 21 bp, Homo sapiens
ggaagggctctgaggacggct

SEQ ID NO: 8466199 - DNA, 22 bp, Homo sapiens
caagtaacttgattaaggtaag

SEQ ID NO: 8466200 - DNA, 22 bp, Homo sapiens
caagtaatggttttataatagt

SEQ ID NO: 8466201 - DNA, 22 bp, Homo sapiens
caagtacaaaatgatatttagt

SEQ ID NO: 8466202 - DNA, 22 bp, Homo sapiens
caagtatttcctgatggcctgt

SEQ ID NO: 8466203 - DNA, 22 bp, Homo sapiens
caagtatatttgaacatgtaaa

SEQ ID NO: 8466204 - DNA, 22 bp, Homo sapiens
caagtactgtgatagctgaagt

SEQ ID NO: 8466205 - DNA, 22 bp, Homo sapiens
caaggtgccatgctgggcgggg

SEQ ID NO: 8466206 - DNA, 22 bp, Homo sapiens
caaggtgccatgctgggcgggg

SEQ ID NO: 8466207 - DNA, 22 bp, Homo sapiens
caaggtgccatgctgggcgggg

SEQ ID NO: 8466208 - DNA, 22 bp, Homo sapiens
caaggtgccatgctgggcgggg

SEQ ID NO: 8466209 - DNA, 22 bp, Homo sapiens
caagtattttaaggactagtgg

SEQ ID NO: 8466210 - DNA, 22 bp, Homo sapiens
caagtatttgcggagttccacg

SEQ ID NO: 8466211 - DNA, 22 bp, Homo sapiens
gctgttcagatgcgattcagga

SEQ ID NO: 8466212 - DNA, 22 bp, Homo sapiens
gctgttcagggcactcatgggc

SEQ ID NO: 8466213 - DNA, 19 bp, Homo sapiens
gctgttaaggaccctcgga

SEQ ID NO: 8466214 - DNA, 22 bp, Homo sapiens
caagtttacaatgtgtatgtgt

SEQ ID NO: 8466215 - DNA, 22 bp, Homo sapiens
gctgttctgtccccatgggtaa

SEQ ID NO: 8466216 - DNA, 22 bp, Homo sapiens
gctgttctccgatgaccccgtg

SEQ ID NO: 8466217 - DNA, 22 bp, Homo sapiens
caataactgctaaattccctgt

SEQ ID NO: 8466218 - DNA, 22 bp, Homo sapiens
caataaagaagatttttgcaat

SEQ ID NO: 8466219 - DNA, 22 bp, Homo sapiens
caataactagtaattattccgg

SEQ ID NO: 8466220 - DNA, 22 bp, Homo sapiens
caagttttgattttgcagtaaa

SEQ ID NO: 8466221 - DNA, 22 bp, Homo sapiens
caagttttgcatagttctgtat

SEQ ID NO: 8466222 - DNA, 22 bp, Homo sapiens
caagttttgattttgcagtaaa

SEQ ID NO: 8466223 - DNA, 21 bp, Homo sapiens
caataaactgcacattgagac

SEQ ID NO: 8466224 - DNA, 22 bp, Homo sapiens
caagttttagcaagtggaaagg

SEQ ID NO: 8466225 - DNA, 22 bp, Homo sapiens
caagttttagcaagtggaaagg

SEQ ID NO: 8466226 - DNA, 22 bp, Homo sapiens
caagttttagaaatatctggat

SEQ ID NO: 8466227 - DNA, 22 bp, Homo sapiens
gctttctggtttgtgctacagg

SEQ ID NO: 8466228 - DNA, 22 bp, Homo sapiens
gctttctggtttgtgctacagg

SEQ ID NO: 8466229 - DNA, 18 bp, Homo sapiens
gctttctgtagaaaaggg

SEQ ID NO: 8466230 - DNA, 18 bp, Homo sapiens
gctttctgtgcagcggag

SEQ ID NO: 8466231 - DNA, 22 bp, Homo sapiens
gctttctgtaggtagttactgt

SEQ ID NO: 8466232 - DNA, 22 bp, Homo sapiens
gctttctgtggtgatgtaaagg

SEQ ID NO: 8466233 - DNA, 22 bp, Homo sapiens
gctttctgtgcagtgaacacta

SEQ ID NO: 8466234 - DNA, 22 bp, Homo sapiens
gctttctgtgcagtgaacacta

SEQ ID NO: 8466235 - DNA, 21 bp, Homo sapiens
gctttctgtggactctgcacc

SEQ ID NO: 8466236 - DNA, 22 bp, Homo sapiens
gctttctggttctcaaagcact

SEQ ID NO: 8466237 - DNA, 22 bp, Homo sapiens
gctttctggttctcaaagcact

SEQ ID NO: 8466238 - DNA, 22 bp, Homo sapiens
gctttctgctctgtaaaatggg

SEQ ID NO: 8466239 - DNA, 22 bp, Homo sapiens
gctttctggagcctgggggaac

SEQ ID NO: 8466240 - DNA, 22 bp, Homo sapiens
gctttctgggctatagaacggg

SEQ ID NO: 8466241 - DNA, 22 bp, Homo sapiens
caataactgctgaggagaagca

SEQ ID NO: 8466242 - DNA, 22 bp, Homo sapiens
caataactttgatattttgcgg

SEQ ID NO: 8466243 - DNA, 22 bp, Homo sapiens
gctttgaagacttttccagggt

SEQ ID NO: 8466244 - DNA, 22 bp, Homo sapiens
caatgtatcaagaagcatcagt

SEQ ID NO: 8466245 - DNA, 22 bp, Homo sapiens
caatgtcaaggagaccaaaacg

SEQ ID NO: 8466246 - DNA, 22 bp, Homo sapiens
caatgtcatgattttccattag

SEQ ID NO: 8466247 - DNA, 22 bp, Homo sapiens
caagattatcttcttcttgtta

SEQ ID NO: 8466248 - DNA, 22 bp, Homo sapiens
caaatgtggtttctcagcattc

SEQ ID NO: 8466249 - DNA, 22 bp, Homo sapiens
caaatgtattctcacttcaggg

SEQ ID NO: 8466250 - DNA, 22 bp, Homo sapiens
caagatttaagagtcagccttg

SEQ ID NO: 8466251 - DNA, 22 bp, Homo sapiens
caagcagccccaacatgaggat

SEQ ID NO: 8466252 - DNA, 22 bp, Homo sapiens
caagcagccccaacatgaggat

SEQ ID NO: 8466253 - DNA, 22 bp, Homo sapiens
caagcaggatgaagcccaggga

SEQ ID NO: 8466254 - DNA, 22 bp, Homo sapiens
caagcaggcctggctggaccgt

SEQ ID NO: 8466255 - DNA, 19 bp, Homo sapiens
caaatgggacaggaaggca

SEQ ID NO: 8466256 - DNA, 22 bp, Homo sapiens
caaatggtcatttctcttttgt

SEQ ID NO: 8466257 - DNA, 22 bp, Homo sapiens
gctggaggatcacttgagccca

SEQ ID NO: 8466258 - DNA, 22 bp, Homo sapiens
caagccagtttgtagttctctc

SEQ ID NO: 8466259 - DNA, 22 bp, Homo sapiens
gctggaggatggactggaagaa

SEQ ID NO: 8466260 - DNA, 22 bp, Homo sapiens
gctggaggatcacttgagccca

SEQ ID NO: 8466261 - DNA, 22 bp, Homo sapiens
caagcatttattataattatca

SEQ ID NO: 8466262 - DNA, 21 bp, Homo sapiens
caagccagaccaatagcagcc

SEQ ID NO: 8466263 - DNA, 22 bp, Homo sapiens
caagcatactgtgagagtttta

SEQ ID NO: 8466264 - DNA, 22 bp, Homo sapiens
caagcagtcagcctgaagactg

SEQ ID NO: 8466265 - DNA, 22 bp, Homo sapiens
caagcagggatactgcagggag

SEQ ID NO: 8466266 - DNA, 22 bp, Homo sapiens
caagcagggtttatgcatggag

SEQ ID NO: 8466267 - DNA, 22 bp, Homo sapiens
caagcagggtttatgcatggag

SEQ ID NO: 8466268 - DNA, 22 bp, Homo sapiens
caagcaggtttgctattttctt

SEQ ID NO: 8466269 - DNA, 22 bp, Homo sapiens
caagcaggtcctgaatctggtc

SEQ ID NO: 8466270 - DNA, 22 bp, Homo sapiens
gctggaggcagttcagacacca

SEQ ID NO: 8466271 - DNA, 22 bp, Homo sapiens
gctggaggcagttcagacacca

SEQ ID NO: 8466272 - DNA, 22 bp, Homo sapiens
gctggaggcagttcagacacca

SEQ ID NO: 8466273 - DNA, 22 bp, Homo sapiens
gctggaggcagttcagacacca

SEQ ID NO: 8466274 - DNA, 22 bp, Homo sapiens
gctggaggctggagtgcagtgg

SEQ ID NO: 8466275 - DNA, 22 bp, Homo sapiens
caaggccaagtctctgtgaaga

SEQ ID NO: 8466276 - DNA, 22 bp, Homo sapiens
caaggcaggaagcctgtcttat

SEQ ID NO: 8466277 - DNA, 22 bp, Homo sapiens
caaggcaggaagcctgtcttat

SEQ ID NO: 8466278 - DNA, 22 bp, Homo sapiens
caaggccaaggttttgtgaact

SEQ ID NO: 8466279 - DNA, 22 bp, Homo sapiens
caaggccactccagagactggt

SEQ ID NO: 8466280 - DNA, 22 bp, Homo sapiens
caaggccactgctcaggtttcc

SEQ ID NO: 8466281 - DNA, 19 bp, Homo sapiens
caaggccaccatttctccg

SEQ ID NO: 8466282 - DNA, 22 bp, Homo sapiens
caaggccacgttctgcatgcgg

SEQ ID NO: 8466283 - DNA, 22 bp, Homo sapiens
caaggccataagagatacaaaa

SEQ ID NO: 8466284 - DNA, 22 bp, Homo sapiens
caaggccagtttctcctagtca

SEQ ID NO: 8466285 - DNA, 22 bp, Homo sapiens
caaggccagttcaccaagggca

SEQ ID NO: 8466286 - DNA, 22 bp, Homo sapiens
caaggccagtccattttggaag

SEQ ID NO: 8466287 - DNA, 22 bp, Homo sapiens
caaggccagggaatttttctgg

SEQ ID NO: 8466288 - DNA, 17 bp, Homo sapiens
caaggccagcatcttca

SEQ ID NO: 8466289 - DNA, 22 bp, Homo sapiens
caaggccagagccagcgataag

SEQ ID NO: 8466290 - DNA, 22 bp, Homo sapiens
caaggccatattgcctgtatgt

SEQ ID NO: 8466291 - DNA, 22 bp, Homo sapiens
caaggccatgagcagcgagtgt

SEQ ID NO: 8466292 - DNA, 22 bp, Homo sapiens
caaggccttcgtctcctagctt

SEQ ID NO: 8466293 - DNA, 22 bp, Homo sapiens
gctggctgggtccctgagaggc

SEQ ID NO: 8466294 - DNA, 22 bp, Homo sapiens
gctggctgggtccctgagaggc

SEQ ID NO: 8466295 - DNA, 22 bp, Homo sapiens
gctggctgtatcacctggccag

SEQ ID NO: 8466296 - DNA, 22 bp, Homo sapiens
caaggctttctcattatccttt

SEQ ID NO: 8466297 - DNA, 22 bp, Homo sapiens
caaggcttggagagaatgccat

SEQ ID NO: 8466298 - DNA, 22 bp, Homo sapiens
caaggcttgaattctgatgggt

SEQ ID NO: 8466299 - DNA, 20 bp, Homo sapiens
caaggcttctttgatggggt

SEQ ID NO: 8466300 - DNA, 22 bp, Homo sapiens
caaggcttggagagaatgccat

SEQ ID NO: 8466301 - DNA, 22 bp, Homo sapiens
caaggcttcacgtccccagtgc

SEQ ID NO: 8466302 - DNA, 22 bp, Homo sapiens
caaggcttcagtgtgacaaaac

SEQ ID NO: 8466303 - DNA, 22 bp, Homo sapiens
caaggcttattttcctccttcc

SEQ ID NO: 8466304 - DNA, 21 bp, Homo sapiens
gctggctgtcccagggaagca

SEQ ID NO: 8466305 - DNA, 22 bp, Homo sapiens
gctggctggtccagcaggggct

SEQ ID NO: 8466306 - DNA, 22 bp, Homo sapiens
caagggaagaggacagggacct

SEQ ID NO: 8466307 - DNA, 23 bp, Homo sapiens
cagaaaacccagagctcagtccc

SEQ ID NO: 8466308 - DNA, 22 bp, Homo sapiens
cagaaaacctgactctagaact

SEQ ID NO: 8466309 - DNA, 22 bp, Homo sapiens
cactttggatgccactggtcta

SEQ ID NO: 8466310 - DNA, 22 bp, Homo sapiens
cagaaaagggtgtttgttcagg

SEQ ID NO: 8466311 - DNA, 22 bp, Homo sapiens
cagaaaagggtgtttgttcagg

SEQ ID NO: 8466312 - DNA, 22 bp, Homo sapiens
cagaaaagggtgtttgttcagg

SEQ ID NO: 8466313 - DNA, 22 bp, Homo sapiens
cagaaaataaagtttctacgca

SEQ ID NO: 8466314 - DNA, 22 bp, Homo sapiens
cagaaaataaacatttgtggaa

SEQ ID NO: 8466315 - DNA, 20 bp, Homo sapiens
ggctgcccactccagagtac

SEQ ID NO: 8466316 - DNA, 22 bp, Homo sapiens
cagaaacatgtataaagttgta

SEQ ID NO: 8466317 - DNA, 22 bp, Homo sapiens
cagaaagcaaaatggatctctg

SEQ ID NO: 8466318 - DNA, 22 bp, Homo sapiens
ggctgcctatagaattattagt

SEQ ID NO: 8466319 - DNA, 22 bp, Homo sapiens
ggctgcctagacttggaatttc

SEQ ID NO: 8466320 - DNA, 22 bp, Homo sapiens
ggctgcctagacttggaatttc

SEQ ID NO: 8466321 - DNA, 22 bp, Homo sapiens
ggctgccctcgtctactgccca

SEQ ID NO: 8466322 - DNA, 22 bp, Homo sapiens
ggctgcctactttcccagagtt

SEQ ID NO: 8466323 - DNA, 22 bp, Homo sapiens
ggctgccctcggggtcgcaggc

SEQ ID NO: 8466324 - DNA, 22 bp, Homo sapiens
cagaaagcagttgtcaatgggc

SEQ ID NO: 8466325 - DNA, 22 bp, Homo sapiens
cagaaagcaagccattcactgt

SEQ ID NO: 8466326 - DNA, 22 bp, Homo sapiens
cagaaagccaactccaactgtc

SEQ ID NO: 8466327 - DNA, 20 bp, Homo sapiens
cagaaagcatgttccagggc

SEQ ID NO: 8466328 - DNA, 20 bp, Homo sapiens
cagaaagcatgttccagggc

SEQ ID NO: 8466329 - DNA, 22 bp, Homo sapiens
cagaaagccctatgtacagtgg

SEQ ID NO: 8466330 - DNA, 23 bp, Homo sapiens
cagaaagccctttccccacagta

SEQ ID NO: 8466331 - DNA, 22 bp, Homo sapiens
cagaaagccgacttacaatgga

SEQ ID NO: 8466332 - DNA, 22 bp, Homo sapiens
cagaaagcgggatgcagcatgt

SEQ ID NO: 8466333 - DNA, 22 bp, Homo sapiens
ggctgtctctgtgactgccacc

SEQ ID NO: 8466334 - DNA, 22 bp, Homo sapiens
ggctgtctctgtgactgccacc

SEQ ID NO: 8466335 - DNA, 22 bp, Homo sapiens
ggctgtcttgggagctcccccg

SEQ ID NO: 8466336 - DNA, 22 bp, Homo sapiens
ggctgtctctgtgactgccacc

SEQ ID NO: 8466337 - DNA, 22 bp, Homo sapiens
ggctgtgaagtagcaggggcag

SEQ ID NO: 8466338 - DNA, 22 bp, Homo sapiens
ggctgtgttccaagtgtcagga

SEQ ID NO: 8466339 - DNA, 21 bp, Homo sapiens
ggctggtgtttagctgtgata

SEQ ID NO: 8466340 - DNA, 22 bp, Homo sapiens
ggctggtgttgagtgcctgtag

SEQ ID NO: 8466341 - DNA, 20 bp, Homo sapiens
ggctgtcccgcggctgccgg

SEQ ID NO: 8466342 - DNA, 22 bp, Homo sapiens
ggctgtccacctaccatgccgg

SEQ ID NO: 8466343 - DNA, 22 bp, Homo sapiens
ggctgtccttggccaaggcact

SEQ ID NO: 8466344 - DNA, 20 bp, Homo sapiens
ggctgtcccgcggctgccgg

SEQ ID NO: 8466345 - DNA, 19 bp, Homo sapiens
ggctgtctacgaaccagtc

SEQ ID NO: 8466346 - DNA, 19 bp, Homo sapiens
ggctgtctcggcccagcca

SEQ ID NO: 8466347 - DNA, 22 bp, Homo sapiens
ggctgtaggttggtgctggaca

SEQ ID NO: 8466348 - DNA, 22 bp, Homo sapiens
ggctgtatatactgtatacagt

SEQ ID NO: 8466349 - DNA, 22 bp, Homo sapiens
ggctgtacctgcctctcctcta

SEQ ID NO: 8466350 - DNA, 22 bp, Homo sapiens
cagaaatacccagcatttggag

SEQ ID NO: 8466351 - DNA, 22 bp, Homo sapiens
cagaaagtgatttgctattcca

SEQ ID NO: 8466352 - DNA, 23 bp, Homo sapiens
cagaaagtttgagaagatacatc

SEQ ID NO: 8466353 - DNA, 23 bp, Homo sapiens
cagaaagtttgagaagatacatc

SEQ ID NO: 8466354 - DNA, 18 bp, Homo sapiens
cagaaagttatttactct

SEQ ID NO: 8466355 - DNA, 22 bp, Homo sapiens
cagaaagctctttcaatcttgc

SEQ ID NO: 8466356 - DNA, 22 bp, Homo sapiens
cagaaagctctttcaatcttgc

SEQ ID NO: 8466357 - DNA, 22 bp, Homo sapiens
ggctctggtgccctggctccca

SEQ ID NO: 8466358 - DNA, 22 bp, Homo sapiens
ggctctggtgccctggctccca

SEQ ID NO: 8466359 - DNA, 22 bp, Homo sapiens
ggctctggtgccctggctccca

SEQ ID NO: 8466360 - DNA, 22 bp, Homo sapiens
ggctctggtgagggtaggagat

SEQ ID NO: 8466361 - DNA, 22 bp, Homo sapiens
ggctctggtgagggtaggagat

SEQ ID NO: 8466362 - DNA, 22 bp, Homo sapiens
ggctctggtgggaaggttagat

SEQ ID NO: 8466363 - DNA, 22 bp, Homo sapiens
ggctctggtggcaattgactgg

SEQ ID NO: 8466364 - DNA, 22 bp, Homo sapiens
ggctctggtgggaaggttagat

SEQ ID NO: 8466365 - DNA, 22 bp, Homo sapiens
ggctgaggcggcgatgcccttg

SEQ ID NO: 8466366 - DNA, 22 bp, Homo sapiens
ggctgagcttatatatgtgctg

SEQ ID NO: 8466367 - DNA, 22 bp, Homo sapiens
ggctgagcttttcatgatggtt

SEQ ID NO: 8466368 - DNA, 19 bp, Homo sapiens
ggctgagcgccttggctgc

SEQ ID NO: 8466369 - DNA, 22 bp, Homo sapiens
ggctccaggtgcatgccaggct

SEQ ID NO: 8466370 - DNA, 22 bp, Homo sapiens
ggctccaggtgcatgccaggct

SEQ ID NO: 8466371 - DNA, 22 bp, Homo sapiens
ggctctggtcagtgaggggcct

SEQ ID NO: 8466372 - DNA, 22 bp, Homo sapiens
ggctctggtcagtgaggggcct

SEQ ID NO: 8466373 - DNA, 22 bp, Homo sapiens
ggctcaggttgggtcacatgac

SEQ ID NO: 8466374 - DNA, 22 bp, Homo sapiens
ggctccagggtacccctggatg

SEQ ID NO: 8466375 - DNA, 22 bp, Homo sapiens
ggctcaggttgggtcacatgac

SEQ ID NO: 8466376 - DNA, 22 bp, Homo sapiens
ggctcaggttaccagtccctcc

SEQ ID NO: 8466377 - DNA, 22 bp, Homo sapiens
ggctccagggtctctccttgtg

SEQ ID NO: 8466378 - DNA, 22 bp, Homo sapiens
ggctcaggcctgtaatcctagc

SEQ ID NO: 8466379 - DNA, 22 bp, Homo sapiens
ggctcacacatgactgggctct

SEQ ID NO: 8466380 - DNA, 18 bp, Homo sapiens
ggctcaggctatcctaac

SEQ ID NO: 8466381 - DNA, 18 bp, Homo sapiens
ggctcaggctatcctaac

SEQ ID NO: 8466382 - DNA, 22 bp, Homo sapiens
ggctcaggctggagtgcagtgg

SEQ ID NO: 8466383 - DNA, 22 bp, Homo sapiens
ggctcaggcctgtaatcctagc

SEQ ID NO: 8466384 - DNA, 22 bp, Homo sapiens
ggctcaggctggagtgcagtgg

SEQ ID NO: 8466385 - DNA, 22 bp, Homo sapiens
ggctcagggaatgaggaagaat

SEQ ID NO: 8466386 - DNA, 22 bp, Homo sapiens
ggctcagggaatgaggaagaat

SEQ ID NO: 8466387 - DNA, 19 bp, Homo sapiens
ggctcagggcgctgccgcc

SEQ ID NO: 8466388 - DNA, 19 bp, Homo sapiens
ggctcagggcgctgccgcc

SEQ ID NO: 8466389 - DNA, 19 bp, Homo sapiens
ggctcagggcgctgccgcc

SEQ ID NO: 8466390 - DNA, 22 bp, Homo sapiens
ggctcaggggccaggcctgtcc

SEQ ID NO: 8466391 - DNA, 22 bp, Homo sapiens
ggctcaggggccaggcctgtcc

SEQ ID NO: 8466392 - DNA, 22 bp, Homo sapiens
ggctcaggggccaggcctgtcc

SEQ ID NO: 8466393 - DNA, 22 bp, Homo sapiens
ggcctgtgctgtcagccctagt

SEQ ID NO: 8466394 - DNA, 22 bp, Homo sapiens
ggcctgtgggaggacagctggg

SEQ ID NO: 8466395 - DNA, 22 bp, Homo sapiens
ggcctgtgtctgtgcctgtcct

SEQ ID NO: 8466396 - DNA, 22 bp, Homo sapiens
ggcctgtgtcctccttgccctg

SEQ ID NO: 8466397 - DNA, 22 bp, Homo sapiens
ggcctgtgtcctccttgccctg

SEQ ID NO: 8466398 - DNA, 22 bp, Homo sapiens
ggcctgagcagacagcatgatg

SEQ ID NO: 8466399 - DNA, 20 bp, Homo sapiens
ggcctgagcatggctggcag

SEQ ID NO: 8466400 - DNA, 22 bp, Homo sapiens
ggcctgagctctggggaggcaa

SEQ ID NO: 8466401 - DNA, 22 bp, Homo sapiens
ggcctgagcttgggcagcgtat

SEQ ID NO: 8466402 - DNA, 22 bp, Homo sapiens
ggcctgaggcaatagtcagaca

SEQ ID NO: 8466403 - DNA, 22 bp, Homo sapiens
ggcctgaggccaccagcagccc

SEQ ID NO: 8466404 - DNA, 22 bp, Homo sapiens
ggcctgaggccaccagcagccc

SEQ ID NO: 8466405 - DNA, 22 bp, Homo sapiens
ggcctgaggccaccagcagccc

SEQ ID NO: 8466406 - DNA, 19 bp, Homo sapiens
ggcctgaggccacagatcc

SEQ ID NO: 8466407 - DNA, 19 bp, Homo sapiens
ggcctgaggccacagatcc

SEQ ID NO: 8466408 - DNA, 19 bp, Homo sapiens
ggcctgaggccacagatcc

SEQ ID NO: 8466409 - DNA, 22 bp, Homo sapiens
ggcctgaggccaccagcagccc

SEQ ID NO: 8466410 - DNA, 22 bp, Homo sapiens
ggcctgaggcgtcccagctgtg

SEQ ID NO: 8466411 - DNA, 22 bp, Homo sapiens
ggcctgaggcgtcccagctgtg

SEQ ID NO: 8466412 - DNA, 22 bp, Homo sapiens
ggcctgtgagcccttgcatgta

SEQ ID NO: 8466413 - DNA, 22 bp, Homo sapiens
ggcctgtgagcccttgcatgta

SEQ ID NO: 8466414 - DNA, 22 bp, Homo sapiens
ggcctgtgcaagacagcacccc

SEQ ID NO: 8466415 - DNA, 22 bp, Homo sapiens
ggcctgtgcacatgtgcaggaa

SEQ ID NO: 8466416 - DNA, 22 bp, Homo sapiens
cacatacaatggtgttatttgg

SEQ ID NO: 8466417 - DNA, 22 bp, Homo sapiens
cacataaatggtgccatgtttt

SEQ ID NO: 8466418 - DNA, 22 bp, Homo sapiens
cacagttttgcccagggcttct

SEQ ID NO: 8466419 - DNA, 22 bp, Homo sapiens
cacatacatacgtatgtataca

SEQ ID NO: 8466420 - DNA, 22 bp, Homo sapiens
cacatacatgcacacctaaata

SEQ ID NO: 8466421 - DNA, 22 bp, Homo sapiens
cacaggcttttttggctgatgt

SEQ ID NO: 8466422 - DNA, 22 bp, Homo sapiens
cacaggcttttttggctgatgt

SEQ ID NO: 8466423 - DNA, 22 bp, Homo sapiens
ggaggtgatcagagttttgagg

SEQ ID NO: 8466424 - DNA, 22 bp, Homo sapiens
ggaggtgactggatcatgggca

SEQ ID NO: 8466425 - DNA, 22 bp, Homo sapiens
ggaggtgaggccgtagggtgtg

SEQ ID NO: 8466426 - DNA, 22 bp, Homo sapiens
ggaggtggagctggaagttcca

SEQ ID NO: 8466427 - DNA, 22 bp, Homo sapiens
ggcaggcaggtcttcatggccc

SEQ ID NO: 8466428 - DNA, 22 bp, Homo sapiens
cacatttctaggaaattaaatg

SEQ ID NO: 8466429 - DNA, 20 bp, Homo sapiens
ggcaggcaggaggtttccag

SEQ ID NO: 8466430 - DNA, 22 bp, Homo sapiens
ggcaggcatggggtctgccatt

SEQ ID NO: 8466431 - DNA, 22 bp, Homo sapiens
ggcagggagagcatgctgataa

SEQ ID NO: 8466432 - DNA, 22 bp, Homo sapiens
ggcaggcatcatgtggtcatta

SEQ ID NO: 8466433 - DNA, 22 bp, Homo sapiens
cacatttagaggttagcatggt

SEQ ID NO: 8466434 - DNA, 22 bp, Homo sapiens
cacatttacatataaaactttc

SEQ ID NO: 8466435 - DNA, 22 bp, Homo sapiens
cacattcttgagttacagtcta

SEQ ID NO: 8466436 - DNA, 22 bp, Homo sapiens
ggccactgcctccgccatggct

SEQ ID NO: 8466437 - DNA, 22 bp, Homo sapiens
ggccactgccctggctacaccg

SEQ ID NO: 8466438 - DNA, 22 bp, Homo sapiens
ggccactgacctacatctgggg

SEQ ID NO: 8466439 - DNA, 22 bp, Homo sapiens
ggccactgccctggctacaccg

SEQ ID NO: 8466440 - DNA, 22 bp, Homo sapiens
ggccactgacctacatctgggg

SEQ ID NO: 8466441 - DNA, 22 bp, Homo sapiens
ggccactgctctccagcctggg

SEQ ID NO: 8466442 - DNA, 22 bp, Homo sapiens
ggccactgtcctctagcccaga

SEQ ID NO: 8466443 - DNA, 22 bp, Homo sapiens
ggccccaggtagaagatataga

SEQ ID NO: 8466444 - DNA, 22 bp, Homo sapiens
ggcccttcctcttgtgctggca

SEQ ID NO: 8466445 - DNA, 22 bp, Homo sapiens
ggccctgttagagctcccacaa

SEQ ID NO: 8466446 - DNA, 22 bp, Homo sapiens
ggccctgttagagctcccacaa

SEQ ID NO: 8466447 - DNA, 20 bp, Homo sapiens
caccttcaaatttcctggca

SEQ ID NO: 8466448 - DNA, 22 bp, Homo sapiens
caccttcagaatgctccaggca

SEQ ID NO: 8466449 - DNA, 22 bp, Homo sapiens
ggcctctctccagtcagtgcag

SEQ ID NO: 8466450 - DNA, 19 bp, Homo sapiens
cacgagttctcttagcaaa

SEQ ID NO: 8466451 - DNA, 22 bp, Homo sapiens
ggccgctgcgcctccaaccgag

SEQ ID NO: 8466452 - DNA, 22 bp, Homo sapiens
cacctgttagctctaattttct

SEQ ID NO: 8466453 - DNA, 22 bp, Homo sapiens
cacctgttagctctaattttct

SEQ ID NO: 8466454 - DNA, 22 bp, Homo sapiens
cacctgttgtttattcatctct

SEQ ID NO: 8466455 - DNA, 22 bp, Homo sapiens
cacctggttctagtgaaagtct

SEQ ID NO: 8466456 - DNA, 22 bp, Homo sapiens
cacctgggtcattgctggtgtt

SEQ ID NO: 8466457 - DNA, 22 bp, Homo sapiens
ggcagggcaggaaagtcaggaa

SEQ ID NO: 8466458 - DNA, 22 bp, Homo sapiens
ggcaggtgccagttggcttggg

SEQ ID NO: 8466459 - DNA, 22 bp, Homo sapiens
ggcaggtgccagttggcttggg

SEQ ID NO: 8466460 - DNA, 22 bp, Homo sapiens
ggcaggtgcccagagagcacga

SEQ ID NO: 8466461 - DNA, 22 bp, Homo sapiens
ggcaggtgcccagagagcacga

SEQ ID NO: 8466462 - DNA, 22 bp, Homo sapiens
ggcaggtgcacctgagccatct

SEQ ID NO: 8466463 - DNA, 22 bp, Homo sapiens
ggccacgtgacctctggctcct

SEQ ID NO: 8466464 - DNA, 22 bp, Homo sapiens
ggccaaggatggtggctctggt

SEQ ID NO: 8466465 - DNA, 23 bp, Homo sapiens
ggccactgaattttctgcatctt

SEQ ID NO: 8466466 - DNA, 23 bp, Homo sapiens
ggccactgaattttctgcatctt

SEQ ID NO: 8466467 - DNA, 22 bp, Homo sapiens
ggcatttttgacaaagagcaat

SEQ ID NO: 8466468 - DNA, 22 bp, Homo sapiens
ggcatttgagccattggcctgt

SEQ ID NO: 8466469 - DNA, 22 bp, Homo sapiens
ggcatcaggatctgtcttgctt

SEQ ID NO: 8466470 - DNA, 22 bp, Homo sapiens
ggcatcaggatctgtcttgctt

SEQ ID NO: 8466471 - DNA, 22 bp, Homo sapiens
ggcatcaggagcttcttcaggt

SEQ ID NO: 8466472 - DNA, 22 bp, Homo sapiens
cagcaagagttggggttgttgg

SEQ ID NO: 8466473 - DNA, 22 bp, Homo sapiens
cagcaagagggtaaggttgaag

SEQ ID NO: 8466474 - DNA, 22 bp, Homo sapiens
cagcaagagactgttctctaag

SEQ ID NO: 8466475 - DNA, 22 bp, Homo sapiens
cagcaagagaggcagggcaaat

SEQ ID NO: 8466476 - DNA, 22 bp, Homo sapiens
cagcaagacttcagggcttggt

SEQ ID NO: 8466477 - DNA, 22 bp, Homo sapiens
cagcaagatttttaaagcaagg

SEQ ID NO: 8466478 - DNA, 22 bp, Homo sapiens
cagcaagattaagggcagaaaa

SEQ ID NO: 8466479 - DNA, 22 bp, Homo sapiens
cagcaagatggtgaatgagacg

SEQ ID NO: 8466480 - DNA, 22 bp, Homo sapiens
cagcaagacaaggaacaaactg

SEQ ID NO: 8466481 - DNA, 22 bp, Homo sapiens
cagcaagacaaggaacaaactg

SEQ ID NO: 8466482 - DNA, 22 bp, Homo sapiens
cagcaaatactactagttttta

SEQ ID NO: 8466483 - DNA, 21 bp, Homo sapiens
cagcaagacatgtttatcaag

SEQ ID NO: 8466484 - DNA, 22 bp, Homo sapiens
cagcaagacaggattcccgtgg

SEQ ID NO: 8466485 - DNA, 22 bp, Homo sapiens
cagcaagacagtttcctaagtg

SEQ ID NO: 8466486 - DNA, 22 bp, Homo sapiens
ggtgagactttagaagagccag

SEQ ID NO: 8466487 - DNA, 22 bp, Homo sapiens
ggtgagactttagaagagccag

SEQ ID NO: 8466488 - DNA, 22 bp, Homo sapiens
ggtgactggtttatctggcagt

SEQ ID NO: 8466489 - DNA, 22 bp, Homo sapiens
ggtgacgaatccatagcatcga

SEQ ID NO: 8466490 - DNA, 22 bp, Homo sapiens
ggtctggaataaggtccaggaa

SEQ ID NO: 8466491 - DNA, 22 bp, Homo sapiens
ggtgacatctagagacatccaa

SEQ ID NO: 8466492 - DNA, 22 bp, Homo sapiens
ggtgacatagttacttcaggct

SEQ ID NO: 8466493 - DNA, 22 bp, Homo sapiens
ggtgacctcacctggtcccacc

SEQ ID NO: 8466494 - DNA, 22 bp, Homo sapiens
ggtgacctcacctggtcccacc

SEQ ID NO: 8466495 - DNA, 22 bp, Homo sapiens
ggtctgaggctccaaggaggtg

SEQ ID NO: 8466496 - DNA, 22 bp, Homo sapiens
ggtctgagcttgagcccatgct

SEQ ID NO: 8466497 - DNA, 22 bp, Homo sapiens
ggtctgagcttgagcccatgct

SEQ ID NO: 8466498 - DNA, 18 bp, Homo sapiens
ggtctgagatcgtttttc

SEQ ID NO: 8466499 - DNA, 22 bp, Homo sapiens
ggtctgagtgggcaggggccgg

SEQ ID NO: 8466500 - DNA, 22 bp, Homo sapiens
ggtgctgatgaagatgtagcct

SEQ ID NO: 8466501 - DNA, 22 bp, Homo sapiens
ggtgctgagtgagctagaggct

SEQ ID NO: 8466502 - DNA, 22 bp, Homo sapiens
ggtgctgcctatagtctgaaac

SEQ ID NO: 8466503 - DNA, 22 bp, Homo sapiens
ggtgctggacacgtggcactcc

SEQ ID NO: 8466504 - DNA, 22 bp, Homo sapiens
ggtgctgggaacgaggaattca

SEQ ID NO: 8466505 - DNA, 22 bp, Homo sapiens
cagcaaggactgggcatgtgaa

SEQ ID NO: 8466506 - DNA, 22 bp, Homo sapiens
ggtgctgaggccttggcaggga

SEQ ID NO: 8466507 - DNA, 20 bp, Homo sapiens
ggtgctgataagaaagaagt

SEQ ID NO: 8466508 - DNA, 22 bp, Homo sapiens
ggtgctgatagtaacaataata

SEQ ID NO: 8466509 - DNA, 22 bp, Homo sapiens
ggtgctgaattctggaggaggc

SEQ ID NO: 8466510 - DNA, 22 bp, Homo sapiens
ggtgctgactgaggatggcttg

SEQ ID NO: 8466511 - DNA, 22 bp, Homo sapiens
ggtgctgagagcctaggagggc

SEQ ID NO: 8466512 - DNA, 22 bp, Homo sapiens
cagcaccatttgcagcctcttt

SEQ ID NO: 8466513 - DNA, 22 bp, Homo sapiens
cagcacatttactcagccctca

SEQ ID NO: 8466514 - DNA, 19 bp, Homo sapiens
cagcacatgcttctctgag

SEQ ID NO: 8466515 - DNA, 22 bp, Homo sapiens
cagcacatctgattatatgact

SEQ ID NO: 8466516 - DNA, 22 bp, Homo sapiens
cagcacagtttgcttggcagag

SEQ ID NO: 8466517 - DNA, 22 bp, Homo sapiens
cagcacagtttgcttggcagag

SEQ ID NO: 8466518 - DNA, 22 bp, Homo sapiens
cagcacataagccgaagactgt

SEQ ID NO: 8466519 - DNA, 22 bp, Homo sapiens
cagcacagtgaccagacccact

SEQ ID NO: 8466520 - DNA, 22 bp, Homo sapiens
cagcacagtttcccccatgagc

SEQ ID NO: 8466521 - DNA, 22 bp, Homo sapiens
cagagggctcggcggccgctcc

SEQ ID NO: 8466522 - DNA, 22 bp, Homo sapiens
cagagggctgtgtaaggatgtt

SEQ ID NO: 8466523 - DNA, 22 bp, Homo sapiens
cagagggcttcaggttcaggat

SEQ ID NO: 8466524 - DNA, 22 bp, Homo sapiens
cagaggggctgacacccttggc

SEQ ID NO: 8466525 - DNA, 22 bp, Homo sapiens
cagagggtgtgaaggggatgaa

SEQ ID NO: 8466526 - DNA, 22 bp, Homo sapiens
cagaggggataacaggtgtaga

SEQ ID NO: 8466527 - DNA, 22 bp, Homo sapiens
cagaggggctgacacccttggc

SEQ ID NO: 8466528 - DNA, 21 bp, Homo sapiens
cagaggggctagcctggctgc

SEQ ID NO: 8466529 - DNA, 21 bp, Homo sapiens
cagaggggctagcctggctgc

SEQ ID NO: 8466530 - DNA, 22 bp, Homo sapiens
ggggagatgcttaggtccgggg

SEQ ID NO: 8466531 - DNA, 22 bp, Homo sapiens
ggggagcaatagttgaggtgtg

SEQ ID NO: 8466532 - DNA, 22 bp, Homo sapiens
ggggagcaggctgggctgtctg

SEQ ID NO: 8466533 - DNA, 22 bp, Homo sapiens
ggggagaccatctgaaggtgat

SEQ ID NO: 8466534 - DNA, 16 bp, Homo sapiens
cagaggcacctggctc

SEQ ID NO: 8466535 - DNA, 22 bp, Homo sapiens
cagaggcacaagaaagcaaggc

SEQ ID NO: 8466536 - DNA, 22 bp, Homo sapiens
cagaggcacagtgcgggccact

SEQ ID NO: 8466537 - DNA, 22 bp, Homo sapiens
cagaggcacaagaaagcaaggc

SEQ ID NO: 8466538 - DNA, 22 bp, Homo sapiens
cagagtctggactgcaggctcc

SEQ ID NO: 8466539 - DNA, 17 bp, Homo sapiens
cagagtctgtctgcatc

SEQ ID NO: 8466540 - DNA, 22 bp, Homo sapiens
cagagtcttgtgtgttcagccc

SEQ ID NO: 8466541 - DNA, 22 bp, Homo sapiens
ggtcctgggaagatgctcatga

SEQ ID NO: 8466542 - DNA, 22 bp, Homo sapiens
cagagtctggactgcaggctcc

SEQ ID NO: 8466543 - DNA, 22 bp, Homo sapiens
ggtcctgggaagatgctcatga

SEQ ID NO: 8466544 - DNA, 22 bp, Homo sapiens
ggtctgagatatttgttcagct

SEQ ID NO: 8466545 - DNA, 18 bp, Homo sapiens
ggtcctgggcctggctca

SEQ ID NO: 8466546 - DNA, 22 bp, Homo sapiens
cagagtctggactgcaggctcc

SEQ ID NO: 8466547 - DNA, 22 bp, Homo sapiens
cagagtctctgggaggctgggt

SEQ ID NO: 8466548 - DNA, 22 bp, Homo sapiens
cagagtctctgggaggctgggt

SEQ ID NO: 8466549 - DNA, 22 bp, Homo sapiens
cagagtcctgcaccagctccag

SEQ ID NO: 8466550 - DNA, 22 bp, Homo sapiens
cagagtcctggacacagagaca

SEQ ID NO: 8466551 - DNA, 22 bp, Homo sapiens
cagagtcagtattgaattgaaa

SEQ ID NO: 8466552 - DNA, 23 bp, Homo sapiens
ggtccacccgagcctgcagcttc

SEQ ID NO: 8466553 - DNA, 22 bp, Homo sapiens
ggtccaaggctcggtggcgggg

SEQ ID NO: 8466554 - DNA, 22 bp, Homo sapiens
ggtcagtgtatgtattgataag

SEQ ID NO: 8466555 - DNA, 22 bp, Homo sapiens
ggtcagtggcagggggtacttc

SEQ ID NO: 8466556 - DNA, 22 bp, Homo sapiens
ggtcagtgacttttttctgtgg

SEQ ID NO: 8466557 - DNA, 22 bp, Homo sapiens
ggtcagtgcgatttcccactcc

SEQ ID NO: 8466558 - DNA, 22 bp, Homo sapiens
ggtcagtgcgatttcccactcc

SEQ ID NO: 8466559 - DNA, 22 bp, Homo sapiens
ggtcagtgcctatcatgtgggc

SEQ ID NO: 8466560 - DNA, 23 bp, Homo sapiens
ggtcagtgagttcgtttctctgg

SEQ ID NO: 8466561 - DNA, 22 bp, Homo sapiens
ggtcacagggaagggctctcaa

SEQ ID NO: 8466562 - DNA, 22 bp, Homo sapiens
ggtcaggtagctctgacaggcc

SEQ ID NO: 8466563 - DNA, 22 bp, Homo sapiens
cagagggttgtcaggcgccttg

SEQ ID NO: 8466564 - DNA, 17 bp, Homo sapiens
ggcttcagggagctggg

SEQ ID NO: 8466565 - DNA, 22 bp, Homo sapiens
ggcttcacctgtgcactctacc

SEQ ID NO: 8466566 - DNA, 20 bp, Homo sapiens
ggcttcactctgcaccacca

SEQ ID NO: 8466567 - DNA, 22 bp, Homo sapiens
ggcttcagaggggaggtagtgc

SEQ ID NO: 8466568 - DNA, 22 bp, Homo sapiens
ggcttcacagttgtagcagctc

SEQ ID NO: 8466569 - DNA, 22 bp, Homo sapiens
ggcttagattgacactgatctc

SEQ ID NO: 8466570 - DNA, 21 bp, Homo sapiens
cagaccctctagaggccacct

SEQ ID NO: 8466571 - DNA, 22 bp, Homo sapiens
cagacctcaaagctgcagtgct

SEQ ID NO: 8466572 - DNA, 22 bp, Homo sapiens
cagacctcagtcctcagtagga

SEQ ID NO: 8466573 - DNA, 22 bp, Homo sapiens
cagaccatcttgaagcaaactg

SEQ ID NO: 8466574 - DNA, 22 bp, Homo sapiens
cagacccaggatccaaatgttg

SEQ ID NO: 8466575 - DNA, 22 bp, Homo sapiens
cagaccagccatttgcctcttc

SEQ ID NO: 8466576 - DNA, 22 bp, Homo sapiens
gggcagcagagccctgccgagt

SEQ ID NO: 8466577 - DNA, 22 bp, Homo sapiens
cagactctgatgcagccttgtg

SEQ ID NO: 8466578 - DNA, 22 bp, Homo sapiens
cagactctcttccatgcatcac

SEQ ID NO: 8466579 - DNA, 22 bp, Homo sapiens
cagactcttgagctgattgtat

SEQ ID NO: 8466580 - DNA, 22 bp, Homo sapiens
cagactggccacatctgcactg

SEQ ID NO: 8466581 - DNA, 22 bp, Homo sapiens
cagagacaggagtgctcccagt

SEQ ID NO: 8466582 - DNA, 22 bp, Homo sapiens
cagagacaggaatcagctgcag

SEQ ID NO: 8466583 - DNA, 22 bp, Homo sapiens
cagagacaggaatcagctgcag

SEQ ID NO: 8466584 - DNA, 22 bp, Homo sapiens
cagagacaggatctcgaagact

SEQ ID NO: 8466585 - DNA, 22 bp, Homo sapiens
cagagacaggatctcgaagact

SEQ ID NO: 8466586 - DNA, 22 bp, Homo sapiens
cagagacaggatctcgaagact

SEQ ID NO: 8466587 - DNA, 22 bp, Homo sapiens
cagagacaggagtgctcccagt

SEQ ID NO: 8466588 - DNA, 22 bp, Homo sapiens
cagagacaggagtgctcccagt

SEQ ID NO: 8466589 - DNA, 22 bp, Homo sapiens
cagagacagggcagggagtgtg

SEQ ID NO: 8466590 - DNA, 22 bp, Homo sapiens
cagagacaggcttgccctccac

SEQ ID NO: 8466591 - DNA, 22 bp, Homo sapiens
cagagacaggcttgccctccac

SEQ ID NO: 8466592 - DNA, 22 bp, Homo sapiens
gggcagtggttacacagctgag

SEQ ID NO: 8466593 - DNA, 22 bp, Homo sapiens
gggcagtggtccaggctacagc

SEQ ID NO: 8466594 - DNA, 22 bp, Homo sapiens
gggcagtgggaccaggcaccag

SEQ ID NO: 8466595 - DNA, 22 bp, Homo sapiens
gggcagtgggtggctgcagcct

SEQ ID NO: 8466596 - DNA, 22 bp, Homo sapiens
gggcagcagcaggaggtctctg

SEQ ID NO: 8466597 - DNA, 22 bp, Homo sapiens
gggcagcatgaggaccctcatc

SEQ ID NO: 8466598 - DNA, 22 bp, Homo sapiens
gggcagcagttgccctaatcaa

SEQ ID NO: 8466599 - DNA, 22 bp, Homo sapiens
gggcagcaggctccacgttcct

SEQ ID NO: 8466600 - DNA, 22 bp, Homo sapiens
cagagacagcaagttgatttcc

SEQ ID NO: 8466601 - DNA, 22 bp, Homo sapiens
cagagacagcaagttgatttcc

SEQ ID NO: 8466602 - DNA, 22 bp, Homo sapiens
cagagacagaaaatggatctag

SEQ ID NO: 8466603 - DNA, 22 bp, Homo sapiens
cagagacaggaatcagctgcag

SEQ ID NO: 8466604 - DNA, 22 bp, Homo sapiens
gggctctgtttagatcagagat

SEQ ID NO: 8466605 - DNA, 22 bp, Homo sapiens
gggctctgtttagaccagagat

SEQ ID NO: 8466606 - DNA, 22 bp, Homo sapiens
cagagcctcagaatcctgtgga

SEQ ID NO: 8466607 - DNA, 22 bp, Homo sapiens
cagagcctcagaatcctgtgga

SEQ ID NO: 8466608 - DNA, 22 bp, Homo sapiens
cagagcctcagaatcctgtgga

SEQ ID NO: 8466609 - DNA, 22 bp, Homo sapiens
cagagcctcagaatcctgtgga

SEQ ID NO: 8466610 - DNA, 19 bp, Homo sapiens
cagagcctcagagctagaa

SEQ ID NO: 8466611 - DNA, 19 bp, Homo sapiens
cagagcctcagagctagaa

SEQ ID NO: 8466612 - DNA, 19 bp, Homo sapiens
cagagcctcagagctagaa

SEQ ID NO: 8466613 - DNA, 19 bp, Homo sapiens
cagagcctcagagctagaa

SEQ ID NO: 8466614 - DNA, 22 bp, Homo sapiens
cagagcccttggctggagccca

SEQ ID NO: 8466615 - DNA, 22 bp, Homo sapiens
cagagcctaaaacgactccact

SEQ ID NO: 8466616 - DNA, 22 bp, Homo sapiens
cagagcctaaaacgactccact

SEQ ID NO: 8466617 - DNA, 22 bp, Homo sapiens
gggccactgggtcctgctggcc

SEQ ID NO: 8466618 - DNA, 22 bp, Homo sapiens
gggccacttctagtgcctcaga

SEQ ID NO: 8466619 - DNA, 22 bp, Homo sapiens
gggccacctggattccatgtgt

SEQ ID NO: 8466620 - DNA, 22 bp, Homo sapiens
gggccacctggattccatgtgt

SEQ ID NO: 8466621 - DNA, 22 bp, Homo sapiens
gggcagtgtcggggcccaggga

SEQ ID NO: 8466622 - DNA, 22 bp, Homo sapiens
gggccagagcacagaggatgtt

SEQ ID NO: 8466623 - DNA, 22 bp, Homo sapiens
gggccagagcacagaggatgtt

SEQ ID NO: 8466624 - DNA, 22 bp, Homo sapiens
gggccagcagtatcggaggcat

SEQ ID NO: 8466625 - DNA, 22 bp, Homo sapiens
gggccagcagtatcggaggcat

SEQ ID NO: 8466626 - DNA, 22 bp, Homo sapiens
gggccagctctgtgatgtaggg

SEQ ID NO: 8466627 - DNA, 22 bp, Homo sapiens
gggccagctctgtgatgtaggg

SEQ ID NO: 8466628 - DNA, 22 bp, Homo sapiens
cagagcctgctcacgtctctgt

SEQ ID NO: 8466629 - DNA, 22 bp, Homo sapiens
cagagcctgcctctggctgtgg

SEQ ID NO: 8466630 - DNA, 22 bp, Homo sapiens
cagagctggctctgcatgtaca

SEQ ID NO: 8466631 - DNA, 22 bp, Homo sapiens
cagagctgcttcccagtttgtg

SEQ ID NO: 8466632 - DNA, 22 bp, Homo sapiens
cagagcctctcagaggtcagac

SEQ ID NO: 8466633 - DNA, 22 bp, Homo sapiens
cagagcctccctcctctgccat

SEQ ID NO: 8466634 - DNA, 22 bp, Homo sapiens
cagagcctctgccctgggcact

SEQ ID NO: 8466635 - DNA, 22 bp, Homo sapiens
cagagcctgccacctttctccc

SEQ ID NO: 8466636 - DNA, 22 bp, Homo sapiens
cagagcctctgccctgggcact

SEQ ID NO: 8466637 - DNA, 22 bp, Homo sapiens
cagagcctctgccctgggcact

SEQ ID NO: 8466638 - DNA, 22 bp, Homo sapiens
cagagcctctcagccccttggg

SEQ ID NO: 8466639 - DNA, 23 bp, Homo sapiens
cagagctggcttcatgggtgtgc

SEQ ID NO: 8466640 - DNA, 22 bp, Homo sapiens
cagagctggggactgttggatg

SEQ ID NO: 8466641 - DNA, 22 bp, Homo sapiens
cagagctgggcatggtgaaagg

SEQ ID NO: 8466642 - DNA, 22 bp, Homo sapiens
cagagctgggcatggtgaaagg

SEQ ID NO: 8466643 - DNA, 22 bp, Homo sapiens
gggctgagtgacctcaggccaa

SEQ ID NO: 8466644 - DNA, 22 bp, Homo sapiens
gggctgagtctgctgcctgtca

SEQ ID NO: 8466645 - DNA, 22 bp, Homo sapiens
gggctgagtcatctggggcctc

SEQ ID NO: 8466646 - DNA, 22 bp, Homo sapiens
gggctgaggggtatctcatggg

SEQ ID NO: 8466647 - DNA, 22 bp, Homo sapiens
gggctgaggggtatctcatggg

SEQ ID NO: 8466648 - DNA, 22 bp, Homo sapiens
cagagctgggtttgggaaacct

SEQ ID NO: 8466649 - DNA, 22 bp, Homo sapiens
gggctgaggggtatctcatggg

SEQ ID NO: 8466650 - DNA, 20 bp, Homo sapiens
cagaggcaaggagacttgga

SEQ ID NO: 8466651 - DNA, 22 bp, Homo sapiens
cagaggcaaaagaggtggaggt

SEQ ID NO: 8466652 - DNA, 22 bp, Homo sapiens
cagaggcaaaagaggtggaggt

SEQ ID NO: 8466653 - DNA, 22 bp, Homo sapiens
cagaggcaaaagaggtggaggt

SEQ ID NO: 8466654 - DNA, 22 bp, Homo sapiens
cagcagctgcaaatggaaacag

SEQ ID NO: 8466655 - DNA, 22 bp, Homo sapiens
cagcagctgatggggaagtgat

SEQ ID NO: 8466656 - DNA, 22 bp, Homo sapiens
cagcagctgatggggaagtgat

SEQ ID NO: 8466657 - DNA, 22 bp, Homo sapiens
cagcagctgcgtgcccaggccg

SEQ ID NO: 8466658 - DNA, 22 bp, Homo sapiens
cagcagctgggaaggaggctga

SEQ ID NO: 8466659 - DNA, 22 bp, Homo sapiens
cagcagctagaggaagggcaga

SEQ ID NO: 8466660 - DNA, 22 bp, Homo sapiens
cagcagctagaggaagggcaga

SEQ ID NO: 8466661 - DNA, 22 bp, Homo sapiens
cagcaccctcggaggctgccgt

SEQ ID NO: 8466662 - DNA, 22 bp, Homo sapiens
cagcacgttgaagtagagtaag

SEQ ID NO: 8466663 - DNA, 22 bp, Homo sapiens
cagcaggacatggaggagtaaa

SEQ ID NO: 8466664 - DNA, 22 bp, Homo sapiens
cagcaggacatggaggagtaaa

SEQ ID NO: 8466665 - DNA, 22 bp, Homo sapiens
cagcaggacatggaggagtaaa

SEQ ID NO: 8466666 - DNA, 22 bp, Homo sapiens
gtcagcctgcactcagggagcg

SEQ ID NO: 8466667 - DNA, 22 bp, Homo sapiens
cagcaggaaggtttcccctgca

SEQ ID NO: 8466668 - DNA, 22 bp, Homo sapiens
cagcaggaaggtttcccctgca

SEQ ID NO: 8466669 - DNA, 22 bp, Homo sapiens
cagcagctttgccaagtcagcc

SEQ ID NO: 8466670 - DNA, 22 bp, Homo sapiens
cagcagctggtgagacacagcc

SEQ ID NO: 8466671 - DNA, 22 bp, Homo sapiens
cagcagctgtttacggaacacc

SEQ ID NO: 8466672 - DNA, 20 bp, Homo sapiens
cagcaggaaaagtgcctcag

SEQ ID NO: 8466673 - DNA, 22 bp, Homo sapiens
cagcagcttctgttgatcagaa

SEQ ID NO: 8466674 - DNA, 22 bp, Homo sapiens
gtcccaggcagagtcaggaggg

SEQ ID NO: 8466675 - DNA, 22 bp, Homo sapiens
gtcccaggcagagtcaggaggg

SEQ ID NO: 8466676 - DNA, 22 bp, Homo sapiens
gtcccaggcaggccactggcag

SEQ ID NO: 8466677 - DNA, 22 bp, Homo sapiens
gtcccaggcagagtcaggaggg

SEQ ID NO: 8466678 - DNA, 22 bp, Homo sapiens
gtcccaggaacattctggctag

SEQ ID NO: 8466679 - DNA, 22 bp, Homo sapiens
gtcccaggaacattctggctag

SEQ ID NO: 8466680 - DNA, 22 bp, Homo sapiens
gtcccagcttcccactagcagc

SEQ ID NO: 8466681 - DNA, 22 bp, Homo sapiens
cagcaggctggacttcagtccc

SEQ ID NO: 8466682 - DNA, 22 bp, Homo sapiens
cagcaggctgtggaaatcctgg

SEQ ID NO: 8466683 - DNA, 22 bp, Homo sapiens
gtccagccagctggtccttgcc

SEQ ID NO: 8466684 - DNA, 22 bp, Homo sapiens
gtccagccactcaccttccagc

SEQ ID NO: 8466685 - DNA, 22 bp, Homo sapiens
gtccagccagctggtccttgcc

SEQ ID NO: 8466686 - DNA, 22 bp, Homo sapiens
gtccagccaccctggaggcacg

SEQ ID NO: 8466687 - DNA, 22 bp, Homo sapiens
cagcaggctctgagtggctgcc

SEQ ID NO: 8466688 - DNA, 22 bp, Homo sapiens
cagcaggctctgagtggctgcc

SEQ ID NO: 8466689 - DNA, 22 bp, Homo sapiens
gtcatagaggcctatataattt

SEQ ID NO: 8466690 - DNA, 22 bp, Homo sapiens
gtcataaagcttgttgcattta

SEQ ID NO: 8466691 - DNA, 21 bp, Homo sapiens
gtcatccacctctcgggctct

SEQ ID NO: 8466692 - DNA, 22 bp, Homo sapiens
gtcatcttaaggactgctatag

SEQ ID NO: 8466693 - DNA, 22 bp, Homo sapiens
gtcatctgtgcttttggtagga

SEQ ID NO: 8466694 - DNA, 22 bp, Homo sapiens
gtcatcttctctcagcccaggc

SEQ ID NO: 8466695 - DNA, 22 bp, Homo sapiens
gtcatcttcgcagagtgatttt

SEQ ID NO: 8466696 - DNA, 20 bp, Homo sapiens
cagcaggctatggggcaccc

SEQ ID NO: 8466697 - DNA, 22 bp, Homo sapiens
cagcaggcggcccgcgggcccg

SEQ ID NO: 8466698 - DNA, 22 bp, Homo sapiens
cagcaggcgttgggagaaagac

SEQ ID NO: 8466699 - DNA, 22 bp, Homo sapiens
gtcatcttgctgttttagatct

SEQ ID NO: 8466700 - DNA, 22 bp, Homo sapiens
gtcatggaggattgtgagtggt

SEQ ID NO: 8466701 - DNA, 22 bp, Homo sapiens
gtctgtctgttgttgagaagca

SEQ ID NO: 8466702 - DNA, 22 bp, Homo sapiens
gtctgtctccctgtgactgaga

SEQ ID NO: 8466703 - DNA, 22 bp, Homo sapiens
gtctgtggcaggggagaagttt

SEQ ID NO: 8466704 - DNA, 22 bp, Homo sapiens
gtctgtggagttgcttgctgga

SEQ ID NO: 8466705 - DNA, 22 bp, Homo sapiens
gtctgtgggccaaatacagccc

SEQ ID NO: 8466706 - DNA, 22 bp, Homo sapiens
gtctgtggtagacaggaaggca

SEQ ID NO: 8466707 - DNA, 22 bp, Homo sapiens
gtctgtggtccctgctggggac

SEQ ID NO: 8466708 - DNA, 22 bp, Homo sapiens
gtctgttacctccaagaccatt

SEQ ID NO: 8466709 - DNA, 22 bp, Homo sapiens
gtctgtagaataaatatgagta

SEQ ID NO: 8466710 - DNA, 22 bp, Homo sapiens
gtctgtagatattcactccttc

SEQ ID NO: 8466711 - DNA, 22 bp, Homo sapiens
gtctgtacccacgtcctgctag

SEQ ID NO: 8466712 - DNA, 22 bp, Homo sapiens
cagccctcaaaccacttccagg

SEQ ID NO: 8466713 - DNA, 22 bp, Homo sapiens
cagccctcaggtcctcagcagc

SEQ ID NO: 8466714 - DNA, 22 bp, Homo sapiens
cagccctcaggtcctcagcagc

SEQ ID NO: 8466715 - DNA, 22 bp, Homo sapiens
cagccctcaggtcctcagcagc

SEQ ID NO: 8466716 - DNA, 22 bp, Homo sapiens
cagccctcaggtcctcagcagc

SEQ ID NO: 8466717 - DNA, 22 bp, Homo sapiens
gtctgtagatgagtcttaagaa

SEQ ID NO: 8466718 - DNA, 22 bp, Homo sapiens
gtctgtagtcacacaggtgaca

SEQ ID NO: 8466719 - DNA, 22 bp, Homo sapiens
cagccaggtatgggcgtgcggg

SEQ ID NO: 8466720 - DNA, 22 bp, Homo sapiens
cagccaggtatgggcgtgcggg

SEQ ID NO: 8466721 - DNA, 22 bp, Homo sapiens
cagcccaggctcagatgttggg

SEQ ID NO: 8466722 - DNA, 22 bp, Homo sapiens
cagccagggtcaggcagcttct

SEQ ID NO: 8466723 - DNA, 22 bp, Homo sapiens
cagccaggggctggcgtgttga

SEQ ID NO: 8466724 - DNA, 22 bp, Homo sapiens
cagccccttgtccggtagccac

SEQ ID NO: 8466725 - DNA, 22 bp, Homo sapiens
cagccctcaaaccacttccagg

SEQ ID NO: 8466726 - DNA, 22 bp, Homo sapiens
cagcccctggcgcacgccgagc

SEQ ID NO: 8466727 - DNA, 22 bp, Homo sapiens
cagccccttcctggcatctgga

SEQ ID NO: 8466728 - DNA, 22 bp, Homo sapiens
cagcccctcacagagctgtcct

SEQ ID NO: 8466729 - DNA, 22 bp, Homo sapiens
gtcccaggctccatggcagcca

SEQ ID NO: 8466730 - DNA, 22 bp, Homo sapiens
gtcccagggaagaaggcagcac

SEQ ID NO: 8466731 - DNA, 22 bp, Homo sapiens
gtccctggggaatcagctggag

SEQ ID NO: 8466732 - DNA, 22 bp, Homo sapiens
gtccctgggggtttaggactca

SEQ ID NO: 8466733 - DNA, 22 bp, Homo sapiens
gtccctgggggtttaggactca

SEQ ID NO: 8466734 - DNA, 22 bp, Homo sapiens
gtccctgggtctaaggcagtaa

SEQ ID NO: 8466735 - DNA, 22 bp, Homo sapiens
gtccctggtttgcccaggacca

SEQ ID NO: 8466736 - DNA, 19 bp, Homo sapiens
gtcccttcactcctgctgg

SEQ ID NO: 8466737 - DNA, 22 bp, Homo sapiens
gtcccttcctcattccacttta

SEQ ID NO: 8466738 - DNA, 22 bp, Homo sapiens
cagccagggagcaaagagttga

SEQ ID NO: 8466739 - DNA, 22 bp, Homo sapiens
gtctggactttatcccaaggtt

SEQ ID NO: 8466740 - DNA, 22 bp, Homo sapiens
gtctggagacttgggtcatcaa

SEQ ID NO: 8466741 - DNA, 22 bp, Homo sapiens
gtctggagagctgagcagagtt

SEQ ID NO: 8466742 - DNA, 22 bp, Homo sapiens
gtctggaagtgtcttgttaagt

SEQ ID NO: 8466743 - DNA, 22 bp, Homo sapiens
cagctaatcctctctatccaag

SEQ ID NO: 8466744 - DNA, 22 bp, Homo sapiens
cagctacaaatacttttgtatg

SEQ ID NO: 8466745 - DNA, 22 bp, Homo sapiens
cagctacaaatacttttgtatg

SEQ ID NO: 8466746 - DNA, 22 bp, Homo sapiens
cagctacaggacgggcatctgc

SEQ ID NO: 8466747 - DNA, 22 bp, Homo sapiens
cagctacaggacctgatgcacc

SEQ ID NO: 8466748 - DNA, 22 bp, Homo sapiens
cagctacacttctgggtgtgtc

SEQ ID NO: 8466749 - DNA, 22 bp, Homo sapiens
cagctaggaaaccagagggcag

SEQ ID NO: 8466750 - DNA, 22 bp, Homo sapiens
cagctagctaagaaggccagag

SEQ ID NO: 8466751 - DNA, 22 bp, Homo sapiens
cagctagcttccctgcagtgct

SEQ ID NO: 8466752 - DNA, 22 bp, Homo sapiens
cagctagcggtgctggcggctc

SEQ ID NO: 8466753 - DNA, 22 bp, Homo sapiens
cagctacagtctgattggttca

SEQ ID NO: 8466754 - DNA, 22 bp, Homo sapiens
gtgcccaggtgtccctgagaag

SEQ ID NO: 8466755 - DNA, 22 bp, Homo sapiens
gtgcccaggtgtccctgagaag

SEQ ID NO: 8466756 - DNA, 22 bp, Homo sapiens
gtgcccagtcctgccttgacag

SEQ ID NO: 8466757 - DNA, 22 bp, Homo sapiens
cagctaggagaaaaggtgtttt

SEQ ID NO: 8466758 - DNA, 22 bp, Homo sapiens
cagctattaatgtttttgctga

SEQ ID NO: 8466759 - DNA, 21 bp, Homo sapiens
cagcctgctgctccagggcca

SEQ ID NO: 8466760 - DNA, 22 bp, Homo sapiens
cagcctggagccacagcccagg

SEQ ID NO: 8466761 - DNA, 22 bp, Homo sapiens
cagcctggagccacagcccagg

SEQ ID NO: 8466762 - DNA, 22 bp, Homo sapiens
cagcctggagccacagcccagg

SEQ ID NO: 8466763 - DNA, 22 bp, Homo sapiens
cagcctggtccccggctcaccc

SEQ ID NO: 8466764 - DNA, 22 bp, Homo sapiens
cagcctgggctccagagtccct

SEQ ID NO: 8466765 - DNA, 22 bp, Homo sapiens
cagcctggtccccggctcaccc

SEQ ID NO: 8466766 - DNA, 22 bp, Homo sapiens
cagcctgtcggctccttcattc

SEQ ID NO: 8466767 - DNA, 22 bp, Homo sapiens
cagccttcaaggcttagctcag

SEQ ID NO: 8466768 - DNA, 22 bp, Homo sapiens
cagcctgtggcagaggtctaat

SEQ ID NO: 8466769 - DNA, 22 bp, Homo sapiens
cagcctggcctgggactgctga

SEQ ID NO: 8466770 - DNA, 22 bp, Homo sapiens
cagccctgcagccatggcctgt

SEQ ID NO: 8466771 - DNA, 22 bp, Homo sapiens
cagccctgcagctggatctcac

SEQ ID NO: 8466772 - DNA, 22 bp, Homo sapiens
cagccctgaaacaacctcctct

SEQ ID NO: 8466773 - DNA, 17 bp, Homo sapiens
cagccctgccgttccca

SEQ ID NO: 8466774 - DNA, 17 bp, Homo sapiens
cagccctgccgttccca

SEQ ID NO: 8466775 - DNA, 17 bp, Homo sapiens
cagccctgccgttccca

SEQ ID NO: 8466776 - DNA, 22 bp, Homo sapiens
cagccctgccatggagcctcct

SEQ ID NO: 8466777 - DNA, 22 bp, Homo sapiens
cagccctgccatggagcctcct

SEQ ID NO: 8466778 - DNA, 22 bp, Homo sapiens
cagccctgctggcaatgatgag

SEQ ID NO: 8466779 - DNA, 22 bp, Homo sapiens
cagccctgctggttttgggcaa

SEQ ID NO: 8466780 - DNA, 22 bp, Homo sapiens
cagccctgcttccccgctagtt

SEQ ID NO: 8466781 - DNA, 22 bp, Homo sapiens
cagccctgcttccccgctagtt

SEQ ID NO: 8466782 - DNA, 22 bp, Homo sapiens
cagccctgcttccccgctagtt

SEQ ID NO: 8466783 - DNA, 22 bp, Homo sapiens
cagccctgcttccccgctagtt

SEQ ID NO: 8466784 - DNA, 22 bp, Homo sapiens
cagccctgcttccccgctagtt

SEQ ID NO: 8466785 - DNA, 22 bp, Homo sapiens
cagccctgcttccccgctagtt

SEQ ID NO: 8466786 - DNA, 22 bp, Homo sapiens
cagccctgctgacactgtctga

SEQ ID NO: 8466787 - DNA, 22 bp, Homo sapiens
cagccctgctgacactgtctga

SEQ ID NO: 8466788 - DNA, 22 bp, Homo sapiens
cagccctgctcttagtgtctcc

SEQ ID NO: 8466789 - DNA, 22 bp, Homo sapiens
cagccctgctcttagtgtctcc

SEQ ID NO: 8466790 - DNA, 20 bp, Homo sapiens
cagcctccactcactcagct

SEQ ID NO: 8466791 - DNA, 22 bp, Homo sapiens
cagccctggcccaggtgcctta

SEQ ID NO: 8466792 - DNA, 23 bp, Homo sapiens
cagccctggagatgtgggaggca

SEQ ID NO: 8466793 - DNA, 22 bp, Homo sapiens
cagccctggaacagctgactca

SEQ ID NO: 8466794 - DNA, 22 bp, Homo sapiens
cagccctggaacagctgactca

SEQ ID NO: 8466795 - DNA, 22 bp, Homo sapiens
cagccctggaacagctgactca

SEQ ID NO: 8466796 - DNA, 22 bp, Homo sapiens
cagccctggaacagctgactca

SEQ ID NO: 8466797 - DNA, 22 bp, Homo sapiens
cagcctgactatggctgcaggt

SEQ ID NO: 8466798 - DNA, 22 bp, Homo sapiens
cagcctgactatggctgcaggt

SEQ ID NO: 8466799 - DNA, 22 bp, Homo sapiens
cagcctgacaccagctttgggc

SEQ ID NO: 8466800 - DNA, 22 bp, Homo sapiens
cagcctgcaggaggccgtcagc

SEQ ID NO: 8466801 - DNA, 22 bp, Homo sapiens
cagcctgagccttctgtagcaa

SEQ ID NO: 8466802 - DNA, 22 bp, Homo sapiens
cagcctgactatggctgcaggt

SEQ ID NO: 8466803 - DNA, 22 bp, Homo sapiens
cagcctgagccttctgtagcaa

SEQ ID NO: 8466804 - DNA, 22 bp, Homo sapiens
cagcctgagccttctgtagcaa

SEQ ID NO: 8466805 - DNA, 16 bp, Homo sapiens
cagcctgcagtggtca

SEQ ID NO: 8466806 - DNA, 22 bp, Homo sapiens
gtgccctcacaaagtggaaaga

SEQ ID NO: 8466807 - DNA, 22 bp, Homo sapiens
gtgccctcatgaaacgaaggat

SEQ ID NO: 8466808 - DNA, 22 bp, Homo sapiens
gtgccctcctgaagccatcaca

SEQ ID NO: 8466809 - DNA, 22 bp, Homo sapiens
gtgctgtgcgctttttctgtat

SEQ ID NO: 8466810 - DNA, 22 bp, Homo sapiens
gtgcccagttgaggccaggact

SEQ ID NO: 8466811 - DNA, 22 bp, Homo sapiens
gtgcccagtgcaggcccgcagg

SEQ ID NO: 8466812 - DNA, 22 bp, Homo sapiens
gtgcccagttgaggccaggact

SEQ ID NO: 8466813 - DNA, 18 bp, Homo sapiens
gtgctgtgggcagtggcc

SEQ ID NO: 8466814 - DNA, 22 bp, Homo sapiens
gtgctgtgtgatccatgctggc

SEQ ID NO: 8466815 - DNA, 22 bp, Homo sapiens
gtgctgtgtgatccatgctggc

SEQ ID NO: 8466816 - DNA, 22 bp, Homo sapiens
gaggagaagctaagaaacacag

SEQ ID NO: 8466817 - DNA, 22 bp, Homo sapiens
gaggagaagctaagaaacacag

SEQ ID NO: 8466818 - DNA, 22 bp, Homo sapiens
gaggagaagctattggaaggac

SEQ ID NO: 8466819 - DNA, 22 bp, Homo sapiens
gaggagaaatttggggacctga

SEQ ID NO: 8466820 - DNA, 22 bp, Homo sapiens
gaggagaaatttggggacctga

SEQ ID NO: 8466821 - DNA, 22 bp, Homo sapiens
gaggaaggctaaggggcttaga

SEQ ID NO: 8466822 - DNA, 22 bp, Homo sapiens
gaggaaggctaaggggcttaga

SEQ ID NO: 8466823 - DNA, 22 bp, Homo sapiens
atggtctttttgttatgagaga

SEQ ID NO: 8466824 - DNA, 22 bp, Homo sapiens
atggtcttgtgagagtaacagt

SEQ ID NO: 8466825 - DNA, 22 bp, Homo sapiens
atggtgctcctgcaggaagcag

SEQ ID NO: 8466826 - DNA, 22 bp, Homo sapiens
atggtggaatcggcgtgaatgg

SEQ ID NO: 8466827 - DNA, 22 bp, Homo sapiens
atggtggaagagcatcagaaag

SEQ ID NO: 8466828 - DNA, 22 bp, Homo sapiens
atggtcttctcaagcaacactg

SEQ ID NO: 8466829 - DNA, 22 bp, Homo sapiens
atggtcttgattttccataggt

SEQ ID NO: 8466830 - DNA, 22 bp, Homo sapiens
gaggagaagggcacggagaaaa

SEQ ID NO: 8466831 - DNA, 22 bp, Homo sapiens
gaggcagcctcagtggacctcg

SEQ ID NO: 8466832 - DNA, 22 bp, Homo sapiens
gaggcagcctcagtggacctcg

SEQ ID NO: 8466833 - DNA, 22 bp, Homo sapiens
gaggcagcattcgcatagacag

SEQ ID NO: 8466834 - DNA, 22 bp, Homo sapiens
gaggcagcattcgcatagacag

SEQ ID NO: 8466835 - DNA, 22 bp, Homo sapiens
gaggcagcatggtaccttggag

SEQ ID NO: 8466836 - DNA, 22 bp, Homo sapiens
atggtggacgggagacaggact

SEQ ID NO: 8466837 - DNA, 22 bp, Homo sapiens
atggtggactcttgattcaggc

SEQ ID NO: 8466838 - DNA, 22 bp, Homo sapiens
atggtggacgggagacaggact

SEQ ID NO: 8466839 - DNA, 22 bp, Homo sapiens
atggtggactcttgattcaggc

SEQ ID NO: 8466840 - DNA, 22 bp, Homo sapiens
atggtggatttgtgattcagct

SEQ ID NO: 8466841 - DNA, 22 bp, Homo sapiens
atggtggaggtgtattctggat

SEQ ID NO: 8466842 - DNA, 22 bp, Homo sapiens
atggtggatttgtgattcagct

SEQ ID NO: 8466843 - DNA, 22 bp, Homo sapiens
atggtggtttgggagaaaaagc

SEQ ID NO: 8466844 - DNA, 22 bp, Homo sapiens
gaggcagcagggctggttcctt

SEQ ID NO: 8466845 - DNA, 22 bp, Homo sapiens
atggttattactgctgttccag

SEQ ID NO: 8466846 - DNA, 22 bp, Homo sapiens
atggtgtttataggcaaagatc

SEQ ID NO: 8466847 - DNA, 22 bp, Homo sapiens
atggggaagagccagtgagctg

SEQ ID NO: 8466848 - DNA, 22 bp, Homo sapiens
atgggcttgaccctacagaaag

SEQ ID NO: 8466849 - DNA, 23 bp, Homo sapiens
atgggcttagaaagcaagtggga

SEQ ID NO: 8466850 - DNA, 22 bp, Homo sapiens
atggggaagcaattggatttcc

SEQ ID NO: 8466851 - DNA, 22 bp, Homo sapiens
atggggagagaagggctgagct

SEQ ID NO: 8466852 - DNA, 22 bp, Homo sapiens
atggggagagcctctgtcccca

SEQ ID NO: 8466853 - DNA, 22 bp, Homo sapiens
atgggagaaacatcatgaggca

SEQ ID NO: 8466854 - DNA, 22 bp, Homo sapiens
atgggacaggcatgggacttag

SEQ ID NO: 8466855 - DNA, 22 bp, Homo sapiens
atgggacagggctggctggtcc

SEQ ID NO: 8466856 - DNA, 22 bp, Homo sapiens
atgggacaggtactagaaaggg

SEQ ID NO: 8466857 - DNA, 22 bp, Homo sapiens
atgggacaatttgaacacagtg

SEQ ID NO: 8466858 - DNA, 22 bp, Homo sapiens
atgggacacgttttaaggaaaa

SEQ ID NO: 8466859 - DNA, 22 bp, Homo sapiens
atgggacaatttgaacacagtg

SEQ ID NO: 8466860 - DNA, 22 bp, Homo sapiens
atgggacacacaaggaagtaaa

SEQ ID NO: 8466861 - DNA, 22 bp, Homo sapiens
atgggaaagaagccactgccca

SEQ ID NO: 8466862 - DNA, 22 bp, Homo sapiens
atgggaaggttttgagagcggg

SEQ ID NO: 8466863 - DNA, 22 bp, Homo sapiens
atgggaaggttttgagagcggg

SEQ ID NO: 8466864 - DNA, 22 bp, Homo sapiens
atgggaagtgaagtcagggagg

SEQ ID NO: 8466865 - DNA, 22 bp, Homo sapiens
atgggaagtgttagaagatttt

SEQ ID NO: 8466866 - DNA, 22 bp, Homo sapiens
atggcttcgagtatatacatag

SEQ ID NO: 8466867 - DNA, 22 bp, Homo sapiens
atggcttcctctggattggatt

SEQ ID NO: 8466868 - DNA, 22 bp, Homo sapiens
atggcttcctctggattggatt

SEQ ID NO: 8466869 - DNA, 17 bp, Homo sapiens
atggcttccattgacca

SEQ ID NO: 8466870 - DNA, 22 bp, Homo sapiens
atggcttccaaggccctccgtg

SEQ ID NO: 8466871 - DNA, 22 bp, Homo sapiens
atggcttcatcttttagtcctt

SEQ ID NO: 8466872 - DNA, 22 bp, Homo sapiens
atggcttcatcttttagtcctt

SEQ ID NO: 8466873 - DNA, 22 bp, Homo sapiens
atggcttctagcattgtcacaa

SEQ ID NO: 8466874 - DNA, 17 bp, Homo sapiens
atggcttccattgacca

SEQ ID NO: 8466875 - DNA, 22 bp, Homo sapiens
atggcttcgagtatatacatag

SEQ ID NO: 8466876 - DNA, 22 bp, Homo sapiens
atggcttctagcattgtcacaa

SEQ ID NO: 8466877 - DNA, 22 bp, Homo sapiens
atggcttctagcattgtcacaa

SEQ ID NO: 8466878 - DNA, 22 bp, Homo sapiens
atggcttctcgctggcacctgt

SEQ ID NO: 8466879 - DNA, 21 bp, Homo sapiens
atggcttctcaggtgcactga

SEQ ID NO: 8466880 - DNA, 22 bp, Homo sapiens
atggccagagaggccagcctgg

SEQ ID NO: 8466881 - DNA, 22 bp, Homo sapiens
atggctggcatccaggtgggct

SEQ ID NO: 8466882 - DNA, 22 bp, Homo sapiens
atggcttctgtcttggaaactt

SEQ ID NO: 8466883 - DNA, 22 bp, Homo sapiens
atggcttctgtcttggaaactt

SEQ ID NO: 8466884 - DNA, 18 bp, Homo sapiens
atggcttctgagtggagg

SEQ ID NO: 8466885 - DNA, 22 bp, Homo sapiens
atggcttctgtcttggaaattt

SEQ ID NO: 8466886 - DNA, 22 bp, Homo sapiens
atggcttctgtcttggaaattt

SEQ ID NO: 8466887 - DNA, 22 bp, Homo sapiens
atggcttgcagagaaaagaggt

SEQ ID NO: 8466888 - DNA, 22 bp, Homo sapiens
atggcttggttggttaaagcac

SEQ ID NO: 8466889 - DNA, 22 bp, Homo sapiens
atggctttgaagttcagctttt

SEQ ID NO: 8466890 - DNA, 22 bp, Homo sapiens
atggcttttcacagagggttct

SEQ ID NO: 8466891 - DNA, 22 bp, Homo sapiens
gagatggggaataggagcaagc

SEQ ID NO: 8466892 - DNA, 22 bp, Homo sapiens
gagatggggaataggagcaagc

SEQ ID NO: 8466893 - DNA, 22 bp, Homo sapiens
gagatggggtcagctgggacat

SEQ ID NO: 8466894 - DNA, 22 bp, Homo sapiens
atggccaagatcacagacttca

SEQ ID NO: 8466895 - DNA, 22 bp, Homo sapiens
atggccaaataacagcttgcat

SEQ ID NO: 8466896 - DNA, 22 bp, Homo sapiens
atggcatttgaatctgtctttt

SEQ ID NO: 8466897 - DNA, 22 bp, Homo sapiens
atggcattgtttatagattgca

SEQ ID NO: 8466898 - DNA, 17 bp, Homo sapiens
atggaggcagacaggtc

SEQ ID NO: 8466899 - DNA, 22 bp, Homo sapiens
atggaggatgtgcagcatgggc

SEQ ID NO: 8466900 - DNA, 18 bp, Homo sapiens
atggaggcagagagctga

SEQ ID NO: 8466901 - DNA, 18 bp, Homo sapiens
atggaggcagagagctga

SEQ ID NO: 8466902 - DNA, 22 bp, Homo sapiens
atggagggaaaagtggagagcc

SEQ ID NO: 8466903 - DNA, 22 bp, Homo sapiens
gagaggttcctccctgctttac

SEQ ID NO: 8466904 - DNA, 21 bp, Homo sapiens
gagatggcccagtagcgggcc

SEQ ID NO: 8466905 - DNA, 22 bp, Homo sapiens
gagatgggcgagaaggtggact

SEQ ID NO: 8466906 - DNA, 22 bp, Homo sapiens
gagatgggcgagaaggtggact

SEQ ID NO: 8466907 - DNA, 22 bp, Homo sapiens
gagatgggcgagaaggtggact

SEQ ID NO: 8466908 - DNA, 22 bp, Homo sapiens
gactggggctctagccaggcct

SEQ ID NO: 8466909 - DNA, 22 bp, Homo sapiens
gactggggctctagccaggcct

SEQ ID NO: 8466910 - DNA, 22 bp, Homo sapiens
gagagcacggtcttgggcatgg

SEQ ID NO: 8466911 - DNA, 22 bp, Homo sapiens
gagagaggcctccatgtactga

SEQ ID NO: 8466912 - DNA, 22 bp, Homo sapiens
gagagagctctgtgcctgggat

SEQ ID NO: 8466913 - DNA, 22 bp, Homo sapiens
gagagagctctgtgcctgggat

SEQ ID NO: 8466914 - DNA, 22 bp, Homo sapiens
gagggcgttcagtcagtgtctc

SEQ ID NO: 8466915 - DNA, 22 bp, Homo sapiens
gagggctcaactactactaggc

SEQ ID NO: 8466916 - DNA, 22 bp, Homo sapiens
atgtctgcggcccaggccaggg

SEQ ID NO: 8466917 - DNA, 22 bp, Homo sapiens
atgtctgcggcccaggccaggg

SEQ ID NO: 8466918 - DNA, 22 bp, Homo sapiens
gagggctcactgagaaagcagt

SEQ ID NO: 8466919 - DNA, 20 bp, Homo sapiens
gagggctcgtggatggataa

SEQ ID NO: 8466920 - DNA, 22 bp, Homo sapiens
gagggctctaccaagtaactct

SEQ ID NO: 8466921 - DNA, 22 bp, Homo sapiens
gagggctgaagattgtggcccc

SEQ ID NO: 8466922 - DNA, 22 bp, Homo sapiens
atgtcgataggagtgccatcgg

SEQ ID NO: 8466923 - DNA, 22 bp, Homo sapiens
atgtcctgttttggcttgctct

SEQ ID NO: 8466924 - DNA, 22 bp, Homo sapiens
gaggcagcggctcacagagaaa

SEQ ID NO: 8466925 - DNA, 22 bp, Homo sapiens
atgtagaaagttcatagatgcg

SEQ ID NO: 8466926 - DNA, 22 bp, Homo sapiens
atgtagaattccttctactttg

SEQ ID NO: 8466927 - DNA, 22 bp, Homo sapiens
atgtagaggagtttctggtctg

SEQ ID NO: 8466928 - DNA, 23 bp, Homo sapiens
atgtagagtacagcacaacagca

SEQ ID NO: 8466929 - DNA, 22 bp, Homo sapiens
atgtcattgccaagatgctaat

SEQ ID NO: 8466930 - DNA, 22 bp, Homo sapiens
atgtccctgagggtctctctga

SEQ ID NO: 8466931 - DNA, 22 bp, Homo sapiens
atgtccctcactcctcattcag

SEQ ID NO: 8466932 - DNA, 22 bp, Homo sapiens
atgtcatttaaatgtttgtata

SEQ ID NO: 8466933 - DNA, 22 bp, Homo sapiens
atgttgttttttcataaagtat

SEQ ID NO: 8466934 - DNA, 22 bp, Homo sapiens
gataatattagaagatacaaat

SEQ ID NO: 8466935 - DNA, 22 bp, Homo sapiens
atgtttaatcggctgcctttcc

SEQ ID NO: 8466936 - DNA, 22 bp, Homo sapiens
atgtttaatcggctgcctttcc

SEQ ID NO: 8466937 - DNA, 22 bp, Homo sapiens
atgtttaaagggttgagaaata

SEQ ID NO: 8466938 - DNA, 22 bp, Homo sapiens
gataatttgatacctcaatcag

SEQ ID NO: 8466939 - DNA, 22 bp, Homo sapiens
gataattttagtctgaaaattg

SEQ ID NO: 8466940 - DNA, 22 bp, Homo sapiens
gataattataggctaagccact

SEQ ID NO: 8466941 - DNA, 22 bp, Homo sapiens
gataattataggctaagccact

SEQ ID NO: 8466942 - DNA, 22 bp, Homo sapiens
gatatatttggaccagagcatt

SEQ ID NO: 8466943 - DNA, 22 bp, Homo sapiens
gatatattttccatggtctgca

SEQ ID NO: 8466944 - DNA, 22 bp, Homo sapiens
gatacaagactaataggaaaca

SEQ ID NO: 8466945 - DNA, 18 bp, Homo sapiens
gatatggaaggccatgcc

SEQ ID NO: 8466946 - DNA, 20 bp, Homo sapiens
atgtgtctgtaaacaactct

SEQ ID NO: 8466947 - DNA, 22 bp, Homo sapiens
atgtgtctggttattgacatgc

SEQ ID NO: 8466948 - DNA, 22 bp, Homo sapiens
atgttctttggaatttatgaaa

SEQ ID NO: 8466949 - DNA, 22 bp, Homo sapiens
atgttgagtggatgaacaaaca

SEQ ID NO: 8466950 - DNA, 22 bp, Homo sapiens
atgttctttgaaatattttaga

SEQ ID NO: 8466951 - DNA, 22 bp, Homo sapiens
atgttcttggatgttgtgtata

SEQ ID NO: 8466952 - DNA, 22 bp, Homo sapiens
atgttcttctatctttattaaa

SEQ ID NO: 8466953 - DNA, 20 bp, Homo sapiens
atgttcttcatttaatgttc

SEQ ID NO: 8466954 - DNA, 22 bp, Homo sapiens
gaggtggcccttgctcagcctt

SEQ ID NO: 8466955 - DNA, 22 bp, Homo sapiens
gaggtggcactgtgaggagcac

SEQ ID NO: 8466956 - DNA, 22 bp, Homo sapiens
gaggtggcctcaagcagtcttc

SEQ ID NO: 8466957 - DNA, 22 bp, Homo sapiens
atgtgtctctaaaatttagtaa

SEQ ID NO: 8466958 - DNA, 22 bp, Homo sapiens
atgtgtctctaccaatgcaatt

SEQ ID NO: 8466959 - DNA, 22 bp, Homo sapiens
gacatttattagaaaactatca

SEQ ID NO: 8466960 - DNA, 22 bp, Homo sapiens
gacatttattagaaaactatca

SEQ ID NO: 8466961 - DNA, 22 bp, Homo sapiens
gacatttattggattttacgag

SEQ ID NO: 8466962 - DNA, 22 bp, Homo sapiens
gacataaatgaagtttgactat

SEQ ID NO: 8466963 - DNA, 22 bp, Homo sapiens
gacataaagttcttgcttgaat

SEQ ID NO: 8466964 - DNA, 22 bp, Homo sapiens
gaccaagatacagcatcataga

SEQ ID NO: 8466965 - DNA, 22 bp, Homo sapiens
gaccacagattcctaagtggca

SEQ ID NO: 8466966 - DNA, 22 bp, Homo sapiens
gaccacagaggtgtgggagaga

SEQ ID NO: 8466967 - DNA, 22 bp, Homo sapiens
gacaccagagactgatgaggcc

SEQ ID NO: 8466968 - DNA, 18 bp, Homo sapiens
gacaccagcctctgcccc

SEQ ID NO: 8466969 - DNA, 22 bp, Homo sapiens
gacaccagcaaggctgtgagga

SEQ ID NO: 8466970 - DNA, 22 bp, Homo sapiens
gacaccattacctttctatatt

SEQ ID NO: 8466971 - DNA, 22 bp, Homo sapiens
gacaccagtaaatattcaaaag

SEQ ID NO: 8466972 - DNA, 22 bp, Homo sapiens
gacaccaggtctgttgtcctcc

SEQ ID NO: 8466973 - DNA, 23 bp, Homo sapiens
gacaccaggcgtggccctcgaca

SEQ ID NO: 8466974 - DNA, 23 bp, Homo sapiens
gacaccaggcgtggccctcgaca

SEQ ID NO: 8466975 - DNA, 22 bp, Homo sapiens
gacaccaggaatagttctgtct

SEQ ID NO: 8466976 - DNA, 18 bp, Homo sapiens
gacacatccccaggcctc

SEQ ID NO: 8466977 - DNA, 22 bp, Homo sapiens
gacaccagaagacataagcaga

SEQ ID NO: 8466978 - DNA, 22 bp, Homo sapiens
gacacaaagtttgtcagaaatt

SEQ ID NO: 8466979 - DNA, 22 bp, Homo sapiens
gacacaaagtttgtcagaaatt

SEQ ID NO: 8466980 - DNA, 22 bp, Homo sapiens
gacacagtttttctcacggtgg

SEQ ID NO: 8466981 - DNA, 21 bp, Homo sapiens
gacacaaagggtagtaatggt

SEQ ID NO: 8466982 - DNA, 21 bp, Homo sapiens
gacacaaagggtagtaatggt

SEQ ID NO: 8466983 - DNA, 21 bp, Homo sapiens
gacacaaagggtagtaatggt

SEQ ID NO: 8466984 - DNA, 22 bp, Homo sapiens
gacaatttctcaatatagaaac

SEQ ID NO: 8466985 - DNA, 22 bp, Homo sapiens
gacaattagatcattcctttga

SEQ ID NO: 8466986 - DNA, 22 bp, Homo sapiens
gacaattgcttttgccgaataa

SEQ ID NO: 8466987 - DNA, 22 bp, Homo sapiens
gacaattaggttaagagcaaga

SEQ ID NO: 8466988 - DNA, 19 bp, Homo sapiens
gacaattagagatcactca

SEQ ID NO: 8466989 - DNA, 22 bp, Homo sapiens
gacctttagtgtcatgttatat

SEQ ID NO: 8466990 - DNA, 22 bp, Homo sapiens
gacgcctcttccctgctgcact

SEQ ID NO: 8466991 - DNA, 22 bp, Homo sapiens
gactaaattcctgttcgcgatg

SEQ ID NO: 8466992 - DNA, 22 bp, Homo sapiens
gactaaatgctttgtgcatgca

SEQ ID NO: 8466993 - DNA, 22 bp, Homo sapiens
gactacaactcccagaagactt

SEQ ID NO: 8466994 - DNA, 22 bp, Homo sapiens
gactggcctggggctgggcaca

SEQ ID NO: 8466995 - DNA, 22 bp, Homo sapiens
gactggcctggagatgcagctg

SEQ ID NO: 8466996 - DNA, 22 bp, Homo sapiens
gactggagtcaatgagcagcac

SEQ ID NO: 8466997 - DNA, 22 bp, Homo sapiens
atgctcagggcacactctggac

SEQ ID NO: 8466998 - DNA, 22 bp, Homo sapiens
atgctatttaccacacatcatt

SEQ ID NO: 8466999 - DNA, 22 bp, Homo sapiens
atgctccaccttttgcaggaac

SEQ ID NO: 8467000 - DNA, 22 bp, Homo sapiens
atgctcattttattgagaatga

SEQ ID NO: 8467001 - DNA, 22 bp, Homo sapiens
gaccctggcagataccgtcaca

SEQ ID NO: 8467002 - DNA, 22 bp, Homo sapiens
gaatcaatggtagattaagtaa

SEQ ID NO: 8467003 - DNA, 22 bp, Homo sapiens
gaatcaatggtagattaagtaa

SEQ ID NO: 8467004 - DNA, 22 bp, Homo sapiens
gaatcaaatcaagttcttttga

SEQ ID NO: 8467005 - DNA, 22 bp, Homo sapiens
gaatcaattgtgaagactatga

SEQ ID NO: 8467006 - DNA, 22 bp, Homo sapiens
gaatcaattatccaggctgttg

SEQ ID NO: 8467007 - DNA, 22 bp, Homo sapiens
gaatattttcagtacagatggt

SEQ ID NO: 8467008 - DNA, 21 bp, Homo sapiens
gacaatgcagtcttttttgga

SEQ ID NO: 8467009 - DNA, 22 bp, Homo sapiens
gacaatgcagaagtacttgttc

SEQ ID NO: 8467010 - DNA, 23 bp, Homo sapiens
gaatacaaagcagatggtccagc

SEQ ID NO: 8467011 - DNA, 22 bp, Homo sapiens
gaatacaaagcagaactcatac

SEQ ID NO: 8467012 - DNA, 22 bp, Homo sapiens
gaatacaaacttaaggctttac

SEQ ID NO: 8467013 - DNA, 22 bp, Homo sapiens
gaataattgtgatgcttgaagt

SEQ ID NO: 8467014 - DNA, 22 bp, Homo sapiens
gaataattgtgatgcttgaagt

SEQ ID NO: 8467015 - DNA, 22 bp, Homo sapiens
gaataattgtgatgcttgaagt

SEQ ID NO: 8467016 - DNA, 22 bp, Homo sapiens
gaataatattgactttgcaggc

SEQ ID NO: 8467017 - DNA, 22 bp, Homo sapiens
gaataattttgatcagaaggga

SEQ ID NO: 8467018 - DNA, 22 bp, Homo sapiens
gaataattttgatcagaaggga

SEQ ID NO: 8467019 - DNA, 22 bp, Homo sapiens
gaataatattgactttgcaggc

SEQ ID NO: 8467020 - DNA, 22 bp, Homo sapiens
gaataacattttttcctttaca

SEQ ID NO: 8467021 - DNA, 22 bp, Homo sapiens
gaataatagcagaaattagcag

SEQ ID NO: 8467022 - DNA, 22 bp, Homo sapiens
gaagtcttggctgaaaaccctc

SEQ ID NO: 8467023 - DNA, 22 bp, Homo sapiens
gaagtcttttagcaaaacgaac

SEQ ID NO: 8467024 - DNA, 22 bp, Homo sapiens
gaagtcttgaaacacaaactag

SEQ ID NO: 8467025 - DNA, 22 bp, Homo sapiens
atgcacaggctgtgggctggtt

SEQ ID NO: 8467026 - DNA, 22 bp, Homo sapiens
atgcacagtaatgagctggttg

SEQ ID NO: 8467027 - DNA, 22 bp, Homo sapiens
atgcacaggtgctgatgcacgc

SEQ ID NO: 8467028 - DNA, 22 bp, Homo sapiens
atgcacaaggtagattattatt

SEQ ID NO: 8467029 - DNA, 22 bp, Homo sapiens
gaaggcttattttctttgtaaa

SEQ ID NO: 8467030 - DNA, 22 bp, Homo sapiens
atgcacaattaggatatagctt

SEQ ID NO: 8467031 - DNA, 22 bp, Homo sapiens
gaaggctgtttctggtagtgat

SEQ ID NO: 8467032 - DNA, 16 bp, Homo sapiens
gaaggcttactgcagg

SEQ ID NO: 8467033 - DNA, 22 bp, Homo sapiens
gaaggcttagaaacaagggagc

SEQ ID NO: 8467034 - DNA, 22 bp, Homo sapiens
gaaggcttatgtgtgactttcg

SEQ ID NO: 8467035 - DNA, 22 bp, Homo sapiens
gaaggctggctttctgagagca

SEQ ID NO: 8467036 - DNA, 22 bp, Homo sapiens
gaaggctggggcatcagtgaaa

SEQ ID NO: 8467037 - DNA, 22 bp, Homo sapiens
atgcacagacccaaaggccatc

SEQ ID NO: 8467038 - DNA, 22 bp, Homo sapiens
atgcacagaacaattttaagag

SEQ ID NO: 8467039 - DNA, 22 bp, Homo sapiens
gaaggctgctgggaagtgtggt

SEQ ID NO: 8467040 - DNA, 22 bp, Homo sapiens
gaaggctggggcatcagtgaaa

SEQ ID NO: 8467041 - DNA, 22 bp, Homo sapiens
gaacaaggattcccaaagaaga

SEQ ID NO: 8467042 - DNA, 22 bp, Homo sapiens
gaacaatacaggctttattcct

SEQ ID NO: 8467043 - DNA, 22 bp, Homo sapiens
gaacaatagtggtaacaaagcc

SEQ ID NO: 8467044 - DNA, 22 bp, Homo sapiens
gaacaaattggagaaatcagga

SEQ ID NO: 8467045 - DNA, 22 bp, Homo sapiens
gaacaaattggagaaatcagga

SEQ ID NO: 8467046 - DNA, 22 bp, Homo sapiens
gaacaaacagtcaggacagtct

SEQ ID NO: 8467047 - DNA, 22 bp, Homo sapiens
gaacaaacacatcccagcagtg

SEQ ID NO: 8467048 - DNA, 22 bp, Homo sapiens
gaacaaacacatcccagcagtg

SEQ ID NO: 8467049 - DNA, 22 bp, Homo sapiens
gaacaaacagaagaggcggaac

SEQ ID NO: 8467050 - DNA, 22 bp, Homo sapiens
gaacaaactgggtcccaatgat

SEQ ID NO: 8467051 - DNA, 22 bp, Homo sapiens
gaacaaacatttttggcagtat

SEQ ID NO: 8467052 - DNA, 19 bp, Homo sapiens
gaacaaacttaaacttttc

SEQ ID NO: 8467053 - DNA, 22 bp, Homo sapiens
gaaatactgcacaccctgtaag

SEQ ID NO: 8467054 - DNA, 21 bp, Homo sapiens
gaaatactgccttaggagctg

SEQ ID NO: 8467055 - DNA, 22 bp, Homo sapiens
gaaatactgcacaccctgtaag

SEQ ID NO: 8467056 - DNA, 22 bp, Homo sapiens
gaaagtatttacattaacatct

SEQ ID NO: 8467057 - DNA, 22 bp, Homo sapiens
gaaagtcatggatgaacactac

SEQ ID NO: 8467058 - DNA, 22 bp, Homo sapiens
gaaagtgcagtcagacaaggca

SEQ ID NO: 8467059 - DNA, 22 bp, Homo sapiens
gaaagtcatggatgaacactac

SEQ ID NO: 8467060 - DNA, 20 bp, Homo sapiens
gaaatacttacccaactgtt

SEQ ID NO: 8467061 - DNA, 21 bp, Homo sapiens
gaaatactgccttaggagctg

SEQ ID NO: 8467062 - DNA, 22 bp, Homo sapiens
gaaatactgtaaagttattatt

SEQ ID NO: 8467063 - DNA, 22 bp, Homo sapiens
gaaatactgtaaagttattatt

SEQ ID NO: 8467064 - DNA, 20 bp, Homo sapiens
gaaatacttacccaactgtt

SEQ ID NO: 8467065 - DNA, 22 bp, Homo sapiens
gaaatagacactttctatgaat

SEQ ID NO: 8467066 - DNA, 22 bp, Homo sapiens
gaaagtatgccatctacctctt

SEQ ID NO: 8467067 - DNA, 22 bp, Homo sapiens
gaaagtatgccatctacctctt

SEQ ID NO: 8467068 - DNA, 22 bp, Homo sapiens
gaaagtattagcctagaagtca

SEQ ID NO: 8467069 - DNA, 22 bp, Homo sapiens
gaaagtattagcctagaagtca

SEQ ID NO: 8467070 - DNA, 22 bp, Homo sapiens
gaaagtattctccctgaatttt

SEQ ID NO: 8467071 - DNA, 22 bp, Homo sapiens
gaaagtatgccatctacctctt

SEQ ID NO: 8467072 - DNA, 22 bp, Homo sapiens
gaaagtattcacaaagttcttg

SEQ ID NO: 8467073 - DNA, 22 bp, Homo sapiens
gaaagtattcacaaagttcttg

SEQ ID NO: 8467074 - DNA, 23 bp, Homo sapiens
gaaagtcaatatggtagctttga

SEQ ID NO: 8467075 - DNA, 22 bp, Homo sapiens
gaaagtatttacattaacatct

SEQ ID NO: 8467076 - DNA, 22 bp, Homo sapiens
gaaagtatttaagtccatattt

SEQ ID NO: 8467077 - DNA, 22 bp, Homo sapiens
gaaagtatttaagtccatattt

SEQ ID NO: 8467078 - DNA, 22 bp, Homo sapiens
gaaagtatttacattaacatct

SEQ ID NO: 8467079 - DNA, 22 bp, Homo sapiens
gaaagtatttaagtccatattt

SEQ ID NO: 8467080 - DNA, 22 bp, Homo sapiens
gaaagtatttaagtccatattt

SEQ ID NO: 8467081 - DNA, 22 bp, Homo sapiens
gaaagtattctccctgaatttt

SEQ ID NO: 8467082 - DNA, 19 bp, Homo sapiens
atgatacaggtgaaaattg

SEQ ID NO: 8467083 - DNA, 19 bp, Homo sapiens
atgatacaggtgaaaattg

SEQ ID NO: 8467084 - DNA, 22 bp, Homo sapiens
gaaatagtacagcatagttctt

SEQ ID NO: 8467085 - DNA, 22 bp, Homo sapiens
gaaatagatctctgggatgcaa

SEQ ID NO: 8467086 - DNA, 22 bp, Homo sapiens
atgatattttagtaaagtgata

SEQ ID NO: 8467087 - DNA, 22 bp, Homo sapiens
atgatatttgcaatgtgcttgc

SEQ ID NO: 8467088 - DNA, 18 bp, Homo sapiens
atgatcttagcaaatatt

SEQ ID NO: 8467089 - DNA, 22 bp, Homo sapiens
atgatgaaattttctatcatgt

SEQ ID NO: 8467090 - DNA, 22 bp, Homo sapiens
atgatgaagagtaacaggctga

SEQ ID NO: 8467091 - DNA, 22 bp, Homo sapiens
gaaaatgttagcttcatagtca

SEQ ID NO: 8467092 - DNA, 22 bp, Homo sapiens
ctttctttcgaagacgtgatta

SEQ ID NO: 8467093 - DNA, 22 bp, Homo sapiens
ctttcttccatagggcccagtc

SEQ ID NO: 8467094 - DNA, 22 bp, Homo sapiens
gaaacatattaatccagtgaaa

SEQ ID NO: 8467095 - DNA, 22 bp, Homo sapiens
gaaacattcagtcaacagtgtt

SEQ ID NO: 8467096 - DNA, 22 bp, Homo sapiens
gaaacattgtgttctacagatt

SEQ ID NO: 8467097 - DNA, 22 bp, Homo sapiens
gaaacattgtgttctacagatt

SEQ ID NO: 8467098 - DNA, 22 bp, Homo sapiens
atgacagcattcaagacataga

SEQ ID NO: 8467099 - DNA, 22 bp, Homo sapiens
gaaacatttgttgagtacttgc

SEQ ID NO: 8467100 - DNA, 22 bp, Homo sapiens
atgacataaagctatgctaggt

SEQ ID NO: 8467101 - DNA, 22 bp, Homo sapiens
atgacataagtgaaaaacatca

SEQ ID NO: 8467102 - DNA, 22 bp, Homo sapiens
atgacatgacctggtagagaca

SEQ ID NO: 8467103 - DNA, 22 bp, Homo sapiens
gaaagcagtatttagttctgtt

SEQ ID NO: 8467104 - DNA, 17 bp, Homo sapiens
gaaagcatcacatgctc

SEQ ID NO: 8467105 - DNA, 22 bp, Homo sapiens
atgaacagcattgaaatccagc

SEQ ID NO: 8467106 - DNA, 22 bp, Homo sapiens
atgaacagtatgcaacatgatt

SEQ ID NO: 8467107 - DNA, 22 bp, Homo sapiens
atgaaacagagtacttaatata

SEQ ID NO: 8467108 - DNA, 22 bp, Homo sapiens
atgaactatcatcagttccacc

SEQ ID NO: 8467109 - DNA, 22 bp, Homo sapiens
atgaagaaactgttctgggtgg

SEQ ID NO: 8467110 - DNA, 22 bp, Homo sapiens
atgaagaaactgttctgggtgg

SEQ ID NO: 8467111 - DNA, 22 bp, Homo sapiens
ctttctcttgagcaagagctgt

SEQ ID NO: 8467112 - DNA, 22 bp, Homo sapiens
ctttctgaagtttaagttctaa

SEQ ID NO: 8467113 - DNA, 22 bp, Homo sapiens
ctttctcttgagcaagagctgt

SEQ ID NO: 8467114 - DNA, 22 bp, Homo sapiens
ctttcttaatttttaaggacac

SEQ ID NO: 8467115 - DNA, 22 bp, Homo sapiens
ctttctgattttaagctctaat

SEQ ID NO: 8467116 - DNA, 22 bp, Homo sapiens
ctttctgattttaagctctaat

SEQ ID NO: 8467117 - DNA, 22 bp, Homo sapiens
cttctttaatgtatacaaaaga

SEQ ID NO: 8467118 - DNA, 22 bp, Homo sapiens
cttctttaccaagagatagagt

SEQ ID NO: 8467119 - DNA, 22 bp, Homo sapiens
cttctttaccaagagatagagt

SEQ ID NO: 8467120 - DNA, 22 bp, Homo sapiens
cttctttaccaagagatagagt

SEQ ID NO: 8467121 - DNA, 22 bp, Homo sapiens
cttctttaatgtatacaaaaga

SEQ ID NO: 8467122 - DNA, 22 bp, Homo sapiens
cttctttaatgtatacaaaaga

SEQ ID NO: 8467123 - DNA, 22 bp, Homo sapiens
cttcttgtgctgggccagcttc

SEQ ID NO: 8467124 - DNA, 22 bp, Homo sapiens
atctggataggttgttttgcat

SEQ ID NO: 8467125 - DNA, 22 bp, Homo sapiens
atctggagtgggacacagaaat

SEQ ID NO: 8467126 - DNA, 22 bp, Homo sapiens
atctggagctctgcacacctgg

SEQ ID NO: 8467127 - DNA, 22 bp, Homo sapiens
ctttcccacgcagtggatgaga

SEQ ID NO: 8467128 - DNA, 22 bp, Homo sapiens
ctttccctgcttagaaggattt

SEQ ID NO: 8467129 - DNA, 22 bp, Homo sapiens
ctttcctagaaatatatactta

SEQ ID NO: 8467130 - DNA, 22 bp, Homo sapiens
atgaaaagttcgatctagaagg

SEQ ID NO: 8467131 - DNA, 22 bp, Homo sapiens
atgaaaagttcgatctagaagg

SEQ ID NO: 8467132 - DNA, 22 bp, Homo sapiens
atgaaaagttcgatctagaagg

SEQ ID NO: 8467133 - DNA, 22 bp, Homo sapiens
ctttcctagatggccatctttc

SEQ ID NO: 8467134 - DNA, 22 bp, Homo sapiens
atgaaaagttcgatctagaagg

SEQ ID NO: 8467135 - DNA, 22 bp, Homo sapiens
ctttccaggaatcctcacagcc

SEQ ID NO: 8467136 - DNA, 22 bp, Homo sapiens
ctttcaaagaccttggcatggg

SEQ ID NO: 8467137 - DNA, 22 bp, Homo sapiens
ctttcaaaacgctctgtatgca

SEQ ID NO: 8467138 - DNA, 22 bp, Homo sapiens
atctggctattgacatgttata

SEQ ID NO: 8467139 - DNA, 22 bp, Homo sapiens
gccaggtggaggttgcagtgag

SEQ ID NO: 8467140 - DNA, 22 bp, Homo sapiens
gccaggtggaggttgcagtgag

SEQ ID NO: 8467141 - DNA, 22 bp, Homo sapiens
gccaggtggaggttgcagtgag

SEQ ID NO: 8467142 - DNA, 22 bp, Homo sapiens
atttccaggctgttttgtgaat

SEQ ID NO: 8467143 - DNA, 19 bp, Homo sapiens
gccaggtcttgggtccagg

SEQ ID NO: 8467144 - DNA, 22 bp, Homo sapiens
gccaggtgcatggctgagtctc

SEQ ID NO: 8467145 - DNA, 22 bp, Homo sapiens
gccaggtgagaggactgaggct

SEQ ID NO: 8467146 - DNA, 22 bp, Homo sapiens
gccaggtgcatattagaagcat

SEQ ID NO: 8467147 - DNA, 22 bp, Homo sapiens
gccaggtggaggttgcagtgag

SEQ ID NO: 8467148 - DNA, 22 bp, Homo sapiens
gccaggctggggggagatgtct

SEQ ID NO: 8467149 - DNA, 22 bp, Homo sapiens
gccaggctggtcttgaactcct

SEQ ID NO: 8467150 - DNA, 22 bp, Homo sapiens
gccaggctggtgcaaggatatt

SEQ ID NO: 8467151 - DNA, 22 bp, Homo sapiens
gccaggctggccagcaccttct

SEQ ID NO: 8467152 - DNA, 22 bp, Homo sapiens
gccaggctggcaaaaggaaacc

SEQ ID NO: 8467153 - DNA, 22 bp, Homo sapiens
gccaggctggaaagaacagaca

SEQ ID NO: 8467154 - DNA, 19 bp, Homo sapiens
gccaggcctggacctgcag

SEQ ID NO: 8467155 - DNA, 22 bp, Homo sapiens
gccacaggtgggctctgggaaa

SEQ ID NO: 8467156 - DNA, 22 bp, Homo sapiens
gccacaggtactatgggagaga

SEQ ID NO: 8467157 - DNA, 22 bp, Homo sapiens
gccacaggtcggctagagggtc

SEQ ID NO: 8467158 - DNA, 22 bp, Homo sapiens
gcccccacaggcgggctcgggt

SEQ ID NO: 8467159 - DNA, 22 bp, Homo sapiens
gccccaggttgcctgtcccagg

SEQ ID NO: 8467160 - DNA, 22 bp, Homo sapiens
atttctgttatacctttctcag

SEQ ID NO: 8467161 - DNA, 22 bp, Homo sapiens
atttctgtggcttcattctcct

SEQ ID NO: 8467162 - DNA, 22 bp, Homo sapiens
atttctgtggcttcattctcct

SEQ ID NO: 8467163 - DNA, 22 bp, Homo sapiens
atttctgtatcctgctgtcaga

SEQ ID NO: 8467164 - DNA, 22 bp, Homo sapiens
atttctgtatcctgctgtcaga

SEQ ID NO: 8467165 - DNA, 22 bp, Homo sapiens
atttctgtgcagtaaatggtga

SEQ ID NO: 8467166 - DNA, 17 bp, Homo sapiens
gcccacccttaggagct

SEQ ID NO: 8467167 - DNA, 22 bp, Homo sapiens
atttctcagtgtgatcaggcct

SEQ ID NO: 8467168 - DNA, 22 bp, Homo sapiens
atttctcagttcctactgttta

SEQ ID NO: 8467169 - DNA, 22 bp, Homo sapiens
atttctgtaacttatgaaagtt

SEQ ID NO: 8467170 - DNA, 22 bp, Homo sapiens
atttctgtagtccacattcttt

SEQ ID NO: 8467171 - DNA, 21 bp, Homo sapiens
gcccacagtgaggaggatccc

SEQ ID NO: 8467172 - DNA, 22 bp, Homo sapiens
gcccacagtgtagcaggtactc

SEQ ID NO: 8467173 - DNA, 22 bp, Homo sapiens
gcccacagttaatgggggctct

SEQ ID NO: 8467174 - DNA, 22 bp, Homo sapiens
gcccacagtgtagcaggtactc

SEQ ID NO: 8467175 - DNA, 17 bp, Homo sapiens
gcccacccttaggagct

SEQ ID NO: 8467176 - DNA, 17 bp, Homo sapiens
gcccacccttaggagct

SEQ ID NO: 8467177 - DNA, 23 bp, Homo sapiens
gcccaccctcagcgtcctcacgg

SEQ ID NO: 8467178 - DNA, 23 bp, Homo sapiens
gcccaccctcagcgtcctcacgg

SEQ ID NO: 8467179 - DNA, 22 bp, Homo sapiens
gcccacatttttggcttagagg

SEQ ID NO: 8467180 - DNA, 23 bp, Homo sapiens
gcccacattggtgcatgaatgtt

SEQ ID NO: 8467181 - DNA, 22 bp, Homo sapiens
gcccacatccactagacatgca

SEQ ID NO: 8467182 - DNA, 22 bp, Homo sapiens
atttccatgaaggcagatttta

SEQ ID NO: 8467183 - DNA, 22 bp, Homo sapiens
atttggaacttataataagttt

SEQ ID NO: 8467184 - DNA, 22 bp, Homo sapiens
atttggaacttataataagttt

SEQ ID NO: 8467185 - DNA, 22 bp, Homo sapiens
atttggaacaaatattagtaaa

SEQ ID NO: 8467186 - DNA, 22 bp, Homo sapiens
atttggaaatgtaagaatgcaa

SEQ ID NO: 8467187 - DNA, 22 bp, Homo sapiens
atttggaagaaatctgtcacag

SEQ ID NO: 8467188 - DNA, 22 bp, Homo sapiens
gcctgaagaacagctgtgagga

SEQ ID NO: 8467189 - DNA, 22 bp, Homo sapiens
gcctcttgtttccttacatgga

SEQ ID NO: 8467190 - DNA, 20 bp, Homo sapiens
gcctagggtcacttcagtga

SEQ ID NO: 8467191 - DNA, 22 bp, Homo sapiens
gcctagtgcactggcagggctc

SEQ ID NO: 8467192 - DNA, 22 bp, Homo sapiens
gcctaggtaccagcagagagcc

SEQ ID NO: 8467193 - DNA, 22 bp, Homo sapiens
atttggaaaatctggttataga

SEQ ID NO: 8467194 - DNA, 19 bp, Homo sapiens
atttggaaataaggtcttc

SEQ ID NO: 8467195 - DNA, 22 bp, Homo sapiens
atttgccttttaaactcacaat

SEQ ID NO: 8467196 - DNA, 22 bp, Homo sapiens
gccccctctttggagccagcca

SEQ ID NO: 8467197 - DNA, 22 bp, Homo sapiens
atttgctctagctgcagtgaat

SEQ ID NO: 8467198 - DNA, 22 bp, Homo sapiens
gcccccagctctcaagctcaaa

SEQ ID NO: 8467199 - DNA, 22 bp, Homo sapiens
atttggaagcttgaagattatt

SEQ ID NO: 8467200 - DNA, 22 bp, Homo sapiens
gcctgagattctgcatttctaa

SEQ ID NO: 8467201 - DNA, 22 bp, Homo sapiens
gcctgagattcccggagccgtg

SEQ ID NO: 8467202 - DNA, 22 bp, Homo sapiens
atttggaaggtttacaaagaga

SEQ ID NO: 8467203 - DNA, 22 bp, Homo sapiens
gcctgaaggagtcagagagggc

SEQ ID NO: 8467204 - DNA, 22 bp, Homo sapiens
gcctgaagctggaataattgta

SEQ ID NO: 8467205 - DNA, 22 bp, Homo sapiens
gcctgaagctggaataattgta

SEQ ID NO: 8467206 - DNA, 22 bp, Homo sapiens
gcctgacctcttctgccctggg

SEQ ID NO: 8467207 - DNA, 22 bp, Homo sapiens
gcctgagaaggacacagcaggt

SEQ ID NO: 8467208 - DNA, 22 bp, Homo sapiens
gcctgagaaggataggaagcga

SEQ ID NO: 8467209 - DNA, 22 bp, Homo sapiens
gcctgagaaggataggaagcga

SEQ ID NO: 8467210 - DNA, 22 bp, Homo sapiens
gcctgagagtctgcatttctaa

SEQ ID NO: 8467211 - DNA, 22 bp, Homo sapiens
gcctgagagttgaagttcagtg

SEQ ID NO: 8467212 - DNA, 22 bp, Homo sapiens
gcctgagatcaggagaaagcca

SEQ ID NO: 8467213 - DNA, 22 bp, Homo sapiens
gcctgagagttgaagttcagtg

SEQ ID NO: 8467214 - DNA, 22 bp, Homo sapiens
gcctgagatcagccaagcccct

SEQ ID NO: 8467215 - DNA, 22 bp, Homo sapiens
gcctgagaaggataggaagcga

SEQ ID NO: 8467216 - DNA, 22 bp, Homo sapiens
attttactactccaattaatga

SEQ ID NO: 8467217 - DNA, 22 bp, Homo sapiens
attttactactccaattaatga

SEQ ID NO: 8467218 - DNA, 22 bp, Homo sapiens
gcctggcacattgcagtggatt

SEQ ID NO: 8467219 - DNA, 22 bp, Homo sapiens
gcctggcacattgcagtggatt

SEQ ID NO: 8467220 - DNA, 22 bp, Homo sapiens
gcctggcaatggcctcaggaag

SEQ ID NO: 8467221 - DNA, 22 bp, Homo sapiens
gcctggcaatggcctcaggaag

SEQ ID NO: 8467222 - DNA, 22 bp, Homo sapiens
gcctggagttgtggtgaagcca

SEQ ID NO: 8467223 - DNA, 22 bp, Homo sapiens
gcctggattccttgtttctcag

SEQ ID NO: 8467224 - DNA, 22 bp, Homo sapiens
caaaattagggagtgagctgga

SEQ ID NO: 8467225 - DNA, 22 bp, Homo sapiens
caaaattagggagtgagctgga

SEQ ID NO: 8467226 - DNA, 22 bp, Homo sapiens
caaaattagaaatgcagctgtt

SEQ ID NO: 8467227 - DNA, 22 bp, Homo sapiens
caaaattagggagtgagctgga

SEQ ID NO: 8467228 - DNA, 22 bp, Homo sapiens
caaaattgatgaatgtatgatt

SEQ ID NO: 8467229 - DNA, 22 bp, Homo sapiens
caaaattagaaatgcagctgtt

SEQ ID NO: 8467230 - DNA, 22 bp, Homo sapiens
caaaattagaaatgcagctgtt

SEQ ID NO: 8467231 - DNA, 22 bp, Homo sapiens
caaaatgttctggcacctttaa

SEQ ID NO: 8467232 - DNA, 22 bp, Homo sapiens
caaaatgtgagtcccacctcaa

SEQ ID NO: 8467233 - DNA, 22 bp, Homo sapiens
caaaatgatgtgattttattgt

SEQ ID NO: 8467234 - DNA, 22 bp, Homo sapiens
caaacattcaagtacaagtctt

SEQ ID NO: 8467235 - DNA, 22 bp, Homo sapiens
caaagagttttttcatataatg

SEQ ID NO: 8467236 - DNA, 22 bp, Homo sapiens
caaagaggttttgagggcagct

SEQ ID NO: 8467237 - DNA, 22 bp, Homo sapiens
caaagcaggaagaatattgaaa

SEQ ID NO: 8467238 - DNA, 22 bp, Homo sapiens
caaagcagagaactgtctcatt

SEQ ID NO: 8467239 - DNA, 22 bp, Homo sapiens
caaagcagagaactgtctcatt

SEQ ID NO: 8467240 - DNA, 22 bp, Homo sapiens
caaagcagagccagagcttgtc

SEQ ID NO: 8467241 - DNA, 22 bp, Homo sapiens
caaagcagttttaatcaagtag

SEQ ID NO: 8467242 - DNA, 22 bp, Homo sapiens
caaagccaggctttctaatgta

SEQ ID NO: 8467243 - DNA, 22 bp, Homo sapiens
caaagccaggctttctaatgta

SEQ ID NO: 8467244 - DNA, 22 bp, Homo sapiens
caaagccatagagtagataaga

SEQ ID NO: 8467245 - DNA, 21 bp, Homo sapiens
caaagccaggcaactctctcc

SEQ ID NO: 8467246 - DNA, 18 bp, Homo sapiens
caaagcaggtgacagtgt

SEQ ID NO: 8467247 - DNA, 22 bp, Homo sapiens
caaagcagtattggattcttta

SEQ ID NO: 8467248 - DNA, 20 bp, Homo sapiens
caaagcagtaggataaaaat

SEQ ID NO: 8467249 - DNA, 22 bp, Homo sapiens
atttttatgacaaaccatcctc

SEQ ID NO: 8467250 - DNA, 23 bp, Homo sapiens
atttttagcctctctgagctgag

SEQ ID NO: 8467251 - DNA, 22 bp, Homo sapiens
attttgtttcctttggagtaga

SEQ ID NO: 8467252 - DNA, 22 bp, Homo sapiens
atttttcagcttcattgaggca

SEQ ID NO: 8467253 - DNA, 22 bp, Homo sapiens
atttttcagcttcattgaggca

SEQ ID NO: 8467254 - DNA, 22 bp, Homo sapiens
attttagagctccaagtacagc

SEQ ID NO: 8467255 - DNA, 22 bp, Homo sapiens
attttagagaaacaaacgtagg

SEQ ID NO: 8467256 - DNA, 22 bp, Homo sapiens
attttagagaaacaaacgtagg

SEQ ID NO: 8467257 - DNA, 22 bp, Homo sapiens
attttagagctccaagtacagc

SEQ ID NO: 8467258 - DNA, 22 bp, Homo sapiens
atttttctctcacacttaccag

SEQ ID NO: 8467259 - DNA, 22 bp, Homo sapiens
atttttctctcacacttaccag

SEQ ID NO: 8467260 - DNA, 22 bp, Homo sapiens
atttttctctcacacttaccag

SEQ ID NO: 8467261 - DNA, 22 bp, Homo sapiens
atttttctctccactccattaa

SEQ ID NO: 8467262 - DNA, 22 bp, Homo sapiens
atttttctctttccactgagat

SEQ ID NO: 8467263 - DNA, 22 bp, Homo sapiens
atttttctctttccactgagat

SEQ ID NO: 8467264 - DNA, 19 bp, Homo sapiens
atttttcttcctctgtgca

SEQ ID NO: 8467265 - DNA, 19 bp, Homo sapiens
atttttcttcctctgtgca

SEQ ID NO: 8467266 - DNA, 22 bp, Homo sapiens
caaaataccacgacttgtttta

SEQ ID NO: 8467267 - DNA, 22 bp, Homo sapiens
caaaataccacgacttgtttta

SEQ ID NO: 8467268 - DNA, 22 bp, Homo sapiens
caaaagcagttctatctgagtt

SEQ ID NO: 8467269 - DNA, 22 bp, Homo sapiens
caaaagcagttctatctgagtt

SEQ ID NO: 8467270 - DNA, 22 bp, Homo sapiens
caaaagcagttctatctgagtt

SEQ ID NO: 8467271 - DNA, 21 bp, Homo sapiens
caaatacttagaaacttaaga

SEQ ID NO: 8467272 - DNA, 21 bp, Homo sapiens
caaatacttagaaacttaaga

SEQ ID NO: 8467273 - DNA, 22 bp, Homo sapiens
caaatacttactgaacctgtgc

SEQ ID NO: 8467274 - DNA, 21 bp, Homo sapiens
caaatacttagaaacttaaga

SEQ ID NO: 8467275 - DNA, 22 bp, Homo sapiens
caaatactttatatacttcaaa

SEQ ID NO: 8467276 - DNA, 22 bp, Homo sapiens
caaatactttatatacttcaaa

SEQ ID NO: 8467277 - DNA, 22 bp, Homo sapiens
caaatactttatatacttcaaa

SEQ ID NO: 8467278 - DNA, 22 bp, Homo sapiens
caaatacttttagcctattgag

SEQ ID NO: 8467279 - DNA, 22 bp, Homo sapiens
caaatacttttagcctattgag

SEQ ID NO: 8467280 - DNA, 22 bp, Homo sapiens
caaatagaactcacagacaaga

SEQ ID NO: 8467281 - DNA, 22 bp, Homo sapiens
caaatagaactcacagacaaga

SEQ ID NO: 8467282 - DNA, 22 bp, Homo sapiens
caaatagaaggtactcagagaa

SEQ ID NO: 8467283 - DNA, 21 bp, Homo sapiens
caaatagacatggctagagga

SEQ ID NO: 8467284 - DNA, 22 bp, Homo sapiens
caaatacttactgaacctgtgc

SEQ ID NO: 8467285 - DNA, 18 bp, Homo sapiens
caaatactgttgtcttat

SEQ ID NO: 8467286 - DNA, 18 bp, Homo sapiens
caaatactgttgtcttat

SEQ ID NO: 8467287 - DNA, 18 bp, Homo sapiens
caaatactgttgtcttat

SEQ ID NO: 8467288 - DNA, 22 bp, Homo sapiens
caaatactgtactgaacactgt

SEQ ID NO: 8467289 - DNA, 22 bp, Homo sapiens
caaatactgtactgaacactgt

SEQ ID NO: 8467290 - DNA, 22 bp, Homo sapiens
caaatactgggtaagttaattt

SEQ ID NO: 8467291 - DNA, 22 bp, Homo sapiens
caaatactgagtttattttcaa

SEQ ID NO: 8467292 - DNA, 22 bp, Homo sapiens
caaatactgagtttattttcaa

SEQ ID NO: 8467293 - DNA, 22 bp, Homo sapiens
caaatactgggtaagttaattt

SEQ ID NO: 8467294 - DNA, 22 bp, Homo sapiens
caaatactgagcacgcaatcaa

SEQ ID NO: 8467295 - DNA, 22 bp, Homo sapiens
caaatactctggatgtgtttgt

SEQ ID NO: 8467296 - DNA, 22 bp, Homo sapiens
caaatactgagcacgcaatcaa

SEQ ID NO: 8467297 - DNA, 22 bp, Homo sapiens
caaatactctggatgtgtttgt

SEQ ID NO: 8467298 - DNA, 22 bp, Homo sapiens
caaatactacgattcttgcagt

SEQ ID NO: 8467299 - DNA, 22 bp, Homo sapiens
caaatactacgattcttgcagt

SEQ ID NO: 8467300 - DNA, 22 bp, Homo sapiens
caaatactaaacataagatttt

SEQ ID NO: 8467301 - DNA, 22 bp, Homo sapiens
caaatactaaacataagatttt

SEQ ID NO: 8467302 - DNA, 22 bp, Homo sapiens
caaatactaaacataagatttt

SEQ ID NO: 8467303 - DNA, 22 bp, Homo sapiens
caaatacaaatacgggcagctt

SEQ ID NO: 8467304 - DNA, 22 bp, Homo sapiens
caaagtgctggaattacaggtg

SEQ ID NO: 8467305 - DNA, 22 bp, Homo sapiens
caaagctgacgaggtcagcatc

SEQ ID NO: 8467306 - DNA, 22 bp, Homo sapiens
caaagctataaattcagacaga

SEQ ID NO: 8467307 - DNA, 22 bp, Homo sapiens
caaagcgtcctgcctccatttg

SEQ ID NO: 8467308 - DNA, 22 bp, Homo sapiens
caaagccctggaaagatgaaga

SEQ ID NO: 8467309 - DNA, 22 bp, Homo sapiens
caaagctgtaccccaacctatg

SEQ ID NO: 8467310 - DNA, 22 bp, Homo sapiens
caaagctgatactcagcaagta

SEQ ID NO: 8467311 - DNA, 22 bp, Homo sapiens
caaagctgtgaattcctacaaa

SEQ ID NO: 8467312 - DNA, 22 bp, Homo sapiens
caaatgctatgattttgagttt

SEQ ID NO: 8467313 - DNA, 21 bp, Homo sapiens
caaatgctggctggatgagga

SEQ ID NO: 8467314 - DNA, 22 bp, Homo sapiens
caaatgctggccctgctactta

SEQ ID NO: 8467315 - DNA, 22 bp, Homo sapiens
caaatgctggccctgctactta

SEQ ID NO: 8467316 - DNA, 22 bp, Homo sapiens
caaatgctactaataggcaagt

SEQ ID NO: 8467317 - DNA, 22 bp, Homo sapiens
caaatgctaacttctttccaaa

SEQ ID NO: 8467318 - DNA, 22 bp, Homo sapiens
caaatgcatgagaaataagagg

SEQ ID NO: 8467319 - DNA, 22 bp, Homo sapiens
gctgactcagatgcagctggat

SEQ ID NO: 8467320 - DNA, 23 bp, Homo sapiens
gctgactgtgaaattctggagct

SEQ ID NO: 8467321 - DNA, 22 bp, Homo sapiens
caaatgatacctattactaggc

SEQ ID NO: 8467322 - DNA, 22 bp, Homo sapiens
gctctttgcacagctctgccct

SEQ ID NO: 8467323 - DNA, 22 bp, Homo sapiens
gctcttgtcaaaaattagttga

SEQ ID NO: 8467324 - DNA, 18 bp, Homo sapiens
gctctggttccttcaacc

SEQ ID NO: 8467325 - DNA, 23 bp, Homo sapiens
gctctttgttcatgtggatgcct

SEQ ID NO: 8467326 - DNA, 22 bp, Homo sapiens
gctctttgtattttggaatcaa

SEQ ID NO: 8467327 - DNA, 22 bp, Homo sapiens
gctctttggattcctttacaaa

SEQ ID NO: 8467328 - DNA, 20 bp, Homo sapiens
gctctttgtaagggaatttg

SEQ ID NO: 8467329 - DNA, 22 bp, Homo sapiens
gctgaaaggggtgacattcttt

SEQ ID NO: 8467330 - DNA, 22 bp, Homo sapiens
gctgaaaggggtgacattcttt

SEQ ID NO: 8467331 - DNA, 22 bp, Homo sapiens
gctcttttcacagtccaaaatg

SEQ ID NO: 8467332 - DNA, 22 bp, Homo sapiens
gctgacagcaaggggctgccct

SEQ ID NO: 8467333 - DNA, 22 bp, Homo sapiens
gctgacagttgtacctgcccct

SEQ ID NO: 8467334 - DNA, 22 bp, Homo sapiens
gctgaccattaggaggacgata

SEQ ID NO: 8467335 - DNA, 22 bp, Homo sapiens
gctgacccctacaggttgtgtt

SEQ ID NO: 8467336 - DNA, 22 bp, Homo sapiens
attagtagctgtaataactggg

SEQ ID NO: 8467337 - DNA, 22 bp, Homo sapiens
attagtctactgtctaataaat

SEQ ID NO: 8467338 - DNA, 22 bp, Homo sapiens
attaggtggggttgttactgtt

SEQ ID NO: 8467339 - DNA, 22 bp, Homo sapiens
attaggttagtgtgcaagagaa

SEQ ID NO: 8467340 - DNA, 22 bp, Homo sapiens
attaggttgaggtactcagagc

SEQ ID NO: 8467341 - DNA, 22 bp, Homo sapiens
attaggtaatctttagatacac

SEQ ID NO: 8467342 - DNA, 22 bp, Homo sapiens
attaggaagtaagtatcacaag

SEQ ID NO: 8467343 - DNA, 22 bp, Homo sapiens
attaggaagtaagtatcacaag

SEQ ID NO: 8467344 - DNA, 22 bp, Homo sapiens
attaggaaatgtgttgcaagca

SEQ ID NO: 8467345 - DNA, 22 bp, Homo sapiens
attagatcagatcggcagtaat

SEQ ID NO: 8467346 - DNA, 22 bp, Homo sapiens
attcaacatattctgagtaaaa

SEQ ID NO: 8467347 - DNA, 21 bp, Homo sapiens
attcaactagatgattatttc

SEQ ID NO: 8467348 - DNA, 22 bp, Homo sapiens
attcaactagtgattgtgttat

SEQ ID NO: 8467349 - DNA, 22 bp, Homo sapiens
attcaacttataagatattaat

SEQ ID NO: 8467350 - DNA, 22 bp, Homo sapiens
attcaactatgtatagtcttct

SEQ ID NO: 8467351 - DNA, 22 bp, Homo sapiens
attcaactgtaaacttgttcac

SEQ ID NO: 8467352 - DNA, 22 bp, Homo sapiens
attcaacttacaaaggagaaga

SEQ ID NO: 8467353 - DNA, 22 bp, Homo sapiens
attagtcttctcatttggatcc

SEQ ID NO: 8467354 - DNA, 22 bp, Homo sapiens
attagtgtacatctcacacgca

SEQ ID NO: 8467355 - DNA, 22 bp, Homo sapiens
attagtgtgtaggctggaaaaa

SEQ ID NO: 8467356 - DNA, 22 bp, Homo sapiens
attagtgttcttatcttctagg

SEQ ID NO: 8467357 - DNA, 22 bp, Homo sapiens
attagtgtggaccctaatttaa

SEQ ID NO: 8467358 - DNA, 22 bp, Homo sapiens
attagtgtctgtgaataattct

SEQ ID NO: 8467359 - DNA, 22 bp, Homo sapiens
attagtgtcatgttgaggactt

SEQ ID NO: 8467360 - DNA, 22 bp, Homo sapiens
attagtgttgtggcttcatggc

SEQ ID NO: 8467361 - DNA, 22 bp, Homo sapiens
attagtgttgtggcttcatggc

SEQ ID NO: 8467362 - DNA, 22 bp, Homo sapiens
attagtgttgtaagaagctgcc

SEQ ID NO: 8467363 - DNA, 22 bp, Homo sapiens
attacaatcgagagaaacaaat

SEQ ID NO: 8467364 - DNA, 22 bp, Homo sapiens
attacaatcgagagaaacaaat

SEQ ID NO: 8467365 - DNA, 22 bp, Homo sapiens
attacagtgggtaaacagaatt

SEQ ID NO: 8467366 - DNA, 22 bp, Homo sapiens
gatattgtgatgatgtctttgg

SEQ ID NO: 8467367 - DNA, 22 bp, Homo sapiens
gatatttaactctcacaggtcc

SEQ ID NO: 8467368 - DNA, 22 bp, Homo sapiens
attacagttctacacatccttt

SEQ ID NO: 8467369 - DNA, 22 bp, Homo sapiens
attacagttctacacatccttt

SEQ ID NO: 8467370 - DNA, 22 bp, Homo sapiens
attacatatgttggcaacattt

SEQ ID NO: 8467371 - DNA, 22 bp, Homo sapiens
attacatgagagaatgtaaata

SEQ ID NO: 8467372 - DNA, 22 bp, Homo sapiens
attacatgagagaatgtaaata

SEQ ID NO: 8467373 - DNA, 22 bp, Homo sapiens
attacatgagagaatgtaaata

SEQ ID NO: 8467374 - DNA, 22 bp, Homo sapiens
attactatgatttgatcattac

SEQ ID NO: 8467375 - DNA, 22 bp, Homo sapiens
attactgagcttgtagctgcat

SEQ ID NO: 8467376 - DNA, 22 bp, Homo sapiens
gatttctctgcacccactcagg

SEQ ID NO: 8467377 - DNA, 17 bp, Homo sapiens
gatttcctgaagttctt

SEQ ID NO: 8467378 - DNA, 22 bp, Homo sapiens
attactgtgactagccatctgg

SEQ ID NO: 8467379 - DNA, 22 bp, Homo sapiens
attactgaggcaaagtagtttt

SEQ ID NO: 8467380 - DNA, 22 bp, Homo sapiens
attactgaggcaaagtagtttt

SEQ ID NO: 8467381 - DNA, 22 bp, Homo sapiens
attagaaaatacatgggctgtc

SEQ ID NO: 8467382 - DNA, 22 bp, Homo sapiens
attagaaaatctggaggtgggg

SEQ ID NO: 8467383 - DNA, 22 bp, Homo sapiens
attagaaaaactcaagggctct

SEQ ID NO: 8467384 - DNA, 22 bp, Homo sapiens
attagaaaccaagaggcaggct

SEQ ID NO: 8467385 - DNA, 23 bp, Homo sapiens
attagaaaggctttctggtgaaa

SEQ ID NO: 8467386 - DNA, 23 bp, Homo sapiens
attagaaaggctttctggtgaaa

SEQ ID NO: 8467387 - DNA, 22 bp, Homo sapiens
gcagcagatgctttcatggaca

SEQ ID NO: 8467388 - DNA, 22 bp, Homo sapiens
gcagcagatgctttcatggaca

SEQ ID NO: 8467389 - DNA, 22 bp, Homo sapiens
gcagcagagtttgggagatggt

SEQ ID NO: 8467390 - DNA, 22 bp, Homo sapiens
gcagcagagtttgggagatggt

SEQ ID NO: 8467391 - DNA, 22 bp, Homo sapiens
attcagactatgaacacgtcag

SEQ ID NO: 8467392 - DNA, 23 bp, Homo sapiens
attcagaattgtgtgtttgtata

SEQ ID NO: 8467393 - DNA, 22 bp, Homo sapiens
attcagactcttgagcagtccc

SEQ ID NO: 8467394 - DNA, 22 bp, Homo sapiens
gcagatggaaagtgcttgaggg

SEQ ID NO: 8467395 - DNA, 20 bp, Homo sapiens
attcagaataggcatgtaaa

SEQ ID NO: 8467396 - DNA, 22 bp, Homo sapiens
attcagaagctattcttagttc

SEQ ID NO: 8467397 - DNA, 22 bp, Homo sapiens
attcagaagcaatcacagtgag

SEQ ID NO: 8467398 - DNA, 22 bp, Homo sapiens
gcagcagagctttgtcctggct

SEQ ID NO: 8467399 - DNA, 22 bp, Homo sapiens
gcagcagagtagacagagccct

SEQ ID NO: 8467400 - DNA, 21 bp, Homo sapiens
gcagcagaggcttgacagaca

SEQ ID NO: 8467401 - DNA, 22 bp, Homo sapiens
gcagcagagaacacaatgatgg

SEQ ID NO: 8467402 - DNA, 20 bp, Homo sapiens
gcagcagacagacaggggac

SEQ ID NO: 8467403 - DNA, 22 bp, Homo sapiens
attcacatgtgcttcttatcac

SEQ ID NO: 8467404 - DNA, 22 bp, Homo sapiens
attcacatgcccaagcagcacc

SEQ ID NO: 8467405 - DNA, 22 bp, Homo sapiens
attcacatttagacatcaggta

SEQ ID NO: 8467406 - DNA, 22 bp, Homo sapiens
attcacatttacaaagcactca

SEQ ID NO: 8467407 - DNA, 22 bp, Homo sapiens
attcagaaatagaaaatttgat

SEQ ID NO: 8467408 - DNA, 22 bp, Homo sapiens
attcagaaagttgtcatatttg

SEQ ID NO: 8467409 - DNA, 22 bp, Homo sapiens
attcacccagcacagtggcagc

SEQ ID NO: 8467410 - DNA, 22 bp, Homo sapiens
attcacctgttagtaaaaatct

SEQ ID NO: 8467411 - DNA, 22 bp, Homo sapiens
attcacatgatgtatgtagggc

SEQ ID NO: 8467412 - DNA, 22 bp, Homo sapiens
gcacgtgcacacatgtgtacaa

SEQ ID NO: 8467413 - DNA, 22 bp, Homo sapiens
attcaagctgaatggtgacaga

SEQ ID NO: 8467414 - DNA, 22 bp, Homo sapiens
attcaagattaattctatgtca

SEQ ID NO: 8467415 - DNA, 22 bp, Homo sapiens
attcaaggtatttaaaacataa

SEQ ID NO: 8467416 - DNA, 22 bp, Homo sapiens
attcaaggtttattcagtttag

SEQ ID NO: 8467417 - DNA, 22 bp, Homo sapiens
attcaaggttggctcaggaatt

SEQ ID NO: 8467418 - DNA, 22 bp, Homo sapiens
gcacctggggtacacagctaca

SEQ ID NO: 8467419 - DNA, 22 bp, Homo sapiens
gcacggcaagacggggcctcct

SEQ ID NO: 8467420 - DNA, 22 bp, Homo sapiens
gcacctttctatattcagtggc

SEQ ID NO: 8467421 - DNA, 18 bp, Homo sapiens
gcagggctgcacacgcat

SEQ ID NO: 8467422 - DNA, 22 bp, Homo sapiens
gcagggctgatggcttccctca

SEQ ID NO: 8467423 - DNA, 18 bp, Homo sapiens
gcagggctgcacacgcat

SEQ ID NO: 8467424 - DNA, 22 bp, Homo sapiens
gcagggctgagtcatgtgtgcc

SEQ ID NO: 8467425 - DNA, 22 bp, Homo sapiens
gcagggctgactcagccaccct

SEQ ID NO: 8467426 - DNA, 22 bp, Homo sapiens
attgcaaagaaatacatgctta

SEQ ID NO: 8467427 - DNA, 22 bp, Homo sapiens
attgatttgaacaaagatatta

SEQ ID NO: 8467428 - DNA, 22 bp, Homo sapiens
attgcaaaattgtcctgtggaa

SEQ ID NO: 8467429 - DNA, 22 bp, Homo sapiens
attgcaaaattgtcctgtggaa

SEQ ID NO: 8467430 - DNA, 22 bp, Homo sapiens
attgatttagctcaagacacat

SEQ ID NO: 8467431 - DNA, 22 bp, Homo sapiens
attgatttgaacaaagatatta

SEQ ID NO: 8467432 - DNA, 22 bp, Homo sapiens
attgatttagctcaagacacat

SEQ ID NO: 8467433 - DNA, 22 bp, Homo sapiens
attgattctgtaagtcaacaat

SEQ ID NO: 8467434 - DNA, 22 bp, Homo sapiens
attgattctcataggaccatct

SEQ ID NO: 8467435 - DNA, 22 bp, Homo sapiens
attgattctaccagctactttg

SEQ ID NO: 8467436 - DNA, 23 bp, Homo sapiens
attgattccctcttggaagggat

SEQ ID NO: 8467437 - DNA, 22 bp, Homo sapiens
gcaggcctttatccctgcctca

SEQ ID NO: 8467438 - DNA, 23 bp, Homo sapiens
attgatgacttgattacactttt

SEQ ID NO: 8467439 - DNA, 22 bp, Homo sapiens
attgatgagcattactctctaa

SEQ ID NO: 8467440 - DNA, 22 bp, Homo sapiens
gcaggcctgcaggtatggccgg

SEQ ID NO: 8467441 - DNA, 22 bp, Homo sapiens
gcaggcctgactgtagggggca

SEQ ID NO: 8467442 - DNA, 22 bp, Homo sapiens
gcaggcctgcccagcaggatgg

SEQ ID NO: 8467443 - DNA, 22 bp, Homo sapiens
gcaggcctgtcttgctcgccct

SEQ ID NO: 8467444 - DNA, 22 bp, Homo sapiens
gcaggccttggcaatgagcctg

SEQ ID NO: 8467445 - DNA, 22 bp, Homo sapiens
gcaggccttggcaatgagcctg

SEQ ID NO: 8467446 - DNA, 22 bp, Homo sapiens
gcaggcctggtttacatggtag

SEQ ID NO: 8467447 - DNA, 22 bp, Homo sapiens
gcaggcctgtaatgaagggaca

SEQ ID NO: 8467448 - DNA, 22 bp, Homo sapiens
attctttaattcaattgaagga

SEQ ID NO: 8467449 - DNA, 22 bp, Homo sapiens
attctttaattcaattgaagga

SEQ ID NO: 8467450 - DNA, 22 bp, Homo sapiens
attctttacattggcttcttcc

SEQ ID NO: 8467451 - DNA, 19 bp, Homo sapiens
attcttgttaagtgtcatc

SEQ ID NO: 8467452 - DNA, 22 bp, Homo sapiens
attcttgtttaatttgcatccc

SEQ ID NO: 8467453 - DNA, 22 bp, Homo sapiens
attcttgtttaatttgcatccc

SEQ ID NO: 8467454 - DNA, 19 bp, Homo sapiens
attcttgttaagtgtcatc

SEQ ID NO: 8467455 - DNA, 22 bp, Homo sapiens
attctttcatataaaggctcag

SEQ ID NO: 8467456 - DNA, 22 bp, Homo sapiens
attctttcatataaaggctcag

SEQ ID NO: 8467457 - DNA, 22 bp, Homo sapiens
attctttcaaggaatagttatt

SEQ ID NO: 8467458 - DNA, 22 bp, Homo sapiens
attctttcaaggaatagttatt

SEQ ID NO: 8467459 - DNA, 22 bp, Homo sapiens
attctttagccagcaggtatat

SEQ ID NO: 8467460 - DNA, 22 bp, Homo sapiens
attctttattgctgatggttat

SEQ ID NO: 8467461 - DNA, 19 bp, Homo sapiens
attcttcagcagtgagacc

SEQ ID NO: 8467462 - DNA, 22 bp, Homo sapiens
attcttgatatagatagttaat

SEQ ID NO: 8467463 - DNA, 22 bp, Homo sapiens
attcttgatatagatagttaat

SEQ ID NO: 8467464 - DNA, 22 bp, Homo sapiens
gcagctgctgtggcatcaagct

SEQ ID NO: 8467465 - DNA, 22 bp, Homo sapiens
attccttgcacatcagatagtt

SEQ ID NO: 8467466 - DNA, 21 bp, Homo sapiens
gcagcgccctctgaccttgat

SEQ ID NO: 8467467 - DNA, 21 bp, Homo sapiens
attgtgaccatcattttggaa

SEQ ID NO: 8467468 - DNA, 22 bp, Homo sapiens
attgtgaattgagagtacttct

SEQ ID NO: 8467469 - DNA, 22 bp, Homo sapiens
attgtgaatagtgccgcagtaa

SEQ ID NO: 8467470 - DNA, 22 bp, Homo sapiens
attgtgcaatgttttacaattt

SEQ ID NO: 8467471 - DNA, 22 bp, Homo sapiens
attgtgcaaaacctcaggcctc

SEQ ID NO: 8467472 - DNA, 22 bp, Homo sapiens
gcattctgtgctacagccattc

SEQ ID NO: 8467473 - DNA, 22 bp, Homo sapiens
attgtctttccactgagaagtt

SEQ ID NO: 8467474 - DNA, 22 bp, Homo sapiens
attgtcttctgtcttatagttc

SEQ ID NO: 8467475 - DNA, 22 bp, Homo sapiens
attgtcttctggtcttatcttt

SEQ ID NO: 8467476 - DNA, 22 bp, Homo sapiens
gccaaatcacagggccaaaagc

SEQ ID NO: 8467477 - DNA, 22 bp, Homo sapiens
gccaaatctggatttagcaaga

SEQ ID NO: 8467478 - DNA, 22 bp, Homo sapiens
gccaaagtacctagccctctgc

SEQ ID NO: 8467479 - DNA, 22 bp, Homo sapiens
gccaaatttgtgagcccccaag

SEQ ID NO: 8467480 - DNA, 22 bp, Homo sapiens
gccaactggctgatctcaaagc

SEQ ID NO: 8467481 - DNA, 20 bp, Homo sapiens
gccaacgcgctggggctgcc

SEQ ID NO: 8467482 - DNA, 22 bp, Homo sapiens
gccaaaggacctgtgggtgaca

SEQ ID NO: 8467483 - DNA, 22 bp, Homo sapiens
gccaaaggattctatggagata

SEQ ID NO: 8467484 - DNA, 22 bp, Homo sapiens
gccaaagtccacttgctttctg

SEQ ID NO: 8467485 - DNA, 22 bp, Homo sapiens
gccaaagtccacttgctttctg

SEQ ID NO: 8467486 - DNA, 22 bp, Homo sapiens
gccaaagtcctccagccatgca

SEQ ID NO: 8467487 - DNA, 22 bp, Homo sapiens
gccaaagtgctgctctttacca

SEQ ID NO: 8467488 - DNA, 22 bp, Homo sapiens
gccaaagtgctgctctttacca

SEQ ID NO: 8467489 - DNA, 22 bp, Homo sapiens
gccacagggcagatgcgcagag

SEQ ID NO: 8467490 - DNA, 22 bp, Homo sapiens
gccacagggcagatgcgcagag

SEQ ID NO: 8467491 - DNA, 22 bp, Homo sapiens
gccacagggcgagcggaggcca

SEQ ID NO: 8467492 - DNA, 22 bp, Homo sapiens
gccacagggcgagcggaggcca

SEQ ID NO: 8467493 - DNA, 22 bp, Homo sapiens
gccacagggcagatgcgcagag

SEQ ID NO: 8467494 - DNA, 21 bp, Homo sapiens
gccaagaacaagacagacatg

SEQ ID NO: 8467495 - DNA, 18 bp, Homo sapiens
gccaagagcttgcaaaca

SEQ ID NO: 8467496 - DNA, 22 bp, Homo sapiens
gcagtgttacttggagtactaa

SEQ ID NO: 8467497 - DNA, 22 bp, Homo sapiens
gcagtgtgtctggagtacatgg

SEQ ID NO: 8467498 - DNA, 22 bp, Homo sapiens
gcagtgctttagtctgtccttt

SEQ ID NO: 8467499 - DNA, 20 bp, Homo sapiens
gcagtgctggtgcctctgct

SEQ ID NO: 8467500 - DNA, 22 bp, Homo sapiens
gcagtgcttgctcaggcttcat

SEQ ID NO: 8467501 - DNA, 23 bp, Homo sapiens
gcagtgcttggcacagctgggtc

SEQ ID NO: 8467502 - DNA, 22 bp, Homo sapiens
gcatattagtaatctttcaaca

SEQ ID NO: 8467503 - DNA, 22 bp, Homo sapiens
gcatagtaggctgtcaaaaatg

SEQ ID NO: 8467504 - DNA, 22 bp, Homo sapiens
gcataggccactagtgccagga

SEQ ID NO: 8467505 - DNA, 22 bp, Homo sapiens
gcataggcactttcctcctcct

SEQ ID NO: 8467506 - DNA, 22 bp, Homo sapiens
gcatcaagacgatgtgaaatcg

SEQ ID NO: 8467507 - DNA, 22 bp, Homo sapiens
attgtcaggggttgtggagttt

SEQ ID NO: 8467508 - DNA, 22 bp, Homo sapiens
attgtatttgtacaagacatgt

SEQ ID NO: 8467509 - DNA, 22 bp, Homo sapiens
attgtcattggcttctatgtct

SEQ ID NO: 8467510 - DNA, 22 bp, Homo sapiens
attgtcattccagtcattgtta

SEQ ID NO: 8467511 - DNA, 22 bp, Homo sapiens
ccattagtacctctggaaaatt

SEQ ID NO: 8467512 - DNA, 22 bp, Homo sapiens
ccattactttccaatatatcag

SEQ ID NO: 8467513 - DNA, 22 bp, Homo sapiens
ccattagaagatgtaatagaga

SEQ ID NO: 8467514 - DNA, 22 bp, Homo sapiens
ccatgttgtatctcttatcggc

SEQ ID NO: 8467515 - DNA, 22 bp, Homo sapiens
ccatgtgttgagattccagcct

SEQ ID NO: 8467516 - DNA, 22 bp, Homo sapiens
ccattaaaatggaatgtagtga

SEQ ID NO: 8467517 - DNA, 22 bp, Homo sapiens
ccattctttcagtgtctcatgt

SEQ ID NO: 8467518 - DNA, 22 bp, Homo sapiens
ccattctgtgtctctccacagc

SEQ ID NO: 8467519 - DNA, 22 bp, Homo sapiens
ccattggagccaagagttttac

SEQ ID NO: 8467520 - DNA, 22 bp, Homo sapiens
ccattggagagttttaagaagg

SEQ ID NO: 8467521 - DNA, 22 bp, Homo sapiens
ccattctgagtcttatgtcttt

SEQ ID NO: 8467522 - DNA, 22 bp, Homo sapiens
ccattctgccatgcttcatcta

SEQ ID NO: 8467523 - DNA, 22 bp, Homo sapiens
ccattctgagtcttatgtcttt

SEQ ID NO: 8467524 - DNA, 22 bp, Homo sapiens
ccattctgacttcattgcctca

SEQ ID NO: 8467525 - DNA, 22 bp, Homo sapiens
ccattctgacacctaattctgt

SEQ ID NO: 8467526 - DNA, 22 bp, Homo sapiens
ccattctgaacaattcttgtct

SEQ ID NO: 8467527 - DNA, 23 bp, Homo sapiens
ccattcccactgtgccttccctg

SEQ ID NO: 8467528 - DNA, 22 bp, Homo sapiens
ccattccatgtgctacacataa

SEQ ID NO: 8467529 - DNA, 22 bp, Homo sapiens
tgattttacttagcatgatgtt

SEQ ID NO: 8467530 - DNA, 22 bp, Homo sapiens
tgatttgcgtctcatttgaaat

SEQ ID NO: 8467531 - DNA, 22 bp, Homo sapiens
tgatttcttctaatttccatca

SEQ ID NO: 8467532 - DNA, 22 bp, Homo sapiens
tgatttgcatggagaataacag

SEQ ID NO: 8467533 - DNA, 22 bp, Homo sapiens
tgatttcttccttgtcattaga

SEQ ID NO: 8467534 - DNA, 22 bp, Homo sapiens
tgatttcttccttgtcattaga

SEQ ID NO: 8467535 - DNA, 21 bp, Homo sapiens
tgatttctgccaagttcacta

SEQ ID NO: 8467536 - DNA, 22 bp, Homo sapiens
tgatttctctccgttatttcag

SEQ ID NO: 8467537 - DNA, 22 bp, Homo sapiens
tgatttctcttggcaatatgtt

SEQ ID NO: 8467538 - DNA, 20 bp, Homo sapiens
tgatttctcttctattcctt

SEQ ID NO: 8467539 - DNA, 22 bp, Homo sapiens
tgattcaagagagttggggtat

SEQ ID NO: 8467540 - DNA, 22 bp, Homo sapiens
tgattcaagccaccacatactg

SEQ ID NO: 8467541 - DNA, 22 bp, Homo sapiens
tgattcaagattggttagctgt

SEQ ID NO: 8467542 - DNA, 19 bp, Homo sapiens
ccattgtaaagaaaaatgt

SEQ ID NO: 8467543 - DNA, 22 bp, Homo sapiens
tgatttctcatattgttcaaaa

SEQ ID NO: 8467544 - DNA, 22 bp, Homo sapiens
tgattcaagctactgttactgg

SEQ ID NO: 8467545 - DNA, 22 bp, Homo sapiens
tgattcaagccaccacatactg

SEQ ID NO: 8467546 - DNA, 22 bp, Homo sapiens
cccagacataacagcagagagg

SEQ ID NO: 8467547 - DNA, 22 bp, Homo sapiens
cccagacattgcagggactggt

SEQ ID NO: 8467548 - DNA, 22 bp, Homo sapiens
cccagacattgcagggactggt

SEQ ID NO: 8467549 - DNA, 22 bp, Homo sapiens
cccagacagtcaagaggcctgc

SEQ ID NO: 8467550 - DNA, 22 bp, Homo sapiens
cccagacagtgatttacttaat

SEQ ID NO: 8467551 - DNA, 22 bp, Homo sapiens
cccagacagtcaagaggcctgc

SEQ ID NO: 8467552 - DNA, 22 bp, Homo sapiens
cccagaaggtcgaggctgcagt

SEQ ID NO: 8467553 - DNA, 22 bp, Homo sapiens
cccagaaggcttgccaggaagc

SEQ ID NO: 8467554 - DNA, 22 bp, Homo sapiens
tgcacacatgtttacaagcatc

SEQ ID NO: 8467555 - DNA, 22 bp, Homo sapiens
tgcacacatgtttacaagcatc

SEQ ID NO: 8467556 - DNA, 22 bp, Homo sapiens
tgcacacatgtttacaagcatc

SEQ ID NO: 8467557 - DNA, 22 bp, Homo sapiens
cccagacccagagggaggcagg

SEQ ID NO: 8467558 - DNA, 23 bp, Homo sapiens
cccagaccttgtgctgcccttgg

SEQ ID NO: 8467559 - DNA, 22 bp, Homo sapiens
cccagactcatccctgggagct

SEQ ID NO: 8467560 - DNA, 22 bp, Homo sapiens
tgcacacattaaggatacacag

SEQ ID NO: 8467561 - DNA, 22 bp, Homo sapiens
tgcacacattctatggggctga

SEQ ID NO: 8467562 - DNA, 22 bp, Homo sapiens
tgcacacctctccaccactctc

SEQ ID NO: 8467563 - DNA, 22 bp, Homo sapiens
cccactgtgttgcagtctagtg

SEQ ID NO: 8467564 - DNA, 22 bp, Homo sapiens
tgcaaatagcctgatgaaagaa

SEQ ID NO: 8467565 - DNA, 22 bp, Homo sapiens
tgcaaataggggacaactcttt

SEQ ID NO: 8467566 - DNA, 22 bp, Homo sapiens
tgcaaatagcctatatttatag

SEQ ID NO: 8467567 - DNA, 22 bp, Homo sapiens
tgcaaatattccatgctgttca

SEQ ID NO: 8467568 - DNA, 22 bp, Homo sapiens
tgcaaagtgctagcccacacca

SEQ ID NO: 8467569 - DNA, 22 bp, Homo sapiens
tgcaaaggggacagagtccact

SEQ ID NO: 8467570 - DNA, 22 bp, Homo sapiens
tgcaaaggggacagagtccact

SEQ ID NO: 8467571 - DNA, 21 bp, Homo sapiens
tgcaaagctgctgaagtggta

SEQ ID NO: 8467572 - DNA, 22 bp, Homo sapiens
tgcaaaggaggatgggaaagaa

SEQ ID NO: 8467573 - DNA, 22 bp, Homo sapiens
tgcaaaggaggatgggaaagaa

SEQ ID NO: 8467574 - DNA, 22 bp, Homo sapiens
tgcaaatacaaaatggtacagc

SEQ ID NO: 8467575 - DNA, 22 bp, Homo sapiens
tgcaaatacaaaatggtacagc

SEQ ID NO: 8467576 - DNA, 22 bp, Homo sapiens
tgcaaatagcctatatttatag

SEQ ID NO: 8467577 - DNA, 22 bp, Homo sapiens
tgcaaataaatttctgttcatt

SEQ ID NO: 8467578 - DNA, 22 bp, Homo sapiens
tgcaaagttgcatcaaaaccca

SEQ ID NO: 8467579 - DNA, 22 bp, Homo sapiens
tgcaaataaatttctgttcatt

SEQ ID NO: 8467580 - DNA, 22 bp, Homo sapiens
ccagtgtttccgtcagtacacg

SEQ ID NO: 8467581 - DNA, 22 bp, Homo sapiens
ccagtgtttccccagaagagag

SEQ ID NO: 8467582 - DNA, 22 bp, Homo sapiens
ccatgccagctgctaggtcaca

SEQ ID NO: 8467583 - DNA, 22 bp, Homo sapiens
ccatgccatactggccacccgg

SEQ ID NO: 8467584 - DNA, 22 bp, Homo sapiens
ccatgccagctgctaggtcaca

SEQ ID NO: 8467585 - DNA, 22 bp, Homo sapiens
ccatgccatactggccacccgg

SEQ ID NO: 8467586 - DNA, 19 bp, Homo sapiens
ccatgccatcattttaaag

SEQ ID NO: 8467587 - DNA, 22 bp, Homo sapiens
ccatgcccttgtcatctccagg

SEQ ID NO: 8467588 - DNA, 22 bp, Homo sapiens
ccatgcccttgtcatctccagg

SEQ ID NO: 8467589 - DNA, 22 bp, Homo sapiens
ccatgcctggactccactctca

SEQ ID NO: 8467590 - DNA, 22 bp, Homo sapiens
ccatgctgaccctgtgcaggca

SEQ ID NO: 8467591 - DNA, 22 bp, Homo sapiens
tgaggtaggtgtcgagagaggt

SEQ ID NO: 8467592 - DNA, 22 bp, Homo sapiens
ccatggcctgaaggagtgcatc

SEQ ID NO: 8467593 - DNA, 22 bp, Homo sapiens
ccatggcctgaaggagtgcatc

SEQ ID NO: 8467594 - DNA, 22 bp, Homo sapiens
ccatggctaagtatctgtagaa

SEQ ID NO: 8467595 - DNA, 22 bp, Homo sapiens
ccatggcctgaaggagtgcatc

SEQ ID NO: 8467596 - DNA, 22 bp, Homo sapiens
tgaggtcaagcccagagcagca

SEQ ID NO: 8467597 - DNA, 22 bp, Homo sapiens
tgaggcagcccactttccttag

SEQ ID NO: 8467598 - DNA, 19 bp, Homo sapiens
ccagtcctctttgggcctg

SEQ ID NO: 8467599 - DNA, 22 bp, Homo sapiens
ccagtcctgtgtgaccctgcac

SEQ ID NO: 8467600 - DNA, 22 bp, Homo sapiens
tgagggcagagcactggggagc

SEQ ID NO: 8467601 - DNA, 20 bp, Homo sapiens
tgagggctaaccagactctg

SEQ ID NO: 8467602 - DNA, 22 bp, Homo sapiens
tgagggctaaattgtggcaggt

SEQ ID NO: 8467603 - DNA, 22 bp, Homo sapiens
tgagggctgcttccagagctag

SEQ ID NO: 8467604 - DNA, 22 bp, Homo sapiens
tgagggctccccgctgctgtgt

SEQ ID NO: 8467605 - DNA, 22 bp, Homo sapiens
ccagtgttctggtgttcatttc

SEQ ID NO: 8467606 - DNA, 22 bp, Homo sapiens
tgaggcagcaattgtattgtat

SEQ ID NO: 8467607 - DNA, 22 bp, Homo sapiens
tgaggcagagtaagatacatga

SEQ ID NO: 8467608 - DNA, 22 bp, Homo sapiens
tgaggcagaaaatagcagttca

SEQ ID NO: 8467609 - DNA, 22 bp, Homo sapiens
tgaggcagaaaatagcagttca

SEQ ID NO: 8467610 - DNA, 23 bp, Homo sapiens
tgaggacctctcaggggccaggc

SEQ ID NO: 8467611 - DNA, 22 bp, Homo sapiens
tgaggcagaaaatagcagttca

SEQ ID NO: 8467612 - DNA, 22 bp, Homo sapiens
tgaggacatttatcttggcgca

SEQ ID NO: 8467613 - DNA, 22 bp, Homo sapiens
ccaggtgtgctctgcagtggat

SEQ ID NO: 8467614 - DNA, 22 bp, Homo sapiens
ccaggtgtgatttggcagtgtc

SEQ ID NO: 8467615 - DNA, 22 bp, Homo sapiens
tgagacgaagtcttgctctgtt

SEQ ID NO: 8467616 - DNA, 22 bp, Homo sapiens
tgagacgaagtcttgctctgtt

SEQ ID NO: 8467617 - DNA, 22 bp, Homo sapiens
tgagacctctgggttctgagct

SEQ ID NO: 8467618 - DNA, 22 bp, Homo sapiens
tgagacctgcccaacgcagacc

SEQ ID NO: 8467619 - DNA, 22 bp, Homo sapiens
tgagacagttctgcagctgggt

SEQ ID NO: 8467620 - DNA, 22 bp, Homo sapiens
ccaggtggacggcgagtacagg

SEQ ID NO: 8467621 - DNA, 22 bp, Homo sapiens
ccaggtggacggcgagtacagg

SEQ ID NO: 8467622 - DNA, 22 bp, Homo sapiens
tgagacagtttttctatttcca

SEQ ID NO: 8467623 - DNA, 22 bp, Homo sapiens
tgagacagttggtgaaatctaa

SEQ ID NO: 8467624 - DNA, 22 bp, Homo sapiens
ccaggggctctcagggtgtgtg

SEQ ID NO: 8467625 - DNA, 22 bp, Homo sapiens
tgagaatcagctgcacagaggt

SEQ ID NO: 8467626 - DNA, 22 bp, Homo sapiens
tgagaatcatccagaggcttct

SEQ ID NO: 8467627 - DNA, 22 bp, Homo sapiens
tgagaaggaaacaatggctttt

SEQ ID NO: 8467628 - DNA, 19 bp, Homo sapiens
tgagaaggcagtggggagc

SEQ ID NO: 8467629 - DNA, 22 bp, Homo sapiens
ccaggtgctcttgccagggctg

SEQ ID NO: 8467630 - DNA, 22 bp, Homo sapiens
ccaggggctggtgctgagctgg

SEQ ID NO: 8467631 - DNA, 21 bp, Homo sapiens
ccagggtccagctgccatggt

SEQ ID NO: 8467632 - DNA, 17 bp, Homo sapiens
ccaggtctccttgcttt

SEQ ID NO: 8467633 - DNA, 17 bp, Homo sapiens
ccaggtctccttgcttt

SEQ ID NO: 8467634 - DNA, 17 bp, Homo sapiens
ccaggtctccttgcttt

SEQ ID NO: 8467635 - DNA, 22 bp, Homo sapiens
ccaggtctcgggtctgctcgtg

SEQ ID NO: 8467636 - DNA, 22 bp, Homo sapiens
tgaatgatacagaattatgtag

SEQ ID NO: 8467637 - DNA, 22 bp, Homo sapiens
tgaatgatatattgggaataat

SEQ ID NO: 8467638 - DNA, 22 bp, Homo sapiens
tgaatgatatgtgaaaaggaac

SEQ ID NO: 8467639 - DNA, 22 bp, Homo sapiens
tgaatgatctccgattagtcct

SEQ ID NO: 8467640 - DNA, 22 bp, Homo sapiens
tgaatgatctagttttgtagac

SEQ ID NO: 8467641 - DNA, 21 bp, Homo sapiens
tgaagttcgcgggcaagatta

SEQ ID NO: 8467642 - DNA, 21 bp, Homo sapiens
tgaatgatgccccagagttgt

SEQ ID NO: 8467643 - DNA, 23 bp, Homo sapiens
tgaatgatggtgctcctcatctt

SEQ ID NO: 8467644 - DNA, 22 bp, Homo sapiens
tgaatgatgcagtataatgata

SEQ ID NO: 8467645 - DNA, 22 bp, Homo sapiens
tgaatgatgcatttgtttccca

SEQ ID NO: 8467646 - DNA, 21 bp, Homo sapiens
tgaatgatctggttgcctttt

SEQ ID NO: 8467647 - DNA, 22 bp, Homo sapiens
tgaatgatgaggggagaataat

SEQ ID NO: 8467648 - DNA, 22 bp, Homo sapiens
tgaatgatgcagtataatgata

SEQ ID NO: 8467649 - DNA, 22 bp, Homo sapiens
tgaatgatgtataatattgaga

SEQ ID NO: 8467650 - DNA, 22 bp, Homo sapiens
tgaatgatggtgtgttcttgcc

SEQ ID NO: 8467651 - DNA, 22 bp, Homo sapiens
tgaatgattaaaacccggacta

SEQ ID NO: 8467652 - DNA, 23 bp, Homo sapiens
tgaatgattgtactgagctttta

SEQ ID NO: 8467653 - DNA, 22 bp, Homo sapiens
tgaatgatttcttaggcaattg

SEQ ID NO: 8467654 - DNA, 22 bp, Homo sapiens
tgaatgatttgggtgcattcag

SEQ ID NO: 8467655 - DNA, 22 bp, Homo sapiens
tgacaagaatttgggactgtta

SEQ ID NO: 8467656 - DNA, 22 bp, Homo sapiens
tgacaagagcattcccacacct

SEQ ID NO: 8467657 - DNA, 22 bp, Homo sapiens
tgacaagagacccctccgcagg

SEQ ID NO: 8467658 - DNA, 22 bp, Homo sapiens
tgacaagaaagcgtcttctttt

SEQ ID NO: 8467659 - DNA, 22 bp, Homo sapiens
tgacaagaagacctggtaatga

SEQ ID NO: 8467660 - DNA, 22 bp, Homo sapiens
tgaatgctcacatgcctaggtc

SEQ ID NO: 8467661 - DNA, 23 bp, Homo sapiens
tgacaacagctctcagccatgtc

SEQ ID NO: 8467662 - DNA, 23 bp, Homo sapiens
tgacaacagctctcagccatgtc

SEQ ID NO: 8467663 - DNA, 22 bp, Homo sapiens
ccaggctggagtgcagtggcac

SEQ ID NO: 8467664 - DNA, 22 bp, Homo sapiens
ccaggctggagtgcagtggcac

SEQ ID NO: 8467665 - DNA, 22 bp, Homo sapiens
ccaggctggagtgcagtggcac

SEQ ID NO: 8467666 - DNA, 22 bp, Homo sapiens
ccaggctggagtgcagtggcac

SEQ ID NO: 8467667 - DNA, 22 bp, Homo sapiens
ccaggctggagtgcaatggtgc

SEQ ID NO: 8467668 - DNA, 22 bp, Homo sapiens
ccaggctggagtgcagtagtgt

SEQ ID NO: 8467669 - DNA, 22 bp, Homo sapiens
ccaggctggagtgcagtagtgt

SEQ ID NO: 8467670 - DNA, 22 bp, Homo sapiens
ccaggctggagtgcaatggtgc

SEQ ID NO: 8467671 - DNA, 22 bp, Homo sapiens
ccaggctggattttgcagttca

SEQ ID NO: 8467672 - DNA, 22 bp, Homo sapiens
ccaggctggattttgcagttca

SEQ ID NO: 8467673 - DNA, 22 bp, Homo sapiens
ccaggctggattttgcagttca

SEQ ID NO: 8467674 - DNA, 22 bp, Homo sapiens
ccaggctggattttgcagttca

SEQ ID NO: 8467675 - DNA, 22 bp, Homo sapiens
ccaggctggagtgtagtcgcat

SEQ ID NO: 8467676 - DNA, 22 bp, Homo sapiens
ccaggctggagtgtagtcgcat

SEQ ID NO: 8467677 - DNA, 22 bp, Homo sapiens
ccaggctggagtgtagtcgcat

SEQ ID NO: 8467678 - DNA, 20 bp, Homo sapiens
ccaggctggcaaatgggggc

SEQ ID NO: 8467679 - DNA, 20 bp, Homo sapiens
ccaggctggcaaatgggggc

SEQ ID NO: 8467680 - DNA, 20 bp, Homo sapiens
ccaggctggcaaatgggggc

SEQ ID NO: 8467681 - DNA, 21 bp, Homo sapiens
ccaggctggccatggtattga

SEQ ID NO: 8467682 - DNA, 21 bp, Homo sapiens
ccaggctggccatggtattga

SEQ ID NO: 8467683 - DNA, 22 bp, Homo sapiens
tgaagttcaagggctacatttg

SEQ ID NO: 8467684 - DNA, 23 bp, Homo sapiens
tgaagttcattctcactgatgta

SEQ ID NO: 8467685 - DNA, 22 bp, Homo sapiens
tgaagttcactgagagttcacc

SEQ ID NO: 8467686 - DNA, 22 bp, Homo sapiens
tgacatacttttagatagatgg

SEQ ID NO: 8467687 - DNA, 22 bp, Homo sapiens
ccaggggcctgtgaaggtgccc

SEQ ID NO: 8467688 - DNA, 21 bp, Homo sapiens
ccaggggcaaattgtcgtttc

SEQ ID NO: 8467689 - DNA, 22 bp, Homo sapiens
tgacaatagcgatttatcttgc

SEQ ID NO: 8467690 - DNA, 22 bp, Homo sapiens
ccagggctgctgtgggactcca

SEQ ID NO: 8467691 - DNA, 22 bp, Homo sapiens
tgacaagtacataatttcatgt

SEQ ID NO: 8467692 - DNA, 19 bp, Homo sapiens
tgacaagataatagccttg

SEQ ID NO: 8467693 - DNA, 22 bp, Homo sapiens
tgacaagatagattgagtttta

SEQ ID NO: 8467694 - DNA, 22 bp, Homo sapiens
tgacaagatcacagtcaagtgt

SEQ ID NO: 8467695 - DNA, 22 bp, Homo sapiens
tgacaagaggcagaatcagctg

SEQ ID NO: 8467696 - DNA, 22 bp, Homo sapiens
tctttcttggtataaagcaggg

SEQ ID NO: 8467697 - DNA, 22 bp, Homo sapiens
tctttcttggtattctgagcta

SEQ ID NO: 8467698 - DNA, 19 bp, Homo sapiens
ccaggcctgcgggcgttgg

SEQ ID NO: 8467699 - DNA, 19 bp, Homo sapiens
ccaggcctgcgggcgttgg

SEQ ID NO: 8467700 - DNA, 22 bp, Homo sapiens
ccaggcctggaccatgccaggg

SEQ ID NO: 8467701 - DNA, 22 bp, Homo sapiens
ccaggcctgcattccctctcag

SEQ ID NO: 8467702 - DNA, 22 bp, Homo sapiens
ccaggcctgcatctgctgcgca

SEQ ID NO: 8467703 - DNA, 22 bp, Homo sapiens
tctttgaaagctgttctagagt

SEQ ID NO: 8467704 - DNA, 22 bp, Homo sapiens
tctttgaaaagggagatagaaa

SEQ ID NO: 8467705 - DNA, 22 bp, Homo sapiens
ccaggcccaccttggccactta

SEQ ID NO: 8467706 - DNA, 22 bp, Homo sapiens
ccaggcccagggtactgaccaa

SEQ ID NO: 8467707 - DNA, 22 bp, Homo sapiens
tctttcttattagccattgttc

SEQ ID NO: 8467708 - DNA, 22 bp, Homo sapiens
ccaggccccagggctggctttc

SEQ ID NO: 8467709 - DNA, 22 bp, Homo sapiens
ccaggccattcccagagttgct

SEQ ID NO: 8467710 - DNA, 18 bp, Homo sapiens
ccaggccatgaacctctg

SEQ ID NO: 8467711 - DNA, 19 bp, Homo sapiens
ccaggccatcccagttccc

SEQ ID NO: 8467712 - DNA, 22 bp, Homo sapiens
ccaggccagtgtttggtccagg

SEQ ID NO: 8467713 - DNA, 22 bp, Homo sapiens
ccaggccagtgtttggtccagg

SEQ ID NO: 8467714 - DNA, 22 bp, Homo sapiens
ccaggccagtgtttggtccagg

SEQ ID NO: 8467715 - DNA, 22 bp, Homo sapiens
ccaggccagggctgcagcgagc

SEQ ID NO: 8467716 - DNA, 22 bp, Homo sapiens
ccaggcctggacgggtggcctg

SEQ ID NO: 8467717 - DNA, 22 bp, Homo sapiens
ccaggcctggaccatgccaggg

SEQ ID NO: 8467718 - DNA, 22 bp, Homo sapiens
ccaggcctggccaggggatgcc

SEQ ID NO: 8467719 - DNA, 21 bp, Homo sapiens
ccaggctcctgaggctggtca

SEQ ID NO: 8467720 - DNA, 22 bp, Homo sapiens
ccaggctctgtctggtcagaag

SEQ ID NO: 8467721 - DNA, 23 bp, Homo sapiens
ccaggctctttcacctgctattc

SEQ ID NO: 8467722 - DNA, 22 bp, Homo sapiens
ccaggctgaatatgttccaggg

SEQ ID NO: 8467723 - DNA, 22 bp, Homo sapiens
ccaggctgaatatgttccaggg

SEQ ID NO: 8467724 - DNA, 22 bp, Homo sapiens
ccaggctgaatatgttccaggg

SEQ ID NO: 8467725 - DNA, 22 bp, Homo sapiens
ccaggctgaatatgttccaggg

SEQ ID NO: 8467726 - DNA, 22 bp, Homo sapiens
ccaggctctgtgtgggctagag

SEQ ID NO: 8467727 - DNA, 22 bp, Homo sapiens
ccaggctctgttccccgaggag

SEQ ID NO: 8467728 - DNA, 22 bp, Homo sapiens
ccaggctggagtgcaatggcgt

SEQ ID NO: 8467729 - DNA, 22 bp, Homo sapiens
ccaggctggagtgcaatggcgt

SEQ ID NO: 8467730 - DNA, 22 bp, Homo sapiens
ccaggctggagtgcaatggcat

SEQ ID NO: 8467731 - DNA, 22 bp, Homo sapiens
ccaggctggagtgcaatggcat

SEQ ID NO: 8467732 - DNA, 22 bp, Homo sapiens
ccaggctgctgttggtgtccgc

SEQ ID NO: 8467733 - DNA, 22 bp, Homo sapiens
tctttggtcatcatgggaagca

SEQ ID NO: 8467734 - DNA, 22 bp, Homo sapiens
tctttgggagaaggggtcccag

SEQ ID NO: 8467735 - DNA, 22 bp, Homo sapiens
tctttggggcatctgggagatt

SEQ ID NO: 8467736 - DNA, 22 bp, Homo sapiens
tctttggtcagaaagattacac

SEQ ID NO: 8467737 - DNA, 22 bp, Homo sapiens
tctttggccttaggagcccttg

SEQ ID NO: 8467738 - DNA, 22 bp, Homo sapiens
tctttggctttgccacacccaa

SEQ ID NO: 8467739 - DNA, 22 bp, Homo sapiens
tctttggcttgtctcctcagtt

SEQ ID NO: 8467740 - DNA, 22 bp, Homo sapiens
tcttagaatgtcaactgatgtt

SEQ ID NO: 8467741 - DNA, 22 bp, Homo sapiens
tcttagaatgtcaactgatgtt

SEQ ID NO: 8467742 - DNA, 22 bp, Homo sapiens
ccaggcaagctctgctgtgccc

SEQ ID NO: 8467743 - DNA, 22 bp, Homo sapiens
ccaggcaaagcccatgcaagag

SEQ ID NO: 8467744 - DNA, 22 bp, Homo sapiens
ccaggatctgtacacctctgag

SEQ ID NO: 8467745 - DNA, 22 bp, Homo sapiens
ccaggatctgggtccatgggac

SEQ ID NO: 8467746 - DNA, 22 bp, Homo sapiens
ccaggatctgatattgggctcc

SEQ ID NO: 8467747 - DNA, 22 bp, Homo sapiens
ccaggagttggaggctgcagtg

SEQ ID NO: 8467748 - DNA, 22 bp, Homo sapiens
ccaggagtttgaggctgcagtg

SEQ ID NO: 8467749 - DNA, 22 bp, Homo sapiens
ccaggagggaccgcggcatccc

SEQ ID NO: 8467750 - DNA, 17 bp, Homo sapiens
ccaggagagatgcttgt

SEQ ID NO: 8467751 - DNA, 17 bp, Homo sapiens
ccaggagagatgcttgt

SEQ ID NO: 8467752 - DNA, 22 bp, Homo sapiens
ccaggagacccagggaaggagc

SEQ ID NO: 8467753 - DNA, 22 bp, Homo sapiens
ccaggagacccagggaaggagc

SEQ ID NO: 8467754 - DNA, 22 bp, Homo sapiens
ccaggagacccagggaaggagc

SEQ ID NO: 8467755 - DNA, 22 bp, Homo sapiens
ccaggagacaaagatgactgct

SEQ ID NO: 8467756 - DNA, 22 bp, Homo sapiens
ccaggagacaaagatgactgct

SEQ ID NO: 8467757 - DNA, 22 bp, Homo sapiens
ccaggagtcaataaaggaagct

SEQ ID NO: 8467758 - DNA, 22 bp, Homo sapiens
ccaggagttggaagctgccatg

SEQ ID NO: 8467759 - DNA, 22 bp, Homo sapiens
ccaggaggttgaggctgcagtg

SEQ ID NO: 8467760 - DNA, 22 bp, Homo sapiens
ccaggaggttgaggctgcagtg

SEQ ID NO: 8467761 - DNA, 22 bp, Homo sapiens
ccaggaggttgaggctgcagtg

SEQ ID NO: 8467762 - DNA, 22 bp, Homo sapiens
ccaggaggttgaggctgcagtg

SEQ ID NO: 8467763 - DNA, 22 bp, Homo sapiens
tcttcagagcatttctgaggta

SEQ ID NO: 8467764 - DNA, 22 bp, Homo sapiens
tcttcagagcatttctgaggta

SEQ ID NO: 8467765 - DNA, 22 bp, Homo sapiens
tcttcagaggagctgaatatat

SEQ ID NO: 8467766 - DNA, 22 bp, Homo sapiens
tcttcagagatgtaacatatgg

SEQ ID NO: 8467767 - DNA, 22 bp, Homo sapiens
tcttcagagatgtaacatatgg

SEQ ID NO: 8467768 - DNA, 22 bp, Homo sapiens
tcttcagactccaaatgtttta

SEQ ID NO: 8467769 - DNA, 22 bp, Homo sapiens
tcttcagactgttgttcttttg

SEQ ID NO: 8467770 - DNA, 22 bp, Homo sapiens
tcttcagaagatcacatcagtg

SEQ ID NO: 8467771 - DNA, 22 bp, Homo sapiens
tcttcagaaaattatcacttgt

SEQ ID NO: 8467772 - DNA, 22 bp, Homo sapiens
tcttcccagctgctgcgatgcc

SEQ ID NO: 8467773 - DNA, 22 bp, Homo sapiens
tcttcccagctgctgcgatgcc

SEQ ID NO: 8467774 - DNA, 22 bp, Homo sapiens
tcttcccagaggaggtgccagc

SEQ ID NO: 8467775 - DNA, 22 bp, Homo sapiens
tcttcccagaggaggtgccagc

SEQ ID NO: 8467776 - DNA, 22 bp, Homo sapiens
tcttcccagaccttacatgtga

SEQ ID NO: 8467777 - DNA, 22 bp, Homo sapiens
tcttcccactgcccatgggcag

SEQ ID NO: 8467778 - DNA, 22 bp, Homo sapiens
tcttcccactgcccatgggcag

SEQ ID NO: 8467779 - DNA, 22 bp, Homo sapiens
tcttccagtctgtaggactagg

SEQ ID NO: 8467780 - DNA, 20 bp, Homo sapiens
tcttccaggtacagtctgca

SEQ ID NO: 8467781 - DNA, 22 bp, Homo sapiens
tcttcagataaagggagagtat

SEQ ID NO: 8467782 - DNA, 22 bp, Homo sapiens
tcttcagataaagggagagtat

SEQ ID NO: 8467783 - DNA, 22 bp, Homo sapiens
ccaggcaggctagaatgtaaat

SEQ ID NO: 8467784 - DNA, 22 bp, Homo sapiens
ccaggcagggagctgtttggcc

SEQ ID NO: 8467785 - DNA, 22 bp, Homo sapiens
ccaggcagggagctgtttggcc

SEQ ID NO: 8467786 - DNA, 22 bp, Homo sapiens
ccaggccagagtgcagtggcac

SEQ ID NO: 8467787 - DNA, 22 bp, Homo sapiens
ccaggccagagtgcagtggcac

SEQ ID NO: 8467788 - DNA, 22 bp, Homo sapiens
ccaggccagagtgcagtggcac

SEQ ID NO: 8467789 - DNA, 22 bp, Homo sapiens
ccaggccagagtgcagtggcac

SEQ ID NO: 8467790 - DNA, 22 bp, Homo sapiens
ccaggccagagtgcagtggcac

SEQ ID NO: 8467791 - DNA, 22 bp, Homo sapiens
ccaggccagcaggcacacctgc

SEQ ID NO: 8467792 - DNA, 22 bp, Homo sapiens
ccaggccagcaggcacacctgc

SEQ ID NO: 8467793 - DNA, 22 bp, Homo sapiens
ccaggccagcaggcacacctgc

SEQ ID NO: 8467794 - DNA, 22 bp, Homo sapiens
ccaggccagcaggcacacctgc

SEQ ID NO: 8467795 - DNA, 22 bp, Homo sapiens
ccaggccagcctggagcatggc

SEQ ID NO: 8467796 - DNA, 22 bp, Homo sapiens
ccaggccagcctggagcatggc

SEQ ID NO: 8467797 - DNA, 22 bp, Homo sapiens
ccaggccagcgctggctggagg

SEQ ID NO: 8467798 - DNA, 22 bp, Homo sapiens
ccaggccagcgctggctggagg

SEQ ID NO: 8467799 - DNA, 22 bp, Homo sapiens
ccaggccagcgctggctggagg

SEQ ID NO: 8467800 - DNA, 22 bp, Homo sapiens
tctgggagccatgccttggagt

SEQ ID NO: 8467801 - DNA, 22 bp, Homo sapiens
tctgggagcctgaaagtgaatg

SEQ ID NO: 8467802 - DNA, 22 bp, Homo sapiens
tctgggagcctgaaagtgaatg

SEQ ID NO: 8467803 - DNA, 22 bp, Homo sapiens
tctgggagcagctcagcagatt

SEQ ID NO: 8467804 - DNA, 22 bp, Homo sapiens
tctggtactagaggagtgctgg

SEQ ID NO: 8467805 - DNA, 23 bp, Homo sapiens
tctggtactattgctgttgagca

SEQ ID NO: 8467806 - DNA, 20 bp, Homo sapiens
tctggggatgaggtctagga

SEQ ID NO: 8467807 - DNA, 22 bp, Homo sapiens
tctggggatgaggtccagtgat

SEQ ID NO: 8467808 - DNA, 22 bp, Homo sapiens
tctgggagcacacgcagtgatc

SEQ ID NO: 8467809 - DNA, 22 bp, Homo sapiens
tctgggagatccaagcagaact

SEQ ID NO: 8467810 - DNA, 21 bp, Homo sapiens
ccaggactccatggggtctct

SEQ ID NO: 8467811 - DNA, 20 bp, Homo sapiens
tctggtccaggtcttcatgg

SEQ ID NO: 8467812 - DNA, 22 bp, Homo sapiens
tctggtcctctctgtgatgcta

SEQ ID NO: 8467813 - DNA, 22 bp, Homo sapiens
tctggtcccttttcctgcagtc

SEQ ID NO: 8467814 - DNA, 22 bp, Homo sapiens
tctggtccctgctcacttcttg

SEQ ID NO: 8467815 - DNA, 22 bp, Homo sapiens
tctggtggtatacatctaggag

SEQ ID NO: 8467816 - DNA, 22 bp, Homo sapiens
tctggtggtgggccacaagcat

SEQ ID NO: 8467817 - DNA, 21 bp, Homo sapiens
tctggtctgctgtggacctgg

SEQ ID NO: 8467818 - DNA, 22 bp, Homo sapiens
tctggtggcacgtgtcttgcat

SEQ ID NO: 8467819 - DNA, 22 bp, Homo sapiens
ccaggacttcgaggctacagtg

SEQ ID NO: 8467820 - DNA, 22 bp, Homo sapiens
ccaggactttaagtccagcact

SEQ ID NO: 8467821 - DNA, 22 bp, Homo sapiens
ccaggactttaagtccagcact

SEQ ID NO: 8467822 - DNA, 22 bp, Homo sapiens
tctggtgtcagtattctttgaa

SEQ ID NO: 8467823 - DNA, 22 bp, Homo sapiens
ccaggacttattacagtataac

SEQ ID NO: 8467824 - DNA, 22 bp, Homo sapiens
ccaggagaagcatctgagtgta

SEQ ID NO: 8467825 - DNA, 22 bp, Homo sapiens
ccaggaaggatcgtttgggagt

SEQ ID NO: 8467826 - DNA, 21 bp, Homo sapiens
ccaggaaggactgagctccct

SEQ ID NO: 8467827 - DNA, 22 bp, Homo sapiens
ccaggacacgatttttagtctg

SEQ ID NO: 8467828 - DNA, 22 bp, Homo sapiens
ccaggacactgcttcacagcag

SEQ ID NO: 8467829 - DNA, 22 bp, Homo sapiens
tctggctagattgatgagtccc

SEQ ID NO: 8467830 - DNA, 17 bp, Homo sapiens
tctggccttcctgaact

SEQ ID NO: 8467831 - DNA, 22 bp, Homo sapiens
tctggctcaaaatacgtactct

SEQ ID NO: 8467832 - DNA, 22 bp, Homo sapiens
tctggctcacttcaggcttcac

SEQ ID NO: 8467833 - DNA, 18 bp, Homo sapiens
tctggctcaggactgaac

SEQ ID NO: 8467834 - DNA, 22 bp, Homo sapiens
tctggctcacttcaggcttcac

SEQ ID NO: 8467835 - DNA, 22 bp, Homo sapiens
tctggctcaggagctgtgttca

SEQ ID NO: 8467836 - DNA, 22 bp, Homo sapiens
tctggctcagggctctgaggga

SEQ ID NO: 8467837 - DNA, 22 bp, Homo sapiens
ccaggacctggagctctatgaa

SEQ ID NO: 8467838 - DNA, 22 bp, Homo sapiens
ccaggaccctgcaaaccctgtt

SEQ ID NO: 8467839 - DNA, 22 bp, Homo sapiens
ccaggactcaatgaccacaggg

SEQ ID NO: 8467840 - DNA, 22 bp, Homo sapiens
ccaggaccacacgacaggagag

SEQ ID NO: 8467841 - DNA, 22 bp, Homo sapiens
ccaggacagtgaacatgtaaga

SEQ ID NO: 8467842 - DNA, 22 bp, Homo sapiens
ccaggacaggagttggcttcgc

SEQ ID NO: 8467843 - DNA, 22 bp, Homo sapiens
ccaggacaggagttggcttcgc

SEQ ID NO: 8467844 - DNA, 22 bp, Homo sapiens
tctggccttatctgtccaagcc

SEQ ID NO: 8467845 - DNA, 22 bp, Homo sapiens
tctggcctcttgggatgctccc

SEQ ID NO: 8467846 - DNA, 22 bp, Homo sapiens
tctggcaggggttctgcacttg

SEQ ID NO: 8467847 - DNA, 22 bp, Homo sapiens
tctggcaggggttctgcacttg

SEQ ID NO: 8467848 - DNA, 22 bp, Homo sapiens
tctggcaggccttgtcaatctg

SEQ ID NO: 8467849 - DNA, 22 bp, Homo sapiens
tctggccctgctgctgtgagca

SEQ ID NO: 8467850 - DNA, 22 bp, Homo sapiens
tctggcagctatcctctggcca

SEQ ID NO: 8467851 - DNA, 22 bp, Homo sapiens
tctggcagctatcctctggcca

SEQ ID NO: 8467852 - DNA, 22 bp, Homo sapiens
tctggcagcgaagcgtgtactt

SEQ ID NO: 8467853 - DNA, 21 bp, Homo sapiens
tctggcagcagtttgttgagt

SEQ ID NO: 8467854 - DNA, 22 bp, Homo sapiens
tctggcagcagcatcagtggct

SEQ ID NO: 8467855 - DNA, 22 bp, Homo sapiens
tctggcagctcagttcaggtct

SEQ ID NO: 8467856 - DNA, 22 bp, Homo sapiens
tctggcagctctcctcggcgga

SEQ ID NO: 8467857 - DNA, 22 bp, Homo sapiens
tctggcaggacatgctgaccat

SEQ ID NO: 8467858 - DNA, 21 bp, Homo sapiens
tctggcaggaagacggatggg

SEQ ID NO: 8467859 - DNA, 22 bp, Homo sapiens
tctggcaggaccatgaagcgta

SEQ ID NO: 8467860 - DNA, 22 bp, Homo sapiens
tctggcaggatatcgaagtgaa

SEQ ID NO: 8467861 - DNA, 22 bp, Homo sapiens
tctggcaggcaatcggctctgg

SEQ ID NO: 8467862 - DNA, 21 bp, Homo sapiens
tctggcaggcacgggcccagc

SEQ ID NO: 8467863 - DNA, 22 bp, Homo sapiens
ccagctctcagcgggagactca

SEQ ID NO: 8467864 - DNA, 22 bp, Homo sapiens
ccagctctcagcgggagactca

SEQ ID NO: 8467865 - DNA, 22 bp, Homo sapiens
tctgctcaatactgctcatgaa

SEQ ID NO: 8467866 - DNA, 22 bp, Homo sapiens
tctgctgtttactgtgtgatat

SEQ ID NO: 8467867 - DNA, 22 bp, Homo sapiens
tctgctttcaaattcacttagt

SEQ ID NO: 8467868 - DNA, 22 bp, Homo sapiens
tctgctttcttactaaaaatga

SEQ ID NO: 8467869 - DNA, 23 bp, Homo sapiens
tctcagacccgaagccagaggaa

SEQ ID NO: 8467870 - DNA, 22 bp, Homo sapiens
tctcagagaaatgtgtcaccat

SEQ ID NO: 8467871 - DNA, 22 bp, Homo sapiens
tctcagagaaatgtgtcaccat

SEQ ID NO: 8467872 - DNA, 22 bp, Homo sapiens
tctcagagaacagttggtgctt

SEQ ID NO: 8467873 - DNA, 22 bp, Homo sapiens
tctcagagaacagttggtgctt

SEQ ID NO: 8467874 - DNA, 22 bp, Homo sapiens
tctcagagaacagttggtgctt

SEQ ID NO: 8467875 - DNA, 19 bp, Homo sapiens
tctcagaattggcaatcat

SEQ ID NO: 8467876 - DNA, 19 bp, Homo sapiens
tctcagaattaagagtgct

SEQ ID NO: 8467877 - DNA, 22 bp, Homo sapiens
tctcagacatgtaatctctacc

SEQ ID NO: 8467878 - DNA, 22 bp, Homo sapiens
ccagagagaaaatggagggcca

SEQ ID NO: 8467879 - DNA, 22 bp, Homo sapiens
ccagagacgtcggtcagggcgc

SEQ ID NO: 8467880 - DNA, 22 bp, Homo sapiens
ccagagagaaatggatttgagt

SEQ ID NO: 8467881 - DNA, 22 bp, Homo sapiens
tctcagaagtgatcaggatgtt

SEQ ID NO: 8467882 - DNA, 22 bp, Homo sapiens
tctcagaagtgatcaggatgtt

SEQ ID NO: 8467883 - DNA, 22 bp, Homo sapiens
tctcagaagggtggtgctggag

SEQ ID NO: 8467884 - DNA, 22 bp, Homo sapiens
ccagctctgattttgacctcca

SEQ ID NO: 8467885 - DNA, 22 bp, Homo sapiens
ccagctctctgtcctccccaca

SEQ ID NO: 8467886 - DNA, 22 bp, Homo sapiens
ccagctgaggttgaagaaagag

SEQ ID NO: 8467887 - DNA, 22 bp, Homo sapiens
tctggaggccatagggaaggat

SEQ ID NO: 8467888 - DNA, 22 bp, Homo sapiens
tctggcagcaagtctgtttctc

SEQ ID NO: 8467889 - DNA, 22 bp, Homo sapiens
ccagctgctgtgcagggaggct

SEQ ID NO: 8467890 - DNA, 22 bp, Homo sapiens
tggcctggggaagaccatgggc

SEQ ID NO: 8467891 - DNA, 22 bp, Homo sapiens
tggcctgggcctgccggtgcaa

SEQ ID NO: 8467892 - DNA, 22 bp, Homo sapiens
tggcctgggcatgaagcatcgt

SEQ ID NO: 8467893 - DNA, 22 bp, Homo sapiens
tggcctgggccggcagatatac

SEQ ID NO: 8467894 - DNA, 22 bp, Homo sapiens
tggctctggtgcgggctcctgc

SEQ ID NO: 8467895 - DNA, 22 bp, Homo sapiens
tggctctggtgcgggctcctgc

SEQ ID NO: 8467896 - DNA, 22 bp, Homo sapiens
tggctctgtcaaactgcacaca

SEQ ID NO: 8467897 - DNA, 22 bp, Homo sapiens
tggctctgtcaaactgcacaca

SEQ ID NO: 8467898 - DNA, 22 bp, Homo sapiens
tggctctgagacacaggctctc

SEQ ID NO: 8467899 - DNA, 22 bp, Homo sapiens
tggctctggtaacattgggtag

SEQ ID NO: 8467900 - DNA, 21 bp, Homo sapiens
tggctctgggtaggagagtgc

SEQ ID NO: 8467901 - DNA, 22 bp, Homo sapiens
cctcatgctgcatctctgaggt

SEQ ID NO: 8467902 - DNA, 22 bp, Homo sapiens
cctccaagctggtcctctgtgt

SEQ ID NO: 8467903 - DNA, 22 bp, Homo sapiens
cctccaagcttcatctcaacca

SEQ ID NO: 8467904 - DNA, 22 bp, Homo sapiens
cctccaagcttcatctcaacca

SEQ ID NO: 8467905 - DNA, 22 bp, Homo sapiens
tggcctggctgccctgtctgga

SEQ ID NO: 8467906 - DNA, 22 bp, Homo sapiens
cctcatggccttgagctgaggg

SEQ ID NO: 8467907 - DNA, 22 bp, Homo sapiens
cctcagtgttaggataagagaa

SEQ ID NO: 8467908 - DNA, 22 bp, Homo sapiens
cctcagtgtgtggatgttagag

SEQ ID NO: 8467909 - DNA, 22 bp, Homo sapiens
cctcagttttctcatctgtaaa

SEQ ID NO: 8467910 - DNA, 20 bp, Homo sapiens
cctcagtgtcctggactggg

SEQ ID NO: 8467911 - DNA, 22 bp, Homo sapiens
cctcagtgcgtactgaacagtg

SEQ ID NO: 8467912 - DNA, 22 bp, Homo sapiens
cctcaggcttgtgagccttcag

SEQ ID NO: 8467913 - DNA, 22 bp, Homo sapiens
cctcaggcttgtgagccttcag

SEQ ID NO: 8467914 - DNA, 22 bp, Homo sapiens
cctcaggcttctagttcagtga

SEQ ID NO: 8467915 - DNA, 22 bp, Homo sapiens
cctcagggaatgggaggctggg

SEQ ID NO: 8467916 - DNA, 22 bp, Homo sapiens
cctcaggcttacgggcaatgga

SEQ ID NO: 8467917 - DNA, 22 bp, Homo sapiens
cctcaggcttaacttgtcttga

SEQ ID NO: 8467918 - DNA, 22 bp, Homo sapiens
cctcaggcttaacttgtcttga

SEQ ID NO: 8467919 - DNA, 22 bp, Homo sapiens
cctcaggctgtcttccttctgg

SEQ ID NO: 8467920 - DNA, 22 bp, Homo sapiens
cctcaggctgtcttccttctgg

SEQ ID NO: 8467921 - DNA, 22 bp, Homo sapiens
cctcaggcttcgtcttccaccc

SEQ ID NO: 8467922 - DNA, 22 bp, Homo sapiens
cctcaggcttctagttcagtga

SEQ ID NO: 8467923 - DNA, 22 bp, Homo sapiens
cctcaggcttacgggcaatgga

SEQ ID NO: 8467924 - DNA, 22 bp, Homo sapiens
cctcaggcttcgtcttccaccc

SEQ ID NO: 8467925 - DNA, 22 bp, Homo sapiens
cctcaggcttacgggcaatgga

SEQ ID NO: 8467926 - DNA, 22 bp, Homo sapiens
cctcaggcctgccagagcccca

SEQ ID NO: 8467927 - DNA, 22 bp, Homo sapiens
cctcaggcctgccagagcccca

SEQ ID NO: 8467928 - DNA, 22 bp, Homo sapiens
cctcaggcctctgcctcattgg

SEQ ID NO: 8467929 - DNA, 22 bp, Homo sapiens
cctcaggcctctgcctcattgg

SEQ ID NO: 8467930 - DNA, 22 bp, Homo sapiens
cctcaggctagctactgtccct

SEQ ID NO: 8467931 - DNA, 22 bp, Homo sapiens
cctcaggctagctactgtccct

SEQ ID NO: 8467932 - DNA, 22 bp, Homo sapiens
cctcaggctagctactgtccct

SEQ ID NO: 8467933 - DNA, 22 bp, Homo sapiens
cctcaggctctgggtgcctacc

SEQ ID NO: 8467934 - DNA, 22 bp, Homo sapiens
cctcaggctctgggtgcctacc

SEQ ID NO: 8467935 - DNA, 22 bp, Homo sapiens
cctcaggctgctcacacttgtc

SEQ ID NO: 8467936 - DNA, 22 bp, Homo sapiens
cctcaggctgtcttccttctgg

SEQ ID NO: 8467937 - DNA, 22 bp, Homo sapiens
cctcaggctgggctgcccctgg

SEQ ID NO: 8467938 - DNA, 22 bp, Homo sapiens
cctcaggctgggctgcccctgg

SEQ ID NO: 8467939 - DNA, 22 bp, Homo sapiens
cctcaggctgggctgcccctgg

SEQ ID NO: 8467940 - DNA, 22 bp, Homo sapiens
cctcaggctgctcacacttgtc

SEQ ID NO: 8467941 - DNA, 20 bp, Homo sapiens
tggcccagcacgacgaggac

SEQ ID NO: 8467942 - DNA, 20 bp, Homo sapiens
tggcccagcacgacgaggac

SEQ ID NO: 8467943 - DNA, 22 bp, Homo sapiens
tggcccagcactccaagtaggg

SEQ ID NO: 8467944 - DNA, 22 bp, Homo sapiens
tggcccagcagttctgccccag

SEQ ID NO: 8467945 - DNA, 22 bp, Homo sapiens
tggcccagatctctgaccttga

SEQ ID NO: 8467946 - DNA, 22 bp, Homo sapiens
tggcccagatctctgaccttga

SEQ ID NO: 8467947 - DNA, 22 bp, Homo sapiens
tggcccagagcactgctgggca

SEQ ID NO: 8467948 - DNA, 22 bp, Homo sapiens
tggcccagagcactgctgggca

SEQ ID NO: 8467949 - DNA, 22 bp, Homo sapiens
tggcccagatctctgaccttga

SEQ ID NO: 8467950 - DNA, 19 bp, Homo sapiens
tggcccagatggtcctggg

SEQ ID NO: 8467951 - DNA, 22 bp, Homo sapiens
cctcagcagacacgcttctcac

SEQ ID NO: 8467952 - DNA, 22 bp, Homo sapiens
cctcagcagacacgcttctcac

SEQ ID NO: 8467953 - DNA, 22 bp, Homo sapiens
cctcagagtttaagatgtcaga

SEQ ID NO: 8467954 - DNA, 22 bp, Homo sapiens
cctcagagtttaagatgtcaga

SEQ ID NO: 8467955 - DNA, 22 bp, Homo sapiens
tggcccagagcactgctgggca

SEQ ID NO: 8467956 - DNA, 22 bp, Homo sapiens
cctcagcatcctcctgctcagt

SEQ ID NO: 8467957 - DNA, 22 bp, Homo sapiens
cctcagcatcctcctgctcagt

SEQ ID NO: 8467958 - DNA, 22 bp, Homo sapiens
cctcagcatcctcctgctcagt

SEQ ID NO: 8467959 - DNA, 22 bp, Homo sapiens
cctcagcatcctcatgctcagt

SEQ ID NO: 8467960 - DNA, 22 bp, Homo sapiens
cctcagcatcctcatgctcagt

SEQ ID NO: 8467961 - DNA, 22 bp, Homo sapiens
cctcagcatcctcatgctcagt

SEQ ID NO: 8467962 - DNA, 22 bp, Homo sapiens
cctcagagttggccacgagagc

SEQ ID NO: 8467963 - DNA, 22 bp, Homo sapiens
cctcagagttggccacgagagc

SEQ ID NO: 8467964 - DNA, 22 bp, Homo sapiens
cctcagagttggaatcacattt

SEQ ID NO: 8467965 - DNA, 22 bp, Homo sapiens
cctcagagttatttgaagtgaa

SEQ ID NO: 8467966 - DNA, 22 bp, Homo sapiens
cctcagagttatttgaagtgaa

SEQ ID NO: 8467967 - DNA, 22 bp, Homo sapiens
cctcagagttatttgaagtgaa

SEQ ID NO: 8467968 - DNA, 22 bp, Homo sapiens
cctcagagttggaatcacattt

SEQ ID NO: 8467969 - DNA, 22 bp, Homo sapiens
cctcagagtctagtaaataata

SEQ ID NO: 8467970 - DNA, 22 bp, Homo sapiens
cctcagagtaggtctcagctgt

SEQ ID NO: 8467971 - DNA, 22 bp, Homo sapiens
cctcagagtaggtctcagctgt

SEQ ID NO: 8467972 - DNA, 22 bp, Homo sapiens
cctcagaggttttcattctgta

SEQ ID NO: 8467973 - DNA, 22 bp, Homo sapiens
cctagatgggatggcggccggg

SEQ ID NO: 8467974 - DNA, 22 bp, Homo sapiens
cctagatgggatggcggccggg

SEQ ID NO: 8467975 - DNA, 22 bp, Homo sapiens
cctagagtgattgagagcatca

SEQ ID NO: 8467976 - DNA, 21 bp, Homo sapiens
cctagcctcttacccagcttt

SEQ ID NO: 8467977 - DNA, 22 bp, Homo sapiens
cctagactagaggcagggagcc

SEQ ID NO: 8467978 - DNA, 19 bp, Homo sapiens
cctagagcagtacctggta

SEQ ID NO: 8467979 - DNA, 22 bp, Homo sapiens
cctagagccgcacctcctccac

SEQ ID NO: 8467980 - DNA, 22 bp, Homo sapiens
cctagagctctgctttatctaa

SEQ ID NO: 8467981 - DNA, 22 bp, Homo sapiens
tggcagaggtaattcaaatccc

SEQ ID NO: 8467982 - DNA, 22 bp, Homo sapiens
tggcagaggtaattcaaatccc

SEQ ID NO: 8467983 - DNA, 22 bp, Homo sapiens
tggcagaggagaattaagatta

SEQ ID NO: 8467984 - DNA, 18 bp, Homo sapiens
tggcaggtagactcaggt

SEQ ID NO: 8467985 - DNA, 22 bp, Homo sapiens
tggcaggtacccattggctgta

SEQ ID NO: 8467986 - DNA, 22 bp, Homo sapiens
tggcaggtagagttctgagatg

SEQ ID NO: 8467987 - DNA, 22 bp, Homo sapiens
cctcagaggttctgtgtgggaa

SEQ ID NO: 8467988 - DNA, 22 bp, Homo sapiens
cctcagaggttctgtgtgggaa

SEQ ID NO: 8467989 - DNA, 22 bp, Homo sapiens
cctcagaggtgtggcatctctg

SEQ ID NO: 8467990 - DNA, 22 bp, Homo sapiens
cctcagaggtgtggcatctctg

SEQ ID NO: 8467991 - DNA, 22 bp, Homo sapiens
cctcagaggtgaacatcagtgc

SEQ ID NO: 8467992 - DNA, 22 bp, Homo sapiens
cctcagaggcagatggtaagaa

SEQ ID NO: 8467993 - DNA, 23 bp, Homo sapiens
cctcagaggcctcatagtctggc

SEQ ID NO: 8467994 - DNA, 22 bp, Homo sapiens
cctcagaggcatggttagaata

SEQ ID NO: 8467995 - DNA, 22 bp, Homo sapiens
cctcagaatagtcctcagatca

SEQ ID NO: 8467996 - DNA, 22 bp, Homo sapiens
tggcagggttggccaccttacc

SEQ ID NO: 8467997 - DNA, 22 bp, Homo sapiens
tggcagggtggcaacttttggt

SEQ ID NO: 8467998 - DNA, 19 bp, Homo sapiens
cctaggcattgtccaaggg

SEQ ID NO: 8467999 - DNA, 21 bp, Homo sapiens
cctaggaggcttaattaggct

SEQ ID NO: 8468000 - DNA, 22 bp, Homo sapiens
ccctgcaggggacctgcagcct

SEQ ID NO: 8468001 - DNA, 21 bp, Homo sapiens
ccctgcaggccagggctgagc

SEQ ID NO: 8468002 - DNA, 22 bp, Homo sapiens
ccctgcaggctcagactggagt

SEQ ID NO: 8468003 - DNA, 22 bp, Homo sapiens
ccctgcaggctcagactggagt

SEQ ID NO: 8468004 - DNA, 22 bp, Homo sapiens
ccctgcagccttgcatgccttc

SEQ ID NO: 8468005 - DNA, 19 bp, Homo sapiens
tggagcagggcccttgttt

SEQ ID NO: 8468006 - DNA, 22 bp, Homo sapiens
tggagcagggcatcactgtgcg

SEQ ID NO: 8468007 - DNA, 22 bp, Homo sapiens
cccttcctggagtaccctctgt

SEQ ID NO: 8468008 - DNA, 22 bp, Homo sapiens
cccttcctcaaggagctgtgtt

SEQ ID NO: 8468009 - DNA, 22 bp, Homo sapiens
cccttcctcaaggagctgtgtt

SEQ ID NO: 8468010 - DNA, 19 bp, Homo sapiens
tggcagaggacaaggactt

SEQ ID NO: 8468011 - DNA, 22 bp, Homo sapiens
tggcagaggagaattaagatta

SEQ ID NO: 8468012 - DNA, 22 bp, Homo sapiens
tgggctctagactttagtgtgg

SEQ ID NO: 8468013 - DNA, 22 bp, Homo sapiens
tgggcccttatgaagctcaaga

SEQ ID NO: 8468014 - DNA, 22 bp, Homo sapiens
tgggctgcggataggcctcgga

SEQ ID NO: 8468015 - DNA, 18 bp, Homo sapiens
tgggctgcctggcctctg

SEQ ID NO: 8468016 - DNA, 22 bp, Homo sapiens
tgggctgctgcggtgctcttgg

SEQ ID NO: 8468017 - DNA, 22 bp, Homo sapiens
tgggccctgacttcaagcatcc

SEQ ID NO: 8468018 - DNA, 22 bp, Homo sapiens
cctgagctagggaaggaagacc

SEQ ID NO: 8468019 - DNA, 22 bp, Homo sapiens
cctgagctcaaagggtgcctgg

SEQ ID NO: 8468020 - DNA, 22 bp, Homo sapiens
cctgagctcaagaaggtgacca

SEQ ID NO: 8468021 - DNA, 22 bp, Homo sapiens
cctgagctcaagaaggtgacca

SEQ ID NO: 8468022 - DNA, 22 bp, Homo sapiens
cctgagctcaagaaggtgacca

SEQ ID NO: 8468023 - DNA, 22 bp, Homo sapiens
cctgagctgaactaagcagttt

SEQ ID NO: 8468024 - DNA, 22 bp, Homo sapiens
cctgagctccagtagcagccag

SEQ ID NO: 8468025 - DNA, 22 bp, Homo sapiens
cctgagctgcggggcagtgctc

SEQ ID NO: 8468026 - DNA, 22 bp, Homo sapiens
tggggaggaagtcagatttcag

SEQ ID NO: 8468027 - DNA, 22 bp, Homo sapiens
tggggagcccactcacctcccc

SEQ ID NO: 8468028 - DNA, 22 bp, Homo sapiens
cctgagcctggctcatgcactc

SEQ ID NO: 8468029 - DNA, 21 bp, Homo sapiens
cctgagcctgtttatccagaa

SEQ ID NO: 8468030 - DNA, 22 bp, Homo sapiens
cctgagcctggctcatgcactc

SEQ ID NO: 8468031 - DNA, 17 bp, Homo sapiens
cctcttcctctcagctg

SEQ ID NO: 8468032 - DNA, 19 bp, Homo sapiens
cctcttcctctgacactat

SEQ ID NO: 8468033 - DNA, 19 bp, Homo sapiens
cctcttcctctgacactat

SEQ ID NO: 8468034 - DNA, 22 bp, Homo sapiens
cctcttccttctcactgtggaa

SEQ ID NO: 8468035 - DNA, 22 bp, Homo sapiens
cctcttcctgcactgacatttt

SEQ ID NO: 8468036 - DNA, 22 bp, Homo sapiens
cctcttctcaactccagccaga

SEQ ID NO: 8468037 - DNA, 22 bp, Homo sapiens
cctgagcagggctctgcagggc

SEQ ID NO: 8468038 - DNA, 22 bp, Homo sapiens
cctgagcatcagcgcctcctta

SEQ ID NO: 8468039 - DNA, 22 bp, Homo sapiens
cctgagcatcagcgcctcctta

SEQ ID NO: 8468040 - DNA, 22 bp, Homo sapiens
cctgagcattagacatccatca

SEQ ID NO: 8468041 - DNA, 22 bp, Homo sapiens
cctgagcctcttgcacgctcag

SEQ ID NO: 8468042 - DNA, 18 bp, Homo sapiens
cctgagccctgcttactt

SEQ ID NO: 8468043 - DNA, 22 bp, Homo sapiens
cctgagcattagacatccatca

SEQ ID NO: 8468044 - DNA, 22 bp, Homo sapiens
tgggcccaagagagtctccaac

SEQ ID NO: 8468045 - DNA, 22 bp, Homo sapiens
tgggccatttttggaagactgg

SEQ ID NO: 8468046 - DNA, 22 bp, Homo sapiens
cctgagcctgcagccgagcaga

SEQ ID NO: 8468047 - DNA, 22 bp, Homo sapiens
cctgagcctgcagccgagcaga

SEQ ID NO: 8468048 - DNA, 22 bp, Homo sapiens
cctgagcctcttgcacgctcag

SEQ ID NO: 8468049 - DNA, 22 bp, Homo sapiens
cctgagcctgagtggtgcaggg

SEQ ID NO: 8468050 - DNA, 22 bp, Homo sapiens
cctgagcctgagtggtgcaggg

SEQ ID NO: 8468051 - DNA, 22 bp, Homo sapiens
cctgagcaaaggcccagaggga

SEQ ID NO: 8468052 - DNA, 22 bp, Homo sapiens
cctgagcaaaggaaggatgact

SEQ ID NO: 8468053 - DNA, 22 bp, Homo sapiens
cctgagatttcattgtctggcc

SEQ ID NO: 8468054 - DNA, 22 bp, Homo sapiens
cctgagagagaagcgacctggt

SEQ ID NO: 8468055 - DNA, 22 bp, Homo sapiens
cctgagatgtgtaacagatggt

SEQ ID NO: 8468056 - DNA, 22 bp, Homo sapiens
cctgagattggctagtatgagt

SEQ ID NO: 8468057 - DNA, 22 bp, Homo sapiens
tggctgagaccatcagggtgta

SEQ ID NO: 8468058 - DNA, 22 bp, Homo sapiens
tggctgagaccatcagggtgta

SEQ ID NO: 8468059 - DNA, 17 bp, Homo sapiens
tggctctgtcctcagct

SEQ ID NO: 8468060 - DNA, 22 bp, Homo sapiens
tggctgagaagttctggtggga

SEQ ID NO: 8468061 - DNA, 22 bp, Homo sapiens
tggctctgtcactgtgagctat

SEQ ID NO: 8468062 - DNA, 22 bp, Homo sapiens
tggctctgtcactgtgagctat

SEQ ID NO: 8468063 - DNA, 16 bp, Homo sapiens
tggctgagagagggtt

SEQ ID NO: 8468064 - DNA, 22 bp, Homo sapiens
tggctgagagaagacggggaag

SEQ ID NO: 8468065 - DNA, 22 bp, Homo sapiens
tggctgagaccttcccaaattc

SEQ ID NO: 8468066 - DNA, 16 bp, Homo sapiens
tggctgagagagggtt

SEQ ID NO: 8468067 - DNA, 22 bp, Homo sapiens
tggctgagagaagacggggaag

SEQ ID NO: 8468068 - DNA, 22 bp, Homo sapiens
tggctgagaatgggatgatgcc

SEQ ID NO: 8468069 - DNA, 22 bp, Homo sapiens
tggctgagaccatcagggtgta

SEQ ID NO: 8468070 - DNA, 22 bp, Homo sapiens
tggctggctgtccagctgggca

SEQ ID NO: 8468071 - DNA, 22 bp, Homo sapiens
tggctggctgtccagctgggca

SEQ ID NO: 8468072 - DNA, 22 bp, Homo sapiens
tggctggctgtcagtaggctgt

SEQ ID NO: 8468073 - DNA, 22 bp, Homo sapiens
tggctggctgtcaaggaaagcc

SEQ ID NO: 8468074 - DNA, 22 bp, Homo sapiens
tggcttcattctcctgtgaata

SEQ ID NO: 8468075 - DNA, 22 bp, Homo sapiens
tggcttcattctcctgtgaata

SEQ ID NO: 8468076 - DNA, 22 bp, Homo sapiens
tggcttccaaattatccctaga

SEQ ID NO: 8468077 - DNA, 20 bp, Homo sapiens
tggcttcataatggtttctg

SEQ ID NO: 8468078 - DNA, 22 bp, Homo sapiens
tggcttcagggttgtcttcagc

SEQ ID NO: 8468079 - DNA, 17 bp, Homo sapiens
tggcttcaggctgagca

SEQ ID NO: 8468080 - DNA, 22 bp, Homo sapiens
tgggaaggacgtgtcagtggca

SEQ ID NO: 8468081 - DNA, 22 bp, Homo sapiens
tgggaaggacgtgtcagtggca

SEQ ID NO: 8468082 - DNA, 22 bp, Homo sapiens
tgggaaggatacgttacaagat

SEQ ID NO: 8468083 - DNA, 22 bp, Homo sapiens
cctcttccagctgttgcttcca

SEQ ID NO: 8468084 - DNA, 22 bp, Homo sapiens
cctcttccagctgttgcttcca

SEQ ID NO: 8468085 - DNA, 19 bp, Homo sapiens
cctctgtgggagtcagtga

SEQ ID NO: 8468086 - DNA, 22 bp, Homo sapiens
cctctgctgctgttgagcaccg

SEQ ID NO: 8468087 - DNA, 22 bp, Homo sapiens
tgggaagctgcattttaacaag

SEQ ID NO: 8468088 - DNA, 20 bp, Homo sapiens
cctctgcctttctagtctga

SEQ ID NO: 8468089 - DNA, 22 bp, Homo sapiens
cctctgctgctgttgagcaccg

SEQ ID NO: 8468090 - DNA, 22 bp, Homo sapiens
cctctgctctggtccatgtgct

SEQ ID NO: 8468091 - DNA, 22 bp, Homo sapiens
cctctgctctggtccatgtgct

SEQ ID NO: 8468092 - DNA, 22 bp, Homo sapiens
cctctgctccctggtgtctgag

SEQ ID NO: 8468093 - DNA, 22 bp, Homo sapiens
cctctgcccttttcctgtatca

SEQ ID NO: 8468094 - DNA, 22 bp, Homo sapiens
cctctgagtcctccctggttgc

SEQ ID NO: 8468095 - DNA, 22 bp, Homo sapiens
cctctgagtacagtgatggatt

SEQ ID NO: 8468096 - DNA, 19 bp, Homo sapiens
tggcttccatctctctcat

SEQ ID NO: 8468097 - DNA, 19 bp, Homo sapiens
tggcttccatctctctcat

SEQ ID NO: 8468098 - DNA, 22 bp, Homo sapiens
tggcttccagtaatcaggattt

SEQ ID NO: 8468099 - DNA, 22 bp, Homo sapiens
tggcttccagaactgagcaaca

SEQ ID NO: 8468100 - DNA, 22 bp, Homo sapiens
tggcttccactgtgtgccccct

SEQ ID NO: 8468101 - DNA, 22 bp, Homo sapiens
tggcttccactgtgtgccccct

SEQ ID NO: 8468102 - DNA, 22 bp, Homo sapiens
tggcttccagagctgctccacc

SEQ ID NO: 8468103 - DNA, 22 bp, Homo sapiens
tggcttccagtaatcaggattt

SEQ ID NO: 8468104 - DNA, 22 bp, Homo sapiens
tggcttccagagctgctccacc

SEQ ID NO: 8468105 - DNA, 22 bp, Homo sapiens
ccctctccctgcagaatgtggc

SEQ ID NO: 8468106 - DNA, 22 bp, Homo sapiens
ccctctcagtcagagccagata

SEQ ID NO: 8468107 - DNA, 22 bp, Homo sapiens
ccctctcagtcagagccagata

SEQ ID NO: 8468108 - DNA, 18 bp, Homo sapiens
ccctctcctgctagtggg

SEQ ID NO: 8468109 - DNA, 22 bp, Homo sapiens
ccctctcctggctgcatggagc

SEQ ID NO: 8468110 - DNA, 18 bp, Homo sapiens
ccctctcctgctagtggg

SEQ ID NO: 8468111 - DNA, 22 bp, Homo sapiens
ccctctcctggctgcatggagc

SEQ ID NO: 8468112 - DNA, 22 bp, Homo sapiens
ccctctctcaggctgacagcct

SEQ ID NO: 8468113 - DNA, 22 bp, Homo sapiens
ccctgaccaccagctccatttg

SEQ ID NO: 8468114 - DNA, 22 bp, Homo sapiens
ccctgaccctatcagagggcca

SEQ ID NO: 8468115 - DNA, 22 bp, Homo sapiens
ccctgaccctatcagagggcca

SEQ ID NO: 8468116 - DNA, 22 bp, Homo sapiens
ccctgagaagatcattgccacg

SEQ ID NO: 8468117 - DNA, 20 bp, Homo sapiens
ccctgagaccagagagcagc

SEQ ID NO: 8468118 - DNA, 20 bp, Homo sapiens
ccctgagacaaaggaggggc

SEQ ID NO: 8468119 - DNA, 20 bp, Homo sapiens
ccctgagacgactgagctcc

SEQ ID NO: 8468120 - DNA, 20 bp, Homo sapiens
ccctgagacgactgagctcc

SEQ ID NO: 8468121 - DNA, 22 bp, Homo sapiens
ccctgaggaaagggtggagggc

SEQ ID NO: 8468122 - DNA, 22 bp, Homo sapiens
ccctgaggaaagggtggagggc

SEQ ID NO: 8468123 - DNA, 23 bp, Homo sapiens
ccctgagctggtccaggctcaac

SEQ ID NO: 8468124 - DNA, 22 bp, Homo sapiens
ccctgaggaccaggaaggaggg

SEQ ID NO: 8468125 - DNA, 22 bp, Homo sapiens
tggagcaggactgctgccctca

SEQ ID NO: 8468126 - DNA, 22 bp, Homo sapiens
ccctgagaggttgagtgtctgc

SEQ ID NO: 8468127 - DNA, 22 bp, Homo sapiens
ccctgagagtgagtgccacctt

SEQ ID NO: 8468128 - DNA, 22 bp, Homo sapiens
ccctgagatgcctcaccctagt

SEQ ID NO: 8468129 - DNA, 22 bp, Homo sapiens
ccctgagatgcctcaccctagt

SEQ ID NO: 8468130 - DNA, 22 bp, Homo sapiens
tgctgttatacttagctggtta

SEQ ID NO: 8468131 - DNA, 22 bp, Homo sapiens
tgctgttagtaaggaacatgac

SEQ ID NO: 8468132 - DNA, 22 bp, Homo sapiens
tggaatggaaacaaactgagga

SEQ ID NO: 8468133 - DNA, 22 bp, Homo sapiens
tggaatggaaacaaactgagga

SEQ ID NO: 8468134 - DNA, 22 bp, Homo sapiens
ccctcctggaggcggatgccca

SEQ ID NO: 8468135 - DNA, 22 bp, Homo sapiens
ccctcgtgcatccatcatttag

SEQ ID NO: 8468136 - DNA, 22 bp, Homo sapiens
ccctcctgtgcctgaggccagc

SEQ ID NO: 8468137 - DNA, 22 bp, Homo sapiens
ccctcctttctaggcttccagc

SEQ ID NO: 8468138 - DNA, 22 bp, Homo sapiens
cccagttgttgccggctctgga

SEQ ID NO: 8468139 - DNA, 22 bp, Homo sapiens
cccattcatcctcgcttccttc

SEQ ID NO: 8468140 - DNA, 22 bp, Homo sapiens
cccagttgttgccggctctgga

SEQ ID NO: 8468141 - DNA, 22 bp, Homo sapiens
cccaggtctccctgcagccctg

SEQ ID NO: 8468142 - DNA, 22 bp, Homo sapiens
cccaggtctccctgcagccctg

SEQ ID NO: 8468143 - DNA, 22 bp, Homo sapiens
cccaggtctatgccagctctga

SEQ ID NO: 8468144 - DNA, 21 bp, Homo sapiens
cccaggtcgtggtcttcccag

SEQ ID NO: 8468145 - DNA, 21 bp, Homo sapiens
cccaggtcgtggtcttcccag

SEQ ID NO: 8468146 - DNA, 22 bp, Homo sapiens
cccaggtcccggggccagctgc

SEQ ID NO: 8468147 - DNA, 22 bp, Homo sapiens
cccaggtccccacctgtctgct

SEQ ID NO: 8468148 - DNA, 18 bp, Homo sapiens
ccccaaaagtcaccctgg

SEQ ID NO: 8468149 - DNA, 22 bp, Homo sapiens
ccccaaaacttggtgacttcca

SEQ ID NO: 8468150 - DNA, 22 bp, Homo sapiens
ccccaaaacttagtgacttaaa

SEQ ID NO: 8468151 - DNA, 22 bp, Homo sapiens
ccccaaaacttagtgacttaaa

SEQ ID NO: 8468152 - DNA, 22 bp, Homo sapiens
ccccacccacctaagagaaact

SEQ ID NO: 8468153 - DNA, 22 bp, Homo sapiens
ccccaccctcgctccatttcgg

SEQ ID NO: 8468154 - DNA, 22 bp, Homo sapiens
ccccaccctcgctccatttcgg

SEQ ID NO: 8468155 - DNA, 22 bp, Homo sapiens
ccccaccagcaccctctctatc

SEQ ID NO: 8468156 - DNA, 22 bp, Homo sapiens
ccccaccagcaccctctctatc

SEQ ID NO: 8468157 - DNA, 22 bp, Homo sapiens
ccccaccctcgctccatttcgg

SEQ ID NO: 8468158 - DNA, 22 bp, Homo sapiens
ccccaaggtgctcactgtctgg

SEQ ID NO: 8468159 - DNA, 22 bp, Homo sapiens
ccccacagccgccagcagggag

SEQ ID NO: 8468160 - DNA, 22 bp, Homo sapiens
ccccacaggtgtctgaggcagg

SEQ ID NO: 8468161 - DNA, 22 bp, Homo sapiens
ccccacagtccgtgaggagcca

SEQ ID NO: 8468162 - DNA, 22 bp, Homo sapiens
ccccacagtccgtgaggagcca

SEQ ID NO: 8468163 - DNA, 22 bp, Homo sapiens
ccccacagcttgtggagagaat

SEQ ID NO: 8468164 - DNA, 22 bp, Homo sapiens
tgctggctttagtgattggggt

SEQ ID NO: 8468165 - DNA, 22 bp, Homo sapiens
tgctggctttgcgagatgcatt

SEQ ID NO: 8468166 - DNA, 23 bp, Homo sapiens
tgctggcttttatctggtcccta

SEQ ID NO: 8468167 - DNA, 22 bp, Homo sapiens
tgctggctaatggaaaccagat

SEQ ID NO: 8468168 - DNA, 22 bp, Homo sapiens
tgctggctttagtgattggggt

SEQ ID NO: 8468169 - DNA, 22 bp, Homo sapiens
tgctggctttaaggttaaagtg

SEQ ID NO: 8468170 - DNA, 22 bp, Homo sapiens
tgctggctttaaggttaaagtg

SEQ ID NO: 8468171 - DNA, 22 bp, Homo sapiens
tgctggctttaaggttaaagtg

SEQ ID NO: 8468172 - DNA, 22 bp, Homo sapiens
tgctggccctggctcagggaac

SEQ ID NO: 8468173 - DNA, 22 bp, Homo sapiens
tgctggcctggttagaaagggg

SEQ ID NO: 8468174 - DNA, 22 bp, Homo sapiens
tgctggcctgggctgcaccttg

SEQ ID NO: 8468175 - DNA, 22 bp, Homo sapiens
tgctggcctgggctgcaccttg

SEQ ID NO: 8468176 - DNA, 21 bp, Homo sapiens
cccgcatcttcctctccagca

SEQ ID NO: 8468177 - DNA, 22 bp, Homo sapiens
ccccttggctgctctcaagtcc

SEQ ID NO: 8468178 - DNA, 23 bp, Homo sapiens
cccctctggtggctcagctcctg

SEQ ID NO: 8468179 - DNA, 23 bp, Homo sapiens
cccctctggtggctcagctcctg

SEQ ID NO: 8468180 - DNA, 22 bp, Homo sapiens
ccccttccttcctcagacagcc

SEQ ID NO: 8468181 - DNA, 22 bp, Homo sapiens
ccccttccttcctcagacagcc

SEQ ID NO: 8468182 - DNA, 22 bp, Homo sapiens
tgctggctttttgtgtcaaaga

SEQ ID NO: 8468183 - DNA, 22 bp, Homo sapiens
tgctggctttttgtgtcaaaga

SEQ ID NO: 8468184 - DNA, 22 bp, Homo sapiens
tgctggcttttccttcaggcag

SEQ ID NO: 8468185 - DNA, 22 bp, Homo sapiens
tgctggcttttccttcaggcag

SEQ ID NO: 8468186 - DNA, 22 bp, Homo sapiens
cccagggaagggctacctgagg

SEQ ID NO: 8468187 - DNA, 22 bp, Homo sapiens
cccagggaagggctacctgagg

SEQ ID NO: 8468188 - DNA, 23 bp, Homo sapiens
cccagggacacgatgacacctcc

SEQ ID NO: 8468189 - DNA, 22 bp, Homo sapiens
cccaggctggtcctgaactcct

SEQ ID NO: 8468190 - DNA, 22 bp, Homo sapiens
cccaggctggtcctgaactcct

SEQ ID NO: 8468191 - DNA, 21 bp, Homo sapiens
cccagggaagccgcagtcacc

SEQ ID NO: 8468192 - DNA, 22 bp, Homo sapiens
cccaggctggcactgctgaagt

SEQ ID NO: 8468193 - DNA, 22 bp, Homo sapiens
cccaggctggcactgctgaagt

SEQ ID NO: 8468194 - DNA, 22 bp, Homo sapiens
cccaggctggatttcggtggca

SEQ ID NO: 8468195 - DNA, 22 bp, Homo sapiens
cccaggctggagtgtaatggtg

SEQ ID NO: 8468196 - DNA, 22 bp, Homo sapiens
cccaggctggatttcggtggca

SEQ ID NO: 8468197 - DNA, 22 bp, Homo sapiens
cccaggctgggaacgattctag

SEQ ID NO: 8468198 - DNA, 22 bp, Homo sapiens
cccaggctggcctccgcagtgc

SEQ ID NO: 8468199 - DNA, 22 bp, Homo sapiens
cccaggctggggctcctccagc

SEQ ID NO: 8468200 - DNA, 22 bp, Homo sapiens
cccaggctggggctcctccagc

SEQ ID NO: 8468201 - DNA, 22 bp, Homo sapiens
cccaggctggagtgcaatggca

SEQ ID NO: 8468202 - DNA, 22 bp, Homo sapiens
cccaggctggagtgcaatggca

SEQ ID NO: 8468203 - DNA, 22 bp, Homo sapiens
cccaggctggagtgcaatggtg

SEQ ID NO: 8468204 - DNA, 22 bp, Homo sapiens
cccaggctggagtgcagtggcg

SEQ ID NO: 8468205 - DNA, 22 bp, Homo sapiens
cccaggctggagtgcaatggtg

SEQ ID NO: 8468206 - DNA, 22 bp, Homo sapiens
cccaggctggagtgcagtggcg

SEQ ID NO: 8468207 - DNA, 22 bp, Homo sapiens
tgccctggtagacacagactgt

SEQ ID NO: 8468208 - DNA, 22 bp, Homo sapiens
tgccctggtgaagtgctctcct

SEQ ID NO: 8468209 - DNA, 22 bp, Homo sapiens
cccaggctggagggcagtgtca

SEQ ID NO: 8468210 - DNA, 22 bp, Homo sapiens
cccaggctggagggcagtgtca

SEQ ID NO: 8468211 - DNA, 22 bp, Homo sapiens
cccaggctgagttagaggtgtc

SEQ ID NO: 8468212 - DNA, 22 bp, Homo sapiens
tgccctggttacactggagtcc

SEQ ID NO: 8468213 - DNA, 22 bp, Homo sapiens
cccaggctggaattccaggcct

SEQ ID NO: 8468214 - DNA, 22 bp, Homo sapiens
cccagggtagctgagctggcag

SEQ ID NO: 8468215 - DNA, 22 bp, Homo sapiens
cccagggttgcctgcctctgct

SEQ ID NO: 8468216 - DNA, 22 bp, Homo sapiens
cccagggtggatgcaagcagca

SEQ ID NO: 8468217 - DNA, 22 bp, Homo sapiens
tgcctgtgtggggtctgccgcc

SEQ ID NO: 8468218 - DNA, 22 bp, Homo sapiens
tgcctgtgttgattactttgtc

SEQ ID NO: 8468219 - DNA, 22 bp, Homo sapiens
cccagggacagatgggcagcta

SEQ ID NO: 8468220 - DNA, 22 bp, Homo sapiens
tgccttcactgagcttatggga

SEQ ID NO: 8468221 - DNA, 22 bp, Homo sapiens
tgccttcctgctttgagttctg

SEQ ID NO: 8468222 - DNA, 22 bp, Homo sapiens
tgccttcctgctttgagttctg

SEQ ID NO: 8468223 - DNA, 22 bp, Homo sapiens
tgccttcatccatgttatagtg

SEQ ID NO: 8468224 - DNA, 22 bp, Homo sapiens
tgccttcctggagctgaaggct

SEQ ID NO: 8468225 - DNA, 22 bp, Homo sapiens
tgccttagggtacctggtgctt

SEQ ID NO: 8468226 - DNA, 23 bp, Homo sapiens
tgccttagttagcacatttctaa

SEQ ID NO: 8468227 - DNA, 20 bp, Homo sapiens
tgccttagagataaaggctt

SEQ ID NO: 8468228 - DNA, 22 bp, Homo sapiens
tgccttagagcactcaagagtg

SEQ ID NO: 8468229 - DNA, 22 bp, Homo sapiens
tgccttagaggatagtgaagcc

SEQ ID NO: 8468230 - DNA, 22 bp, Homo sapiens
tgccttcaccaggccttcagcc

SEQ ID NO: 8468231 - DNA, 22 bp, Homo sapiens
tgccttcaatcaggatggtctc

SEQ ID NO: 8468232 - DNA, 22 bp, Homo sapiens
tgccttcaagacccatcctcca

SEQ ID NO: 8468233 - DNA, 22 bp, Homo sapiens
tgcctgttgcccacctgataaa

SEQ ID NO: 8468234 - DNA, 22 bp, Homo sapiens
tgcctgttgcccacctgataaa

SEQ ID NO: 8468235 - DNA, 22 bp, Homo sapiens
tgcccagccagtttatggtaat

SEQ ID NO: 8468236 - DNA, 22 bp, Homo sapiens
tgcccagccagtttatggtaat

SEQ ID NO: 8468237 - DNA, 22 bp, Homo sapiens
tgcccagccaatttgttatgtt

SEQ ID NO: 8468238 - DNA, 22 bp, Homo sapiens
tgcccagccaatttgttatgtt

SEQ ID NO: 8468239 - DNA, 22 bp, Homo sapiens
tgccatattattgagcatatta

SEQ ID NO: 8468240 - DNA, 22 bp, Homo sapiens
tgccatactataaggctgtcaa

SEQ ID NO: 8468241 - DNA, 22 bp, Homo sapiens
tgccagtgtggaactaggaaga

SEQ ID NO: 8468242 - DNA, 22 bp, Homo sapiens
tgccagtgtggaactaggaaga

SEQ ID NO: 8468243 - DNA, 22 bp, Homo sapiens
cccaggcagtgtgtgcatgcgt

SEQ ID NO: 8468244 - DNA, 19 bp, Homo sapiens
cccaggctacatggagagg

SEQ ID NO: 8468245 - DNA, 22 bp, Homo sapiens
cccaggcagtgtgtgcatgcgt

SEQ ID NO: 8468246 - DNA, 22 bp, Homo sapiens
tgcccagctgtcaaagtagata

SEQ ID NO: 8468247 - DNA, 22 bp, Homo sapiens
tgcccagcgcccacattctgtc

SEQ ID NO: 8468248 - DNA, 22 bp, Homo sapiens
tgcccagcgcccacattctgtc

SEQ ID NO: 8468249 - DNA, 22 bp, Homo sapiens
tgcccagcctaaacttggcaag

SEQ ID NO: 8468250 - DNA, 22 bp, Homo sapiens
tgcccagctattcctttcttag

SEQ ID NO: 8468251 - DNA, 22 bp, Homo sapiens
tgcccagcccctatccctggga

SEQ ID NO: 8468252 - DNA, 22 bp, Homo sapiens
tgcccagcctaaacttggcaag

SEQ ID NO: 8468253 - DNA, 22 bp, Homo sapiens
tgcccagcctaaacttggcaag

SEQ ID NO: 8468254 - DNA, 22 bp, Homo sapiens
tgccctgggagttggagctgct

SEQ ID NO: 8468255 - DNA, 22 bp, Homo sapiens
cccaggctcctactgtattctg

SEQ ID NO: 8468256 - DNA, 22 bp, Homo sapiens
tgccctggggagcccagccagg

SEQ ID NO: 8468257 - DNA, 22 bp, Homo sapiens
tgccctgggagttggagctgct

SEQ ID NO: 8468258 - DNA, 22 bp, Homo sapiens
tgccctggggtctggagcagca

SEQ ID NO: 8468259 - DNA, 22 bp, Homo sapiens
tgccctggggtctggagcagca

SEQ ID NO: 8468260 - DNA, 22 bp, Homo sapiens
tgccctggggagcccagccagg

SEQ ID NO: 8468261 - DNA, 22 bp, Homo sapiens
tgccctggggagcccagccagg

SEQ ID NO: 8468262 - DNA, 22 bp, Homo sapiens
tgccctggggagcccagccagg

SEQ ID NO: 8468263 - DNA, 22 bp, Homo sapiens
cccaggctagtatgatatcagt

SEQ ID NO: 8468264 - DNA, 22 bp, Homo sapiens
cccaggctagaaaggccaacaa

SEQ ID NO: 8468265 - DNA, 22 bp, Homo sapiens
cccaggctagtatgatatcagt

SEQ ID NO: 8468266 - DNA, 22 bp, Homo sapiens
cccaggctagaaaggccaacaa

SEQ ID NO: 8468267 - DNA, 22 bp, Homo sapiens
cccaggctcagactggcttgtt

SEQ ID NO: 8468268 - DNA, 22 bp, Homo sapiens
cccaggctcagactggcttgtt

SEQ ID NO: 8468269 - DNA, 22 bp, Homo sapiens
cccaggctcccaggtgggacaa

SEQ ID NO: 8468270 - DNA, 22 bp, Homo sapiens
cccaggctcagactggcttgtt

SEQ ID NO: 8468271 - DNA, 22 bp, Homo sapiens
cccaggctcactgtccgcttcc

SEQ ID NO: 8468272 - DNA, 22 bp, Homo sapiens
cccaggctcactgtccgcttcc

SEQ ID NO: 8468273 - DNA, 22 bp, Homo sapiens
tgccagtgaaacatggaagaat

SEQ ID NO: 8468274 - DNA, 22 bp, Homo sapiens
tgccaggctaagtggaggactt

SEQ ID NO: 8468275 - DNA, 22 bp, Homo sapiens
cccaggagagaggggataaagc

SEQ ID NO: 8468276 - DNA, 22 bp, Homo sapiens
cccaggagagaggggataaagc

SEQ ID NO: 8468277 - DNA, 22 bp, Homo sapiens
cccaggagagggaaccaaatgt

SEQ ID NO: 8468278 - DNA, 22 bp, Homo sapiens
cccaggagagaggggataaagc

SEQ ID NO: 8468279 - DNA, 22 bp, Homo sapiens
cccaggagagaggccagttggc

SEQ ID NO: 8468280 - DNA, 22 bp, Homo sapiens
cccaggagacctgtgaaaggac

SEQ ID NO: 8468281 - DNA, 22 bp, Homo sapiens
cccaggagacctgtgaaaggac

SEQ ID NO: 8468282 - DNA, 22 bp, Homo sapiens
tgccaggagtgtagagtggttt

SEQ ID NO: 8468283 - DNA, 22 bp, Homo sapiens
tgccaggaggggacacctcctc

SEQ ID NO: 8468284 - DNA, 22 bp, Homo sapiens
cccaggagacatatagaaggac

SEQ ID NO: 8468285 - DNA, 22 bp, Homo sapiens
cccaggagacatatagaaggac

SEQ ID NO: 8468286 - DNA, 22 bp, Homo sapiens
tgccagcttgtggtcagaggct

SEQ ID NO: 8468287 - DNA, 19 bp, Homo sapiens
tgccaggaatactccagaa

SEQ ID NO: 8468288 - DNA, 22 bp, Homo sapiens
tgccaggaggaggtgggacaga

SEQ ID NO: 8468289 - DNA, 22 bp, Homo sapiens
tgcacagagggaggcataaaat

SEQ ID NO: 8468290 - DNA, 22 bp, Homo sapiens
tgcacagagagatgagacacgt

SEQ ID NO: 8468291 - DNA, 20 bp, Homo sapiens
tgcacagacaatgagcccag

SEQ ID NO: 8468292 - DNA, 22 bp, Homo sapiens
tgccacagaggtgaagcccact

SEQ ID NO: 8468293 - DNA, 22 bp, Homo sapiens
cagttggaggaatgaggctgta

SEQ ID NO: 8468294 - DNA, 17 bp, Homo sapiens
cagttggagacaagtcc

SEQ ID NO: 8468295 - DNA, 23 bp, Homo sapiens
cagttggaggtacagagacactg

SEQ ID NO: 8468296 - DNA, 17 bp, Homo sapiens
cagttggagacaagtcc

SEQ ID NO: 8468297 - DNA, 22 bp, Homo sapiens
cagttgcagctgtgacattgcg

SEQ ID NO: 8468298 - DNA, 21 bp, Homo sapiens
tcagagagtcacagtgaactg

SEQ ID NO: 8468299 - DNA, 22 bp, Homo sapiens
cagttggtgatgaggctagtag

SEQ ID NO: 8468300 - DNA, 22 bp, Homo sapiens
tcagagagttttcactagggtg

SEQ ID NO: 8468301 - DNA, 22 bp, Homo sapiens
tcagagatggagttagcagtga

SEQ ID NO: 8468302 - DNA, 22 bp, Homo sapiens
tcagagcaaattcctgtgagcc

SEQ ID NO: 8468303 - DNA, 22 bp, Homo sapiens
tcagagcaaattcctgtgagcc

SEQ ID NO: 8468304 - DNA, 22 bp, Homo sapiens
tcagagcaacttttcctgcttt

SEQ ID NO: 8468305 - DNA, 22 bp, Homo sapiens
tcaatcaatgtgtcagttccca

SEQ ID NO: 8468306 - DNA, 22 bp, Homo sapiens
tcaatcaatggtttccaaattt

SEQ ID NO: 8468307 - DNA, 22 bp, Homo sapiens
tcaatcaaagcactgggctttg

SEQ ID NO: 8468308 - DNA, 22 bp, Homo sapiens
tcaatcaaagccagatgtcctt

SEQ ID NO: 8468309 - DNA, 22 bp, Homo sapiens
tcaatattcttctttagtagga

SEQ ID NO: 8468310 - DNA, 22 bp, Homo sapiens
tcaatagcatagcaattaatgt

SEQ ID NO: 8468311 - DNA, 22 bp, Homo sapiens
cagttagctgacaagtaggcta

SEQ ID NO: 8468312 - DNA, 22 bp, Homo sapiens
cagttataagactaagctattc

SEQ ID NO: 8468313 - DNA, 22 bp, Homo sapiens
cagttataagactaagctattc

SEQ ID NO: 8468314 - DNA, 22 bp, Homo sapiens
cagttctggtttgcagatatat

SEQ ID NO: 8468315 - DNA, 22 bp, Homo sapiens
cagttgatgtttagactctgca

SEQ ID NO: 8468316 - DNA, 22 bp, Homo sapiens
tcagatatggagtctaaaacca

SEQ ID NO: 8468317 - DNA, 22 bp, Homo sapiens
tcagagtttctgatttagtagg

SEQ ID NO: 8468318 - DNA, 22 bp, Homo sapiens
tcagagttggcctttctgtatt

SEQ ID NO: 8468319 - DNA, 22 bp, Homo sapiens
tcagaggatgctgttctttaat

SEQ ID NO: 8468320 - DNA, 22 bp, Homo sapiens
tcagaggagcaaaagaggggat

SEQ ID NO: 8468321 - DNA, 23 bp, Homo sapiens
tcagagcaagatgatgtatgagc

SEQ ID NO: 8468322 - DNA, 23 bp, Homo sapiens
tcagagcaagatgatgtatgagc

SEQ ID NO: 8468323 - DNA, 18 bp, Homo sapiens
tcagaggagatacctaaa

SEQ ID NO: 8468324 - DNA, 22 bp, Homo sapiens
tcagaggagccaaagttctgag

SEQ ID NO: 8468325 - DNA, 22 bp, Homo sapiens
tcagaggagcaaaagaggggat

SEQ ID NO: 8468326 - DNA, 22 bp, Homo sapiens
tcagaggagcaaaagaggggat

SEQ ID NO: 8468327 - DNA, 22 bp, Homo sapiens
tcagaggagctgcagaacgctg

SEQ ID NO: 8468328 - DNA, 22 bp, Homo sapiens
tcagaggagggactcagaccca

SEQ ID NO: 8468329 - DNA, 22 bp, Homo sapiens
tcagaggatcatgtccctactc

SEQ ID NO: 8468330 - DNA, 22 bp, Homo sapiens
tcagaggatagaaatacttatt

SEQ ID NO: 8468331 - DNA, 22 bp, Homo sapiens
cagtttgtcttgattcagaaca

SEQ ID NO: 8468332 - DNA, 22 bp, Homo sapiens
tcagatctggtgaagttatagt

SEQ ID NO: 8468333 - DNA, 22 bp, Homo sapiens
cagttttggtcctttctaggta

SEQ ID NO: 8468334 - DNA, 22 bp, Homo sapiens
cagttttggtcctttctaggta

SEQ ID NO: 8468335 - DNA, 22 bp, Homo sapiens
cagtttgtgctaggcactattt

SEQ ID NO: 8468336 - DNA, 22 bp, Homo sapiens
cagtttttgccattaagagtaa

SEQ ID NO: 8468337 - DNA, 22 bp, Homo sapiens
cataaaagccacctatttaaag

SEQ ID NO: 8468338 - DNA, 22 bp, Homo sapiens
cagtttttcaaaattacatgat

SEQ ID NO: 8468339 - DNA, 23 bp, Homo sapiens
cataaaatattagtatggtagca

SEQ ID NO: 8468340 - DNA, 22 bp, Homo sapiens
cataaaagccacctatttaaag

SEQ ID NO: 8468341 - DNA, 22 bp, Homo sapiens
cataaaagccacctatttaaag

SEQ ID NO: 8468342 - DNA, 22 bp, Homo sapiens
cataaaaggtagcagtttgaaa

SEQ ID NO: 8468343 - DNA, 22 bp, Homo sapiens
catagaacagctcctagcacat

SEQ ID NO: 8468344 - DNA, 22 bp, Homo sapiens
catagaatcatagcacatttga

SEQ ID NO: 8468345 - DNA, 22 bp, Homo sapiens
catagaatatgtgtgattgtta

SEQ ID NO: 8468346 - DNA, 22 bp, Homo sapiens
catagaaatcaggtgagaatct

SEQ ID NO: 8468347 - DNA, 22 bp, Homo sapiens
tcaggctgtatatcttgcactc

SEQ ID NO: 8468348 - DNA, 21 bp, Homo sapiens
tcaggctgtctgctggttcca

SEQ ID NO: 8468349 - DNA, 21 bp, Homo sapiens
tcaggctgtctgctggttcca

SEQ ID NO: 8468350 - DNA, 21 bp, Homo sapiens
tcaggctgtctgctggttcca

SEQ ID NO: 8468351 - DNA, 17 bp, Homo sapiens
tcaggctgtgcctggta

SEQ ID NO: 8468352 - DNA, 17 bp, Homo sapiens
tcaggctgtgcctggta

SEQ ID NO: 8468353 - DNA, 17 bp, Homo sapiens
tcaggctgtgcctggta

SEQ ID NO: 8468354 - DNA, 22 bp, Homo sapiens
tcaggctgtgtctttaaacaat

SEQ ID NO: 8468355 - DNA, 22 bp, Homo sapiens
tcaggctgttagccacctcctc

SEQ ID NO: 8468356 - DNA, 22 bp, Homo sapiens
tcaggctgttagccacctcctc

SEQ ID NO: 8468357 - DNA, 22 bp, Homo sapiens
tcaggctgtgtctttaaacaat

SEQ ID NO: 8468358 - DNA, 22 bp, Homo sapiens
tcagggagaggtgagagcctgt

SEQ ID NO: 8468359 - DNA, 22 bp, Homo sapiens
tcaggctgtggcttcagttctt

SEQ ID NO: 8468360 - DNA, 22 bp, Homo sapiens
tcaggctgtggctttgaccgca

SEQ ID NO: 8468361 - DNA, 22 bp, Homo sapiens
tcaggctgtggcttcagttctt

SEQ ID NO: 8468362 - DNA, 22 bp, Homo sapiens
tcaggctgtgggcactggccat

SEQ ID NO: 8468363 - DNA, 22 bp, Homo sapiens
tcaggctgtgggcactggccat

SEQ ID NO: 8468364 - DNA, 22 bp, Homo sapiens
tcaggctgtgggcactggccat

SEQ ID NO: 8468365 - DNA, 22 bp, Homo sapiens
tcaggctgtggctttgaccgca

SEQ ID NO: 8468366 - DNA, 22 bp, Homo sapiens
catagaaactgagacaaggatt

SEQ ID NO: 8468367 - DNA, 22 bp, Homo sapiens
catagaaactgagacaaggatt

SEQ ID NO: 8468368 - DNA, 22 bp, Homo sapiens
catagaaatcaggtgagaatct

SEQ ID NO: 8468369 - DNA, 22 bp, Homo sapiens
catagaaagtattatggaattt

SEQ ID NO: 8468370 - DNA, 22 bp, Homo sapiens
catagaaacttgcagcaagcac

SEQ ID NO: 8468371 - DNA, 22 bp, Homo sapiens
catagaaacttgcagcaagcac

SEQ ID NO: 8468372 - DNA, 22 bp, Homo sapiens
tcaggccccatcccagacttat

SEQ ID NO: 8468373 - DNA, 22 bp, Homo sapiens
tcaggccccttgtcagctctgt

SEQ ID NO: 8468374 - DNA, 22 bp, Homo sapiens
tcaggccccttgtcagctctgt

SEQ ID NO: 8468375 - DNA, 22 bp, Homo sapiens
tcaggccccatcccagacttat

SEQ ID NO: 8468376 - DNA, 22 bp, Homo sapiens
tcaggccccatcccagacttat

SEQ ID NO: 8468377 - DNA, 22 bp, Homo sapiens
tcaggccctttgctgctgcccc

SEQ ID NO: 8468378 - DNA, 22 bp, Homo sapiens
tcaggcccttctcccaggactc

SEQ ID NO: 8468379 - DNA, 22 bp, Homo sapiens
tcaggcctagaacacagcagat

SEQ ID NO: 8468380 - DNA, 22 bp, Homo sapiens
tcaggcctagggagccacacca

SEQ ID NO: 8468381 - DNA, 22 bp, Homo sapiens
tcaggcagagtggaagctgcaa

SEQ ID NO: 8468382 - DNA, 22 bp, Homo sapiens
tcaggcccagagtcacggatcc

SEQ ID NO: 8468383 - DNA, 22 bp, Homo sapiens
tcaggcagagtggaagctgcaa

SEQ ID NO: 8468384 - DNA, 22 bp, Homo sapiens
cataattactgatatgctgatt

SEQ ID NO: 8468385 - DNA, 22 bp, Homo sapiens
cataattagagaattcatgtta

SEQ ID NO: 8468386 - DNA, 22 bp, Homo sapiens
cataattagagaattcatgtta

SEQ ID NO: 8468387 - DNA, 22 bp, Homo sapiens
cataattaaattctgggcaaga

SEQ ID NO: 8468388 - DNA, 22 bp, Homo sapiens
cataattactgatatgctgatt

SEQ ID NO: 8468389 - DNA, 22 bp, Homo sapiens
cataattactgatatgctgatt

SEQ ID NO: 8468390 - DNA, 22 bp, Homo sapiens
cataattaaattctgggcaaga

SEQ ID NO: 8468391 - DNA, 22 bp, Homo sapiens
cataattaggcagttgatcatt

SEQ ID NO: 8468392 - DNA, 22 bp, Homo sapiens
cataattaggcagttgatcatt

SEQ ID NO: 8468393 - DNA, 22 bp, Homo sapiens
cataattataaacgcaagttca

SEQ ID NO: 8468394 - DNA, 22 bp, Homo sapiens
cataattagtcatgttatgcat

SEQ ID NO: 8468395 - DNA, 22 bp, Homo sapiens
cataattagtcatgttatgcat

SEQ ID NO: 8468396 - DNA, 22 bp, Homo sapiens
cataattataaacgcaagttca

SEQ ID NO: 8468397 - DNA, 22 bp, Homo sapiens
cataatcctgtcctggattctt

SEQ ID NO: 8468398 - DNA, 22 bp, Homo sapiens
cataatccttgattcaaataat

SEQ ID NO: 8468399 - DNA, 22 bp, Homo sapiens
cataatcctggtgtagccctct

SEQ ID NO: 8468400 - DNA, 22 bp, Homo sapiens
cataatccatttgcactgcaga

SEQ ID NO: 8468401 - DNA, 22 bp, Homo sapiens
cataatcccaggcttgcattca

SEQ ID NO: 8468402 - DNA, 22 bp, Homo sapiens
cataatcccccatttgtgacat

SEQ ID NO: 8468403 - DNA, 22 bp, Homo sapiens
cataatatctccgattacttgc

SEQ ID NO: 8468404 - DNA, 22 bp, Homo sapiens
cataatgtctgacacagtaaga

SEQ ID NO: 8468405 - DNA, 22 bp, Homo sapiens
cataatatctccgattacttgc

SEQ ID NO: 8468406 - DNA, 22 bp, Homo sapiens
cataatatctccgattacttgc

SEQ ID NO: 8468407 - DNA, 22 bp, Homo sapiens
tcagcaggtggtgggcaggtga

SEQ ID NO: 8468408 - DNA, 22 bp, Homo sapiens
tcagcaggtggtgggcaggtga

SEQ ID NO: 8468409 - DNA, 22 bp, Homo sapiens
tcagcaggtggtgggcaggtga

SEQ ID NO: 8468410 - DNA, 22 bp, Homo sapiens
tcagcaggtgctttgtttactc

SEQ ID NO: 8468411 - DNA, 22 bp, Homo sapiens
tcagcaggtgctttgtttactc

SEQ ID NO: 8468412 - DNA, 22 bp, Homo sapiens
tcagcaggtgcctcagattctt

SEQ ID NO: 8468413 - DNA, 22 bp, Homo sapiens
tcagcaggtgaacatcatgcca

SEQ ID NO: 8468414 - DNA, 22 bp, Homo sapiens
tcagcaggtgaacatcatgcca

SEQ ID NO: 8468415 - DNA, 22 bp, Homo sapiens
tcagcagggtttgacttctaat

SEQ ID NO: 8468416 - DNA, 22 bp, Homo sapiens
tcagcagggtttgacttctaat

SEQ ID NO: 8468417 - DNA, 22 bp, Homo sapiens
tcagcaggtctgaggcggggcc

SEQ ID NO: 8468418 - DNA, 22 bp, Homo sapiens
catgaaggctgccagcaggcat

SEQ ID NO: 8468419 - DNA, 23 bp, Homo sapiens
catgaaggtagcacaaagcctct

SEQ ID NO: 8468420 - DNA, 22 bp, Homo sapiens
catgaaggaccatttcacggtc

SEQ ID NO: 8468421 - DNA, 22 bp, Homo sapiens
catgaaggaataattgtttaga

SEQ ID NO: 8468422 - DNA, 22 bp, Homo sapiens
catgaattagcaatggtgtgca

SEQ ID NO: 8468423 - DNA, 22 bp, Homo sapiens
catgaatgagtaatttacaaag

SEQ ID NO: 8468424 - DNA, 23 bp, Homo sapiens
catgacaaaggatctcatgggcc

SEQ ID NO: 8468425 - DNA, 22 bp, Homo sapiens
catgaatttttctgtgggttaa

SEQ ID NO: 8468426 - DNA, 22 bp, Homo sapiens
catgaattttaagactgttttt

SEQ ID NO: 8468427 - DNA, 22 bp, Homo sapiens
catgaatttatattattagtga

SEQ ID NO: 8468428 - DNA, 22 bp, Homo sapiens
catgaattatttttcacaagat

SEQ ID NO: 8468429 - DNA, 22 bp, Homo sapiens
catgacaaatcagaggggcttg

SEQ ID NO: 8468430 - DNA, 22 bp, Homo sapiens
catgacaaataaacctttgcca

SEQ ID NO: 8468431 - DNA, 22 bp, Homo sapiens
catgacaataagccagcagaaa

SEQ ID NO: 8468432 - DNA, 22 bp, Homo sapiens
catgacaatatgttctttcatt

SEQ ID NO: 8468433 - DNA, 22 bp, Homo sapiens
catgcaggcctatggagcagtg

SEQ ID NO: 8468434 - DNA, 22 bp, Homo sapiens
catgcaggcctatggagcagtg

SEQ ID NO: 8468435 - DNA, 22 bp, Homo sapiens
catgcaggcctatggagcagtg

SEQ ID NO: 8468436 - DNA, 22 bp, Homo sapiens
catgaccccccaaggcctgcag

SEQ ID NO: 8468437 - DNA, 22 bp, Homo sapiens
catgacccatttttcttgctgt

SEQ ID NO: 8468438 - DNA, 22 bp, Homo sapiens
catgacatcctgaagctgcaca

SEQ ID NO: 8468439 - DNA, 22 bp, Homo sapiens
catgcagggacttgtgctccat

SEQ ID NO: 8468440 - DNA, 22 bp, Homo sapiens
catgcagggagcagaggagaca

SEQ ID NO: 8468441 - DNA, 22 bp, Homo sapiens
catgcaggtgaccaggtgtggg

SEQ ID NO: 8468442 - DNA, 22 bp, Homo sapiens
catgcaggtgaccaggtgtggg

SEQ ID NO: 8468443 - DNA, 22 bp, Homo sapiens
catggcagggctgtgggcaggt

SEQ ID NO: 8468444 - DNA, 22 bp, Homo sapiens
catggcagggctgtgggcaggt

SEQ ID NO: 8468445 - DNA, 22 bp, Homo sapiens
catggcagtgattcagcctttg

SEQ ID NO: 8468446 - DNA, 22 bp, Homo sapiens
catggcaggaaggacatgcact

SEQ ID NO: 8468447 - DNA, 22 bp, Homo sapiens
catggcaggaggctgctggcag

SEQ ID NO: 8468448 - DNA, 22 bp, Homo sapiens
catggcaggcttcttcagcctt

SEQ ID NO: 8468449 - DNA, 22 bp, Homo sapiens
catggccaaggatgctcaacca

SEQ ID NO: 8468450 - DNA, 22 bp, Homo sapiens
tccaggagaaggccatccagcg

SEQ ID NO: 8468451 - DNA, 22 bp, Homo sapiens
tccaggagaaggccatccagcg

SEQ ID NO: 8468452 - DNA, 23 bp, Homo sapiens
tccaggagaattccagggcccgg

SEQ ID NO: 8468453 - DNA, 22 bp, Homo sapiens
catggcaggaaaatgaacaggc

SEQ ID NO: 8468454 - DNA, 22 bp, Homo sapiens
catggcaggaaggacatgcact

SEQ ID NO: 8468455 - DNA, 23 bp, Homo sapiens
catggcagcaagagctcatggcc

SEQ ID NO: 8468456 - DNA, 22 bp, Homo sapiens
catggcagagcctgcaggtggg

SEQ ID NO: 8468457 - DNA, 22 bp, Homo sapiens
catggcagagcctgcaggtggg

SEQ ID NO: 8468458 - DNA, 22 bp, Homo sapiens
catggcagcaattttcctgact

SEQ ID NO: 8468459 - DNA, 22 bp, Homo sapiens
catggcagcctgccctgcttgc

SEQ ID NO: 8468460 - DNA, 22 bp, Homo sapiens
tcagggattgcaaaattcatcc

SEQ ID NO: 8468461 - DNA, 22 bp, Homo sapiens
tcagggattgcaaaattcatcc

SEQ ID NO: 8468462 - DNA, 22 bp, Homo sapiens
tcagtcatgaccatggggtgga

SEQ ID NO: 8468463 - DNA, 22 bp, Homo sapiens
tcagtcaggagatgccagagat

SEQ ID NO: 8468464 - DNA, 22 bp, Homo sapiens
tcagtcatagtttggagagaat

SEQ ID NO: 8468465 - DNA, 22 bp, Homo sapiens
tcagggagggacctgaggctgg

SEQ ID NO: 8468466 - DNA, 22 bp, Homo sapiens
tcagggagagtgacccatccac

SEQ ID NO: 8468467 - DNA, 22 bp, Homo sapiens
tcagggagatttggggactcaa

SEQ ID NO: 8468468 - DNA, 22 bp, Homo sapiens
tcagggagcctggacttcaagg

SEQ ID NO: 8468469 - DNA, 19 bp, Homo sapiens
tcagggagtttacagcatg

SEQ ID NO: 8468470 - DNA, 22 bp, Homo sapiens
tcagggagtgttggcaggatca

SEQ ID NO: 8468471 - DNA, 22 bp, Homo sapiens
tcagggagtagtttgtgctatg

SEQ ID NO: 8468472 - DNA, 22 bp, Homo sapiens
tcagggaggtgtctgccagaga

SEQ ID NO: 8468473 - DNA, 22 bp, Homo sapiens
tcagtgctaaaagagctggtgt

SEQ ID NO: 8468474 - DNA, 22 bp, Homo sapiens
catctcagtgtacagggagtct

SEQ ID NO: 8468475 - DNA, 22 bp, Homo sapiens
catctcaggtctgtggttcact

SEQ ID NO: 8468476 - DNA, 22 bp, Homo sapiens
tcagtgctgctttatgacagtt

SEQ ID NO: 8468477 - DNA, 22 bp, Homo sapiens
tcagtgctgagtagcgtgcacc

SEQ ID NO: 8468478 - DNA, 20 bp, Homo sapiens
tcagtgctcaggcaccaggt

SEQ ID NO: 8468479 - DNA, 22 bp, Homo sapiens
tcagtgctgagtagcgtgcacc

SEQ ID NO: 8468480 - DNA, 22 bp, Homo sapiens
tcagtccataggtgggcctgag

SEQ ID NO: 8468481 - DNA, 22 bp, Homo sapiens
tcagtccataggtgggcctgag

SEQ ID NO: 8468482 - DNA, 22 bp, Homo sapiens
tcagtccaggggctgtgatgtc

SEQ ID NO: 8468483 - DNA, 22 bp, Homo sapiens
tcagtgcattgttcattgtagg

SEQ ID NO: 8468484 - DNA, 22 bp, Homo sapiens
tcagtgcattctaccaaaaggc

SEQ ID NO: 8468485 - DNA, 22 bp, Homo sapiens
catctgctctgtctgccatgtt

SEQ ID NO: 8468486 - DNA, 22 bp, Homo sapiens
catctgctgacttgacaagtac

SEQ ID NO: 8468487 - DNA, 22 bp, Homo sapiens
catctgctgctgaagccagcat

SEQ ID NO: 8468488 - DNA, 20 bp, Homo sapiens
catctgagcccacagaagtc

SEQ ID NO: 8468489 - DNA, 21 bp, Homo sapiens
catctcagtgggttggtggat

SEQ ID NO: 8468490 - DNA, 22 bp, Homo sapiens
catctgctgttccttggactca

SEQ ID NO: 8468491 - DNA, 22 bp, Homo sapiens
catctgggttctcagatggata

SEQ ID NO: 8468492 - DNA, 22 bp, Homo sapiens
catctgtaggtgacacatgagt

SEQ ID NO: 8468493 - DNA, 22 bp, Homo sapiens
catctgtagctccatgacaatt

SEQ ID NO: 8468494 - DNA, 22 bp, Homo sapiens
catgaagcttgaagcagtccac

SEQ ID NO: 8468495 - DNA, 22 bp, Homo sapiens
catgaacatttgtttacatctg

SEQ ID NO: 8468496 - DNA, 21 bp, Homo sapiens
catgaagaatcaagacccttg

SEQ ID NO: 8468497 - DNA, 22 bp, Homo sapiens
catgaaaataacattgttgtga

SEQ ID NO: 8468498 - DNA, 22 bp, Homo sapiens
catgaaaataacattgttgtga

SEQ ID NO: 8468499 - DNA, 22 bp, Homo sapiens
catctgtctgctgttagctgca

SEQ ID NO: 8468500 - DNA, 22 bp, Homo sapiens
tctaagatctactatacatgtg

SEQ ID NO: 8468501 - DNA, 22 bp, Homo sapiens
tctaagaatactcatatcttct

SEQ ID NO: 8468502 - DNA, 22 bp, Homo sapiens
ccactgtttttcagttaacttt

SEQ ID NO: 8468503 - DNA, 22 bp, Homo sapiens
ccactgttggcccgaaggggtc

SEQ ID NO: 8468504 - DNA, 22 bp, Homo sapiens
ccactgtctgtgacatcagaaa

SEQ ID NO: 8468505 - DNA, 22 bp, Homo sapiens
ccactgtcttttccaggctgaa

SEQ ID NO: 8468506 - DNA, 22 bp, Homo sapiens
ccactgtcagaggggctgtgcc

SEQ ID NO: 8468507 - DNA, 22 bp, Homo sapiens
tctaatccttgctacctgggtg

SEQ ID NO: 8468508 - DNA, 22 bp, Homo sapiens
tctaatccttgctacctgggtg

SEQ ID NO: 8468509 - DNA, 22 bp, Homo sapiens
tctaatcctatggtggggaggg

SEQ ID NO: 8468510 - DNA, 22 bp, Homo sapiens
tctaatcctatggtggggaggg

SEQ ID NO: 8468511 - DNA, 22 bp, Homo sapiens
tctaagtaaaatttgtcatttc

SEQ ID NO: 8468512 - DNA, 22 bp, Homo sapiens
ccagagaccagaacatggggat

SEQ ID NO: 8468513 - DNA, 19 bp, Homo sapiens
ccagagacattggcatctt

SEQ ID NO: 8468514 - DNA, 19 bp, Homo sapiens
ccagagacattggcatctt

SEQ ID NO: 8468515 - DNA, 22 bp, Homo sapiens
ccagagaaccatctgcttgagg

SEQ ID NO: 8468516 - DNA, 22 bp, Homo sapiens
ccagagaaccatctgcttgagg

SEQ ID NO: 8468517 - DNA, 23 bp, Homo sapiens
tcctttaatgctggaatggctag

SEQ ID NO: 8468518 - DNA, 22 bp, Homo sapiens
tccttgggtcagtgagtgaggt

SEQ ID NO: 8468519 - DNA, 22 bp, Homo sapiens
tcctttaaactcctttcaagtc

SEQ ID NO: 8468520 - DNA, 22 bp, Homo sapiens
tccttggggacgctgacatcgt

SEQ ID NO: 8468521 - DNA, 22 bp, Homo sapiens
tccttggggtaactccagcctg

SEQ ID NO: 8468522 - DNA, 22 bp, Homo sapiens
tccttcctgcaggccaagtcct

SEQ ID NO: 8468523 - DNA, 23 bp, Homo sapiens
tccttgggcctgcccagagtggt

SEQ ID NO: 8468524 - DNA, 22 bp, Homo sapiens
tcctgggctttgtttctctcct

SEQ ID NO: 8468525 - DNA, 22 bp, Homo sapiens
tcctgggcttgctcctccagct

SEQ ID NO: 8468526 - DNA, 19 bp, Homo sapiens
tcctggggaggggcatggc

SEQ ID NO: 8468527 - DNA, 22 bp, Homo sapiens
tcctgtttttgtaatcgactct

SEQ ID NO: 8468528 - DNA, 19 bp, Homo sapiens
tccttaaaaaagcagttct

SEQ ID NO: 8468529 - DNA, 19 bp, Homo sapiens
tcctggggaggggcatggc

SEQ ID NO: 8468530 - DNA, 22 bp, Homo sapiens
tccttccatggtggggctgctt

SEQ ID NO: 8468531 - DNA, 19 bp, Homo sapiens
tccttccagttcctggggt

SEQ ID NO: 8468532 - DNA, 22 bp, Homo sapiens
tccttaaaggactagaagtcaa

SEQ ID NO: 8468533 - DNA, 22 bp, Homo sapiens
ccaaggccacaaacagcctggc

SEQ ID NO: 8468534 - DNA, 22 bp, Homo sapiens
ccaaggcagaagatggctcttg

SEQ ID NO: 8468535 - DNA, 22 bp, Homo sapiens
ccaaggaggccccaggtcagct

SEQ ID NO: 8468536 - DNA, 22 bp, Homo sapiens
ccaaggaggccccaggtcagct

SEQ ID NO: 8468537 - DNA, 22 bp, Homo sapiens
ccaaggcaatgtgcagctggtg

SEQ ID NO: 8468538 - DNA, 22 bp, Homo sapiens
ccaaggagaatgacaccatgga

SEQ ID NO: 8468539 - DNA, 22 bp, Homo sapiens
ccaaggagcaaggctcaacaag

SEQ ID NO: 8468540 - DNA, 22 bp, Homo sapiens
tcctagaagatggatcagagaa

SEQ ID NO: 8468541 - DNA, 22 bp, Homo sapiens
tcctagaaagatgtcttttcac

SEQ ID NO: 8468542 - DNA, 22 bp, Homo sapiens
tcctagaactccaggacagtcc

SEQ ID NO: 8468543 - DNA, 22 bp, Homo sapiens
tcctagaactccaggacagtcc

SEQ ID NO: 8468544 - DNA, 22 bp, Homo sapiens
tcctagaacagcccacctggaa

SEQ ID NO: 8468545 - DNA, 22 bp, Homo sapiens
tcctagaacagcccacctggaa

SEQ ID NO: 8468546 - DNA, 20 bp, Homo sapiens
tcctaataacctgaagaaat

SEQ ID NO: 8468547 - DNA, 20 bp, Homo sapiens
tcctaataacctgaagaaat

SEQ ID NO: 8468548 - DNA, 22 bp, Homo sapiens
ccaaggcttcccagagatgctc

SEQ ID NO: 8468549 - DNA, 22 bp, Homo sapiens
ccaaggcttcccagagatgctc

SEQ ID NO: 8468550 - DNA, 22 bp, Homo sapiens
ccaagggaaaccgagaggctgg

SEQ ID NO: 8468551 - DNA, 22 bp, Homo sapiens
tcctggaggagatccaatctga

SEQ ID NO: 8468552 - DNA, 22 bp, Homo sapiens
tcctggaggagatccaatctga

SEQ ID NO: 8468553 - DNA, 22 bp, Homo sapiens
tcctggcagagagcatgaggcc

SEQ ID NO: 8468554 - DNA, 22 bp, Homo sapiens
ccaaggctggagtgcagtggcg

SEQ ID NO: 8468555 - DNA, 22 bp, Homo sapiens
ccaaggctgtcattcagtagct

SEQ ID NO: 8468556 - DNA, 22 bp, Homo sapiens
ccaaggctcctcagctggtctt

SEQ ID NO: 8468557 - DNA, 18 bp, Homo sapiens
ccaaggcccctgctgggg

SEQ ID NO: 8468558 - DNA, 22 bp, Homo sapiens
ccaaggcccctgtggtctagcc

SEQ ID NO: 8468559 - DNA, 22 bp, Homo sapiens
ccaaggccacaaacagcctggc

SEQ ID NO: 8468560 - DNA, 22 bp, Homo sapiens
ccacagaaagcctgggaagtgg

SEQ ID NO: 8468561 - DNA, 22 bp, Homo sapiens
ccacagaaaataaagcacgatt

SEQ ID NO: 8468562 - DNA, 18 bp, Homo sapiens
tcctggcagtcagagagg

SEQ ID NO: 8468563 - DNA, 22 bp, Homo sapiens
ccacactaaactgctcaaacca

SEQ ID NO: 8468564 - DNA, 22 bp, Homo sapiens
tcctggcaggtgtattggctgt

SEQ ID NO: 8468565 - DNA, 22 bp, Homo sapiens
tcctggcagggtggcagcgggt

SEQ ID NO: 8468566 - DNA, 22 bp, Homo sapiens
tcctggcaggtcagcaggagca

SEQ ID NO: 8468567 - DNA, 22 bp, Homo sapiens
tcctggcaggtcagcaggagca

SEQ ID NO: 8468568 - DNA, 22 bp, Homo sapiens
tcctggcagcccgcaggtgctg

SEQ ID NO: 8468569 - DNA, 22 bp, Homo sapiens
tcctggcagcccgcaggtgctg

SEQ ID NO: 8468570 - DNA, 21 bp, Homo sapiens
tcctggcaggcccaggaccct

SEQ ID NO: 8468571 - DNA, 21 bp, Homo sapiens
tcctggcaggcccaggaccct

SEQ ID NO: 8468572 - DNA, 22 bp, Homo sapiens
tcctggcagggtctaggtctag

SEQ ID NO: 8468573 - DNA, 22 bp, Homo sapiens
tcctggcagggaacttgtcagc

SEQ ID NO: 8468574 - DNA, 22 bp, Homo sapiens
tcctggcagggtggcagcgggt

SEQ ID NO: 8468575 - DNA, 22 bp, Homo sapiens
tcctgggagagtgggactgtat

SEQ ID NO: 8468576 - DNA, 22 bp, Homo sapiens
tcctgggagagtgggactgtat

SEQ ID NO: 8468577 - DNA, 22 bp, Homo sapiens
tcctgggactttcaaggctagg

SEQ ID NO: 8468578 - DNA, 22 bp, Homo sapiens
tcctgggactctttatcagaga

SEQ ID NO: 8468579 - DNA, 22 bp, Homo sapiens
tcctgggagacccagctgtgga

SEQ ID NO: 8468580 - DNA, 22 bp, Homo sapiens
tcctgggagacccagctgtgga

SEQ ID NO: 8468581 - DNA, 22 bp, Homo sapiens
ccacagaacctcagctttgagc

SEQ ID NO: 8468582 - DNA, 22 bp, Homo sapiens
ccacagaaagttgtctagagta

SEQ ID NO: 8468583 - DNA, 22 bp, Homo sapiens
tcctggctccagcagctcttcc

SEQ ID NO: 8468584 - DNA, 22 bp, Homo sapiens
tcctgggactctttatcagaga

SEQ ID NO: 8468585 - DNA, 22 bp, Homo sapiens
tcctggctcctgatctgtcact

SEQ ID NO: 8468586 - DNA, 22 bp, Homo sapiens
tcctgggagcatggtgccgtga

SEQ ID NO: 8468587 - DNA, 22 bp, Homo sapiens
tcctgggagcatgaagagggat

SEQ ID NO: 8468588 - DNA, 22 bp, Homo sapiens
tcctgggagcacatggtcctgc

SEQ ID NO: 8468589 - DNA, 22 bp, Homo sapiens
tcctgggagcacatggtcctgc

SEQ ID NO: 8468590 - DNA, 22 bp, Homo sapiens
tcctgggagagtttgattcatt

SEQ ID NO: 8468591 - DNA, 22 bp, Homo sapiens
tcctgggagcccttgctccacc

SEQ ID NO: 8468592 - DNA, 22 bp, Homo sapiens
tcctgggagcccttgctccacc

SEQ ID NO: 8468593 - DNA, 22 bp, Homo sapiens
tcctgggagcatggtgccgtga

SEQ ID NO: 8468594 - DNA, 22 bp, Homo sapiens
tcctgggagcccttgctccacc

SEQ ID NO: 8468595 - DNA, 22 bp, Homo sapiens
tcctgggcttagtggctaggtc

SEQ ID NO: 8468596 - DNA, 22 bp, Homo sapiens
tcctgggcttaagtgatcctcc

SEQ ID NO: 8468597 - DNA, 22 bp, Homo sapiens
tccctctcttgggcgtggctca

SEQ ID NO: 8468598 - DNA, 22 bp, Homo sapiens
tccctctctggctggggtgcgg

SEQ ID NO: 8468599 - DNA, 22 bp, Homo sapiens
tccctctctagcctgttcagta

SEQ ID NO: 8468600 - DNA, 22 bp, Homo sapiens
tccctctccctattgcctggag

SEQ ID NO: 8468601 - DNA, 22 bp, Homo sapiens
tccctctccctattgcctggag

SEQ ID NO: 8468602 - DNA, 22 bp, Homo sapiens
tccctctccctattgcctggag

SEQ ID NO: 8468603 - DNA, 22 bp, Homo sapiens
tccctcctttatcaaaaagaga

SEQ ID NO: 8468604 - DNA, 22 bp, Homo sapiens
tccctggggtaacattagaggg

SEQ ID NO: 8468605 - DNA, 18 bp, Homo sapiens
tccctggggctgccaccc

SEQ ID NO: 8468606 - DNA, 18 bp, Homo sapiens
tccctggggctgccaccc

SEQ ID NO: 8468607 - DNA, 22 bp, Homo sapiens
tccctggggtatcgctgaggca

SEQ ID NO: 8468608 - DNA, 22 bp, Homo sapiens
tccctggggtatcgctgaggca

SEQ ID NO: 8468609 - DNA, 22 bp, Homo sapiens
tccctggggtatcgctgaggca

SEQ ID NO: 8468610 - DNA, 22 bp, Homo sapiens
tccctggggttcctccagccac

SEQ ID NO: 8468611 - DNA, 22 bp, Homo sapiens
tccctggggttcctccagccac

SEQ ID NO: 8468612 - DNA, 22 bp, Homo sapiens
tccctggggttcctccagccac

SEQ ID NO: 8468613 - DNA, 22 bp, Homo sapiens
tccctgggtcattctctggcac

SEQ ID NO: 8468614 - DNA, 22 bp, Homo sapiens
tccctgggttacctttcaaggt

SEQ ID NO: 8468615 - DNA, 22 bp, Homo sapiens
tccctgggtcctgcttgctctc

SEQ ID NO: 8468616 - DNA, 22 bp, Homo sapiens
tccctgggtcctgcttgctctc

SEQ ID NO: 8468617 - DNA, 22 bp, Homo sapiens
tccctgggttcccgtggaagtg

SEQ ID NO: 8468618 - DNA, 22 bp, Homo sapiens
cattgttttgagaacaacctga

SEQ ID NO: 8468619 - DNA, 22 bp, Homo sapiens
cattgtttctggagggatctgt

SEQ ID NO: 8468620 - DNA, 18 bp, Homo sapiens
cattgtttccagaagacc

SEQ ID NO: 8468621 - DNA, 22 bp, Homo sapiens
cattgtttgtaaaattccagta

SEQ ID NO: 8468622 - DNA, 22 bp, Homo sapiens
cattgtttgagcatctgggatc

SEQ ID NO: 8468623 - DNA, 22 bp, Homo sapiens
catttacacacagaggtgtgct

SEQ ID NO: 8468624 - DNA, 22 bp, Homo sapiens
catttacacacagaggtgtgct

SEQ ID NO: 8468625 - DNA, 22 bp, Homo sapiens
catttacaatgtacaggttgtg

SEQ ID NO: 8468626 - DNA, 22 bp, Homo sapiens
catttaatctggctcatgagca

SEQ ID NO: 8468627 - DNA, 22 bp, Homo sapiens
tccctcctgcatgaggctcggc

SEQ ID NO: 8468628 - DNA, 22 bp, Homo sapiens
tccctcctggccgtcaccgctg

SEQ ID NO: 8468629 - DNA, 18 bp, Homo sapiens
tccctcctgcctgcttcc

SEQ ID NO: 8468630 - DNA, 21 bp, Homo sapiens
tccctcagaagctcttggtca

SEQ ID NO: 8468631 - DNA, 22 bp, Homo sapiens
tccctccttaataagaggtctg

SEQ ID NO: 8468632 - DNA, 22 bp, Homo sapiens
tccctcctggtgatgatgcaaa

SEQ ID NO: 8468633 - DNA, 22 bp, Homo sapiens
tccctcctggtgagcaggggct

SEQ ID NO: 8468634 - DNA, 22 bp, Homo sapiens
tccctcctggtgagcaggggct

SEQ ID NO: 8468635 - DNA, 22 bp, Homo sapiens
cattagaattaggttgtttacc

SEQ ID NO: 8468636 - DNA, 22 bp, Homo sapiens
cattagaaggttttaaaggaat

SEQ ID NO: 8468637 - DNA, 22 bp, Homo sapiens
cattagaaggttttaaaggaat

SEQ ID NO: 8468638 - DNA, 23 bp, Homo sapiens
cattagaaggtagagtggaatga

SEQ ID NO: 8468639 - DNA, 22 bp, Homo sapiens
cattagaagaacagttatatta

SEQ ID NO: 8468640 - DNA, 22 bp, Homo sapiens
cattagaactaagatgtccagg

SEQ ID NO: 8468641 - DNA, 22 bp, Homo sapiens
cattagaactaagatgtccagg

SEQ ID NO: 8468642 - DNA, 22 bp, Homo sapiens
cattagaacctataaaaagcat

SEQ ID NO: 8468643 - DNA, 22 bp, Homo sapiens
cattagaacctataaaaagcat

SEQ ID NO: 8468644 - DNA, 22 bp, Homo sapiens
cattagaaaagcagctgggacc

SEQ ID NO: 8468645 - DNA, 22 bp, Homo sapiens
cattacatttcaaaatgtttcc

SEQ ID NO: 8468646 - DNA, 22 bp, Homo sapiens
tcccacccatcctgcatctctt

SEQ ID NO: 8468647 - DNA, 22 bp, Homo sapiens
tcccacattaccctgactgaca

SEQ ID NO: 8468648 - DNA, 22 bp, Homo sapiens
tcccacccatcctgcatctctt

SEQ ID NO: 8468649 - DNA, 22 bp, Homo sapiens
cattcttgcaccgtgatggctt

SEQ ID NO: 8468650 - DNA, 22 bp, Homo sapiens
tcccacattaccctgactgaca

SEQ ID NO: 8468651 - DNA, 22 bp, Homo sapiens
tcccaccccttgactctttaag

SEQ ID NO: 8468652 - DNA, 22 bp, Homo sapiens
tcccaccccggtcaagggctga

SEQ ID NO: 8468653 - DNA, 22 bp, Homo sapiens
tcccaccccttgactctttaag

SEQ ID NO: 8468654 - DNA, 22 bp, Homo sapiens
tcccaccccctccaaggaggaa

SEQ ID NO: 8468655 - DNA, 22 bp, Homo sapiens
tcccaccccctccaaggaggaa

SEQ ID NO: 8468656 - DNA, 22 bp, Homo sapiens
tcccaccccggtcaagggctga

SEQ ID NO: 8468657 - DNA, 22 bp, Homo sapiens
cattctgggtctggctcaggga

SEQ ID NO: 8468658 - DNA, 22 bp, Homo sapiens
cattcttatatttactcattca

SEQ ID NO: 8468659 - DNA, 22 bp, Homo sapiens
cattctcttgacaggacagccc

SEQ ID NO: 8468660 - DNA, 22 bp, Homo sapiens
tccaggagaggcctgaccaggt

SEQ ID NO: 8468661 - DNA, 22 bp, Homo sapiens
tccaggagaggcctgaccaggt

SEQ ID NO: 8468662 - DNA, 22 bp, Homo sapiens
tccaggagaggtgtggggactg

SEQ ID NO: 8468663 - DNA, 22 bp, Homo sapiens
tccaggagatacactgcaccag

SEQ ID NO: 8468664 - DNA, 22 bp, Homo sapiens
tccaggagattcattaggtcat

SEQ ID NO: 8468665 - DNA, 17 bp, Homo sapiens
tccaggagaggcaatgg

SEQ ID NO: 8468666 - DNA, 22 bp, Homo sapiens
tccaggagacacaaggtacata

SEQ ID NO: 8468667 - DNA, 21 bp, Homo sapiens
tccaggagcacgggactagga

SEQ ID NO: 8468668 - DNA, 21 bp, Homo sapiens
tccaggagcacgggactagga

SEQ ID NO: 8468669 - DNA, 19 bp, Homo sapiens
tccaggagcaaagccagtt

SEQ ID NO: 8468670 - DNA, 22 bp, Homo sapiens
tccaggagcatccaggtgaagc

SEQ ID NO: 8468671 - DNA, 22 bp, Homo sapiens
tccaggagcatccaggtgaagc

SEQ ID NO: 8468672 - DNA, 20 bp, Homo sapiens
tcccaaaattctactttatc

SEQ ID NO: 8468673 - DNA, 22 bp, Homo sapiens
tccatttttcatgactcctcaa

SEQ ID NO: 8468674 - DNA, 22 bp, Homo sapiens
tccattttctaagtatcactta

SEQ ID NO: 8468675 - DNA, 22 bp, Homo sapiens
tccattttcatctcatgtataa

SEQ ID NO: 8468676 - DNA, 22 bp, Homo sapiens
tccatttagctggcaaacaatg

SEQ ID NO: 8468677 - DNA, 22 bp, Homo sapiens
tccatttggcactctatttcca

SEQ ID NO: 8468678 - DNA, 22 bp, Homo sapiens
tccatttggcctctgtattgta

SEQ ID NO: 8468679 - DNA, 22 bp, Homo sapiens
tattaggttggtgcaaaattaa

SEQ ID NO: 8468680 - DNA, 22 bp, Homo sapiens
tattaggtatgaactggcaacc

SEQ ID NO: 8468681 - DNA, 22 bp, Homo sapiens
tattaggttggtgcaacagtaa

SEQ ID NO: 8468682 - DNA, 22 bp, Homo sapiens
tattaggtagattttactgatt

SEQ ID NO: 8468683 - DNA, 22 bp, Homo sapiens
caggtggctgagctgacctttg

SEQ ID NO: 8468684 - DNA, 22 bp, Homo sapiens
caggtggctaacggcctcatag

SEQ ID NO: 8468685 - DNA, 22 bp, Homo sapiens
caggtggctaacggcctcatag

SEQ ID NO: 8468686 - DNA, 22 bp, Homo sapiens
caggtggcatgactgcctacaa

SEQ ID NO: 8468687 - DNA, 22 bp, Homo sapiens
caggtggcagaggtctctggaa

SEQ ID NO: 8468688 - DNA, 22 bp, Homo sapiens
caggtggcaaatgagtagcatt

SEQ ID NO: 8468689 - DNA, 22 bp, Homo sapiens
tattatgcataggcaataatgg

SEQ ID NO: 8468690 - DNA, 18 bp, Homo sapiens
caggtgggtctcctgccc

SEQ ID NO: 8468691 - DNA, 18 bp, Homo sapiens
caggtgggtctcctgccc

SEQ ID NO: 8468692 - DNA, 20 bp, Homo sapiens
tattatgacctgtgttctgg

SEQ ID NO: 8468693 - DNA, 22 bp, Homo sapiens
tattatcattaactgttgaatt

SEQ ID NO: 8468694 - DNA, 22 bp, Homo sapiens
cagggtggggctggctatcaaa

SEQ ID NO: 8468695 - DNA, 22 bp, Homo sapiens
cagggtggggctggctatcaaa

SEQ ID NO: 8468696 - DNA, 22 bp, Homo sapiens
cagggtggggctggctatcaaa

SEQ ID NO: 8468697 - DNA, 22 bp, Homo sapiens
cagggtttctgttgagaagtcc

SEQ ID NO: 8468698 - DNA, 22 bp, Homo sapiens
caggtaggtatggtgcagtctt

SEQ ID NO: 8468699 - DNA, 22 bp, Homo sapiens
caggtcaaaggttagttatgtt

SEQ ID NO: 8468700 - DNA, 22 bp, Homo sapiens
caggtcagaggcgcagccccca

SEQ ID NO: 8468701 - DNA, 22 bp, Homo sapiens
caggtcagaggcgcagccccca

SEQ ID NO: 8468702 - DNA, 22 bp, Homo sapiens
caggtcagagtccccctgtcct

SEQ ID NO: 8468703 - DNA, 18 bp, Homo sapiens
caggtcagcctggcctca

SEQ ID NO: 8468704 - DNA, 22 bp, Homo sapiens
caggtcagctggtgccccaggt

SEQ ID NO: 8468705 - DNA, 18 bp, Homo sapiens
caggtcagcctggcctca

SEQ ID NO: 8468706 - DNA, 22 bp, Homo sapiens
caggtgctctgctgcaggtaag

SEQ ID NO: 8468707 - DNA, 22 bp, Homo sapiens
caggtgctgcagggctggcgtc

SEQ ID NO: 8468708 - DNA, 22 bp, Homo sapiens
caggtgctgtcctgcacatgtc

SEQ ID NO: 8468709 - DNA, 22 bp, Homo sapiens
caggtgctgtgaatcttcataa

SEQ ID NO: 8468710 - DNA, 22 bp, Homo sapiens
caggtgctgtcctgcacatgtc

SEQ ID NO: 8468711 - DNA, 22 bp, Homo sapiens
caggtgctgcgtggcggagctg

SEQ ID NO: 8468712 - DNA, 22 bp, Homo sapiens
tcaaaaatgttttatattggta

SEQ ID NO: 8468713 - DNA, 22 bp, Homo sapiens
tattttacatgacaggtgttta

SEQ ID NO: 8468714 - DNA, 22 bp, Homo sapiens
tattttacatgatccagagttg

SEQ ID NO: 8468715 - DNA, 22 bp, Homo sapiens
tattttactttaaagcgagaga

SEQ ID NO: 8468716 - DNA, 22 bp, Homo sapiens
tattttactatttggcaaagtc

SEQ ID NO: 8468717 - DNA, 22 bp, Homo sapiens
tattttactatttggcaaagtc

SEQ ID NO: 8468718 - DNA, 22 bp, Homo sapiens
tattttaggtaatatccattgt

SEQ ID NO: 8468719 - DNA, 22 bp, Homo sapiens
tattttaggtaatatccattgt

SEQ ID NO: 8468720 - DNA, 22 bp, Homo sapiens
tcaaaacaacactcaggtgtaa

SEQ ID NO: 8468721 - DNA, 22 bp, Homo sapiens
tcaaaacactattacctttaat

SEQ ID NO: 8468722 - DNA, 19 bp, Homo sapiens
tcaaaacacaaatggttga

SEQ ID NO: 8468723 - DNA, 19 bp, Homo sapiens
tcaaaacacaaatggttga

SEQ ID NO: 8468724 - DNA, 22 bp, Homo sapiens
tcaagcagcttttacagaagag

SEQ ID NO: 8468725 - DNA, 23 bp, Homo sapiens
tcaagcaattctcctgcctcggc

SEQ ID NO: 8468726 - DNA, 22 bp, Homo sapiens
tcaagcaatctctgtgtccctg

SEQ ID NO: 8468727 - DNA, 22 bp, Homo sapiens
tcaagcaattctcctgcctcag

SEQ ID NO: 8468728 - DNA, 23 bp, Homo sapiens
tcaagcaataattggtaatagtg

SEQ ID NO: 8468729 - DNA, 20 bp, Homo sapiens
tcaagctagtttccaaagtt

SEQ ID NO: 8468730 - DNA, 22 bp, Homo sapiens
tcaacaaatacttaaagcagag

SEQ ID NO: 8468731 - DNA, 22 bp, Homo sapiens
tcaaaacactattacctttaat

SEQ ID NO: 8468732 - DNA, 20 bp, Homo sapiens
tcaagatgaggtcatactgg

SEQ ID NO: 8468733 - DNA, 22 bp, Homo sapiens
tcaagatgcatgggtggcataa

SEQ ID NO: 8468734 - DNA, 19 bp, Homo sapiens
tcaagatggatggctccca

SEQ ID NO: 8468735 - DNA, 22 bp, Homo sapiens
tcaagatgaaccaggacattca

SEQ ID NO: 8468736 - DNA, 22 bp, Homo sapiens
tcaagcaactgaattctaaaag

SEQ ID NO: 8468737 - DNA, 22 bp, Homo sapiens
tcaagcaacagaactgtgagac

SEQ ID NO: 8468738 - DNA, 22 bp, Homo sapiens
tcaagcaagttgcatattgcta

SEQ ID NO: 8468739 - DNA, 22 bp, Homo sapiens
tcaagcaagtgtttggtgtaaa

SEQ ID NO: 8468740 - DNA, 22 bp, Homo sapiens
tcaagcaaagatacaaatggaa

SEQ ID NO: 8468741 - DNA, 22 bp, Homo sapiens
tcaagcaaagtttagctggtta

SEQ ID NO: 8468742 - DNA, 22 bp, Homo sapiens
tcaagcaaatgtccttttgttc

SEQ ID NO: 8468743 - DNA, 22 bp, Homo sapiens
tcaagatgtccagtgcctataa

SEQ ID NO: 8468744 - DNA, 22 bp, Homo sapiens
tcaagcaaactctgagaaataa

SEQ ID NO: 8468745 - DNA, 22 bp, Homo sapiens
tattttacagactactttagat

SEQ ID NO: 8468746 - DNA, 22 bp, Homo sapiens
tattttacagactactttagat

SEQ ID NO: 8468747 - DNA, 22 bp, Homo sapiens
tattttacagactactttagat

SEQ ID NO: 8468748 - DNA, 22 bp, Homo sapiens
tattttacaaatgggaatgctg

SEQ ID NO: 8468749 - DNA, 22 bp, Homo sapiens
tattttacaaatgggaatgctg

SEQ ID NO: 8468750 - DNA, 22 bp, Homo sapiens
tattttaaagtgaagggtcttg

SEQ ID NO: 8468751 - DNA, 22 bp, Homo sapiens
cagtcagaaggaagatgcttaa

SEQ ID NO: 8468752 - DNA, 22 bp, Homo sapiens
cagtcactggaatagctgagga

SEQ ID NO: 8468753 - DNA, 22 bp, Homo sapiens
cagtcagagtcacagtaatttg

SEQ ID NO: 8468754 - DNA, 22 bp, Homo sapiens
cagtcagaggtcttctaaaaca

SEQ ID NO: 8468755 - DNA, 22 bp, Homo sapiens
cagtcagggacaccagctagga

SEQ ID NO: 8468756 - DNA, 19 bp, Homo sapiens
cagtatcattgcacatagt

SEQ ID NO: 8468757 - DNA, 22 bp, Homo sapiens
cagtcacagtgacaggatgtgg

SEQ ID NO: 8468758 - DNA, 17 bp, Homo sapiens
cagggctgtctgcctag

SEQ ID NO: 8468759 - DNA, 17 bp, Homo sapiens
cagggctgtctgcctag

SEQ ID NO: 8468760 - DNA, 22 bp, Homo sapiens
cagggctgtctccaaaggcccc

SEQ ID NO: 8468761 - DNA, 22 bp, Homo sapiens
cagggctgtgcccatcttcccc

SEQ ID NO: 8468762 - DNA, 22 bp, Homo sapiens
cagggctgtggaaaactggtgc

SEQ ID NO: 8468763 - DNA, 22 bp, Homo sapiens
cagggctgtgcccatcttcccc

SEQ ID NO: 8468764 - DNA, 22 bp, Homo sapiens
cagggctgtggctttgtgctgt

SEQ ID NO: 8468765 - DNA, 22 bp, Homo sapiens
cagggggctcaaaggagagtgc

SEQ ID NO: 8468766 - DNA, 22 bp, Homo sapiens
cagggggcagcgtagaaaatga

SEQ ID NO: 8468767 - DNA, 22 bp, Homo sapiens
cagggggctcaaaggagagtgc

SEQ ID NO: 8468768 - DNA, 22 bp, Homo sapiens
cagggggctgtggctgtccagt

SEQ ID NO: 8468769 - DNA, 22 bp, Homo sapiens
cagggggctcaaaggagagtgc

SEQ ID NO: 8468770 - DNA, 22 bp, Homo sapiens
caggggcttaagtgacagaagg

SEQ ID NO: 8468771 - DNA, 22 bp, Homo sapiens
caggggcctgtcctggcttctg

SEQ ID NO: 8468772 - DNA, 22 bp, Homo sapiens
cagggtcccaggagctgctttc

SEQ ID NO: 8468773 - DNA, 22 bp, Homo sapiens
cagggtccatctttcatcactg

SEQ ID NO: 8468774 - DNA, 22 bp, Homo sapiens
cagggtcaggaggatctggctt

SEQ ID NO: 8468775 - DNA, 22 bp, Homo sapiens
cagggtggggctggctatcaaa

SEQ ID NO: 8468776 - DNA, 22 bp, Homo sapiens
cagggtccggctgcctggctgt

SEQ ID NO: 8468777 - DNA, 22 bp, Homo sapiens
cagggtccggctgcctggctgt

SEQ ID NO: 8468778 - DNA, 22 bp, Homo sapiens
cagggtcccaggagctgctttc

SEQ ID NO: 8468779 - DNA, 22 bp, Homo sapiens
cagggtccccgggtctcctgtg

SEQ ID NO: 8468780 - DNA, 22 bp, Homo sapiens
cagggtccccgggtctcctgtg

SEQ ID NO: 8468781 - DNA, 22 bp, Homo sapiens
cagggtccccgggtctcctgtg

SEQ ID NO: 8468782 - DNA, 22 bp, Homo sapiens
caggggtgtttttggccaggag

SEQ ID NO: 8468783 - DNA, 22 bp, Homo sapiens
cagggtagggcaagggaacctg

SEQ ID NO: 8468784 - DNA, 22 bp, Homo sapiens
cagggtagacagtaggtgtctg

SEQ ID NO: 8468785 - DNA, 22 bp, Homo sapiens
cagggggtggtccaggctgcgc

SEQ ID NO: 8468786 - DNA, 22 bp, Homo sapiens
cagggggtggtccaggctgcgc

SEQ ID NO: 8468787 - DNA, 22 bp, Homo sapiens
cagggggtggtccaggctgcgc

SEQ ID NO: 8468788 - DNA, 22 bp, Homo sapiens
cagggctgtctccaaaggcccc

SEQ ID NO: 8468789 - DNA, 22 bp, Homo sapiens
cagggctgtaaattagtgctga

SEQ ID NO: 8468790 - DNA, 22 bp, Homo sapiens
cagggctgtaaattagtgctga

SEQ ID NO: 8468791 - DNA, 22 bp, Homo sapiens
cagggctgtaaattagtgctga

SEQ ID NO: 8468792 - DNA, 22 bp, Homo sapiens
cagggctggtttgtcgaagaaa

SEQ ID NO: 8468793 - DNA, 22 bp, Homo sapiens
cagggctggtttgtcgaagaaa

SEQ ID NO: 8468794 - DNA, 23 bp, Homo sapiens
cagggctggtagggaagagcgtg

SEQ ID NO: 8468795 - DNA, 23 bp, Homo sapiens
cagggctggtagggaagagcgtg

SEQ ID NO: 8468796 - DNA, 23 bp, Homo sapiens
cagggctggtagggaagagcgtg

SEQ ID NO: 8468797 - DNA, 22 bp, Homo sapiens
cagggctggatttcatttctag

SEQ ID NO: 8468798 - DNA, 22 bp, Homo sapiens
cagggctgggttaaaagcaggg

SEQ ID NO: 8468799 - DNA, 22 bp, Homo sapiens
cagggctggatttcatttctag

SEQ ID NO: 8468800 - DNA, 23 bp, Homo sapiens
taggcttctgctgtccccgacgc

SEQ ID NO: 8468801 - DNA, 22 bp, Homo sapiens
taggcttccgagtcttggtatc

SEQ ID NO: 8468802 - DNA, 22 bp, Homo sapiens
taggcttcccgctcacatgccc

SEQ ID NO: 8468803 - DNA, 22 bp, Homo sapiens
taggcttcacttccagttattc

SEQ ID NO: 8468804 - DNA, 22 bp, Homo sapiens
cagggctgaactgagcttgtga

SEQ ID NO: 8468805 - DNA, 22 bp, Homo sapiens
cagggctgaactgagcttgtga

SEQ ID NO: 8468806 - DNA, 22 bp, Homo sapiens
cagggctgaagaaattcaaaag

SEQ ID NO: 8468807 - DNA, 22 bp, Homo sapiens
taggctgggcctgccttccagg

SEQ ID NO: 8468808 - DNA, 22 bp, Homo sapiens
taggctgggcctgccttccagg

SEQ ID NO: 8468809 - DNA, 22 bp, Homo sapiens
taggctgggctgagctggacgg

SEQ ID NO: 8468810 - DNA, 22 bp, Homo sapiens
taggctgggctgagctggacgg

SEQ ID NO: 8468811 - DNA, 22 bp, Homo sapiens
taggctgggctgagctggacgg

SEQ ID NO: 8468812 - DNA, 22 bp, Homo sapiens
taggctgtaagagagggcagag

SEQ ID NO: 8468813 - DNA, 18 bp, Homo sapiens
taggctgggggctgtagt

SEQ ID NO: 8468814 - DNA, 22 bp, Homo sapiens
taggctgggggtaggaattgag

SEQ ID NO: 8468815 - DNA, 22 bp, Homo sapiens
cagggctgaaatcaaggtgtag

SEQ ID NO: 8468816 - DNA, 22 bp, Homo sapiens
cagggctgaaatcaaggtgtag

SEQ ID NO: 8468817 - DNA, 22 bp, Homo sapiens
cagggctgaactgagcttgtga

SEQ ID NO: 8468818 - DNA, 22 bp, Homo sapiens
cagggctgaactgagcttgtga

SEQ ID NO: 8468819 - DNA, 20 bp, Homo sapiens
cagggctctgggcctggcct

SEQ ID NO: 8468820 - DNA, 20 bp, Homo sapiens
cagggctctgggcctggcct

SEQ ID NO: 8468821 - DNA, 22 bp, Homo sapiens
cagggctcttcatcacacagta

SEQ ID NO: 8468822 - DNA, 22 bp, Homo sapiens
cagggcctcatcctcagagatt

SEQ ID NO: 8468823 - DNA, 22 bp, Homo sapiens
cagggcctcatggccggggtgc

SEQ ID NO: 8468824 - DNA, 20 bp, Homo sapiens
cagggcctatgattgagctt

SEQ ID NO: 8468825 - DNA, 22 bp, Homo sapiens
cagggcccatggctcaggtagg

SEQ ID NO: 8468826 - DNA, 22 bp, Homo sapiens
cagggcccagtccctgctgtca

SEQ ID NO: 8468827 - DNA, 22 bp, Homo sapiens
cagggcccagtccctgctgtca

SEQ ID NO: 8468828 - DNA, 22 bp, Homo sapiens
cagggcccaggccactgggttg

SEQ ID NO: 8468829 - DNA, 22 bp, Homo sapiens
taggccagaggagcagctttgg

SEQ ID NO: 8468830 - DNA, 19 bp, Homo sapiens
taggccagaagttttccac

SEQ ID NO: 8468831 - DNA, 22 bp, Homo sapiens
taggccacaaataagatcctgt

SEQ ID NO: 8468832 - DNA, 22 bp, Homo sapiens
tagctttaaaaatcatcaaagc

SEQ ID NO: 8468833 - DNA, 22 bp, Homo sapiens
tagcttggaataaaatgagaat

SEQ ID NO: 8468834 - DNA, 22 bp, Homo sapiens
tagcttctggagtgtttgaaaa

SEQ ID NO: 8468835 - DNA, 22 bp, Homo sapiens
tagcttcttgagaaagggtgcc

SEQ ID NO: 8468836 - DNA, 22 bp, Homo sapiens
tagcttctgggagtgtttacta

SEQ ID NO: 8468837 - DNA, 22 bp, Homo sapiens
tagcttcttgagaaagggtgcc

SEQ ID NO: 8468838 - DNA, 22 bp, Homo sapiens
tagcttgagtgtttcataaata

SEQ ID NO: 8468839 - DNA, 22 bp, Homo sapiens
tagcttcagggaaaccactgct

SEQ ID NO: 8468840 - DNA, 22 bp, Homo sapiens
tagcttctaatacttaccaatt

SEQ ID NO: 8468841 - DNA, 22 bp, Homo sapiens
tagcttctcataatttatgctg

SEQ ID NO: 8468842 - DNA, 22 bp, Homo sapiens
tagcttctcataatttatgctg

SEQ ID NO: 8468843 - DNA, 22 bp, Homo sapiens
taggaggcttaaagctgctcag

SEQ ID NO: 8468844 - DNA, 22 bp, Homo sapiens
taggaggcatttgctcccaggg

SEQ ID NO: 8468845 - DNA, 22 bp, Homo sapiens
taggcaggtgtgcactgcccac

SEQ ID NO: 8468846 - DNA, 22 bp, Homo sapiens
taggcatgcaaataaatgtgca

SEQ ID NO: 8468847 - DNA, 22 bp, Homo sapiens
cagggccattggaacaaagagg

SEQ ID NO: 8468848 - DNA, 22 bp, Homo sapiens
tagcttaacagcaaaactgttg

SEQ ID NO: 8468849 - DNA, 22 bp, Homo sapiens
cagggccaggctgatggcctgg

SEQ ID NO: 8468850 - DNA, 22 bp, Homo sapiens
cagggagcaggctctgtccatc

SEQ ID NO: 8468851 - DNA, 20 bp, Homo sapiens
tagatttcatacttctcttt

SEQ ID NO: 8468852 - DNA, 22 bp, Homo sapiens
tagattctttgctagatcattg

SEQ ID NO: 8468853 - DNA, 22 bp, Homo sapiens
tagatttaagaccctgaatttg

SEQ ID NO: 8468854 - DNA, 22 bp, Homo sapiens
tagatttgatgtaagcatagtc

SEQ ID NO: 8468855 - DNA, 22 bp, Homo sapiens
tagatttgcctgggaaagctca

SEQ ID NO: 8468856 - DNA, 22 bp, Homo sapiens
tagatttgtgcaagaagggatt

SEQ ID NO: 8468857 - DNA, 22 bp, Homo sapiens
cagggagcagcgctggggcctc

SEQ ID NO: 8468858 - DNA, 22 bp, Homo sapiens
cagggagcagcccctagaagta

SEQ ID NO: 8468859 - DNA, 22 bp, Homo sapiens
cagggagcagcccctagaagta

SEQ ID NO: 8468860 - DNA, 22 bp, Homo sapiens
cagggagcaggctctgtccatc

SEQ ID NO: 8468861 - DNA, 22 bp, Homo sapiens
cagggagatcttggctcctggt

SEQ ID NO: 8468862 - DNA, 22 bp, Homo sapiens
cagggagatcttggctcctggt

SEQ ID NO: 8468863 - DNA, 22 bp, Homo sapiens
tacaaaaaattgatactgacga

SEQ ID NO: 8468864 - DNA, 22 bp, Homo sapiens
caggcatggtgagaactcagcc

SEQ ID NO: 8468865 - DNA, 22 bp, Homo sapiens
caggcattgttctaggttctca

SEQ ID NO: 8468866 - DNA, 22 bp, Homo sapiens
caggcattgccattcctccaga

SEQ ID NO: 8468867 - DNA, 22 bp, Homo sapiens
caggcattgtgacgagtgttct

SEQ ID NO: 8468868 - DNA, 22 bp, Homo sapiens
tacaaaagtaattacggttttt

SEQ ID NO: 8468869 - DNA, 22 bp, Homo sapiens
caggccagagcgcgtggttggg

SEQ ID NO: 8468870 - DNA, 22 bp, Homo sapiens
caggccagagcgcgtggttggg

SEQ ID NO: 8468871 - DNA, 22 bp, Homo sapiens
tacaaaaaattgatactgacga

SEQ ID NO: 8468872 - DNA, 22 bp, Homo sapiens
caggccaggtggcaggcaaaac

SEQ ID NO: 8468873 - DNA, 22 bp, Homo sapiens
caggccagtgggaaatagggat

SEQ ID NO: 8468874 - DNA, 19 bp, Homo sapiens
caggccagtgtcagggggc

SEQ ID NO: 8468875 - DNA, 22 bp, Homo sapiens
caggccagtgggaaatagggat

SEQ ID NO: 8468876 - DNA, 22 bp, Homo sapiens
caggccagggttgagaagagaa

SEQ ID NO: 8468877 - DNA, 22 bp, Homo sapiens
caggccagggttgagaagagaa

SEQ ID NO: 8468878 - DNA, 22 bp, Homo sapiens
caggccaggtggcaggcaaaac

SEQ ID NO: 8468879 - DNA, 22 bp, Homo sapiens
caggccaggtgctctagaatca

SEQ ID NO: 8468880 - DNA, 22 bp, Homo sapiens
caggccagggttgagaagagaa

SEQ ID NO: 8468881 - DNA, 22 bp, Homo sapiens
caggccagtgtgcttcccaggc

SEQ ID NO: 8468882 - DNA, 22 bp, Homo sapiens
caggccagttttgatttaagcc

SEQ ID NO: 8468883 - DNA, 22 bp, Homo sapiens
caggccagtgtgcttcccaggc

SEQ ID NO: 8468884 - DNA, 22 bp, Homo sapiens
caggccagtgtgcttcccaggc

SEQ ID NO: 8468885 - DNA, 22 bp, Homo sapiens
caggcccacgaggcacacagag

SEQ ID NO: 8468886 - DNA, 22 bp, Homo sapiens
caggcccacgaggcacacagag

SEQ ID NO: 8468887 - DNA, 22 bp, Homo sapiens
caggcccactgcttgtctagtc

SEQ ID NO: 8468888 - DNA, 22 bp, Homo sapiens
caggcccaaatgcaaccttctt

SEQ ID NO: 8468889 - DNA, 22 bp, Homo sapiens
caggcccaaatgcaaccttctt

SEQ ID NO: 8468890 - DNA, 22 bp, Homo sapiens
taatcacagaaacagactgttt

SEQ ID NO: 8468891 - DNA, 22 bp, Homo sapiens
taatatctggcattcaaacatg

SEQ ID NO: 8468892 - DNA, 22 bp, Homo sapiens
taatatctggcattcaaacatg

SEQ ID NO: 8468893 - DNA, 22 bp, Homo sapiens
taatgtataacaaatactcatc

SEQ ID NO: 8468894 - DNA, 20 bp, Homo sapiens
taatgtcaaagtcacaaggt

SEQ ID NO: 8468895 - DNA, 22 bp, Homo sapiens
caggcatggaaaagcccagagg

SEQ ID NO: 8468896 - DNA, 22 bp, Homo sapiens
caggcatggagaggcagagact

SEQ ID NO: 8468897 - DNA, 22 bp, Homo sapiens
caggcatgatcataggagttta

SEQ ID NO: 8468898 - DNA, 22 bp, Homo sapiens
caggcagggagctggaaaggat

SEQ ID NO: 8468899 - DNA, 22 bp, Homo sapiens
caggcatgagccaggcccctcc

SEQ ID NO: 8468900 - DNA, 22 bp, Homo sapiens
caggcagggagctggaaaggat

SEQ ID NO: 8468901 - DNA, 22 bp, Homo sapiens
caggcatgatgggaagtgcctg

SEQ ID NO: 8468902 - DNA, 22 bp, Homo sapiens
caggcatgcttctgtctgggca

SEQ ID NO: 8468903 - DNA, 22 bp, Homo sapiens
caggcatgcttctgtctgggca

SEQ ID NO: 8468904 - DNA, 22 bp, Homo sapiens
taatgtcaaggtcattctagag

SEQ ID NO: 8468905 - DNA, 22 bp, Homo sapiens
cagctattttctcattaaggat

SEQ ID NO: 8468906 - DNA, 22 bp, Homo sapiens
cagctattggcaagaagtggtg

SEQ ID NO: 8468907 - DNA, 22 bp, Homo sapiens
cagctattggtccacaggtatg

SEQ ID NO: 8468908 - DNA, 22 bp, Homo sapiens
cagctattgataaatgttgggg

SEQ ID NO: 8468909 - DNA, 22 bp, Homo sapiens
gtgcttctgccaactaattaac

SEQ ID NO: 8468910 - DNA, 22 bp, Homo sapiens
cagctcagacgcaggtcgagca

SEQ ID NO: 8468911 - DNA, 22 bp, Homo sapiens
cagctcagacgcaggtcgagca

SEQ ID NO: 8468912 - DNA, 22 bp, Homo sapiens
gtgcttcctgtattgattccat

SEQ ID NO: 8468913 - DNA, 22 bp, Homo sapiens
cagctattctctgaaatgaata

SEQ ID NO: 8468914 - DNA, 22 bp, Homo sapiens
gtgcttctccgttctgcagcac

SEQ ID NO: 8468915 - DNA, 23 bp, Homo sapiens
cagctcagcacataggaggtact

SEQ ID NO: 8468916 - DNA, 23 bp, Homo sapiens
cagctcagagtgtgtcctgtttc

SEQ ID NO: 8468917 - DNA, 23 bp, Homo sapiens
cagctcagagtgtgtcctgtttc

SEQ ID NO: 8468918 - DNA, 23 bp, Homo sapiens
cagctcagcacataggaggtact

SEQ ID NO: 8468919 - DNA, 22 bp, Homo sapiens
taagtatgttagaaaatcaagt

SEQ ID NO: 8468920 - DNA, 22 bp, Homo sapiens
taagtattggcctatagctaga

SEQ ID NO: 8468921 - DNA, 22 bp, Homo sapiens
taagtcttcatagtctaatgtc

SEQ ID NO: 8468922 - DNA, 22 bp, Homo sapiens
taagtcttcatagtctaatgtc

SEQ ID NO: 8468923 - DNA, 22 bp, Homo sapiens
taagtcgtggatgattcttcgg

SEQ ID NO: 8468924 - DNA, 22 bp, Homo sapiens
taagtcgtggatgattcttcgg

SEQ ID NO: 8468925 - DNA, 22 bp, Homo sapiens
taatacaatggagttgggcccc

SEQ ID NO: 8468926 - DNA, 22 bp, Homo sapiens
taatacaaggcaggaagcagta

SEQ ID NO: 8468927 - DNA, 22 bp, Homo sapiens
taatacaatggagttgggcccc

SEQ ID NO: 8468928 - DNA, 22 bp, Homo sapiens
taataattggctaaccctggga

SEQ ID NO: 8468929 - DNA, 22 bp, Homo sapiens
taataattggctaaccctggga

SEQ ID NO: 8468930 - DNA, 22 bp, Homo sapiens
taataattttaaagaaggctag

SEQ ID NO: 8468931 - DNA, 22 bp, Homo sapiens
taataattttaaagaaggctag

SEQ ID NO: 8468932 - DNA, 22 bp, Homo sapiens
taataattggcaatgttgagca

SEQ ID NO: 8468933 - DNA, 22 bp, Homo sapiens
taataattggcaatgttgagca

SEQ ID NO: 8468934 - DNA, 22 bp, Homo sapiens
taataattggcaatgttgagca

SEQ ID NO: 8468935 - DNA, 22 bp, Homo sapiens
taataattagttattgatcgtg

SEQ ID NO: 8468936 - DNA, 21 bp, Homo sapiens
taataattccactacagagta

SEQ ID NO: 8468937 - DNA, 21 bp, Homo sapiens
taataattccactacagagta

SEQ ID NO: 8468938 - DNA, 22 bp, Homo sapiens
taataattagttattgatcgtg

SEQ ID NO: 8468939 - DNA, 22 bp, Homo sapiens
caggcagatttgctgccctcca

SEQ ID NO: 8468940 - DNA, 22 bp, Homo sapiens
caggcagatgctgacaagagtt

SEQ ID NO: 8468941 - DNA, 22 bp, Homo sapiens
caggcagatgctgacaagagtt

SEQ ID NO: 8468942 - DNA, 22 bp, Homo sapiens
caggcagatgctgacaagagtt

SEQ ID NO: 8468943 - DNA, 22 bp, Homo sapiens
caggcacgggggcatggcctct

SEQ ID NO: 8468944 - DNA, 22 bp, Homo sapiens
caggcaccacactaggggctga

SEQ ID NO: 8468945 - DNA, 22 bp, Homo sapiens
caggcaccccaggtgagcactg

SEQ ID NO: 8468946 - DNA, 22 bp, Homo sapiens
caggcacctgtgtgtctcaggg

SEQ ID NO: 8468947 - DNA, 22 bp, Homo sapiens
caggctacatttgctctgagaa

SEQ ID NO: 8468948 - DNA, 22 bp, Homo sapiens
caggctacatttgctctgagaa

SEQ ID NO: 8468949 - DNA, 22 bp, Homo sapiens
caggctactggggcttggatgg

SEQ ID NO: 8468950 - DNA, 22 bp, Homo sapiens
caggctagattggggccagtag

SEQ ID NO: 8468951 - DNA, 22 bp, Homo sapiens
caggctagcagggcccagggca

SEQ ID NO: 8468952 - DNA, 22 bp, Homo sapiens
caggctagattggggccagtag

SEQ ID NO: 8468953 - DNA, 22 bp, Homo sapiens
caggctcaaggctgacttccat

SEQ ID NO: 8468954 - DNA, 22 bp, Homo sapiens
tactttaaaaactgataattca

SEQ ID NO: 8468955 - DNA, 22 bp, Homo sapiens
tactgtggtaacattttaaatt

SEQ ID NO: 8468956 - DNA, 22 bp, Homo sapiens
tactttaatatatgtgaagttc

SEQ ID NO: 8468957 - DNA, 22 bp, Homo sapiens
tacatttacagagccttctctg

SEQ ID NO: 8468958 - DNA, 22 bp, Homo sapiens
tacatttataaggcttctctgt

SEQ ID NO: 8468959 - DNA, 22 bp, Homo sapiens
tacatttcagagctcctctctg

SEQ ID NO: 8468960 - DNA, 22 bp, Homo sapiens
caggccttttttcctgcagtgt

SEQ ID NO: 8468961 - DNA, 22 bp, Homo sapiens
caggcggccatgatctggcagg

SEQ ID NO: 8468962 - DNA, 22 bp, Homo sapiens
caggccttgtcaagaaaatgcc

SEQ ID NO: 8468963 - DNA, 18 bp, Homo sapiens
caggcctttgagacagaa

SEQ ID NO: 8468964 - DNA, 18 bp, Homo sapiens
caggcctttgagacagaa

SEQ ID NO: 8468965 - DNA, 22 bp, Homo sapiens
caggcctttgcacgtgcagttg

SEQ ID NO: 8468966 - DNA, 22 bp, Homo sapiens
caggcctttgcagggagagaga

SEQ ID NO: 8468967 - DNA, 22 bp, Homo sapiens
caggcctgcaggaaaggctccc

SEQ ID NO: 8468968 - DNA, 19 bp, Homo sapiens
tacattgctggtggggatg

SEQ ID NO: 8468969 - DNA, 22 bp, Homo sapiens
tacattgctttctaatacatct

SEQ ID NO: 8468970 - DNA, 20 bp, Homo sapiens
tacattgtagaaatattcaa

SEQ ID NO: 8468971 - DNA, 22 bp, Homo sapiens
caggcctgcttcttacccttca

SEQ ID NO: 8468972 - DNA, 22 bp, Homo sapiens
tacatgttcaaatttgtctttc

SEQ ID NO: 8468973 - DNA, 22 bp, Homo sapiens
caggcctgcaggaaaggctccc

SEQ ID NO: 8468974 - DNA, 22 bp, Homo sapiens
caggcctgcaggaaaggctccc

SEQ ID NO: 8468975 - DNA, 22 bp, Homo sapiens
caggcctgagtgtggaagtctt

SEQ ID NO: 8468976 - DNA, 22 bp, Homo sapiens
caggcctgagtgtggaagtctt

SEQ ID NO: 8468977 - DNA, 18 bp, Homo sapiens
caggcctcttgatcttcc

SEQ ID NO: 8468978 - DNA, 19 bp, Homo sapiens
caggcctcttaccctctct

SEQ ID NO: 8468979 - DNA, 22 bp, Homo sapiens
caggcctcttccatgcagcagc

SEQ ID NO: 8468980 - DNA, 22 bp, Homo sapiens
caggcctgagacatctgagata

SEQ ID NO: 8468981 - DNA, 22 bp, Homo sapiens
caggcctgaccctgagcttcac

SEQ ID NO: 8468982 - DNA, 22 bp, Homo sapiens
caggcctgaccctgagcttcac

SEQ ID NO: 8468983 - DNA, 22 bp, Homo sapiens
caggcctcctatgagcactagc

SEQ ID NO: 8468984 - DNA, 22 bp, Homo sapiens
caggcctctatggtcagctgag

SEQ ID NO: 8468985 - DNA, 22 bp, Homo sapiens
caggcctctatggtcagctgag

SEQ ID NO: 8468986 - DNA, 19 bp, Homo sapiens
caggcctctggtctgctgt

SEQ ID NO: 8468987 - DNA, 22 bp, Homo sapiens
caggcctctccttagtctggca

SEQ ID NO: 8468988 - DNA, 22 bp, Homo sapiens
caggcctcctatgagcactagc

SEQ ID NO: 8468989 - DNA, 22 bp, Homo sapiens
caggcccagcccttagccaggt

SEQ ID NO: 8468990 - DNA, 22 bp, Homo sapiens
caggcccagcccttagccaggt

SEQ ID NO: 8468991 - DNA, 22 bp, Homo sapiens
caggcccagaggcctcttccca

SEQ ID NO: 8468992 - DNA, 22 bp, Homo sapiens
caggctgccaaggctggggagg

SEQ ID NO: 8468993 - DNA, 22 bp, Homo sapiens
caggctgccaaggctggggagg

SEQ ID NO: 8468994 - DNA, 22 bp, Homo sapiens
caggctgcagtgcagtggctat

SEQ ID NO: 8468995 - DNA, 22 bp, Homo sapiens
caggctgcatggaggggtacag

SEQ ID NO: 8468996 - DNA, 22 bp, Homo sapiens
caggctgcagtgcagtggctat

SEQ ID NO: 8468997 - DNA, 22 bp, Homo sapiens
caggctgccgtgaagcaggcct

SEQ ID NO: 8468998 - DNA, 22 bp, Homo sapiens
caggctgccctagcttggacat

SEQ ID NO: 8468999 - DNA, 22 bp, Homo sapiens
caggctgccctagcttggacat

SEQ ID NO: 8469000 - DNA, 22 bp, Homo sapiens
caggctgccgaggctgcagaat

SEQ ID NO: 8469001 - DNA, 22 bp, Homo sapiens
caggctgccgaggctgcagaat

SEQ ID NO: 8469002 - DNA, 22 bp, Homo sapiens
caggctgccgaggctgcagaat

SEQ ID NO: 8469003 - DNA, 22 bp, Homo sapiens
caggctgccgtggggtccaggc

SEQ ID NO: 8469004 - DNA, 22 bp, Homo sapiens
caggctgccgtggggtccaggc

SEQ ID NO: 8469005 - DNA, 22 bp, Homo sapiens
caggctgccgtgaagcaggcct

SEQ ID NO: 8469006 - DNA, 22 bp, Homo sapiens
caggctggagtgcagtggtgcc

SEQ ID NO: 8469007 - DNA, 22 bp, Homo sapiens
caggctggagttcagtggtgtg

SEQ ID NO: 8469008 - DNA, 22 bp, Homo sapiens
caggctggagttcagtggtgtg

SEQ ID NO: 8469009 - DNA, 22 bp, Homo sapiens
caggctggagttcagtggtgtg

SEQ ID NO: 8469010 - DNA, 22 bp, Homo sapiens
caggctggcaatgcgtcaagca

SEQ ID NO: 8469011 - DNA, 22 bp, Homo sapiens
caggctggcaatgcgtcaagca

SEQ ID NO: 8469012 - DNA, 22 bp, Homo sapiens
caggctggcaatgcgtcaagca

SEQ ID NO: 8469013 - DNA, 22 bp, Homo sapiens
caggctggagttcagtggtgtg

SEQ ID NO: 8469014 - DNA, 22 bp, Homo sapiens
caggctggcaatgcgtcaagca

SEQ ID NO: 8469015 - DNA, 22 bp, Homo sapiens
caggctgggaacgccacccgct

SEQ ID NO: 8469016 - DNA, 22 bp, Homo sapiens
caggctgggaacgccacccgct

SEQ ID NO: 8469017 - DNA, 22 bp, Homo sapiens
caggctgggactgacccctgct

SEQ ID NO: 8469018 - DNA, 22 bp, Homo sapiens
caggctgggactgacccctgct

SEQ ID NO: 8469019 - DNA, 22 bp, Homo sapiens
caggctgggactgacccctgct

SEQ ID NO: 8469020 - DNA, 22 bp, Homo sapiens
tagaaaatgttccactgccatt

SEQ ID NO: 8469021 - DNA, 22 bp, Homo sapiens
caggcttgtgtctcagctgcag

SEQ ID NO: 8469022 - DNA, 22 bp, Homo sapiens
caggctttactttctctctgaa

SEQ ID NO: 8469023 - DNA, 22 bp, Homo sapiens
caggcttgtgtctcagctgcag

SEQ ID NO: 8469024 - DNA, 22 bp, Homo sapiens
caggcttgtgtctcagctgcag

SEQ ID NO: 8469025 - DNA, 22 bp, Homo sapiens
caggcttgggagcagagccact

SEQ ID NO: 8469026 - DNA, 22 bp, Homo sapiens
caggcttgggagcagagccact

SEQ ID NO: 8469027 - DNA, 22 bp, Homo sapiens
caggcttgggttctctgagtta

SEQ ID NO: 8469028 - DNA, 22 bp, Homo sapiens
caggcttggcagggaggctggt

SEQ ID NO: 8469029 - DNA, 22 bp, Homo sapiens
caggcttggcagggaggctggt

SEQ ID NO: 8469030 - DNA, 22 bp, Homo sapiens
caggcttggcagggaggctggt

SEQ ID NO: 8469031 - DNA, 22 bp, Homo sapiens
caggcttggagggcagtggcat

SEQ ID NO: 8469032 - DNA, 22 bp, Homo sapiens
caggcttggagggcagtggcat

SEQ ID NO: 8469033 - DNA, 22 bp, Homo sapiens
tagaaacaaagacctgggtgct

SEQ ID NO: 8469034 - DNA, 22 bp, Homo sapiens
tagaaacaaagacctgggtgct

SEQ ID NO: 8469035 - DNA, 22 bp, Homo sapiens
caggctttttctgctgtcctct

SEQ ID NO: 8469036 - DNA, 22 bp, Homo sapiens
caggcttttgcatagcactggg

SEQ ID NO: 8469037 - DNA, 22 bp, Homo sapiens
cagggacaatggcagagcctga

SEQ ID NO: 8469038 - DNA, 22 bp, Homo sapiens
cagggacagcactaaactcttg

SEQ ID NO: 8469039 - DNA, 22 bp, Homo sapiens
cagggacagcactaaactcttg

SEQ ID NO: 8469040 - DNA, 22 bp, Homo sapiens
cagggacagagactgcaccttg

SEQ ID NO: 8469041 - DNA, 22 bp, Homo sapiens
tagattcttagtttcatagaat

SEQ ID NO: 8469042 - DNA, 22 bp, Homo sapiens
tagattctactgtcacttagtt

SEQ ID NO: 8469043 - DNA, 22 bp, Homo sapiens
tagattctactgtcacttagtt

SEQ ID NO: 8469044 - DNA, 22 bp, Homo sapiens
tagattctggagagacagcagt

SEQ ID NO: 8469045 - DNA, 22 bp, Homo sapiens
tagattctcccatcatgagatg

SEQ ID NO: 8469046 - DNA, 22 bp, Homo sapiens
tttcacaaagcatagcacttta

SEQ ID NO: 8469047 - DNA, 22 bp, Homo sapiens
ctcctggccctgagctcccagg

SEQ ID NO: 8469048 - DNA, 21 bp, Homo sapiens
tttcaatgtgttctttgtagt

SEQ ID NO: 8469049 - DNA, 22 bp, Homo sapiens
tttcaatgtatgtctttctgag

SEQ ID NO: 8469050 - DNA, 22 bp, Homo sapiens
tttcaatgtaacatttccaggc

SEQ ID NO: 8469051 - DNA, 22 bp, Homo sapiens
tttcctaaggtagtgataattt

SEQ ID NO: 8469052 - DNA, 20 bp, Homo sapiens
tttccactgtaatgtatgat

SEQ ID NO: 8469053 - DNA, 22 bp, Homo sapiens
tttcacataaatggagtaaaga

SEQ ID NO: 8469054 - DNA, 22 bp, Homo sapiens
tttcacatacagtgtatagtag

SEQ ID NO: 8469055 - DNA, 22 bp, Homo sapiens
tttcacagtcaatttggagtca

SEQ ID NO: 8469056 - DNA, 22 bp, Homo sapiens
tttcacagtgctctgtaagtat

SEQ ID NO: 8469057 - DNA, 22 bp, Homo sapiens
tttcctcacacagaagatcttg

SEQ ID NO: 8469058 - DNA, 22 bp, Homo sapiens
tttcctcaactgtcaaatgggg

SEQ ID NO: 8469059 - DNA, 22 bp, Homo sapiens
tttcctagttctaagaaatgta

SEQ ID NO: 8469060 - DNA, 22 bp, Homo sapiens
tttcctcactcatgtcatcagt

SEQ ID NO: 8469061 - DNA, 22 bp, Homo sapiens
tttcctcactcatgtcatcagt

SEQ ID NO: 8469062 - DNA, 22 bp, Homo sapiens
ctctccaggctgggacaggacc

SEQ ID NO: 8469063 - DNA, 22 bp, Homo sapiens
ctctccagggaagcagtgtact

SEQ ID NO: 8469064 - DNA, 22 bp, Homo sapiens
ctctccagggaagcagtgtact

SEQ ID NO: 8469065 - DNA, 22 bp, Homo sapiens
ctctccaggcgaggtcctactg

SEQ ID NO: 8469066 - DNA, 22 bp, Homo sapiens
ctctccaggcgaggtcctactg

SEQ ID NO: 8469067 - DNA, 22 bp, Homo sapiens
ctctccaggagctcagagtcta

SEQ ID NO: 8469068 - DNA, 22 bp, Homo sapiens
ctctccaggagctcagagtcta

SEQ ID NO: 8469069 - DNA, 22 bp, Homo sapiens
ctctccaggggtagatgccttc

SEQ ID NO: 8469070 - DNA, 22 bp, Homo sapiens
ctctccaggggtagatgccttc

SEQ ID NO: 8469071 - DNA, 22 bp, Homo sapiens
ctctccagggcatgagttccac

SEQ ID NO: 8469072 - DNA, 22 bp, Homo sapiens
ctctccagggcatgagttccac

SEQ ID NO: 8469073 - DNA, 22 bp, Homo sapiens
ctctccaggggaacattgttcc

SEQ ID NO: 8469074 - DNA, 22 bp, Homo sapiens
ctctccagtcatattctcagtc

SEQ ID NO: 8469075 - DNA, 22 bp, Homo sapiens
ctctcctggtgtggaggacagg

SEQ ID NO: 8469076 - DNA, 22 bp, Homo sapiens
ctctcctggtgtggaggacagg

SEQ ID NO: 8469077 - DNA, 22 bp, Homo sapiens
ctctccaggttagagcacttat

SEQ ID NO: 8469078 - DNA, 22 bp, Homo sapiens
ctctccagtcaggaactctgac

SEQ ID NO: 8469079 - DNA, 22 bp, Homo sapiens
ctctctgctgtatccttaggct

SEQ ID NO: 8469080 - DNA, 22 bp, Homo sapiens
ctctctgaggcaggcctgtggg

SEQ ID NO: 8469081 - DNA, 22 bp, Homo sapiens
ctctctgagtggctgtactttc

SEQ ID NO: 8469082 - DNA, 22 bp, Homo sapiens
ctctctgatgtcaggtcgctga

SEQ ID NO: 8469083 - DNA, 22 bp, Homo sapiens
tttccttgcctcctgtccttct

SEQ ID NO: 8469084 - DNA, 22 bp, Homo sapiens
ctctctggaagggggagctgat

SEQ ID NO: 8469085 - DNA, 22 bp, Homo sapiens
tttagtctaataaaagtggagt

SEQ ID NO: 8469086 - DNA, 22 bp, Homo sapiens
tttagtatataaaaagagaagt

SEQ ID NO: 8469087 - DNA, 22 bp, Homo sapiens
tttagtatgtatttaatggact

SEQ ID NO: 8469088 - DNA, 22 bp, Homo sapiens
ctcctccacagacctactgaat

SEQ ID NO: 8469089 - DNA, 22 bp, Homo sapiens
ctcctccacagagtccttgcca

SEQ ID NO: 8469090 - DNA, 22 bp, Homo sapiens
ctcctccacagagtccttgcca

SEQ ID NO: 8469091 - DNA, 22 bp, Homo sapiens
ctcctccacagagtccttgcca

SEQ ID NO: 8469092 - DNA, 18 bp, Homo sapiens
ctcctccacagcccctgc

SEQ ID NO: 8469093 - DNA, 22 bp, Homo sapiens
tttagtatataaaaagagaagt

SEQ ID NO: 8469094 - DNA, 22 bp, Homo sapiens
tttagtagaatagtatatcaaa

SEQ ID NO: 8469095 - DNA, 22 bp, Homo sapiens
tttaggttcttggaatcagtct

SEQ ID NO: 8469096 - DNA, 23 bp, Homo sapiens
ctccccagtgtcctcatgcatct

SEQ ID NO: 8469097 - DNA, 22 bp, Homo sapiens
tttaatcaggcaaagcataata

SEQ ID NO: 8469098 - DNA, 22 bp, Homo sapiens
tttaatcataagaaggaaaata

SEQ ID NO: 8469099 - DNA, 22 bp, Homo sapiens
tttaatcataagaaggaaaata

SEQ ID NO: 8469100 - DNA, 17 bp, Homo sapiens
ctcccccccacgtgtcc

SEQ ID NO: 8469101 - DNA, 22 bp, Homo sapiens
ctccccgagagaggttgtccgc

SEQ ID NO: 8469102 - DNA, 22 bp, Homo sapiens
ctccccatccaggcagcaggtg

SEQ ID NO: 8469103 - DNA, 22 bp, Homo sapiens
ctcccctccttaggtcttctag

SEQ ID NO: 8469104 - DNA, 22 bp, Homo sapiens
ctcccctgagcatagactctgt

SEQ ID NO: 8469105 - DNA, 22 bp, Homo sapiens
ctccccttccgccagctcttga

SEQ ID NO: 8469106 - DNA, 22 bp, Homo sapiens
ctccccttcttgccagatcctt

SEQ ID NO: 8469107 - DNA, 22 bp, Homo sapiens
ctcccctttggaagaagggtct

SEQ ID NO: 8469108 - DNA, 22 bp, Homo sapiens
ctcccggcacttggcatgtcat

SEQ ID NO: 8469109 - DNA, 22 bp, Homo sapiens
ctcctggcactcagtgtggaag

SEQ ID NO: 8469110 - DNA, 22 bp, Homo sapiens
ctcctggatgcaggctgtctgc

SEQ ID NO: 8469111 - DNA, 22 bp, Homo sapiens
tttatttaccttatgtcctcca

SEQ ID NO: 8469112 - DNA, 16 bp, Homo sapiens
tttatttactagtgtt

SEQ ID NO: 8469113 - DNA, 22 bp, Homo sapiens
tttatttaaagtcgtgtgttaa

SEQ ID NO: 8469114 - DNA, 22 bp, Homo sapiens
tttatttaaagtcgtgtgttaa

SEQ ID NO: 8469115 - DNA, 22 bp, Homo sapiens
tttatttaccttatgtcctcca

SEQ ID NO: 8469116 - DNA, 22 bp, Homo sapiens
tttatttaaagtcgtgtgttaa

SEQ ID NO: 8469117 - DNA, 22 bp, Homo sapiens
ctcctggccccagatcccaatc

SEQ ID NO: 8469118 - DNA, 22 bp, Homo sapiens
ctcctggccacgttcttgctgg

SEQ ID NO: 8469119 - DNA, 22 bp, Homo sapiens
ctcctggccacgttcttgctgg

SEQ ID NO: 8469120 - DNA, 22 bp, Homo sapiens
ctcctggccacgttcttgctgg

SEQ ID NO: 8469121 - DNA, 17 bp, Homo sapiens
ctcctggccacccctct

SEQ ID NO: 8469122 - DNA, 17 bp, Homo sapiens
ctcctggccacccctct

SEQ ID NO: 8469123 - DNA, 22 bp, Homo sapiens
ctcctggcactgtcttgaccca

SEQ ID NO: 8469124 - DNA, 22 bp, Homo sapiens
ctcctggcagttccccttgtca

SEQ ID NO: 8469125 - DNA, 22 bp, Homo sapiens
ctcctggcactgtcttgaccca

SEQ ID NO: 8469126 - DNA, 22 bp, Homo sapiens
ctcctggcactgtcttgaccca

SEQ ID NO: 8469127 - DNA, 22 bp, Homo sapiens
ctcctggcagcaacatttatat

SEQ ID NO: 8469128 - DNA, 22 bp, Homo sapiens
ctcctggcaggctgagtgaaat

SEQ ID NO: 8469129 - DNA, 17 bp, Homo sapiens
ctcctggcagcctcagg

SEQ ID NO: 8469130 - DNA, 17 bp, Homo sapiens
ctcctggcagcctcagg

SEQ ID NO: 8469131 - DNA, 17 bp, Homo sapiens
ctcctggcagcctcagg

SEQ ID NO: 8469132 - DNA, 22 bp, Homo sapiens
ctcctccagctctccctggggg

SEQ ID NO: 8469133 - DNA, 22 bp, Homo sapiens
ctcctccagcttccagtggctc

SEQ ID NO: 8469134 - DNA, 22 bp, Homo sapiens
ctcctccagcttccagtggctc

SEQ ID NO: 8469135 - DNA, 22 bp, Homo sapiens
ctcctccacccgctggggccca

SEQ ID NO: 8469136 - DNA, 22 bp, Homo sapiens
ctcctccacccgctggggccca

SEQ ID NO: 8469137 - DNA, 22 bp, Homo sapiens
ctcctccactaggcaaaatgtg

SEQ ID NO: 8469138 - DNA, 22 bp, Homo sapiens
ctcctcccaattgccaagtgct

SEQ ID NO: 8469139 - DNA, 22 bp, Homo sapiens
ctcctccagcttccagtggctc

SEQ ID NO: 8469140 - DNA, 22 bp, Homo sapiens
ctcctccagtcctccaaggaca

SEQ ID NO: 8469141 - DNA, 22 bp, Homo sapiens
tttattgttatcatgggtgagt

SEQ ID NO: 8469142 - DNA, 22 bp, Homo sapiens
tttattgtgttgaaactgaatt

SEQ ID NO: 8469143 - DNA, 22 bp, Homo sapiens
tttattgttgggtcttaagctg

SEQ ID NO: 8469144 - DNA, 22 bp, Homo sapiens
tttattgttgttagtcataagt

SEQ ID NO: 8469145 - DNA, 22 bp, Homo sapiens
ctcccaggccatgctctagcca

SEQ ID NO: 8469146 - DNA, 22 bp, Homo sapiens
tttaagttccttttcaacaact

SEQ ID NO: 8469147 - DNA, 22 bp, Homo sapiens
ctcccaggactggctctaactg

SEQ ID NO: 8469148 - DNA, 22 bp, Homo sapiens
ctcccaggcagggctgcccact

SEQ ID NO: 8469149 - DNA, 22 bp, Homo sapiens
ctcccaggcagggctgcccact

SEQ ID NO: 8469150 - DNA, 22 bp, Homo sapiens
ctcccaggcagggctgcccact

SEQ ID NO: 8469151 - DNA, 22 bp, Homo sapiens
tttaatatccagtggatacaaa

SEQ ID NO: 8469152 - DNA, 22 bp, Homo sapiens
tttaatacagaacttgtcaggg

SEQ ID NO: 8469153 - DNA, 22 bp, Homo sapiens
tttaatagggcccaatgagact

SEQ ID NO: 8469154 - DNA, 22 bp, Homo sapiens
tttaatagggcccaatgagact

SEQ ID NO: 8469155 - DNA, 22 bp, Homo sapiens
tttaatatctcacacttccatg

SEQ ID NO: 8469156 - DNA, 22 bp, Homo sapiens
tttaatatctcacacttccatg

SEQ ID NO: 8469157 - DNA, 22 bp, Homo sapiens
tttaatatccagtggatacaaa

SEQ ID NO: 8469158 - DNA, 22 bp, Homo sapiens
tttaatattctgcattctcctt

SEQ ID NO: 8469159 - DNA, 22 bp, Homo sapiens
ctccatgggggctggcctgtgt

SEQ ID NO: 8469160 - DNA, 22 bp, Homo sapiens
ctcccagaaaattctcagacaa

SEQ ID NO: 8469161 - DNA, 22 bp, Homo sapiens
ctcccagattcctgctgtggga

SEQ ID NO: 8469162 - DNA, 22 bp, Homo sapiens
ctcccagattcctgctgtggga

SEQ ID NO: 8469163 - DNA, 22 bp, Homo sapiens
ctcccagccttcgccagtctga

SEQ ID NO: 8469164 - DNA, 22 bp, Homo sapiens
ctcccagagaccaagctgagaa

SEQ ID NO: 8469165 - DNA, 22 bp, Homo sapiens
ctcccagagaccaagctgagaa

SEQ ID NO: 8469166 - DNA, 22 bp, Homo sapiens
ttgtcttttgtgggaaatatgg

SEQ ID NO: 8469167 - DNA, 22 bp, Homo sapiens
ttgtcttttgtgggaaatatgg

SEQ ID NO: 8469168 - DNA, 22 bp, Homo sapiens
ttgtctttggaaatttaatgtt

SEQ ID NO: 8469169 - DNA, 22 bp, Homo sapiens
ttgtcttttgtgggaaatatgg

SEQ ID NO: 8469170 - DNA, 22 bp, Homo sapiens
ttgtctgtgaaatggaaatagt

SEQ ID NO: 8469171 - DNA, 20 bp, Homo sapiens
ctccagcccctgccctggtc

SEQ ID NO: 8469172 - DNA, 23 bp, Homo sapiens
ttgtatttttagtagagacaggg

SEQ ID NO: 8469173 - DNA, 22 bp, Homo sapiens
ttgtctgtccaggcaccccaag

SEQ ID NO: 8469174 - DNA, 20 bp, Homo sapiens
ctccagcccctgccctggtc

SEQ ID NO: 8469175 - DNA, 22 bp, Homo sapiens
ctccagccagagtgcctctgtt

SEQ ID NO: 8469176 - DNA, 20 bp, Homo sapiens
ctccagcccctgccctggtc

SEQ ID NO: 8469177 - DNA, 22 bp, Homo sapiens
ctccagccagagtgcctctgtt

SEQ ID NO: 8469178 - DNA, 22 bp, Homo sapiens
ctccagccagagtgcctctgtt

SEQ ID NO: 8469179 - DNA, 18 bp, Homo sapiens
ttgtgaaatattggagtc

SEQ ID NO: 8469180 - DNA, 22 bp, Homo sapiens
ttgtgaaatcgtgtttggaagc

SEQ ID NO: 8469181 - DNA, 22 bp, Homo sapiens
ctccagtgcgtcttagtaaacc

SEQ ID NO: 8469182 - DNA, 22 bp, Homo sapiens
ctccagtgcgcaggacagcccc

SEQ ID NO: 8469183 - DNA, 22 bp, Homo sapiens
ctccagtgctcatgccgttgac

SEQ ID NO: 8469184 - DNA, 22 bp, Homo sapiens
ctccatggctttcgcatctgca

SEQ ID NO: 8469185 - DNA, 22 bp, Homo sapiens
ctccatggaaccggggctgctt

SEQ ID NO: 8469186 - DNA, 22 bp, Homo sapiens
ctccatggctttcgcatctgca

SEQ ID NO: 8469187 - DNA, 22 bp, Homo sapiens
ttctttcttagcaatctatggt

SEQ ID NO: 8469188 - DNA, 22 bp, Homo sapiens
ttctttcttagcaatctatggt

SEQ ID NO: 8469189 - DNA, 22 bp, Homo sapiens
ctcacaggttagttgtgtggat

SEQ ID NO: 8469190 - DNA, 22 bp, Homo sapiens
ttcttttaatttctgtctgcag

SEQ ID NO: 8469191 - DNA, 22 bp, Homo sapiens
ttcttttaatttctgtctgcag

SEQ ID NO: 8469192 - DNA, 22 bp, Homo sapiens
ttcttttagaatttcctaaggt

SEQ ID NO: 8469193 - DNA, 22 bp, Homo sapiens
ttcttttagtcattcagggaag

SEQ ID NO: 8469194 - DNA, 22 bp, Homo sapiens
ttcttttagtcattcagggaag

SEQ ID NO: 8469195 - DNA, 22 bp, Homo sapiens
ttcttttacattaagatttcag

SEQ ID NO: 8469196 - DNA, 22 bp, Homo sapiens
ttcttttacattaagatttcag

SEQ ID NO: 8469197 - DNA, 22 bp, Homo sapiens
ttcttttcggcctgtgagaagg

SEQ ID NO: 8469198 - DNA, 22 bp, Homo sapiens
ttcttttcctgtggctcatcca

SEQ ID NO: 8469199 - DNA, 22 bp, Homo sapiens
ttgaaaggtgctgtgtgctgat

SEQ ID NO: 8469200 - DNA, 22 bp, Homo sapiens
ttgaaaggtgaacatgatgcac

SEQ ID NO: 8469201 - DNA, 22 bp, Homo sapiens
ttcttttcccaatattttgctg

SEQ ID NO: 8469202 - DNA, 18 bp, Homo sapiens
ttcttttcatgtgatctc

SEQ ID NO: 8469203 - DNA, 22 bp, Homo sapiens
ttgaaatactgcattgttcagt

SEQ ID NO: 8469204 - DNA, 22 bp, Homo sapiens
ctcatctgtctgggctggtttt

SEQ ID NO: 8469205 - DNA, 22 bp, Homo sapiens
ttgaaatagatgcgtcagagat

SEQ ID NO: 8469206 - DNA, 22 bp, Homo sapiens
ttgaaagtccttcttgagttac

SEQ ID NO: 8469207 - DNA, 22 bp, Homo sapiens
ctcatttacctttgcaatcaag

SEQ ID NO: 8469208 - DNA, 22 bp, Homo sapiens
ctcatttacactatgggaacta

SEQ ID NO: 8469209 - DNA, 22 bp, Homo sapiens
ctcatttaacagattaaaaagt

SEQ ID NO: 8469210 - DNA, 22 bp, Homo sapiens
ctcatttactactcatgtgacc

SEQ ID NO: 8469211 - DNA, 22 bp, Homo sapiens
ctcatttactgtagaacagtta

SEQ ID NO: 8469212 - DNA, 22 bp, Homo sapiens
ctcatttatccaaaagccagtt

SEQ ID NO: 8469213 - DNA, 21 bp, Homo sapiens
ctcatttatttttgtgtccaa

SEQ ID NO: 8469214 - DNA, 22 bp, Homo sapiens
ctccacagctcaggctcagagt

SEQ ID NO: 8469215 - DNA, 22 bp, Homo sapiens
ctccacagcccctccagtggca

SEQ ID NO: 8469216 - DNA, 19 bp, Homo sapiens
ctccacagggattgtgatt

SEQ ID NO: 8469217 - DNA, 22 bp, Homo sapiens
ctccacaggtgtactgtacctt

SEQ ID NO: 8469218 - DNA, 20 bp, Homo sapiens
ctccacacctgttcgcaggc

SEQ ID NO: 8469219 - DNA, 22 bp, Homo sapiens
ctccaatctgggcaacagagca

SEQ ID NO: 8469220 - DNA, 22 bp, Homo sapiens
ctccacagagatgctgattgta

SEQ ID NO: 8469221 - DNA, 22 bp, Homo sapiens
ctccaagtatgttaaaatctaa

SEQ ID NO: 8469222 - DNA, 22 bp, Homo sapiens
ctccaagtccgagggctctcaa

SEQ ID NO: 8469223 - DNA, 18 bp, Homo sapiens
ctccaaggtctctggctt

SEQ ID NO: 8469224 - DNA, 20 bp, Homo sapiens
ctccaaggcttgcaggaggc

SEQ ID NO: 8469225 - DNA, 22 bp, Homo sapiens
ttgtaatttgcaaatgtattgt

SEQ ID NO: 8469226 - DNA, 22 bp, Homo sapiens
ttggtcagctaataaggacagg

SEQ ID NO: 8469227 - DNA, 22 bp, Homo sapiens
ttggtcagctaataaggacagg

SEQ ID NO: 8469228 - DNA, 22 bp, Homo sapiens
ttgtaattaatggcagcaatta

SEQ ID NO: 8469229 - DNA, 22 bp, Homo sapiens
ctccaccacacatctgtccacc

SEQ ID NO: 8469230 - DNA, 22 bp, Homo sapiens
ctccaccacacatctgtccacc

SEQ ID NO: 8469231 - DNA, 22 bp, Homo sapiens
ctccagattcctgctggcagaa

SEQ ID NO: 8469232 - DNA, 22 bp, Homo sapiens
ctccagattccgtttattcagg

SEQ ID NO: 8469233 - DNA, 22 bp, Homo sapiens
ttgtacaacgttttaaatttga

SEQ ID NO: 8469234 - DNA, 22 bp, Homo sapiens
ctctgccatttatcagaactgt

SEQ ID NO: 8469235 - DNA, 22 bp, Homo sapiens
ctctgccatcttggagctcaag

SEQ ID NO: 8469236 - DNA, 22 bp, Homo sapiens
ctctgccatcttggagctcaag

SEQ ID NO: 8469237 - DNA, 22 bp, Homo sapiens
ctctgccatttatcagaactgt

SEQ ID NO: 8469238 - DNA, 21 bp, Homo sapiens
ctctgcccagggcctcctgcc

SEQ ID NO: 8469239 - DNA, 22 bp, Homo sapiens
ctctgccatctcactgggtcct

SEQ ID NO: 8469240 - DNA, 22 bp, Homo sapiens
ctctgccagtttctggcctcag

SEQ ID NO: 8469241 - DNA, 22 bp, Homo sapiens
ctctgccactcgaagtcaagga

SEQ ID NO: 8469242 - DNA, 22 bp, Homo sapiens
tttcctttccaaaattctgcct

SEQ ID NO: 8469243 - DNA, 22 bp, Homo sapiens
tttcctttccaaaattctgcct

SEQ ID NO: 8469244 - DNA, 22 bp, Homo sapiens
ctctgcagaggcccaaggctga

SEQ ID NO: 8469245 - DNA, 20 bp, Homo sapiens
ctctgcagcaaggcctgggt

SEQ ID NO: 8469246 - DNA, 22 bp, Homo sapiens
tttgcaaagtgcttgcagagta

SEQ ID NO: 8469247 - DNA, 22 bp, Homo sapiens
ctctgcccgcggatgccacgtc

SEQ ID NO: 8469248 - DNA, 22 bp, Homo sapiens
ctctgcccgtgcctttcccagt

SEQ ID NO: 8469249 - DNA, 22 bp, Homo sapiens
ctctgcccagtgcccacaggag

SEQ ID NO: 8469250 - DNA, 22 bp, Homo sapiens
ctctgcccagtgcccacaggag

SEQ ID NO: 8469251 - DNA, 21 bp, Homo sapiens
ctctgcccagggcctcctgcc

SEQ ID NO: 8469252 - DNA, 22 bp, Homo sapiens
tttggacaaacagaatagagct

SEQ ID NO: 8469253 - DNA, 22 bp, Homo sapiens
ctctggaaatggccatagtcat

SEQ ID NO: 8469254 - DNA, 22 bp, Homo sapiens
ctctggaatgtttacatgccct

SEQ ID NO: 8469255 - DNA, 22 bp, Homo sapiens
ctctggaattaaggaagcctgt

SEQ ID NO: 8469256 - DNA, 22 bp, Homo sapiens
ctctggaatgggtgtttctaac

SEQ ID NO: 8469257 - DNA, 22 bp, Homo sapiens
ctctggaatgtttacatgccct

SEQ ID NO: 8469258 - DNA, 22 bp, Homo sapiens
tttgggatgctagacacctcag

SEQ ID NO: 8469259 - DNA, 22 bp, Homo sapiens
tttgggattttacattgtatgg

SEQ ID NO: 8469260 - DNA, 18 bp, Homo sapiens
tttgggatcctcttttct

SEQ ID NO: 8469261 - DNA, 22 bp, Homo sapiens
tttgggaattgtagctgtcttg

SEQ ID NO: 8469262 - DNA, 22 bp, Homo sapiens
tttgggaatagcagggactgag

SEQ ID NO: 8469263 - DNA, 22 bp, Homo sapiens
tttgggaagtgggagcaaggtg

SEQ ID NO: 8469264 - DNA, 22 bp, Homo sapiens
tttgggaagaggaatctctgga

SEQ ID NO: 8469265 - DNA, 19 bp, Homo sapiens
tttgggaagcccagagtgt

SEQ ID NO: 8469266 - DNA, 22 bp, Homo sapiens
ctctggaaaaccactagcagga

SEQ ID NO: 8469267 - DNA, 22 bp, Homo sapiens
tttgcgtctatgtgtgagcctt

SEQ ID NO: 8469268 - DNA, 22 bp, Homo sapiens
tttgcctgattctaagagctca

SEQ ID NO: 8469269 - DNA, 21 bp, Homo sapiens
tttgccttcacgaagcatcct

SEQ ID NO: 8469270 - DNA, 22 bp, Homo sapiens
tttgcctgattctaagagctca

SEQ ID NO: 8469271 - DNA, 22 bp, Homo sapiens
tttgtacactgtctactatgaa

SEQ ID NO: 8469272 - DNA, 22 bp, Homo sapiens
tttgtacacctacctaatacag

SEQ ID NO: 8469273 - DNA, 22 bp, Homo sapiens
ttttagaatcaggttgtctggg

SEQ ID NO: 8469274 - DNA, 22 bp, Homo sapiens
ttttagatagtttaactgcact

SEQ ID NO: 8469275 - DNA, 20 bp, Homo sapiens
ttttagcacttgttatggtg

SEQ ID NO: 8469276 - DNA, 22 bp, Homo sapiens
ttttagcactaagtgatatgct

SEQ ID NO: 8469277 - DNA, 22 bp, Homo sapiens
ttttagctgttgattgttcccc

SEQ ID NO: 8469278 - DNA, 22 bp, Homo sapiens
ttttagcactaagtgatatgct

SEQ ID NO: 8469279 - DNA, 22 bp, Homo sapiens
ttttaatactgctattgtagga

SEQ ID NO: 8469280 - DNA, 23 bp, Homo sapiens
ttttagtgactcctttatctgcc

SEQ ID NO: 8469281 - DNA, 22 bp, Homo sapiens
ctctgttacagccccctgcctc

SEQ ID NO: 8469282 - DNA, 22 bp, Homo sapiens
ctctgttgtcagtggaagcagc

SEQ ID NO: 8469283 - DNA, 22 bp, Homo sapiens
ctcttattttatggcatttgtg

SEQ ID NO: 8469284 - DNA, 22 bp, Homo sapiens
ctcttattgatgaaggtgctaa

SEQ ID NO: 8469285 - DNA, 22 bp, Homo sapiens
ctcttcagtaaatgacactgtt

SEQ ID NO: 8469286 - DNA, 22 bp, Homo sapiens
ctctttaagctcctaacagcca

SEQ ID NO: 8469287 - DNA, 21 bp, Homo sapiens
ctcttgtctttgctcagtagc

SEQ ID NO: 8469288 - DNA, 22 bp, Homo sapiens
ttttcagttactgtttatgtga

SEQ ID NO: 8469289 - DNA, 18 bp, Homo sapiens
ctctttctttggcacaaa

SEQ ID NO: 8469290 - DNA, 22 bp, Homo sapiens
ctctttgaaatccatcactgct

SEQ ID NO: 8469291 - DNA, 22 bp, Homo sapiens
ctctttctgattcgctgggacc

SEQ ID NO: 8469292 - DNA, 22 bp, Homo sapiens
ctctttggagaagcacgtatta

SEQ ID NO: 8469293 - DNA, 22 bp, Homo sapiens
ctctttggatgtttatgataag

SEQ ID NO: 8469294 - DNA, 22 bp, Homo sapiens
ctctttggatagaattacaaag

SEQ ID NO: 8469295 - DNA, 19 bp, Homo sapiens
ctctttggagatccttgga

SEQ ID NO: 8469296 - DNA, 17 bp, Homo sapiens
ctctttataaagagtta

SEQ ID NO: 8469297 - DNA, 21 bp, Homo sapiens
ctctttatatagtaaagatat

SEQ ID NO: 8469298 - DNA, 22 bp, Homo sapiens
ctctttctcgccgcccgcagtc

SEQ ID NO: 8469299 - DNA, 22 bp, Homo sapiens
ctctttctcattgtcagcagaa

SEQ ID NO: 8469300 - DNA, 22 bp, Homo sapiens
ctgaatattagtcatgtctgat

SEQ ID NO: 8469301 - DNA, 22 bp, Homo sapiens
ctgacagggtagacagagggca

SEQ ID NO: 8469302 - DNA, 22 bp, Homo sapiens
ctgaccagggtagaggtgagag

SEQ ID NO: 8469303 - DNA, 22 bp, Homo sapiens
ctgaccagaccccaggaggctg

SEQ ID NO: 8469304 - DNA, 22 bp, Homo sapiens
ctgaccaacatggtgaaacctt

SEQ ID NO: 8469305 - DNA, 22 bp, Homo sapiens
ctgacatgtataagctttaagt

SEQ ID NO: 8469306 - DNA, 22 bp, Homo sapiens
ctgacaggttggtagctttgga

SEQ ID NO: 8469307 - DNA, 22 bp, Homo sapiens
ctgaggcagagggcagaccaga

SEQ ID NO: 8469308 - DNA, 22 bp, Homo sapiens
ctgaggcagagggcagaccaga

SEQ ID NO: 8469309 - DNA, 21 bp, Homo sapiens
ctgaggcatgcaggcctgggc

SEQ ID NO: 8469310 - DNA, 22 bp, Homo sapiens
ctgaggcagagggcagaccaga

SEQ ID NO: 8469311 - DNA, 22 bp, Homo sapiens
ctgagcctcctgcttctatttc

SEQ ID NO: 8469312 - DNA, 22 bp, Homo sapiens
ctgagccctctgttttccctct

SEQ ID NO: 8469313 - DNA, 22 bp, Homo sapiens
ctgagccctggctcgcctggag

SEQ ID NO: 8469314 - DNA, 22 bp, Homo sapiens
ctgagccctggctcgcctggag

SEQ ID NO: 8469315 - DNA, 22 bp, Homo sapiens
ctgagcccttgaacccaagtcc

SEQ ID NO: 8469316 - DNA, 22 bp, Homo sapiens
ctgagcccttgaacccaagtcc

SEQ ID NO: 8469317 - DNA, 22 bp, Homo sapiens
ctgagcctccatttcatcaggt

SEQ ID NO: 8469318 - DNA, 19 bp, Homo sapiens
ctgagcctcagtttcctag

SEQ ID NO: 8469319 - DNA, 20 bp, Homo sapiens
ctgagcccagatcccaggtc

SEQ ID NO: 8469320 - DNA, 20 bp, Homo sapiens
ctgagcccagatcccaggtc

SEQ ID NO: 8469321 - DNA, 22 bp, Homo sapiens
ctgagcccaggcgggagctgag

SEQ ID NO: 8469322 - DNA, 20 bp, Homo sapiens
ctgagcccagatcccaggtc

SEQ ID NO: 8469323 - DNA, 22 bp, Homo sapiens
ctgagcccgggtgctctacccc

SEQ ID NO: 8469324 - DNA, 20 bp, Homo sapiens
ctgagcccccagcctgcagg

SEQ ID NO: 8469325 - DNA, 17 bp, Homo sapiens
ctgagccccgggcagct

SEQ ID NO: 8469326 - DNA, 17 bp, Homo sapiens
ctgagccccgggcagct

SEQ ID NO: 8469327 - DNA, 20 bp, Homo sapiens
ctgactctccttggcttgga

SEQ ID NO: 8469328 - DNA, 22 bp, Homo sapiens
ctgactctcctgagatggggag

SEQ ID NO: 8469329 - DNA, 18 bp, Homo sapiens
ctgactcctttgctgcca

SEQ ID NO: 8469330 - DNA, 22 bp, Homo sapiens
ctgactccctccccaaagctgg

SEQ ID NO: 8469331 - DNA, 22 bp, Homo sapiens
ctgagccataagggaggctggg

SEQ ID NO: 8469332 - DNA, 22 bp, Homo sapiens
ctgagccatgagcctgcgccca

SEQ ID NO: 8469333 - DNA, 22 bp, Homo sapiens
ctgagccatgggtctaagcact

SEQ ID NO: 8469334 - DNA, 22 bp, Homo sapiens
ctgagccaaccacagcaggagc

SEQ ID NO: 8469335 - DNA, 22 bp, Homo sapiens
ctgagccagtagtcagggacaa

SEQ ID NO: 8469336 - DNA, 22 bp, Homo sapiens
ctgcagggaggttccttgttct

SEQ ID NO: 8469337 - DNA, 22 bp, Homo sapiens
ctgcagggatgtgaggcccgtt

SEQ ID NO: 8469338 - DNA, 22 bp, Homo sapiens
ctgcagggatgtgaggcccgtt

SEQ ID NO: 8469339 - DNA, 22 bp, Homo sapiens
ctgcagggatgtgaggcccgtt

SEQ ID NO: 8469340 - DNA, 19 bp, Homo sapiens
ctgcagggatgtgcagagt

SEQ ID NO: 8469341 - DNA, 19 bp, Homo sapiens
ctgcagggatgtgcagagt

SEQ ID NO: 8469342 - DNA, 19 bp, Homo sapiens
ctgcagggatgtgcagagt

SEQ ID NO: 8469343 - DNA, 19 bp, Homo sapiens
ctgcagggatgtgcagagt

SEQ ID NO: 8469344 - DNA, 22 bp, Homo sapiens
ctgcagggattgcttctgtata

SEQ ID NO: 8469345 - DNA, 22 bp, Homo sapiens
ctgcagggattgcttctgtata

SEQ ID NO: 8469346 - DNA, 22 bp, Homo sapiens
ctgcagggcagaagggcataga

SEQ ID NO: 8469347 - DNA, 22 bp, Homo sapiens
ctgcagggcagggcctcctggc

SEQ ID NO: 8469348 - DNA, 22 bp, Homo sapiens
ctgcagggcagggcctcctggc

SEQ ID NO: 8469349 - DNA, 22 bp, Homo sapiens
ctgcagggcagggcctcctggc

SEQ ID NO: 8469350 - DNA, 22 bp, Homo sapiens
ctgcagggcattgtaactcttt

SEQ ID NO: 8469351 - DNA, 22 bp, Homo sapiens
ctgcagggcattgtaactcttt

SEQ ID NO: 8469352 - DNA, 22 bp, Homo sapiens
ctgcaggggaccaaagtctgac

SEQ ID NO: 8469353 - DNA, 22 bp, Homo sapiens
ctgcaggggaccaaagtctgac

SEQ ID NO: 8469354 - DNA, 22 bp, Homo sapiens
ctgcagggcttaccttgctctg

SEQ ID NO: 8469355 - DNA, 22 bp, Homo sapiens
ctgcagggcttaccttgctctg

SEQ ID NO: 8469356 - DNA, 22 bp, Homo sapiens
ctgcagggcttaccttgctctg

SEQ ID NO: 8469357 - DNA, 22 bp, Homo sapiens
ctgcaggggcagtccacttcct

SEQ ID NO: 8469358 - DNA, 22 bp, Homo sapiens
ctgcaggggcagtccacttcct

SEQ ID NO: 8469359 - DNA, 22 bp, Homo sapiens
ctgcagggcccgcctgagccct

SEQ ID NO: 8469360 - DNA, 22 bp, Homo sapiens
ctgcagggcccgcctgagccct

SEQ ID NO: 8469361 - DNA, 22 bp, Homo sapiens
ctgcagggcccaaggtcaacgg

SEQ ID NO: 8469362 - DNA, 22 bp, Homo sapiens
ctgcagggcccaaggtcaacgg

SEQ ID NO: 8469363 - DNA, 22 bp, Homo sapiens
ctgcagggccatgggttctata

SEQ ID NO: 8469364 - DNA, 22 bp, Homo sapiens
ctgcagggccatgggttctata

SEQ ID NO: 8469365 - DNA, 22 bp, Homo sapiens
ctgcagggcccaaggtcaacgg

SEQ ID NO: 8469366 - DNA, 22 bp, Homo sapiens
ctgcacagtgttggaagctgcc

SEQ ID NO: 8469367 - DNA, 22 bp, Homo sapiens
ctgcaccacagcctgaggcagc

SEQ ID NO: 8469368 - DNA, 22 bp, Homo sapiens
ctgcacccaggcctggtcccag

SEQ ID NO: 8469369 - DNA, 22 bp, Homo sapiens
ctgcaccctcaaactcctgggc

SEQ ID NO: 8469370 - DNA, 22 bp, Homo sapiens
ctgcacccatgagctcaaggga

SEQ ID NO: 8469371 - DNA, 22 bp, Homo sapiens
ctgcaccatctggagcacctcc

SEQ ID NO: 8469372 - DNA, 22 bp, Homo sapiens
ctgcaccatccttcatgctctg

SEQ ID NO: 8469373 - DNA, 22 bp, Homo sapiens
ctgcactgaagaaaggagctct

SEQ ID NO: 8469374 - DNA, 20 bp, Homo sapiens
ctgcactgaacatgtctgag

SEQ ID NO: 8469375 - DNA, 22 bp, Homo sapiens
ctgcaccgtgtctcgggctgcc

SEQ ID NO: 8469376 - DNA, 22 bp, Homo sapiens
ctgcaccctgcaggtacccctg

SEQ ID NO: 8469377 - DNA, 22 bp, Homo sapiens
ctgcactgacttccccggctgc

SEQ ID NO: 8469378 - DNA, 22 bp, Homo sapiens
ctgcactgagctctcccagccc

SEQ ID NO: 8469379 - DNA, 22 bp, Homo sapiens
ctgcaggcatctaactgtgggc

SEQ ID NO: 8469380 - DNA, 22 bp, Homo sapiens
ctgcagggagcagatggcgtgt

SEQ ID NO: 8469381 - DNA, 22 bp, Homo sapiens
ctgcagggagcagatggcgtgt

SEQ ID NO: 8469382 - DNA, 22 bp, Homo sapiens
ctgcacagtggacagtgaagat

SEQ ID NO: 8469383 - DNA, 22 bp, Homo sapiens
ctgcacagtggacagtgaagat

SEQ ID NO: 8469384 - DNA, 22 bp, Homo sapiens
ctgcacagtgggtggggcgtca

SEQ ID NO: 8469385 - DNA, 22 bp, Homo sapiens
ctgcacagggatatggggagct

SEQ ID NO: 8469386 - DNA, 22 bp, Homo sapiens
ctgcacaggggatgagggcagt

SEQ ID NO: 8469387 - DNA, 22 bp, Homo sapiens
ctgcacagctgggcaagatata

SEQ ID NO: 8469388 - DNA, 22 bp, Homo sapiens
ctgcacagctggccagggagag

SEQ ID NO: 8469389 - DNA, 22 bp, Homo sapiens
ctgcacagccctcaagagcctg

SEQ ID NO: 8469390 - DNA, 22 bp, Homo sapiens
ctgcacagcctgtctgggggcc

SEQ ID NO: 8469391 - DNA, 22 bp, Homo sapiens
ctgaggccggagcactgaagag

SEQ ID NO: 8469392 - DNA, 22 bp, Homo sapiens
ctgaggccgtctgggtctgcag

SEQ ID NO: 8469393 - DNA, 20 bp, Homo sapiens
ctgcaaaatgacattaggaa

SEQ ID NO: 8469394 - DNA, 22 bp, Homo sapiens
ctgcaaaattgttctttgctcc

SEQ ID NO: 8469395 - DNA, 21 bp, Homo sapiens
ctgcaaatacctagttatctg

SEQ ID NO: 8469396 - DNA, 22 bp, Homo sapiens
ctgcacacatatggcttctctc

SEQ ID NO: 8469397 - DNA, 22 bp, Homo sapiens
ctgcacagaggtcggtctgcca

SEQ ID NO: 8469398 - DNA, 22 bp, Homo sapiens
ctgaggcatgggaagttgggtg

SEQ ID NO: 8469399 - DNA, 22 bp, Homo sapiens
ctgaggcatgggaagttgggtg

SEQ ID NO: 8469400 - DNA, 22 bp, Homo sapiens
ctgaggcatgttacaggacata

SEQ ID NO: 8469401 - DNA, 22 bp, Homo sapiens
ctgaggcatgttacaggacata

SEQ ID NO: 8469402 - DNA, 22 bp, Homo sapiens
ctgaggccagctgcagagctct

SEQ ID NO: 8469403 - DNA, 22 bp, Homo sapiens
ctgaggccagctgcagagctct

SEQ ID NO: 8469404 - DNA, 18 bp, Homo sapiens
ctgaggccaactacactg

SEQ ID NO: 8469405 - DNA, 22 bp, Homo sapiens
ctgaggccagctgcagagctct

SEQ ID NO: 8469406 - DNA, 18 bp, Homo sapiens
ctgaggcccagagagggc

SEQ ID NO: 8469407 - DNA, 17 bp, Homo sapiens
ctgaggcccagggccca

SEQ ID NO: 8469408 - DNA, 17 bp, Homo sapiens
ctgaggcccagggccca

SEQ ID NO: 8469409 - DNA, 22 bp, Homo sapiens
ctaaatgatattttggtttcct

SEQ ID NO: 8469410 - DNA, 22 bp, Homo sapiens
ttccaggaattcagctctcagt

SEQ ID NO: 8469411 - DNA, 22 bp, Homo sapiens
ttccaggaccaggaagagggga

SEQ ID NO: 8469412 - DNA, 22 bp, Homo sapiens
ctaaatgacaggtaccatagtg

SEQ ID NO: 8469413 - DNA, 22 bp, Homo sapiens
ctaaatctagtctttactgatt

SEQ ID NO: 8469414 - DNA, 22 bp, Homo sapiens
ctaaatcatcatttatgtttgt

SEQ ID NO: 8469415 - DNA, 22 bp, Homo sapiens
ttccaggactcgttctggctca

SEQ ID NO: 8469416 - DNA, 22 bp, Homo sapiens
ttccaggactgggtgtttgaag

SEQ ID NO: 8469417 - DNA, 22 bp, Homo sapiens
ttccaggactcgttctggctca

SEQ ID NO: 8469418 - DNA, 22 bp, Homo sapiens
ttccaggagaggaaacctgatt

SEQ ID NO: 8469419 - DNA, 22 bp, Homo sapiens
ttccaggacttcatggctctga

SEQ ID NO: 8469420 - DNA, 22 bp, Homo sapiens
ttccaggacttcatggctctga

SEQ ID NO: 8469421 - DNA, 22 bp, Homo sapiens
ctacaacattatgctttctgtc

SEQ ID NO: 8469422 - DNA, 22 bp, Homo sapiens
ctacaacatagtcttctacaga

SEQ ID NO: 8469423 - DNA, 22 bp, Homo sapiens
ctacagagaactcagctgccct

SEQ ID NO: 8469424 - DNA, 22 bp, Homo sapiens
ttccaggaggaggtactagagg

SEQ ID NO: 8469425 - DNA, 22 bp, Homo sapiens
ttccaggaggcattcttagttt

SEQ ID NO: 8469426 - DNA, 22 bp, Homo sapiens
ttccaggaggtcaaaggcctgt

SEQ ID NO: 8469427 - DNA, 22 bp, Homo sapiens
ttccaggatagctttcaggaat

SEQ ID NO: 8469428 - DNA, 22 bp, Homo sapiens
ttccaggatggagacactagta

SEQ ID NO: 8469429 - DNA, 22 bp, Homo sapiens
ttccaggatgctgctgcttttt

SEQ ID NO: 8469430 - DNA, 22 bp, Homo sapiens
ttccaggatgctgctgcttttt

SEQ ID NO: 8469431 - DNA, 22 bp, Homo sapiens
ctacagtactggatgctcagcc

SEQ ID NO: 8469432 - DNA, 22 bp, Homo sapiens
ctacaggctcagggagccctct

SEQ ID NO: 8469433 - DNA, 22 bp, Homo sapiens
ctacagccagatgcagaaagtt

SEQ ID NO: 8469434 - DNA, 22 bp, Homo sapiens
ctacagcagagctacactaact

SEQ ID NO: 8469435 - DNA, 22 bp, Homo sapiens
ctacaggaaggatcttgctcaa

SEQ ID NO: 8469436 - DNA, 22 bp, Homo sapiens
ctacagctgtgtgtttatgtgc

SEQ ID NO: 8469437 - DNA, 22 bp, Homo sapiens
ttcctgggactggagcagccca

SEQ ID NO: 8469438 - DNA, 22 bp, Homo sapiens
ttcctggctgtcatgccctagt

SEQ ID NO: 8469439 - DNA, 22 bp, Homo sapiens
ttcctggctggcggttttggtg

SEQ ID NO: 8469440 - DNA, 22 bp, Homo sapiens
ttcctggcttcatactttgtac

SEQ ID NO: 8469441 - DNA, 22 bp, Homo sapiens
ttcctggcttgtcacatctacg

SEQ ID NO: 8469442 - DNA, 22 bp, Homo sapiens
ttcctggcttttgggctaattc

SEQ ID NO: 8469443 - DNA, 22 bp, Homo sapiens
ttcctggctgatctaccaaagt

SEQ ID NO: 8469444 - DNA, 22 bp, Homo sapiens
ttcctggctgaactgaactcct

SEQ ID NO: 8469445 - DNA, 19 bp, Homo sapiens
ttcctggctcttctgtttt

SEQ ID NO: 8469446 - DNA, 22 bp, Homo sapiens
ttcctggctctctgttgcacag

SEQ ID NO: 8469447 - DNA, 22 bp, Homo sapiens
ctacagtctggcaggaatgtta

SEQ ID NO: 8469448 - DNA, 20 bp, Homo sapiens
ttcctggctctaggaccttg

SEQ ID NO: 8469449 - DNA, 22 bp, Homo sapiens
ttcctgggccttaaatcttttg

SEQ ID NO: 8469450 - DNA, 22 bp, Homo sapiens
ttcctgggctctggctggccta

SEQ ID NO: 8469451 - DNA, 22 bp, Homo sapiens
ttcctgggcaggacgagagtct

SEQ ID NO: 8469452 - DNA, 22 bp, Homo sapiens
ttcctgggattattgtcaagca

SEQ ID NO: 8469453 - DNA, 22 bp, Homo sapiens
ttcctgggagctagccacatct

SEQ ID NO: 8469454 - DNA, 22 bp, Homo sapiens
ttcctgggaggctgtgtacttg

SEQ ID NO: 8469455 - DNA, 22 bp, Homo sapiens
ctagaaaaatactttattgtga

SEQ ID NO: 8469456 - DNA, 19 bp, Homo sapiens
ctactttataatatgcctc

SEQ ID NO: 8469457 - DNA, 22 bp, Homo sapiens
ctacttctaagtacatggtgat

SEQ ID NO: 8469458 - DNA, 22 bp, Homo sapiens
ctacttccaggggtggggctca

SEQ ID NO: 8469459 - DNA, 17 bp, Homo sapiens
ctacttcttctattctt

SEQ ID NO: 8469460 - DNA, 22 bp, Homo sapiens
ctacttcttgatctgtcgacct

SEQ ID NO: 8469461 - DNA, 22 bp, Homo sapiens
ctacttctgtgatgaaactaca

SEQ ID NO: 8469462 - DNA, 20 bp, Homo sapiens
ttctctggatagccagatgt

SEQ ID NO: 8469463 - DNA, 20 bp, Homo sapiens
ttctctggatagccagatgt

SEQ ID NO: 8469464 - DNA, 21 bp, Homo sapiens
ttctctggataggccagtcct

SEQ ID NO: 8469465 - DNA, 21 bp, Homo sapiens
ttctctggataggccagtcct

SEQ ID NO: 8469466 - DNA, 22 bp, Homo sapiens
ttctctggagggctgcccggcc

SEQ ID NO: 8469467 - DNA, 22 bp, Homo sapiens
ttctctggagagtatcttctta

SEQ ID NO: 8469468 - DNA, 19 bp, Homo sapiens
ttctctggactagatgctg

SEQ ID NO: 8469469 - DNA, 22 bp, Homo sapiens
ttctctggactatttgcactcc

SEQ ID NO: 8469470 - DNA, 22 bp, Homo sapiens
ctagaaaaatactttattgtga

SEQ ID NO: 8469471 - DNA, 22 bp, Homo sapiens
ctagaaacgcctttagcacaac

SEQ ID NO: 8469472 - DNA, 22 bp, Homo sapiens
ctagaaacattacatgtgttaa

SEQ ID NO: 8469473 - DNA, 22 bp, Homo sapiens
ctagaaaaatactttattgtga

SEQ ID NO: 8469474 - DNA, 22 bp, Homo sapiens
ctactgagtccttcagctgcca

SEQ ID NO: 8469475 - DNA, 22 bp, Homo sapiens
ctactgatgatgttggttgtgg

SEQ ID NO: 8469476 - DNA, 22 bp, Homo sapiens
ctactgatgatgttggttgtgg

SEQ ID NO: 8469477 - DNA, 22 bp, Homo sapiens
ctactgatgctatacttctcag

SEQ ID NO: 8469478 - DNA, 22 bp, Homo sapiens
ctactctgaaaacccagaaact

SEQ ID NO: 8469479 - DNA, 22 bp, Homo sapiens
ctacctggtacatagaaatgtt

SEQ ID NO: 8469480 - DNA, 22 bp, Homo sapiens
ctactgtagtggcctatttacc

SEQ ID NO: 8469481 - DNA, 22 bp, Homo sapiens
ctactgttattattaatagtaa

SEQ ID NO: 8469482 - DNA, 22 bp, Homo sapiens
ctactgttgggagccctggaag

SEQ ID NO: 8469483 - DNA, 22 bp, Homo sapiens
ctactgttgtgttttaaaggta

SEQ ID NO: 8469484 - DNA, 23 bp, Homo sapiens
ctactgccttgcacaggctagat

SEQ ID NO: 8469485 - DNA, 22 bp, Homo sapiens
ctactgatgctatacttctcag

SEQ ID NO: 8469486 - DNA, 21 bp, Homo sapiens
ctaccctcactcccattcctc

SEQ ID NO: 8469487 - DNA, 22 bp, Homo sapiens
ctacccttaagtttctgtgggg

SEQ ID NO: 8469488 - DNA, 22 bp, Homo sapiens
ctacccttgcctgccaggtgac

SEQ ID NO: 8469489 - DNA, 21 bp, Homo sapiens
ttcctggggaaggagctgcct

SEQ ID NO: 8469490 - DNA, 22 bp, Homo sapiens
ctacatttcatccagggagagc

SEQ ID NO: 8469491 - DNA, 22 bp, Homo sapiens
ctacatttcatccagggagagc

SEQ ID NO: 8469492 - DNA, 22 bp, Homo sapiens
ttcctgggctttcccctctggt

SEQ ID NO: 8469493 - DNA, 22 bp, Homo sapiens
ttcctgggctgcagagagcacc

SEQ ID NO: 8469494 - DNA, 22 bp, Homo sapiens
ctagcatcagatgagaagctgt

SEQ ID NO: 8469495 - DNA, 22 bp, Homo sapiens
ctagatttgcatgcctacacca

SEQ ID NO: 8469496 - DNA, 23 bp, Homo sapiens
ctagatgcaagctccatgaggga

SEQ ID NO: 8469497 - DNA, 22 bp, Homo sapiens
ttctctgggaacataaatgaag

SEQ ID NO: 8469498 - DNA, 21 bp, Homo sapiens
ttctctggcttctgtagctgg

SEQ ID NO: 8469499 - DNA, 22 bp, Homo sapiens
ttctctggatgtttctcagtca

SEQ ID NO: 8469500 - DNA, 22 bp, Homo sapiens
ttctctggatgtttctcagtca

SEQ ID NO: 8469501 - DNA, 22 bp, Homo sapiens
ttctctggccatagctggctag

SEQ ID NO: 8469502 - DNA, 22 bp, Homo sapiens
ttctctggcctgaggcgaggcc

SEQ ID NO: 8469503 - DNA, 22 bp, Homo sapiens
ttctctggcgcgctgtgctatg

SEQ ID NO: 8469504 - DNA, 22 bp, Homo sapiens
ttctctggcggtgtgttttcct

SEQ ID NO: 8469505 - DNA, 22 bp, Homo sapiens
ctattaaatactcttcaaattg

SEQ ID NO: 8469506 - DNA, 22 bp, Homo sapiens
ctattacatttctggacattca

SEQ ID NO: 8469507 - DNA, 22 bp, Homo sapiens
ctattacaatctgctactatga

SEQ ID NO: 8469508 - DNA, 22 bp, Homo sapiens
ctattaaatactcttcaaattg

SEQ ID NO: 8469509 - DNA, 22 bp, Homo sapiens
ctatgtttatctgtatttctgt

SEQ ID NO: 8469510 - DNA, 22 bp, Homo sapiens
ctcaaaatccataaaatcaggt

SEQ ID NO: 8469511 - DNA, 22 bp, Homo sapiens
ctattatttcctcatctataaa

SEQ ID NO: 8469512 - DNA, 22 bp, Homo sapiens
ctatttttctgtaccctaattt

SEQ ID NO: 8469513 - DNA, 22 bp, Homo sapiens
ctattagacacaattagtgatt

SEQ ID NO: 8469514 - DNA, 22 bp, Homo sapiens
ctattagaaagcatcttctata

SEQ ID NO: 8469515 - DNA, 22 bp, Homo sapiens
ctcaaggccagttcttctgact

SEQ ID NO: 8469516 - DNA, 20 bp, Homo sapiens
ctcaagtaaggttataaggt

SEQ ID NO: 8469517 - DNA, 22 bp, Homo sapiens
ctcaagtaagaaacagaattgg

SEQ ID NO: 8469518 - DNA, 22 bp, Homo sapiens
ctcaagatcatcaatataccaa

SEQ ID NO: 8469519 - DNA, 22 bp, Homo sapiens
ctcaaggacttattcatgcctg

SEQ ID NO: 8469520 - DNA, 22 bp, Homo sapiens
ctcacagctgcttcaggatcca

SEQ ID NO: 8469521 - DNA, 22 bp, Homo sapiens
ctcacagctgcttcaggatcca

SEQ ID NO: 8469522 - DNA, 22 bp, Homo sapiens
ctcacagcatggaattttctgg

SEQ ID NO: 8469523 - DNA, 22 bp, Homo sapiens
ctcacaggagaaagtcatggtc

SEQ ID NO: 8469524 - DNA, 22 bp, Homo sapiens
ctcacagcagctctgcgagata

SEQ ID NO: 8469525 - DNA, 22 bp, Homo sapiens
ctcacagcacttgtgtcattgg

SEQ ID NO: 8469526 - DNA, 22 bp, Homo sapiens
ctcacagcaaggaggtaaggta

SEQ ID NO: 8469527 - DNA, 22 bp, Homo sapiens
ctcacagcagccagtctgcctt

SEQ ID NO: 8469528 - DNA, 22 bp, Homo sapiens
ctcacagcacttgtgtcattgg

SEQ ID NO: 8469529 - DNA, 22 bp, Homo sapiens
ctcacaggcatctcatcaggct

SEQ ID NO: 8469530 - DNA, 22 bp, Homo sapiens
ctcacagggttctatcgaagag

SEQ ID NO: 8469531 - DNA, 22 bp, Homo sapiens
ctcacaggtcatgtggtggctt

SEQ ID NO: 8469532 - DNA, 22 bp, Homo sapiens
ttcatctgtagtttttccaagg

SEQ ID NO: 8469533 - DNA, 21 bp, Homo sapiens
ttcatctggccgtattccagg

SEQ ID NO: 8469534 - DNA, 22 bp, Homo sapiens
ttcatctggaatttatgttata

SEQ ID NO: 8469535 - DNA, 22 bp, Homo sapiens
ttcatctggaagttcccaaggc

SEQ ID NO: 8469536 - DNA, 22 bp, Homo sapiens
ttcatgaaacttaactgttggg

SEQ ID NO: 8469537 - DNA, 22 bp, Homo sapiens
cgtatacatgaagacattgctg

SEQ ID NO: 8469538 - DNA, 19 bp, Homo sapiens
cggtggcttgcagggaggt

SEQ ID NO: 8469539 - DNA, 21 bp, Homo sapiens
cggtggctcccgggatggctc

SEQ ID NO: 8469540 - DNA, 22 bp, Homo sapiens
cgtagctcacgccccctctccc

SEQ ID NO: 8469541 - DNA, 22 bp, Homo sapiens
cggtccagggaacgcccccgcc

SEQ ID NO: 8469542 - DNA, 22 bp, Homo sapiens
cggtccagagctagttcattgc

SEQ ID NO: 8469543 - DNA, 22 bp, Homo sapiens
cggtccaggatggctggcaagc

SEQ ID NO: 8469544 - DNA, 22 bp, Homo sapiens
cggtcctggcacttgcggctcc

SEQ ID NO: 8469545 - DNA, 22 bp, Homo sapiens
cggtcctgtacttgatgagata

SEQ ID NO: 8469546 - DNA, 22 bp, Homo sapiens
ctaaataatccctctggtctta

SEQ ID NO: 8469547 - DNA, 22 bp, Homo sapiens
ctaaagcaactgagacacatag

SEQ ID NO: 8469548 - DNA, 22 bp, Homo sapiens
ctaaagcaactgagacacatag

SEQ ID NO: 8469549 - DNA, 22 bp, Homo sapiens
ctaaagaagctagcaatctata

SEQ ID NO: 8469550 - DNA, 22 bp, Homo sapiens
ctaaagaattttgcttgaccag

SEQ ID NO: 8469551 - DNA, 22 bp, Homo sapiens
ctaaagaagctagcaatctata

SEQ ID NO: 8469552 - DNA, 22 bp, Homo sapiens
ctaaacttttataacattgaga

SEQ ID NO: 8469553 - DNA, 22 bp, Homo sapiens
ctaaagaagctagcaatctata

SEQ ID NO: 8469554 - DNA, 22 bp, Homo sapiens
ttcatgaatatattgaattagc

SEQ ID NO: 8469555 - DNA, 22 bp, Homo sapiens
ttcatgaaagtgtatcttgtgg

SEQ ID NO: 8469556 - DNA, 22 bp, Homo sapiens
ttcatgaacgaacatatgtata

SEQ ID NO: 8469557 - DNA, 22 bp, Homo sapiens
ttcatgaacgaacatatgtata

SEQ ID NO: 8469558 - DNA, 22 bp, Homo sapiens
ttcatgaagggtgaatatagtc

SEQ ID NO: 8469559 - DNA, 22 bp, Homo sapiens
ttcagaaagtgaatcttgttat

SEQ ID NO: 8469560 - DNA, 22 bp, Homo sapiens
ttcacactttggaattccacct

SEQ ID NO: 8469561 - DNA, 20 bp, Homo sapiens
ttcagagtcagcaaatgcag

SEQ ID NO: 8469562 - DNA, 22 bp, Homo sapiens
ttcagataaactacaaataatt

SEQ ID NO: 8469563 - DNA, 22 bp, Homo sapiens
ttcagatatcattaatttagta

SEQ ID NO: 8469564 - DNA, 22 bp, Homo sapiens
ttcaggcatccctacagttagg

SEQ ID NO: 8469565 - DNA, 22 bp, Homo sapiens
ttcaggcatggaaactggatta

SEQ ID NO: 8469566 - DNA, 22 bp, Homo sapiens
ttcagggcagagagttcaggga

SEQ ID NO: 8469567 - DNA, 22 bp, Homo sapiens
cggggctgtagcacagctgagc

SEQ ID NO: 8469568 - DNA, 22 bp, Homo sapiens
ttcacaatttcccttcatcagg

SEQ ID NO: 8469569 - DNA, 22 bp, Homo sapiens
ttcacacagaatctgaggagct

SEQ ID NO: 8469570 - DNA, 22 bp, Homo sapiens
ttcaagttacctttaaacagct

SEQ ID NO: 8469571 - DNA, 22 bp, Homo sapiens
ttcaagttacctttaaacagct

SEQ ID NO: 8469572 - DNA, 20 bp, Homo sapiens
ttcaagttgggtctctggct

SEQ ID NO: 8469573 - DNA, 22 bp, Homo sapiens
cgcccagggcaggaggccgctc

SEQ ID NO: 8469574 - DNA, 22 bp, Homo sapiens
cgcccagctgaaatctccaggc

SEQ ID NO: 8469575 - DNA, 22 bp, Homo sapiens
cgccggcttgaggcaggcggca

SEQ ID NO: 8469576 - DNA, 22 bp, Homo sapiens
ttcaagtgaggctgtctttaga

SEQ ID NO: 8469577 - DNA, 18 bp, Homo sapiens
cgccctgctataaatgac

SEQ ID NO: 8469578 - DNA, 23 bp, Homo sapiens
cgcccagcctcagtgacctgggc

SEQ ID NO: 8469579 - DNA, 23 bp, Homo sapiens
cgcccagcctcagtgacctgggc

SEQ ID NO: 8469580 - DNA, 22 bp, Homo sapiens
ttaggatttgaaaaggggcaga

SEQ ID NO: 8469581 - DNA, 22 bp, Homo sapiens
ttaggcctttgattggggtgct

SEQ ID NO: 8469582 - DNA, 22 bp, Homo sapiens
ttaggctgggctacaacaactg

SEQ ID NO: 8469583 - DNA, 22 bp, Homo sapiens
cctttctctttgctgatcatgt

SEQ ID NO: 8469584 - DNA, 22 bp, Homo sapiens
ttaggaatgagatttctagtga

SEQ ID NO: 8469585 - DNA, 22 bp, Homo sapiens
ttaggaatcacctgcagatctt

SEQ ID NO: 8469586 - DNA, 22 bp, Homo sapiens
ttaggaatgagatttctagtga

SEQ ID NO: 8469587 - DNA, 22 bp, Homo sapiens
ttaggaatttatcacagactgg

SEQ ID NO: 8469588 - DNA, 22 bp, Homo sapiens
ttaggaatatagactaagtaga

SEQ ID NO: 8469589 - DNA, 22 bp, Homo sapiens
ttaggaatattttctgagtagt

SEQ ID NO: 8469590 - DNA, 22 bp, Homo sapiens
cctttcccgctttgagggcaag

SEQ ID NO: 8469591 - DNA, 22 bp, Homo sapiens
cctttccccgcgggaggtgcca

SEQ ID NO: 8469592 - DNA, 22 bp, Homo sapiens
cctttcaggtacaccagggatg

SEQ ID NO: 8469593 - DNA, 19 bp, Homo sapiens
cctttcagaacagaagcca

SEQ ID NO: 8469594 - DNA, 22 bp, Homo sapiens
cctttcagatgggcatggaccg

SEQ ID NO: 8469595 - DNA, 21 bp, Homo sapiens
tgttacagtccaaatgtttgt

SEQ ID NO: 8469596 - DNA, 22 bp, Homo sapiens
tgttcagttaacacagacacca

SEQ ID NO: 8469597 - DNA, 22 bp, Homo sapiens
tgttcagtccaatgttggaaaa

SEQ ID NO: 8469598 - DNA, 21 bp, Homo sapiens
tgttcagaccaacttggactg

SEQ ID NO: 8469599 - DNA, 22 bp, Homo sapiens
tgttcattaaactactgtgtgg

SEQ ID NO: 8469600 - DNA, 22 bp, Homo sapiens
tgttcagtttgctatcataatc

SEQ ID NO: 8469601 - DNA, 22 bp, Homo sapiens
tgttacaatattatcaactgag

SEQ ID NO: 8469602 - DNA, 22 bp, Homo sapiens
tgttacagaaagtttatgaatg

SEQ ID NO: 8469603 - DNA, 22 bp, Homo sapiens
tgttacagcagaattgaaagag

SEQ ID NO: 8469604 - DNA, 22 bp, Homo sapiens
tgttacaggaaatagaattacc

SEQ ID NO: 8469605 - DNA, 22 bp, Homo sapiens
tgttacagggataaatgaggta

SEQ ID NO: 8469606 - DNA, 22 bp, Homo sapiens
tgttacagtactacaattctgc

SEQ ID NO: 8469607 - DNA, 22 bp, Homo sapiens
tgttacagtactacaattctgc

SEQ ID NO: 8469608 - DNA, 23 bp, Homo sapiens
tgttccagatacgccttttcctc

SEQ ID NO: 8469609 - DNA, 22 bp, Homo sapiens
tgttcattgccccctgtgtaaa

SEQ ID NO: 8469610 - DNA, 22 bp, Homo sapiens
tgttcatttggcccttttgtat

SEQ ID NO: 8469611 - DNA, 22 bp, Homo sapiens
tgttcatttggcccttttgtat

SEQ ID NO: 8469612 - DNA, 22 bp, Homo sapiens
tgttcattagtggaagtaagtt

SEQ ID NO: 8469613 - DNA, 22 bp, Homo sapiens
tgttcattcgctattgtctatg

SEQ ID NO: 8469614 - DNA, 22 bp, Homo sapiens
tgttcattccggggagggctaa

SEQ ID NO: 8469615 - DNA, 22 bp, Homo sapiens
cctggtggaaggtgagtgaggc

SEQ ID NO: 8469616 - DNA, 22 bp, Homo sapiens
cctggtggaaggtgagtgaggc

SEQ ID NO: 8469617 - DNA, 22 bp, Homo sapiens
cctggtggacagcagccagcag

SEQ ID NO: 8469618 - DNA, 22 bp, Homo sapiens
cctgggtgtcatgggcagctgg

SEQ ID NO: 8469619 - DNA, 22 bp, Homo sapiens
cctggtggagaggggcggagcg

SEQ ID NO: 8469620 - DNA, 22 bp, Homo sapiens
cctggtggcgaatggtggtagg

SEQ ID NO: 8469621 - DNA, 22 bp, Homo sapiens
cctggtggccttcagcccacaa

SEQ ID NO: 8469622 - DNA, 22 bp, Homo sapiens
cctggtgggcaggagtgagacc

SEQ ID NO: 8469623 - DNA, 22 bp, Homo sapiens
cctggtgggcaggagtgagacc

SEQ ID NO: 8469624 - DNA, 22 bp, Homo sapiens
cctggtggcttctgggtggacg

SEQ ID NO: 8469625 - DNA, 22 bp, Homo sapiens
cctggtggagaggggcggagcg

SEQ ID NO: 8469626 - DNA, 22 bp, Homo sapiens
cctggtggcgaatggtggtagg

SEQ ID NO: 8469627 - DNA, 22 bp, Homo sapiens
cctggtggcttctgggtggacg

SEQ ID NO: 8469628 - DNA, 22 bp, Homo sapiens
cctggttgagggaggtgtggac

SEQ ID NO: 8469629 - DNA, 22 bp, Homo sapiens
cctggttgtgagttgagttgag

SEQ ID NO: 8469630 - DNA, 22 bp, Homo sapiens
cctggttcagtctttctatgct

SEQ ID NO: 8469631 - DNA, 22 bp, Homo sapiens
tgtttacttcatcgagtacttc

SEQ ID NO: 8469632 - DNA, 22 bp, Homo sapiens
tgtttacttaaatgttttcata

SEQ ID NO: 8469633 - DNA, 22 bp, Homo sapiens
tgtttacttctttccatggctt

SEQ ID NO: 8469634 - DNA, 22 bp, Homo sapiens
tgtttacttgaggtggaaacaa

SEQ ID NO: 8469635 - DNA, 22 bp, Homo sapiens
cctggtttcaggaacataatct

SEQ ID NO: 8469636 - DNA, 22 bp, Homo sapiens
tgtttactggctcctgtggttc

SEQ ID NO: 8469637 - DNA, 22 bp, Homo sapiens
cctgggctgttgcatcatcctt

SEQ ID NO: 8469638 - DNA, 22 bp, Homo sapiens
cctgggcttacgacctctgact

SEQ ID NO: 8469639 - DNA, 22 bp, Homo sapiens
cctgggctgtacctgtgcgcgg

SEQ ID NO: 8469640 - DNA, 21 bp, Homo sapiens
cctgggctgtggtttggagac

SEQ ID NO: 8469641 - DNA, 22 bp, Homo sapiens
cctgggctgggcgtctcatggg

SEQ ID NO: 8469642 - DNA, 22 bp, Homo sapiens
cctgggctgggcgtctcatggg

SEQ ID NO: 8469643 - DNA, 22 bp, Homo sapiens
tgttaatatactaaaatccact

SEQ ID NO: 8469644 - DNA, 22 bp, Homo sapiens
tgtgttctcctacagataagga

SEQ ID NO: 8469645 - DNA, 22 bp, Homo sapiens
tgtgttctgaaggagaagagtg

SEQ ID NO: 8469646 - DNA, 17 bp, Homo sapiens
tgttaattccaatgata

SEQ ID NO: 8469647 - DNA, 22 bp, Homo sapiens
cctgggctgcatgatggcattt

SEQ ID NO: 8469648 - DNA, 22 bp, Homo sapiens
cctgggctgcatgatggcattt

SEQ ID NO: 8469649 - DNA, 22 bp, Homo sapiens
cctgggctgaagtcaagtgtgg

SEQ ID NO: 8469650 - DNA, 22 bp, Homo sapiens
cctgggctgaagtcaagtgtgg

SEQ ID NO: 8469651 - DNA, 22 bp, Homo sapiens
cctgggctctgtcagaattggg

SEQ ID NO: 8469652 - DNA, 16 bp, Homo sapiens
cctgggctctgttgga

SEQ ID NO: 8469653 - DNA, 22 bp, Homo sapiens
cctgggctgctcatggggatga

SEQ ID NO: 8469654 - DNA, 22 bp, Homo sapiens
cctgggctggagtacagcagtg

SEQ ID NO: 8469655 - DNA, 22 bp, Homo sapiens
cctgggctggagtacagcagtg

SEQ ID NO: 8469656 - DNA, 22 bp, Homo sapiens
cctgggctcaagtgatcctcct

SEQ ID NO: 8469657 - DNA, 22 bp, Homo sapiens
cctgggctcaagtgatcctcct

SEQ ID NO: 8469658 - DNA, 22 bp, Homo sapiens
cctgggctctatcctgacccag

SEQ ID NO: 8469659 - DNA, 22 bp, Homo sapiens
cctgggctctatcctgacccag

SEQ ID NO: 8469660 - DNA, 22 bp, Homo sapiens
cctgggctctatcctgacccag

SEQ ID NO: 8469661 - DNA, 22 bp, Homo sapiens
cctgggctctgaggagggagtc

SEQ ID NO: 8469662 - DNA, 22 bp, Homo sapiens
tggggctgtgagactacaggat

SEQ ID NO: 8469663 - DNA, 22 bp, Homo sapiens
tggggctgtgagactacaggat

SEQ ID NO: 8469664 - DNA, 22 bp, Homo sapiens
tggggcagttaataaacattct

SEQ ID NO: 8469665 - DNA, 22 bp, Homo sapiens
tggggctgtccttagtctgaga

SEQ ID NO: 8469666 - DNA, 22 bp, Homo sapiens
tggggcagccacatagacaaca

SEQ ID NO: 8469667 - DNA, 22 bp, Homo sapiens
tggggcagctccatctattcca

SEQ ID NO: 8469668 - DNA, 22 bp, Homo sapiens
tggggcagtggcttttcaccct

SEQ ID NO: 8469669 - DNA, 22 bp, Homo sapiens
tggggcagctccatctattcca

SEQ ID NO: 8469670 - DNA, 22 bp, Homo sapiens
tggggcagggatgggaaactat

SEQ ID NO: 8469671 - DNA, 22 bp, Homo sapiens
tggggcagggatgggaaactat

SEQ ID NO: 8469672 - DNA, 22 bp, Homo sapiens
cctgggagtggcactcacagca

SEQ ID NO: 8469673 - DNA, 22 bp, Homo sapiens
cctgggagtggcactcacagca

SEQ ID NO: 8469674 - DNA, 19 bp, Homo sapiens
cctgggagtcagctgaagg

SEQ ID NO: 8469675 - DNA, 22 bp, Homo sapiens
cctgggagtgtgccatctctgt

SEQ ID NO: 8469676 - DNA, 22 bp, Homo sapiens
cctgggagtgtgccatctctgt

SEQ ID NO: 8469677 - DNA, 22 bp, Homo sapiens
cctgggagtgtcagacttgctt

SEQ ID NO: 8469678 - DNA, 21 bp, Homo sapiens
tgggggagaattggttgcttt

SEQ ID NO: 8469679 - DNA, 21 bp, Homo sapiens
tgggggagaattggttgcttt

SEQ ID NO: 8469680 - DNA, 22 bp, Homo sapiens
tgggggacaccagtctctctct

SEQ ID NO: 8469681 - DNA, 22 bp, Homo sapiens
tgtgtctgcactgagtcctcac

SEQ ID NO: 8469682 - DNA, 22 bp, Homo sapiens
tgtgtctgaactagttgctctc

SEQ ID NO: 8469683 - DNA, 23 bp, Homo sapiens
tgtgtatgtatctatgcataggt

SEQ ID NO: 8469684 - DNA, 22 bp, Homo sapiens
tgtgtatgtaagcatgtgcata

SEQ ID NO: 8469685 - DNA, 22 bp, Homo sapiens
tgtgtattaatgtttgtatatg

SEQ ID NO: 8469686 - DNA, 22 bp, Homo sapiens
tgtgtatgttttgaggttgcta

SEQ ID NO: 8469687 - DNA, 22 bp, Homo sapiens
tgtgtatagatgcatgcatata

SEQ ID NO: 8469688 - DNA, 22 bp, Homo sapiens
cctgggcaaatgccagagacaa

SEQ ID NO: 8469689 - DNA, 22 bp, Homo sapiens
cctgggcaacatagggagaccc

SEQ ID NO: 8469690 - DNA, 22 bp, Homo sapiens
cctgggcaacatagggagaccc

SEQ ID NO: 8469691 - DNA, 22 bp, Homo sapiens
ttagaaaacataagtggtaaag

SEQ ID NO: 8469692 - DNA, 22 bp, Homo sapiens
ttagaaaacataagtggtaaag

SEQ ID NO: 8469693 - DNA, 22 bp, Homo sapiens
ttagaaaacataagtggtaaag

SEQ ID NO: 8469694 - DNA, 22 bp, Homo sapiens
ttagaaaaatgttcagtagttt

SEQ ID NO: 8469695 - DNA, 22 bp, Homo sapiens
ttagaaaaaggctgtggtctta

SEQ ID NO: 8469696 - DNA, 22 bp, Homo sapiens
ttagaaaaaggctgtggtctta

SEQ ID NO: 8469697 - DNA, 22 bp, Homo sapiens
ttagaaaaatgttcagtagttt

SEQ ID NO: 8469698 - DNA, 22 bp, Homo sapiens
ttagaaaaatgttcagtagttt

SEQ ID NO: 8469699 - DNA, 22 bp, Homo sapiens
ttagaagtcatctagtctaaaa

SEQ ID NO: 8469700 - DNA, 22 bp, Homo sapiens
ttagaagtcatctagtctaaaa

SEQ ID NO: 8469701 - DNA, 22 bp, Homo sapiens
ttagaagtacatttagaacata

SEQ ID NO: 8469702 - DNA, 22 bp, Homo sapiens
ttagaaaatggaggtgggaggg

SEQ ID NO: 8469703 - DNA, 22 bp, Homo sapiens
ttagaaaatggaggtgggaggg

SEQ ID NO: 8469704 - DNA, 22 bp, Homo sapiens
ttagaatctaacattcttatct

SEQ ID NO: 8469705 - DNA, 22 bp, Homo sapiens
ttagaatctttagagtctcact

SEQ ID NO: 8469706 - DNA, 22 bp, Homo sapiens
ttagaatcttgtatcagaagtt

SEQ ID NO: 8469707 - DNA, 22 bp, Homo sapiens
ttagaatcaggtgttataatca

SEQ ID NO: 8469708 - DNA, 20 bp, Homo sapiens
ttagaagtggctatttcctc

SEQ ID NO: 8469709 - DNA, 22 bp, Homo sapiens
ttagaatccatggttgcagtgg

SEQ ID NO: 8469710 - DNA, 22 bp, Homo sapiens
ttagaatcagaagagaggtatt

SEQ ID NO: 8469711 - DNA, 22 bp, Homo sapiens
ttagaagttcaggtctgtaatc

SEQ ID NO: 8469712 - DNA, 22 bp, Homo sapiens
ttagaagttcaggtctgtaatc

SEQ ID NO: 8469713 - DNA, 22 bp, Homo sapiens
ttagaagtggtaagtagaaaga

SEQ ID NO: 8469714 - DNA, 22 bp, Homo sapiens
ttagaagtgggcctatagtcct

SEQ ID NO: 8469715 - DNA, 22 bp, Homo sapiens
cctttagaaagtcagtagttgc

SEQ ID NO: 8469716 - DNA, 20 bp, Homo sapiens
cctttagaaactcatatgta

SEQ ID NO: 8469717 - DNA, 22 bp, Homo sapiens
ttagacaatctgttggtaaggt

SEQ ID NO: 8469718 - DNA, 23 bp, Homo sapiens
ttagacaatcctcaaaaggtaat

SEQ ID NO: 8469719 - DNA, 22 bp, Homo sapiens
ttagaatttctgctcactttga

SEQ ID NO: 8469720 - DNA, 21 bp, Homo sapiens
ccttctccacagggtctccgg

SEQ ID NO: 8469721 - DNA, 22 bp, Homo sapiens
ccttccttgtctacaaaagctc

SEQ ID NO: 8469722 - DNA, 22 bp, Homo sapiens
ttactaaggactctaagttcta

SEQ ID NO: 8469723 - DNA, 22 bp, Homo sapiens
ttactacaagattctgttttat

SEQ ID NO: 8469724 - DNA, 22 bp, Homo sapiens
ttactaagttttatgcaactta

SEQ ID NO: 8469725 - DNA, 22 bp, Homo sapiens
ttagaaaaaacgtcttctagtg

SEQ ID NO: 8469726 - DNA, 22 bp, Homo sapiens
ttagaaaaaacgtcttctagtg

SEQ ID NO: 8469727 - DNA, 22 bp, Homo sapiens
ccttcccaggctagaccaacat

SEQ ID NO: 8469728 - DNA, 22 bp, Homo sapiens
ccttcccacattccttacatgc

SEQ ID NO: 8469729 - DNA, 20 bp, Homo sapiens
ccttccccacccgctgaggt

SEQ ID NO: 8469730 - DNA, 22 bp, Homo sapiens
ccttcctggagcccatgcagat

SEQ ID NO: 8469731 - DNA, 22 bp, Homo sapiens
ccttcctggagcccatgcagat

SEQ ID NO: 8469732 - DNA, 22 bp, Homo sapiens
ccttcctggagcccatgcagat

SEQ ID NO: 8469733 - DNA, 22 bp, Homo sapiens
ccttcctggctgtccgcctgat

SEQ ID NO: 8469734 - DNA, 22 bp, Homo sapiens
ccttcctggagcccatgcagat

SEQ ID NO: 8469735 - DNA, 20 bp, Homo sapiens
cctgtgtggccagctgaggc

SEQ ID NO: 8469736 - DNA, 19 bp, Homo sapiens
cctgtgtggggtagagatc

SEQ ID NO: 8469737 - DNA, 22 bp, Homo sapiens
ccttcaggtcatatatgtcaga

SEQ ID NO: 8469738 - DNA, 22 bp, Homo sapiens
cctgtgtctttgcctcagggtc

SEQ ID NO: 8469739 - DNA, 22 bp, Homo sapiens
cctgtgtgctgatgacgacaga

SEQ ID NO: 8469740 - DNA, 22 bp, Homo sapiens
cctgtctctttcaatctgagag

SEQ ID NO: 8469741 - DNA, 22 bp, Homo sapiens
tgtttagaggaactggaatcag

SEQ ID NO: 8469742 - DNA, 22 bp, Homo sapiens
tgtttagaggaactggaatcag

SEQ ID NO: 8469743 - DNA, 22 bp, Homo sapiens
tgtttagactcaaaattgaaag

SEQ ID NO: 8469744 - DNA, 22 bp, Homo sapiens
tgtttactttccttctcacagg

SEQ ID NO: 8469745 - DNA, 22 bp, Homo sapiens
tgtttactggctcctgtggttc

SEQ ID NO: 8469746 - DNA, 22 bp, Homo sapiens
tgtttacttttaattacctgtc

SEQ ID NO: 8469747 - DNA, 22 bp, Homo sapiens
tgtttacttttaattacctgtc

SEQ ID NO: 8469748 - DNA, 22 bp, Homo sapiens
cctgtcagccccacttctgcct

SEQ ID NO: 8469749 - DNA, 22 bp, Homo sapiens
tgtttataaattttcttgccat

SEQ ID NO: 8469750 - DNA, 22 bp, Homo sapiens
cctgtctggccaccagggcgat

SEQ ID NO: 8469751 - DNA, 22 bp, Homo sapiens
cctgtctgtcctctcatgagcc

SEQ ID NO: 8469752 - DNA, 21 bp, Homo sapiens
cctgtcttggactgaggcacc

SEQ ID NO: 8469753 - DNA, 22 bp, Homo sapiens
cctgtcttagggaaagactgga

SEQ ID NO: 8469754 - DNA, 17 bp, Homo sapiens
cctgtcttgtttctgcc

SEQ ID NO: 8469755 - DNA, 22 bp, Homo sapiens
cctgtgacaaacccgcctattc

SEQ ID NO: 8469756 - DNA, 23 bp, Homo sapiens
cctgtgacactgtttgtggtaag

SEQ ID NO: 8469757 - DNA, 22 bp, Homo sapiens
cctgtgaatccatcattatttc

SEQ ID NO: 8469758 - DNA, 18 bp, Homo sapiens
cctgtgacagaggcatca

SEQ ID NO: 8469759 - DNA, 22 bp, Homo sapiens
cctgtgaacttgcatgagtttt

SEQ ID NO: 8469760 - DNA, 23 bp, Homo sapiens
cctgtgacactgtttgtggtaag

SEQ ID NO: 8469761 - DNA, 22 bp, Homo sapiens
cctgtgccatcctgagcatccc

SEQ ID NO: 8469762 - DNA, 22 bp, Homo sapiens
cctgtgccatcctgagcatccc

SEQ ID NO: 8469763 - DNA, 23 bp, Homo sapiens
cctgtctgtgctgggtggacaca

SEQ ID NO: 8469764 - DNA, 23 bp, Homo sapiens
ttaaaggcagatgttgagtatta

SEQ ID NO: 8469765 - DNA, 22 bp, Homo sapiens
ttaaagctggcgttacagtttg

SEQ ID NO: 8469766 - DNA, 22 bp, Homo sapiens
ttaaagctgagccctcagaagc

SEQ ID NO: 8469767 - DNA, 22 bp, Homo sapiens
cctgtgccctctgcatagcagc

SEQ ID NO: 8469768 - DNA, 22 bp, Homo sapiens
cctgtgctcccatagcttctgt

SEQ ID NO: 8469769 - DNA, 18 bp, Homo sapiens
cctgtgctccagcatctg

SEQ ID NO: 8469770 - DNA, 21 bp, Homo sapiens
cctgtgctatcagcttgggtt

SEQ ID NO: 8469771 - DNA, 19 bp, Homo sapiens
cctgtgctaggagctgacc

SEQ ID NO: 8469772 - DNA, 22 bp, Homo sapiens
ttaaatagctcttgtagaagaa

SEQ ID NO: 8469773 - DNA, 22 bp, Homo sapiens
ttaaatagctcttgtagaagaa

SEQ ID NO: 8469774 - DNA, 22 bp, Homo sapiens
cctgtggcttccacgacctaat

SEQ ID NO: 8469775 - DNA, 22 bp, Homo sapiens
ttaaatagctcttgtagaagaa

SEQ ID NO: 8469776 - DNA, 22 bp, Homo sapiens
cctgtgggtcacatgggtgact

SEQ ID NO: 8469777 - DNA, 22 bp, Homo sapiens
cctgtgtcatcagctgtggcta

SEQ ID NO: 8469778 - DNA, 22 bp, Homo sapiens
cctgtgtcagcccctgcctcca

SEQ ID NO: 8469779 - DNA, 22 bp, Homo sapiens
ctgccaccatgccccagcagag

SEQ ID NO: 8469780 - DNA, 22 bp, Homo sapiens
ctgccaccaaatagctgcatga

SEQ ID NO: 8469781 - DNA, 22 bp, Homo sapiens
ctgcatcattttcagacaatgg

SEQ ID NO: 8469782 - DNA, 21 bp, Homo sapiens
ctgccacctgctccatcagca

SEQ ID NO: 8469783 - DNA, 22 bp, Homo sapiens
ctgccactttggagtgctcaga

SEQ ID NO: 8469784 - DNA, 18 bp, Homo sapiens
ctgccacttaatgtggtg

SEQ ID NO: 8469785 - DNA, 22 bp, Homo sapiens
ctgccactttcacccagtgctc

SEQ ID NO: 8469786 - DNA, 22 bp, Homo sapiens
ctgccagacacgttatgctcat

SEQ ID NO: 8469787 - DNA, 22 bp, Homo sapiens
ctgccagaaggttcctgctgca

SEQ ID NO: 8469788 - DNA, 22 bp, Homo sapiens
ctggcaggaagttagatggtaa

SEQ ID NO: 8469789 - DNA, 22 bp, Homo sapiens
ctggcaggaagttagatggtaa

SEQ ID NO: 8469790 - DNA, 22 bp, Homo sapiens
ctggcaggagcattcacagagg

SEQ ID NO: 8469791 - DNA, 22 bp, Homo sapiens
ctggcaggaagaggaaaggtca

SEQ ID NO: 8469792 - DNA, 22 bp, Homo sapiens
ctggcaggaagaggaaaggtca

SEQ ID NO: 8469793 - DNA, 22 bp, Homo sapiens
ctggcagcccaacctagagtct

SEQ ID NO: 8469794 - DNA, 19 bp, Homo sapiens
ctggcagcctgtctgtgtc

SEQ ID NO: 8469795 - DNA, 22 bp, Homo sapiens
ctggcagcttcaggacactcgg

SEQ ID NO: 8469796 - DNA, 22 bp, Homo sapiens
ctggcagcttcaggacactcgg

SEQ ID NO: 8469797 - DNA, 22 bp, Homo sapiens
ctgccagctcaccggctcagac

SEQ ID NO: 8469798 - DNA, 22 bp, Homo sapiens
ctgccagctcaaagcgcagcta

SEQ ID NO: 8469799 - DNA, 22 bp, Homo sapiens
ctgccagctagctcctagttga

SEQ ID NO: 8469800 - DNA, 22 bp, Homo sapiens
ctgccagccaggccaggtaggc

SEQ ID NO: 8469801 - DNA, 22 bp, Homo sapiens
ctgccagctcaaagcgcagcta

SEQ ID NO: 8469802 - DNA, 22 bp, Homo sapiens
ctggcagccaagtgggatactc

SEQ ID NO: 8469803 - DNA, 22 bp, Homo sapiens
ctggcagccaagtgggatactc

SEQ ID NO: 8469804 - DNA, 22 bp, Homo sapiens
ctgccagcagaggccagcgctg

SEQ ID NO: 8469805 - DNA, 22 bp, Homo sapiens
ctgccagcaatgtgaccatgct

SEQ ID NO: 8469806 - DNA, 22 bp, Homo sapiens
ctgccagcaagctaccctggca

SEQ ID NO: 8469807 - DNA, 22 bp, Homo sapiens
ctggccagctgacagcagggct

SEQ ID NO: 8469808 - DNA, 22 bp, Homo sapiens
ctggccagctgacagcagggct

SEQ ID NO: 8469809 - DNA, 22 bp, Homo sapiens
ctggccagcctgtcgatgccct

SEQ ID NO: 8469810 - DNA, 22 bp, Homo sapiens
ctggccagcctgtcgatgccct

SEQ ID NO: 8469811 - DNA, 22 bp, Homo sapiens
ctggccagatgttacgtccaat

SEQ ID NO: 8469812 - DNA, 22 bp, Homo sapiens
ctggccagaggttcctctgccc

SEQ ID NO: 8469813 - DNA, 22 bp, Homo sapiens
ctggcaggcaaattggtgggag

SEQ ID NO: 8469814 - DNA, 22 bp, Homo sapiens
ctggcaggatctaaccagggaa

SEQ ID NO: 8469815 - DNA, 22 bp, Homo sapiens
ctggcaggatctaaccagggaa

SEQ ID NO: 8469816 - DNA, 22 bp, Homo sapiens
ctggcaggatctaaccagggaa

SEQ ID NO: 8469817 - DNA, 22 bp, Homo sapiens
ctggcaggcaaattggtgggag

SEQ ID NO: 8469818 - DNA, 22 bp, Homo sapiens
ctggcaggagctgtggccgtag

SEQ ID NO: 8469819 - DNA, 22 bp, Homo sapiens
ctggcaggagctgtggccgtag

SEQ ID NO: 8469820 - DNA, 22 bp, Homo sapiens
ctggcaggagcattcacagagg

SEQ ID NO: 8469821 - DNA, 22 bp, Homo sapiens
ctggcaggcggaggttgcagtg

SEQ ID NO: 8469822 - DNA, 22 bp, Homo sapiens
ctggcaggcggaggttgcagtg

SEQ ID NO: 8469823 - DNA, 22 bp, Homo sapiens
ctggcaggcggaggttgcagtg

SEQ ID NO: 8469824 - DNA, 22 bp, Homo sapiens
ctggcaggcggaggttgcagtg

SEQ ID NO: 8469825 - DNA, 22 bp, Homo sapiens
ctggcaggcagacttctgcaag

SEQ ID NO: 8469826 - DNA, 22 bp, Homo sapiens
ctggcaggcggcagagcccagg

SEQ ID NO: 8469827 - DNA, 22 bp, Homo sapiens
ctggccctcggagtccagctgc

SEQ ID NO: 8469828 - DNA, 22 bp, Homo sapiens
ctggccctcggagtccagctgc

SEQ ID NO: 8469829 - DNA, 22 bp, Homo sapiens
ctggccctcggagtccagctgc

SEQ ID NO: 8469830 - DNA, 22 bp, Homo sapiens
ctggccctcagactcatgggca

SEQ ID NO: 8469831 - DNA, 22 bp, Homo sapiens
ctggccctcggagtccagctgc

SEQ ID NO: 8469832 - DNA, 22 bp, Homo sapiens
ctggccctggagggctgtgcga

SEQ ID NO: 8469833 - DNA, 22 bp, Homo sapiens
ctggccctgccagagatcaaca

SEQ ID NO: 8469834 - DNA, 22 bp, Homo sapiens
ctggccctgcctaatgtacttg

SEQ ID NO: 8469835 - DNA, 22 bp, Homo sapiens
ctggcccaggtggtcgttgagg

SEQ ID NO: 8469836 - DNA, 22 bp, Homo sapiens
ctggcccagtctcagagtgtca

SEQ ID NO: 8469837 - DNA, 22 bp, Homo sapiens
ctggccctatgagcctcctgat

SEQ ID NO: 8469838 - DNA, 19 bp, Homo sapiens
ctggccaggccaggggccc

SEQ ID NO: 8469839 - DNA, 22 bp, Homo sapiens
ctggccaggccccttgcagggc

SEQ ID NO: 8469840 - DNA, 22 bp, Homo sapiens
ctggctcagggtggtctgggtc

SEQ ID NO: 8469841 - DNA, 22 bp, Homo sapiens
ctggctcaggaaagttgctgct

SEQ ID NO: 8469842 - DNA, 22 bp, Homo sapiens
ctggctcaggaaagttgctgct

SEQ ID NO: 8469843 - DNA, 22 bp, Homo sapiens
ctggctcaggaaagttgctgct

SEQ ID NO: 8469844 - DNA, 22 bp, Homo sapiens
ctggccctggtaaggacaccca

SEQ ID NO: 8469845 - DNA, 22 bp, Homo sapiens
ctggccctggctggagcccagg

SEQ ID NO: 8469846 - DNA, 22 bp, Homo sapiens
ctggccctggctggagcccagg

SEQ ID NO: 8469847 - DNA, 22 bp, Homo sapiens
ctggccctggctggagcccagg

SEQ ID NO: 8469848 - DNA, 23 bp, Homo sapiens
ctggccctggctctgtgatcatg

SEQ ID NO: 8469849 - DNA, 22 bp, Homo sapiens
ctggcctggtctggcctctcca

SEQ ID NO: 8469850 - DNA, 22 bp, Homo sapiens
ctggccctgtaggatgtgagtt

SEQ ID NO: 8469851 - DNA, 22 bp, Homo sapiens
ctggccctgtaggatgtgagtt

SEQ ID NO: 8469852 - DNA, 20 bp, Homo sapiens
ctggctggaaacttagcctt

SEQ ID NO: 8469853 - DNA, 22 bp, Homo sapiens
ctggctggaacgccgaggcggc

SEQ ID NO: 8469854 - DNA, 22 bp, Homo sapiens
ctggctggaagttagagaactt

SEQ ID NO: 8469855 - DNA, 22 bp, Homo sapiens
ctggctgcttgttttgatgggt

SEQ ID NO: 8469856 - DNA, 22 bp, Homo sapiens
ctggctgcttgtagactcgact

SEQ ID NO: 8469857 - DNA, 22 bp, Homo sapiens
ctggctgcttgttttgatgggt

SEQ ID NO: 8469858 - DNA, 22 bp, Homo sapiens
ctggctgtgcagtcttccagaa

SEQ ID NO: 8469859 - DNA, 22 bp, Homo sapiens
ctggctgcgctagtccagaaga

SEQ ID NO: 8469860 - DNA, 22 bp, Homo sapiens
ctggctgcgtctgctctgacag

SEQ ID NO: 8469861 - DNA, 22 bp, Homo sapiens
ctggctgctggcctgaggatgc

SEQ ID NO: 8469862 - DNA, 22 bp, Homo sapiens
ctggctgcgtctgctctgacag

SEQ ID NO: 8469863 - DNA, 22 bp, Homo sapiens
ctggctgcttgtagactcgact

SEQ ID NO: 8469864 - DNA, 22 bp, Homo sapiens
ctggctgcttgggacagccatg

SEQ ID NO: 8469865 - DNA, 22 bp, Homo sapiens
ctggctgcttgggacagccatg

SEQ ID NO: 8469866 - DNA, 22 bp, Homo sapiens
ctggctgctggcctgaggatgc

SEQ ID NO: 8469867 - DNA, 22 bp, Homo sapiens
ctggctgcttgggacagccatg

SEQ ID NO: 8469868 - DNA, 22 bp, Homo sapiens
ctggctgcattggcaagtcaat

SEQ ID NO: 8469869 - DNA, 22 bp, Homo sapiens
ctggctgcattggcaagtcaat

SEQ ID NO: 8469870 - DNA, 22 bp, Homo sapiens
ctggctgccacttcagggtctt

SEQ ID NO: 8469871 - DNA, 22 bp, Homo sapiens
ctggctgccacttcagggtctt

SEQ ID NO: 8469872 - DNA, 22 bp, Homo sapiens
ctggctgccagcatttggggga

SEQ ID NO: 8469873 - DNA, 22 bp, Homo sapiens
ctggctgccagcatttggggga

SEQ ID NO: 8469874 - DNA, 22 bp, Homo sapiens
ctggctgcctatagtctccctt

SEQ ID NO: 8469875 - DNA, 22 bp, Homo sapiens
ctggctgcctggagtgagggag

SEQ ID NO: 8469876 - DNA, 22 bp, Homo sapiens
ctggctgcctggagtgagggag

SEQ ID NO: 8469877 - DNA, 22 bp, Homo sapiens
ctggctgcctggagtgagggag

SEQ ID NO: 8469878 - DNA, 22 bp, Homo sapiens
ctggctgcctatagtctccctt

SEQ ID NO: 8469879 - DNA, 22 bp, Homo sapiens
ctggctcatccaggtgttgctc

SEQ ID NO: 8469880 - DNA, 22 bp, Homo sapiens
ctggctcatagagcagctccaa

SEQ ID NO: 8469881 - DNA, 22 bp, Homo sapiens
ctggctcagttcttggttttca

SEQ ID NO: 8469882 - DNA, 22 bp, Homo sapiens
ctggctcatagagcagctccaa

SEQ ID NO: 8469883 - DNA, 22 bp, Homo sapiens
ctggctcattttagcatcaggt

SEQ ID NO: 8469884 - DNA, 22 bp, Homo sapiens
ctggctcatgtgatgagggcaa

SEQ ID NO: 8469885 - DNA, 22 bp, Homo sapiens
ctggctcatccaggtgttgctc

SEQ ID NO: 8469886 - DNA, 22 bp, Homo sapiens
ctggctcatgtgatgagggcaa

SEQ ID NO: 8469887 - DNA, 22 bp, Homo sapiens
ctggctcttgcgactcagcttg

SEQ ID NO: 8469888 - DNA, 22 bp, Homo sapiens
ctggctccaaattctgatgttc

SEQ ID NO: 8469889 - DNA, 22 bp, Homo sapiens
ctggctgcagtagcaagagact

SEQ ID NO: 8469890 - DNA, 22 bp, Homo sapiens
ctggctgcaggatgaggctgcc

SEQ ID NO: 8469891 - DNA, 22 bp, Homo sapiens
ctggctgcaggatgaggctgcc

SEQ ID NO: 8469892 - DNA, 22 bp, Homo sapiens
ctggctgcaggatgaggctgcc

SEQ ID NO: 8469893 - DNA, 22 bp, Homo sapiens
ctggctgcaggaaggagtgggc

SEQ ID NO: 8469894 - DNA, 22 bp, Homo sapiens
ctggctgcaggaaggagtgggc

SEQ ID NO: 8469895 - DNA, 22 bp, Homo sapiens
ctggctgcaggaaggagtgggc

SEQ ID NO: 8469896 - DNA, 18 bp, Homo sapiens
ctgggccagagtttctgc

SEQ ID NO: 8469897 - DNA, 22 bp, Homo sapiens
ctgggccagaccttgtggtctt

SEQ ID NO: 8469898 - DNA, 22 bp, Homo sapiens
ctgggccagaccttgtggtctt

SEQ ID NO: 8469899 - DNA, 22 bp, Homo sapiens
ctgggccagatccagcctcaca

SEQ ID NO: 8469900 - DNA, 22 bp, Homo sapiens
ctgggctctgcagttgatgttt

SEQ ID NO: 8469901 - DNA, 22 bp, Homo sapiens
ctgggctctaggaaccattcct

SEQ ID NO: 8469902 - DNA, 22 bp, Homo sapiens
ctgggctctgcagttgatgttt

SEQ ID NO: 8469903 - DNA, 22 bp, Homo sapiens
ctgggctgcagcgggagcgacg

SEQ ID NO: 8469904 - DNA, 23 bp, Homo sapiens
ctgggctgcttgagtccctggct

SEQ ID NO: 8469905 - DNA, 22 bp, Homo sapiens
ctgggtctggctactgcttcct

SEQ ID NO: 8469906 - DNA, 22 bp, Homo sapiens
ctgggtctggccacaggaagta

SEQ ID NO: 8469907 - DNA, 22 bp, Homo sapiens
ctgggtctggccacaggaagta

SEQ ID NO: 8469908 - DNA, 22 bp, Homo sapiens
ctgggtctgggcctcctggagt

SEQ ID NO: 8469909 - DNA, 22 bp, Homo sapiens
ctgggtctgggcctcctggagt

SEQ ID NO: 8469910 - DNA, 22 bp, Homo sapiens
ctgggtctggtgtcaggcgacg

SEQ ID NO: 8469911 - DNA, 22 bp, Homo sapiens
ctgggtctggtgtcaggcgacg

SEQ ID NO: 8469912 - DNA, 22 bp, Homo sapiens
ctgggtctggtgtcaggcgacg

SEQ ID NO: 8469913 - DNA, 22 bp, Homo sapiens
ctgggtctccggcagcctcggg

SEQ ID NO: 8469914 - DNA, 22 bp, Homo sapiens
ctgggtctccggcagcctcggg

SEQ ID NO: 8469915 - DNA, 22 bp, Homo sapiens
ctgggtctcttaccatgtgact

SEQ ID NO: 8469916 - DNA, 20 bp, Homo sapiens
ctgggtctccttctgcttaa

SEQ ID NO: 8469917 - DNA, 22 bp, Homo sapiens
ctgggtctccggcagcctcggg

SEQ ID NO: 8469918 - DNA, 22 bp, Homo sapiens
ctgggtctctttagggtgccgt

SEQ ID NO: 8469919 - DNA, 22 bp, Homo sapiens
ctgggtctctttagggtgccgt

SEQ ID NO: 8469920 - DNA, 22 bp, Homo sapiens
ctgggtctggaggccaagggtg

SEQ ID NO: 8469921 - DNA, 22 bp, Homo sapiens
ctgggtctggaggccaagggtg

SEQ ID NO: 8469922 - DNA, 22 bp, Homo sapiens
ctggggctgcagcgatcttcat

SEQ ID NO: 8469923 - DNA, 22 bp, Homo sapiens
ctggggccagtgaggaggcttt

SEQ ID NO: 8469924 - DNA, 22 bp, Homo sapiens
ctggggcccatcgagggctgag

SEQ ID NO: 8469925 - DNA, 22 bp, Homo sapiens
ctggggcattgggagaggcctg

SEQ ID NO: 8469926 - DNA, 22 bp, Homo sapiens
ctggggccctgggtctgccctc

SEQ ID NO: 8469927 - DNA, 22 bp, Homo sapiens
ctggggctcactccagccctgg

SEQ ID NO: 8469928 - DNA, 22 bp, Homo sapiens
ctggggctcactccagccctgg

SEQ ID NO: 8469929 - DNA, 22 bp, Homo sapiens
ctggggctcactccagccctgg

SEQ ID NO: 8469930 - DNA, 23 bp, Homo sapiens
ctggggctcattgcagtagccat

SEQ ID NO: 8469931 - DNA, 22 bp, Homo sapiens
ctggctttaatgtcatctttct

SEQ ID NO: 8469932 - DNA, 22 bp, Homo sapiens
ctggctttaaccctacaaacct

SEQ ID NO: 8469933 - DNA, 22 bp, Homo sapiens
ctggctgtgctgactgagaggg

SEQ ID NO: 8469934 - DNA, 22 bp, Homo sapiens
ctggctttgaaggtctttccta

SEQ ID NO: 8469935 - DNA, 22 bp, Homo sapiens
ctggctttgcgtctttgccaca

SEQ ID NO: 8469936 - DNA, 22 bp, Homo sapiens
ctggctttgaaatgcatttcag

SEQ ID NO: 8469937 - DNA, 22 bp, Homo sapiens
ctggctttgaaggtctttccta

SEQ ID NO: 8469938 - DNA, 22 bp, Homo sapiens
ctggctttaaaatgctcctgga

SEQ ID NO: 8469939 - DNA, 22 bp, Homo sapiens
ctgggaagaaattgtgggaggc

SEQ ID NO: 8469940 - DNA, 22 bp, Homo sapiens
ctgggaagaaattgtgggaggc

SEQ ID NO: 8469941 - DNA, 22 bp, Homo sapiens
ctgggaactgtactgccttgaa

SEQ ID NO: 8469942 - DNA, 22 bp, Homo sapiens
ctgggagctagctctgagctga

SEQ ID NO: 8469943 - DNA, 22 bp, Homo sapiens
ctgggaggattcattgaggtga

SEQ ID NO: 8469944 - DNA, 22 bp, Homo sapiens
ctgggaggattcattgaggtga

SEQ ID NO: 8469945 - DNA, 22 bp, Homo sapiens
ctgggaggcaccgcgtcgtgct

SEQ ID NO: 8469946 - DNA, 22 bp, Homo sapiens
ctgggaggcaccgcgtcgtgct

SEQ ID NO: 8469947 - DNA, 22 bp, Homo sapiens
ctgggaaaactgtgacccctgt

SEQ ID NO: 8469948 - DNA, 22 bp, Homo sapiens
ctggcttttggaggagggtcag

SEQ ID NO: 8469949 - DNA, 22 bp, Homo sapiens
ctgggaaatggcttcgagctca

SEQ ID NO: 8469950 - DNA, 22 bp, Homo sapiens
ctgggaaatataataaagtggt

SEQ ID NO: 8469951 - DNA, 22 bp, Homo sapiens
ctgggaaatataataaagtggt

SEQ ID NO: 8469952 - DNA, 22 bp, Homo sapiens
ctgggaaagtgtgctcccctcc

SEQ ID NO: 8469953 - DNA, 22 bp, Homo sapiens
ctgggaaagcaaggttgtggat

SEQ ID NO: 8469954 - DNA, 22 bp, Homo sapiens
ctgggaaattgacactgataaa

SEQ ID NO: 8469955 - DNA, 22 bp, Homo sapiens
ctgggaacaggcactgctgtca

SEQ ID NO: 8469956 - DNA, 22 bp, Homo sapiens
ctgggaactgtactgccttgaa

SEQ ID NO: 8469957 - DNA, 22 bp, Homo sapiens
ctgggcaggagaggtggttgga

SEQ ID NO: 8469958 - DNA, 22 bp, Homo sapiens
ctgggcaggagggctctatgga

SEQ ID NO: 8469959 - DNA, 22 bp, Homo sapiens
ctgggccactccagatgcccac

SEQ ID NO: 8469960 - DNA, 22 bp, Homo sapiens
ctgggccacatcagatgaagac

SEQ ID NO: 8469961 - DNA, 22 bp, Homo sapiens
ctgggccacatcagatgaagac

SEQ ID NO: 8469962 - DNA, 22 bp, Homo sapiens
ctgggccacatcagatgaagac

SEQ ID NO: 8469963 - DNA, 22 bp, Homo sapiens
ctgggccacaagcctgtgtgat

SEQ ID NO: 8469964 - DNA, 22 bp, Homo sapiens
ctgggccacaagcctgtgtgat

SEQ ID NO: 8469965 - DNA, 22 bp, Homo sapiens
ctgggaggcccacgttgggaag

SEQ ID NO: 8469966 - DNA, 22 bp, Homo sapiens
ctgggaggcccacgttgggaag

SEQ ID NO: 8469967 - DNA, 22 bp, Homo sapiens
ctgggaggcccacgttgggaag

SEQ ID NO: 8469968 - DNA, 22 bp, Homo sapiens
ctgggaggcagtctctctagaa

SEQ ID NO: 8469969 - DNA, 22 bp, Homo sapiens
ctgggaggcggagcttgcagtg

SEQ ID NO: 8469970 - DNA, 22 bp, Homo sapiens
ctgggcaggagaggtggttgga

SEQ ID NO: 8469971 - DNA, 22 bp, Homo sapiens
ctgggaggcactattcaggagg

SEQ ID NO: 8469972 - DNA, 22 bp, Homo sapiens
ctgggaggcactattcaggagg

SEQ ID NO: 8469973 - DNA, 22 bp, Homo sapiens
ctgggaggcactattcaggagg

SEQ ID NO: 8469974 - DNA, 22 bp, Homo sapiens
ctgggaggcagaggttgtagtg

SEQ ID NO: 8469975 - DNA, 22 bp, Homo sapiens
ctgggaggcagaggttgcagtg

SEQ ID NO: 8469976 - DNA, 22 bp, Homo sapiens
ctgggaggcagaggttgcagtg

SEQ ID NO: 8469977 - DNA, 22 bp, Homo sapiens
ctgggaggcagaggttgcagtg

SEQ ID NO: 8469978 - DNA, 22 bp, Homo sapiens
ctgggaggcagaggttgcagtg

SEQ ID NO: 8469979 - DNA, 22 bp, Homo sapiens
cttgtagctgcttcttctgaag

SEQ ID NO: 8469980 - DNA, 22 bp, Homo sapiens
cttgccagtgttgcagaagctc

SEQ ID NO: 8469981 - DNA, 22 bp, Homo sapiens
cttgccaaattaacatacagaa

SEQ ID NO: 8469982 - DNA, 22 bp, Homo sapiens
cttgccaatggtacaaacgatt

SEQ ID NO: 8469983 - DNA, 20 bp, Homo sapiens
cttgcccagggtctcctgcc

SEQ ID NO: 8469984 - DNA, 22 bp, Homo sapiens
cttgggtcacaactctgaggtg

SEQ ID NO: 8469985 - DNA, 22 bp, Homo sapiens
cttgggtctgtcctgctgtgca

SEQ ID NO: 8469986 - DNA, 22 bp, Homo sapiens
cttgtctgggcagcttgggagt

SEQ ID NO: 8469987 - DNA, 22 bp, Homo sapiens
cttgtattaagcttagagaggc

SEQ ID NO: 8469988 - DNA, 22 bp, Homo sapiens
cttgtatagggaaagataaatc

SEQ ID NO: 8469989 - DNA, 22 bp, Homo sapiens
cttgtattaggaagaatgcttt

SEQ ID NO: 8469990 - DNA, 22 bp, Homo sapiens
cttgtattatggttcgcttagt

SEQ ID NO: 8469991 - DNA, 22 bp, Homo sapiens
cttgtattaggaagaatgcttt

SEQ ID NO: 8469992 - DNA, 22 bp, Homo sapiens
cttgtattcagagtggacatga

SEQ ID NO: 8469993 - DNA, 22 bp, Homo sapiens
cttgtattcagagtggacatga

SEQ ID NO: 8469994 - DNA, 22 bp, Homo sapiens
cttgtattcccctatctctaaa

SEQ ID NO: 8469995 - DNA, 22 bp, Homo sapiens
cttgtcagccaattgtggattt

SEQ ID NO: 8469996 - DNA, 22 bp, Homo sapiens
cttgtcagccaattgtggattt

SEQ ID NO: 8469997 - DNA, 22 bp, Homo sapiens
cttgtcagccaattgtggattt

SEQ ID NO: 8469998 - DNA, 22 bp, Homo sapiens
cttgtattgcaaactggccagg

SEQ ID NO: 8469999 - DNA, 22 bp, Homo sapiens
cttgtattctgcctaaccttca

SEQ ID NO: 8470000 - DNA, 22 bp, Homo sapiens
cttgtattcttccacttaagat

SEQ ID NO: 8470001 - DNA, 22 bp, Homo sapiens
cttgtattcttgtacctttcaa

SEQ ID NO: 8470002 - DNA, 22 bp, Homo sapiens
cttcctggccattgccatggca

SEQ ID NO: 8470003 - DNA, 22 bp, Homo sapiens
cttcctggctcggtgcctcacc

SEQ ID NO: 8470004 - DNA, 22 bp, Homo sapiens
cttcctggcatgggtctcatga

SEQ ID NO: 8470005 - DNA, 22 bp, Homo sapiens
cttcctggccattgccatggca

SEQ ID NO: 8470006 - DNA, 22 bp, Homo sapiens
cttcctgggcaatgttctgctt

SEQ ID NO: 8470007 - DNA, 22 bp, Homo sapiens
cttcctggccattgccatggca

SEQ ID NO: 8470008 - DNA, 22 bp, Homo sapiens
cttcctggctcggtgcctcacc

SEQ ID NO: 8470009 - DNA, 22 bp, Homo sapiens
cttcctggctcggtgcctcacc

SEQ ID NO: 8470010 - DNA, 22 bp, Homo sapiens
cttgacactgtcactcaggcca

SEQ ID NO: 8470011 - DNA, 22 bp, Homo sapiens
cttcctgggtcagcctggaggt

SEQ ID NO: 8470012 - DNA, 22 bp, Homo sapiens
cttcctgggtcagcctggaggt

SEQ ID NO: 8470013 - DNA, 22 bp, Homo sapiens
cttcctgcaacacctgtgttgc

SEQ ID NO: 8470014 - DNA, 22 bp, Homo sapiens
cttcctgcccacttcctgctgg

SEQ ID NO: 8470015 - DNA, 19 bp, Homo sapiens
cttcctggaggagagcctc

SEQ ID NO: 8470016 - DNA, 19 bp, Homo sapiens
cttcctggaggagagcctc

SEQ ID NO: 8470017 - DNA, 22 bp, Homo sapiens
cttcctggatgaagcccagcat

SEQ ID NO: 8470018 - DNA, 22 bp, Homo sapiens
cttcctggatgaagcccagcat

SEQ ID NO: 8470019 - DNA, 22 bp, Homo sapiens
cttcctggatgaacagtagaaa

SEQ ID NO: 8470020 - DNA, 22 bp, Homo sapiens
cttcctggcaaagcaatcagag

SEQ ID NO: 8470021 - DNA, 22 bp, Homo sapiens
cttcctggatgagcaggctgat

SEQ ID NO: 8470022 - DNA, 22 bp, Homo sapiens
cttcctggatgagcaggctgat

SEQ ID NO: 8470023 - DNA, 22 bp, Homo sapiens
cttcctggatgagcaggctgat

SEQ ID NO: 8470024 - DNA, 22 bp, Homo sapiens
cttgactcttgcttcccatgga

SEQ ID NO: 8470025 - DNA, 22 bp, Homo sapiens
cttgacttcttctagaaataag

SEQ ID NO: 8470026 - DNA, 22 bp, Homo sapiens
cttgactttgccttttaaatgt

SEQ ID NO: 8470027 - DNA, 22 bp, Homo sapiens
cttgatttattacccactatat

SEQ ID NO: 8470028 - DNA, 22 bp, Homo sapiens
cttgatttcagccttgtgatat

SEQ ID NO: 8470029 - DNA, 22 bp, Homo sapiens
cttgatttattacccactatat

SEQ ID NO: 8470030 - DNA, 22 bp, Homo sapiens
cttgcaggattttgctgctgta

SEQ ID NO: 8470031 - DNA, 18 bp, Homo sapiens
cttcagtgacagtctggc

SEQ ID NO: 8470032 - DNA, 18 bp, Homo sapiens
cttcagtgacagtctggc

SEQ ID NO: 8470033 - DNA, 22 bp, Homo sapiens
cttcagtgatataggcttctcc

SEQ ID NO: 8470034 - DNA, 22 bp, Homo sapiens
cttcaggatttaggaagatgaa

SEQ ID NO: 8470035 - DNA, 22 bp, Homo sapiens
cttcaggaaaatctctaaggat

SEQ ID NO: 8470036 - DNA, 22 bp, Homo sapiens
cttcagctttcagcttccctga

SEQ ID NO: 8470037 - DNA, 22 bp, Homo sapiens
cttcaggagtagttacctagca

SEQ ID NO: 8470038 - DNA, 22 bp, Homo sapiens
cttcaggattaatttggggcct

SEQ ID NO: 8470039 - DNA, 22 bp, Homo sapiens
cttcagctcttggtaaatgttt

SEQ ID NO: 8470040 - DNA, 22 bp, Homo sapiens
cttcagctaggatccctgcagc

SEQ ID NO: 8470041 - DNA, 22 bp, Homo sapiens
cttccctttttatgtcttcagc

SEQ ID NO: 8470042 - DNA, 18 bp, Homo sapiens
cttcagtggctgctctgc

SEQ ID NO: 8470043 - DNA, 22 bp, Homo sapiens
cttcagtgtcctctctagtaga

SEQ ID NO: 8470044 - DNA, 23 bp, Homo sapiens
cttcagtgtgggactgcagcgtg

SEQ ID NO: 8470045 - DNA, 22 bp, Homo sapiens
ctgttgtcttcattgtcatatc

SEQ ID NO: 8470046 - DNA, 22 bp, Homo sapiens
cttatatttgtcaactttacaa

SEQ ID NO: 8470047 - DNA, 23 bp, Homo sapiens
cttattcattcatgtagcccatt

SEQ ID NO: 8470048 - DNA, 22 bp, Homo sapiens
cttatcagattatctgggctgt

SEQ ID NO: 8470049 - DNA, 22 bp, Homo sapiens
cttatattttaggaacagacaa

SEQ ID NO: 8470050 - DNA, 22 bp, Homo sapiens
cttattctactccacaagctct

SEQ ID NO: 8470051 - DNA, 22 bp, Homo sapiens
cttcagaaccagccagaagagg

SEQ ID NO: 8470052 - DNA, 22 bp, Homo sapiens
cttcagaagaaaagcagtgtgt

SEQ ID NO: 8470053 - DNA, 22 bp, Homo sapiens
cttatttcagccctgggcaccc

SEQ ID NO: 8470054 - DNA, 19 bp, Homo sapiens
ctgtggctgacctctggcc

SEQ ID NO: 8470055 - DNA, 19 bp, Homo sapiens
ctgtggctgacctctggcc

SEQ ID NO: 8470056 - DNA, 19 bp, Homo sapiens
ctgtggctgacctctggcc

SEQ ID NO: 8470057 - DNA, 23 bp, Homo sapiens
ctgtggctgagtcctgttggagt

SEQ ID NO: 8470058 - DNA, 22 bp, Homo sapiens
ctgtggctgagttccttatgtt

SEQ ID NO: 8470059 - DNA, 22 bp, Homo sapiens
ctgtggctctttagttgagcac

SEQ ID NO: 8470060 - DNA, 22 bp, Homo sapiens
ctgtggctctttagttgagcac

SEQ ID NO: 8470061 - DNA, 22 bp, Homo sapiens
ctgtggctgcgccctgggggag

SEQ ID NO: 8470062 - DNA, 22 bp, Homo sapiens
ctgtggctgcagccttggtcct

SEQ ID NO: 8470063 - DNA, 22 bp, Homo sapiens
ctgtggctccagtgaaccaatg

SEQ ID NO: 8470064 - DNA, 20 bp, Homo sapiens
ctgtggctcatgcatctgcc

SEQ ID NO: 8470065 - DNA, 20 bp, Homo sapiens
ctgtggctcatgcatctgcc

SEQ ID NO: 8470066 - DNA, 22 bp, Homo sapiens
ctgtggctctccaatggaggga

SEQ ID NO: 8470067 - DNA, 22 bp, Homo sapiens
ctgtggctctctgcagggtccc

SEQ ID NO: 8470068 - DNA, 22 bp, Homo sapiens
ctgtggctctcagaggctgctg

SEQ ID NO: 8470069 - DNA, 22 bp, Homo sapiens
ctgtggctctcagaggctgctg

SEQ ID NO: 8470070 - DNA, 22 bp, Homo sapiens
ctgtggctgtatttggccagag

SEQ ID NO: 8470071 - DNA, 22 bp, Homo sapiens
ctgtggctgtatttggccagag

SEQ ID NO: 8470072 - DNA, 22 bp, Homo sapiens
ctgtggctgtatttggccagag

SEQ ID NO: 8470073 - DNA, 22 bp, Homo sapiens
ctgtggctgcgtaggtctggca

SEQ ID NO: 8470074 - DNA, 22 bp, Homo sapiens
ctgtggctggcctgtctgacat

SEQ ID NO: 8470075 - DNA, 22 bp, Homo sapiens
ctgtggctggcctgtctgacat

SEQ ID NO: 8470076 - DNA, 22 bp, Homo sapiens
ctgtggctggcctgtctgacat

SEQ ID NO: 8470077 - DNA, 22 bp, Homo sapiens
ctgtgtagcctcatgtgggctt

SEQ ID NO: 8470078 - DNA, 22 bp, Homo sapiens
ctgtggctgtatttggccagag

SEQ ID NO: 8470079 - DNA, 22 bp, Homo sapiens
ctgtgtcctgcgtcaagccaat

SEQ ID NO: 8470080 - DNA, 23 bp, Homo sapiens
ctgtgtctatgcagccatatcca

SEQ ID NO: 8470081 - DNA, 22 bp, Homo sapiens
ctgtgtcctttaaaaaagacac

SEQ ID NO: 8470082 - DNA, 22 bp, Homo sapiens
ctgtgtcctgtctcctaaggtg

SEQ ID NO: 8470083 - DNA, 22 bp, Homo sapiens
ctgttctttagttccactgcaa

SEQ ID NO: 8470084 - DNA, 22 bp, Homo sapiens
ctgttctggagacactgatgaa

SEQ ID NO: 8470085 - DNA, 18 bp, Homo sapiens
ctgttgagatgtggctga

SEQ ID NO: 8470086 - DNA, 22 bp, Homo sapiens
ctgttgctgggaacgcatgtca

SEQ ID NO: 8470087 - DNA, 22 bp, Homo sapiens
ctgttcagaaaaaatcttcatg

SEQ ID NO: 8470088 - DNA, 22 bp, Homo sapiens
ctgttcagtaacctataaaaca

SEQ ID NO: 8470089 - DNA, 22 bp, Homo sapiens
ctgttcagtaacctataaaaca

SEQ ID NO: 8470090 - DNA, 18 bp, Homo sapiens
ctgttcagctgaactaca

SEQ ID NO: 8470091 - DNA, 18 bp, Homo sapiens
ctgttcagctgaactaca

SEQ ID NO: 8470092 - DNA, 23 bp, Homo sapiens
ctgttaaattccttaagagcagg

SEQ ID NO: 8470093 - DNA, 23 bp, Homo sapiens
ctgttaaattccttaagagcagg

SEQ ID NO: 8470094 - DNA, 22 bp, Homo sapiens
ctgttacccagcaaccccagca

SEQ ID NO: 8470095 - DNA, 22 bp, Homo sapiens
ctgtgtctgcctgggatccatt

SEQ ID NO: 8470096 - DNA, 22 bp, Homo sapiens
ctgtgagggccagagtcagggc

SEQ ID NO: 8470097 - DNA, 22 bp, Homo sapiens
ctgtgagggtcacagccatgcc

SEQ ID NO: 8470098 - DNA, 22 bp, Homo sapiens
ctgtcctgtggacctgaggacg

SEQ ID NO: 8470099 - DNA, 22 bp, Homo sapiens
ctgtcctgtggacctgaggacg

SEQ ID NO: 8470100 - DNA, 22 bp, Homo sapiens
ctgtgcagtccagccctggaca

SEQ ID NO: 8470101 - DNA, 22 bp, Homo sapiens
ctgtgcagtggggctctgggtt

SEQ ID NO: 8470102 - DNA, 22 bp, Homo sapiens
ctgtgccactgccctgccacgc

SEQ ID NO: 8470103 - DNA, 22 bp, Homo sapiens
ctgtgccactgccccaggcctc

SEQ ID NO: 8470104 - DNA, 22 bp, Homo sapiens
ctgtgccatcctagggctgctg

SEQ ID NO: 8470105 - DNA, 22 bp, Homo sapiens
ctgtgccaggcccagctgactt

SEQ ID NO: 8470106 - DNA, 22 bp, Homo sapiens
ctgtgccaggcccagctgactt

SEQ ID NO: 8470107 - DNA, 22 bp, Homo sapiens
ctgtgcccacctggctctgagg

SEQ ID NO: 8470108 - DNA, 22 bp, Homo sapiens
ctgtgcccagctccctgactgc

SEQ ID NO: 8470109 - DNA, 19 bp, Homo sapiens
ctgtgccctatgacttgta

SEQ ID NO: 8470110 - DNA, 22 bp, Homo sapiens
ctgtcctggccgcccttgtgag

SEQ ID NO: 8470111 - DNA, 22 bp, Homo sapiens
ctgtcctgcccaccctgcaggg

SEQ ID NO: 8470112 - DNA, 22 bp, Homo sapiens
ctgtcctgtactttgaggccct

SEQ ID NO: 8470113 - DNA, 22 bp, Homo sapiens
ctgtcctggtgctggggatccc

SEQ ID NO: 8470114 - DNA, 21 bp, Homo sapiens
ctgtcctggtctagaggcaca

SEQ ID NO: 8470115 - DNA, 21 bp, Homo sapiens
ctgtcctggtctagaggcaca

SEQ ID NO: 8470116 - DNA, 22 bp, Homo sapiens
ctgtcctgaggcaggtggcctg

SEQ ID NO: 8470117 - DNA, 22 bp, Homo sapiens
ctgtcctgagttcttggaggtc

SEQ ID NO: 8470118 - DNA, 20 bp, Homo sapiens
ctgtcctgatcttttcagaa

SEQ ID NO: 8470119 - DNA, 22 bp, Homo sapiens
ctgtcctgcagttgggggcagg

SEQ ID NO: 8470120 - DNA, 22 bp, Homo sapiens
ctgtcctgcccaccctgcaggg

SEQ ID NO: 8470121 - DNA, 22 bp, Homo sapiens
ctgtcctgcccaccctgcaggg

SEQ ID NO: 8470122 - DNA, 22 bp, Homo sapiens
ctgtcctgcccaccctgcaggg

SEQ ID NO: 8470123 - DNA, 22 bp, Homo sapiens
ctgggtgcgtgagcgcatgcgt

SEQ ID NO: 8470124 - DNA, 22 bp, Homo sapiens
ctgtccctgagcaactcctgtt

SEQ ID NO: 8470125 - DNA, 22 bp, Homo sapiens
ctgtccctgagcaactcctgtt

SEQ ID NO: 8470126 - DNA, 22 bp, Homo sapiens
ctgtcctctgtcctcagcagga

SEQ ID NO: 8470127 - DNA, 22 bp, Homo sapiens
ctgtcctctgtcctcagcagga

SEQ ID NO: 8470128 - DNA, 22 bp, Homo sapiens
ctgggtgagctggccagagggt

SEQ ID NO: 8470129 - DNA, 22 bp, Homo sapiens
ctgggtgaatttgaaggaaagg

SEQ ID NO: 8470130 - DNA, 22 bp, Homo sapiens
ctgggtcttcagcagcaggcgg

SEQ ID NO: 8470131 - DNA, 22 bp, Homo sapiens
ctgggtcttcagcagcaggcgg

SEQ ID NO: 8470132 - DNA, 22 bp, Homo sapiens
ctgggtctttttcttccattga

SEQ ID NO: 8470133 - DNA, 22 bp, Homo sapiens
ctgggtctttttcttccattga

SEQ ID NO: 8470134 - DNA, 22 bp, Homo sapiens
ctgggtctgtcactagataaat

SEQ ID NO: 8470135 - DNA, 22 bp, Homo sapiens
ctgggtctgtgcccagggacct

SEQ ID NO: 8470136 - DNA, 22 bp, Homo sapiens
ctgggtctgtgcccagggacct

SEQ ID NO: 8470137 - DNA, 19 bp, Homo sapiens
ctgggtcttattctgtgaa

SEQ ID NO: 8470138 - DNA, 22 bp, Homo sapiens
ctgggtcttcagcagcaggcgg

SEQ ID NO: 8470139 - DNA, 19 bp, Homo sapiens
ctgggtcttattctgtgaa

SEQ ID NO: 8470140 - DNA, 22 bp, Homo sapiens
ctgggtctgtgcccagggacct

SEQ ID NO: 8470141 - DNA, 22 bp, Homo sapiens
gagcctggacatctcaggccca

SEQ ID NO: 8470142 - DNA, 22 bp, Homo sapiens
gagcctggacatctcaggccca

SEQ ID NO: 8470143 - DNA, 22 bp, Homo sapiens
gagcctggattgaagtgggtgg

SEQ ID NO: 8470144 - DNA, 22 bp, Homo sapiens
gagcctggatagccttgttcca

SEQ ID NO: 8470145 - DNA, 22 bp, Homo sapiens
gagccgtgccagccctgtctcg

SEQ ID NO: 8470146 - DNA, 22 bp, Homo sapiens
gagcccttttcctagatactgt

SEQ ID NO: 8470147 - DNA, 22 bp, Homo sapiens
gagccctgttcaggcctcctca

SEQ ID NO: 8470148 - DNA, 22 bp, Homo sapiens
gagccctgttcaggcctcctca

SEQ ID NO: 8470149 - DNA, 22 bp, Homo sapiens
gagccctgttcaggcctcctca

SEQ ID NO: 8470150 - DNA, 22 bp, Homo sapiens
gagctctgttctcgtcctgctg

SEQ ID NO: 8470151 - DNA, 22 bp, Homo sapiens
gagctctgtgtagcctgagggt

SEQ ID NO: 8470152 - DNA, 22 bp, Homo sapiens
gagctataatagagcttcagtg

SEQ ID NO: 8470153 - DNA, 22 bp, Homo sapiens
gagctctgaaaaagcttgcctt

SEQ ID NO: 8470154 - DNA, 22 bp, Homo sapiens
gagctacaagggagactttttt

SEQ ID NO: 8470155 - DNA, 22 bp, Homo sapiens
gagctagcttcttccaggtttc

SEQ ID NO: 8470156 - DNA, 20 bp, Homo sapiens
gagctacacaaatgctgctt

SEQ ID NO: 8470157 - DNA, 22 bp, Homo sapiens
gagctacaagggagactttttt

SEQ ID NO: 8470158 - DNA, 22 bp, Homo sapiens
gagctacagagtttggtgttca

SEQ ID NO: 8470159 - DNA, 22 bp, Homo sapiens
gagctacactgattcatttgtt

SEQ ID NO: 8470160 - DNA, 22 bp, Homo sapiens
gagctacaggcagctgagccct

SEQ ID NO: 8470161 - DNA, 22 bp, Homo sapiens
gagctaaatgaatcataaatca

SEQ ID NO: 8470162 - DNA, 22 bp, Homo sapiens
gagcttcatatgttgcagagaa

SEQ ID NO: 8470163 - DNA, 22 bp, Homo sapiens
gagcttccactctagaaggagt

SEQ ID NO: 8470164 - DNA, 22 bp, Homo sapiens
gagcttcagagaccacttaact

SEQ ID NO: 8470165 - DNA, 22 bp, Homo sapiens
gagcttccctctgcagtccctg

SEQ ID NO: 8470166 - DNA, 22 bp, Homo sapiens
gagctgttaagagggagtgaca

SEQ ID NO: 8470167 - DNA, 22 bp, Homo sapiens
gagcttaaatggctaaatataa

SEQ ID NO: 8470168 - DNA, 23 bp, Homo sapiens
gagcttagtctactcagacatcc

SEQ ID NO: 8470169 - DNA, 22 bp, Homo sapiens
gagcttggacaccttggcaggt

SEQ ID NO: 8470170 - DNA, 22 bp, Homo sapiens
gagcttggcagtgtcactaggg

SEQ ID NO: 8470171 - DNA, 22 bp, Homo sapiens
gagcttggatgtcttttgttca

SEQ ID NO: 8470172 - DNA, 22 bp, Homo sapiens
gagcttggacaagctctgaagg

SEQ ID NO: 8470173 - DNA, 22 bp, Homo sapiens
gagcttggacaccttggcaggt

SEQ ID NO: 8470174 - DNA, 22 bp, Homo sapiens
gagcttggcctcttgaacgtgg

SEQ ID NO: 8470175 - DNA, 22 bp, Homo sapiens
gagcttggcagtgtcactaggg

SEQ ID NO: 8470176 - DNA, 22 bp, Homo sapiens
gagcttggctggacctcacgga

SEQ ID NO: 8470177 - DNA, 22 bp, Homo sapiens
gagcttcctgatgccgaccagt

SEQ ID NO: 8470178 - DNA, 18 bp, Homo sapiens
gagcttgaaatggctttt

SEQ ID NO: 8470179 - DNA, 22 bp, Homo sapiens
gagcttggaagcagatcctcac

SEQ ID NO: 8470180 - DNA, 22 bp, Homo sapiens
gagctgaaggagaaagcagggg

SEQ ID NO: 8470181 - DNA, 22 bp, Homo sapiens
gagctgaacgggaattccccga

SEQ ID NO: 8470182 - DNA, 22 bp, Homo sapiens
gagctgaagatgtcagaaccgt

SEQ ID NO: 8470183 - DNA, 22 bp, Homo sapiens
gagctctttgaacctgggcagt

SEQ ID NO: 8470184 - DNA, 22 bp, Homo sapiens
gagctgaaatatgaagccaatt

SEQ ID NO: 8470185 - DNA, 22 bp, Homo sapiens
gagctgaacaaattgcgagtgg

SEQ ID NO: 8470186 - DNA, 22 bp, Homo sapiens
gagctgaacatcatggaaaggc

SEQ ID NO: 8470187 - DNA, 22 bp, Homo sapiens
gagctcttccccatcttacatc

SEQ ID NO: 8470188 - DNA, 22 bp, Homo sapiens
gagctcttcctttcaggaggcc

SEQ ID NO: 8470189 - DNA, 22 bp, Homo sapiens
gagctcttctaaagatggcaat

SEQ ID NO: 8470190 - DNA, 22 bp, Homo sapiens
gagctcttgcttctagtccagg

SEQ ID NO: 8470191 - DNA, 22 bp, Homo sapiens
gagctgaattgctgccatttgc

SEQ ID NO: 8470192 - DNA, 18 bp, Homo sapiens
gagctgagaagaggatgc

SEQ ID NO: 8470193 - DNA, 22 bp, Homo sapiens
gagctgaagtttccatttgtac

SEQ ID NO: 8470194 - DNA, 22 bp, Homo sapiens
gagctgaaggagaaagcagggg

SEQ ID NO: 8470195 - DNA, 22 bp, Homo sapiens
gagctgaagcgctacagcatcc

SEQ ID NO: 8470196 - DNA, 22 bp, Homo sapiens
gagctgaattgaagcaaggagc

SEQ ID NO: 8470197 - DNA, 22 bp, Homo sapiens
gagctgaatcagagatattatt

SEQ ID NO: 8470198 - DNA, 21 bp, Homo sapiens
gagctgaatatgttctagggg

SEQ ID NO: 8470199 - DNA, 22 bp, Homo sapiens
gagctgaattacggtgagtcat

SEQ ID NO: 8470200 - DNA, 22 bp, Homo sapiens
gaggcaaggccgcacgtctcag

SEQ ID NO: 8470201 - DNA, 22 bp, Homo sapiens
gaggcacaatacatgtctcaag

SEQ ID NO: 8470202 - DNA, 22 bp, Homo sapiens
gaggcacatcacttggtgcatt

SEQ ID NO: 8470203 - DNA, 22 bp, Homo sapiens
gaggcactgagagtgggggatg

SEQ ID NO: 8470204 - DNA, 22 bp, Homo sapiens
gaggcactgaccattttcatat

SEQ ID NO: 8470205 - DNA, 22 bp, Homo sapiens
gaggcagagaccttcaggacct

SEQ ID NO: 8470206 - DNA, 22 bp, Homo sapiens
gaggcagaagttgcagtgagca

SEQ ID NO: 8470207 - DNA, 22 bp, Homo sapiens
gaggcactgctgggcccctgta

SEQ ID NO: 8470208 - DNA, 22 bp, Homo sapiens
gaggcactgctgggcccctgta

SEQ ID NO: 8470209 - DNA, 22 bp, Homo sapiens
gaggccagcgcgcagcactttt

SEQ ID NO: 8470210 - DNA, 22 bp, Homo sapiens
gaggccagcgcgcagcactttt

SEQ ID NO: 8470211 - DNA, 22 bp, Homo sapiens
gaggccagcccctcttgaaggc

SEQ ID NO: 8470212 - DNA, 22 bp, Homo sapiens
gaggccagatgtcatgtcttat

SEQ ID NO: 8470213 - DNA, 22 bp, Homo sapiens
gaggccagctacccaagggtca

SEQ ID NO: 8470214 - DNA, 22 bp, Homo sapiens
gaggccagctagtccaggaagt

SEQ ID NO: 8470215 - DNA, 22 bp, Homo sapiens
gaggccaggaagcccaagatca

SEQ ID NO: 8470216 - DNA, 22 bp, Homo sapiens
gaggccaggaagcccaagatca

SEQ ID NO: 8470217 - DNA, 22 bp, Homo sapiens
gaggccaggacatgaaagctga

SEQ ID NO: 8470218 - DNA, 22 bp, Homo sapiens
gaggagccctgttccccaggcc

SEQ ID NO: 8470219 - DNA, 22 bp, Homo sapiens
gaggagccctgttccccaggcc

SEQ ID NO: 8470220 - DNA, 22 bp, Homo sapiens
gaggaaaatattcagggaggtt

SEQ ID NO: 8470221 - DNA, 22 bp, Homo sapiens
gaggaaaataacaactaagggc

SEQ ID NO: 8470222 - DNA, 22 bp, Homo sapiens
gaggaaaagagacaggttattg

SEQ ID NO: 8470223 - DNA, 20 bp, Homo sapiens
gaggaaaagctgccaggcct

SEQ ID NO: 8470224 - DNA, 19 bp, Homo sapiens
gaggagctatcggagacag

SEQ ID NO: 8470225 - DNA, 22 bp, Homo sapiens
gaggagctgttccctcacctct

SEQ ID NO: 8470226 - DNA, 22 bp, Homo sapiens
gaggagctgttccctcacctct

SEQ ID NO: 8470227 - DNA, 22 bp, Homo sapiens
gaggagcctggccccacatcca

SEQ ID NO: 8470228 - DNA, 18 bp, Homo sapiens
gaggagccgtccctacta

SEQ ID NO: 8470229 - DNA, 22 bp, Homo sapiens
gaggagcttgaggctaggagcc

SEQ ID NO: 8470230 - DNA, 22 bp, Homo sapiens
gaggagcttcagaggaatctta

SEQ ID NO: 8470231 - DNA, 22 bp, Homo sapiens
gaggagcttgtgagaagatgtc

SEQ ID NO: 8470232 - DNA, 22 bp, Homo sapiens
gaggagcttgaggctaggagcc

SEQ ID NO: 8470233 - DNA, 22 bp, Homo sapiens
gaggaggaagttctctgtaggc

SEQ ID NO: 8470234 - DNA, 22 bp, Homo sapiens
gaggaggaggaagtggaaccca

SEQ ID NO: 8470235 - DNA, 19 bp, Homo sapiens
gaggaggaaaactagtgta

SEQ ID NO: 8470236 - DNA, 19 bp, Homo sapiens
gaggaggaaaactagtgta

SEQ ID NO: 8470237 - DNA, 22 bp, Homo sapiens
gaggaggctaagtgggctctgg

SEQ ID NO: 8470238 - DNA, 22 bp, Homo sapiens
gaggaggcacttgagcagatgt

SEQ ID NO: 8470239 - DNA, 22 bp, Homo sapiens
gaggaggctaagtgggctctgg

SEQ ID NO: 8470240 - DNA, 22 bp, Homo sapiens
gaggaggctatcagcaatcagg

SEQ ID NO: 8470241 - DNA, 22 bp, Homo sapiens
gaggcaaggccgcacgtctcag

SEQ ID NO: 8470242 - DNA, 19 bp, Homo sapiens
gaggcaaggagtttaagcc

SEQ ID NO: 8470243 - DNA, 22 bp, Homo sapiens
gaggcaagcccagtgggtctaa

SEQ ID NO: 8470244 - DNA, 22 bp, Homo sapiens
gaggcaagagaagccagctttc

SEQ ID NO: 8470245 - DNA, 21 bp, Homo sapiens
gagaatctgttttcttgtctt

SEQ ID NO: 8470246 - DNA, 22 bp, Homo sapiens
gagaatctttccccacagaagg

SEQ ID NO: 8470247 - DNA, 22 bp, Homo sapiens
gagaatctccagatgaagtcct

SEQ ID NO: 8470248 - DNA, 22 bp, Homo sapiens
gagaatctgggttttggctatc

SEQ ID NO: 8470249 - DNA, 22 bp, Homo sapiens
gagaatctctttgacaagcaga

SEQ ID NO: 8470250 - DNA, 19 bp, Homo sapiens
gagaatctctttgatgttt

SEQ ID NO: 8470251 - DNA, 22 bp, Homo sapiens
gagaattagggcgtaattcaga

SEQ ID NO: 8470252 - DNA, 22 bp, Homo sapiens
gagaaggccaggaacccagtgt

SEQ ID NO: 8470253 - DNA, 22 bp, Homo sapiens
gagaaggcttccaaattctgtg

SEQ ID NO: 8470254 - DNA, 22 bp, Homo sapiens
gagaaggctgatccttggagtt

SEQ ID NO: 8470255 - DNA, 18 bp, Homo sapiens
gagaaggccacttgtttt

SEQ ID NO: 8470256 - DNA, 22 bp, Homo sapiens
gagaaggatgtggctcatagct

SEQ ID NO: 8470257 - DNA, 22 bp, Homo sapiens
gagaagggatatggcttcttga

SEQ ID NO: 8470258 - DNA, 22 bp, Homo sapiens
gagaagggatatgccactctcg

SEQ ID NO: 8470259 - DNA, 22 bp, Homo sapiens
gagaaggcttcttttcctctga

SEQ ID NO: 8470260 - DNA, 16 bp, Homo sapiens
gacctcagtgctggct

SEQ ID NO: 8470261 - DNA, 22 bp, Homo sapiens
gacctcatctgaacatatgcaa

SEQ ID NO: 8470262 - DNA, 22 bp, Homo sapiens
gacctcagtgaatggtcatgta

SEQ ID NO: 8470263 - DNA, 22 bp, Homo sapiens
gacctcagtgaatggtcatgta

SEQ ID NO: 8470264 - DNA, 22 bp, Homo sapiens
gacctcagtattgttcaggatg

SEQ ID NO: 8470265 - DNA, 22 bp, Homo sapiens
gacctcagtattgttcaggatg

SEQ ID NO: 8470266 - DNA, 22 bp, Homo sapiens
gacctcagctgtggggatgctg

SEQ ID NO: 8470267 - DNA, 22 bp, Homo sapiens
gacctcagattttcccaggcca

SEQ ID NO: 8470268 - DNA, 22 bp, Homo sapiens
gacctccagcggccctgcagag

SEQ ID NO: 8470269 - DNA, 22 bp, Homo sapiens
gacctccagcggccctgcagag

SEQ ID NO: 8470270 - DNA, 22 bp, Homo sapiens
gacctccattctgtcatgactg

SEQ ID NO: 8470271 - DNA, 22 bp, Homo sapiens
gagaggcatggaacagattctt

SEQ ID NO: 8470272 - DNA, 22 bp, Homo sapiens
gagaggccaaaatccctgcccc

SEQ ID NO: 8470273 - DNA, 22 bp, Homo sapiens
gagaggccatggctgtgcagtg

SEQ ID NO: 8470274 - DNA, 22 bp, Homo sapiens
gagaggcctgggcccgtgagct

SEQ ID NO: 8470275 - DNA, 22 bp, Homo sapiens
gagaggcctgggcccgtgagct

SEQ ID NO: 8470276 - DNA, 21 bp, Homo sapiens
gagaggcctgggcccgtgagc

SEQ ID NO: 8470277 - DNA, 22 bp, Homo sapiens
gagaggctatgaggttctgtgt

SEQ ID NO: 8470278 - DNA, 22 bp, Homo sapiens
gagaggccctgtggtcccagct

SEQ ID NO: 8470279 - DNA, 22 bp, Homo sapiens
gagaggccctgtggtcccagct

SEQ ID NO: 8470280 - DNA, 22 bp, Homo sapiens
gagaggccctgtggtcccagct

SEQ ID NO: 8470281 - DNA, 22 bp, Homo sapiens
gagaggcctgagaggctgcgga

SEQ ID NO: 8470282 - DNA, 22 bp, Homo sapiens
gagaggcctgagaggctgcgga

SEQ ID NO: 8470283 - DNA, 22 bp, Homo sapiens
gagaggccatggggtgggatgc

SEQ ID NO: 8470284 - DNA, 18 bp, Homo sapiens
gagaggcccggctgtgcc

SEQ ID NO: 8470285 - DNA, 22 bp, Homo sapiens
gagaggccctgaagcccacaga

SEQ ID NO: 8470286 - DNA, 22 bp, Homo sapiens
gagaggctgggttggagatcga

SEQ ID NO: 8470287 - DNA, 22 bp, Homo sapiens
gagaggctcagggacttgctga

SEQ ID NO: 8470288 - DNA, 22 bp, Homo sapiens
gagaggctgtgtgccattgttg

SEQ ID NO: 8470289 - DNA, 22 bp, Homo sapiens
gagaggctggtaaagtctgaac

SEQ ID NO: 8470290 - DNA, 22 bp, Homo sapiens
gagagggagccagccaggaacc

SEQ ID NO: 8470291 - DNA, 22 bp, Homo sapiens
gagatgatgagatttggaactt

SEQ ID NO: 8470292 - DNA, 22 bp, Homo sapiens
gagatgagtgggggatctctca

SEQ ID NO: 8470293 - DNA, 22 bp, Homo sapiens
gagatcttcaaggttttagata

SEQ ID NO: 8470294 - DNA, 22 bp, Homo sapiens
gagatgaagaggcccttggagt

SEQ ID NO: 8470295 - DNA, 22 bp, Homo sapiens
gagatcttcaaggttttagata

SEQ ID NO: 8470296 - DNA, 18 bp, Homo sapiens
gagagggatccctcagga

SEQ ID NO: 8470297 - DNA, 22 bp, Homo sapiens
gagccagggtttgaaactagac

SEQ ID NO: 8470298 - DNA, 22 bp, Homo sapiens
gagccaggggtcagctccgagg

SEQ ID NO: 8470299 - DNA, 22 bp, Homo sapiens
gagccagggctgtgagctgagc

SEQ ID NO: 8470300 - DNA, 22 bp, Homo sapiens
gagccagggctgtgagctgagc

SEQ ID NO: 8470301 - DNA, 22 bp, Homo sapiens
gagccaggttggaggctgcagt

SEQ ID NO: 8470302 - DNA, 22 bp, Homo sapiens
gagccaccttcaactcaggaat

SEQ ID NO: 8470303 - DNA, 22 bp, Homo sapiens
gagccagactgcctgaagctca

SEQ ID NO: 8470304 - DNA, 22 bp, Homo sapiens
gagccagcagccggcaccacca

SEQ ID NO: 8470305 - DNA, 22 bp, Homo sapiens
gagccagagctacaagtgtctg

SEQ ID NO: 8470306 - DNA, 22 bp, Homo sapiens
gagccaagcaatatacccaacc

SEQ ID NO: 8470307 - DNA, 22 bp, Homo sapiens
gagccaagctcttctccatgag

SEQ ID NO: 8470308 - DNA, 22 bp, Homo sapiens
gagccaagggcgtgctggagag

SEQ ID NO: 8470309 - DNA, 22 bp, Homo sapiens
gagccaagggcgtgctggagag

SEQ ID NO: 8470310 - DNA, 22 bp, Homo sapiens
gagcatttttgtctgcatttta

SEQ ID NO: 8470311 - DNA, 17 bp, Homo sapiens
gagccaccctgtgcgag

SEQ ID NO: 8470312 - DNA, 22 bp, Homo sapiens
gagccaagggttgccatggaga

SEQ ID NO: 8470313 - DNA, 22 bp, Homo sapiens
gagccacagcaacctcaaagga

SEQ ID NO: 8470314 - DNA, 22 bp, Homo sapiens
gagatggtgttccactgccagt

SEQ ID NO: 8470315 - DNA, 22 bp, Homo sapiens
gagatggagtctttttctgtca

SEQ ID NO: 8470316 - DNA, 20 bp, Homo sapiens
gagatggacagatgaagggg

SEQ ID NO: 8470317 - DNA, 22 bp, Homo sapiens
gagatttaattggattaactta

SEQ ID NO: 8470318 - DNA, 22 bp, Homo sapiens
gagatttaattggattaactta

SEQ ID NO: 8470319 - DNA, 23 bp, Homo sapiens
gagatgtgggtttgttcagtgtc

SEQ ID NO: 8470320 - DNA, 22 bp, Homo sapiens
gagatggtgttccactgccagt

SEQ ID NO: 8470321 - DNA, 21 bp, Homo sapiens
gagatttagaaggatcaattt

SEQ ID NO: 8470322 - DNA, 22 bp, Homo sapiens
gagatttagctgcttaactcct

SEQ ID NO: 8470323 - DNA, 22 bp, Homo sapiens
gagcagcaaagggagggtaaat

SEQ ID NO: 8470324 - DNA, 22 bp, Homo sapiens
gagcagcaaagggagggtaaat

SEQ ID NO: 8470325 - DNA, 22 bp, Homo sapiens
gagcagcagctgggccaggttc

SEQ ID NO: 8470326 - DNA, 22 bp, Homo sapiens
gaaatccagttccctactctta

SEQ ID NO: 8470327 - DNA, 22 bp, Homo sapiens
gaaatctacgattagtgaaaat

SEQ ID NO: 8470328 - DNA, 22 bp, Homo sapiens
gaaatctacgattagtgaaaat

SEQ ID NO: 8470329 - DNA, 22 bp, Homo sapiens
gaaatgattttagtttatcatg

SEQ ID NO: 8470330 - DNA, 22 bp, Homo sapiens
gaaatggtaaacattttaatgg

SEQ ID NO: 8470331 - DNA, 22 bp, Homo sapiens
gaacagcagctcgttctcgatg

SEQ ID NO: 8470332 - DNA, 20 bp, Homo sapiens
gaaatgtacacattaccaca

SEQ ID NO: 8470333 - DNA, 17 bp, Homo sapiens
gaacagtgtaagacact

SEQ ID NO: 8470334 - DNA, 22 bp, Homo sapiens
gaacagtgccagcacacaataa

SEQ ID NO: 8470335 - DNA, 22 bp, Homo sapiens
gaacagtatcagtagtgccagt

SEQ ID NO: 8470336 - DNA, 22 bp, Homo sapiens
gaacagtatttccaggaatccc

SEQ ID NO: 8470337 - DNA, 22 bp, Homo sapiens
gaacagtacagttgagtagttg

SEQ ID NO: 8470338 - DNA, 22 bp, Homo sapiens
gaacagtaactgtctgctgtgt

SEQ ID NO: 8470339 - DNA, 22 bp, Homo sapiens
gaacagtactaagagctttaca

SEQ ID NO: 8470340 - DNA, 22 bp, Homo sapiens
gaacagtagatgagatgctaga

SEQ ID NO: 8470341 - DNA, 22 bp, Homo sapiens
gaacagcatgtaagaagctact

SEQ ID NO: 8470342 - DNA, 22 bp, Homo sapiens
gaacagcatgcatgcaagacta

SEQ ID NO: 8470343 - DNA, 22 bp, Homo sapiens
gaacagggagtacggcacattt

SEQ ID NO: 8470344 - DNA, 22 bp, Homo sapiens
gaacagggttgggtgagagagg

SEQ ID NO: 8470345 - DNA, 22 bp, Homo sapiens
gaacagtaaatttatgcagcac

SEQ ID NO: 8470346 - DNA, 22 bp, Homo sapiens
ctttcaatgtgcctgccttggg

SEQ ID NO: 8470347 - DNA, 22 bp, Homo sapiens
ctttcacacacatacatttgga

SEQ ID NO: 8470348 - DNA, 22 bp, Homo sapiens
ctttcataaaggaaatgatgag

SEQ ID NO: 8470349 - DNA, 22 bp, Homo sapiens
ctttcagaggttactcaggaaa

SEQ ID NO: 8470350 - DNA, 22 bp, Homo sapiens
ctttcagaggggcgtacacagc

SEQ ID NO: 8470351 - DNA, 22 bp, Homo sapiens
ctttcagaagccggaagggcag

SEQ ID NO: 8470352 - DNA, 22 bp, Homo sapiens
ctttcattcttagatattagtg

SEQ ID NO: 8470353 - DNA, 22 bp, Homo sapiens
ctttcatccgcagatgagcctc

SEQ ID NO: 8470354 - DNA, 22 bp, Homo sapiens
ctttcataaggggttttataat

SEQ ID NO: 8470355 - DNA, 22 bp, Homo sapiens
ctttccaactctagtgaaattt

SEQ ID NO: 8470356 - DNA, 22 bp, Homo sapiens
ctttcattcttagatattagtg

SEQ ID NO: 8470357 - DNA, 22 bp, Homo sapiens
gaaatcaaggctacattcaggt

SEQ ID NO: 8470358 - DNA, 22 bp, Homo sapiens
gaaatcaaacccttttctgata

SEQ ID NO: 8470359 - DNA, 22 bp, Homo sapiens
gaaatcaaggctacattcaggt

SEQ ID NO: 8470360 - DNA, 22 bp, Homo sapiens
gaaatcaatttcttggttgata

SEQ ID NO: 8470361 - DNA, 22 bp, Homo sapiens
gaaatcaatttcttggttgata

SEQ ID NO: 8470362 - DNA, 22 bp, Homo sapiens
gaaatatttctcttgagcccct

SEQ ID NO: 8470363 - DNA, 22 bp, Homo sapiens
gaaatcaaacccttttctgata

SEQ ID NO: 8470364 - DNA, 20 bp, Homo sapiens
gaagacacagagttcatctc

SEQ ID NO: 8470365 - DNA, 22 bp, Homo sapiens
gaagacacaattggtgggtcca

SEQ ID NO: 8470366 - DNA, 22 bp, Homo sapiens
gaaccatttctgaatagtttgt

SEQ ID NO: 8470367 - DNA, 22 bp, Homo sapiens
gaacatttggcatgagaatttg

SEQ ID NO: 8470368 - DNA, 22 bp, Homo sapiens
gaaccacaatgtgaagaaggag

SEQ ID NO: 8470369 - DNA, 22 bp, Homo sapiens
gaaccacaagattcaaaggggt

SEQ ID NO: 8470370 - DNA, 22 bp, Homo sapiens
gaagacactctgcagagttatc

SEQ ID NO: 8470371 - DNA, 22 bp, Homo sapiens
gaagacactctgcagagttatc

SEQ ID NO: 8470372 - DNA, 22 bp, Homo sapiens
gaagacactaaggcccagggag

SEQ ID NO: 8470373 - DNA, 22 bp, Homo sapiens
gaagacacctactgtcatttct

SEQ ID NO: 8470374 - DNA, 22 bp, Homo sapiens
gaagacactaaactggggcttc

SEQ ID NO: 8470375 - DNA, 21 bp, Homo sapiens
gaagacacataacctctctcc

SEQ ID NO: 8470376 - DNA, 22 bp, Homo sapiens
gaagacattaagtctatgtcac

SEQ ID NO: 8470377 - DNA, 22 bp, Homo sapiens
gaagacatgtttttaatatgta

SEQ ID NO: 8470378 - DNA, 22 bp, Homo sapiens
gaagacatttgtaacacttgca

SEQ ID NO: 8470379 - DNA, 22 bp, Homo sapiens
gaagaggatgacaggagccggt

SEQ ID NO: 8470380 - DNA, 22 bp, Homo sapiens
gaagagctgtagcctgctcttt

SEQ ID NO: 8470381 - DNA, 22 bp, Homo sapiens
gaagagaagcatcaataggtaa

SEQ ID NO: 8470382 - DNA, 22 bp, Homo sapiens
gaagagaagcatcaataggtaa

SEQ ID NO: 8470383 - DNA, 22 bp, Homo sapiens
gaagagctgacagtgtcatcct

SEQ ID NO: 8470384 - DNA, 22 bp, Homo sapiens
gaagccccaaaccctcgccatc

SEQ ID NO: 8470385 - DNA, 22 bp, Homo sapiens
gaagccatctttgttccccacc

SEQ ID NO: 8470386 - DNA, 22 bp, Homo sapiens
gaagccagtactgtgctctgca

SEQ ID NO: 8470387 - DNA, 22 bp, Homo sapiens
gaagccaggggcctgacaggca

SEQ ID NO: 8470388 - DNA, 22 bp, Homo sapiens
gaagatttgaaacacatagaca

SEQ ID NO: 8470389 - DNA, 22 bp, Homo sapiens
gaagccagatttggggcatatc

SEQ ID NO: 8470390 - DNA, 22 bp, Homo sapiens
gaagccagattatcacaagcca

SEQ ID NO: 8470391 - DNA, 22 bp, Homo sapiens
gaagccaggggcctgacaggca

SEQ ID NO: 8470392 - DNA, 22 bp, Homo sapiens
gaagatttaagcacaatagtct

SEQ ID NO: 8470393 - DNA, 22 bp, Homo sapiens
gaagatttctttatgaaagatg

SEQ ID NO: 8470394 - DNA, 22 bp, Homo sapiens
gaagatttcagttaagtatcta

SEQ ID NO: 8470395 - DNA, 22 bp, Homo sapiens
gaagattacctgagaccacttg

SEQ ID NO: 8470396 - DNA, 22 bp, Homo sapiens
gaagattaaatggctcccatat

SEQ ID NO: 8470397 - DNA, 22 bp, Homo sapiens
gaagattaatgagaaacctgct

SEQ ID NO: 8470398 - DNA, 22 bp, Homo sapiens
gaagattaaatgaagtgacctg

SEQ ID NO: 8470399 - DNA, 20 bp, Homo sapiens
gaagatgggtagaggcacag

SEQ ID NO: 8470400 - DNA, 22 bp, Homo sapiens
gaagatgggaatgatgagtggg

SEQ ID NO: 8470401 - DNA, 22 bp, Homo sapiens
gaagaggtagcattggcaggtg

SEQ ID NO: 8470402 - DNA, 22 bp, Homo sapiens
gaagaggctttcctagggcaag

SEQ ID NO: 8470403 - DNA, 22 bp, Homo sapiens
gaagaggctttcctagggcaag

SEQ ID NO: 8470404 - DNA, 22 bp, Homo sapiens
gaagagtatatttagtgaaatc

SEQ ID NO: 8470405 - DNA, 22 bp, Homo sapiens
gaagataattcctacttataac

SEQ ID NO: 8470406 - DNA, 22 bp, Homo sapiens
gaagtttagagtgttgtaattt

SEQ ID NO: 8470407 - DNA, 22 bp, Homo sapiens
gaataacattggaaccctgaag

SEQ ID NO: 8470408 - DNA, 22 bp, Homo sapiens
gaataacagcaagtttgcaggc

SEQ ID NO: 8470409 - DNA, 22 bp, Homo sapiens
gaatacaaataataccaaggtg

SEQ ID NO: 8470410 - DNA, 22 bp, Homo sapiens
gaagttttagtcaaaatgtaga

SEQ ID NO: 8470411 - DNA, 22 bp, Homo sapiens
gaagttttagtcaaaatgtaga

SEQ ID NO: 8470412 - DNA, 22 bp, Homo sapiens
gaagttttctgaggctgtagct

SEQ ID NO: 8470413 - DNA, 22 bp, Homo sapiens
gaatacaccaaggaatcagaat

SEQ ID NO: 8470414 - DNA, 22 bp, Homo sapiens
gaatacaagcctgccacctgga

SEQ ID NO: 8470415 - DNA, 22 bp, Homo sapiens
gaatacacgaatagagcatggt

SEQ ID NO: 8470416 - DNA, 22 bp, Homo sapiens
gaatacaagccaggcacaaggc

SEQ ID NO: 8470417 - DNA, 22 bp, Homo sapiens
gaatacaagccaggcacaaggc

SEQ ID NO: 8470418 - DNA, 19 bp, Homo sapiens
gaatacagataataagcag

SEQ ID NO: 8470419 - DNA, 22 bp, Homo sapiens
gaatacatgaaccctcctgtgg

SEQ ID NO: 8470420 - DNA, 22 bp, Homo sapiens
gaatacatctgaaggctatgaa

SEQ ID NO: 8470421 - DNA, 22 bp, Homo sapiens
gaatacatccagagcagggctg

SEQ ID NO: 8470422 - DNA, 22 bp, Homo sapiens
gaatacatatcagatgtgtttc

SEQ ID NO: 8470423 - DNA, 22 bp, Homo sapiens
gaagcctcaacatctctgcgtc

SEQ ID NO: 8470424 - DNA, 22 bp, Homo sapiens
gaagctttgagagcagaagccc

SEQ ID NO: 8470425 - DNA, 22 bp, Homo sapiens
gaagcttgagaactactgtcct

SEQ ID NO: 8470426 - DNA, 22 bp, Homo sapiens
gaagcttggataactgtatggg

SEQ ID NO: 8470427 - DNA, 22 bp, Homo sapiens
gaaggaaaaatactctgtaagg

SEQ ID NO: 8470428 - DNA, 22 bp, Homo sapiens
gaagctttgtcttgtctcctgg

SEQ ID NO: 8470429 - DNA, 22 bp, Homo sapiens
gaaggaaaacagatctgcctga

SEQ ID NO: 8470430 - DNA, 22 bp, Homo sapiens
gaaggaaatctgtgatttatgc

SEQ ID NO: 8470431 - DNA, 22 bp, Homo sapiens
gaagttgatagagtacatgatt

SEQ ID NO: 8470432 - DNA, 22 bp, Homo sapiens
gaagttctttatagcagtgtga

SEQ ID NO: 8470433 - DNA, 22 bp, Homo sapiens
gacaagataatgaagtgcaatt

SEQ ID NO: 8470434 - DNA, 22 bp, Homo sapiens
gacaagactggtttatttaagg

SEQ ID NO: 8470435 - DNA, 22 bp, Homo sapiens
gacaagattaaccatagttaag

SEQ ID NO: 8470436 - DNA, 22 bp, Homo sapiens
gacaagatgacatcatggcttc

SEQ ID NO: 8470437 - DNA, 22 bp, Homo sapiens
gacaagatgagcagctcagtgt

SEQ ID NO: 8470438 - DNA, 22 bp, Homo sapiens
gacaagattaaccatagttaag

SEQ ID NO: 8470439 - DNA, 22 bp, Homo sapiens
gacaagatttagagtctgctaa

SEQ ID NO: 8470440 - DNA, 22 bp, Homo sapiens
gacaagctcccggtggccctcc

SEQ ID NO: 8470441 - DNA, 22 bp, Homo sapiens
gacaagacatgtgatgacatca

SEQ ID NO: 8470442 - DNA, 22 bp, Homo sapiens
gacaagacattggtaaagatat

SEQ ID NO: 8470443 - DNA, 22 bp, Homo sapiens
gacaagactatgtagaaagtat

SEQ ID NO: 8470444 - DNA, 17 bp, Homo sapiens
gacaagacagaattcat

SEQ ID NO: 8470445 - DNA, 22 bp, Homo sapiens
gacaagacagcttgcagacaac

SEQ ID NO: 8470446 - DNA, 22 bp, Homo sapiens
gacaagacacctctctccatcc

SEQ ID NO: 8470447 - DNA, 22 bp, Homo sapiens
gacaactgccccattttaaatg

SEQ ID NO: 8470448 - DNA, 22 bp, Homo sapiens
gaatatcccgctatgcaaagta

SEQ ID NO: 8470449 - DNA, 22 bp, Homo sapiens
gaatatatttctcttaccttta

SEQ ID NO: 8470450 - DNA, 22 bp, Homo sapiens
gaatatcccgctatgcaaagta

SEQ ID NO: 8470451 - DNA, 22 bp, Homo sapiens
gacaactgagcagaggaaatga

SEQ ID NO: 8470452 - DNA, 22 bp, Homo sapiens
gacaactgccccattttaaatg

SEQ ID NO: 8470453 - DNA, 22 bp, Homo sapiens
gaatacattggaaatcagaata

SEQ ID NO: 8470454 - DNA, 22 bp, Homo sapiens
gaatacattggaaatcagaata

SEQ ID NO: 8470455 - DNA, 22 bp, Homo sapiens
gaatacatttgccgtggttctc

SEQ ID NO: 8470456 - DNA, 22 bp, Homo sapiens
gaatacattggaaatcagaata

SEQ ID NO: 8470457 - DNA, 22 bp, Homo sapiens
gaatacatgtgtgtatagaggt

SEQ ID NO: 8470458 - DNA, 22 bp, Homo sapiens
gaatacatgttgtttccctgga

SEQ ID NO: 8470459 - DNA, 22 bp, Homo sapiens
gaatacatgtgtgtatagaggt

SEQ ID NO: 8470460 - DNA, 22 bp, Homo sapiens
gaatacatgcacgacacggggg

SEQ ID NO: 8470461 - DNA, 22 bp, Homo sapiens
gaatacatggcagggagtcatc

SEQ ID NO: 8470462 - DNA, 22 bp, Homo sapiens
gaatacatgattaaagtttgat

SEQ ID NO: 8470463 - DNA, 22 bp, Homo sapiens
gaatacatgatacatgaactgc

SEQ ID NO: 8470464 - DNA, 22 bp, Homo sapiens
gaatagcttagattccttagtg

SEQ ID NO: 8470465 - DNA, 22 bp, Homo sapiens
gaatagcttgacaattattttt

SEQ ID NO: 8470466 - DNA, 22 bp, Homo sapiens
gaatagcttccttttttccaaa

SEQ ID NO: 8470467 - DNA, 22 bp, Homo sapiens
gaatagctgtaggctagtgtct

SEQ ID NO: 8470468 - DNA, 22 bp, Homo sapiens
gaatatattattcagcttttca

SEQ ID NO: 8470469 - DNA, 22 bp, Homo sapiens
gaatatattggtgaaaatagtt

SEQ ID NO: 8470470 - DNA, 22 bp, Homo sapiens
gaatatattggtgaaaatagtt

SEQ ID NO: 8470471 - DNA, 22 bp, Homo sapiens
gaatatattggtgaaaatagtt

SEQ ID NO: 8470472 - DNA, 22 bp, Homo sapiens
gaatatattggtgaaaatagtt

SEQ ID NO: 8470473 - DNA, 22 bp, Homo sapiens
gaatatattggtgaaaatagtt

SEQ ID NO: 8470474 - DNA, 22 bp, Homo sapiens
gacaggttgaagtatcaaaggt

SEQ ID NO: 8470475 - DNA, 18 bp, Homo sapiens
gacagtaaacttccccat

SEQ ID NO: 8470476 - DNA, 22 bp, Homo sapiens
gacagtaactacagttctgtgg

SEQ ID NO: 8470477 - DNA, 22 bp, Homo sapiens
gacagtaaatgcagtctagcac

SEQ ID NO: 8470478 - DNA, 22 bp, Homo sapiens
gacagggtccaaaggcagggga

SEQ ID NO: 8470479 - DNA, 22 bp, Homo sapiens
gacagtaagtcagagacttggt

SEQ ID NO: 8470480 - DNA, 22 bp, Homo sapiens
gacagtaagtcagagacttggt

SEQ ID NO: 8470481 - DNA, 22 bp, Homo sapiens
gacagtaaggtggcttcttctt

SEQ ID NO: 8470482 - DNA, 22 bp, Homo sapiens
gacagtaactgagagatgtaat

SEQ ID NO: 8470483 - DNA, 22 bp, Homo sapiens
gacagtaactgagagatgtaat

SEQ ID NO: 8470484 - DNA, 22 bp, Homo sapiens
gacagtaagaccttaccagcct

SEQ ID NO: 8470485 - DNA, 22 bp, Homo sapiens
gacagtaagagtgtctgggttc

SEQ ID NO: 8470486 - DNA, 22 bp, Homo sapiens
gacccatataggaccctccaaa

SEQ ID NO: 8470487 - DNA, 22 bp, Homo sapiens
gacccatatatacgtaatttgt

SEQ ID NO: 8470488 - DNA, 22 bp, Homo sapiens
gacccataggaatctgttgtcc

SEQ ID NO: 8470489 - DNA, 22 bp, Homo sapiens
gacagtcccccagcagcaaacc

SEQ ID NO: 8470490 - DNA, 22 bp, Homo sapiens
gacccttagaatgtgatcttat

SEQ ID NO: 8470491 - DNA, 22 bp, Homo sapiens
gacccttagaatgtgatcttat

SEQ ID NO: 8470492 - DNA, 22 bp, Homo sapiens
gacctagattaacattctgtga

SEQ ID NO: 8470493 - DNA, 22 bp, Homo sapiens
gaccctgtttctacaaataatt

SEQ ID NO: 8470494 - DNA, 22 bp, Homo sapiens
gaccctgtttctacaaataatt

SEQ ID NO: 8470495 - DNA, 22 bp, Homo sapiens
gaccctggtgtccaggtcctgc

SEQ ID NO: 8470496 - DNA, 22 bp, Homo sapiens
gaccctggtgtccaggtcctgc

SEQ ID NO: 8470497 - DNA, 22 bp, Homo sapiens
gaccctggtgggcactggcacc

SEQ ID NO: 8470498 - DNA, 22 bp, Homo sapiens
gaccctggtgggcactggcacc

SEQ ID NO: 8470499 - DNA, 22 bp, Homo sapiens
gacaagtgctgatttatctccc

SEQ ID NO: 8470500 - DNA, 16 bp, Homo sapiens
gacaagtggaggggcc

SEQ ID NO: 8470501 - DNA, 22 bp, Homo sapiens
gacaaggaaattactagctgga

SEQ ID NO: 8470502 - DNA, 22 bp, Homo sapiens
gacaaggcaaccagggaggctt

SEQ ID NO: 8470503 - DNA, 22 bp, Homo sapiens
gacacagaattcccctccaagt

SEQ ID NO: 8470504 - DNA, 22 bp, Homo sapiens
gacacagacagttagaggtaat

SEQ ID NO: 8470505 - DNA, 22 bp, Homo sapiens
gacacagaatttactcccgata

SEQ ID NO: 8470506 - DNA, 22 bp, Homo sapiens
gacaggccaggggctgaggtgg

SEQ ID NO: 8470507 - DNA, 22 bp, Homo sapiens
gacacagagataggcctgtgtt

SEQ ID NO: 8470508 - DNA, 22 bp, Homo sapiens
gacaggctaggttgctgtcctc

SEQ ID NO: 8470509 - DNA, 22 bp, Homo sapiens
gacaggctaggttgctgtcctc

SEQ ID NO: 8470510 - DNA, 22 bp, Homo sapiens
gacaggctttctcaggatgagc

SEQ ID NO: 8470511 - DNA, 22 bp, Homo sapiens
gacaggcttcctaagtgccaga

SEQ ID NO: 8470512 - DNA, 22 bp, Homo sapiens
gacaggcttccactatgttgcc

SEQ ID NO: 8470513 - DNA, 22 bp, Homo sapiens
gacaggctttgagtcccagaac

SEQ ID NO: 8470514 - DNA, 22 bp, Homo sapiens
gacaggctttgagtcccagaac

SEQ ID NO: 8470515 - DNA, 22 bp, Homo sapiens
gacaggctttctcaggatgagc

SEQ ID NO: 8470516 - DNA, 22 bp, Homo sapiens
gacaggctttgagtcccagaac

SEQ ID NO: 8470517 - DNA, 22 bp, Homo sapiens
gacagggaaacattgaagtgtc

SEQ ID NO: 8470518 - DNA, 22 bp, Homo sapiens
gacaggcttcctaagtgccaga

SEQ ID NO: 8470519 - DNA, 22 bp, Homo sapiens
gacagggaacttcattagctgt

SEQ ID NO: 8470520 - DNA, 17 bp, Homo sapiens
gacaggctcagtgacga

SEQ ID NO: 8470521 - DNA, 22 bp, Homo sapiens
gacaggctattttcttacgggt

SEQ ID NO: 8470522 - DNA, 17 bp, Homo sapiens
gacaggctcagtgacga

SEQ ID NO: 8470523 - DNA, 22 bp, Homo sapiens
gacaggctggcaatgccctgct

SEQ ID NO: 8470524 - DNA, 22 bp, Homo sapiens
gacaggcttagggagggtgctc

SEQ ID NO: 8470525 - DNA, 22 bp, Homo sapiens
gacaggcttagggagggtgctc

SEQ ID NO: 8470526 - DNA, 22 bp, Homo sapiens
gacaggctggcaatgccctgct

SEQ ID NO: 8470527 - DNA, 22 bp, Homo sapiens
gacaggctgtgatggccgggag

SEQ ID NO: 8470528 - DNA, 22 bp, Homo sapiens
gacaggcttcatcctcagagtt

SEQ ID NO: 8470529 - DNA, 22 bp, Homo sapiens
gacaggcttcatcctcagagtt

SEQ ID NO: 8470530 - DNA, 22 bp, Homo sapiens
gacaggcttcatgatggcagga

SEQ ID NO: 8470531 - DNA, 22 bp, Homo sapiens
gacaggcttcatgatggcagga

SEQ ID NO: 8470532 - DNA, 22 bp, Homo sapiens
gacagggacacagccagtgagg

SEQ ID NO: 8470533 - DNA, 22 bp, Homo sapiens
gacaggggtccctctgggctgt

SEQ ID NO: 8470534 - DNA, 22 bp, Homo sapiens
ggctttagggcaggcagtgtta

SEQ ID NO: 8470535 - DNA, 22 bp, Homo sapiens
gggacaggcaaaggtatgcttc

SEQ ID NO: 8470536 - DNA, 22 bp, Homo sapiens
ggcttctggtaaagaccacacc

SEQ ID NO: 8470537 - DNA, 22 bp, Homo sapiens
ggcttgggagcaggcatgtgac

SEQ ID NO: 8470538 - DNA, 22 bp, Homo sapiens
ggcttggcttgggctcagaggc

SEQ ID NO: 8470539 - DNA, 22 bp, Homo sapiens
ggcttcttaatcatgagagtga

SEQ ID NO: 8470540 - DNA, 22 bp, Homo sapiens
ggcttggctgtctcccagccca

SEQ ID NO: 8470541 - DNA, 21 bp, Homo sapiens
ggcttgtcaccatagctactg

SEQ ID NO: 8470542 - DNA, 22 bp, Homo sapiens
ggcttgtccttctggttgtctt

SEQ ID NO: 8470543 - DNA, 22 bp, Homo sapiens
gggagaagtggaaatctcatta

SEQ ID NO: 8470544 - DNA, 22 bp, Homo sapiens
gggagaagtggaaatctcatta

SEQ ID NO: 8470545 - DNA, 22 bp, Homo sapiens
gggaccagaggctgtgcacaat

SEQ ID NO: 8470546 - DNA, 23 bp, Homo sapiens
gggaccagctagggctgtgacct

SEQ ID NO: 8470547 - DNA, 22 bp, Homo sapiens
gggaccagaagaaggatggtga

SEQ ID NO: 8470548 - DNA, 22 bp, Homo sapiens
gggaccagaagaaggatggtga

SEQ ID NO: 8470549 - DNA, 22 bp, Homo sapiens
gggacaggcccctcgctagctt

SEQ ID NO: 8470550 - DNA, 22 bp, Homo sapiens
gggacatctttctagtcagggt

SEQ ID NO: 8470551 - DNA, 22 bp, Homo sapiens
gggagctggttcctgccctcca

SEQ ID NO: 8470552 - DNA, 22 bp, Homo sapiens
gggagctggggcatttataccc

SEQ ID NO: 8470553 - DNA, 18 bp, Homo sapiens
gggagctgggaagctggt

SEQ ID NO: 8470554 - DNA, 19 bp, Homo sapiens
gggagctgtctgcccgtgg

SEQ ID NO: 8470555 - DNA, 22 bp, Homo sapiens
gggagctgtagtccagataccg

SEQ ID NO: 8470556 - DNA, 22 bp, Homo sapiens
gggagctgtagtccagataccg

SEQ ID NO: 8470557 - DNA, 22 bp, Homo sapiens
gggagaggttacccgagcaact

SEQ ID NO: 8470558 - DNA, 22 bp, Homo sapiens
gggagaggttacccgagcaact

SEQ ID NO: 8470559 - DNA, 18 bp, Homo sapiens
gggagctgggaagctggt

SEQ ID NO: 8470560 - DNA, 22 bp, Homo sapiens
gggagctggcggattccccagg

SEQ ID NO: 8470561 - DNA, 22 bp, Homo sapiens
gggagagatgctgattgccaat

SEQ ID NO: 8470562 - DNA, 22 bp, Homo sapiens
gggagagaattattgccagacc

SEQ ID NO: 8470563 - DNA, 22 bp, Homo sapiens
gggagagaattattgccagacc

SEQ ID NO: 8470564 - DNA, 22 bp, Homo sapiens
gggagagaaattatagcaatga

SEQ ID NO: 8470565 - DNA, 22 bp, Homo sapiens
gggagacccccaatgccaggtc

SEQ ID NO: 8470566 - DNA, 22 bp, Homo sapiens
gggagacagttcagatagtttc

SEQ ID NO: 8470567 - DNA, 22 bp, Homo sapiens
gggagacaaaggtgaggttctt

SEQ ID NO: 8470568 - DNA, 22 bp, Homo sapiens
gggagacacgctgcaggcataa

SEQ ID NO: 8470569 - DNA, 22 bp, Homo sapiens
gggcaagaagctggaagcattc

SEQ ID NO: 8470570 - DNA, 22 bp, Homo sapiens
gggcaaagtggtggaggcagtt

SEQ ID NO: 8470571 - DNA, 22 bp, Homo sapiens
gggcacagcccagtggggtccc

SEQ ID NO: 8470572 - DNA, 22 bp, Homo sapiens
gggcaagaagctggaagcattc

SEQ ID NO: 8470573 - DNA, 19 bp, Homo sapiens
gggcacagcctccccccag

SEQ ID NO: 8470574 - DNA, 22 bp, Homo sapiens
gggcacagcctaactatggaga

SEQ ID NO: 8470575 - DNA, 22 bp, Homo sapiens
gggcacagcctaactatggaga

SEQ ID NO: 8470576 - DNA, 22 bp, Homo sapiens
gggcacagcctaactatggaga

SEQ ID NO: 8470577 - DNA, 22 bp, Homo sapiens
gggcacagcctaactatggaga

SEQ ID NO: 8470578 - DNA, 22 bp, Homo sapiens
gggatggggtcgggaccctgct

SEQ ID NO: 8470579 - DNA, 22 bp, Homo sapiens
gggatggggtcgggaccctgct

SEQ ID NO: 8470580 - DNA, 22 bp, Homo sapiens
gggatggggtcaacatgtacct

SEQ ID NO: 8470581 - DNA, 22 bp, Homo sapiens
gggcaaaatacttataaaggct

SEQ ID NO: 8470582 - DNA, 22 bp, Homo sapiens
gggcaaaacctgggcatcatga

SEQ ID NO: 8470583 - DNA, 22 bp, Homo sapiens
gggattgaattgggggatcaca

SEQ ID NO: 8470584 - DNA, 23 bp, Homo sapiens
gggagctgtggtgaaaagaggtg

SEQ ID NO: 8470585 - DNA, 22 bp, Homo sapiens
gggaggaaatgtgcagcgaatt

SEQ ID NO: 8470586 - DNA, 22 bp, Homo sapiens
gggaggaaatgtgcagcgaatt

SEQ ID NO: 8470587 - DNA, 22 bp, Homo sapiens
gggcaggagagggccacctgga

SEQ ID NO: 8470588 - DNA, 22 bp, Homo sapiens
gggcaggagagggccacctgga

SEQ ID NO: 8470589 - DNA, 22 bp, Homo sapiens
gggcaggagaaggtggatgtcc

SEQ ID NO: 8470590 - DNA, 22 bp, Homo sapiens
gggcaggctgagcatgtcacct

SEQ ID NO: 8470591 - DNA, 22 bp, Homo sapiens
gggcaggctgagcatgtcacct

SEQ ID NO: 8470592 - DNA, 19 bp, Homo sapiens
gggcatgctggctctagag

SEQ ID NO: 8470593 - DNA, 22 bp, Homo sapiens
gggcatgcctgcgcagtgcatg

SEQ ID NO: 8470594 - DNA, 22 bp, Homo sapiens
gggcaggctgagcatgtcacct

SEQ ID NO: 8470595 - DNA, 22 bp, Homo sapiens
gggcagctctgcccatcagagg

SEQ ID NO: 8470596 - DNA, 22 bp, Homo sapiens
gggcagctctggctgtgggaag

SEQ ID NO: 8470597 - DNA, 22 bp, Homo sapiens
gggcagctctggctgtgggaag

SEQ ID NO: 8470598 - DNA, 22 bp, Homo sapiens
gggcacaggaatttgggatgtg

SEQ ID NO: 8470599 - DNA, 22 bp, Homo sapiens
gggcacaggaatttgggatgtg

SEQ ID NO: 8470600 - DNA, 22 bp, Homo sapiens
gggcacagctgctacccagtgc

SEQ ID NO: 8470601 - DNA, 22 bp, Homo sapiens
gggcagctgtatctgagcttat

SEQ ID NO: 8470602 - DNA, 22 bp, Homo sapiens
gggcagctgccagaggccatgg

SEQ ID NO: 8470603 - DNA, 22 bp, Homo sapiens
gggcagctgccagaggccatgg

SEQ ID NO: 8470604 - DNA, 22 bp, Homo sapiens
gggcagctgccagaggccatgg

SEQ ID NO: 8470605 - DNA, 22 bp, Homo sapiens
ggctctgggaaatggtcttcct

SEQ ID NO: 8470606 - DNA, 22 bp, Homo sapiens
ggctctgggaaatggtcttcct

SEQ ID NO: 8470607 - DNA, 22 bp, Homo sapiens
ggctctgggcatagaaggaagc

SEQ ID NO: 8470608 - DNA, 22 bp, Homo sapiens
ggctctgggcatagaaggaagc

SEQ ID NO: 8470609 - DNA, 19 bp, Homo sapiens
ggctctggcggctgtagcc

SEQ ID NO: 8470610 - DNA, 19 bp, Homo sapiens
ggctctggcggctgtagcc

SEQ ID NO: 8470611 - DNA, 22 bp, Homo sapiens
ggctctggcgtccaatggagcg

SEQ ID NO: 8470612 - DNA, 22 bp, Homo sapiens
ggctctggctactccaccctgt

SEQ ID NO: 8470613 - DNA, 22 bp, Homo sapiens
ggctctggcggctctttcaata

SEQ ID NO: 8470614 - DNA, 22 bp, Homo sapiens
ggctctggcaaggggaggctac

SEQ ID NO: 8470615 - DNA, 22 bp, Homo sapiens
ggctctggagcacagacgtctg

SEQ ID NO: 8470616 - DNA, 22 bp, Homo sapiens
ggctctggagatgtccgacctg

SEQ ID NO: 8470617 - DNA, 22 bp, Homo sapiens
ggctctggagacatgtggagag

SEQ ID NO: 8470618 - DNA, 22 bp, Homo sapiens
ggctctggagacatgtggagag

SEQ ID NO: 8470619 - DNA, 22 bp, Homo sapiens
ggctgagaatcaacaacctgct

SEQ ID NO: 8470620 - DNA, 22 bp, Homo sapiens
ggctgagaatcaacaacctgct

SEQ ID NO: 8470621 - DNA, 23 bp, Homo sapiens
ggctgagaagtcccatgataggt

SEQ ID NO: 8470622 - DNA, 22 bp, Homo sapiens
ggctgagaaggagtgggtgagg

SEQ ID NO: 8470623 - DNA, 22 bp, Homo sapiens
ggctgagactagagtgaggcat

SEQ ID NO: 8470624 - DNA, 22 bp, Homo sapiens
ggctgagacaacctgggaccca

SEQ ID NO: 8470625 - DNA, 22 bp, Homo sapiens
ggctcttctgtggcagccaagg

SEQ ID NO: 8470626 - DNA, 22 bp, Homo sapiens
ggctcttgagaggcacaggttt

SEQ ID NO: 8470627 - DNA, 22 bp, Homo sapiens
ggctcttgagaggcacaggttt

SEQ ID NO: 8470628 - DNA, 22 bp, Homo sapiens
ggctcttgggagctcagagttg

SEQ ID NO: 8470629 - DNA, 22 bp, Homo sapiens
ggctcttgggagctcagagttg

SEQ ID NO: 8470630 - DNA, 22 bp, Homo sapiens
ggctcttgttcgtaccatggct

SEQ ID NO: 8470631 - DNA, 22 bp, Homo sapiens
ggctcttgttcgtaccatggct

SEQ ID NO: 8470632 - DNA, 22 bp, Homo sapiens
ggctgaaaggtagtagtaggct

SEQ ID NO: 8470633 - DNA, 22 bp, Homo sapiens
ggctgaaagcgcgacttgcccc

SEQ ID NO: 8470634 - DNA, 22 bp, Homo sapiens
ggctgaaacagatttcaagaca

SEQ ID NO: 8470635 - DNA, 22 bp, Homo sapiens
ggctgaaaccgttatccactga

SEQ ID NO: 8470636 - DNA, 22 bp, Homo sapiens
ggctgaaattggatccttgggc

SEQ ID NO: 8470637 - DNA, 20 bp, Homo sapiens
ggctgaaagtagaaagtatt

SEQ ID NO: 8470638 - DNA, 22 bp, Homo sapiens
ggctgaaattcagagtaaattc

SEQ ID NO: 8470639 - DNA, 22 bp, Homo sapiens
ggctgaaaggtgggaggatggc

SEQ ID NO: 8470640 - DNA, 22 bp, Homo sapiens
ggctccaccctgcttccagaag

SEQ ID NO: 8470641 - DNA, 22 bp, Homo sapiens
ggctccagaaacttcagtccat

SEQ ID NO: 8470642 - DNA, 22 bp, Homo sapiens
ggctccagaaatcatagagcag

SEQ ID NO: 8470643 - DNA, 16 bp, Homo sapiens
ggctccagaatagcga

SEQ ID NO: 8470644 - DNA, 22 bp, Homo sapiens
ggctccagatgtcccctggcaa

SEQ ID NO: 8470645 - DNA, 22 bp, Homo sapiens
ggctccagatgtcccctggcaa

SEQ ID NO: 8470646 - DNA, 22 bp, Homo sapiens
ggctccagaggccttacctgca

SEQ ID NO: 8470647 - DNA, 22 bp, Homo sapiens
ggctccaggagggccttggcca

SEQ ID NO: 8470648 - DNA, 22 bp, Homo sapiens
ggctccaggagggccttggcca

SEQ ID NO: 8470649 - DNA, 22 bp, Homo sapiens
ggctctgctcacagcccgcagc

SEQ ID NO: 8470650 - DNA, 22 bp, Homo sapiens
ggctccaggagatgctgggcag

SEQ ID NO: 8470651 - DNA, 22 bp, Homo sapiens
ggctctgctcctggtgccagtg

SEQ ID NO: 8470652 - DNA, 22 bp, Homo sapiens
ggctctgctgcacccttggctc

SEQ ID NO: 8470653 - DNA, 22 bp, Homo sapiens
ggctctggagacatgtggagag

SEQ ID NO: 8470654 - DNA, 22 bp, Homo sapiens
ggctccagccctggctcttcac

SEQ ID NO: 8470655 - DNA, 22 bp, Homo sapiens
ggctccagccctggctcttcac

SEQ ID NO: 8470656 - DNA, 22 bp, Homo sapiens
ggctccagatgtctcctggcaa

SEQ ID NO: 8470657 - DNA, 22 bp, Homo sapiens
ggctccagatgtctcctggcaa

SEQ ID NO: 8470658 - DNA, 22 bp, Homo sapiens
ggctccagatgtctcctggcaa

SEQ ID NO: 8470659 - DNA, 22 bp, Homo sapiens
ggctccaggaacctcctctcct

SEQ ID NO: 8470660 - DNA, 22 bp, Homo sapiens
ggctccaggaacctcctctcct

SEQ ID NO: 8470661 - DNA, 18 bp, Homo sapiens
ggctccaggacctaccca

SEQ ID NO: 8470662 - DNA, 22 bp, Homo sapiens
ggctgctgaagtgtggcaatct

SEQ ID NO: 8470663 - DNA, 22 bp, Homo sapiens
ggctgctgaagtgtggcaatct

SEQ ID NO: 8470664 - DNA, 19 bp, Homo sapiens
ggctgctgaagagaattac

SEQ ID NO: 8470665 - DNA, 22 bp, Homo sapiens
ggctgctgacaaacatgatcat

SEQ ID NO: 8470666 - DNA, 22 bp, Homo sapiens
ggctgagcaattttgatgacat

SEQ ID NO: 8470667 - DNA, 22 bp, Homo sapiens
ggctgagcactttaggcaggag

SEQ ID NO: 8470668 - DNA, 21 bp, Homo sapiens
ggctgagatggcagaatcacc

SEQ ID NO: 8470669 - DNA, 22 bp, Homo sapiens
ggctgagagtttcctctggggc

SEQ ID NO: 8470670 - DNA, 22 bp, Homo sapiens
ggctgctgagttggccaggaga

SEQ ID NO: 8470671 - DNA, 22 bp, Homo sapiens
ggctgctgcccacccctgcatg

SEQ ID NO: 8470672 - DNA, 22 bp, Homo sapiens
ggctgctgctgtgtaggcctgt

SEQ ID NO: 8470673 - DNA, 22 bp, Homo sapiens
ggctgctgctgtgtaggcctgt

SEQ ID NO: 8470674 - DNA, 22 bp, Homo sapiens
ggctgctgggaatatgccagct

SEQ ID NO: 8470675 - DNA, 22 bp, Homo sapiens
ggctgctggcattgaggtaggt

SEQ ID NO: 8470676 - DNA, 22 bp, Homo sapiens
ggctggcttggtgagctgtcac

SEQ ID NO: 8470677 - DNA, 22 bp, Homo sapiens
ggctgggaggatgacttgctac

SEQ ID NO: 8470678 - DNA, 22 bp, Homo sapiens
ggctggcttgcggagtcacaga

SEQ ID NO: 8470679 - DNA, 22 bp, Homo sapiens
ggctggcttgccaagctcaggg

SEQ ID NO: 8470680 - DNA, 22 bp, Homo sapiens
ggctgggaggccgtgctgacct

SEQ ID NO: 8470681 - DNA, 22 bp, Homo sapiens
ggctgggaggccgtgctgacct

SEQ ID NO: 8470682 - DNA, 22 bp, Homo sapiens
ggctgggcaggtctgcacaggg

SEQ ID NO: 8470683 - DNA, 22 bp, Homo sapiens
ggctgggcatccatccatgaga

SEQ ID NO: 8470684 - DNA, 22 bp, Homo sapiens
ggctgggctccgggagcatgcg

SEQ ID NO: 8470685 - DNA, 22 bp, Homo sapiens
ggctgggctcgctgattggctg

SEQ ID NO: 8470686 - DNA, 22 bp, Homo sapiens
ggctgggccgcggctacccaga

SEQ ID NO: 8470687 - DNA, 22 bp, Homo sapiens
ggcttctcctggaagtacagag

SEQ ID NO: 8470688 - DNA, 22 bp, Homo sapiens
ggcttctcctggaagtacagag

SEQ ID NO: 8470689 - DNA, 22 bp, Homo sapiens
ggcttctcccttcttctgattg

SEQ ID NO: 8470690 - DNA, 22 bp, Homo sapiens
ggcttctcccattcttcagggg

SEQ ID NO: 8470691 - DNA, 22 bp, Homo sapiens
ggcttctcccattcttcagggg

SEQ ID NO: 8470692 - DNA, 22 bp, Homo sapiens
ggcttctcccctttgagtcttc

SEQ ID NO: 8470693 - DNA, 22 bp, Homo sapiens
ggcttctcccctttgagtcttc

SEQ ID NO: 8470694 - DNA, 22 bp, Homo sapiens
ggcttctctaaagatcatgcgt

SEQ ID NO: 8470695 - DNA, 22 bp, Homo sapiens
ggcttctctaaagatcatgcgt

SEQ ID NO: 8470696 - DNA, 22 bp, Homo sapiens
ggcttctcgtgccgaagcaaga

SEQ ID NO: 8470697 - DNA, 22 bp, Homo sapiens
ggcttctctccagtatgcattc

SEQ ID NO: 8470698 - DNA, 22 bp, Homo sapiens
ggcttctctcccccagctccac

SEQ ID NO: 8470699 - DNA, 22 bp, Homo sapiens
ggcttctctcccccagctccac

SEQ ID NO: 8470700 - DNA, 22 bp, Homo sapiens
ggcttctgctcagcctgcacgc

SEQ ID NO: 8470701 - DNA, 22 bp, Homo sapiens
ggcttctgccacgagagggaag

SEQ ID NO: 8470702 - DNA, 22 bp, Homo sapiens
ggcttctggtgggagcatgact

SEQ ID NO: 8470703 - DNA, 22 bp, Homo sapiens
ggcttctgtctcaagcaccagc

SEQ ID NO: 8470704 - DNA, 22 bp, Homo sapiens
ggcttctgaaatctctgtgcgt

SEQ ID NO: 8470705 - DNA, 22 bp, Homo sapiens
ggcttctctgtctagtttctac

SEQ ID NO: 8470706 - DNA, 18 bp, Homo sapiens
ggcttctctgtttatttc

SEQ ID NO: 8470707 - DNA, 22 bp, Homo sapiens
ggcttctctcttcacatggctt

SEQ ID NO: 8470708 - DNA, 22 bp, Homo sapiens
ggcttctgagtgctctgctgtt

SEQ ID NO: 8470709 - DNA, 21 bp, Homo sapiens
ggcaagaaacacaatcaagta

SEQ ID NO: 8470710 - DNA, 22 bp, Homo sapiens
ggcaactcttcttgcaatgggg

SEQ ID NO: 8470711 - DNA, 22 bp, Homo sapiens
ggcaagaaggcttcaggtagct

SEQ ID NO: 8470712 - DNA, 22 bp, Homo sapiens
ggcaagagggcagatggagtgc

SEQ ID NO: 8470713 - DNA, 22 bp, Homo sapiens
ggcaagaaggcttcaggtagct

SEQ ID NO: 8470714 - DNA, 21 bp, Homo sapiens
ggcaacagatattttgcttag

SEQ ID NO: 8470715 - DNA, 19 bp, Homo sapiens
ggcaagcacaaaagctttg

SEQ ID NO: 8470716 - DNA, 22 bp, Homo sapiens
ggcaagctcaggcctcaggtgt

SEQ ID NO: 8470717 - DNA, 22 bp, Homo sapiens
ggcaagagtgaggagtgtctct

SEQ ID NO: 8470718 - DNA, 22 bp, Homo sapiens
ggcaagatccaaggggctagga

SEQ ID NO: 8470719 - DNA, 22 bp, Homo sapiens
ggcaagaggtccaagaggtctc

SEQ ID NO: 8470720 - DNA, 22 bp, Homo sapiens
ggcaaaaacagcaatgactttt

SEQ ID NO: 8470721 - DNA, 22 bp, Homo sapiens
ggcaaaaaccacaattactttt

SEQ ID NO: 8470722 - DNA, 22 bp, Homo sapiens
ggcaaaaaccgcaataacttct

SEQ ID NO: 8470723 - DNA, 22 bp, Homo sapiens
ggcaaaaagttcccatcagtgt

SEQ ID NO: 8470724 - DNA, 22 bp, Homo sapiens
ggcaaaaagttcccatcagtgt

SEQ ID NO: 8470725 - DNA, 22 bp, Homo sapiens
ggcaaaaaccgcaataacttct

SEQ ID NO: 8470726 - DNA, 22 bp, Homo sapiens
ggcaaaaaccataattactttt

SEQ ID NO: 8470727 - DNA, 22 bp, Homo sapiens
ggcaaaaatcacccctggttca

SEQ ID NO: 8470728 - DNA, 22 bp, Homo sapiens
ggcaaaagtattatctctttaa

SEQ ID NO: 8470729 - DNA, 22 bp, Homo sapiens
ggcaaaaatcacccctggttca

SEQ ID NO: 8470730 - DNA, 22 bp, Homo sapiens
ggagtgatggaaagtgcttggc

SEQ ID NO: 8470731 - DNA, 23 bp, Homo sapiens
ggagtgcaatggcgccatctcgg

SEQ ID NO: 8470732 - DNA, 22 bp, Homo sapiens
ggagtattgtagcttccagttc

SEQ ID NO: 8470733 - DNA, 19 bp, Homo sapiens
ggagccagctgtggaaggc

SEQ ID NO: 8470734 - DNA, 19 bp, Homo sapiens
ggagccagctgtggaaggc

SEQ ID NO: 8470735 - DNA, 22 bp, Homo sapiens
ggagccagagtctgcagtgtaa

SEQ ID NO: 8470736 - DNA, 22 bp, Homo sapiens
ggagccagagtttaatgtggag

SEQ ID NO: 8470737 - DNA, 22 bp, Homo sapiens
ggagccagagggatgcagttga

SEQ ID NO: 8470738 - DNA, 22 bp, Homo sapiens
ggagccagagcactggggagcc

SEQ ID NO: 8470739 - DNA, 22 bp, Homo sapiens
ggagccagagcactggggagcc

SEQ ID NO: 8470740 - DNA, 22 bp, Homo sapiens
ggagccagaggctgctgctgtg

SEQ ID NO: 8470741 - DNA, 22 bp, Homo sapiens
ggagccagaggctgctgctgtg

SEQ ID NO: 8470742 - DNA, 22 bp, Homo sapiens
ggagtcctggactccatctcac

SEQ ID NO: 8470743 - DNA, 22 bp, Homo sapiens
ggagtctgactctgaccctgga

SEQ ID NO: 8470744 - DNA, 22 bp, Homo sapiens
ggagtgaggcatttgtagctga

SEQ ID NO: 8470745 - DNA, 22 bp, Homo sapiens
ggagtctgattttttatgggtg

SEQ ID NO: 8470746 - DNA, 22 bp, Homo sapiens
ggagtctgatactgagttcctc

SEQ ID NO: 8470747 - DNA, 22 bp, Homo sapiens
ggagtctgagcttgtgtcctgg

SEQ ID NO: 8470748 - DNA, 22 bp, Homo sapiens
ggagtctgagtcctcatagaca

SEQ ID NO: 8470749 - DNA, 19 bp, Homo sapiens
ggagtctgagcccaggtat

SEQ ID NO: 8470750 - DNA, 19 bp, Homo sapiens
ggagtctgagcccaggtat

SEQ ID NO: 8470751 - DNA, 22 bp, Homo sapiens
ggcacagcgactaccatcgaaa

SEQ ID NO: 8470752 - DNA, 21 bp, Homo sapiens
ggcacagcctgaaatgcctca

SEQ ID NO: 8470753 - DNA, 22 bp, Homo sapiens
ggcacagcgactaccatcgaaa

SEQ ID NO: 8470754 - DNA, 22 bp, Homo sapiens
ggcacagctcaggtcccagctc

SEQ ID NO: 8470755 - DNA, 22 bp, Homo sapiens
ggcacagctacttgctcactct

SEQ ID NO: 8470756 - DNA, 22 bp, Homo sapiens
ggcacagctacttgctcactct

SEQ ID NO: 8470757 - DNA, 22 bp, Homo sapiens
ggcacagccctctctgtggaca

SEQ ID NO: 8470758 - DNA, 22 bp, Homo sapiens
ggcacagccactttggagaact

SEQ ID NO: 8470759 - DNA, 22 bp, Homo sapiens
ggcacagccactttggagaact

SEQ ID NO: 8470760 - DNA, 22 bp, Homo sapiens
ggcacagcaggagctatgtgaa

SEQ ID NO: 8470761 - DNA, 22 bp, Homo sapiens
ggcaccagcacttgggatggct

SEQ ID NO: 8470762 - DNA, 17 bp, Homo sapiens
ggcaccagacggagagt

SEQ ID NO: 8470763 - DNA, 17 bp, Homo sapiens
ggcaccagacggagagt

SEQ ID NO: 8470764 - DNA, 22 bp, Homo sapiens
ggcaccagcaggcaccgatgcc

SEQ ID NO: 8470765 - DNA, 22 bp, Homo sapiens
ggcaccagccacctatttctag

SEQ ID NO: 8470766 - DNA, 22 bp, Homo sapiens
ggcacagctgatgcagacacac

SEQ ID NO: 8470767 - DNA, 22 bp, Homo sapiens
ggcacagctcaggtcccagctc

SEQ ID NO: 8470768 - DNA, 22 bp, Homo sapiens
ggcacagctcaggtcccagctc

SEQ ID NO: 8470769 - DNA, 22 bp, Homo sapiens
ggcacaggaatctgtgaagtgc

SEQ ID NO: 8470770 - DNA, 22 bp, Homo sapiens
ggcacaggaatctgtgaagtgc

SEQ ID NO: 8470771 - DNA, 22 bp, Homo sapiens
ggcacagctgatgcagacacac

SEQ ID NO: 8470772 - DNA, 22 bp, Homo sapiens
ggcagaggagctggaaacatgg

SEQ ID NO: 8470773 - DNA, 22 bp, Homo sapiens
ggcagaggaggggtgaatttgc

SEQ ID NO: 8470774 - DNA, 23 bp, Homo sapiens
ggcaccaggccatggagcgggag

SEQ ID NO: 8470775 - DNA, 22 bp, Homo sapiens
ggcaccaggatcagtctgtcat

SEQ ID NO: 8470776 - DNA, 22 bp, Homo sapiens
ggcaccaggacatgactcccag

SEQ ID NO: 8470777 - DNA, 20 bp, Homo sapiens
ggcaccaggctaggattgga

SEQ ID NO: 8470778 - DNA, 22 bp, Homo sapiens
ggcagaggaaggatgaattcac

SEQ ID NO: 8470779 - DNA, 22 bp, Homo sapiens
ggcaggcaacggaccactagtc

SEQ ID NO: 8470780 - DNA, 22 bp, Homo sapiens
ggcaggcaagtctgctctgtga

SEQ ID NO: 8470781 - DNA, 22 bp, Homo sapiens
ggcaggcaaggcagcctggtga

SEQ ID NO: 8470782 - DNA, 22 bp, Homo sapiens
ggcaggcaaggcagcctggtga

SEQ ID NO: 8470783 - DNA, 22 bp, Homo sapiens
ggcaggcaaggcagcctggtga

SEQ ID NO: 8470784 - DNA, 22 bp, Homo sapiens
ggcaggcacatttgggggccgt

SEQ ID NO: 8470785 - DNA, 22 bp, Homo sapiens
ggcaggcacatttgggggccgt

SEQ ID NO: 8470786 - DNA, 22 bp, Homo sapiens
ggcaggcactgtgctaggcgct

SEQ ID NO: 8470787 - DNA, 20 bp, Homo sapiens
ggcagagggcctgggagaag

SEQ ID NO: 8470788 - DNA, 20 bp, Homo sapiens
ggcagagggcctgggagaag

SEQ ID NO: 8470789 - DNA, 20 bp, Homo sapiens
ggcagagggcctgggagaag

SEQ ID NO: 8470790 - DNA, 22 bp, Homo sapiens
ggcagaggtagctggaaccagg

SEQ ID NO: 8470791 - DNA, 22 bp, Homo sapiens
ggcagaggtagctggaaccagg

SEQ ID NO: 8470792 - DNA, 22 bp, Homo sapiens
ggcagaggtagctggaaccagg

SEQ ID NO: 8470793 - DNA, 22 bp, Homo sapiens
ggcagaggtagctggaaccagg

SEQ ID NO: 8470794 - DNA, 22 bp, Homo sapiens
ggcagaggtagctggaaccagg

SEQ ID NO: 8470795 - DNA, 22 bp, Homo sapiens
ggcaggaggaagagttagcacc

SEQ ID NO: 8470796 - DNA, 22 bp, Homo sapiens
ggcaggaggtgagtggcgggtg

SEQ ID NO: 8470797 - DNA, 22 bp, Homo sapiens
ggcaggaggtgagtggcgggtg

SEQ ID NO: 8470798 - DNA, 22 bp, Homo sapiens
ggcctcagagaaggctgtgcgg

SEQ ID NO: 8470799 - DNA, 22 bp, Homo sapiens
ggcctcagagaaggctgtgcgg

SEQ ID NO: 8470800 - DNA, 22 bp, Homo sapiens
ggcctcagaccggagctggcca

SEQ ID NO: 8470801 - DNA, 22 bp, Homo sapiens
ggcctcagaccggagctggcca

SEQ ID NO: 8470802 - DNA, 22 bp, Homo sapiens
ggccatggaccccgagctgacc

SEQ ID NO: 8470803 - DNA, 22 bp, Homo sapiens
ggccatgctgttgcctgctggt

SEQ ID NO: 8470804 - DNA, 22 bp, Homo sapiens
ggccatgctgttgcctgctggt

SEQ ID NO: 8470805 - DNA, 22 bp, Homo sapiens
ggccatgcctgtgggtgcaggc

SEQ ID NO: 8470806 - DNA, 22 bp, Homo sapiens
ggccatgcctggtctggcacca

SEQ ID NO: 8470807 - DNA, 22 bp, Homo sapiens
ggcctcagggtcactctgtaga

SEQ ID NO: 8470808 - DNA, 18 bp, Homo sapiens
ggcctcagcctggccgga

SEQ ID NO: 8470809 - DNA, 18 bp, Homo sapiens
ggcctcagcctggccgga

SEQ ID NO: 8470810 - DNA, 23 bp, Homo sapiens
ggcctcagcgcacagaaactgct

SEQ ID NO: 8470811 - DNA, 23 bp, Homo sapiens
ggcctcagcgcacagaaactgct

SEQ ID NO: 8470812 - DNA, 21 bp, Homo sapiens
ggcctcagccacctggctctg

SEQ ID NO: 8470813 - DNA, 21 bp, Homo sapiens
ggcctcagccacctggctctg

SEQ ID NO: 8470814 - DNA, 21 bp, Homo sapiens
ggcctcagccacctggctctg

SEQ ID NO: 8470815 - DNA, 21 bp, Homo sapiens
ggcctcagccacctggctctg

SEQ ID NO: 8470816 - DNA, 18 bp, Homo sapiens
ggcctcagcctggccgga

SEQ ID NO: 8470817 - DNA, 22 bp, Homo sapiens
ggcctctggttcacagggagga

SEQ ID NO: 8470818 - DNA, 22 bp, Homo sapiens
ggcctctggttcgtggtgacct

SEQ ID NO: 8470819 - DNA, 21 bp, Homo sapiens
ggcctctgtcatcctgggaag

SEQ ID NO: 8470820 - DNA, 22 bp, Homo sapiens
ggcctctgtttggagccaggat

SEQ ID NO: 8470821 - DNA, 22 bp, Homo sapiens
ggcctctgtttggagccaggat

SEQ ID NO: 8470822 - DNA, 22 bp, Homo sapiens
ggcctctgtttggagccaggat

SEQ ID NO: 8470823 - DNA, 22 bp, Homo sapiens
ggcctcttatctggctcctgca

SEQ ID NO: 8470824 - DNA, 23 bp, Homo sapiens
ggcctctgtgttctgcccacatg

SEQ ID NO: 8470825 - DNA, 23 bp, Homo sapiens
ggcctctgtgttctgcccacatg

SEQ ID NO: 8470826 - DNA, 22 bp, Homo sapiens
ggcctctgttctgcattcctcc

SEQ ID NO: 8470827 - DNA, 22 bp, Homo sapiens
ggcctcagtgggccgctgcagg

SEQ ID NO: 8470828 - DNA, 22 bp, Homo sapiens
ggcctcagtgggccgctgcagg

SEQ ID NO: 8470829 - DNA, 22 bp, Homo sapiens
ggcctcagtgggccgctgcagg

SEQ ID NO: 8470830 - DNA, 22 bp, Homo sapiens
ggcctcagtgggccgctgcagg

SEQ ID NO: 8470831 - DNA, 22 bp, Homo sapiens
ggcctcagggttgggcccatta

SEQ ID NO: 8470832 - DNA, 22 bp, Homo sapiens
ggcctcagtttctccatgggtt

SEQ ID NO: 8470833 - DNA, 22 bp, Homo sapiens
ggcctctggttcacagggagga

SEQ ID NO: 8470834 - DNA, 22 bp, Homo sapiens
ggcctcagtttcttcaactgta

SEQ ID NO: 8470835 - DNA, 22 bp, Homo sapiens
ggcctcagtttcttcaactgta

SEQ ID NO: 8470836 - DNA, 22 bp, Homo sapiens
ggcctgatctttgaccctcatc

SEQ ID NO: 8470837 - DNA, 22 bp, Homo sapiens
ggcctgagtcccacctggctgt

SEQ ID NO: 8470838 - DNA, 22 bp, Homo sapiens
ggcctgagtcacatcaggagag

SEQ ID NO: 8470839 - DNA, 21 bp, Homo sapiens
ggcctgagtataggacaggcc

SEQ ID NO: 8470840 - DNA, 22 bp, Homo sapiens
ggcctgagtcacatcaggagag

SEQ ID NO: 8470841 - DNA, 21 bp, Homo sapiens
ggcctgagtataggacaggcc

SEQ ID NO: 8470842 - DNA, 22 bp, Homo sapiens
ggccttgggatgtggctgcagc

SEQ ID NO: 8470843 - DNA, 22 bp, Homo sapiens
ggcctgcacagaggtggctcta

SEQ ID NO: 8470844 - DNA, 22 bp, Homo sapiens
ggcctgagaaccatggggccaa

SEQ ID NO: 8470845 - DNA, 22 bp, Homo sapiens
ggcctgacttgatcggctctct

SEQ ID NO: 8470846 - DNA, 22 bp, Homo sapiens
ggcctgactgacctgattctaa

SEQ ID NO: 8470847 - DNA, 22 bp, Homo sapiens
ggcctgacatttgcatcaacac

SEQ ID NO: 8470848 - DNA, 22 bp, Homo sapiens
ggcctgagaatgtaccagatct

SEQ ID NO: 8470849 - DNA, 22 bp, Homo sapiens
ggcctgaggcgtcccagctgtg

SEQ ID NO: 8470850 - DNA, 22 bp, Homo sapiens
ggcctgagggtgggctctcagt

SEQ ID NO: 8470851 - DNA, 22 bp, Homo sapiens
ggcctgagggtgggctctcagt

SEQ ID NO: 8470852 - DNA, 22 bp, Homo sapiens
ggccttggtggctttgctgatg

SEQ ID NO: 8470853 - DNA, 22 bp, Homo sapiens
ggccttggtgctctgtgttgca

SEQ ID NO: 8470854 - DNA, 22 bp, Homo sapiens
ggccttgggtataggtgggtat

SEQ ID NO: 8470855 - DNA, 22 bp, Homo sapiens
ggcaggtggcactgctgctccc

SEQ ID NO: 8470856 - DNA, 22 bp, Homo sapiens
ggcaggtggcactgctgctccc

SEQ ID NO: 8470857 - DNA, 22 bp, Homo sapiens
ggcaggtggccaagtgtctaag

SEQ ID NO: 8470858 - DNA, 21 bp, Homo sapiens
ggcaggtgggtctctgttgct

SEQ ID NO: 8470859 - DNA, 22 bp, Homo sapiens
ggcaggtggacgtgctaaagct

SEQ ID NO: 8470860 - DNA, 22 bp, Homo sapiens
ggcaggtggaagttggcagagc

SEQ ID NO: 8470861 - DNA, 22 bp, Homo sapiens
ggcaggtggaagttggcagagc

SEQ ID NO: 8470862 - DNA, 22 bp, Homo sapiens
ggcaggcagaggctgagacagg

SEQ ID NO: 8470863 - DNA, 22 bp, Homo sapiens
ggcatggggtgtatgtggcacg

SEQ ID NO: 8470864 - DNA, 22 bp, Homo sapiens
ggcatggggtgtatgtggcacg

SEQ ID NO: 8470865 - DNA, 22 bp, Homo sapiens
ggcatgggccgaggtgcctcct

SEQ ID NO: 8470866 - DNA, 22 bp, Homo sapiens
ggcatgggccgaggtgcctcct

SEQ ID NO: 8470867 - DNA, 22 bp, Homo sapiens
ggcatgggccgaggtgcctcct

SEQ ID NO: 8470868 - DNA, 22 bp, Homo sapiens
ggcatggctgggttctggtgag

SEQ ID NO: 8470869 - DNA, 22 bp, Homo sapiens
ggcagtgaatgaaacagaggct

SEQ ID NO: 8470870 - DNA, 22 bp, Homo sapiens
ggcagtgaatctgagagcctgg

SEQ ID NO: 8470871 - DNA, 22 bp, Homo sapiens
ggcatggacgtctctgaggcca

SEQ ID NO: 8470872 - DNA, 22 bp, Homo sapiens
ggccaaggctcttgagggctga

SEQ ID NO: 8470873 - DNA, 22 bp, Homo sapiens
ggcatgtgcctgaggtcacaca

SEQ ID NO: 8470874 - DNA, 18 bp, Homo sapiens
ggcatgtgagtgctgagg

SEQ ID NO: 8470875 - DNA, 22 bp, Homo sapiens
ggcatggtctttgcttgcagga

SEQ ID NO: 8470876 - DNA, 20 bp, Homo sapiens
ggcatgggtggggctcccag

SEQ ID NO: 8470877 - DNA, 20 bp, Homo sapiens
ggcatgggtggggctcccag

SEQ ID NO: 8470878 - DNA, 22 bp, Homo sapiens
ggccaaggtgttctgatatgcc

SEQ ID NO: 8470879 - DNA, 19 bp, Homo sapiens
ggccaggctgactgtggtc

SEQ ID NO: 8470880 - DNA, 22 bp, Homo sapiens
ggccacagaacagctacaggac

SEQ ID NO: 8470881 - DNA, 22 bp, Homo sapiens
ggccacagaacagctacaggac

SEQ ID NO: 8470882 - DNA, 22 bp, Homo sapiens
ggccacagaacagctacaggac

SEQ ID NO: 8470883 - DNA, 22 bp, Homo sapiens
ggccagtcccctaatccagggc

SEQ ID NO: 8470884 - DNA, 19 bp, Homo sapiens
ggccatctctgccccagca

SEQ ID NO: 8470885 - DNA, 22 bp, Homo sapiens
ggccatgccaggctgcctggga

SEQ ID NO: 8470886 - DNA, 19 bp, Homo sapiens
ggccaggctgactgtggtc

SEQ ID NO: 8470887 - DNA, 22 bp, Homo sapiens
ggccaggtggctgtcctggcgt

SEQ ID NO: 8470888 - DNA, 22 bp, Homo sapiens
ggccaggtggctgtcctggcgt

SEQ ID NO: 8470889 - DNA, 22 bp, Homo sapiens
ggccagggggcttcagactcca

SEQ ID NO: 8470890 - DNA, 18 bp, Homo sapiens
gtattagttttcagagag

SEQ ID NO: 8470891 - DNA, 22 bp, Homo sapiens
gtattagtcaattacagtgggg

SEQ ID NO: 8470892 - DNA, 22 bp, Homo sapiens
gtattagttatctactgctgtg

SEQ ID NO: 8470893 - DNA, 22 bp, Homo sapiens
gtattacatttagtaattaggc

SEQ ID NO: 8470894 - DNA, 22 bp, Homo sapiens
gtagaatcccagtggctatatt

SEQ ID NO: 8470895 - DNA, 22 bp, Homo sapiens
gtagaattacctctctatgtcc

SEQ ID NO: 8470896 - DNA, 22 bp, Homo sapiens
gtagaattttaataatggagat

SEQ ID NO: 8470897 - DNA, 22 bp, Homo sapiens
gtagaaccttctttactagagt

SEQ ID NO: 8470898 - DNA, 20 bp, Homo sapiens
gtagaaccatgtgtgctggg

SEQ ID NO: 8470899 - DNA, 22 bp, Homo sapiens
gtagaaccttctttactagagt

SEQ ID NO: 8470900 - DNA, 22 bp, Homo sapiens
gtagaaatggtgtgtttcttct

SEQ ID NO: 8470901 - DNA, 22 bp, Homo sapiens
gtagaaattccatttactttga

SEQ ID NO: 8470902 - DNA, 22 bp, Homo sapiens
gtattcagtttgattgtctaca

SEQ ID NO: 8470903 - DNA, 22 bp, Homo sapiens
gtattcatttatttactcatcc

SEQ ID NO: 8470904 - DNA, 22 bp, Homo sapiens
gtattcagaaggatgatctagt

SEQ ID NO: 8470905 - DNA, 22 bp, Homo sapiens
gtattcagggctagtcagagga

SEQ ID NO: 8470906 - DNA, 22 bp, Homo sapiens
gtattcatattaaacatatcaa

SEQ ID NO: 8470907 - DNA, 22 bp, Homo sapiens
gtattcttggttatcaaaatac

SEQ ID NO: 8470908 - DNA, 21 bp, Homo sapiens
gtattctttatgaagtgaaaa

SEQ ID NO: 8470909 - DNA, 22 bp, Homo sapiens
gtattcttatactcagtgagct

SEQ ID NO: 8470910 - DNA, 22 bp, Homo sapiens
gtattcttaaggattgagcaaa

SEQ ID NO: 8470911 - DNA, 22 bp, Homo sapiens
gtattcttaaggattgagcaaa

SEQ ID NO: 8470912 - DNA, 22 bp, Homo sapiens
gtaccctgtggccagccagcca

SEQ ID NO: 8470913 - DNA, 22 bp, Homo sapiens
gtacattttgaggttaaaacaa

SEQ ID NO: 8470914 - DNA, 22 bp, Homo sapiens
gtacattttgaggttaaaacaa

SEQ ID NO: 8470915 - DNA, 22 bp, Homo sapiens
gtacatttctcttgttcttatt

SEQ ID NO: 8470916 - DNA, 22 bp, Homo sapiens
gtacattttactttgtttgaat

SEQ ID NO: 8470917 - DNA, 20 bp, Homo sapiens
gtacattttcaggaggggat

SEQ ID NO: 8470918 - DNA, 22 bp, Homo sapiens
gtacatttctcttgttcttatt

SEQ ID NO: 8470919 - DNA, 22 bp, Homo sapiens
gtacatttctcccaacactaaa

SEQ ID NO: 8470920 - DNA, 22 bp, Homo sapiens
gtacatttctcccaacactaaa

SEQ ID NO: 8470921 - DNA, 22 bp, Homo sapiens
gtacatttctcccaacactaaa

SEQ ID NO: 8470922 - DNA, 22 bp, Homo sapiens
gtacatttcagtttccttaaga

SEQ ID NO: 8470923 - DNA, 22 bp, Homo sapiens
gtacatttcatttaaatgatgt

SEQ ID NO: 8470924 - DNA, 22 bp, Homo sapiens
gtacatttcatttaaatgatgt

SEQ ID NO: 8470925 - DNA, 22 bp, Homo sapiens
gtacatttcatttaaatgatgt

SEQ ID NO: 8470926 - DNA, 22 bp, Homo sapiens
gtacatttcagtttccttaaga

SEQ ID NO: 8470927 - DNA, 22 bp, Homo sapiens
gtacatttcagtttccttaaga

SEQ ID NO: 8470928 - DNA, 22 bp, Homo sapiens
gtaaaacctgcttttcaacacc

SEQ ID NO: 8470929 - DNA, 22 bp, Homo sapiens
gtacatttaggattcattgaaa

SEQ ID NO: 8470930 - DNA, 22 bp, Homo sapiens
gtacatttaggattcattgaaa

SEQ ID NO: 8470931 - DNA, 23 bp, Homo sapiens
gtaaaatacgcagtgcagtgtga

SEQ ID NO: 8470932 - DNA, 22 bp, Homo sapiens
ggtttcaatgagaagtgcttgt

SEQ ID NO: 8470933 - DNA, 22 bp, Homo sapiens
ggtttcaactaaatcaagaagg

SEQ ID NO: 8470934 - DNA, 22 bp, Homo sapiens
ggtttcaactcagctagtaagg

SEQ ID NO: 8470935 - DNA, 22 bp, Homo sapiens
ggtttcaaattaaagtcttaag

SEQ ID NO: 8470936 - DNA, 22 bp, Homo sapiens
ggtttcaacttcaacctctcca

SEQ ID NO: 8470937 - DNA, 22 bp, Homo sapiens
ggtttcaacttttgtgaggaat

SEQ ID NO: 8470938 - DNA, 22 bp, Homo sapiens
ggtttctagcagagtctcttta

SEQ ID NO: 8470939 - DNA, 22 bp, Homo sapiens
ggtttctcaccttcagcactac

SEQ ID NO: 8470940 - DNA, 22 bp, Homo sapiens
ggtttctctagggctgaccagt

SEQ ID NO: 8470941 - DNA, 22 bp, Homo sapiens
ggttttaaccattcacaagtga

SEQ ID NO: 8470942 - DNA, 22 bp, Homo sapiens
ggtttggttttggccatcttcc

SEQ ID NO: 8470943 - DNA, 22 bp, Homo sapiens
ggttttaactacagaattgcaa

SEQ ID NO: 8470944 - DNA, 22 bp, Homo sapiens
gtccaaaagagccagccgggcg

SEQ ID NO: 8470945 - DNA, 22 bp, Homo sapiens
gtccaatggtaaatccaaataa

SEQ ID NO: 8470946 - DNA, 22 bp, Homo sapiens
gtccaaggatggggtctcccag

SEQ ID NO: 8470947 - DNA, 19 bp, Homo sapiens
gtatttcaggacaagacgt

SEQ ID NO: 8470948 - DNA, 19 bp, Homo sapiens
gtatttcaggacaagacgt

SEQ ID NO: 8470949 - DNA, 22 bp, Homo sapiens
gtatttcagttcctcttgtgac

SEQ ID NO: 8470950 - DNA, 23 bp, Homo sapiens
gtatttcagcattctcagttaaa

SEQ ID NO: 8470951 - DNA, 22 bp, Homo sapiens
gtatttcacatatggatatgct

SEQ ID NO: 8470952 - DNA, 22 bp, Homo sapiens
gtatttcatcttgaaaaccagt

SEQ ID NO: 8470953 - DNA, 22 bp, Homo sapiens
gtcattttctagaattatttga

SEQ ID NO: 8470954 - DNA, 22 bp, Homo sapiens
gtatttcatcttgaaaaccagt

SEQ ID NO: 8470955 - DNA, 22 bp, Homo sapiens
gtcatttttttcgtaatagtgg

SEQ ID NO: 8470956 - DNA, 22 bp, Homo sapiens
gtccactgctgtgtgcttcacc

SEQ ID NO: 8470957 - DNA, 22 bp, Homo sapiens
gtccagaaagggcagtgatttg

SEQ ID NO: 8470958 - DNA, 23 bp, Homo sapiens
gtccagaacccaggctggggtgg

SEQ ID NO: 8470959 - DNA, 22 bp, Homo sapiens
gtccccagaaaggtgaggcagg

SEQ ID NO: 8470960 - DNA, 22 bp, Homo sapiens
gtccccagaaaggtgaggcagg

SEQ ID NO: 8470961 - DNA, 22 bp, Homo sapiens
gtccacccatgacacctgcctg

SEQ ID NO: 8470962 - DNA, 22 bp, Homo sapiens
gtccacagctctgaggtctccc

SEQ ID NO: 8470963 - DNA, 18 bp, Homo sapiens
gtccacagccctcacagc

SEQ ID NO: 8470964 - DNA, 22 bp, Homo sapiens
gtccacagctggccagggcctc

SEQ ID NO: 8470965 - DNA, 22 bp, Homo sapiens
gtccacagctctgaggtctccc

SEQ ID NO: 8470966 - DNA, 22 bp, Homo sapiens
gtccctggaatggactctgcgc

SEQ ID NO: 8470967 - DNA, 22 bp, Homo sapiens
gtcctgggaactggacagctaa

SEQ ID NO: 8470968 - DNA, 22 bp, Homo sapiens
gtcctgggaaggaagccaggga

SEQ ID NO: 8470969 - DNA, 22 bp, Homo sapiens
gtcctgggagatgggaccctga

SEQ ID NO: 8470970 - DNA, 22 bp, Homo sapiens
gtcctgggagatgggaccctga

SEQ ID NO: 8470971 - DNA, 20 bp, Homo sapiens
gtcctgggagccacagcaca

SEQ ID NO: 8470972 - DNA, 22 bp, Homo sapiens
gtcctgggaggggctggtcctg

SEQ ID NO: 8470973 - DNA, 22 bp, Homo sapiens
gtcctgggcatgcagggctttc

SEQ ID NO: 8470974 - DNA, 22 bp, Homo sapiens
gtcctgggcatgcagggctttc

SEQ ID NO: 8470975 - DNA, 22 bp, Homo sapiens
gtcctgggcccaggggctgcct

SEQ ID NO: 8470976 - DNA, 22 bp, Homo sapiens
gtcctgggcccaggggctgcct

SEQ ID NO: 8470977 - DNA, 22 bp, Homo sapiens
gtcctgggaggggctggtcctg

SEQ ID NO: 8470978 - DNA, 17 bp, Homo sapiens
gtcctgggaggagagag

SEQ ID NO: 8470979 - DNA, 20 bp, Homo sapiens
gtcctgggagccacagcaca

SEQ ID NO: 8470980 - DNA, 17 bp, Homo sapiens
gtcctgggaggagagag

SEQ ID NO: 8470981 - DNA, 22 bp, Homo sapiens
gtccctcagtagtgcacagtgg

SEQ ID NO: 8470982 - DNA, 22 bp, Homo sapiens
gtcccctggtggctggagctgc

SEQ ID NO: 8470983 - DNA, 22 bp, Homo sapiens
gtcccctgtccagggccagcca

SEQ ID NO: 8470984 - DNA, 22 bp, Homo sapiens
gtccccctgaaagcagccgcag

SEQ ID NO: 8470985 - DNA, 22 bp, Homo sapiens
gtccccagctgtgacgagagcc

SEQ ID NO: 8470986 - DNA, 22 bp, Homo sapiens
gtgcagggtcctaattgttaag

SEQ ID NO: 8470987 - DNA, 22 bp, Homo sapiens
gtgcagggtcctaattgttaag

SEQ ID NO: 8470988 - DNA, 22 bp, Homo sapiens
gtgcaggtgttttggctgccag

SEQ ID NO: 8470989 - DNA, 22 bp, Homo sapiens
gtgcagtgaccctggagagctg

SEQ ID NO: 8470990 - DNA, 22 bp, Homo sapiens
gtgcagtgaccctggagagctg

SEQ ID NO: 8470991 - DNA, 22 bp, Homo sapiens
gtgcagtatctctgggagtggg

SEQ ID NO: 8470992 - DNA, 22 bp, Homo sapiens
gtgcagagtgtctgtggactga

SEQ ID NO: 8470993 - DNA, 20 bp, Homo sapiens
gtgcagaggcagcctgtggg

SEQ ID NO: 8470994 - DNA, 22 bp, Homo sapiens
gtgcagaggtcacaaaagtgaa

SEQ ID NO: 8470995 - DNA, 22 bp, Homo sapiens
gtgcagaggacgtggcggcctc

SEQ ID NO: 8470996 - DNA, 22 bp, Homo sapiens
gtgcagtgtgtaatccaggaac

SEQ ID NO: 8470997 - DNA, 22 bp, Homo sapiens
gtgccaaagaacataaggctga

SEQ ID NO: 8470998 - DNA, 22 bp, Homo sapiens
gtgcatttatatttgcctttgg

SEQ ID NO: 8470999 - DNA, 20 bp, Homo sapiens
gtgcatttcacctgtactgt

SEQ ID NO: 8471000 - DNA, 22 bp, Homo sapiens
gtgacccatgcagtggttttgg

SEQ ID NO: 8471001 - DNA, 22 bp, Homo sapiens
gtgacgtttaatagtgacatgg

SEQ ID NO: 8471002 - DNA, 18 bp, Homo sapiens
gtgacgttttggatgatt

SEQ ID NO: 8471003 - DNA, 22 bp, Homo sapiens
gtgactttaacttcagattaga

SEQ ID NO: 8471004 - DNA, 22 bp, Homo sapiens
gtgactgtaattaccttagcaa

SEQ ID NO: 8471005 - DNA, 22 bp, Homo sapiens
gtgagcaggataggggctccct

SEQ ID NO: 8471006 - DNA, 22 bp, Homo sapiens
gtgagacacgtgtgtgacctgg

SEQ ID NO: 8471007 - DNA, 22 bp, Homo sapiens
gtgagagaatttgagttaaatt

SEQ ID NO: 8471008 - DNA, 22 bp, Homo sapiens
gtgcacagaaattggtaagact

SEQ ID NO: 8471009 - DNA, 22 bp, Homo sapiens
gtgcacagaagcagaagctaga

SEQ ID NO: 8471010 - DNA, 22 bp, Homo sapiens
gtgcacagagcccagggccgcg

SEQ ID NO: 8471011 - DNA, 22 bp, Homo sapiens
gtgcacagattcagaggttttg

SEQ ID NO: 8471012 - DNA, 22 bp, Homo sapiens
gtgcacagattcagaggttttg

SEQ ID NO: 8471013 - DNA, 22 bp, Homo sapiens
gtgcacagagcccagggccgcg

SEQ ID NO: 8471014 - DNA, 23 bp, Homo sapiens
gtgcacagtcaagcccagcttag

SEQ ID NO: 8471015 - DNA, 23 bp, Homo sapiens
gtgcacagtcaagcccagcttag

SEQ ID NO: 8471016 - DNA, 22 bp, Homo sapiens
gtgcacaggtgggaaaatgagt

SEQ ID NO: 8471017 - DNA, 22 bp, Homo sapiens
gtgcacagatttaattttattc

SEQ ID NO: 8471018 - DNA, 21 bp, Homo sapiens
gtgcacagtcctgcacacagg

SEQ ID NO: 8471019 - DNA, 21 bp, Homo sapiens
gtgcacagtcctgcacacagg

SEQ ID NO: 8471020 - DNA, 22 bp, Homo sapiens
gtgcacatcgtgcaggtttgtt

SEQ ID NO: 8471021 - DNA, 22 bp, Homo sapiens
gtgcaccccggggccctgctcc

SEQ ID NO: 8471022 - DNA, 22 bp, Homo sapiens
gtgcacccccaaggaggtggag

SEQ ID NO: 8471023 - DNA, 22 bp, Homo sapiens
gtgcagagaggaccttggggag

SEQ ID NO: 8471024 - DNA, 22 bp, Homo sapiens
gtgaaattgtatttggcattga

SEQ ID NO: 8471025 - DNA, 22 bp, Homo sapiens
gtgaaatatttaacgtccaggt

SEQ ID NO: 8471026 - DNA, 22 bp, Homo sapiens
gtgaacagttcattttatcatg

SEQ ID NO: 8471027 - DNA, 22 bp, Homo sapiens
gtgaaacaccctccaatgcaca

SEQ ID NO: 8471028 - DNA, 22 bp, Homo sapiens
gtctggagtggggcctgagaat

SEQ ID NO: 8471029 - DNA, 22 bp, Homo sapiens
gtgaaaagcaacattgtggacc

SEQ ID NO: 8471030 - DNA, 22 bp, Homo sapiens
gtgaaaagagagcctgtgtcag

SEQ ID NO: 8471031 - DNA, 22 bp, Homo sapiens
gtctggagggaagagatgtcag

SEQ ID NO: 8471032 - DNA, 18 bp, Homo sapiens
gtctggaggtcaggagct

SEQ ID NO: 8471033 - DNA, 17 bp, Homo sapiens
gtctggagtggccttca

SEQ ID NO: 8471034 - DNA, 22 bp, Homo sapiens
gtctggagtaccataaaaagga

SEQ ID NO: 8471035 - DNA, 22 bp, Homo sapiens
gtgacccaggacactgtgtatc

SEQ ID NO: 8471036 - DNA, 22 bp, Homo sapiens
gtgacccaggtaggtaagcaat

SEQ ID NO: 8471037 - DNA, 22 bp, Homo sapiens
gtgacccagaggctgactaaca

SEQ ID NO: 8471038 - DNA, 23 bp, Homo sapiens
gtgacccaaggaccttccagaat

SEQ ID NO: 8471039 - DNA, 22 bp, Homo sapiens
gtgaccatttgacatatccttg

SEQ ID NO: 8471040 - DNA, 22 bp, Homo sapiens
gtgaccataatagattatgagt

SEQ ID NO: 8471041 - DNA, 22 bp, Homo sapiens
gtgaaggactagcatggagggc

SEQ ID NO: 8471042 - DNA, 22 bp, Homo sapiens
gtgaagatctgagccctcaggt

SEQ ID NO: 8471043 - DNA, 17 bp, Homo sapiens
gtgaagagtcattgaat

SEQ ID NO: 8471044 - DNA, 22 bp, Homo sapiens
gtgaagagctgttgcagagatt

SEQ ID NO: 8471045 - DNA, 22 bp, Homo sapiens
gtgaagatgcctcaggtgaccc

SEQ ID NO: 8471046 - DNA, 22 bp, Homo sapiens
gtgaagcagggaaggaaaggat

SEQ ID NO: 8471047 - DNA, 22 bp, Homo sapiens
gtgaagcagttgcgtgggttcc

SEQ ID NO: 8471048 - DNA, 22 bp, Homo sapiens
gtcctgggcctgctgaggctga

SEQ ID NO: 8471049 - DNA, 22 bp, Homo sapiens
gtcctgggcggagggctgctgt

SEQ ID NO: 8471050 - DNA, 22 bp, Homo sapiens
gtcctgggcggagggctgctgt

SEQ ID NO: 8471051 - DNA, 22 bp, Homo sapiens
gtcctggggaatacagaagccg

SEQ ID NO: 8471052 - DNA, 22 bp, Homo sapiens
gtcctggggatacagaagtgaa

SEQ ID NO: 8471053 - DNA, 22 bp, Homo sapiens
gtcctggggattatagagtgtt

SEQ ID NO: 8471054 - DNA, 22 bp, Homo sapiens
gtcctggggaatacagaagccg

SEQ ID NO: 8471055 - DNA, 22 bp, Homo sapiens
gtcctggggatacagaagtgaa

SEQ ID NO: 8471056 - DNA, 22 bp, Homo sapiens
gtcctgggggcagctgtgtcca

SEQ ID NO: 8471057 - DNA, 22 bp, Homo sapiens
gtcctgggggcagctgtgtcca

SEQ ID NO: 8471058 - DNA, 22 bp, Homo sapiens
gtctgccccacaggctcagttg

SEQ ID NO: 8471059 - DNA, 22 bp, Homo sapiens
gtctgccctcacgccagctggg

SEQ ID NO: 8471060 - DNA, 22 bp, Homo sapiens
gtctgccctgcagacatgcctc

SEQ ID NO: 8471061 - DNA, 22 bp, Homo sapiens
gtctgcccttcctctccacgat

SEQ ID NO: 8471062 - DNA, 22 bp, Homo sapiens
gtctgctgtaggtaggacagca

SEQ ID NO: 8471063 - DNA, 22 bp, Homo sapiens
gtctgctgtaggtaggacagca

SEQ ID NO: 8471064 - DNA, 22 bp, Homo sapiens
gtctgctgcagtcgtggctcta

SEQ ID NO: 8471065 - DNA, 22 bp, Homo sapiens
gtctgctggcacgtcacagata

SEQ ID NO: 8471066 - DNA, 22 bp, Homo sapiens
gtctggaggcactttctcatga

SEQ ID NO: 8471067 - DNA, 22 bp, Homo sapiens
gtctggaggcccgtcagcccta

SEQ ID NO: 8471068 - DNA, 22 bp, Homo sapiens
gtctggaggaggaagaaggcac

SEQ ID NO: 8471069 - DNA, 22 bp, Homo sapiens
gtctggagcctgggtccctgct

SEQ ID NO: 8471070 - DNA, 22 bp, Homo sapiens
gtctgctgttcagagatgttgc

SEQ ID NO: 8471071 - DNA, 22 bp, Homo sapiens
gtctgctcatgctaccgcgggc

SEQ ID NO: 8471072 - DNA, 22 bp, Homo sapiens
gtctgctgcagagcatggcttt

SEQ ID NO: 8471073 - DNA, 22 bp, Homo sapiens
gtctgctgcagtcgtggctcta

SEQ ID NO: 8471074 - DNA, 19 bp, Homo sapiens
ggtggctcagggcccagcc

SEQ ID NO: 8471075 - DNA, 17 bp, Homo sapiens
ggtggcctgcagtggct

SEQ ID NO: 8471076 - DNA, 22 bp, Homo sapiens
ggtggccttttatgagcagggt

SEQ ID NO: 8471077 - DNA, 22 bp, Homo sapiens
ggtggcctccagggcataggtg

SEQ ID NO: 8471078 - DNA, 22 bp, Homo sapiens
ggtggcctcggtggtgcacagg

SEQ ID NO: 8471079 - DNA, 22 bp, Homo sapiens
ggtctctgttgcctccatcaag

SEQ ID NO: 8471080 - DNA, 22 bp, Homo sapiens
ggtctggcactcatgcagcagg

SEQ ID NO: 8471081 - DNA, 22 bp, Homo sapiens
ggtctggcactcatgcagcagg

SEQ ID NO: 8471082 - DNA, 22 bp, Homo sapiens
ggtctggcaggtgaggactcag

SEQ ID NO: 8471083 - DNA, 22 bp, Homo sapiens
ggtctggccaatagacagcccc

SEQ ID NO: 8471084 - DNA, 22 bp, Homo sapiens
ggtttcaaagtggacagttagt

SEQ ID NO: 8471085 - DNA, 22 bp, Homo sapiens
ggtgttgcagttgaagactggt

SEQ ID NO: 8471086 - DNA, 22 bp, Homo sapiens
ggtgttggaacatggtgagatt

SEQ ID NO: 8471087 - DNA, 22 bp, Homo sapiens
ggtgttaacttgtttatgacaa

SEQ ID NO: 8471088 - DNA, 22 bp, Homo sapiens
ggtgttcttagtggcactggca

SEQ ID NO: 8471089 - DNA, 22 bp, Homo sapiens
ggtgttcaaatgaacacatgca

SEQ ID NO: 8471090 - DNA, 22 bp, Homo sapiens
ggtggctcgtttttcttgaaag

SEQ ID NO: 8471091 - DNA, 22 bp, Homo sapiens
ggtgtgggccctgatgtcagca

SEQ ID NO: 8471092 - DNA, 22 bp, Homo sapiens
ggtgtgggccctgatgtcagca

SEQ ID NO: 8471093 - DNA, 22 bp, Homo sapiens
gggtggcacaggtgcagagggt

SEQ ID NO: 8471094 - DNA, 22 bp, Homo sapiens
gggtggcacaggtgcagagggt

SEQ ID NO: 8471095 - DNA, 22 bp, Homo sapiens
gggtggcactgataatgagacg

SEQ ID NO: 8471096 - DNA, 22 bp, Homo sapiens
gggtggcaggattggcaggagt

SEQ ID NO: 8471097 - DNA, 22 bp, Homo sapiens
gggtggcaggattggcaggagt

SEQ ID NO: 8471098 - DNA, 22 bp, Homo sapiens
ggtcagaagtgcaaaatcagtt

SEQ ID NO: 8471099 - DNA, 22 bp, Homo sapiens
ggtcagaaggattctgggaaat

SEQ ID NO: 8471100 - DNA, 22 bp, Homo sapiens
ggtcagaattaggtctagagta

SEQ ID NO: 8471101 - DNA, 19 bp, Homo sapiens
ggtcagagagatccaggct

SEQ ID NO: 8471102 - DNA, 22 bp, Homo sapiens
ggtcagagccgttagcattcag

SEQ ID NO: 8471103 - DNA, 22 bp, Homo sapiens
ggtcagaggggattccttggga

SEQ ID NO: 8471104 - DNA, 22 bp, Homo sapiens
ggtcagagggtgggctgcctgt

SEQ ID NO: 8471105 - DNA, 22 bp, Homo sapiens
ggtcagaggggattccttggga

SEQ ID NO: 8471106 - DNA, 22 bp, Homo sapiens
ggtcagagggtgggctgcctgt

SEQ ID NO: 8471107 - DNA, 22 bp, Homo sapiens
ggtcagagggtgggctgcctgt

SEQ ID NO: 8471108 - DNA, 22 bp, Homo sapiens
ggtcactgtctgaggtactgga

SEQ ID NO: 8471109 - DNA, 20 bp, Homo sapiens
ggtcactgtggctgcaggat

SEQ ID NO: 8471110 - DNA, 22 bp, Homo sapiens
ggtcactgtctgaggtactgga

SEQ ID NO: 8471111 - DNA, 22 bp, Homo sapiens
ggtcacatgagatgctgccctc

SEQ ID NO: 8471112 - DNA, 22 bp, Homo sapiens
ggtcacatctaaatggagcatt

SEQ ID NO: 8471113 - DNA, 22 bp, Homo sapiens
ggtcacatatcctcggtttgga

SEQ ID NO: 8471114 - DNA, 22 bp, Homo sapiens
ggtcacattctgaggaatcagg

SEQ ID NO: 8471115 - DNA, 22 bp, Homo sapiens
ggtcacattctgaggtattagg

SEQ ID NO: 8471116 - DNA, 22 bp, Homo sapiens
ggtcacatggttgagcttgatc

SEQ ID NO: 8471117 - DNA, 22 bp, Homo sapiens
ggtcacatggttgagcttgatc

SEQ ID NO: 8471118 - DNA, 22 bp, Homo sapiens
ggtcacatgcggggctgtagcc

SEQ ID NO: 8471119 - DNA, 23 bp, Homo sapiens
ggtcacatgtgagattaaacttg

SEQ ID NO: 8471120 - DNA, 22 bp, Homo sapiens
ggtcacatgtgatttgagccaa

SEQ ID NO: 8471121 - DNA, 22 bp, Homo sapiens
ggtcgctgtgtaggttcagcta

SEQ ID NO: 8471122 - DNA, 22 bp, Homo sapiens
ggtcgctgtgtaggttcagcta

SEQ ID NO: 8471123 - DNA, 22 bp, Homo sapiens
ggtcgctgtgtaggttcagcta

SEQ ID NO: 8471124 - DNA, 22 bp, Homo sapiens
ggtccttgggtctcctgtgttt

SEQ ID NO: 8471125 - DNA, 22 bp, Homo sapiens
ggtctcagactggcaggcagtg

SEQ ID NO: 8471126 - DNA, 22 bp, Homo sapiens
ggtctcagactggcaggcagtg

SEQ ID NO: 8471127 - DNA, 22 bp, Homo sapiens
ggtctagatcaagaacagaact

SEQ ID NO: 8471128 - DNA, 22 bp, Homo sapiens
ggtctagatgaaattaaatgtt

SEQ ID NO: 8471129 - DNA, 22 bp, Homo sapiens
ggtctacattgagagagctgct

SEQ ID NO: 8471130 - DNA, 22 bp, Homo sapiens
ggtctagagtggggcctggaaa

SEQ ID NO: 8471131 - DNA, 22 bp, Homo sapiens
ggtcctgtctgacatcactgct

SEQ ID NO: 8471132 - DNA, 18 bp, Homo sapiens
ggtcctgggcctggctca

SEQ ID NO: 8471133 - DNA, 22 bp, Homo sapiens
ggtcagcagtgcagggcagagc

SEQ ID NO: 8471134 - DNA, 22 bp, Homo sapiens
ggtcagcagtgcagggcagagc

SEQ ID NO: 8471135 - DNA, 19 bp, Homo sapiens
ggtctcagtgcagctgcag

SEQ ID NO: 8471136 - DNA, 22 bp, Homo sapiens
ggtctccaaagcttaggactac

SEQ ID NO: 8471137 - DNA, 22 bp, Homo sapiens
ggtctcagctggagtccttggt

SEQ ID NO: 8471138 - DNA, 22 bp, Homo sapiens
ggtctcagaggtttctgctcag

SEQ ID NO: 8471139 - DNA, 22 bp, Homo sapiens
ggtctccattccttcatctcac

SEQ ID NO: 8471140 - DNA, 22 bp, Homo sapiens
ggtctccaaagctgcattgatg

SEQ ID NO: 8471141 - DNA, 22 bp, Homo sapiens
ggtctccagctgggaccctgca

SEQ ID NO: 8471142 - DNA, 22 bp, Homo sapiens
ggtctccattccttcatctcac

SEQ ID NO: 8471143 - DNA, 22 bp, Homo sapiens
ggtctcctgaggctgccacacc

SEQ ID NO: 8471144 - DNA, 22 bp, Homo sapiens
ggtctccttgggaaagcaggaa

SEQ ID NO: 8471145 - DNA, 20 bp, Homo sapiens
ggtctctgacagctggttgc

SEQ ID NO: 8471146 - DNA, 22 bp, Homo sapiens
ggtctctgacttagagatggat

SEQ ID NO: 8471147 - DNA, 22 bp, Homo sapiens
ggtctctggccttggagattga

SEQ ID NO: 8471148 - DNA, 22 bp, Homo sapiens
ggtctctgctcagatgccactt

SEQ ID NO: 8471149 - DNA, 22 bp, Homo sapiens
ggtctctggccttggagattga

SEQ ID NO: 8471150 - DNA, 22 bp, Homo sapiens
ggggctccagtcttcacatttt

SEQ ID NO: 8471151 - DNA, 20 bp, Homo sapiens
ggggctgcatgcagagaaga

SEQ ID NO: 8471152 - DNA, 22 bp, Homo sapiens
gggcttggtggagagaatgctg

SEQ ID NO: 8471153 - DNA, 22 bp, Homo sapiens
ggggaagaggcgtgatggatcc

SEQ ID NO: 8471154 - DNA, 22 bp, Homo sapiens
ggggaagaggcgtgatggatcc

SEQ ID NO: 8471155 - DNA, 22 bp, Homo sapiens
ggggaagaggcgtgatggatcc

SEQ ID NO: 8471156 - DNA, 22 bp, Homo sapiens
ggggttgatcacagaggggtct

SEQ ID NO: 8471157 - DNA, 20 bp, Homo sapiens
ggggttgaccctcttggact

SEQ ID NO: 8471158 - DNA, 22 bp, Homo sapiens
ggggtgtgagtagagctgggga

SEQ ID NO: 8471159 - DNA, 22 bp, Homo sapiens
ggggtggggttactcattgtgc

SEQ ID NO: 8471160 - DNA, 22 bp, Homo sapiens
ggggtggggttactcattgtgc

SEQ ID NO: 8471161 - DNA, 22 bp, Homo sapiens
ggggtgggcgtgcagggacacc

SEQ ID NO: 8471162 - DNA, 22 bp, Homo sapiens
ggggtgggcgtgcagggacacc

SEQ ID NO: 8471163 - DNA, 22 bp, Homo sapiens
ggggtgggcgtgcagggacacc

SEQ ID NO: 8471164 - DNA, 22 bp, Homo sapiens
ggggtgggcgtgcagggacacc

SEQ ID NO: 8471165 - DNA, 22 bp, Homo sapiens
ggggtgggcgtgcagggacacc

SEQ ID NO: 8471166 - DNA, 22 bp, Homo sapiens
ggggtgggcgtgcagggacacc

SEQ ID NO: 8471167 - DNA, 22 bp, Homo sapiens
ggggctggtggtggtttctcca

SEQ ID NO: 8471168 - DNA, 22 bp, Homo sapiens
gggtaggccagaagggcctgga

SEQ ID NO: 8471169 - DNA, 22 bp, Homo sapiens
gggtaggctctgcaggctgggt

SEQ ID NO: 8471170 - DNA, 22 bp, Homo sapiens
gggtaggcagtgcgtcctgcct

SEQ ID NO: 8471171 - DNA, 22 bp, Homo sapiens
gggtaggctgctcctggggccc

SEQ ID NO: 8471172 - DNA, 22 bp, Homo sapiens
gggtagggtgacttaggctggc

SEQ ID NO: 8471173 - DNA, 21 bp, Homo sapiens
ggggttggcaagagcagagac

SEQ ID NO: 8471174 - DNA, 22 bp, Homo sapiens
gggtaggagaggtgtctgtgtg

SEQ ID NO: 8471175 - DNA, 22 bp, Homo sapiens
gggcttggagtaggctgatgaa

SEQ ID NO: 8471176 - DNA, 22 bp, Homo sapiens
gggcttggagtaggctgatgaa

SEQ ID NO: 8471177 - DNA, 19 bp, Homo sapiens
gggcttggggctgaagcct

SEQ ID NO: 8471178 - DNA, 19 bp, Homo sapiens
gggcttggggctgaagcct

SEQ ID NO: 8471179 - DNA, 22 bp, Homo sapiens
gggcttgggtattgtgagaggt

SEQ ID NO: 8471180 - DNA, 22 bp, Homo sapiens
gggcttgggtattgtgagaggt

SEQ ID NO: 8471181 - DNA, 22 bp, Homo sapiens
gggcttggccccagaagagcta

SEQ ID NO: 8471182 - DNA, 22 bp, Homo sapiens
gggcttggccccagaagagcta

SEQ ID NO: 8471183 - DNA, 22 bp, Homo sapiens
gggcttggctggggccaccaga

SEQ ID NO: 8471184 - DNA, 22 bp, Homo sapiens
gggcttggctcataagtggatg

SEQ ID NO: 8471185 - DNA, 22 bp, Homo sapiens
gggctgctgtgttcctgaggca

SEQ ID NO: 8471186 - DNA, 22 bp, Homo sapiens
gggcttcttgagctgccggccc

SEQ ID NO: 8471187 - DNA, 22 bp, Homo sapiens
gggcttcttgcaggggcaacat

SEQ ID NO: 8471188 - DNA, 22 bp, Homo sapiens
gggcttcttgcaggggcaacat

SEQ ID NO: 8471189 - DNA, 22 bp, Homo sapiens
gggcttgctaagaagagcgcat

SEQ ID NO: 8471190 - DNA, 22 bp, Homo sapiens
gggcttcttgccatggggacgg

SEQ ID NO: 8471191 - DNA, 22 bp, Homo sapiens
gggcttcttgccatggggacgg

SEQ ID NO: 8471192 - DNA, 22 bp, Homo sapiens
gggcttcttgccatggggacgg

SEQ ID NO: 8471193 - DNA, 22 bp, Homo sapiens
gggctgctgctgccagcgacac

SEQ ID NO: 8471194 - DNA, 22 bp, Homo sapiens
gggctgctgctgccagcgacac

SEQ ID NO: 8471195 - DNA, 22 bp, Homo sapiens
gggctgctgggcaagaaacatt

SEQ ID NO: 8471196 - DNA, 22 bp, Homo sapiens
gggctgctgccaccaggtggat

SEQ ID NO: 8471197 - DNA, 22 bp, Homo sapiens
gggctgcatcagcaggacccgg

SEQ ID NO: 8471198 - DNA, 22 bp, Homo sapiens
gggctgccaagcctgcctgcct

SEQ ID NO: 8471199 - DNA, 23 bp, Homo sapiens
gggctgctccaggccaaggctgg

SEQ ID NO: 8471200 - DNA, 22 bp, Homo sapiens
gggctgctacgagaactgaata

SEQ ID NO: 8471201 - DNA, 22 bp, Homo sapiens
gggctgagtgtcccaggccgaa

SEQ ID NO: 8471202 - DNA, 22 bp, Homo sapiens
gggctgagttcctgcctcactc

SEQ ID NO: 8471203 - DNA, 22 bp, Homo sapiens
gggctgagttcctgcctcactc

SEQ ID NO: 8471204 - DNA, 22 bp, Homo sapiens
gggctgagggccaattcctact

SEQ ID NO: 8471205 - DNA, 22 bp, Homo sapiens
gggctgagggccaattcctact

SEQ ID NO: 8471206 - DNA, 22 bp, Homo sapiens
gggctgaggctaccactggtct

SEQ ID NO: 8471207 - DNA, 22 bp, Homo sapiens
gggccaagggtgcgtggcagga

SEQ ID NO: 8471208 - DNA, 22 bp, Homo sapiens
gggccaaggggagctggaaggg

SEQ ID NO: 8471209 - DNA, 22 bp, Homo sapiens
gggcatggccaggtgaggggtc

SEQ ID NO: 8471210 - DNA, 22 bp, Homo sapiens
gggctgagagctggaatctgag

SEQ ID NO: 8471211 - DNA, 22 bp, Homo sapiens
gggctgagagctggaatctgag

SEQ ID NO: 8471212 - DNA, 22 bp, Homo sapiens
gggctgagagctggaatctgag

SEQ ID NO: 8471213 - DNA, 22 bp, Homo sapiens
gggctgagattggtgccctgtc

SEQ ID NO: 8471214 - DNA, 22 bp, Homo sapiens
gggctgagattggtgccctgtc

SEQ ID NO: 8471215 - DNA, 22 bp, Homo sapiens
gggctgagagtgactgttctgt

SEQ ID NO: 8471216 - DNA, 22 bp, Homo sapiens
gggctgagagtgactgttctgt

SEQ ID NO: 8471217 - DNA, 22 bp, Homo sapiens
gggctgagctaagctgggttga

SEQ ID NO: 8471218 - DNA, 22 bp, Homo sapiens
gggctgagctaagctgggttga

SEQ ID NO: 8471219 - DNA, 22 bp, Homo sapiens
gggctgagctgttctgagttta

SEQ ID NO: 8471220 - DNA, 22 bp, Homo sapiens
gggctgagctaagctgggttga

SEQ ID NO: 8471221 - DNA, 22 bp, Homo sapiens
gggctgagctgttctgagttta

SEQ ID NO: 8471222 - DNA, 22 bp, Homo sapiens
gggctgagctgttctgagttta

SEQ ID NO: 8471223 - DNA, 22 bp, Homo sapiens
gggctgaggaacatattttgtt

SEQ ID NO: 8471224 - DNA, 22 bp, Homo sapiens
gggctgaggaacatattttgtt

SEQ ID NO: 8471225 - DNA, 22 bp, Homo sapiens
gggctgaggctaccactggtct

SEQ ID NO: 8471226 - DNA, 22 bp, Homo sapiens
gggctgagccatttgaaccttg

SEQ ID NO: 8471227 - DNA, 22 bp, Homo sapiens
gggctgagccacagcttttgtt

SEQ ID NO: 8471228 - DNA, 22 bp, Homo sapiens
gggctgagcacatactgacagc

SEQ ID NO: 8471229 - DNA, 22 bp, Homo sapiens
gctgccttatgtctattagtat

SEQ ID NO: 8471230 - DNA, 22 bp, Homo sapiens
gctgccttcagttctgattcat

SEQ ID NO: 8471231 - DNA, 22 bp, Homo sapiens
gctgccttatgtctattagtat

SEQ ID NO: 8471232 - DNA, 22 bp, Homo sapiens
gctgccttaacttcttcgctgt

SEQ ID NO: 8471233 - DNA, 22 bp, Homo sapiens
gctgccttagagggagtggttc

SEQ ID NO: 8471234 - DNA, 20 bp, Homo sapiens
gctgcctgtttctgtaagta

SEQ ID NO: 8471235 - DNA, 22 bp, Homo sapiens
gctgcgagctcttgttctgaga

SEQ ID NO: 8471236 - DNA, 22 bp, Homo sapiens
gctgctcactgaaggaccctgt

SEQ ID NO: 8471237 - DNA, 22 bp, Homo sapiens
gctgctaagcgtttctgttcca

SEQ ID NO: 8471238 - DNA, 22 bp, Homo sapiens
gctgcctgtgcgggtcgctagg

SEQ ID NO: 8471239 - DNA, 22 bp, Homo sapiens
gctgcctgtggcccttctgggt

SEQ ID NO: 8471240 - DNA, 22 bp, Homo sapiens
gctgcctgtggcccttctgggt

SEQ ID NO: 8471241 - DNA, 22 bp, Homo sapiens
gctgcctgttgaagggtctgtg

SEQ ID NO: 8471242 - DNA, 22 bp, Homo sapiens
gctgcctgttgaagggtctgtg

SEQ ID NO: 8471243 - DNA, 22 bp, Homo sapiens
gctgcctgtgtggccactcact

SEQ ID NO: 8471244 - DNA, 22 bp, Homo sapiens
gctgctgtgcctggcgtcctgt

SEQ ID NO: 8471245 - DNA, 22 bp, Homo sapiens
gctgctgttgatttagtccaat

SEQ ID NO: 8471246 - DNA, 22 bp, Homo sapiens
gctgctgtctggtctgagggct

SEQ ID NO: 8471247 - DNA, 22 bp, Homo sapiens
gctgctgtggcagattggattc

SEQ ID NO: 8471248 - DNA, 22 bp, Homo sapiens
gctgctcagtgggcctgagcct

SEQ ID NO: 8471249 - DNA, 22 bp, Homo sapiens
gctgctccgtctgagctctggt

SEQ ID NO: 8471250 - DNA, 22 bp, Homo sapiens
gctgcccagcaggccccagggg

SEQ ID NO: 8471251 - DNA, 22 bp, Homo sapiens
gctgcccaggaagcctggggtt

SEQ ID NO: 8471252 - DNA, 22 bp, Homo sapiens
gctgcccagcaggccccagggg

SEQ ID NO: 8471253 - DNA, 22 bp, Homo sapiens
gctgcccaggcaacattgactt

SEQ ID NO: 8471254 - DNA, 22 bp, Homo sapiens
gctgcccagggctgagtgtcct

SEQ ID NO: 8471255 - DNA, 22 bp, Homo sapiens
gctgcccagggtggagccggct

SEQ ID NO: 8471256 - DNA, 22 bp, Homo sapiens
gctgcccagggtggagccggct

SEQ ID NO: 8471257 - DNA, 22 bp, Homo sapiens
gctgagggcatgtgtggcgact

SEQ ID NO: 8471258 - DNA, 22 bp, Homo sapiens
gctgagggatagctgctcactg

SEQ ID NO: 8471259 - DNA, 22 bp, Homo sapiens
gctgcccaattacagggccgtg

SEQ ID NO: 8471260 - DNA, 22 bp, Homo sapiens
gctgcctgtcctgaggagtccg

SEQ ID NO: 8471261 - DNA, 22 bp, Homo sapiens
gctgcctgtcctgaggagtccg

SEQ ID NO: 8471262 - DNA, 22 bp, Homo sapiens
gctgcctccaatctgtgccccg

SEQ ID NO: 8471263 - DNA, 22 bp, Homo sapiens
gctgcctcaggcacctcctggc

SEQ ID NO: 8471264 - DNA, 22 bp, Homo sapiens
gctgcctcaggcacctcctggc

SEQ ID NO: 8471265 - DNA, 22 bp, Homo sapiens
gctgcctcactccagcccaata

SEQ ID NO: 8471266 - DNA, 22 bp, Homo sapiens
gctgcctagtctgctgagcaga

SEQ ID NO: 8471267 - DNA, 22 bp, Homo sapiens
gctgcccttcgtcatctataaa

SEQ ID NO: 8471268 - DNA, 22 bp, Homo sapiens
gctgccctgtttagccagggtt

SEQ ID NO: 8471269 - DNA, 22 bp, Homo sapiens
gctgccctgtggtccagcaggt

SEQ ID NO: 8471270 - DNA, 22 bp, Homo sapiens
gctgcccattccactggatggt

SEQ ID NO: 8471271 - DNA, 22 bp, Homo sapiens
gctgcccattccactggatggt

SEQ ID NO: 8471272 - DNA, 22 bp, Homo sapiens
gctgccccagctgggggctgga

SEQ ID NO: 8471273 - DNA, 22 bp, Homo sapiens
gctgccctagaagtacagagag

SEQ ID NO: 8471274 - DNA, 22 bp, Homo sapiens
gctgccctagaagtacagagag

SEQ ID NO: 8471275 - DNA, 22 bp, Homo sapiens
gctgccctacccgaggcactct

SEQ ID NO: 8471276 - DNA, 22 bp, Homo sapiens
gctgccctaatatcacatgtta

SEQ ID NO: 8471277 - DNA, 18 bp, Homo sapiens
gctgccctagctcccctc

SEQ ID NO: 8471278 - DNA, 18 bp, Homo sapiens
gctgccctagctcccctc

SEQ ID NO: 8471279 - DNA, 22 bp, Homo sapiens
gctgccctgtggtagagggtgg

SEQ ID NO: 8471280 - DNA, 22 bp, Homo sapiens
gctctgggctgaatcatttatc

SEQ ID NO: 8471281 - DNA, 22 bp, Homo sapiens
gctctgggctgaatcatttatc

SEQ ID NO: 8471282 - DNA, 22 bp, Homo sapiens
gctctggggatgcttctgccgt

SEQ ID NO: 8471283 - DNA, 22 bp, Homo sapiens
gctctgggctgccctctggaca

SEQ ID NO: 8471284 - DNA, 22 bp, Homo sapiens
gctctgggctgccctctggaca

SEQ ID NO: 8471285 - DNA, 22 bp, Homo sapiens
gctctgggctgaatcatttatc

SEQ ID NO: 8471286 - DNA, 22 bp, Homo sapiens
gctctggggatgcttctgccgt

SEQ ID NO: 8471287 - DNA, 22 bp, Homo sapiens
gctctggggcccagggatcaca

SEQ ID NO: 8471288 - DNA, 22 bp, Homo sapiens
gctctgggattaccagccttag

SEQ ID NO: 8471289 - DNA, 22 bp, Homo sapiens
gctctgggattaccagccttag

SEQ ID NO: 8471290 - DNA, 22 bp, Homo sapiens
gctctgggattaccagccttag

SEQ ID NO: 8471291 - DNA, 22 bp, Homo sapiens
gctctgggaattcagaaagcct

SEQ ID NO: 8471292 - DNA, 20 bp, Homo sapiens
gctctgggagggatgtgatg

SEQ ID NO: 8471293 - DNA, 22 bp, Homo sapiens
gctctgggccgggcaccagcct

SEQ ID NO: 8471294 - DNA, 22 bp, Homo sapiens
gctctgggccatcctggccggg

SEQ ID NO: 8471295 - DNA, 22 bp, Homo sapiens
gctctgggaaggatcgtagtga

SEQ ID NO: 8471296 - DNA, 22 bp, Homo sapiens
gctctgggaactgactgccttc

SEQ ID NO: 8471297 - DNA, 22 bp, Homo sapiens
gctctgggaagtcctttaccat

SEQ ID NO: 8471298 - DNA, 22 bp, Homo sapiens
gctctggcttggggcactcgtc

SEQ ID NO: 8471299 - DNA, 18 bp, Homo sapiens
gctctggctcacctccag

SEQ ID NO: 8471300 - DNA, 18 bp, Homo sapiens
gctctggctcacctccag

SEQ ID NO: 8471301 - DNA, 22 bp, Homo sapiens
gctctggctcaaaccaccggct

SEQ ID NO: 8471302 - DNA, 22 bp, Homo sapiens
gctctggctcaaaccaccggct

SEQ ID NO: 8471303 - DNA, 22 bp, Homo sapiens
gctcctccaatatggactcctc

SEQ ID NO: 8471304 - DNA, 22 bp, Homo sapiens
gctctggctcaaaccaccggct

SEQ ID NO: 8471305 - DNA, 22 bp, Homo sapiens
gctctggctagttacctcttac

SEQ ID NO: 8471306 - DNA, 22 bp, Homo sapiens
gctccctgttctcagccatgat

SEQ ID NO: 8471307 - DNA, 22 bp, Homo sapiens
gctgaggcggaaggattgctag

SEQ ID NO: 8471308 - DNA, 22 bp, Homo sapiens
gctgaggcctcagaaggctgag

SEQ ID NO: 8471309 - DNA, 22 bp, Homo sapiens
gctgaggccccagggtgatggg

SEQ ID NO: 8471310 - DNA, 22 bp, Homo sapiens
gctgaggccagtttaatgagga

SEQ ID NO: 8471311 - DNA, 22 bp, Homo sapiens
gctgaggccaggccccaccgga

SEQ ID NO: 8471312 - DNA, 22 bp, Homo sapiens
gctgaggctcaatccccttctg

SEQ ID NO: 8471313 - DNA, 22 bp, Homo sapiens
gctgaggctcaagtcatgggtc

SEQ ID NO: 8471314 - DNA, 22 bp, Homo sapiens
gctgagggaggctgaactgagt

SEQ ID NO: 8471315 - DNA, 22 bp, Homo sapiens
gctgagggaccatgtttcagga

SEQ ID NO: 8471316 - DNA, 22 bp, Homo sapiens
gctgaggctgggagcagcctgt

SEQ ID NO: 8471317 - DNA, 22 bp, Homo sapiens
gctgagacttccactgccatct

SEQ ID NO: 8471318 - DNA, 22 bp, Homo sapiens
gctgagacttccactgccatct

SEQ ID NO: 8471319 - DNA, 22 bp, Homo sapiens
gctgagactggcagcaggaagt

SEQ ID NO: 8471320 - DNA, 21 bp, Homo sapiens
gctgagacgcaacctcagtga

SEQ ID NO: 8471321 - DNA, 22 bp, Homo sapiens
gctgacaaacaaggtggtgtca

SEQ ID NO: 8471322 - DNA, 22 bp, Homo sapiens
gctgagaatcaagatggagagg

SEQ ID NO: 8471323 - DNA, 22 bp, Homo sapiens
gctgagaatgttcctactggta

SEQ ID NO: 8471324 - DNA, 17 bp, Homo sapiens
gctgagaaggggaagag

SEQ ID NO: 8471325 - DNA, 22 bp, Homo sapiens
gcctttattgtttattcagtgc

SEQ ID NO: 8471326 - DNA, 22 bp, Homo sapiens
gcctttatccctgtacaaggtg

SEQ ID NO: 8471327 - DNA, 22 bp, Homo sapiens
gcctttatcttgggccaagttt

SEQ ID NO: 8471328 - DNA, 22 bp, Homo sapiens
gccttgtttcattacacgtggt

SEQ ID NO: 8471329 - DNA, 22 bp, Homo sapiens
gccttggttggccagcaggtcc

SEQ ID NO: 8471330 - DNA, 18 bp, Homo sapiens
gcctttgcacaagcagct

SEQ ID NO: 8471331 - DNA, 22 bp, Homo sapiens
gcgggttgaagggcgcatcgaa

SEQ ID NO: 8471332 - DNA, 22 bp, Homo sapiens
gcgtccagggaaggcccagctg

SEQ ID NO: 8471333 - DNA, 22 bp, Homo sapiens
gcgtcttttagattttacatct

SEQ ID NO: 8471334 - DNA, 22 bp, Homo sapiens
gcgtgcaacagcctcttccatt

SEQ ID NO: 8471335 - DNA, 22 bp, Homo sapiens
gcggtccaggagcgcaggtcct

SEQ ID NO: 8471336 - DNA, 22 bp, Homo sapiens
gctacaggtgacagcctctgca

SEQ ID NO: 8471337 - DNA, 22 bp, Homo sapiens
gctacagagctctgtgaagaga

SEQ ID NO: 8471338 - DNA, 22 bp, Homo sapiens
gcgtgggctggactgggatgaa

SEQ ID NO: 8471339 - DNA, 22 bp, Homo sapiens
gcgtggctcctaacagatctga

SEQ ID NO: 8471340 - DNA, 18 bp, Homo sapiens
gcctctgttgcttgcctg

SEQ ID NO: 8471341 - DNA, 22 bp, Homo sapiens
gcctgagattggacattattta

SEQ ID NO: 8471342 - DNA, 22 bp, Homo sapiens
gcctgagcagctatacacacag

SEQ ID NO: 8471343 - DNA, 19 bp, Homo sapiens
gcctgagccagccatgcaa

SEQ ID NO: 8471344 - DNA, 22 bp, Homo sapiens
gcctgagcccaggtgtgcagag

SEQ ID NO: 8471345 - DNA, 22 bp, Homo sapiens
gcctgagcaggcgtggaccatg

SEQ ID NO: 8471346 - DNA, 22 bp, Homo sapiens
gcctctggggtggagcccagca

SEQ ID NO: 8471347 - DNA, 22 bp, Homo sapiens
gcctctggggcagctgagtcat

SEQ ID NO: 8471348 - DNA, 22 bp, Homo sapiens
gcctctggtccctcatgctgtg

SEQ ID NO: 8471349 - DNA, 22 bp, Homo sapiens
gcctgagctttaattttcttgt

SEQ ID NO: 8471350 - DNA, 20 bp, Homo sapiens
gcctgagctattgccaggat

SEQ ID NO: 8471351 - DNA, 22 bp, Homo sapiens
gcctgagccgcctgagcggcgg

SEQ ID NO: 8471352 - DNA, 22 bp, Homo sapiens
gccttgccgctcagcagtgggg

SEQ ID NO: 8471353 - DNA, 22 bp, Homo sapiens
gccttggagatcactgctcatg

SEQ ID NO: 8471354 - DNA, 22 bp, Homo sapiens
gccttggagatcactgctcatg

SEQ ID NO: 8471355 - DNA, 22 bp, Homo sapiens
gccttggactcgggtggactca

SEQ ID NO: 8471356 - DNA, 23 bp, Homo sapiens
gccttggagaagtcactcaggga

SEQ ID NO: 8471357 - DNA, 22 bp, Homo sapiens
gccttggactaccactcccaca

SEQ ID NO: 8471358 - DNA, 22 bp, Homo sapiens
gccttggaaagctggagcagtt

SEQ ID NO: 8471359 - DNA, 22 bp, Homo sapiens
gccttggactaccactcccaca

SEQ ID NO: 8471360 - DNA, 22 bp, Homo sapiens
gccttgggattcttggatgctc

SEQ ID NO: 8471361 - DNA, 22 bp, Homo sapiens
gccttgggaaagtgggaggaga

SEQ ID NO: 8471362 - DNA, 22 bp, Homo sapiens
gccttgggggtgaaagaggcta

SEQ ID NO: 8471363 - DNA, 22 bp, Homo sapiens
gccttgggcacaggcagggccc

SEQ ID NO: 8471364 - DNA, 22 bp, Homo sapiens
gccttggcccacagtgctcctg

SEQ ID NO: 8471365 - DNA, 19 bp, Homo sapiens
gccttggcattctctgctt

SEQ ID NO: 8471366 - DNA, 22 bp, Homo sapiens
gccttggctgccaagctgctga

SEQ ID NO: 8471367 - DNA, 22 bp, Homo sapiens
gccttggctgccaagctgctga

SEQ ID NO: 8471368 - DNA, 22 bp, Homo sapiens
gccttggctgttggagcttgat

SEQ ID NO: 8471369 - DNA, 22 bp, Homo sapiens
gccttggctgttggagcttgat

SEQ ID NO: 8471370 - DNA, 23 bp, Homo sapiens
gctcagaggtttttctctggatg

SEQ ID NO: 8471371 - DNA, 23 bp, Homo sapiens
gctcagaggtttttctctggatg

SEQ ID NO: 8471372 - DNA, 23 bp, Homo sapiens
gctcagaggtttttctctggatg

SEQ ID NO: 8471373 - DNA, 23 bp, Homo sapiens
gctcagaggtttttctctggatg

SEQ ID NO: 8471374 - DNA, 22 bp, Homo sapiens
gctcagaggttgttcttgggtt

SEQ ID NO: 8471375 - DNA, 22 bp, Homo sapiens
gctcagaggttgttcttgggtt

SEQ ID NO: 8471376 - DNA, 22 bp, Homo sapiens
gctcagaggttgttcttgggtt

SEQ ID NO: 8471377 - DNA, 19 bp, Homo sapiens
gctcagagggccctgtgct

SEQ ID NO: 8471378 - DNA, 19 bp, Homo sapiens
gctcagagggccctgtgct

SEQ ID NO: 8471379 - DNA, 19 bp, Homo sapiens
gctcagagggccctgtgct

SEQ ID NO: 8471380 - DNA, 22 bp, Homo sapiens
gctcagagggttttggccaagt

SEQ ID NO: 8471381 - DNA, 22 bp, Homo sapiens
gctcagaggccactgttggaaa

SEQ ID NO: 8471382 - DNA, 19 bp, Homo sapiens
gctcagagggccctgtgct

SEQ ID NO: 8471383 - DNA, 23 bp, Homo sapiens
gctcagaggtgaaatgttttggg

SEQ ID NO: 8471384 - DNA, 22 bp, Homo sapiens
gctcagagggttttggccaagt

SEQ ID NO: 8471385 - DNA, 17 bp, Homo sapiens
gctcagagtacacgtgt

SEQ ID NO: 8471386 - DNA, 17 bp, Homo sapiens
gctcagagtacacgtgt

SEQ ID NO: 8471387 - DNA, 21 bp, Homo sapiens
gctcagagtattgcactgttt

SEQ ID NO: 8471388 - DNA, 21 bp, Homo sapiens
gctcagagtattgcactgttt

SEQ ID NO: 8471389 - DNA, 21 bp, Homo sapiens
gctcagagtattgcactgttt

SEQ ID NO: 8471390 - DNA, 22 bp, Homo sapiens
gctcagagtggcctggctaggg

SEQ ID NO: 8471391 - DNA, 22 bp, Homo sapiens
gctcagagtggcctggctaggg

SEQ ID NO: 8471392 - DNA, 22 bp, Homo sapiens
gctcagagtggcctggctaggg

SEQ ID NO: 8471393 - DNA, 22 bp, Homo sapiens
gctcagagtggcctggctaggg

SEQ ID NO: 8471394 - DNA, 19 bp, Homo sapiens
gctcagagtccccctgcgg

SEQ ID NO: 8471395 - DNA, 19 bp, Homo sapiens
gctcagagtccccctgcgg

SEQ ID NO: 8471396 - DNA, 22 bp, Homo sapiens
gctactgattgaccttggagag

SEQ ID NO: 8471397 - DNA, 22 bp, Homo sapiens
gctcagagcttgaagttccact

SEQ ID NO: 8471398 - DNA, 22 bp, Homo sapiens
gctacagtgataggaaacacat

SEQ ID NO: 8471399 - DNA, 19 bp, Homo sapiens
gctactgaggcccaggacc

SEQ ID NO: 8471400 - DNA, 22 bp, Homo sapiens
gctaccctgggaatctccctca

SEQ ID NO: 8471401 - DNA, 20 bp, Homo sapiens
gctaccagaacaaggccatt

SEQ ID NO: 8471402 - DNA, 22 bp, Homo sapiens
gctacctgagcaagagcttcaa

SEQ ID NO: 8471403 - DNA, 22 bp, Homo sapiens
gctcagagggaacaaggggctg

SEQ ID NO: 8471404 - DNA, 22 bp, Homo sapiens
gctcagagggaacaaggggctg

SEQ ID NO: 8471405 - DNA, 22 bp, Homo sapiens
gctcagaggccactgttggaaa

SEQ ID NO: 8471406 - DNA, 22 bp, Homo sapiens
gctcagaggccaagtgcccgcc

SEQ ID NO: 8471407 - DNA, 22 bp, Homo sapiens
gctcagaggccactgttggaaa

SEQ ID NO: 8471408 - DNA, 22 bp, Homo sapiens
gctcagaggagcatcataagga

SEQ ID NO: 8471409 - DNA, 22 bp, Homo sapiens
gctcagaggagcatcataagga

SEQ ID NO: 8471410 - DNA, 22 bp, Homo sapiens
gctcagaggatgctcctttatg

SEQ ID NO: 8471411 - DNA, 22 bp, Homo sapiens
gctcagaggaggcctttaccta

SEQ ID NO: 8471412 - DNA, 22 bp, Homo sapiens
gctcagaggcacgacctcttgg

SEQ ID NO: 8471413 - DNA, 22 bp, Homo sapiens
gctcagctatcagtgttcctga

SEQ ID NO: 8471414 - DNA, 18 bp, Homo sapiens
gctcagctatgggaggtt

SEQ ID NO: 8471415 - DNA, 22 bp, Homo sapiens
gctcagctacttacaggtggct

SEQ ID NO: 8471416 - DNA, 22 bp, Homo sapiens
gctcagccgaacttcagagcag

SEQ ID NO: 8471417 - DNA, 23 bp, Homo sapiens
gctcagcctcagcaggcccagga

SEQ ID NO: 8471418 - DNA, 22 bp, Homo sapiens
gctcagagttaaatatagtgct

SEQ ID NO: 8471419 - DNA, 22 bp, Homo sapiens
gctcagagttaaatatagtgct

SEQ ID NO: 8471420 - DNA, 22 bp, Homo sapiens
gctcagagttaattggatgggt

SEQ ID NO: 8471421 - DNA, 22 bp, Homo sapiens
gctcagagttaattggatgggt

SEQ ID NO: 8471422 - DNA, 22 bp, Homo sapiens
gctcagagttaattggatgggt

SEQ ID NO: 8471423 - DNA, 21 bp, Homo sapiens
gctcagcaaaggtgaggtgca

SEQ ID NO: 8471424 - DNA, 22 bp, Homo sapiens
gctcagcactttctccaaccac

SEQ ID NO: 8471425 - DNA, 22 bp, Homo sapiens
gctcagccgaacttcagagcag

SEQ ID NO: 8471426 - DNA, 19 bp, Homo sapiens
gctcagcagacccagtgct

SEQ ID NO: 8471427 - DNA, 22 bp, Homo sapiens
gctccaggataataaagttgtt

SEQ ID NO: 8471428 - DNA, 22 bp, Homo sapiens
gctccaggataataaagttgtt

SEQ ID NO: 8471429 - DNA, 22 bp, Homo sapiens
gctccaggcagagcctctttcg

SEQ ID NO: 8471430 - DNA, 22 bp, Homo sapiens
gctcagctgagcgaaggacatg

SEQ ID NO: 8471431 - DNA, 22 bp, Homo sapiens
gctccaggaggctcccgcgtct

SEQ ID NO: 8471432 - DNA, 22 bp, Homo sapiens
gctccagggtcagctcagaact

SEQ ID NO: 8471433 - DNA, 22 bp, Homo sapiens
gctccagggtcagctcagaact

SEQ ID NO: 8471434 - DNA, 22 bp, Homo sapiens
gctccagggagtacatttatca

SEQ ID NO: 8471435 - DNA, 22 bp, Homo sapiens
gctcccagaaccaaggctgggg

SEQ ID NO: 8471436 - DNA, 22 bp, Homo sapiens
gctcccagaaccaaggctgggg

SEQ ID NO: 8471437 - DNA, 22 bp, Homo sapiens
gctccaggtgaatcctctcacc

SEQ ID NO: 8471438 - DNA, 22 bp, Homo sapiens
gctccaggtgaatcctctcacc

SEQ ID NO: 8471439 - DNA, 20 bp, Homo sapiens
gctccaggtcagagaggacg

SEQ ID NO: 8471440 - DNA, 22 bp, Homo sapiens
gctccaggtatttgccctttta

SEQ ID NO: 8471441 - DNA, 22 bp, Homo sapiens
gctccagtggatacagcagtgg

SEQ ID NO: 8471442 - DNA, 22 bp, Homo sapiens
gctccagtggactgggggaggc

SEQ ID NO: 8471443 - DNA, 22 bp, Homo sapiens
gctccagtgaccatcgttttag

SEQ ID NO: 8471444 - DNA, 22 bp, Homo sapiens
gctccaggtgtcccaggtaaaa

SEQ ID NO: 8471445 - DNA, 21 bp, Homo sapiens
gctccctgctcagctcctggg

SEQ ID NO: 8471446 - DNA, 21 bp, Homo sapiens
gctccctgctcagctcctggg

SEQ ID NO: 8471447 - DNA, 22 bp, Homo sapiens
gctccctgcactctgcagccct

SEQ ID NO: 8471448 - DNA, 22 bp, Homo sapiens
gctccctgcatttcccaccctt

SEQ ID NO: 8471449 - DNA, 17 bp, Homo sapiens
gctccctgaggacagct

SEQ ID NO: 8471450 - DNA, 21 bp, Homo sapiens
gctccctgctcagctcctggg

SEQ ID NO: 8471451 - DNA, 22 bp, Homo sapiens
gctccctggaatgttggctgcc

SEQ ID NO: 8471452 - DNA, 22 bp, Homo sapiens
ggacaggttcagcagtttataa

SEQ ID NO: 8471453 - DNA, 22 bp, Homo sapiens
ggacagtagtcactaaactaga

SEQ ID NO: 8471454 - DNA, 22 bp, Homo sapiens
ggacagtccacctcagtgaaga

SEQ ID NO: 8471455 - DNA, 22 bp, Homo sapiens
ggacaggtgactgcccagagtg

SEQ ID NO: 8471456 - DNA, 22 bp, Homo sapiens
ggacaggtgcaaagggcacatg

SEQ ID NO: 8471457 - DNA, 19 bp, Homo sapiens
ggacagtctcagcctcatg

SEQ ID NO: 8471458 - DNA, 23 bp, Homo sapiens
ggacacaggccttgtctgcgcct

SEQ ID NO: 8471459 - DNA, 23 bp, Homo sapiens
ggacacaggccttgtctgcgcct

SEQ ID NO: 8471460 - DNA, 22 bp, Homo sapiens
ggacacaggtaaataccactga

SEQ ID NO: 8471461 - DNA, 22 bp, Homo sapiens
ggacacagctgcagccacaccc

SEQ ID NO: 8471462 - DNA, 22 bp, Homo sapiens
ggacacaggcagctgggtgggt

SEQ ID NO: 8471463 - DNA, 22 bp, Homo sapiens
ggacacaggcagctgggtgggt

SEQ ID NO: 8471464 - DNA, 22 bp, Homo sapiens
ggacacagtggaagacagcttg

SEQ ID NO: 8471465 - DNA, 22 bp, Homo sapiens
ggacatctcttgccagggctgc

SEQ ID NO: 8471466 - DNA, 22 bp, Homo sapiens
ggacatgatatttcaggaagac

SEQ ID NO: 8471467 - DNA, 22 bp, Homo sapiens
ggaccaggactggtggtatctc

SEQ ID NO: 8471468 - DNA, 22 bp, Homo sapiens
ggaccaggagctcagagccctc

SEQ ID NO: 8471469 - DNA, 20 bp, Homo sapiens
ggaccagctgtctgaggggc

SEQ ID NO: 8471470 - DNA, 22 bp, Homo sapiens
ggaccaggcaagctgaggcggg

SEQ ID NO: 8471471 - DNA, 22 bp, Homo sapiens
ggaccaggccagcctccctgcg

SEQ ID NO: 8471472 - DNA, 22 bp, Homo sapiens
ggaccaggctgagcacctgcct

SEQ ID NO: 8471473 - DNA, 22 bp, Homo sapiens
ggaccaggctgagcacctgcct

SEQ ID NO: 8471474 - DNA, 22 bp, Homo sapiens
ggagacagtatggcttgtagct

SEQ ID NO: 8471475 - DNA, 22 bp, Homo sapiens
ggagacagggttgaaccacgca

SEQ ID NO: 8471476 - DNA, 22 bp, Homo sapiens
ggaccagtttcaaactgtacca

SEQ ID NO: 8471477 - DNA, 19 bp, Homo sapiens
ggaccaggtcctgggcagc

SEQ ID NO: 8471478 - DNA, 22 bp, Homo sapiens
ggaccaggggcgcactccctgc

SEQ ID NO: 8471479 - DNA, 22 bp, Homo sapiens
ggaccaggggcgcactccctgc

SEQ ID NO: 8471480 - DNA, 22 bp, Homo sapiens
ggagagaaattgaggtagcaag

SEQ ID NO: 8471481 - DNA, 22 bp, Homo sapiens
ggagagaaattgaggtagcaag

SEQ ID NO: 8471482 - DNA, 22 bp, Homo sapiens
ggagagaaattgaggtagcaag

SEQ ID NO: 8471483 - DNA, 22 bp, Homo sapiens
ggagagaatctgaacctgctcc

SEQ ID NO: 8471484 - DNA, 22 bp, Homo sapiens
ggagagaagggagaatttgttc

SEQ ID NO: 8471485 - DNA, 22 bp, Homo sapiens
ggagagaattccatggacatgt

SEQ ID NO: 8471486 - DNA, 22 bp, Homo sapiens
ggagagaatctgaacctgctcc

SEQ ID NO: 8471487 - DNA, 22 bp, Homo sapiens
ggagacagtgacttagagactg

SEQ ID NO: 8471488 - DNA, 22 bp, Homo sapiens
ggagacagtggtagggcctaag

SEQ ID NO: 8471489 - DNA, 22 bp, Homo sapiens
ggagaccagaaggaagcttcga

SEQ ID NO: 8471490 - DNA, 22 bp, Homo sapiens
ggagaccttaaggtgcttccta

SEQ ID NO: 8471491 - DNA, 22 bp, Homo sapiens
ggagacccaggttaggaagtaa

SEQ ID NO: 8471492 - DNA, 22 bp, Homo sapiens
ggagactgatctgagtgataac

SEQ ID NO: 8471493 - DNA, 22 bp, Homo sapiens
ggagccagaaatgctgtggttg

SEQ ID NO: 8471494 - DNA, 22 bp, Homo sapiens
ggagcagggaattacagcgcag

SEQ ID NO: 8471495 - DNA, 22 bp, Homo sapiens
ggagcagcactgccacacagag

SEQ ID NO: 8471496 - DNA, 22 bp, Homo sapiens
ggagcagatgtcttcatggcct

SEQ ID NO: 8471497 - DNA, 22 bp, Homo sapiens
ggagagagagctcattagctgc

SEQ ID NO: 8471498 - DNA, 22 bp, Homo sapiens
ggagagagacctccatgcccag

SEQ ID NO: 8471499 - DNA, 22 bp, Homo sapiens
ggagagagacctccatgcccag

SEQ ID NO: 8471500 - DNA, 22 bp, Homo sapiens
ggagagagagctcattagctgc

SEQ ID NO: 8471501 - DNA, 22 bp, Homo sapiens
gctttattttgtgagggattac

SEQ ID NO: 8471502 - DNA, 22 bp, Homo sapiens
gctttcaattatgtcagcctgt

SEQ ID NO: 8471503 - DNA, 22 bp, Homo sapiens
gctttccctgccctcagaagga

SEQ ID NO: 8471504 - DNA, 22 bp, Homo sapiens
gctttgctgggtgcttcatgta

SEQ ID NO: 8471505 - DNA, 22 bp, Homo sapiens
gctttggaacttaaatccttgg

SEQ ID NO: 8471506 - DNA, 22 bp, Homo sapiens
gctttgctgaggtctgaggatt

SEQ ID NO: 8471507 - DNA, 22 bp, Homo sapiens
gctttctgattgcgaaaacaaa

SEQ ID NO: 8471508 - DNA, 22 bp, Homo sapiens
gctttctgcctgggctccattt

SEQ ID NO: 8471509 - DNA, 22 bp, Homo sapiens
gctttctgattgcgaaaacaaa

SEQ ID NO: 8471510 - DNA, 22 bp, Homo sapiens
gctttctgaagcagtgtttctc

SEQ ID NO: 8471511 - DNA, 22 bp, Homo sapiens
gctttctgatgagcttaagaaa

SEQ ID NO: 8471512 - DNA, 22 bp, Homo sapiens
gctttctgatgagcttaagaaa

SEQ ID NO: 8471513 - DNA, 22 bp, Homo sapiens
gctttctgattgcgaaaacaaa

SEQ ID NO: 8471514 - DNA, 22 bp, Homo sapiens
ggaagaggctgagccaggtccc

SEQ ID NO: 8471515 - DNA, 22 bp, Homo sapiens
ggaagaggctgagccaggtccc

SEQ ID NO: 8471516 - DNA, 22 bp, Homo sapiens
ggaagaggctgaggccatgctg

SEQ ID NO: 8471517 - DNA, 22 bp, Homo sapiens
ggaagaggctctcattgagggc

SEQ ID NO: 8471518 - DNA, 22 bp, Homo sapiens
ggaagaggctctcattgagggc

SEQ ID NO: 8471519 - DNA, 22 bp, Homo sapiens
gctttggaaggggctggtggag

SEQ ID NO: 8471520 - DNA, 22 bp, Homo sapiens
ggaagacagaagcctacagctt

SEQ ID NO: 8471521 - DNA, 22 bp, Homo sapiens
ggaagaggaggagccaggcttt

SEQ ID NO: 8471522 - DNA, 22 bp, Homo sapiens
ggaagaggaggagccaggcttt

SEQ ID NO: 8471523 - DNA, 22 bp, Homo sapiens
ggaagaggaggagccaggcttt

SEQ ID NO: 8471524 - DNA, 22 bp, Homo sapiens
ggaatgtttttcattgctctct

SEQ ID NO: 8471525 - DNA, 22 bp, Homo sapiens
ggaatgttttccagacctagat

SEQ ID NO: 8471526 - DNA, 22 bp, Homo sapiens
ggaattcagtggccagacatga

SEQ ID NO: 8471527 - DNA, 22 bp, Homo sapiens
ggacaaaatccaaacttcttag

SEQ ID NO: 8471528 - DNA, 22 bp, Homo sapiens
ggaattggtttcaagggaaagt

SEQ ID NO: 8471529 - DNA, 18 bp, Homo sapiens
ggacacagataggtacag

SEQ ID NO: 8471530 - DNA, 17 bp, Homo sapiens
ggacacagctcatggct

SEQ ID NO: 8471531 - DNA, 17 bp, Homo sapiens
ggacacagctcatggct

SEQ ID NO: 8471532 - DNA, 17 bp, Homo sapiens
ggacacagctcatggct

SEQ ID NO: 8471533 - DNA, 22 bp, Homo sapiens
ggaatgtttgctcccttcaggg

SEQ ID NO: 8471534 - DNA, 22 bp, Homo sapiens
ggaatgttttagcttgactttt

SEQ ID NO: 8471535 - DNA, 23 bp, Homo sapiens
ggaatgtttacctgtgaatgtca

SEQ ID NO: 8471536 - DNA, 22 bp, Homo sapiens
ggaatgttctggaacaccgctt

SEQ ID NO: 8471537 - DNA, 22 bp, Homo sapiens
ggaatgttgtcatttacattat

SEQ ID NO: 8471538 - DNA, 22 bp, Homo sapiens
ggaatgttctggtctggttcat

SEQ ID NO: 8471539 - DNA, 22 bp, Homo sapiens
ggaatctttgaaggattttaag

SEQ ID NO: 8471540 - DNA, 22 bp, Homo sapiens
ggaatctttttcataagcctca

SEQ ID NO: 8471541 - DNA, 22 bp, Homo sapiens
ggaatgaatttccagctgggtc

SEQ ID NO: 8471542 - DNA, 22 bp, Homo sapiens
ggaatctagaaagggagcaagg

SEQ ID NO: 8471543 - DNA, 22 bp, Homo sapiens
ggaatcttcagccatgccaaga

SEQ ID NO: 8471544 - DNA, 22 bp, Homo sapiens
ggaatcttaatggcatggagtt

SEQ ID NO: 8471545 - DNA, 22 bp, Homo sapiens
ggaagcagcctgaagccaaggg

SEQ ID NO: 8471546 - DNA, 22 bp, Homo sapiens
ggaagcagcctgaagccaaggg

SEQ ID NO: 8471547 - DNA, 22 bp, Homo sapiens
ggaagcaggaggctggggtaaa

SEQ ID NO: 8471548 - DNA, 22 bp, Homo sapiens
ggaagagtaacaggaggtggaa

SEQ ID NO: 8471549 - DNA, 22 bp, Homo sapiens
ggaagagggaaccacgactgta

SEQ ID NO: 8471550 - DNA, 22 bp, Homo sapiens
ggaagagggaaccacgactgta

SEQ ID NO: 8471551 - DNA, 22 bp, Homo sapiens
ggaagaggctggtagtgcccgt

SEQ ID NO: 8471552 - DNA, 22 bp, Homo sapiens
ggaagaggctggtagtgcccgt

SEQ ID NO: 8471553 - DNA, 22 bp, Homo sapiens
ggaagatgagaagtggggctcc

SEQ ID NO: 8471554 - DNA, 18 bp, Homo sapiens
gctttatttcttggggaa

SEQ ID NO: 8471555 - DNA, 22 bp, Homo sapiens
gcttgctctttagccatggcca

SEQ ID NO: 8471556 - DNA, 22 bp, Homo sapiens
gcttgctctttagccatggcca

SEQ ID NO: 8471557 - DNA, 20 bp, Homo sapiens
gcttggaagccacctgtatt

SEQ ID NO: 8471558 - DNA, 20 bp, Homo sapiens
gcttgcccacatctgcactg

SEQ ID NO: 8471559 - DNA, 22 bp, Homo sapiens
gcttgcctatctggtggtcgtt

SEQ ID NO: 8471560 - DNA, 22 bp, Homo sapiens
gcttgatgatacctaggagatg

SEQ ID NO: 8471561 - DNA, 22 bp, Homo sapiens
gcttgaaaatgactcttgtgaa

SEQ ID NO: 8471562 - DNA, 22 bp, Homo sapiens
gcttctttggcaaccctgacat

SEQ ID NO: 8471563 - DNA, 22 bp, Homo sapiens
gctgtggtctgtgagctccaaa

SEQ ID NO: 8471564 - DNA, 22 bp, Homo sapiens
gctgtgtacctactaactgctt

SEQ ID NO: 8471565 - DNA, 22 bp, Homo sapiens
gctgtgtgaaaactgggcctgg

SEQ ID NO: 8471566 - DNA, 22 bp, Homo sapiens
gctgtgtcctcacacagccttt

SEQ ID NO: 8471567 - DNA, 22 bp, Homo sapiens
gcttctttccttgggctggaac

SEQ ID NO: 8471568 - DNA, 19 bp, Homo sapiens
gcttctgtttgggcttaga

SEQ ID NO: 8471569 - DNA, 22 bp, Homo sapiens
gcttctgtggttgtcacgacta

SEQ ID NO: 8471570 - DNA, 22 bp, Homo sapiens
gcttctgtggtgaggtcacctt

SEQ ID NO: 8471571 - DNA, 22 bp, Homo sapiens
gcttctgtcttagctacctccc

SEQ ID NO: 8471572 - DNA, 22 bp, Homo sapiens
gctgtggctgtacagagaccat

SEQ ID NO: 8471573 - DNA, 22 bp, Homo sapiens
gctgtggctgacattgcagaca

SEQ ID NO: 8471574 - DNA, 22 bp, Homo sapiens
gctggggctgggctgaggaaga

SEQ ID NO: 8471575 - DNA, 22 bp, Homo sapiens
gctggggctgggctgaggaaga

SEQ ID NO: 8471576 - DNA, 19 bp, Homo sapiens
gctggggcctgaccagaca

SEQ ID NO: 8471577 - DNA, 22 bp, Homo sapiens
gctggggcctgaacagtcagct

SEQ ID NO: 8471578 - DNA, 22 bp, Homo sapiens
gctggggcctgaacagtcagct

SEQ ID NO: 8471579 - DNA, 22 bp, Homo sapiens
gctggggagggcgtcaaggcca

SEQ ID NO: 8471580 - DNA, 22 bp, Homo sapiens
gctggggagggcgtcaaggcca

SEQ ID NO: 8471581 - DNA, 22 bp, Homo sapiens
gctgggcttggtttccctgctt

SEQ ID NO: 8471582 - DNA, 19 bp, Homo sapiens
gctgggcttgggtttgtag

SEQ ID NO: 8471583 - DNA, 22 bp, Homo sapiens
gctgggcttctcaatgctgcct

SEQ ID NO: 8471584 - DNA, 22 bp, Homo sapiens
gctggcttccttctgcagctag

SEQ ID NO: 8471585 - DNA, 17 bp, Homo sapiens
gctggcttctccttgct

SEQ ID NO: 8471586 - DNA, 22 bp, Homo sapiens
gctggcttccttctgcagctag

SEQ ID NO: 8471587 - DNA, 21 bp, Homo sapiens
gctggcttcctgagggctgag

SEQ ID NO: 8471588 - DNA, 18 bp, Homo sapiens
gctggcttgctgggtttg

SEQ ID NO: 8471589 - DNA, 22 bp, Homo sapiens
gctggcttgacagaggcctggg

SEQ ID NO: 8471590 - DNA, 22 bp, Homo sapiens
gctggcttaatgtagctaaaaa

SEQ ID NO: 8471591 - DNA, 22 bp, Homo sapiens
gctggcttccctacctgcacct

SEQ ID NO: 8471592 - DNA, 22 bp, Homo sapiens
gctggctggcgggtgcgtcctc

SEQ ID NO: 8471593 - DNA, 22 bp, Homo sapiens
gctggctgtgttccttctgcca

SEQ ID NO: 8471594 - DNA, 22 bp, Homo sapiens
gctgggcttctcaatgctgcct

SEQ ID NO: 8471595 - DNA, 22 bp, Homo sapiens
gctgggcttcacctccagagtt

SEQ ID NO: 8471596 - DNA, 22 bp, Homo sapiens
gctgggcttcacctccagagtt

SEQ ID NO: 8471597 - DNA, 22 bp, Homo sapiens
gctgggcttcacagagccttta

SEQ ID NO: 8471598 - DNA, 22 bp, Homo sapiens
gctgggcttcacctccagagtt

SEQ ID NO: 8471599 - DNA, 22 bp, Homo sapiens
gctgggctgtagtttgctgacc

SEQ ID NO: 8471600 - DNA, 22 bp, Homo sapiens
gctgggctgtagtttgctgacc

SEQ ID NO: 8471601 - DNA, 22 bp, Homo sapiens
gctgggctggccgccgagatcg

SEQ ID NO: 8471602 - DNA, 23 bp, Homo sapiens
gctgggcttactctttcagtgag

SEQ ID NO: 8471603 - DNA, 22 bp, Homo sapiens
gctgggcttcacagagccttta

SEQ ID NO: 8471604 - DNA, 22 bp, Homo sapiens
gctgggctggaaggccaaggca

SEQ ID NO: 8471605 - DNA, 22 bp, Homo sapiens
gctgggctggaaggccaaggca

SEQ ID NO: 8471606 - DNA, 22 bp, Homo sapiens
gctgggctggccgccgagatcg

SEQ ID NO: 8471607 - DNA, 22 bp, Homo sapiens
gctggctttatcgtcagactcc

SEQ ID NO: 8471608 - DNA, 22 bp, Homo sapiens
gctggctttatggggcttgtgg

SEQ ID NO: 8471609 - DNA, 22 bp, Homo sapiens
gctggctttgtcaagggcagca

SEQ ID NO: 8471610 - DNA, 22 bp, Homo sapiens
gctggagacctcagagaaccca

SEQ ID NO: 8471611 - DNA, 22 bp, Homo sapiens
gctggagaaactgcagctgagg

SEQ ID NO: 8471612 - DNA, 22 bp, Homo sapiens
gctgctttactgaagagatatg

SEQ ID NO: 8471613 - DNA, 22 bp, Homo sapiens
gctggagaaacaggaggaggaa

SEQ ID NO: 8471614 - DNA, 22 bp, Homo sapiens
gctggagaaacaggaggaggaa

SEQ ID NO: 8471615 - DNA, 22 bp, Homo sapiens
gctggctgcgtcatcacagggc

SEQ ID NO: 8471616 - DNA, 22 bp, Homo sapiens
gctggctggatggttggttcgc

SEQ ID NO: 8471617 - DNA, 23 bp, Homo sapiens
gctggctggcagtaaaggttgtt

SEQ ID NO: 8471618 - DNA, 23 bp, Homo sapiens
gctggctggcagtaaaggttgtt

SEQ ID NO: 8471619 - DNA, 22 bp, Homo sapiens
gctggctggcacgttcgcacgt

SEQ ID NO: 8471620 - DNA, 22 bp, Homo sapiens
gctggctggaggtgaggaagaa

SEQ ID NO: 8471621 - DNA, 22 bp, Homo sapiens
gctggctggagtaaggagggag

SEQ ID NO: 8471622 - DNA, 22 bp, Homo sapiens
gctggctggaggagggaggttg

SEQ ID NO: 8471623 - DNA, 22 bp, Homo sapiens
gctggctggaatgggagaagaa

SEQ ID NO: 8471624 - DNA, 19 bp, Homo sapiens
gctggctggaggagggaca

SEQ ID NO: 8471625 - DNA, 22 bp, Homo sapiens
gctggctggaactagcagttgg

SEQ ID NO: 8471626 - DNA, 21 bp, Homo sapiens
gccacccctggcacaggtgct

SEQ ID NO: 8471627 - DNA, 22 bp, Homo sapiens
gccacccccaagtaggtggtct

SEQ ID NO: 8471628 - DNA, 22 bp, Homo sapiens
gccaccccaacctccctaagtt

SEQ ID NO: 8471629 - DNA, 22 bp, Homo sapiens
gccaccccaacctccctaagtt

SEQ ID NO: 8471630 - DNA, 22 bp, Homo sapiens
gccaccatgtagcccattagag

SEQ ID NO: 8471631 - DNA, 18 bp, Homo sapiens
gccagccctccaacctcc

SEQ ID NO: 8471632 - DNA, 20 bp, Homo sapiens
gccagccctgacacaggagc

SEQ ID NO: 8471633 - DNA, 20 bp, Homo sapiens
gccagccctgacacaggagc

SEQ ID NO: 8471634 - DNA, 22 bp, Homo sapiens
gccagccctgggagacttatgg

SEQ ID NO: 8471635 - DNA, 22 bp, Homo sapiens
gccagccttctgtggcctgcaa

SEQ ID NO: 8471636 - DNA, 21 bp, Homo sapiens
gccagcctgtttacctgtggt

SEQ ID NO: 8471637 - DNA, 23 bp, Homo sapiens
gccagccttgctctcctgcagcc

SEQ ID NO: 8471638 - DNA, 22 bp, Homo sapiens
gccagccttctgtggcctgcaa

SEQ ID NO: 8471639 - DNA, 22 bp, Homo sapiens
gccagcctgtgcttggccaggc

SEQ ID NO: 8471640 - DNA, 22 bp, Homo sapiens
gccagcctgtgcttggccaggc

SEQ ID NO: 8471641 - DNA, 21 bp, Homo sapiens
gccagcctgtttacctgtggt

SEQ ID NO: 8471642 - DNA, 22 bp, Homo sapiens
gccagcctgtgggggctctgtg

SEQ ID NO: 8471643 - DNA, 22 bp, Homo sapiens
gccagcctgtgggggctctgtg

SEQ ID NO: 8471644 - DNA, 22 bp, Homo sapiens
gccagcctgtgggggctctgtg

SEQ ID NO: 8471645 - DNA, 22 bp, Homo sapiens
gccagctcagtttcaaagtagg

SEQ ID NO: 8471646 - DNA, 22 bp, Homo sapiens
gccagctcagtttcaaagtagg

SEQ ID NO: 8471647 - DNA, 22 bp, Homo sapiens
gccagctctcattgtataggct

SEQ ID NO: 8471648 - DNA, 23 bp, Homo sapiens
gccagccttgctctcctgcagcc

SEQ ID NO: 8471649 - DNA, 23 bp, Homo sapiens
gccagccttgctctcctgcagcc

SEQ ID NO: 8471650 - DNA, 22 bp, Homo sapiens
gccagctcagtgccaggcccct

SEQ ID NO: 8471651 - DNA, 22 bp, Homo sapiens
gccaggcagacaggtcatcagg

SEQ ID NO: 8471652 - DNA, 22 bp, Homo sapiens
gccaggcagagccccgtgcagc

SEQ ID NO: 8471653 - DNA, 22 bp, Homo sapiens
gccaggcagagccccgtgcagc

SEQ ID NO: 8471654 - DNA, 22 bp, Homo sapiens
gccaggcactgctctaagccct

SEQ ID NO: 8471655 - DNA, 22 bp, Homo sapiens
gccagctgaagggaagctcctg

SEQ ID NO: 8471656 - DNA, 22 bp, Homo sapiens
gccaggcagatatgtgagctta

SEQ ID NO: 8471657 - DNA, 22 bp, Homo sapiens
gccaggcagccaccctctgcga

SEQ ID NO: 8471658 - DNA, 22 bp, Homo sapiens
gccaggcagcagcgaggatggt

SEQ ID NO: 8471659 - DNA, 22 bp, Homo sapiens
gccaggcagttcaagtacacca

SEQ ID NO: 8471660 - DNA, 22 bp, Homo sapiens
gccaggcaggtgtcggagccct

SEQ ID NO: 8471661 - DNA, 22 bp, Homo sapiens
gccaggcaggtgtcggagccct

SEQ ID NO: 8471662 - DNA, 22 bp, Homo sapiens
gccaggcagctagcaacccctg

SEQ ID NO: 8471663 - DNA, 22 bp, Homo sapiens
gccaggcagcaggaagccagtg

SEQ ID NO: 8471664 - DNA, 22 bp, Homo sapiens
gccaggcaggccacgctgtgtt

SEQ ID NO: 8471665 - DNA, 22 bp, Homo sapiens
gccaggcatgggcttctgggcg

SEQ ID NO: 8471666 - DNA, 22 bp, Homo sapiens
gccaggcatgtcctctgcagaa

SEQ ID NO: 8471667 - DNA, 22 bp, Homo sapiens
gccagggagtctgggccacaga

SEQ ID NO: 8471668 - DNA, 22 bp, Homo sapiens
gcaggggagtggatgatggatt

SEQ ID NO: 8471669 - DNA, 22 bp, Homo sapiens
gcaggggagtccactctatgca

SEQ ID NO: 8471670 - DNA, 22 bp, Homo sapiens
gcaggggagtggcaggcccgga

SEQ ID NO: 8471671 - DNA, 22 bp, Homo sapiens
gcagtgacagacaactgtttga

SEQ ID NO: 8471672 - DNA, 22 bp, Homo sapiens
gcagtgctttagtctgtccttt

SEQ ID NO: 8471673 - DNA, 22 bp, Homo sapiens
gcagtggcaccgctggctctgg

SEQ ID NO: 8471674 - DNA, 22 bp, Homo sapiens
gcagtggcagagacagcaccaa

SEQ ID NO: 8471675 - DNA, 22 bp, Homo sapiens
gcagtggcatgatgtgggctca

SEQ ID NO: 8471676 - DNA, 22 bp, Homo sapiens
gcagtggctaagctcgcatgca

SEQ ID NO: 8471677 - DNA, 22 bp, Homo sapiens
gcagtggccacatggaggagga

SEQ ID NO: 8471678 - DNA, 22 bp, Homo sapiens
gcagtgggagcttaggcagtgc

SEQ ID NO: 8471679 - DNA, 22 bp, Homo sapiens
gcagtgggaaggttggcacatg

SEQ ID NO: 8471680 - DNA, 22 bp, Homo sapiens
gcagtggctaggagtctggcgt

SEQ ID NO: 8471681 - DNA, 22 bp, Homo sapiens
gcatgcagggagggtctggctg

SEQ ID NO: 8471682 - DNA, 22 bp, Homo sapiens
gcatgcaggaagggcttgggga

SEQ ID NO: 8471683 - DNA, 22 bp, Homo sapiens
gcatgcaggagagaaagacggc

SEQ ID NO: 8471684 - DNA, 22 bp, Homo sapiens
gcatgcagagtccctctgcatt

SEQ ID NO: 8471685 - DNA, 22 bp, Homo sapiens
gcatgcaggaagggcttgggga

SEQ ID NO: 8471686 - DNA, 22 bp, Homo sapiens
gcatgcagagaatacctgtgat

SEQ ID NO: 8471687 - DNA, 22 bp, Homo sapiens
gcatgcagaaaatgaacaacga

SEQ ID NO: 8471688 - DNA, 22 bp, Homo sapiens
gcatgcagacagtctgagacca

SEQ ID NO: 8471689 - DNA, 22 bp, Homo sapiens
gcatgctgctgaggctggaata

SEQ ID NO: 8471690 - DNA, 22 bp, Homo sapiens
gcatggccaggaaaggtagaaa

SEQ ID NO: 8471691 - DNA, 21 bp, Homo sapiens
gcatgcctgcatcttagtgtt

SEQ ID NO: 8471692 - DNA, 22 bp, Homo sapiens
gcatgcagtaaaattcagcaac

SEQ ID NO: 8471693 - DNA, 22 bp, Homo sapiens
gcatggccttgctgtagtggta

SEQ ID NO: 8471694 - DNA, 20 bp, Homo sapiens
gcatggctaatctgtactga

SEQ ID NO: 8471695 - DNA, 22 bp, Homo sapiens
gcatggccaggaaaggtagaaa

SEQ ID NO: 8471696 - DNA, 22 bp, Homo sapiens
gcatggctggtgtcctgaggga

SEQ ID NO: 8471697 - DNA, 22 bp, Homo sapiens
gcatggctgttgaagtcagctc

SEQ ID NO: 8471698 - DNA, 22 bp, Homo sapiens
gcatggcttacagaggctgcag

SEQ ID NO: 8471699 - DNA, 22 bp, Homo sapiens
gcatggctattatgaggcagaa

SEQ ID NO: 8471700 - DNA, 22 bp, Homo sapiens
gcatggctcctgtcttactccc

SEQ ID NO: 8471701 - DNA, 22 bp, Homo sapiens
gcatggctctggcctcagtgtg

SEQ ID NO: 8471702 - DNA, 22 bp, Homo sapiens
gcatggctggtgtcctgaggga

SEQ ID NO: 8471703 - DNA, 22 bp, Homo sapiens
gcatggctctggcctcagtgtg

SEQ ID NO: 8471704 - DNA, 22 bp, Homo sapiens
gcatggctgctccctggctgca

SEQ ID NO: 8471705 - DNA, 22 bp, Homo sapiens
gcatggctctggcctcagtgtg

SEQ ID NO: 8471706 - DNA, 22 bp, Homo sapiens
gccaccaggagcccagtccaaa

SEQ ID NO: 8471707 - DNA, 22 bp, Homo sapiens
gccaccagccccatgcgctgtg

SEQ ID NO: 8471708 - DNA, 22 bp, Homo sapiens
gccaccagtgggggcctgggca

SEQ ID NO: 8471709 - DNA, 22 bp, Homo sapiens
gccaccagtagctaacaacagt

SEQ ID NO: 8471710 - DNA, 22 bp, Homo sapiens
gccaccagggggctccagtgag

SEQ ID NO: 8471711 - DNA, 22 bp, Homo sapiens
gccaccagccccatgcgctgtg

SEQ ID NO: 8471712 - DNA, 22 bp, Homo sapiens
gccaccagcagaaaaggggcca

SEQ ID NO: 8471713 - DNA, 22 bp, Homo sapiens
gccacattagccctcaccatct

SEQ ID NO: 8471714 - DNA, 19 bp, Homo sapiens
gccacatcttttccagagt

SEQ ID NO: 8471715 - DNA, 22 bp, Homo sapiens
gccacatgcaattgcagcacgt

SEQ ID NO: 8471716 - DNA, 19 bp, Homo sapiens
gccacatctgtaccccttt

SEQ ID NO: 8471717 - DNA, 22 bp, Homo sapiens
gccacatccaggtggatcaaat

SEQ ID NO: 8471718 - DNA, 22 bp, Homo sapiens
gccacatccttcagaaagcttt

SEQ ID NO: 8471719 - DNA, 22 bp, Homo sapiens
gccacaggcttaggagggaggt

SEQ ID NO: 8471720 - DNA, 22 bp, Homo sapiens
gccccagctctgccacaactag

SEQ ID NO: 8471721 - DNA, 22 bp, Homo sapiens
gccccaggataaatttgtaaga

SEQ ID NO: 8471722 - DNA, 17 bp, Homo sapiens
gccctggagccaggcta

SEQ ID NO: 8471723 - DNA, 22 bp, Homo sapiens
gccccaggggaggtgccctgca

SEQ ID NO: 8471724 - DNA, 22 bp, Homo sapiens
gccccaggggaggtgccctgca

SEQ ID NO: 8471725 - DNA, 22 bp, Homo sapiens
gccctggagctagactaggaca

SEQ ID NO: 8471726 - DNA, 22 bp, Homo sapiens
gccctggagggccagcgactgg

SEQ ID NO: 8471727 - DNA, 22 bp, Homo sapiens
gccccagccaaggtgacacgaa

SEQ ID NO: 8471728 - DNA, 22 bp, Homo sapiens
gccccagatggaggaagctggg

SEQ ID NO: 8471729 - DNA, 22 bp, Homo sapiens
gccccagcctcccgagtagctg

SEQ ID NO: 8471730 - DNA, 22 bp, Homo sapiens
gccccagcctcccgagtagctg

SEQ ID NO: 8471731 - DNA, 22 bp, Homo sapiens
gccccagcctagttttctttca

SEQ ID NO: 8471732 - DNA, 22 bp, Homo sapiens
gccccagccctgtggaccatgg

SEQ ID NO: 8471733 - DNA, 22 bp, Homo sapiens
gccctgggattgggtggaggct

SEQ ID NO: 8471734 - DNA, 22 bp, Homo sapiens
gccctgggattgggtggaggct

SEQ ID NO: 8471735 - DNA, 22 bp, Homo sapiens
gccctgggattgggtggaggct

SEQ ID NO: 8471736 - DNA, 22 bp, Homo sapiens
gccctggcctcctggaacaggc

SEQ ID NO: 8471737 - DNA, 22 bp, Homo sapiens
gccctggccttcatctcagaca

SEQ ID NO: 8471738 - DNA, 22 bp, Homo sapiens
gccctggatgtacaggcatgtt

SEQ ID NO: 8471739 - DNA, 22 bp, Homo sapiens
gccctggatggcaggagccatc

SEQ ID NO: 8471740 - DNA, 22 bp, Homo sapiens
gccctggatgctcatggcatca

SEQ ID NO: 8471741 - DNA, 22 bp, Homo sapiens
gccctggagggccagcgactgg

SEQ ID NO: 8471742 - DNA, 22 bp, Homo sapiens
gccctgggcaaggttctggcca

SEQ ID NO: 8471743 - DNA, 22 bp, Homo sapiens
gccctgggcaaggttctggcca

SEQ ID NO: 8471744 - DNA, 22 bp, Homo sapiens
gccctgggcaaggttctggcca

SEQ ID NO: 8471745 - DNA, 22 bp, Homo sapiens
gccctgggattgggtggaggct

SEQ ID NO: 8471746 - DNA, 22 bp, Homo sapiens
gccctgtggattaatgagcagg

SEQ ID NO: 8471747 - DNA, 22 bp, Homo sapiens
gccctgtggattaatgagcagg

SEQ ID NO: 8471748 - DNA, 22 bp, Homo sapiens
gccctgtggacccaggaactct

SEQ ID NO: 8471749 - DNA, 22 bp, Homo sapiens
gccctgtggacccaggaactct

SEQ ID NO: 8471750 - DNA, 22 bp, Homo sapiens
gccctgtggacagtgagaagtg

SEQ ID NO: 8471751 - DNA, 22 bp, Homo sapiens
gccctgtggacagtgagaagtg

SEQ ID NO: 8471752 - DNA, 22 bp, Homo sapiens
gccctgtggacagtgagaagtg

SEQ ID NO: 8471753 - DNA, 22 bp, Homo sapiens
gccctgtgcttggatggcagat

SEQ ID NO: 8471754 - DNA, 22 bp, Homo sapiens
gccctgtgcgctgagttcaggg

SEQ ID NO: 8471755 - DNA, 22 bp, Homo sapiens
gccctgtgcgctgagttcaggg

SEQ ID NO: 8471756 - DNA, 22 bp, Homo sapiens
gcctcctggcctttgctcctca

SEQ ID NO: 8471757 - DNA, 22 bp, Homo sapiens
gcctcctggcctttgctcctca

SEQ ID NO: 8471758 - DNA, 22 bp, Homo sapiens
gcctcctggggtgccatcatct

SEQ ID NO: 8471759 - DNA, 22 bp, Homo sapiens
gcctcctggggtgccatcatct

SEQ ID NO: 8471760 - DNA, 22 bp, Homo sapiens
gcctcctggttgcttctccaac

SEQ ID NO: 8471761 - DNA, 22 bp, Homo sapiens
gcctcctggttgcttctccaac

SEQ ID NO: 8471762 - DNA, 22 bp, Homo sapiens
gcctcctgggttcatgccattc

SEQ ID NO: 8471763 - DNA, 22 bp, Homo sapiens
gcctctgggctctgcccctggc

SEQ ID NO: 8471764 - DNA, 22 bp, Homo sapiens
gcctcctggaagtcacatgttt

SEQ ID NO: 8471765 - DNA, 22 bp, Homo sapiens
gcctcctgcccagatgagtgat

SEQ ID NO: 8471766 - DNA, 22 bp, Homo sapiens
gcctcctggcctttgctcctca

SEQ ID NO: 8471767 - DNA, 22 bp, Homo sapiens
gcctcctggattttagtgccat

SEQ ID NO: 8471768 - DNA, 22 bp, Homo sapiens
gcctcctgacttacactgagct

SEQ ID NO: 8471769 - DNA, 22 bp, Homo sapiens
gcctcctgacttacactgagct

SEQ ID NO: 8471770 - DNA, 22 bp, Homo sapiens
gcctcctgacttacactgagct

SEQ ID NO: 8471771 - DNA, 22 bp, Homo sapiens
gcctcctgagaagccacaggct

SEQ ID NO: 8471772 - DNA, 22 bp, Homo sapiens
gcctcctgagtagctgggattg

SEQ ID NO: 8471773 - DNA, 22 bp, Homo sapiens
gcctcctgagtagctgggattg

SEQ ID NO: 8471774 - DNA, 22 bp, Homo sapiens
gcctcctgagtagctgggattg

SEQ ID NO: 8471775 - DNA, 22 bp, Homo sapiens
gcctccggagtcacagtgtctt

SEQ ID NO: 8471776 - DNA, 22 bp, Homo sapiens
gcctccggagttgcagtgtctt

SEQ ID NO: 8471777 - DNA, 22 bp, Homo sapiens
gccctgtgtgatcacatgaaca

SEQ ID NO: 8471778 - DNA, 22 bp, Homo sapiens
gccctgtgtatcccctgtgctt

SEQ ID NO: 8471779 - DNA, 22 bp, Homo sapiens
gccctgtgtatcccctgtgctt

SEQ ID NO: 8471780 - DNA, 22 bp, Homo sapiens
gccctgtggttccaggaagcaa

SEQ ID NO: 8471781 - DNA, 22 bp, Homo sapiens
gccctgtgtgtttgcactgatt

SEQ ID NO: 8471782 - DNA, 22 bp, Homo sapiens
gccctgtgtgtttgcactgatt

SEQ ID NO: 8471783 - DNA, 22 bp, Homo sapiens
gccctgtgtgatctgctgttag

SEQ ID NO: 8471784 - DNA, 22 bp, Homo sapiens
gccctgtgtgtttgcactgatt

SEQ ID NO: 8471785 - DNA, 22 bp, Homo sapiens
gcctcctccttcccgagggtct

SEQ ID NO: 8471786 - DNA, 22 bp, Homo sapiens
gcctcctgaaaggaagagctcc

SEQ ID NO: 8471787 - DNA, 22 bp, Homo sapiens
gcctcctgaaaggaagagctcc

SEQ ID NO: 8471788 - DNA, 22 bp, Homo sapiens
gcctcctcttgagggtcaggga

SEQ ID NO: 8471789 - DNA, 22 bp, Homo sapiens
gcctcctgaagtgctgggatta

SEQ ID NO: 8471790 - DNA, 22 bp, Homo sapiens
gcctcctgaagtgctgggatta

SEQ ID NO: 8471791 - DNA, 22 bp, Homo sapiens
gcctcctgaagtgctgggatta

SEQ ID NO: 8471792 - DNA, 22 bp, Homo sapiens
gcccagcagatctcagtgtctc

SEQ ID NO: 8471793 - DNA, 22 bp, Homo sapiens
gcccagcagatctcagtgtctc

SEQ ID NO: 8471794 - DNA, 22 bp, Homo sapiens
gcccagcagctggtggagaagg

SEQ ID NO: 8471795 - DNA, 22 bp, Homo sapiens
gcccagcagctggtggagaagg

SEQ ID NO: 8471796 - DNA, 22 bp, Homo sapiens
gcccagcacctctctcagggtt

SEQ ID NO: 8471797 - DNA, 22 bp, Homo sapiens
gcccagcacctctctcagggtt

SEQ ID NO: 8471798 - DNA, 22 bp, Homo sapiens
gcccagcactcctctctgacat

SEQ ID NO: 8471799 - DNA, 22 bp, Homo sapiens
gcccagcactaaaagctttgct

SEQ ID NO: 8471800 - DNA, 22 bp, Homo sapiens
gcccagcctccaagctccaagg

SEQ ID NO: 8471801 - DNA, 22 bp, Homo sapiens
gcccagcctccaagctccaagg

SEQ ID NO: 8471802 - DNA, 22 bp, Homo sapiens
gcccagccctgaggtcacagct

SEQ ID NO: 8471803 - DNA, 22 bp, Homo sapiens
gcccagcacatctggccttgaa

SEQ ID NO: 8471804 - DNA, 22 bp, Homo sapiens
gcccagcacagctggaagagtc

SEQ ID NO: 8471805 - DNA, 22 bp, Homo sapiens
gcccagcacattgctgaggacc

SEQ ID NO: 8471806 - DNA, 22 bp, Homo sapiens
gcccagcacattgctgaggacc

SEQ ID NO: 8471807 - DNA, 22 bp, Homo sapiens
gccagggttgccaatgggggca

SEQ ID NO: 8471808 - DNA, 22 bp, Homo sapiens
gccaggtcacctcactcatcca

SEQ ID NO: 8471809 - DNA, 22 bp, Homo sapiens
gcccagcacagctggaagagtc

SEQ ID NO: 8471810 - DNA, 22 bp, Homo sapiens
gcccagcacagctggaagagtc

SEQ ID NO: 8471811 - DNA, 21 bp, Homo sapiens
gcccagcaaggtgagaaggcc

SEQ ID NO: 8471812 - DNA, 21 bp, Homo sapiens
gcccagcaaggtgagaaggcc

SEQ ID NO: 8471813 - DNA, 22 bp, Homo sapiens
gccaggggacgcggagcgacga

SEQ ID NO: 8471814 - DNA, 22 bp, Homo sapiens
gccaggggacgcggagcgacga

SEQ ID NO: 8471815 - DNA, 22 bp, Homo sapiens
gccagggggtcagcaggcactt

SEQ ID NO: 8471816 - DNA, 22 bp, Homo sapiens
gccagggttcgaatccgtatgg

SEQ ID NO: 8471817 - DNA, 22 bp, Homo sapiens
gccagggtgagggctgagaggt

SEQ ID NO: 8471818 - DNA, 22 bp, Homo sapiens
gccagggtgagggctgagaggt

SEQ ID NO: 8471819 - DNA, 22 bp, Homo sapiens
gccagggtggcagaaggcccca

SEQ ID NO: 8471820 - DNA, 22 bp, Homo sapiens
gcccagctggcttccagcacat

SEQ ID NO: 8471821 - DNA, 22 bp, Homo sapiens
gcccaggaaagatagggcctca

SEQ ID NO: 8471822 - DNA, 22 bp, Homo sapiens
gcccaggaaataaaagtgggct

SEQ ID NO: 8471823 - DNA, 22 bp, Homo sapiens
gcccaggaaatgccccgtggtg

SEQ ID NO: 8471824 - DNA, 22 bp, Homo sapiens
gcccaggaagttgaggctgccg

SEQ ID NO: 8471825 - DNA, 22 bp, Homo sapiens
gcccaggaagtgactcagatgt

SEQ ID NO: 8471826 - DNA, 22 bp, Homo sapiens
gcccatggtcagggaggcaggg

SEQ ID NO: 8471827 - DNA, 22 bp, Homo sapiens
gccccacctgctaccttccagc

SEQ ID NO: 8471828 - DNA, 22 bp, Homo sapiens
gccccacctgctaccttccagc

SEQ ID NO: 8471829 - DNA, 22 bp, Homo sapiens
gccccaccgagggtgcagtcct

SEQ ID NO: 8471830 - DNA, 22 bp, Homo sapiens
gccccaccgagggtgcagtcct

SEQ ID NO: 8471831 - DNA, 22 bp, Homo sapiens
gcccaggactcagggtgtcgcg

SEQ ID NO: 8471832 - DNA, 22 bp, Homo sapiens
gcccaggagaggccagggctga

SEQ ID NO: 8471833 - DNA, 22 bp, Homo sapiens
gcccatggcttccctaggcaca

SEQ ID NO: 8471834 - DNA, 22 bp, Homo sapiens
gcccatgggcctgaggccctag

SEQ ID NO: 8471835 - DNA, 22 bp, Homo sapiens
gcccatggcttccctaggcaca

SEQ ID NO: 8471836 - DNA, 22 bp, Homo sapiens
gcacagaacagagaaatagcca

SEQ ID NO: 8471837 - DNA, 22 bp, Homo sapiens
gcacagaacactggtgagtccc

SEQ ID NO: 8471838 - DNA, 22 bp, Homo sapiens
gcacagaaatgtctacacatgt

SEQ ID NO: 8471839 - DNA, 22 bp, Homo sapiens
gcacagaacagagaaatagcca

SEQ ID NO: 8471840 - DNA, 22 bp, Homo sapiens
gcacacgtagaagaacttgact

SEQ ID NO: 8471841 - DNA, 22 bp, Homo sapiens
gcacacttaatactcactgtgc

SEQ ID NO: 8471842 - DNA, 19 bp, Homo sapiens
gcacacgttgtgcttgagc

SEQ ID NO: 8471843 - DNA, 19 bp, Homo sapiens
gcacaccctgcaccaccat

SEQ ID NO: 8471844 - DNA, 22 bp, Homo sapiens
gcacaggtcaggagatgagatt

SEQ ID NO: 8471845 - DNA, 22 bp, Homo sapiens
gcacagtacctgtcacagaggc

SEQ ID NO: 8471846 - DNA, 22 bp, Homo sapiens
gcacagtaggtatttacccagt

SEQ ID NO: 8471847 - DNA, 22 bp, Homo sapiens
gcacagtaggctcagctctatc

SEQ ID NO: 8471848 - DNA, 22 bp, Homo sapiens
gcacagtattgcacaactctag

SEQ ID NO: 8471849 - DNA, 22 bp, Homo sapiens
gcacacactgttttcctcacat

SEQ ID NO: 8471850 - DNA, 22 bp, Homo sapiens
gcacacagaacatttggatcct

SEQ ID NO: 8471851 - DNA, 22 bp, Homo sapiens
gcacacagtagggattcaatga

SEQ ID NO: 8471852 - DNA, 22 bp, Homo sapiens
gcacacagtactatatgctaca

SEQ ID NO: 8471853 - DNA, 19 bp, Homo sapiens
gcacacatacaccctttgg

SEQ ID NO: 8471854 - DNA, 19 bp, Homo sapiens
gcacacagtagggctggca

SEQ ID NO: 8471855 - DNA, 20 bp, Homo sapiens
gcacacatagaaatgcatat

SEQ ID NO: 8471856 - DNA, 22 bp, Homo sapiens
gcacacatcttgtaatcctgag

SEQ ID NO: 8471857 - DNA, 22 bp, Homo sapiens
gcacacatatatatgagcatgt

SEQ ID NO: 8471858 - DNA, 22 bp, Homo sapiens
gcacacatatatatgagcatgt

SEQ ID NO: 8471859 - DNA, 22 bp, Homo sapiens
gcacacatgcgtgtatatgggt

SEQ ID NO: 8471860 - DNA, 22 bp, Homo sapiens
gcacacatgtgagtgtcctttc

SEQ ID NO: 8471861 - DNA, 22 bp, Homo sapiens
gcacacattctagccttttgtg

SEQ ID NO: 8471862 - DNA, 22 bp, Homo sapiens
gcacacattcggattcttaacc

SEQ ID NO: 8471863 - DNA, 22 bp, Homo sapiens
gcacacatgcatgcacaggagt

SEQ ID NO: 8471864 - DNA, 22 bp, Homo sapiens
gcacacatgcatgtgtgcatcc

SEQ ID NO: 8471865 - DNA, 22 bp, Homo sapiens
gcaaatacatgttgagcaccta

SEQ ID NO: 8471866 - DNA, 22 bp, Homo sapiens
gcaaatagaagattctgttgac

SEQ ID NO: 8471867 - DNA, 22 bp, Homo sapiens
gcaaagtgaaatggggcagaga

SEQ ID NO: 8471868 - DNA, 22 bp, Homo sapiens
gcaaagtgcttcagtgggagct

SEQ ID NO: 8471869 - DNA, 22 bp, Homo sapiens
gcaaagtattaagtattaagtt

SEQ ID NO: 8471870 - DNA, 22 bp, Homo sapiens
gcaaagtattaaccaacaggat

SEQ ID NO: 8471871 - DNA, 22 bp, Homo sapiens
gcaaagtaaaaatagattctga

SEQ ID NO: 8471872 - DNA, 22 bp, Homo sapiens
gcaaagtaaaaatagattctga

SEQ ID NO: 8471873 - DNA, 22 bp, Homo sapiens
gcaaagcagtcttctgtgccta

SEQ ID NO: 8471874 - DNA, 22 bp, Homo sapiens
gcaaagcagaaccctctctatc

SEQ ID NO: 8471875 - DNA, 22 bp, Homo sapiens
gcaaagcacactggagatgtcg

SEQ ID NO: 8471876 - DNA, 22 bp, Homo sapiens
gcaaagcacactggagatgtcg

SEQ ID NO: 8471877 - DNA, 22 bp, Homo sapiens
gcaaagcatcagtagaaatgtt

SEQ ID NO: 8471878 - DNA, 22 bp, Homo sapiens
gcaaagcaatcaggagtagcat

SEQ ID NO: 8471879 - DNA, 22 bp, Homo sapiens
gcaaagcacaccctcagagttt

SEQ ID NO: 8471880 - DNA, 22 bp, Homo sapiens
gcaaagcacaccctcagagttt

SEQ ID NO: 8471881 - DNA, 22 bp, Homo sapiens
gcaaagcaagctgtcagcctca

SEQ ID NO: 8471882 - DNA, 22 bp, Homo sapiens
gcaaagcaagattcagatgtag

SEQ ID NO: 8471883 - DNA, 22 bp, Homo sapiens
gaggccagtgtgctgtgttttc

SEQ ID NO: 8471884 - DNA, 22 bp, Homo sapiens
gaggccagtgaaatgttataaa

SEQ ID NO: 8471885 - DNA, 22 bp, Homo sapiens
gaggccaggaggatctctctaa

SEQ ID NO: 8471886 - DNA, 22 bp, Homo sapiens
gaggccaggaggatctctctaa

SEQ ID NO: 8471887 - DNA, 22 bp, Homo sapiens
gaggcccaaggactctgtcccg

SEQ ID NO: 8471888 - DNA, 22 bp, Homo sapiens
gaggccataagaagttcttggg

SEQ ID NO: 8471889 - DNA, 20 bp, Homo sapiens
gaggcccagagaggtgaagc

SEQ ID NO: 8471890 - DNA, 22 bp, Homo sapiens
gaggcccagcagcgcaggtctt

SEQ ID NO: 8471891 - DNA, 23 bp, Homo sapiens
gcaaagactctgccaaaaactgc

SEQ ID NO: 8471892 - DNA, 22 bp, Homo sapiens
gcacatccaatgattgttttga

SEQ ID NO: 8471893 - DNA, 20 bp, Homo sapiens
gcacatctgctttggatttc

SEQ ID NO: 8471894 - DNA, 22 bp, Homo sapiens
gcacatatgctgtaagcacatg

SEQ ID NO: 8471895 - DNA, 22 bp, Homo sapiens
gcacatgactttgaggaaacca

SEQ ID NO: 8471896 - DNA, 22 bp, Homo sapiens
gcacatctggagctctgtggaa

SEQ ID NO: 8471897 - DNA, 22 bp, Homo sapiens
gcacatgacagtaagtagagca

SEQ ID NO: 8471898 - DNA, 22 bp, Homo sapiens
gcacagtgtaccacagtcccta

SEQ ID NO: 8471899 - DNA, 22 bp, Homo sapiens
gcacagtgatgtcagaattgga

SEQ ID NO: 8471900 - DNA, 22 bp, Homo sapiens
gcacagtggtgaaagcatgggt

SEQ ID NO: 8471901 - DNA, 22 bp, Homo sapiens
gcagagcaccctgcagtggtat

SEQ ID NO: 8471902 - DNA, 22 bp, Homo sapiens
gcagagattggtgcactgatga

SEQ ID NO: 8471903 - DNA, 22 bp, Homo sapiens
gcagagaagatgcccaggcttc

SEQ ID NO: 8471904 - DNA, 22 bp, Homo sapiens
gcagagaaagttttgtcctcag

SEQ ID NO: 8471905 - DNA, 22 bp, Homo sapiens
gcagagaaagttttgtcctcag

SEQ ID NO: 8471906 - DNA, 22 bp, Homo sapiens
gcagagaagatgcccaggcttc

SEQ ID NO: 8471907 - DNA, 22 bp, Homo sapiens
gcagagaacccagcagattggc

SEQ ID NO: 8471908 - DNA, 22 bp, Homo sapiens
gcagagaacccagcagattggc

SEQ ID NO: 8471909 - DNA, 22 bp, Homo sapiens
gcagactgtacactggactttg

SEQ ID NO: 8471910 - DNA, 22 bp, Homo sapiens
gcagactggtcttcagccttgg

SEQ ID NO: 8471911 - DNA, 22 bp, Homo sapiens
gcagacatcacctcagtgctat

SEQ ID NO: 8471912 - DNA, 22 bp, Homo sapiens
gcagactctgagagtgagtgcc

SEQ ID NO: 8471913 - DNA, 21 bp, Homo sapiens
gcagactgccctgctgtcccc

SEQ ID NO: 8471914 - DNA, 22 bp, Homo sapiens
gcagaccctgaactgggcatgg

SEQ ID NO: 8471915 - DNA, 22 bp, Homo sapiens
gcagagtggtttcagagttgag

SEQ ID NO: 8471916 - DNA, 22 bp, Homo sapiens
gcagatggactgtatgacctga

SEQ ID NO: 8471917 - DNA, 22 bp, Homo sapiens
gcagatggaaagtgcttgaggg

SEQ ID NO: 8471918 - DNA, 22 bp, Homo sapiens
gcagaggtgagaagggcctccc

SEQ ID NO: 8471919 - DNA, 22 bp, Homo sapiens
gcagaggccaggccaccagcaa

SEQ ID NO: 8471920 - DNA, 22 bp, Homo sapiens
gcagaggggaagctgaggaatt

SEQ ID NO: 8471921 - DNA, 22 bp, Homo sapiens
gcagaggtcctagccaggagtc

SEQ ID NO: 8471922 - DNA, 22 bp, Homo sapiens
gcagagggtcctgtgccagcag

SEQ ID NO: 8471923 - DNA, 22 bp, Homo sapiens
gcagagggtcctgtgccagcag

SEQ ID NO: 8471924 - DNA, 22 bp, Homo sapiens
gcagagggtcctgtgccagcag

SEQ ID NO: 8471925 - DNA, 22 bp, Homo sapiens
gcagaggcacagccccagatga

SEQ ID NO: 8471926 - DNA, 22 bp, Homo sapiens
gcagaggatcaggctctggaaa

SEQ ID NO: 8471927 - DNA, 18 bp, Homo sapiens
gcagagcagaagctcaag

SEQ ID NO: 8471928 - DNA, 22 bp, Homo sapiens
gcagagcagcaaatggaaagga

SEQ ID NO: 8471929 - DNA, 22 bp, Homo sapiens
gcagaggagtgattatgccgtg

SEQ ID NO: 8471930 - DNA, 22 bp, Homo sapiens
gcagggctgttcaggagggtgg

SEQ ID NO: 8471931 - DNA, 22 bp, Homo sapiens
gcagggcttagaaatggtggct

SEQ ID NO: 8471932 - DNA, 22 bp, Homo sapiens
gcagggcttagaaatggtggct

SEQ ID NO: 8471933 - DNA, 22 bp, Homo sapiens
gcagggcttgcagcagctagac

SEQ ID NO: 8471934 - DNA, 22 bp, Homo sapiens
gcagggctggggctgctcctga

SEQ ID NO: 8471935 - DNA, 22 bp, Homo sapiens
gcagggctgaaggtcccaggcc

SEQ ID NO: 8471936 - DNA, 22 bp, Homo sapiens
gcagggctgggtcctgtctcat

SEQ ID NO: 8471937 - DNA, 22 bp, Homo sapiens
gcagggctgtaatttgagcctg

SEQ ID NO: 8471938 - DNA, 22 bp, Homo sapiens
gcagggctgggtgggagacaga

SEQ ID NO: 8471939 - DNA, 22 bp, Homo sapiens
gcagggacctatgacgatggaa

SEQ ID NO: 8471940 - DNA, 22 bp, Homo sapiens
gcagggaccaaaagaggcagta

SEQ ID NO: 8471941 - DNA, 22 bp, Homo sapiens
gcagggacagggcagggccttt

SEQ ID NO: 8471942 - DNA, 18 bp, Homo sapiens
gcagggacacagggtcac

SEQ ID NO: 8471943 - DNA, 22 bp, Homo sapiens
gcagggaagatcttggagctgc

SEQ ID NO: 8471944 - DNA, 22 bp, Homo sapiens
gcaggcagttatttagtagaat

SEQ ID NO: 8471945 - DNA, 22 bp, Homo sapiens
gcagggaagacccggagcagcg

SEQ ID NO: 8471946 - DNA, 22 bp, Homo sapiens
gcaggcagttgcagttttctag

SEQ ID NO: 8471947 - DNA, 19 bp, Homo sapiens
gcaggcagtggcattcgga

SEQ ID NO: 8471948 - DNA, 22 bp, Homo sapiens
gcaggcaggtggcatcttgtga

SEQ ID NO: 8471949 - DNA, 22 bp, Homo sapiens
gcaggcagtcatctttcatatt

SEQ ID NO: 8471950 - DNA, 22 bp, Homo sapiens
gcaggacacagatgcaaggcca

SEQ ID NO: 8471951 - DNA, 22 bp, Homo sapiens
gcaggcagaggtggaggagaca

SEQ ID NO: 8471952 - DNA, 14 bp, Homo sapiens
gcaggcagatcacc

SEQ ID NO: 8471953 - DNA, 16 bp, Homo sapiens
gcaggcagatcacatg

SEQ ID NO: 8471954 - DNA, 15 bp, Homo sapiens
gcaggcagatcaccg

SEQ ID NO: 8471955 - DNA, 22 bp, Homo sapiens
gcaggcagagtcaatttgatcc

SEQ ID NO: 8471956 - DNA, 22 bp, Homo sapiens
gcaggcagatcacctgtcagga

SEQ ID NO: 8471957 - DNA, 22 bp, Homo sapiens
gcaggcagatcacctgtcagga

SEQ ID NO: 8471958 - DNA, 14 bp, Homo sapiens
gcaggcagatcact

SEQ ID NO: 8471959 - DNA, 19 bp, Homo sapiens
gcaggcagctggggtatcc

SEQ ID NO: 8471960 - DNA, 14 bp, Homo sapiens
gcaggcagatcatt

SEQ ID NO: 8471961 - DNA, 22 bp, Homo sapiens
gcaggcagccacgattcccttg

SEQ ID NO: 8471962 - DNA, 22 bp, Homo sapiens
gcagctttctacttcctacagc

SEQ ID NO: 8471963 - DNA, 22 bp, Homo sapiens
gcagctttctaagctttattgc

SEQ ID NO: 8471964 - DNA, 22 bp, Homo sapiens
gcagctttctaagctttattgc

SEQ ID NO: 8471965 - DNA, 20 bp, Homo sapiens
gcagctgtgcattcttagga

SEQ ID NO: 8471966 - DNA, 22 bp, Homo sapiens
gcagctgtcggaaagctaagtg

SEQ ID NO: 8471967 - DNA, 22 bp, Homo sapiens
gcagctttgaagacttatttgc

SEQ ID NO: 8471968 - DNA, 22 bp, Homo sapiens
gcagctttctttttgcatgtct

SEQ ID NO: 8471969 - DNA, 22 bp, Homo sapiens
gcagcctctgatgatggccgta

SEQ ID NO: 8471970 - DNA, 22 bp, Homo sapiens
gcagctgtcgctaggagctgtg

SEQ ID NO: 8471971 - DNA, 22 bp, Homo sapiens
gcagctgtcgctaggagctgtg

SEQ ID NO: 8471972 - DNA, 22 bp, Homo sapiens
gcagcctcagggcactcagatg

SEQ ID NO: 8471973 - DNA, 20 bp, Homo sapiens
gcagcctcaacaggcacagc

SEQ ID NO: 8471974 - DNA, 20 bp, Homo sapiens
gcagcctcaacaggcacagc

SEQ ID NO: 8471975 - DNA, 22 bp, Homo sapiens
gcagcctcaaactccccagctc

SEQ ID NO: 8471976 - DNA, 22 bp, Homo sapiens
gcagcctcaaactccccagctc

SEQ ID NO: 8471977 - DNA, 20 bp, Homo sapiens
gcagccgtggagactaggag

SEQ ID NO: 8471978 - DNA, 22 bp, Homo sapiens
gcaggaagaggctcgaagcccc

SEQ ID NO: 8471979 - DNA, 22 bp, Homo sapiens
gcaggaagatgagctcaggtaa

SEQ ID NO: 8471980 - DNA, 22 bp, Homo sapiens
gcaggaagatgagctcaggtaa

SEQ ID NO: 8471981 - DNA, 22 bp, Homo sapiens
gcaggaagcatagaagaatgcc

SEQ ID NO: 8471982 - DNA, 22 bp, Homo sapiens
gcaggaagccttaccaagccca

SEQ ID NO: 8471983 - DNA, 22 bp, Homo sapiens
gcaggaagggaaaggttgactc

SEQ ID NO: 8471984 - DNA, 22 bp, Homo sapiens
gcaggaagggaaaggttgactc

SEQ ID NO: 8471985 - DNA, 23 bp, Homo sapiens
gcaggacaacagagtgggaaggc

SEQ ID NO: 8471986 - DNA, 22 bp, Homo sapiens
gcagcccagagcgcaggacccc

SEQ ID NO: 8471987 - DNA, 22 bp, Homo sapiens
gcagcccagcagggcccggagc

SEQ ID NO: 8471988 - DNA, 22 bp, Homo sapiens
gcagatggtgggggaggagtac

SEQ ID NO: 8471989 - DNA, 22 bp, Homo sapiens
gcagatgtaatggctggaggtc

SEQ ID NO: 8471990 - DNA, 22 bp, Homo sapiens
gcagatgttctgtgtctcacaa

SEQ ID NO: 8471991 - DNA, 22 bp, Homo sapiens
gcagcccaggaccctggacaga

SEQ ID NO: 8471992 - DNA, 22 bp, Homo sapiens
gcagcccaggaccctggacaga

SEQ ID NO: 8471993 - DNA, 22 bp, Homo sapiens
gcagcccaggagcaggcgaccc

SEQ ID NO: 8471994 - DNA, 22 bp, Homo sapiens
gcagcccaggtggagtaatcta

SEQ ID NO: 8471995 - DNA, 22 bp, Homo sapiens
gcagcccaggtctctctcactc

SEQ ID NO: 8471996 - DNA, 22 bp, Homo sapiens
gcagcccaggctcgctcactgc

SEQ ID NO: 8471997 - DNA, 22 bp, Homo sapiens
gcagccctgcagctccacaccg

SEQ ID NO: 8471998 - DNA, 18 bp, Homo sapiens
gcagcccctcttccttcc

SEQ ID NO: 8471999 - DNA, 18 bp, Homo sapiens
gcagcccctcttccttcc

SEQ ID NO: 8472000 - DNA, 22 bp, Homo sapiens
gcagatgggagccccaggggag

SEQ ID NO: 8472001 - DNA, 21 bp, Homo sapiens
gcagatgggagtcatcaggct

SEQ ID NO: 8472002 - DNA, 22 bp, Homo sapiens
gcagatggatcacctgaggtcg

SEQ ID NO: 8472003 - DNA, 22 bp, Homo sapiens
tcattcactttgaaataaacga

SEQ ID NO: 8472004 - DNA, 22 bp, Homo sapiens
tcattcagagagaatgttccag

SEQ ID NO: 8472005 - DNA, 23 bp, Homo sapiens
tcattcaaggctggtatctttca

SEQ ID NO: 8472006 - DNA, 20 bp, Homo sapiens
tcattacagtgctaagatgt

SEQ ID NO: 8472007 - DNA, 22 bp, Homo sapiens
tcattagaaatgcagattctca

SEQ ID NO: 8472008 - DNA, 22 bp, Homo sapiens
tcattataaacatatgctaaag

SEQ ID NO: 8472009 - DNA, 22 bp, Homo sapiens
tcatggcacatgccctccaggg

SEQ ID NO: 8472010 - DNA, 20 bp, Homo sapiens
tcatggcagccacccacagg

SEQ ID NO: 8472011 - DNA, 22 bp, Homo sapiens
tcatggctaatgcagtatattc

SEQ ID NO: 8472012 - DNA, 22 bp, Homo sapiens
tcatggctctaaagacatagat

SEQ ID NO: 8472013 - DNA, 22 bp, Homo sapiens
tcatggcacttagcacagtcct

SEQ ID NO: 8472014 - DNA, 22 bp, Homo sapiens
tcatggcagccctttactagag

SEQ ID NO: 8472015 - DNA, 22 bp, Homo sapiens
tcatgctttgttaatgtggcac

SEQ ID NO: 8472016 - DNA, 22 bp, Homo sapiens
tcatggaaacagcaatgctaat

SEQ ID NO: 8472017 - DNA, 22 bp, Homo sapiens
tcatataagtttaaaactatct

SEQ ID NO: 8472018 - DNA, 22 bp, Homo sapiens
tcatatacctgcatgtgcatgt

SEQ ID NO: 8472019 - DNA, 22 bp, Homo sapiens
tcatatgattgtaatgagaata

SEQ ID NO: 8472020 - DNA, 22 bp, Homo sapiens
tcatataagagctttagagtca

SEQ ID NO: 8472021 - DNA, 22 bp, Homo sapiens
tcatataagtttaaaactatct

SEQ ID NO: 8472022 - DNA, 22 bp, Homo sapiens
tcatatttaggcctttaattca

SEQ ID NO: 8472023 - DNA, 22 bp, Homo sapiens
tcatatttaggcctttaattca

SEQ ID NO: 8472024 - DNA, 21 bp, Homo sapiens
tcatatttctcttgctattgt

SEQ ID NO: 8472025 - DNA, 22 bp, Homo sapiens
tcatatttagttcacgctcaat

SEQ ID NO: 8472026 - DNA, 22 bp, Homo sapiens
tcatatttatatgttggcacag

SEQ ID NO: 8472027 - DNA, 19 bp, Homo sapiens
tcatgcatttctaagtgca

SEQ ID NO: 8472028 - DNA, 22 bp, Homo sapiens
tcatgccaaactgaacacagtt

SEQ ID NO: 8472029 - DNA, 22 bp, Homo sapiens
tcatgccaaaatccagtggctt

SEQ ID NO: 8472030 - DNA, 22 bp, Homo sapiens
tcatgccagctttgcttgtccc

SEQ ID NO: 8472031 - DNA, 22 bp, Homo sapiens
tcatgccagttaaaggctgtga

SEQ ID NO: 8472032 - DNA, 22 bp, Homo sapiens
tcatgccacttacaaaataatg

SEQ ID NO: 8472033 - DNA, 21 bp, Homo sapiens
tcatatttctcttgctattgt

SEQ ID NO: 8472034 - DNA, 22 bp, Homo sapiens
tcatgctgaggatgctgtgaag

SEQ ID NO: 8472035 - DNA, 22 bp, Homo sapiens
tcatgcctgattatgttactca

SEQ ID NO: 8472036 - DNA, 22 bp, Homo sapiens
tcatgccatccacatctgtttc

SEQ ID NO: 8472037 - DNA, 22 bp, Homo sapiens
tcatgctcatcattagagtgac

SEQ ID NO: 8472038 - DNA, 21 bp, Homo sapiens
tcagtgcaattctatggggaa

SEQ ID NO: 8472039 - DNA, 22 bp, Homo sapiens
tcagtgcaatcaaggtatgttt

SEQ ID NO: 8472040 - DNA, 23 bp, Homo sapiens
tcagtgcaaaaataggattttgg

SEQ ID NO: 8472041 - DNA, 22 bp, Homo sapiens
tcagtgcaaaaaatgggctaga

SEQ ID NO: 8472042 - DNA, 21 bp, Homo sapiens
tcagtgcaattctatggggaa

SEQ ID NO: 8472043 - DNA, 22 bp, Homo sapiens
tcagtgcacaatgacggtggct

SEQ ID NO: 8472044 - DNA, 22 bp, Homo sapiens
tcagtgcacagagatttttgtt

SEQ ID NO: 8472045 - DNA, 22 bp, Homo sapiens
tcagtgcacccaattctctcca

SEQ ID NO: 8472046 - DNA, 22 bp, Homo sapiens
tcagtgcagggtgggagagaga

SEQ ID NO: 8472047 - DNA, 22 bp, Homo sapiens
tcagtgcaggaatttccttaga

SEQ ID NO: 8472048 - DNA, 22 bp, Homo sapiens
tcagtgcaggaatctctagcca

SEQ ID NO: 8472049 - DNA, 22 bp, Homo sapiens
tcagtgcagcggcagcagctct

SEQ ID NO: 8472050 - DNA, 20 bp, Homo sapiens
tcagtgcagattgtccaagt

SEQ ID NO: 8472051 - DNA, 22 bp, Homo sapiens
tcagtgcagactgtaagttgga

SEQ ID NO: 8472052 - DNA, 22 bp, Homo sapiens
tcagtgcagaatagtgatgcat

SEQ ID NO: 8472053 - DNA, 21 bp, Homo sapiens
tcagtgacaggtgctgacctc

SEQ ID NO: 8472054 - DNA, 22 bp, Homo sapiens
tcagtctttgcttatgacaata

SEQ ID NO: 8472055 - DNA, 22 bp, Homo sapiens
tcagtctttgcttatgacaata

SEQ ID NO: 8472056 - DNA, 22 bp, Homo sapiens
tcagtcttttgccctgaggagt

SEQ ID NO: 8472057 - DNA, 22 bp, Homo sapiens
tcagtctttttctcttaagtac

SEQ ID NO: 8472058 - DNA, 22 bp, Homo sapiens
tcagtctttttctcttaagtac

SEQ ID NO: 8472059 - DNA, 22 bp, Homo sapiens
tcagtctttccctccctcagtt

SEQ ID NO: 8472060 - DNA, 22 bp, Homo sapiens
tcagtctttcgaattcagccag

SEQ ID NO: 8472061 - DNA, 22 bp, Homo sapiens
tcagtctttgcttatgacaata

SEQ ID NO: 8472062 - DNA, 22 bp, Homo sapiens
tcagtctttaaaagctcaggaa

SEQ ID NO: 8472063 - DNA, 23 bp, Homo sapiens
tcagtcttggcttctgattttcc

SEQ ID NO: 8472064 - DNA, 22 bp, Homo sapiens
tcagtgcagtagaactttagtt

SEQ ID NO: 8472065 - DNA, 22 bp, Homo sapiens
tcagtggtcttggctgattgtt

SEQ ID NO: 8472066 - DNA, 22 bp, Homo sapiens
tcagtgcagggtgggagagaga

SEQ ID NO: 8472067 - DNA, 18 bp, Homo sapiens
tcagggaatcttggcctt

SEQ ID NO: 8472068 - DNA, 22 bp, Homo sapiens
tcagggaatcagactctgcagc

SEQ ID NO: 8472069 - DNA, 22 bp, Homo sapiens
tcagggaactacttctccctat

SEQ ID NO: 8472070 - DNA, 22 bp, Homo sapiens
tcagggaagagagatctcctag

SEQ ID NO: 8472071 - DNA, 23 bp, Homo sapiens
tcagtcttccctgtcagtaatag

SEQ ID NO: 8472072 - DNA, 22 bp, Homo sapiens
tcagtcttctaaagggatgcaa

SEQ ID NO: 8472073 - DNA, 22 bp, Homo sapiens
tcagtcttctagcaaatccagg

SEQ ID NO: 8472074 - DNA, 22 bp, Homo sapiens
tcagtcttctagcaaatccagg

SEQ ID NO: 8472075 - DNA, 22 bp, Homo sapiens
tcagtcttgaacagccccctgt

SEQ ID NO: 8472076 - DNA, 22 bp, Homo sapiens
tcagtcttcaaatctgagtcgt

SEQ ID NO: 8472077 - DNA, 22 bp, Homo sapiens
tcagtcttccctccagtgcaac

SEQ ID NO: 8472078 - DNA, 20 bp, Homo sapiens
tcaggatgtgctgagtgaag

SEQ ID NO: 8472079 - DNA, 21 bp, Homo sapiens
tcaggcagtgcaaatacatgg

SEQ ID NO: 8472080 - DNA, 22 bp, Homo sapiens
tcaggcagtctgactccggagg

SEQ ID NO: 8472081 - DNA, 22 bp, Homo sapiens
tcaggatccatagactcccaaa

SEQ ID NO: 8472082 - DNA, 22 bp, Homo sapiens
tcaggatcaggggcctttcctt

SEQ ID NO: 8472083 - DNA, 22 bp, Homo sapiens
tcaggagtgataccatttgtca

SEQ ID NO: 8472084 - DNA, 22 bp, Homo sapiens
tcaggccaggagatcagattga

SEQ ID NO: 8472085 - DNA, 22 bp, Homo sapiens
tcaggccagcaccatccctatc

SEQ ID NO: 8472086 - DNA, 22 bp, Homo sapiens
tcaggcctgagaaaaatccttt

SEQ ID NO: 8472087 - DNA, 22 bp, Homo sapiens
tcaggcctgcaaatgaatggta

SEQ ID NO: 8472088 - DNA, 22 bp, Homo sapiens
tcaggcctgccctgaaagcaca

SEQ ID NO: 8472089 - DNA, 22 bp, Homo sapiens
tcaggcctgcagtgccaaccca

SEQ ID NO: 8472090 - DNA, 22 bp, Homo sapiens
tcaggcctgcaggcttcctgga

SEQ ID NO: 8472091 - DNA, 22 bp, Homo sapiens
tcaggcctgcaaggagagtccc

SEQ ID NO: 8472092 - DNA, 22 bp, Homo sapiens
tcaggccaaggtagacatgact

SEQ ID NO: 8472093 - DNA, 22 bp, Homo sapiens
tcaggccacggctcactgagac

SEQ ID NO: 8472094 - DNA, 22 bp, Homo sapiens
tcaggccaaggtagacatgact

SEQ ID NO: 8472095 - DNA, 22 bp, Homo sapiens
tcaggccaaagaaacagcatga

SEQ ID NO: 8472096 - DNA, 19 bp, Homo sapiens
tcaggcagttattcacaaa

SEQ ID NO: 8472097 - DNA, 22 bp, Homo sapiens
tcaggcagtggtaaatgagtta

SEQ ID NO: 8472098 - DNA, 20 bp, Homo sapiens
tcaggcagtggggaaaggca

SEQ ID NO: 8472099 - DNA, 20 bp, Homo sapiens
tcaggcagtggggaaaggca

SEQ ID NO: 8472100 - DNA, 22 bp, Homo sapiens
tcaggctgctggccagcaggct

SEQ ID NO: 8472101 - DNA, 22 bp, Homo sapiens
tcaggctgctggccagcaggct

SEQ ID NO: 8472102 - DNA, 22 bp, Homo sapiens
tcaggctgataggaggaactga

SEQ ID NO: 8472103 - DNA, 22 bp, Homo sapiens
tcaggctgataggaggaactga

SEQ ID NO: 8472104 - DNA, 21 bp, Homo sapiens
tcaggctgatgtcgatgttag

SEQ ID NO: 8472105 - DNA, 21 bp, Homo sapiens
tcaggctgatgtcgatgttag

SEQ ID NO: 8472106 - DNA, 22 bp, Homo sapiens
tcaggcctgtgctggaggagat

SEQ ID NO: 8472107 - DNA, 22 bp, Homo sapiens
tcaggcctggagaaaggaatga

SEQ ID NO: 8472108 - DNA, 22 bp, Homo sapiens
tcaggctgctgtactgtgaatg

SEQ ID NO: 8472109 - DNA, 22 bp, Homo sapiens
tcaggctgctgtactgtgaatg

SEQ ID NO: 8472110 - DNA, 22 bp, Homo sapiens
tcaggctgctttcatgcttaga

SEQ ID NO: 8472111 - DNA, 22 bp, Homo sapiens
tcaggctgctttcatgcttaga

SEQ ID NO: 8472112 - DNA, 18 bp, Homo sapiens
tcaggctggaagtttgcc

SEQ ID NO: 8472113 - DNA, 18 bp, Homo sapiens
tcaggctggaagtttgcc

SEQ ID NO: 8472114 - DNA, 22 bp, Homo sapiens
tcaggctggagtgcagtggcgc

SEQ ID NO: 8472115 - DNA, 22 bp, Homo sapiens
tcaggctggaatgcagtggggc

SEQ ID NO: 8472116 - DNA, 22 bp, Homo sapiens
tcaggctggaatgcagtggggc

SEQ ID NO: 8472117 - DNA, 22 bp, Homo sapiens
tcaggctggagtgcagtggcgc

SEQ ID NO: 8472118 - DNA, 22 bp, Homo sapiens
tcaggctgggagacaatcactg

SEQ ID NO: 8472119 - DNA, 18 bp, Homo sapiens
tcaggctgggcctccttc

SEQ ID NO: 8472120 - DNA, 18 bp, Homo sapiens
tcaggctgggcctccttc

SEQ ID NO: 8472121 - DNA, 18 bp, Homo sapiens
tcaggctgggcctccttc

SEQ ID NO: 8472122 - DNA, 22 bp, Homo sapiens
tcaggctgggagacaatcactg

SEQ ID NO: 8472123 - DNA, 22 bp, Homo sapiens
tcaggctttttctcaacctctt

SEQ ID NO: 8472124 - DNA, 22 bp, Homo sapiens
tcaggctggggtgctaaggtgt

SEQ ID NO: 8472125 - DNA, 22 bp, Homo sapiens
tcaggctggggtgctaaggtgt

SEQ ID NO: 8472126 - DNA, 22 bp, Homo sapiens
tcaggctgggctcctctcccca

SEQ ID NO: 8472127 - DNA, 22 bp, Homo sapiens
tcaggctgggctcctctcccca

SEQ ID NO: 8472128 - DNA, 22 bp, Homo sapiens
tcaggaagggctcagtctgtgc

SEQ ID NO: 8472129 - DNA, 22 bp, Homo sapiens
tcaggaagggctcagtctgtgc

SEQ ID NO: 8472130 - DNA, 22 bp, Homo sapiens
tcaggaggtgtaacgaatacag

SEQ ID NO: 8472131 - DNA, 22 bp, Homo sapiens
tcaggaaggcacttggtgtgtt

SEQ ID NO: 8472132 - DNA, 22 bp, Homo sapiens
tcaggaaggcacttggtgtgtt

SEQ ID NO: 8472133 - DNA, 22 bp, Homo sapiens
tcaggaaggcttcacacgagtg

SEQ ID NO: 8472134 - DNA, 22 bp, Homo sapiens
tcaggaaggcgccccatcagga

SEQ ID NO: 8472135 - DNA, 22 bp, Homo sapiens
tcaggaagctgaattacaaaaa

SEQ ID NO: 8472136 - DNA, 22 bp, Homo sapiens
tcaggaagctgctctgggtggt

SEQ ID NO: 8472137 - DNA, 22 bp, Homo sapiens
tcaggaagctgctctgggtggt

SEQ ID NO: 8472138 - DNA, 22 bp, Homo sapiens
tcaggaaggagctggcctgcca

SEQ ID NO: 8472139 - DNA, 22 bp, Homo sapiens
tcaggaaggcaaattgcatgat

SEQ ID NO: 8472140 - DNA, 22 bp, Homo sapiens
tcaggaaggagctggcctgcca

SEQ ID NO: 8472141 - DNA, 22 bp, Homo sapiens
tcaggaagctactgccagcagc

SEQ ID NO: 8472142 - DNA, 22 bp, Homo sapiens
tcaggaagctcttgctgattct

SEQ ID NO: 8472143 - DNA, 22 bp, Homo sapiens
tcaggaagccggttaaatagat

SEQ ID NO: 8472144 - DNA, 22 bp, Homo sapiens
tcaggaagccactccacagaga

SEQ ID NO: 8472145 - DNA, 21 bp, Homo sapiens
tcaggaagagccagttcatgc

SEQ ID NO: 8472146 - DNA, 21 bp, Homo sapiens
tcaggaagagcttctcccact

SEQ ID NO: 8472147 - DNA, 21 bp, Homo sapiens
tcaggaagagcttctcccact

SEQ ID NO: 8472148 - DNA, 22 bp, Homo sapiens
tcaggaagattagtttcctacc

SEQ ID NO: 8472149 - DNA, 22 bp, Homo sapiens
tcaggaagattagtttcctacc

SEQ ID NO: 8472150 - DNA, 22 bp, Homo sapiens
tcaggaagcatcctgaggtgtc

SEQ ID NO: 8472151 - DNA, 22 bp, Homo sapiens
tcaggaagacaatctttggctc

SEQ ID NO: 8472152 - DNA, 22 bp, Homo sapiens
tcaggaagacaatctttggctc

SEQ ID NO: 8472153 - DNA, 22 bp, Homo sapiens
tcaggaagaagacggggcagga

SEQ ID NO: 8472154 - DNA, 22 bp, Homo sapiens
tcaggaagaaattctgtatctt

SEQ ID NO: 8472155 - DNA, 22 bp, Homo sapiens
tcaggaagaaagaagggagtgt

SEQ ID NO: 8472156 - DNA, 22 bp, Homo sapiens
tcagctctgcactccactgtgg

SEQ ID NO: 8472157 - DNA, 22 bp, Homo sapiens
tcagctctgcaaggtcacctcc

SEQ ID NO: 8472158 - DNA, 22 bp, Homo sapiens
tcaggaacatttaaccacaggg

SEQ ID NO: 8472159 - DNA, 22 bp, Homo sapiens
tcaggaaccctggtctcctgct

SEQ ID NO: 8472160 - DNA, 22 bp, Homo sapiens
tcagcactttgaagcagaagga

SEQ ID NO: 8472161 - DNA, 22 bp, Homo sapiens
tcagcactttttaaagcagcat

SEQ ID NO: 8472162 - DNA, 22 bp, Homo sapiens
tcagcagaaaggcactagatga

SEQ ID NO: 8472163 - DNA, 21 bp, Homo sapiens
tcagcagcttttgcagtccct

SEQ ID NO: 8472164 - DNA, 22 bp, Homo sapiens
tcagcaggcacaccaaaaactg

SEQ ID NO: 8472165 - DNA, 22 bp, Homo sapiens
tcagcagaagtatagaggccat

SEQ ID NO: 8472166 - DNA, 22 bp, Homo sapiens
tcagcagaagtatagaggccat

SEQ ID NO: 8472167 - DNA, 22 bp, Homo sapiens
tcagcagaagtatagaggccat

SEQ ID NO: 8472168 - DNA, 21 bp, Homo sapiens
tcagcaggcaccagaaggctg

SEQ ID NO: 8472169 - DNA, 21 bp, Homo sapiens
tcagcaggcaccagaaggctg

SEQ ID NO: 8472170 - DNA, 22 bp, Homo sapiens
tcagcaggcacggacaggctgc

SEQ ID NO: 8472171 - DNA, 22 bp, Homo sapiens
tcagcaggcaccggaagtgttt

SEQ ID NO: 8472172 - DNA, 21 bp, Homo sapiens
tcagcaggcaccagaaggctg

SEQ ID NO: 8472173 - DNA, 22 bp, Homo sapiens
tcagcctgctccaagtgctgcc

SEQ ID NO: 8472174 - DNA, 22 bp, Homo sapiens
tcagcaggcagaaatctgcaga

SEQ ID NO: 8472175 - DNA, 22 bp, Homo sapiens
tcagcctggtgattcctctgtc

SEQ ID NO: 8472176 - DNA, 22 bp, Homo sapiens
tcagcctggtgattcctctgtc

SEQ ID NO: 8472177 - DNA, 18 bp, Homo sapiens
tcagcctgttgtctgcct

SEQ ID NO: 8472178 - DNA, 22 bp, Homo sapiens
tcagctccagagttgcacagtg

SEQ ID NO: 8472179 - DNA, 22 bp, Homo sapiens
tcagctccacagctcctctgcc

SEQ ID NO: 8472180 - DNA, 22 bp, Homo sapiens
tcagctcctcagagcctcagtt

SEQ ID NO: 8472181 - DNA, 22 bp, Homo sapiens
tcagctcctcatgcaggggata

SEQ ID NO: 8472182 - DNA, 22 bp, Homo sapiens
tcagctctacacacacctgtgt

SEQ ID NO: 8472183 - DNA, 22 bp, Homo sapiens
tcacaaaagcttttgaatttgg

SEQ ID NO: 8472184 - DNA, 22 bp, Homo sapiens
tcacaaaagcttttgaatttgg

SEQ ID NO: 8472185 - DNA, 22 bp, Homo sapiens
tcacaaaagcttttgaatttgg

SEQ ID NO: 8472186 - DNA, 22 bp, Homo sapiens
tcacaaaagcttttgaatttgg

SEQ ID NO: 8472187 - DNA, 22 bp, Homo sapiens
tcacaaaagcttttgaatttgg

SEQ ID NO: 8472188 - DNA, 22 bp, Homo sapiens
tcacaaagctttgataagcaga

SEQ ID NO: 8472189 - DNA, 22 bp, Homo sapiens
tcacaaaaggccatgtggcttc

SEQ ID NO: 8472190 - DNA, 21 bp, Homo sapiens
tcacaagtactcatctctgcc

SEQ ID NO: 8472191 - DNA, 22 bp, Homo sapiens
tcacaaagggagggatagctgg

SEQ ID NO: 8472192 - DNA, 22 bp, Homo sapiens
tcacagaacaatgtttagttct

SEQ ID NO: 8472193 - DNA, 22 bp, Homo sapiens
tcacagaacaagcctggtggag

SEQ ID NO: 8472194 - DNA, 22 bp, Homo sapiens
tcacagaaatctgttttttcta

SEQ ID NO: 8472195 - DNA, 22 bp, Homo sapiens
tcacagaaatctgttttttcta

SEQ ID NO: 8472196 - DNA, 22 bp, Homo sapiens
tcacagaaataagatagttatt

SEQ ID NO: 8472197 - DNA, 22 bp, Homo sapiens
tcacagaaacagaatggcacag

SEQ ID NO: 8472198 - DNA, 22 bp, Homo sapiens
tcacagaaagctgtgtcctgac

SEQ ID NO: 8472199 - DNA, 22 bp, Homo sapiens
tcacagaagagatattgacaga

SEQ ID NO: 8472200 - DNA, 22 bp, Homo sapiens
tcacagaagaagtagattgcat

SEQ ID NO: 8472201 - DNA, 22 bp, Homo sapiens
tcacagaacaatgtttagttct

SEQ ID NO: 8472202 - DNA, 22 bp, Homo sapiens
tcacagaacacaaatgccactt

SEQ ID NO: 8472203 - DNA, 20 bp, Homo sapiens
tcacaatatgagctcataca

SEQ ID NO: 8472204 - DNA, 22 bp, Homo sapiens
tcacaatgcaagtgttcagtgg

SEQ ID NO: 8472205 - DNA, 22 bp, Homo sapiens
tcacacatgagtaaatacaggg

SEQ ID NO: 8472206 - DNA, 22 bp, Homo sapiens
tcacacatgctaagccagagat

SEQ ID NO: 8472207 - DNA, 20 bp, Homo sapiens
tcacacatggtaagctatga

SEQ ID NO: 8472208 - DNA, 22 bp, Homo sapiens
tcacagaaaagctgagcatcag

SEQ ID NO: 8472209 - DNA, 20 bp, Homo sapiens
tcacagaaacaaatagagaa

SEQ ID NO: 8472210 - DNA, 22 bp, Homo sapiens
tcacagaaaagctgagcatcag

SEQ ID NO: 8472211 - DNA, 22 bp, Homo sapiens
tcacagaaaagtggagagccta

SEQ ID NO: 8472212 - DNA, 22 bp, Homo sapiens
tcacagaaggaccttgtttcat

SEQ ID NO: 8472213 - DNA, 22 bp, Homo sapiens
tcacagaaggaccttgtttcat

SEQ ID NO: 8472214 - DNA, 22 bp, Homo sapiens
tcacagaaggagggaagctagt

SEQ ID NO: 8472215 - DNA, 22 bp, Homo sapiens
tcacagaagccctcgcaaacta

SEQ ID NO: 8472216 - DNA, 22 bp, Homo sapiens
tcacagaagcttgaagattttc

SEQ ID NO: 8472217 - DNA, 22 bp, Homo sapiens
tcacagaagagcattaagatga

SEQ ID NO: 8472218 - DNA, 22 bp, Homo sapiens
tcacagaagatgctggatgttg

SEQ ID NO: 8472219 - DNA, 22 bp, Homo sapiens
tcacagaagcatcatacccgga

SEQ ID NO: 8472220 - DNA, 22 bp, Homo sapiens
tcacagaagttgaatttgcatg

SEQ ID NO: 8472221 - DNA, 22 bp, Homo sapiens
tcacagaagtgtagtgaggaaa

SEQ ID NO: 8472222 - DNA, 22 bp, Homo sapiens
tcacagaagtgtgtttcaggag

SEQ ID NO: 8472223 - DNA, 22 bp, Homo sapiens
tcacagaagggaaagatgccaa

SEQ ID NO: 8472224 - DNA, 22 bp, Homo sapiens
tcacagaaggtggccatagctg

SEQ ID NO: 8472225 - DNA, 22 bp, Homo sapiens
tcacagaaggcatcacagaaga

SEQ ID NO: 8472226 - DNA, 22 bp, Homo sapiens
tcacagaataaatgtactggcc

SEQ ID NO: 8472227 - DNA, 22 bp, Homo sapiens
tcacagctccagactgcaactc

SEQ ID NO: 8472228 - DNA, 22 bp, Homo sapiens
tcacaggcaaagaagattggtg

SEQ ID NO: 8472229 - DNA, 19 bp, Homo sapiens
tcacaggcatctccccaga

SEQ ID NO: 8472230 - DNA, 20 bp, Homo sapiens
tcacagctggctatgacagg

SEQ ID NO: 8472231 - DNA, 22 bp, Homo sapiens
tcacaggagtcataattacagt

SEQ ID NO: 8472232 - DNA, 22 bp, Homo sapiens
tcacaggctggtctccgaggac

SEQ ID NO: 8472233 - DNA, 22 bp, Homo sapiens
tcacaggctctagggattaaga

SEQ ID NO: 8472234 - DNA, 22 bp, Homo sapiens
tcacaggctctccaccatgagg

SEQ ID NO: 8472235 - DNA, 22 bp, Homo sapiens
tcacaggcccaaaccacgctta

SEQ ID NO: 8472236 - DNA, 22 bp, Homo sapiens
tcacaggctaaatttatgcagg

SEQ ID NO: 8472237 - DNA, 22 bp, Homo sapiens
tcacaggcctggggcagagggc

SEQ ID NO: 8472238 - DNA, 22 bp, Homo sapiens
tcacaggctccagggcctggat

SEQ ID NO: 8472239 - DNA, 21 bp, Homo sapiens
tcacaggctcagggagagagt

SEQ ID NO: 8472240 - DNA, 22 bp, Homo sapiens
tcacagggtttggaagcctcct

SEQ ID NO: 8472241 - DNA, 23 bp, Homo sapiens
tcacaggggccagcgctctgtgg

SEQ ID NO: 8472242 - DNA, 22 bp, Homo sapiens
tcacagtaactttgttgctttt

SEQ ID NO: 8472243 - DNA, 18 bp, Homo sapiens
tcaagacatcatgaaata

SEQ ID NO: 8472244 - DNA, 22 bp, Homo sapiens
tcaagagcatgtatctccctaa

SEQ ID NO: 8472245 - DNA, 22 bp, Homo sapiens
tcaagagacaggacgtgtttca

SEQ ID NO: 8472246 - DNA, 22 bp, Homo sapiens
tcaagacagtgtgatactggcc

SEQ ID NO: 8472247 - DNA, 22 bp, Homo sapiens
tcaagacatattaaatgtgcga

SEQ ID NO: 8472248 - DNA, 22 bp, Homo sapiens
tcaagacatcactgtgcatttt

SEQ ID NO: 8472249 - DNA, 22 bp, Homo sapiens
tcaagacagggtttaaggttga

SEQ ID NO: 8472250 - DNA, 21 bp, Homo sapiens
tcaagacagcatatttaagaa

SEQ ID NO: 8472251 - DNA, 22 bp, Homo sapiens
tcaagacagatgggtaacttgg

SEQ ID NO: 8472252 - DNA, 22 bp, Homo sapiens
tcaaggaatttagtttagtaaa

SEQ ID NO: 8472253 - DNA, 22 bp, Homo sapiens
tcaaggaaggtctgttgctcca

SEQ ID NO: 8472254 - DNA, 22 bp, Homo sapiens
tcaaggaatgactatatgagga

SEQ ID NO: 8472255 - DNA, 22 bp, Homo sapiens
tcaagctttctgtctcttatgg

SEQ ID NO: 8472256 - DNA, 22 bp, Homo sapiens
tcaaggaagatagctattatga

SEQ ID NO: 8472257 - DNA, 22 bp, Homo sapiens
tcaagatgaaagatgtagccat

SEQ ID NO: 8472258 - DNA, 22 bp, Homo sapiens
tatttctgattgctcatgaggc

SEQ ID NO: 8472259 - DNA, 20 bp, Homo sapiens
tatttctgggcaaccattta

SEQ ID NO: 8472260 - DNA, 22 bp, Homo sapiens
tatttctgtcagccagatatgg

SEQ ID NO: 8472261 - DNA, 22 bp, Homo sapiens
tatttcttcgggattcaagcta

SEQ ID NO: 8472262 - DNA, 22 bp, Homo sapiens
tatttcttcgggattcaagcta

SEQ ID NO: 8472263 - DNA, 22 bp, Homo sapiens
tatttcttgagactcgtcttcc

SEQ ID NO: 8472264 - DNA, 22 bp, Homo sapiens
tatttcttgagactcgtcttcc

SEQ ID NO: 8472265 - DNA, 22 bp, Homo sapiens
tatttcttgagtggtcagtttc

SEQ ID NO: 8472266 - DNA, 22 bp, Homo sapiens
tatttcttgagtggtcagtttc

SEQ ID NO: 8472267 - DNA, 22 bp, Homo sapiens
tcaagaaggagttatttattca

SEQ ID NO: 8472268 - DNA, 22 bp, Homo sapiens
tcaagaatttggataagaaatg

SEQ ID NO: 8472269 - DNA, 20 bp, Homo sapiens
tcaagacagacatggagttt

SEQ ID NO: 8472270 - DNA, 22 bp, Homo sapiens
tcaaggagcccacagtctaatg

SEQ ID NO: 8472271 - DNA, 22 bp, Homo sapiens
tcaaggcaaagtaaatattcaa

SEQ ID NO: 8472272 - DNA, 22 bp, Homo sapiens
tcaaggcacttcatgtctcagt

SEQ ID NO: 8472273 - DNA, 22 bp, Homo sapiens
tcaaggctattaattctgtgag

SEQ ID NO: 8472274 - DNA, 22 bp, Homo sapiens
tcaagggaggagacacagccct

SEQ ID NO: 8472275 - DNA, 22 bp, Homo sapiens
tcaagtcactggcagggatgct

SEQ ID NO: 8472276 - DNA, 22 bp, Homo sapiens
tcaagtatttatttctgctggc

SEQ ID NO: 8472277 - DNA, 22 bp, Homo sapiens
tcaataactttgtttagcattg

SEQ ID NO: 8472278 - DNA, 20 bp, Homo sapiens
tcaagttttgcttgacaaga

SEQ ID NO: 8472279 - DNA, 22 bp, Homo sapiens
tcaataatggcaggataaattt

SEQ ID NO: 8472280 - DNA, 22 bp, Homo sapiens
tcaataatggcaggataaattt

SEQ ID NO: 8472281 - DNA, 22 bp, Homo sapiens
tcaataatggcaggataaattt

SEQ ID NO: 8472282 - DNA, 21 bp, Homo sapiens
tcaatacaggtgcatgtgtct

SEQ ID NO: 8472283 - DNA, 22 bp, Homo sapiens
tcaatttatgtggctattcatt

SEQ ID NO: 8472284 - DNA, 22 bp, Homo sapiens
tcaatttatgtggctattcatt

SEQ ID NO: 8472285 - DNA, 22 bp, Homo sapiens
tcaatttcttggtttgataata

SEQ ID NO: 8472286 - DNA, 22 bp, Homo sapiens
tcaatttcattctattagttaa

SEQ ID NO: 8472287 - DNA, 22 bp, Homo sapiens
tcagaaaataactgttagtttg

SEQ ID NO: 8472288 - DNA, 22 bp, Homo sapiens
tcagacagggagtcagaaaata

SEQ ID NO: 8472289 - DNA, 22 bp, Homo sapiens
tcagaaaaggtagctgtgacaa

SEQ ID NO: 8472290 - DNA, 22 bp, Homo sapiens
tcagaaaagagaaaatcttata

SEQ ID NO: 8472291 - DNA, 22 bp, Homo sapiens
tcagaaaagagaaaatcttata

SEQ ID NO: 8472292 - DNA, 22 bp, Homo sapiens
tcagaaaagaccacattattct

SEQ ID NO: 8472293 - DNA, 22 bp, Homo sapiens
tcagaaaagaccacattattct

SEQ ID NO: 8472294 - DNA, 22 bp, Homo sapiens
tcagaaaagagaaaatcttata

SEQ ID NO: 8472295 - DNA, 22 bp, Homo sapiens
tcagaaaagaccacattattct

SEQ ID NO: 8472296 - DNA, 22 bp, Homo sapiens
tcagacccaggtgccaagctgt

SEQ ID NO: 8472297 - DNA, 22 bp, Homo sapiens
tcagaccccagaatgaagccag

SEQ ID NO: 8472298 - DNA, 20 bp, Homo sapiens
tcagacccagattagcaggt

SEQ ID NO: 8472299 - DNA, 20 bp, Homo sapiens
tcagacccggggaagggagc

SEQ ID NO: 8472300 - DNA, 20 bp, Homo sapiens
tcagaccctacattcctcag

SEQ ID NO: 8472301 - DNA, 22 bp, Homo sapiens
tcagaccctgcggtgtttggat

SEQ ID NO: 8472302 - DNA, 17 bp, Homo sapiens
tcagaccctgtgtcagg

SEQ ID NO: 8472303 - DNA, 22 bp, Homo sapiens
tcagagaactccacaccttagg

SEQ ID NO: 8472304 - DNA, 22 bp, Homo sapiens
tcagacatatttttaacaaagt

SEQ ID NO: 8472305 - DNA, 22 bp, Homo sapiens
tcagagaagctgccaggcgagc

SEQ ID NO: 8472306 - DNA, 22 bp, Homo sapiens
tcagagaagctgccaggcgagc

SEQ ID NO: 8472307 - DNA, 20 bp, Homo sapiens
tcagagaaggagctttcctg

SEQ ID NO: 8472308 - DNA, 20 bp, Homo sapiens
tcagagaaggagctttcctg

SEQ ID NO: 8472309 - DNA, 23 bp, Homo sapiens
tcagagaggccccctgcagagat

SEQ ID NO: 8472310 - DNA, 22 bp, Homo sapiens
tcagagcactggtgctaccttg

SEQ ID NO: 8472311 - DNA, 22 bp, Homo sapiens
tcagagccaatcatggtgcatt

SEQ ID NO: 8472312 - DNA, 22 bp, Homo sapiens
tcagagcattcgggtgacaaat

SEQ ID NO: 8472313 - DNA, 22 bp, Homo sapiens
tcagagcacttggctcatggca

SEQ ID NO: 8472314 - DNA, 22 bp, Homo sapiens
tcagagcatgtgggctgcagtt

SEQ ID NO: 8472315 - DNA, 22 bp, Homo sapiens
tcagagctcatgagcagagcca

SEQ ID NO: 8472316 - DNA, 22 bp, Homo sapiens
tcagagctaaggggagagcaaa

SEQ ID NO: 8472317 - DNA, 22 bp, Homo sapiens
tcagagctaaggggagagcaaa

SEQ ID NO: 8472318 - DNA, 22 bp, Homo sapiens
tcagagctcatgagcagagcca

SEQ ID NO: 8472319 - DNA, 20 bp, Homo sapiens
tcagagctgcaggagagaaa

SEQ ID NO: 8472320 - DNA, 22 bp, Homo sapiens
tcagagccctgctcctccccaa

SEQ ID NO: 8472321 - DNA, 22 bp, Homo sapiens
tcagagcccctccgctgtccca

SEQ ID NO: 8472322 - DNA, 22 bp, Homo sapiens
tcagagcccctccgctgtccca

SEQ ID NO: 8472323 - DNA, 20 bp, Homo sapiens
tcagagctgcaggagagaaa

SEQ ID NO: 8472324 - DNA, 22 bp, Homo sapiens
tcagagctgggtgcttcttcct

SEQ ID NO: 8472325 - DNA, 22 bp, Homo sapiens
tcagagctcctaagggctgatt

SEQ ID NO: 8472326 - DNA, 20 bp, Homo sapiens
tcagagctgcaggagagaaa

SEQ ID NO: 8472327 - DNA, 22 bp, Homo sapiens
tcagagctgcccatgcaagggg

SEQ ID NO: 8472328 - DNA, 22 bp, Homo sapiens
tcagagctgtgcttcaggaaag

SEQ ID NO: 8472329 - DNA, 22 bp, Homo sapiens
tcagagcttatctcttgctgga

SEQ ID NO: 8472330 - DNA, 22 bp, Homo sapiens
tcagagcttcacctgttacatt

SEQ ID NO: 8472331 - DNA, 22 bp, Homo sapiens
tcagagcttcacctgttacatt

SEQ ID NO: 8472332 - DNA, 22 bp, Homo sapiens
tcagcactgatgtttcagaaga

SEQ ID NO: 8472333 - DNA, 22 bp, Homo sapiens
tcagcacttggatttcagagat

SEQ ID NO: 8472334 - DNA, 22 bp, Homo sapiens
tcagcacaggtcttgcaaaaca

SEQ ID NO: 8472335 - DNA, 22 bp, Homo sapiens
tcagaggaactggactaaagcc

SEQ ID NO: 8472336 - DNA, 22 bp, Homo sapiens
tcagaggaactggactaaagcc

SEQ ID NO: 8472337 - DNA, 22 bp, Homo sapiens
tcagaggaagcatcaagttctc

SEQ ID NO: 8472338 - DNA, 22 bp, Homo sapiens
tcagaggaaaggtcagatggct

SEQ ID NO: 8472339 - DNA, 22 bp, Homo sapiens
tcagaggaacactgtttcatgc

SEQ ID NO: 8472340 - DNA, 22 bp, Homo sapiens
tcagaggaaagggaacatagtc

SEQ ID NO: 8472341 - DNA, 22 bp, Homo sapiens
tcagaggaaagggaacatagtc

SEQ ID NO: 8472342 - DNA, 22 bp, Homo sapiens
tcagagctttggagaccaggaa

SEQ ID NO: 8472343 - DNA, 22 bp, Homo sapiens
tcagaggaaacaatctttagta

SEQ ID NO: 8472344 - DNA, 22 bp, Homo sapiens
tcactttcctcatcacgactag

SEQ ID NO: 8472345 - DNA, 22 bp, Homo sapiens
tcacttgactttccagtcttgg

SEQ ID NO: 8472346 - DNA, 23 bp, Homo sapiens
tcacttgaagctagaatctgccc

SEQ ID NO: 8472347 - DNA, 19 bp, Homo sapiens
tcacttctgttagcatgga

SEQ ID NO: 8472348 - DNA, 22 bp, Homo sapiens
tcacttcttcccttgcacatat

SEQ ID NO: 8472349 - DNA, 22 bp, Homo sapiens
tcactctgtggcccaggcagtg

SEQ ID NO: 8472350 - DNA, 22 bp, Homo sapiens
tcactctgttagaggaaagtgc

SEQ ID NO: 8472351 - DNA, 22 bp, Homo sapiens
tcactctgggccctactgggct

SEQ ID NO: 8472352 - DNA, 22 bp, Homo sapiens
tcactctgttttactcactgtt

SEQ ID NO: 8472353 - DNA, 22 bp, Homo sapiens
tcaccaggattgggctgtaggc

SEQ ID NO: 8472354 - DNA, 22 bp, Homo sapiens
tcaccagctctgcctcgccagt

SEQ ID NO: 8472355 - DNA, 22 bp, Homo sapiens
tcaccaggattcctatcagtag

SEQ ID NO: 8472356 - DNA, 22 bp, Homo sapiens
tcacccagcgggcgcacactcg

SEQ ID NO: 8472357 - DNA, 22 bp, Homo sapiens
tcactacaacctccgcctcctg

SEQ ID NO: 8472358 - DNA, 22 bp, Homo sapiens
tcactacaacctccgcctcctg

SEQ ID NO: 8472359 - DNA, 22 bp, Homo sapiens
tcactctgctgcccgagggctg

SEQ ID NO: 8472360 - DNA, 22 bp, Homo sapiens
tcactctgcaggaaggagcagc

SEQ ID NO: 8472361 - DNA, 22 bp, Homo sapiens
tcactctgagaggtcactggaa

SEQ ID NO: 8472362 - DNA, 20 bp, Homo sapiens
tcactctgatgctagggtgg

SEQ ID NO: 8472363 - DNA, 22 bp, Homo sapiens
tcactctgaatggtactgagga

SEQ ID NO: 8472364 - DNA, 21 bp, Homo sapiens
tcactacaatgttctcttata

SEQ ID NO: 8472365 - DNA, 22 bp, Homo sapiens
tcactagcattgttgaaggact

SEQ ID NO: 8472366 - DNA, 22 bp, Homo sapiens
tcactagcattgttgaaggact

SEQ ID NO: 8472367 - DNA, 22 bp, Homo sapiens
tcccagtctgtgtcctttacag

SEQ ID NO: 8472368 - DNA, 20 bp, Homo sapiens
tcccagtcagccagagtgag

SEQ ID NO: 8472369 - DNA, 22 bp, Homo sapiens
tcccagtgctgctaaagaggta

SEQ ID NO: 8472370 - DNA, 22 bp, Homo sapiens
tcccagtgggaagcagcacgct

SEQ ID NO: 8472371 - DNA, 22 bp, Homo sapiens
tcccagtggcttcataaggcag

SEQ ID NO: 8472372 - DNA, 19 bp, Homo sapiens
tcccagtggggagaggtgt

SEQ ID NO: 8472373 - DNA, 22 bp, Homo sapiens
tcccagtgtggcaggccatgga

SEQ ID NO: 8472374 - DNA, 22 bp, Homo sapiens
tcccagtgtggcaggccatgga

SEQ ID NO: 8472375 - DNA, 22 bp, Homo sapiens
tcccagtgggtgactggaggct

SEQ ID NO: 8472376 - DNA, 22 bp, Homo sapiens
tcccatatatgtttatattgga

SEQ ID NO: 8472377 - DNA, 22 bp, Homo sapiens
tcccatatatgcaaaaatgtaa

SEQ ID NO: 8472378 - DNA, 22 bp, Homo sapiens
tcccattgccatagataggaca

SEQ ID NO: 8472379 - DNA, 22 bp, Homo sapiens
tcccatggtctatatagaggca

SEQ ID NO: 8472380 - DNA, 22 bp, Homo sapiens
tcccagggactgggctaggctt

SEQ ID NO: 8472381 - DNA, 22 bp, Homo sapiens
tcccagggactgggctaggctt

SEQ ID NO: 8472382 - DNA, 22 bp, Homo sapiens
tcccagggactggatgatgcag

SEQ ID NO: 8472383 - DNA, 22 bp, Homo sapiens
tcccagggatcctccgggtcgc

SEQ ID NO: 8472384 - DNA, 21 bp, Homo sapiens
tcccagggtcttatgggatgt

SEQ ID NO: 8472385 - DNA, 22 bp, Homo sapiens
tcccagggattaggacatggat

SEQ ID NO: 8472386 - DNA, 22 bp, Homo sapiens
tcccaggtgatgctgaggccac

SEQ ID NO: 8472387 - DNA, 22 bp, Homo sapiens
tcccagggttacagccagggca

SEQ ID NO: 8472388 - DNA, 22 bp, Homo sapiens
tcccagggtgcgcctgccctcg

SEQ ID NO: 8472389 - DNA, 22 bp, Homo sapiens
tcccagggtgaaatgcagtagg

SEQ ID NO: 8472390 - DNA, 20 bp, Homo sapiens
tccccagggcatcaggagca

SEQ ID NO: 8472391 - DNA, 22 bp, Homo sapiens
tccccaggagttttactttgca

SEQ ID NO: 8472392 - DNA, 22 bp, Homo sapiens
tccccaggagcaatgattcagt

SEQ ID NO: 8472393 - DNA, 22 bp, Homo sapiens
tccccagggtccctgcttccat

SEQ ID NO: 8472394 - DNA, 22 bp, Homo sapiens
tccccaggggcatctctctgct

SEQ ID NO: 8472395 - DNA, 22 bp, Homo sapiens
tccccaggggcatctctctgct

SEQ ID NO: 8472396 - DNA, 22 bp, Homo sapiens
tccccaccccagaactactagg

SEQ ID NO: 8472397 - DNA, 22 bp, Homo sapiens
tccccacctacacactgctcct

SEQ ID NO: 8472398 - DNA, 22 bp, Homo sapiens
tccccacctacacactgctcct

SEQ ID NO: 8472399 - DNA, 22 bp, Homo sapiens
tccccacctacacactgctcct

SEQ ID NO: 8472400 - DNA, 22 bp, Homo sapiens
tccccactcaccactggccaaa

SEQ ID NO: 8472401 - DNA, 22 bp, Homo sapiens
tccccaggaaattctgattctt

SEQ ID NO: 8472402 - DNA, 22 bp, Homo sapiens
tccccaggaaggcccttcctgg

SEQ ID NO: 8472403 - DNA, 22 bp, Homo sapiens
tccccaggaaattctgattctt

SEQ ID NO: 8472404 - DNA, 22 bp, Homo sapiens
tccccaggagcaatgattcagt

SEQ ID NO: 8472405 - DNA, 19 bp, Homo sapiens
tccccaagagttctagctc

SEQ ID NO: 8472406 - DNA, 22 bp, Homo sapiens
tccccacacagatacagagtag

SEQ ID NO: 8472407 - DNA, 22 bp, Homo sapiens
tccccacactttcactcctggc

SEQ ID NO: 8472408 - DNA, 22 bp, Homo sapiens
tccccacatctctgcatcaggc

SEQ ID NO: 8472409 - DNA, 22 bp, Homo sapiens
tccaggaggcctcatttcctgt

SEQ ID NO: 8472410 - DNA, 22 bp, Homo sapiens
tccaggaggctctggttgacgt

SEQ ID NO: 8472411 - DNA, 22 bp, Homo sapiens
tccaggaaagcactgggctggg

SEQ ID NO: 8472412 - DNA, 22 bp, Homo sapiens
tccaggaaagcactgggctggg

SEQ ID NO: 8472413 - DNA, 22 bp, Homo sapiens
tccaggaaagtgggatgtgtgt

SEQ ID NO: 8472414 - DNA, 22 bp, Homo sapiens
tccaggaaaaggcttgcagggg

SEQ ID NO: 8472415 - DNA, 22 bp, Homo sapiens
tccagctttggctctagctaca

SEQ ID NO: 8472416 - DNA, 22 bp, Homo sapiens
tccagcttttaccaaatgagca

SEQ ID NO: 8472417 - DNA, 19 bp, Homo sapiens
tccagctgttttgagtcac

SEQ ID NO: 8472418 - DNA, 22 bp, Homo sapiens
tccagctgttgatattctaggt

SEQ ID NO: 8472419 - DNA, 19 bp, Homo sapiens
tccagctgttttgagtcac

SEQ ID NO: 8472420 - DNA, 21 bp, Homo sapiens
tccagctcctgccactcctta

SEQ ID NO: 8472421 - DNA, 19 bp, Homo sapiens
tccagctggtatgcccaga

SEQ ID NO: 8472422 - DNA, 22 bp, Homo sapiens
tccagctcagggttggctcaag

SEQ ID NO: 8472423 - DNA, 22 bp, Homo sapiens
tccagctcagggttggctcaag

SEQ ID NO: 8472424 - DNA, 22 bp, Homo sapiens
tccagctcaaagtgctcctgtc

SEQ ID NO: 8472425 - DNA, 22 bp, Homo sapiens
tccagccaagccttggtagctg

SEQ ID NO: 8472426 - DNA, 22 bp, Homo sapiens
tccagctccacagcctccctgt

SEQ ID NO: 8472427 - DNA, 23 bp, Homo sapiens
tccagctcccttcaatggcactg

SEQ ID NO: 8472428 - DNA, 22 bp, Homo sapiens
tccagcagtccatgtgagacac

SEQ ID NO: 8472429 - DNA, 19 bp, Homo sapiens
tccagcagtgcttgaaatc

SEQ ID NO: 8472430 - DNA, 20 bp, Homo sapiens
tccagcatataaactcctct

SEQ ID NO: 8472431 - DNA, 22 bp, Homo sapiens
tccagcagtgctcaggactcac

SEQ ID NO: 8472432 - DNA, 22 bp, Homo sapiens
tccagccaagggaggttactag

SEQ ID NO: 8472433 - DNA, 22 bp, Homo sapiens
tccagccaatcaactattgttt

SEQ ID NO: 8472434 - DNA, 22 bp, Homo sapiens
tccagccaatcagagctgaggc

SEQ ID NO: 8472435 - DNA, 22 bp, Homo sapiens
tccagccaactgcctagggagc

SEQ ID NO: 8472436 - DNA, 22 bp, Homo sapiens
tccagccaccaccttgattgcc

SEQ ID NO: 8472437 - DNA, 22 bp, Homo sapiens
tccagccaactgcctagggagc

SEQ ID NO: 8472438 - DNA, 23 bp, Homo sapiens
tccagccaaatctggctgacagt

SEQ ID NO: 8472439 - DNA, 22 bp, Homo sapiens
tccagcattcttagacctctat

SEQ ID NO: 8472440 - DNA, 22 bp, Homo sapiens
tccagcatgactagttccccat

SEQ ID NO: 8472441 - DNA, 22 bp, Homo sapiens
tccagaggggcagccctgtgct

SEQ ID NO: 8472442 - DNA, 22 bp, Homo sapiens
tccagaggtatgtagagagtat

SEQ ID NO: 8472443 - DNA, 22 bp, Homo sapiens
tccagaggggcagccctgtgct

SEQ ID NO: 8472444 - DNA, 22 bp, Homo sapiens
tccagagggcgatggctggggg

SEQ ID NO: 8472445 - DNA, 20 bp, Homo sapiens
tccagaggccacatccagtg

SEQ ID NO: 8472446 - DNA, 22 bp, Homo sapiens
tccagaggctccaaagggagat

SEQ ID NO: 8472447 - DNA, 22 bp, Homo sapiens
tccagaggctctgagggagagt

SEQ ID NO: 8472448 - DNA, 21 bp, Homo sapiens
tccagaggaggacagactcag

SEQ ID NO: 8472449 - DNA, 22 bp, Homo sapiens
tccagaggcaaaaaggtatgga

SEQ ID NO: 8472450 - DNA, 22 bp, Homo sapiens
tccagaggcaaaaaggtatgga

SEQ ID NO: 8472451 - DNA, 22 bp, Homo sapiens
tccagagctgggtctgtgctca

SEQ ID NO: 8472452 - DNA, 22 bp, Homo sapiens
tccagcagactcatcagcaagg

SEQ ID NO: 8472453 - DNA, 23 bp, Homo sapiens
tccagcagagccttccaggaggg

SEQ ID NO: 8472454 - DNA, 22 bp, Homo sapiens
tccagcagaccatcaaggctca

SEQ ID NO: 8472455 - DNA, 23 bp, Homo sapiens
tccagcagccaagaagggtagaa

SEQ ID NO: 8472456 - DNA, 22 bp, Homo sapiens
tccagcagcccgaaggcccatc

SEQ ID NO: 8472457 - DNA, 22 bp, Homo sapiens
tccagcagcctgacttccctct

SEQ ID NO: 8472458 - DNA, 22 bp, Homo sapiens
tccagcagccacacctctggac

SEQ ID NO: 8472459 - DNA, 22 bp, Homo sapiens
tccagcaggtgtttgccaactt

SEQ ID NO: 8472460 - DNA, 18 bp, Homo sapiens
tccagcaggtctgaggtg

SEQ ID NO: 8472461 - DNA, 22 bp, Homo sapiens
tccagcaggtccgagacaagtt

SEQ ID NO: 8472462 - DNA, 22 bp, Homo sapiens
tcattgaatgagatgcaataga

SEQ ID NO: 8472463 - DNA, 22 bp, Homo sapiens
tcattgaatttcacagctttat

SEQ ID NO: 8472464 - DNA, 22 bp, Homo sapiens
tcattgaatgagatgcaataga

SEQ ID NO: 8472465 - DNA, 22 bp, Homo sapiens
tcattgaagtgactgaaagatt

SEQ ID NO: 8472466 - DNA, 20 bp, Homo sapiens
tccagagagtggcaaagctc

SEQ ID NO: 8472467 - DNA, 20 bp, Homo sapiens
tccagagagtggcaaagctc

SEQ ID NO: 8472468 - DNA, 22 bp, Homo sapiens
tccagagaggtttctccatgct

SEQ ID NO: 8472469 - DNA, 22 bp, Homo sapiens
tcattgcagaaataaaggtgaa

SEQ ID NO: 8472470 - DNA, 22 bp, Homo sapiens
tcattgcagactaacaatctca

SEQ ID NO: 8472471 - DNA, 19 bp, Homo sapiens
tccagaactgccctggcct

SEQ ID NO: 8472472 - DNA, 19 bp, Homo sapiens
tccagaagtccctgagcgg

SEQ ID NO: 8472473 - DNA, 22 bp, Homo sapiens
tccagagcaggtggtcagaagg

SEQ ID NO: 8472474 - DNA, 22 bp, Homo sapiens
tccagagatcacactgggcagg

SEQ ID NO: 8472475 - DNA, 17 bp, Homo sapiens
tccagagcacagagctc

SEQ ID NO: 8472476 - DNA, 22 bp, Homo sapiens
tccagagctaattcagcagctg

SEQ ID NO: 8472477 - DNA, 22 bp, Homo sapiens
tccagagcctgcgcactggctg

SEQ ID NO: 8472478 - DNA, 21 bp, Homo sapiens
tccaggctggaaggggcgttg

SEQ ID NO: 8472479 - DNA, 22 bp, Homo sapiens
tccaggctggaaatgtcaaact

SEQ ID NO: 8472480 - DNA, 22 bp, Homo sapiens
tccaggctgcagtcttgccctc

SEQ ID NO: 8472481 - DNA, 22 bp, Homo sapiens
tccaggctgccacagtgcaacg

SEQ ID NO: 8472482 - DNA, 22 bp, Homo sapiens
tccaggctgcagtcttgccctc

SEQ ID NO: 8472483 - DNA, 22 bp, Homo sapiens
tccagggccatctccatgaggc

SEQ ID NO: 8472484 - DNA, 22 bp, Homo sapiens
tccagggccagtccttgtctgt

SEQ ID NO: 8472485 - DNA, 22 bp, Homo sapiens
tccagggccagtccttgtctgt

SEQ ID NO: 8472486 - DNA, 20 bp, Homo sapiens
tccagggccctggctcctct

SEQ ID NO: 8472487 - DNA, 20 bp, Homo sapiens
tccagggccctggctcctct

SEQ ID NO: 8472488 - DNA, 20 bp, Homo sapiens
tccagggccctggctcctct

SEQ ID NO: 8472489 - DNA, 22 bp, Homo sapiens
tccagtttatttttggcagggt

SEQ ID NO: 8472490 - DNA, 22 bp, Homo sapiens
tccagtttattatgcatttaca

SEQ ID NO: 8472491 - DNA, 22 bp, Homo sapiens
tccagtttccaatcactgcacg

SEQ ID NO: 8472492 - DNA, 22 bp, Homo sapiens
tccagtttcatagctaaggaac

SEQ ID NO: 8472493 - DNA, 22 bp, Homo sapiens
tccatcatgttcacagctatat

SEQ ID NO: 8472494 - DNA, 22 bp, Homo sapiens
tccatcatgttcacagctatat

SEQ ID NO: 8472495 - DNA, 22 bp, Homo sapiens
tccatcatggcagcagcagtga

SEQ ID NO: 8472496 - DNA, 22 bp, Homo sapiens
tccatcatggcagcagcagtga

SEQ ID NO: 8472497 - DNA, 22 bp, Homo sapiens
tccagtttacagggttgctttt

SEQ ID NO: 8472498 - DNA, 22 bp, Homo sapiens
tccagggctcattccctctgca

SEQ ID NO: 8472499 - DNA, 20 bp, Homo sapiens
tccagggctagggagctcat

SEQ ID NO: 8472500 - DNA, 22 bp, Homo sapiens
tccagggctcattccctctgca

SEQ ID NO: 8472501 - DNA, 20 bp, Homo sapiens
tccagggccctggctcctct

SEQ ID NO: 8472502 - DNA, 20 bp, Homo sapiens
tccagggctagggagctcat

SEQ ID NO: 8472503 - DNA, 22 bp, Homo sapiens
tccatgcagagaactgaagtac

SEQ ID NO: 8472504 - DNA, 22 bp, Homo sapiens
tccatgcaaacagtggctagct

SEQ ID NO: 8472505 - DNA, 22 bp, Homo sapiens
tccatgattggtcatcatagaa

SEQ ID NO: 8472506 - DNA, 22 bp, Homo sapiens
tccatccataccacttggagac

SEQ ID NO: 8472507 - DNA, 21 bp, Homo sapiens
tccatccatcagtccagccag

SEQ ID NO: 8472508 - DNA, 22 bp, Homo sapiens
tccatctacggctataccaccc

SEQ ID NO: 8472509 - DNA, 22 bp, Homo sapiens
tccatctgggtggggagaagga

SEQ ID NO: 8472510 - DNA, 22 bp, Homo sapiens
tccatctggtaaaattcattga

SEQ ID NO: 8472511 - DNA, 22 bp, Homo sapiens
tccatctggtgagtgaggagcc

SEQ ID NO: 8472512 - DNA, 22 bp, Homo sapiens
tccatctggatggtatgtgtaa

SEQ ID NO: 8472513 - DNA, 22 bp, Homo sapiens
tcccaaggtgctcggcaacagg

SEQ ID NO: 8472514 - DNA, 20 bp, Homo sapiens
tcccaagggctgagaggatc

SEQ ID NO: 8472515 - DNA, 22 bp, Homo sapiens
tccatgcagcagcctcccagcc

SEQ ID NO: 8472516 - DNA, 22 bp, Homo sapiens
tcccaagcaatgagtcagggcc

SEQ ID NO: 8472517 - DNA, 21 bp, Homo sapiens
tcccacagcgccagctcctgt

SEQ ID NO: 8472518 - DNA, 22 bp, Homo sapiens
tcccacagatgctgtccagagt

SEQ ID NO: 8472519 - DNA, 22 bp, Homo sapiens
tcccacactacacggttgttgg

SEQ ID NO: 8472520 - DNA, 22 bp, Homo sapiens
tcccacacttgaaacaaggctg

SEQ ID NO: 8472521 - DNA, 22 bp, Homo sapiens
tcccacacctgtctattcctag

SEQ ID NO: 8472522 - DNA, 22 bp, Homo sapiens
tcccaagtgtcttggaccaggg

SEQ ID NO: 8472523 - DNA, 22 bp, Homo sapiens
tcccaagtactaccaatctaat

SEQ ID NO: 8472524 - DNA, 23 bp, Homo sapiens
tccaggcatgagctctggatgga

SEQ ID NO: 8472525 - DNA, 22 bp, Homo sapiens
tccaggcatgtggccagtactc

SEQ ID NO: 8472526 - DNA, 22 bp, Homo sapiens
tccaggcatgtcccaagccgga

SEQ ID NO: 8472527 - DNA, 22 bp, Homo sapiens
tccaggcatgtctgagtccttc

SEQ ID NO: 8472528 - DNA, 22 bp, Homo sapiens
tccaggcatagaaggcacgcac

SEQ ID NO: 8472529 - DNA, 22 bp, Homo sapiens
tccaggcatcccccaggacaga

SEQ ID NO: 8472530 - DNA, 19 bp, Homo sapiens
tccaggcatccttcaggct

SEQ ID NO: 8472531 - DNA, 19 bp, Homo sapiens
tccaggcatccttcaggct

SEQ ID NO: 8472532 - DNA, 22 bp, Homo sapiens
tccaggcattccagccattcca

SEQ ID NO: 8472533 - DNA, 22 bp, Homo sapiens
tccaggccaatgtagcaggccc

SEQ ID NO: 8472534 - DNA, 22 bp, Homo sapiens
tccaggccaatgtagcaggccc

SEQ ID NO: 8472535 - DNA, 22 bp, Homo sapiens
tccaggccaatgtagcaggccc

SEQ ID NO: 8472536 - DNA, 22 bp, Homo sapiens
tccaggccaatgtagcaggccc

SEQ ID NO: 8472537 - DNA, 22 bp, Homo sapiens
tccaggccacatggatggcgat

SEQ ID NO: 8472538 - DNA, 22 bp, Homo sapiens
tccaggccaatgtagcaggccc

SEQ ID NO: 8472539 - DNA, 22 bp, Homo sapiens
tccaggccacatggatggcgat

SEQ ID NO: 8472540 - DNA, 22 bp, Homo sapiens
tccaggccacgacctcctggat

SEQ ID NO: 8472541 - DNA, 22 bp, Homo sapiens
tccaggccacgacctcctggat

SEQ ID NO: 8472542 - DNA, 22 bp, Homo sapiens
tccaggctcagcacttgctact

SEQ ID NO: 8472543 - DNA, 22 bp, Homo sapiens
tccaggccactgcagaggctct

SEQ ID NO: 8472544 - DNA, 22 bp, Homo sapiens
tccaggctaggtttacaggaca

SEQ ID NO: 8472545 - DNA, 22 bp, Homo sapiens
tccaggccactgcagaggctct

SEQ ID NO: 8472546 - DNA, 22 bp, Homo sapiens
tccaggccactgcagaggctct

SEQ ID NO: 8472547 - DNA, 22 bp, Homo sapiens
tccaggctctcaggtgtcagca

SEQ ID NO: 8472548 - DNA, 22 bp, Homo sapiens
tccaggctctcaggtgtcagca

SEQ ID NO: 8472549 - DNA, 22 bp, Homo sapiens
tccaggctctcaggtgtcagca

SEQ ID NO: 8472550 - DNA, 22 bp, Homo sapiens
tccaggctctaggctgctctcc

SEQ ID NO: 8472551 - DNA, 22 bp, Homo sapiens
tccaggctcagcacttgctact

SEQ ID NO: 8472552 - DNA, 22 bp, Homo sapiens
tccaggctctaggctgctctcc

SEQ ID NO: 8472553 - DNA, 19 bp, Homo sapiens
tccaggctgagagtcagct

SEQ ID NO: 8472554 - DNA, 19 bp, Homo sapiens
tccaggctgagagtcagct

SEQ ID NO: 8472555 - DNA, 19 bp, Homo sapiens
tccaggctgagagtcagct

SEQ ID NO: 8472556 - DNA, 22 bp, Homo sapiens
tccaggctgacgcagctattta

SEQ ID NO: 8472557 - DNA, 23 bp, Homo sapiens
tccaggctgaaggagcagatttt

SEQ ID NO: 8472558 - DNA, 23 bp, Homo sapiens
tccaggctgaaggagcagatttt

SEQ ID NO: 8472559 - DNA, 22 bp, Homo sapiens
tccaggctgcaaggccacaggg

SEQ ID NO: 8472560 - DNA, 22 bp, Homo sapiens
tccaggctgatccatgaagaat

SEQ ID NO: 8472561 - DNA, 21 bp, Homo sapiens
tccaggctgatgatgtcaact

SEQ ID NO: 8472562 - DNA, 22 bp, Homo sapiens
tccaggagggttttctgccttc

SEQ ID NO: 8472563 - DNA, 22 bp, Homo sapiens
tccaggagggttttctgccttc

SEQ ID NO: 8472564 - DNA, 22 bp, Homo sapiens
tccaggagggattgggctgtgg

SEQ ID NO: 8472565 - DNA, 22 bp, Homo sapiens
tccaggagggattgggctgtgg

SEQ ID NO: 8472566 - DNA, 22 bp, Homo sapiens
tccaggagggggagccgtgccg

SEQ ID NO: 8472567 - DNA, 22 bp, Homo sapiens
tccaggaggtatgagtggcccc

SEQ ID NO: 8472568 - DNA, 22 bp, Homo sapiens
tccaggaggtgaggggaccaaa

SEQ ID NO: 8472569 - DNA, 22 bp, Homo sapiens
tccaggaggtatgagtggcccc

SEQ ID NO: 8472570 - DNA, 20 bp, Homo sapiens
tccaggaggttagtgtggct

SEQ ID NO: 8472571 - DNA, 22 bp, Homo sapiens
tccaggaggtgaggggaccaaa

SEQ ID NO: 8472572 - DNA, 22 bp, Homo sapiens
tccaggaggttgagactgcagt

SEQ ID NO: 8472573 - DNA, 22 bp, Homo sapiens
tccaggaggttgagactgcagt

SEQ ID NO: 8472574 - DNA, 22 bp, Homo sapiens
tccaggaggttgagtgagttcc

SEQ ID NO: 8472575 - DNA, 22 bp, Homo sapiens
tccaggaggtttggaggaagca

SEQ ID NO: 8472576 - DNA, 22 bp, Homo sapiens
tccaggagtcctgggagtgatt

SEQ ID NO: 8472577 - DNA, 22 bp, Homo sapiens
tccaggagtcagacagatggtg

SEQ ID NO: 8472578 - DNA, 22 bp, Homo sapiens
tccaggagtcagacagatggtg

SEQ ID NO: 8472579 - DNA, 22 bp, Homo sapiens
tccaggagtcagacagatggtg

SEQ ID NO: 8472580 - DNA, 22 bp, Homo sapiens
tccaggagtcctgggagtgatt

SEQ ID NO: 8472581 - DNA, 22 bp, Homo sapiens
tccaggagtcctgggtggcccc

SEQ ID NO: 8472582 - DNA, 22 bp, Homo sapiens
tccaggagtcctgggtggcccc

SEQ ID NO: 8472583 - DNA, 22 bp, Homo sapiens
tccaggagtcctgggtggcccc

SEQ ID NO: 8472584 - DNA, 22 bp, Homo sapiens
tccaggagtctagcctcaggcc

SEQ ID NO: 8472585 - DNA, 22 bp, Homo sapiens
tccaggagtctagcctcaggcc

SEQ ID NO: 8472586 - DNA, 22 bp, Homo sapiens
tccaggagtctagcctcaggcc

SEQ ID NO: 8472587 - DNA, 22 bp, Homo sapiens
tccaggagtcctgggtggcccc

SEQ ID NO: 8472588 - DNA, 22 bp, Homo sapiens
tccaggagtcctgggtggcccc

SEQ ID NO: 8472589 - DNA, 22 bp, Homo sapiens
tccaggcagggcagccatcaag

SEQ ID NO: 8472590 - DNA, 22 bp, Homo sapiens
tccaggattgtcagccagaagg

SEQ ID NO: 8472591 - DNA, 22 bp, Homo sapiens
tccaggattgcaggtgcacaac

SEQ ID NO: 8472592 - DNA, 22 bp, Homo sapiens
tccaggatgcccgcttttgctt

SEQ ID NO: 8472593 - DNA, 22 bp, Homo sapiens
tccaggatggtgacggtggcca

SEQ ID NO: 8472594 - DNA, 22 bp, Homo sapiens
tccaggagtttgagactgcagt

SEQ ID NO: 8472595 - DNA, 22 bp, Homo sapiens
tccaggcagttttccaggttgt

SEQ ID NO: 8472596 - DNA, 22 bp, Homo sapiens
tccaggagtgtgtgctaatggg

SEQ ID NO: 8472597 - DNA, 22 bp, Homo sapiens
tccaggagtggggcagaggtct

SEQ ID NO: 8472598 - DNA, 22 bp, Homo sapiens
tccaggagtttgacctgtgggc

SEQ ID NO: 8472599 - DNA, 22 bp, Homo sapiens
tccaggagtttgacctgtgggc

SEQ ID NO: 8472600 - DNA, 22 bp, Homo sapiens
tccaggagtttgagactgcagt

SEQ ID NO: 8472601 - DNA, 22 bp, Homo sapiens
tccaggagtgataaggccactg

SEQ ID NO: 8472602 - DNA, 22 bp, Homo sapiens
tccaggagtgataaggccactg

SEQ ID NO: 8472603 - DNA, 22 bp, Homo sapiens
taaagtggtggtgctaatgtat

SEQ ID NO: 8472604 - DNA, 22 bp, Homo sapiens
taaagtgcttcctaacccagag

SEQ ID NO: 8472605 - DNA, 22 bp, Homo sapiens
taaattaaagattggagaagga

SEQ ID NO: 8472606 - DNA, 22 bp, Homo sapiens
taaagtgtcctagctaggaggc

SEQ ID NO: 8472607 - DNA, 22 bp, Homo sapiens
taaattagagccaggtaagttt

SEQ ID NO: 8472608 - DNA, 22 bp, Homo sapiens
taaattactcaatgcacataaa

SEQ ID NO: 8472609 - DNA, 23 bp, Homo sapiens
taaattacctttccagtgcaggg

SEQ ID NO: 8472610 - DNA, 22 bp, Homo sapiens
taaattaccctttagggaattg

SEQ ID NO: 8472611 - DNA, 22 bp, Homo sapiens
taaattatgtcacatgactctg

SEQ ID NO: 8472612 - DNA, 22 bp, Homo sapiens
taaattatggctggcagagcag

SEQ ID NO: 8472613 - DNA, 22 bp, Homo sapiens
taaattagggactttagttaat

SEQ ID NO: 8472614 - DNA, 20 bp, Homo sapiens
taaattagccttgaagatta

SEQ ID NO: 8472615 - DNA, 22 bp, Homo sapiens
taaattagggactttagttaat

SEQ ID NO: 8472616 - DNA, 20 bp, Homo sapiens
taaattagccttgaagatta

SEQ ID NO: 8472617 - DNA, 22 bp, Homo sapiens
taaagtgctgggattataggcc

SEQ ID NO: 8472618 - DNA, 22 bp, Homo sapiens
taaagtgcttatgataaccaag

SEQ ID NO: 8472619 - DNA, 22 bp, Homo sapiens
taaagtatccagttattcttct

SEQ ID NO: 8472620 - DNA, 22 bp, Homo sapiens
taaagtatccagttattcttct

SEQ ID NO: 8472621 - DNA, 22 bp, Homo sapiens
taaagtatattttttctcaata

SEQ ID NO: 8472622 - DNA, 22 bp, Homo sapiens
taaagtatattttttctcaata

SEQ ID NO: 8472623 - DNA, 22 bp, Homo sapiens
taaagtatccagttattcttct

SEQ ID NO: 8472624 - DNA, 22 bp, Homo sapiens
taaagtatccagttattcttct

SEQ ID NO: 8472625 - DNA, 22 bp, Homo sapiens
taaagtataagcattggagtat

SEQ ID NO: 8472626 - DNA, 22 bp, Homo sapiens
taaagtataagcattggagtat

SEQ ID NO: 8472627 - DNA, 22 bp, Homo sapiens
taaaggtttattcaacaaaata

SEQ ID NO: 8472628 - DNA, 22 bp, Homo sapiens
taactacaagggcggtctctgt

SEQ ID NO: 8472629 - DNA, 22 bp, Homo sapiens
taactagaagaatgcaccaaga

SEQ ID NO: 8472630 - DNA, 22 bp, Homo sapiens
taactagaatggctattttgag

SEQ ID NO: 8472631 - DNA, 23 bp, Homo sapiens
taacctgagttttttagatgcaa

SEQ ID NO: 8472632 - DNA, 22 bp, Homo sapiens
taacctactatgattctgggaa

SEQ ID NO: 8472633 - DNA, 22 bp, Homo sapiens
taacctgaggagaacagtgctt

SEQ ID NO: 8472634 - DNA, 22 bp, Homo sapiens
taacctgactgctctttagaat

SEQ ID NO: 8472635 - DNA, 23 bp, Homo sapiens
taacctgagattgcaagggagct

SEQ ID NO: 8472636 - DNA, 22 bp, Homo sapiens
taactctagtcccaggcatgaa

SEQ ID NO: 8472637 - DNA, 22 bp, Homo sapiens
taactgaacagcctaattcttt

SEQ ID NO: 8472638 - DNA, 22 bp, Homo sapiens
taactgaacatctcaaatcaag

SEQ ID NO: 8472639 - DNA, 22 bp, Homo sapiens
taactgaacatctcaaatcaag

SEQ ID NO: 8472640 - DNA, 22 bp, Homo sapiens
taactgaacatctcaaatcaag

SEQ ID NO: 8472641 - DNA, 22 bp, Homo sapiens
taactgaatgtattacaacaga

SEQ ID NO: 8472642 - DNA, 22 bp, Homo sapiens
taactgaatgtattacaacaga

SEQ ID NO: 8472643 - DNA, 22 bp, Homo sapiens
taactgaatgtattacaacaga

SEQ ID NO: 8472644 - DNA, 22 bp, Homo sapiens
taactgatgtgaacttaccatt

SEQ ID NO: 8472645 - DNA, 22 bp, Homo sapiens
taaccatattttccattaagtt

SEQ ID NO: 8472646 - DNA, 22 bp, Homo sapiens
taacctgaacacacaataggga

SEQ ID NO: 8472647 - DNA, 22 bp, Homo sapiens
taaccagacagaaacagctaga

SEQ ID NO: 8472648 - DNA, 22 bp, Homo sapiens
taaatttacccaaggaacatgt

SEQ ID NO: 8472649 - DNA, 22 bp, Homo sapiens
taaattgtgtgttgctagggga

SEQ ID NO: 8472650 - DNA, 22 bp, Homo sapiens
taaattgttttctagaagttgt

SEQ ID NO: 8472651 - DNA, 22 bp, Homo sapiens
taaattctacaacttcaaagat

SEQ ID NO: 8472652 - DNA, 22 bp, Homo sapiens
taaaagttttagttgtacataa

SEQ ID NO: 8472653 - DNA, 22 bp, Homo sapiens
taaaagttttagttgtacataa

SEQ ID NO: 8472654 - DNA, 22 bp, Homo sapiens
taaaatgatctctcatgttctt

SEQ ID NO: 8472655 - DNA, 22 bp, Homo sapiens
taaaattgcggtgaatatttcc

SEQ ID NO: 8472656 - DNA, 22 bp, Homo sapiens
taaacaagctggactgataagt

SEQ ID NO: 8472657 - DNA, 22 bp, Homo sapiens
taaacaagaaacattttctgtt

SEQ ID NO: 8472658 - DNA, 22 bp, Homo sapiens
taaaggcttttagtgatggtaa

SEQ ID NO: 8472659 - DNA, 22 bp, Homo sapiens
taaacaagggttactgagcatg

SEQ ID NO: 8472660 - DNA, 22 bp, Homo sapiens
taaacaagaaacattttctgtt

SEQ ID NO: 8472661 - DNA, 22 bp, Homo sapiens
gttttcttcctgcaattggcat

SEQ ID NO: 8472662 - DNA, 22 bp, Homo sapiens
gttttcttcctgcaattggcat

SEQ ID NO: 8472663 - DNA, 22 bp, Homo sapiens
gttttgaatactactagaactt

SEQ ID NO: 8472664 - DNA, 22 bp, Homo sapiens
gttttgtgaggcacccacaggt

SEQ ID NO: 8472665 - DNA, 22 bp, Homo sapiens
gttaataaaggtatagaatcag

SEQ ID NO: 8472666 - DNA, 23 bp, Homo sapiens
gttaataatgaacactttctccc

SEQ ID NO: 8472667 - DNA, 22 bp, Homo sapiens
gttaatgtggtagtgcatatct

SEQ ID NO: 8472668 - DNA, 22 bp, Homo sapiens
gttaatacaaccatgatcttct

SEQ ID NO: 8472669 - DNA, 22 bp, Homo sapiens
gttaatgtcttcctattctaca

SEQ ID NO: 8472670 - DNA, 22 bp, Homo sapiens
gttaatgtcactttatgtggct

SEQ ID NO: 8472671 - DNA, 22 bp, Homo sapiens
gttacaaagcacttcaagtgaa

SEQ ID NO: 8472672 - DNA, 22 bp, Homo sapiens
gttacaaactcaggtgccaaaa

SEQ ID NO: 8472673 - DNA, 22 bp, Homo sapiens
gttacaaaggaagcttcactgc

SEQ ID NO: 8472674 - DNA, 22 bp, Homo sapiens
gttacaaagcacttcaagtgaa

SEQ ID NO: 8472675 - DNA, 22 bp, Homo sapiens
gttaagaatcaagacttatctt

SEQ ID NO: 8472676 - DNA, 22 bp, Homo sapiens
gtgtgggaaggctaggatgctg

SEQ ID NO: 8472677 - DNA, 22 bp, Homo sapiens
gtgtgggaaggctaggatgctg

SEQ ID NO: 8472678 - DNA, 22 bp, Homo sapiens
gtgtggctgtttagtgactttc

SEQ ID NO: 8472679 - DNA, 22 bp, Homo sapiens
gtgtggctagaagtgtcttgtt

SEQ ID NO: 8472680 - DNA, 22 bp, Homo sapiens
gtgtgccctggctccagcacca

SEQ ID NO: 8472681 - DNA, 22 bp, Homo sapiens
gtgtgccactgcctgaggaccc

SEQ ID NO: 8472682 - DNA, 22 bp, Homo sapiens
gtgtgccaggaactggctgctg

SEQ ID NO: 8472683 - DNA, 22 bp, Homo sapiens
gtgctctgtgtattaggatgtc

SEQ ID NO: 8472684 - DNA, 22 bp, Homo sapiens
gtgctctgtggattgagttgaa

SEQ ID NO: 8472685 - DNA, 21 bp, Homo sapiens
gtgctctgggcagcagagggc

SEQ ID NO: 8472686 - DNA, 21 bp, Homo sapiens
gtgctctgggcagcagagggc

SEQ ID NO: 8472687 - DNA, 22 bp, Homo sapiens
gtgctctgcctggggtcatggc

SEQ ID NO: 8472688 - DNA, 22 bp, Homo sapiens
gtgctccctccttcctcaagga

SEQ ID NO: 8472689 - DNA, 22 bp, Homo sapiens
gtgctccctccttcctcaagga

SEQ ID NO: 8472690 - DNA, 22 bp, Homo sapiens
gtgctccattgtctagaactgg

SEQ ID NO: 8472691 - DNA, 19 bp, Homo sapiens
gtgctccagggcaaggagt

SEQ ID NO: 8472692 - DNA, 22 bp, Homo sapiens
gtgctcagcccggatgagatca

SEQ ID NO: 8472693 - DNA, 22 bp, Homo sapiens
gtgctcagcccggatgagatca

SEQ ID NO: 8472694 - DNA, 22 bp, Homo sapiens
gtgctcagaaacttgctcattt

SEQ ID NO: 8472695 - DNA, 22 bp, Homo sapiens
gtgctcaggttcccatgagtgc

SEQ ID NO: 8472696 - DNA, 22 bp, Homo sapiens
gtgctcaggttcccatgagtgc

SEQ ID NO: 8472697 - DNA, 22 bp, Homo sapiens
gtgctcagggcctggctgggga

SEQ ID NO: 8472698 - DNA, 22 bp, Homo sapiens
gtgctcaggggcaatcctggga

SEQ ID NO: 8472699 - DNA, 22 bp, Homo sapiens
gtgctcaggggcaatcctggga

SEQ ID NO: 8472700 - DNA, 22 bp, Homo sapiens
gttgtaaatacagtactgaaac

SEQ ID NO: 8472701 - DNA, 22 bp, Homo sapiens
gttgtaaatacagcagataatt

SEQ ID NO: 8472702 - DNA, 22 bp, Homo sapiens
gttgtacaaaatatcagtgagg

SEQ ID NO: 8472703 - DNA, 22 bp, Homo sapiens
gttgtaagtttaatgtcaattg

SEQ ID NO: 8472704 - DNA, 18 bp, Homo sapiens
gtttcatgcatgtgaaac

SEQ ID NO: 8472705 - DNA, 22 bp, Homo sapiens
gttgcagatgtggaactcgtgc

SEQ ID NO: 8472706 - DNA, 22 bp, Homo sapiens
gttgcagatgtggaactcgtgc

SEQ ID NO: 8472707 - DNA, 22 bp, Homo sapiens
gttgcaggaagcacacacatgt

SEQ ID NO: 8472708 - DNA, 22 bp, Homo sapiens
gttgccaggggctgctgtcacc

SEQ ID NO: 8472709 - DNA, 22 bp, Homo sapiens
gttgctcaggcaggagtacagt

SEQ ID NO: 8472710 - DNA, 22 bp, Homo sapiens
gttgccttctatgattctcagt

SEQ ID NO: 8472711 - DNA, 22 bp, Homo sapiens
gttgggccccagaggtccaggc

SEQ ID NO: 8472712 - DNA, 22 bp, Homo sapiens
gttgggccccagaggtccaggc

SEQ ID NO: 8472713 - DNA, 22 bp, Homo sapiens
gttcagtttgacaacctttata

SEQ ID NO: 8472714 - DNA, 22 bp, Homo sapiens
gttcagttatgtgacctcaaaa

SEQ ID NO: 8472715 - DNA, 22 bp, Homo sapiens
gttcatattctaagtaactggc

SEQ ID NO: 8472716 - DNA, 18 bp, Homo sapiens
gttcatctttttctaaag

SEQ ID NO: 8472717 - DNA, 22 bp, Homo sapiens
gttcatcttcctcccagtgcct

SEQ ID NO: 8472718 - DNA, 22 bp, Homo sapiens
gttcagttttgaaatgttaatt

SEQ ID NO: 8472719 - DNA, 22 bp, Homo sapiens
gttgaggtgatgccagccctgc

SEQ ID NO: 8472720 - DNA, 22 bp, Homo sapiens
gttgagtgggttaggatgctga

SEQ ID NO: 8472721 - DNA, 22 bp, Homo sapiens
gttgagtgggttaggatgctga

SEQ ID NO: 8472722 - DNA, 22 bp, Homo sapiens
gttcattctgaaaagcagcttg

SEQ ID NO: 8472723 - DNA, 20 bp, Homo sapiens
gttcatgtctcaaatagaaa

SEQ ID NO: 8472724 - DNA, 21 bp, Homo sapiens
gttcatgtcagcattaaggga

SEQ ID NO: 8472725 - DNA, 22 bp, Homo sapiens
gttcatgtttgagaacaaggag

SEQ ID NO: 8472726 - DNA, 22 bp, Homo sapiens
gttcacatcccagaaagagcat

SEQ ID NO: 8472727 - DNA, 22 bp, Homo sapiens
gttcaatttagaaagcacagtt

SEQ ID NO: 8472728 - DNA, 22 bp, Homo sapiens
gttacaaaggactgggggccac

SEQ ID NO: 8472729 - DNA, 22 bp, Homo sapiens
gttcactggctgtgtgactctg

SEQ ID NO: 8472730 - DNA, 22 bp, Homo sapiens
gttcagagacacttattggaaa

SEQ ID NO: 8472731 - DNA, 22 bp, Homo sapiens
gttcactgtactggtgatggtt

SEQ ID NO: 8472732 - DNA, 22 bp, Homo sapiens
gttcagagtgggaatgatcact

SEQ ID NO: 8472733 - DNA, 22 bp, Homo sapiens
tacatacatgtatgtgtgtatt

SEQ ID NO: 8472734 - DNA, 22 bp, Homo sapiens
tacatagagggtaatagcatca

SEQ ID NO: 8472735 - DNA, 22 bp, Homo sapiens
tacatagaatatttcacttaaa

SEQ ID NO: 8472736 - DNA, 22 bp, Homo sapiens
tacatagagggtaatagcatca

SEQ ID NO: 8472737 - DNA, 22 bp, Homo sapiens
tacagtaataaaatgagctaca

SEQ ID NO: 8472738 - DNA, 21 bp, Homo sapiens
tacagtaagttgggtggtcct

SEQ ID NO: 8472739 - DNA, 21 bp, Homo sapiens
tacagtaagttgggtggtcct

SEQ ID NO: 8472740 - DNA, 22 bp, Homo sapiens
tacagtaagatgaaatagcaat

SEQ ID NO: 8472741 - DNA, 22 bp, Homo sapiens
tacagtaataaaatgagctaca

SEQ ID NO: 8472742 - DNA, 22 bp, Homo sapiens
tacagtaatctggacatgattt

SEQ ID NO: 8472743 - DNA, 22 bp, Homo sapiens
tacagtaatctggacatgattt

SEQ ID NO: 8472744 - DNA, 22 bp, Homo sapiens
tacagtaatgtgtccctgcagg

SEQ ID NO: 8472745 - DNA, 22 bp, Homo sapiens
tacagtaagatgaaatagcaat

SEQ ID NO: 8472746 - DNA, 22 bp, Homo sapiens
tacagtaagatgaaatagcaat

SEQ ID NO: 8472747 - DNA, 22 bp, Homo sapiens
tacagtaactggaattcttctt

SEQ ID NO: 8472748 - DNA, 22 bp, Homo sapiens
tacagggaccaataataactat

SEQ ID NO: 8472749 - DNA, 22 bp, Homo sapiens
tacagggacatggaacaggctc

SEQ ID NO: 8472750 - DNA, 22 bp, Homo sapiens
tacagggactcccgcagagata

SEQ ID NO: 8472751 - DNA, 22 bp, Homo sapiens
tacaggctagggagagtgactg

SEQ ID NO: 8472752 - DNA, 22 bp, Homo sapiens
tacaggctcttgtcagacgtat

SEQ ID NO: 8472753 - DNA, 20 bp, Homo sapiens
tacaggctctgagagatgat

SEQ ID NO: 8472754 - DNA, 20 bp, Homo sapiens
tacaggctctgagagatgat

SEQ ID NO: 8472755 - DNA, 20 bp, Homo sapiens
tacaggctctgagagatgat

SEQ ID NO: 8472756 - DNA, 22 bp, Homo sapiens
tacagggaatgggacataaatc

SEQ ID NO: 8472757 - DNA, 22 bp, Homo sapiens
tacaggctgaactcaatgatga

SEQ ID NO: 8472758 - DNA, 22 bp, Homo sapiens
tacaggctagggagagtgactg

SEQ ID NO: 8472759 - DNA, 22 bp, Homo sapiens
tacaggctgcagggctagaggg

SEQ ID NO: 8472760 - DNA, 22 bp, Homo sapiens
tacaggctcttgtcagacgtat

SEQ ID NO: 8472761 - DNA, 22 bp, Homo sapiens
tacaggcatgaatgaaatctgt

SEQ ID NO: 8472762 - DNA, 22 bp, Homo sapiens
tacaggcatgtagcatggtgat

SEQ ID NO: 8472763 - DNA, 22 bp, Homo sapiens
tacaggcatgtagcatggtgat

SEQ ID NO: 8472764 - DNA, 19 bp, Homo sapiens
tacaggcagtttctacaat

SEQ ID NO: 8472765 - DNA, 22 bp, Homo sapiens
tacaggagctgctctgtgatac

SEQ ID NO: 8472766 - DNA, 19 bp, Homo sapiens
tacaggaggcctgcaatct

SEQ ID NO: 8472767 - DNA, 20 bp, Homo sapiens
tacaggagtgagtgggtggg

SEQ ID NO: 8472768 - DNA, 20 bp, Homo sapiens
tacaggagtgagtgggtggg

SEQ ID NO: 8472769 - DNA, 17 bp, Homo sapiens
tacaggagagcaggaac

SEQ ID NO: 8472770 - DNA, 22 bp, Homo sapiens
tacaggagcacaaaagagttga

SEQ ID NO: 8472771 - DNA, 22 bp, Homo sapiens
tacaggagcatggggaagggat

SEQ ID NO: 8472772 - DNA, 22 bp, Homo sapiens
tacatctatactgatctacatt

SEQ ID NO: 8472773 - DNA, 22 bp, Homo sapiens
tacatctagccttacaattatt

SEQ ID NO: 8472774 - DNA, 22 bp, Homo sapiens
tacatccaaatgaattagaatt

SEQ ID NO: 8472775 - DNA, 22 bp, Homo sapiens
tacattcctgggctccacccta

SEQ ID NO: 8472776 - DNA, 22 bp, Homo sapiens
tacatctttgtctatgaccagc

SEQ ID NO: 8472777 - DNA, 20 bp, Homo sapiens
tacatctctcagatgtctaa

SEQ ID NO: 8472778 - DNA, 22 bp, Homo sapiens
tacatctcatctgtgctctccg

SEQ ID NO: 8472779 - DNA, 22 bp, Homo sapiens
tacatatagacagttactctag

SEQ ID NO: 8472780 - DNA, 22 bp, Homo sapiens
tacatatagacagttactctag

SEQ ID NO: 8472781 - DNA, 22 bp, Homo sapiens
tacatatactgagtgatttgct

SEQ ID NO: 8472782 - DNA, 22 bp, Homo sapiens
tacatagtgaacatttacagag

SEQ ID NO: 8472783 - DNA, 22 bp, Homo sapiens
tacattccttcgtttagagatt

SEQ ID NO: 8472784 - DNA, 22 bp, Homo sapiens
tacacttttcaatgtagtctgt

SEQ ID NO: 8472785 - DNA, 22 bp, Homo sapiens
tacactttttactacagattct

SEQ ID NO: 8472786 - DNA, 22 bp, Homo sapiens
tacagaaaaacatctggagccg

SEQ ID NO: 8472787 - DNA, 22 bp, Homo sapiens
tacactattttactgatacaaa

SEQ ID NO: 8472788 - DNA, 22 bp, Homo sapiens
tacaacataacgggcattcagt

SEQ ID NO: 8472789 - DNA, 22 bp, Homo sapiens
tacagaaacagcgtggttagaa

SEQ ID NO: 8472790 - DNA, 22 bp, Homo sapiens
tacagaaaaactggcattgaag

SEQ ID NO: 8472791 - DNA, 22 bp, Homo sapiens
tacagaaagggatgattgatct

SEQ ID NO: 8472792 - DNA, 22 bp, Homo sapiens
tacagaaagggatgattgatct

SEQ ID NO: 8472793 - DNA, 22 bp, Homo sapiens
tacagaaagacctctcgggaaa

SEQ ID NO: 8472794 - DNA, 20 bp, Homo sapiens
tacagaaacaggacttttgg

SEQ ID NO: 8472795 - DNA, 20 bp, Homo sapiens
tacagaaacaggacttttgg

SEQ ID NO: 8472796 - DNA, 20 bp, Homo sapiens
tacagaaacaggacttttgg

SEQ ID NO: 8472797 - DNA, 22 bp, Homo sapiens
tacagaaagacctctcgggaaa

SEQ ID NO: 8472798 - DNA, 22 bp, Homo sapiens
tacaaagtcagaataacaggtg

SEQ ID NO: 8472799 - DNA, 22 bp, Homo sapiens
tacaaagtcccattgccatgga

SEQ ID NO: 8472800 - DNA, 22 bp, Homo sapiens
tacaaagtgaaataattctgag

SEQ ID NO: 8472801 - DNA, 22 bp, Homo sapiens
tacaaagtgctttagaaatgaa

SEQ ID NO: 8472802 - DNA, 22 bp, Homo sapiens
tacaaatgaaccaactttgatg

SEQ ID NO: 8472803 - DNA, 20 bp, Homo sapiens
tacaacaagtagagacatac

SEQ ID NO: 8472804 - DNA, 22 bp, Homo sapiens
tacaacaatttccacattagaa

SEQ ID NO: 8472805 - DNA, 22 bp, Homo sapiens
tacaacagacaggaataagatt

SEQ ID NO: 8472806 - DNA, 22 bp, Homo sapiens
tacaacactgttcagcctcttc

SEQ ID NO: 8472807 - DNA, 22 bp, Homo sapiens
tacagcaatggttctaagagtc

SEQ ID NO: 8472808 - DNA, 22 bp, Homo sapiens
tacagcaaagaaaccctcagtc

SEQ ID NO: 8472809 - DNA, 22 bp, Homo sapiens
tacagcaataatgacaccgctc

SEQ ID NO: 8472810 - DNA, 21 bp, Homo sapiens
tacagatgaggagaccaaggc

SEQ ID NO: 8472811 - DNA, 22 bp, Homo sapiens
tacagatattgtacagttatag

SEQ ID NO: 8472812 - DNA, 22 bp, Homo sapiens
tacagattgaggtttttaatat

SEQ ID NO: 8472813 - DNA, 22 bp, Homo sapiens
tacagatatagagatttataga

SEQ ID NO: 8472814 - DNA, 22 bp, Homo sapiens
tacagaataaagcgtgaagctt

SEQ ID NO: 8472815 - DNA, 22 bp, Homo sapiens
tacagagtggttgtccaactct

SEQ ID NO: 8472816 - DNA, 22 bp, Homo sapiens
tacagaactgaagtagtgaaaa

SEQ ID NO: 8472817 - DNA, 22 bp, Homo sapiens
tacagaaattgccaccagctct

SEQ ID NO: 8472818 - DNA, 22 bp, Homo sapiens
taactgccagcagcgatgaaca

SEQ ID NO: 8472819 - DNA, 22 bp, Homo sapiens
taactggtactctggtagcctg

SEQ ID NO: 8472820 - DNA, 22 bp, Homo sapiens
taactgcctactgtgcaaatat

SEQ ID NO: 8472821 - DNA, 22 bp, Homo sapiens
taaggcaaagaaccatagtaat

SEQ ID NO: 8472822 - DNA, 22 bp, Homo sapiens
taaggcaaagtgatttcttaaa

SEQ ID NO: 8472823 - DNA, 22 bp, Homo sapiens
taaggcagttttgcctgagata

SEQ ID NO: 8472824 - DNA, 22 bp, Homo sapiens
taaggcagtgagaagaaacagg

SEQ ID NO: 8472825 - DNA, 21 bp, Homo sapiens
taaggccaagtctatttctgt

SEQ ID NO: 8472826 - DNA, 22 bp, Homo sapiens
taaggccaaggggccatagtct

SEQ ID NO: 8472827 - DNA, 22 bp, Homo sapiens
taaggccaagttcatatacaac

SEQ ID NO: 8472828 - DNA, 19 bp, Homo sapiens
taaggccaaaagtaagtgt

SEQ ID NO: 8472829 - DNA, 19 bp, Homo sapiens
taaggccaaaagtaagtgt

SEQ ID NO: 8472830 - DNA, 22 bp, Homo sapiens
taaggccaaactattatagttc

SEQ ID NO: 8472831 - DNA, 22 bp, Homo sapiens
taaggcttatatacttagacat

SEQ ID NO: 8472832 - DNA, 22 bp, Homo sapiens
taaggcttatgatcagaaggtt

SEQ ID NO: 8472833 - DNA, 22 bp, Homo sapiens
taaggcttagaagctatctgct

SEQ ID NO: 8472834 - DNA, 22 bp, Homo sapiens
taaggcttttgttcagcgtggg

SEQ ID NO: 8472835 - DNA, 22 bp, Homo sapiens
taaggctttgtagtgattgctt

SEQ ID NO: 8472836 - DNA, 22 bp, Homo sapiens
taaggcttttaaaggttcacca

SEQ ID NO: 8472837 - DNA, 22 bp, Homo sapiens
taaggctttctaaatatgcaga

SEQ ID NO: 8472838 - DNA, 22 bp, Homo sapiens
taaggctttctaaatatgcaga

SEQ ID NO: 8472839 - DNA, 22 bp, Homo sapiens
taaggcttggggaaaagtgagg

SEQ ID NO: 8472840 - DNA, 22 bp, Homo sapiens
taaggctttggtcaccatggag

SEQ ID NO: 8472841 - DNA, 22 bp, Homo sapiens
taaggcttggacttctccaacc

SEQ ID NO: 8472842 - DNA, 22 bp, Homo sapiens
taaggctttccttgtcatcttt

SEQ ID NO: 8472843 - DNA, 22 bp, Homo sapiens
taaggctttatttttacaatgc

SEQ ID NO: 8472844 - DNA, 22 bp, Homo sapiens
taaggcttcagcattcaaaaca

SEQ ID NO: 8472845 - DNA, 22 bp, Homo sapiens
taaggctactgtcagcttcagg

SEQ ID NO: 8472846 - DNA, 22 bp, Homo sapiens
taaggccattatggtgggcccg

SEQ ID NO: 8472847 - DNA, 22 bp, Homo sapiens
taaggctagcaagatgagaata

SEQ ID NO: 8472848 - DNA, 22 bp, Homo sapiens
taaggctaggaattctctgaag

SEQ ID NO: 8472849 - DNA, 22 bp, Homo sapiens
taaggctagtgcctgactgggt

SEQ ID NO: 8472850 - DNA, 22 bp, Homo sapiens
taaggctatctgagtttatgtg

SEQ ID NO: 8472851 - DNA, 22 bp, Homo sapiens
taaggctatcttttgagtgtgt

SEQ ID NO: 8472852 - DNA, 22 bp, Homo sapiens
taaggccaccgttatagaacca

SEQ ID NO: 8472853 - DNA, 22 bp, Homo sapiens
taaggccagcatgaatgcagca

SEQ ID NO: 8472854 - DNA, 22 bp, Homo sapiens
taaggccagccagcaaatctgt

SEQ ID NO: 8472855 - DNA, 22 bp, Homo sapiens
taaggccaggctgtggtcggca

SEQ ID NO: 8472856 - DNA, 22 bp, Homo sapiens
taaggccaattacatatgttca

SEQ ID NO: 8472857 - DNA, 22 bp, Homo sapiens
taaggccaattaacaaccaggg

SEQ ID NO: 8472858 - DNA, 22 bp, Homo sapiens
taaggccaccgttatagaacca

SEQ ID NO: 8472859 - DNA, 22 bp, Homo sapiens
taaggtttctagtttctaaact

SEQ ID NO: 8472860 - DNA, 22 bp, Homo sapiens
taagggttcagaatgcagtggt

SEQ ID NO: 8472861 - DNA, 22 bp, Homo sapiens
taaggcttcttggaatactgca

SEQ ID NO: 8472862 - DNA, 22 bp, Homo sapiens
taagtgatttgtagtatactat

SEQ ID NO: 8472863 - DNA, 23 bp, Homo sapiens
taagtgattccaagtttcaggga

SEQ ID NO: 8472864 - DNA, 22 bp, Homo sapiens
taagtgatgatagtacctagaa

SEQ ID NO: 8472865 - DNA, 22 bp, Homo sapiens
taagtgatgtcttggttaatga

SEQ ID NO: 8472866 - DNA, 23 bp, Homo sapiens
taagtgattagaatttgctgtca

SEQ ID NO: 8472867 - DNA, 17 bp, Homo sapiens
taagtgattatctcata

SEQ ID NO: 8472868 - DNA, 22 bp, Homo sapiens
taagtgatgagcacagtaatta

SEQ ID NO: 8472869 - DNA, 22 bp, Homo sapiens
taagtgatgaagacctgtttgg

SEQ ID NO: 8472870 - DNA, 22 bp, Homo sapiens
taagtgatgaaagcagatgtct

SEQ ID NO: 8472871 - DNA, 22 bp, Homo sapiens
taaggtttgtggggagcaaaag

SEQ ID NO: 8472872 - DNA, 22 bp, Homo sapiens
taataattaacagtgatgggtc

SEQ ID NO: 8472873 - DNA, 22 bp, Homo sapiens
taataattaacagtgatgggtc

SEQ ID NO: 8472874 - DNA, 22 bp, Homo sapiens
taataatagcagtagctgccac

SEQ ID NO: 8472875 - DNA, 22 bp, Homo sapiens
taataatagcagtagctgccac

SEQ ID NO: 8472876 - DNA, 22 bp, Homo sapiens
taagtggttgcttgttttcatt

SEQ ID NO: 8472877 - DNA, 22 bp, Homo sapiens
taagtggtaccaagctcagtga

SEQ ID NO: 8472878 - DNA, 22 bp, Homo sapiens
taagtgttattattctcacttt

SEQ ID NO: 8472879 - DNA, 22 bp, Homo sapiens
taagtgttgatctgagtgctaa

SEQ ID NO: 8472880 - DNA, 22 bp, Homo sapiens
taataagcgtagaaggtatatc

SEQ ID NO: 8472881 - DNA, 22 bp, Homo sapiens
taatacattacctaacctctct

SEQ ID NO: 8472882 - DNA, 22 bp, Homo sapiens
taatacatgtattccagagagt

SEQ ID NO: 8472883 - DNA, 22 bp, Homo sapiens
taatacatcattcatctaagga

SEQ ID NO: 8472884 - DNA, 22 bp, Homo sapiens
taatacatcattcatctaagga

SEQ ID NO: 8472885 - DNA, 22 bp, Homo sapiens
taatacatcattcatctaagga

SEQ ID NO: 8472886 - DNA, 22 bp, Homo sapiens
taattatacaaaaaggcatgca

SEQ ID NO: 8472887 - DNA, 22 bp, Homo sapiens
taattatagcattggagtggcc

SEQ ID NO: 8472888 - DNA, 22 bp, Homo sapiens
taattatagccgctattttgct

SEQ ID NO: 8472889 - DNA, 22 bp, Homo sapiens
taattataacatgctttctggc

SEQ ID NO: 8472890 - DNA, 22 bp, Homo sapiens
taattatacaaaaaggcatgca

SEQ ID NO: 8472891 - DNA, 22 bp, Homo sapiens
taattataaactgcagtaggta

SEQ ID NO: 8472892 - DNA, 22 bp, Homo sapiens
taattagtgtccagcttctgct

SEQ ID NO: 8472893 - DNA, 22 bp, Homo sapiens
taattagagtttggtaaacaat

SEQ ID NO: 8472894 - DNA, 22 bp, Homo sapiens
taattagagtttggtaaacaat

SEQ ID NO: 8472895 - DNA, 22 bp, Homo sapiens
taattacaggtccaaaacaatc

SEQ ID NO: 8472896 - DNA, 23 bp, Homo sapiens
taattagatgttgattcctgaga

SEQ ID NO: 8472897 - DNA, 23 bp, Homo sapiens
taattagatgttgattcctgaga

SEQ ID NO: 8472898 - DNA, 22 bp, Homo sapiens
taattataacagttacatctta

SEQ ID NO: 8472899 - DNA, 22 bp, Homo sapiens
taattataacagttacatctta

SEQ ID NO: 8472900 - DNA, 22 bp, Homo sapiens
taattataacagttacatctta

SEQ ID NO: 8472901 - DNA, 22 bp, Homo sapiens
taattaacatacaaaacagctg

SEQ ID NO: 8472902 - DNA, 22 bp, Homo sapiens
taattacaaagcaagcacaggg

SEQ ID NO: 8472903 - DNA, 22 bp, Homo sapiens
taattacaaagcaagcacaggg

SEQ ID NO: 8472904 - DNA, 22 bp, Homo sapiens
taattacaggtccaaaacaatc

SEQ ID NO: 8472905 - DNA, 22 bp, Homo sapiens
taattacaggtccaaaacaatc

SEQ ID NO: 8472906 - DNA, 22 bp, Homo sapiens
taattagagtcacaagtaacca

SEQ ID NO: 8472907 - DNA, 22 bp, Homo sapiens
taattagagtcacaagtaacca

SEQ ID NO: 8472908 - DNA, 22 bp, Homo sapiens
taattacagaggtttgccagtt

SEQ ID NO: 8472909 - DNA, 22 bp, Homo sapiens
taattacaaagcaagcacaggg

SEQ ID NO: 8472910 - DNA, 22 bp, Homo sapiens
taattacagaggtttgccagtt

SEQ ID NO: 8472911 - DNA, 22 bp, Homo sapiens
taattacagaggtttgccagtt

SEQ ID NO: 8472912 - DNA, 22 bp, Homo sapiens
taattacaggtccaaaacaatc

SEQ ID NO: 8472913 - DNA, 22 bp, Homo sapiens
taatggcagagtcatgctttct

SEQ ID NO: 8472914 - DNA, 22 bp, Homo sapiens
taatagaatagtggaaacattg

SEQ ID NO: 8472915 - DNA, 22 bp, Homo sapiens
taatactgtatactgcaaattt

SEQ ID NO: 8472916 - DNA, 22 bp, Homo sapiens
taatactgagccaccaggtagg

SEQ ID NO: 8472917 - DNA, 23 bp, Homo sapiens
taatactgcttcagaggcttaga

SEQ ID NO: 8472918 - DNA, 22 bp, Homo sapiens
taatagaaaggtattttttgca

SEQ ID NO: 8472919 - DNA, 22 bp, Homo sapiens
taatacttgtcataaaggcatt

SEQ ID NO: 8472920 - DNA, 22 bp, Homo sapiens
taatacttaccttgcagagtct

SEQ ID NO: 8472921 - DNA, 22 bp, Homo sapiens
taatacttaccttgcagagtct

SEQ ID NO: 8472922 - DNA, 22 bp, Homo sapiens
tacaaagtaatgtataatatcg

SEQ ID NO: 8472923 - DNA, 22 bp, Homo sapiens
tacaaagtaatgtataatatcg

SEQ ID NO: 8472924 - DNA, 22 bp, Homo sapiens
tacaaagtaatgtataatatcg

SEQ ID NO: 8472925 - DNA, 22 bp, Homo sapiens
tacaaagtagaaattcagtaaa

SEQ ID NO: 8472926 - DNA, 22 bp, Homo sapiens
tacaaagtagaaattcagtaaa

SEQ ID NO: 8472927 - DNA, 22 bp, Homo sapiens
tacaaagtcacattgaaatgaa

SEQ ID NO: 8472928 - DNA, 22 bp, Homo sapiens
tacaaagcctggtagatatctg

SEQ ID NO: 8472929 - DNA, 22 bp, Homo sapiens
tacaaagcttgtactgtgtgac

SEQ ID NO: 8472930 - DNA, 22 bp, Homo sapiens
tacaaagatagtgttagagtaa

SEQ ID NO: 8472931 - DNA, 22 bp, Homo sapiens
tacaaagataaaatctcaccat

SEQ ID NO: 8472932 - DNA, 22 bp, Homo sapiens
taattatagccgctattttgct

SEQ ID NO: 8472933 - DNA, 22 bp, Homo sapiens
tacaaaaaattgatactgacga

SEQ ID NO: 8472934 - DNA, 22 bp, Homo sapiens
tacaaactctttatatttcata

SEQ ID NO: 8472935 - DNA, 22 bp, Homo sapiens
tacaaactctttatatttcata

SEQ ID NO: 8472936 - DNA, 22 bp, Homo sapiens
tacaaactctttatatttcata

SEQ ID NO: 8472937 - DNA, 22 bp, Homo sapiens
tacaaactgtccagcccagagg

SEQ ID NO: 8472938 - DNA, 22 bp, Homo sapiens
tacaaactgtccagcccagagg

SEQ ID NO: 8472939 - DNA, 22 bp, Homo sapiens
tacaaaaaattgatactgacga

SEQ ID NO: 8472940 - DNA, 22 bp, Homo sapiens
tacaaaaaattgatactgacga

SEQ ID NO: 8472941 - DNA, 22 bp, Homo sapiens
tacaaactccgaagtttgtacc

SEQ ID NO: 8472942 - DNA, 18 bp, Homo sapiens
tacaaactccttgaaggc

SEQ ID NO: 8472943 - DNA, 22 bp, Homo sapiens
tacaaacttgttttaagtaagt

SEQ ID NO: 8472944 - DNA, 22 bp, Homo sapiens
tacaaactgttattattattgt

SEQ ID NO: 8472945 - DNA, 22 bp, Homo sapiens
tacaaagaggtaattgcatata

SEQ ID NO: 8472946 - DNA, 22 bp, Homo sapiens
tatacacatttttacctatagt

SEQ ID NO: 8472947 - DNA, 22 bp, Homo sapiens
tatacacatttttacctatagt

SEQ ID NO: 8472948 - DNA, 22 bp, Homo sapiens
tatacacatttttacctatagt

SEQ ID NO: 8472949 - DNA, 22 bp, Homo sapiens
tatacactgttgttgggagtct

SEQ ID NO: 8472950 - DNA, 22 bp, Homo sapiens
tatacactgatataaggagtaa

SEQ ID NO: 8472951 - DNA, 23 bp, Homo sapiens
tatacacatgtggcagtatagtg

SEQ ID NO: 8472952 - DNA, 23 bp, Homo sapiens
tatacacatgtggcagtatagtg

SEQ ID NO: 8472953 - DNA, 22 bp, Homo sapiens
tatacacatgtgtgtattcata

SEQ ID NO: 8472954 - DNA, 22 bp, Homo sapiens
tatacacatgtgtgtattcata

SEQ ID NO: 8472955 - DNA, 22 bp, Homo sapiens
tatacacattacagtttcagga

SEQ ID NO: 8472956 - DNA, 22 bp, Homo sapiens
tatacacatttttacctatagt

SEQ ID NO: 8472957 - DNA, 22 bp, Homo sapiens
tatacacatatacgtttgtgtg

SEQ ID NO: 8472958 - DNA, 22 bp, Homo sapiens
tatacacatatcttctaggcct

SEQ ID NO: 8472959 - DNA, 17 bp, Homo sapiens
tatacacagacagactg

SEQ ID NO: 8472960 - DNA, 22 bp, Homo sapiens
tatacacaggaatctgtgaaaa

SEQ ID NO: 8472961 - DNA, 22 bp, Homo sapiens
tatacacatcctccaaagatag

SEQ ID NO: 8472962 - DNA, 22 bp, Homo sapiens
tatacacatatcttctaggcct

SEQ ID NO: 8472963 - DNA, 23 bp, Homo sapiens
tatacacatgtggcagtatagtg

SEQ ID NO: 8472964 - DNA, 22 bp, Homo sapiens
tatacacatcctccaaagatag

SEQ ID NO: 8472965 - DNA, 22 bp, Homo sapiens
tatacaatgagtacattctggg

SEQ ID NO: 8472966 - DNA, 22 bp, Homo sapiens
tataattttaagtggtaaatta

SEQ ID NO: 8472967 - DNA, 22 bp, Homo sapiens
tataattttaagtggtaaatta

SEQ ID NO: 8472968 - DNA, 22 bp, Homo sapiens
tataatttggggaaagtggtgt

SEQ ID NO: 8472969 - DNA, 22 bp, Homo sapiens
tatacacacctccaaagcagga

SEQ ID NO: 8472970 - DNA, 22 bp, Homo sapiens
tatacacacctccaaagcagga

SEQ ID NO: 8472971 - DNA, 22 bp, Homo sapiens
tatacacacctccaaagcagga

SEQ ID NO: 8472972 - DNA, 22 bp, Homo sapiens
tatacacacatgctccggcctt

SEQ ID NO: 8472973 - DNA, 22 bp, Homo sapiens
tatacacaaggtgtgcatttgt

SEQ ID NO: 8472974 - DNA, 22 bp, Homo sapiens
tatacacaaggtgtgcatttgt

SEQ ID NO: 8472975 - DNA, 22 bp, Homo sapiens
tatacacaaggtgtgcatttgt

SEQ ID NO: 8472976 - DNA, 22 bp, Homo sapiens
tatacacaaacaaggggttaag

SEQ ID NO: 8472977 - DNA, 22 bp, Homo sapiens
tatacaatgagtacattctggg

SEQ ID NO: 8472978 - DNA, 22 bp, Homo sapiens
tatacaatggctgaatcatcca

SEQ ID NO: 8472979 - DNA, 22 bp, Homo sapiens
tataatttatcatgtcacagtt

SEQ ID NO: 8472980 - DNA, 22 bp, Homo sapiens
tataattagtaaatggcagatt

SEQ ID NO: 8472981 - DNA, 22 bp, Homo sapiens
tataactgagaagatacatagt

SEQ ID NO: 8472982 - DNA, 20 bp, Homo sapiens
tataaattcagagctttggt

SEQ ID NO: 8472983 - DNA, 21 bp, Homo sapiens
tataacacacttcagcttctc

SEQ ID NO: 8472984 - DNA, 22 bp, Homo sapiens
tataaattattaggctgctaaa

SEQ ID NO: 8472985 - DNA, 20 bp, Homo sapiens
tataaattcagagctttggt

SEQ ID NO: 8472986 - DNA, 22 bp, Homo sapiens
tataaatctttgttcctagaat

SEQ ID NO: 8472987 - DNA, 22 bp, Homo sapiens
tataaattattaggctgctaaa

SEQ ID NO: 8472988 - DNA, 22 bp, Homo sapiens
tataaattaatgtgcccatgag

SEQ ID NO: 8472989 - DNA, 22 bp, Homo sapiens
taggtgagtttggggaagatag

SEQ ID NO: 8472990 - DNA, 22 bp, Homo sapiens
taggtgcaggtcacaagggatg

SEQ ID NO: 8472991 - DNA, 22 bp, Homo sapiens
taggggtgtttcgagagaggtt

SEQ ID NO: 8472992 - DNA, 22 bp, Homo sapiens
taggtctgatttccattcagtc

SEQ ID NO: 8472993 - DNA, 22 bp, Homo sapiens
tatctagataccaagaagcaca

SEQ ID NO: 8472994 - DNA, 16 bp, Homo sapiens
tatctagagttgaggt

SEQ ID NO: 8472995 - DNA, 22 bp, Homo sapiens
tatctagataccaagaagcaca

SEQ ID NO: 8472996 - DNA, 22 bp, Homo sapiens
tatctagatagtttagccatct

SEQ ID NO: 8472997 - DNA, 19 bp, Homo sapiens
tatgacaagtactagttct

SEQ ID NO: 8472998 - DNA, 22 bp, Homo sapiens
tatctagatatttggataaatg

SEQ ID NO: 8472999 - DNA, 22 bp, Homo sapiens
tatctagaaatttcttttgttg

SEQ ID NO: 8473000 - DNA, 22 bp, Homo sapiens
tatctagaactccagaatgtag

SEQ ID NO: 8473001 - DNA, 22 bp, Homo sapiens
tatctagagcagtggttctcaa

SEQ ID NO: 8473002 - DNA, 22 bp, Homo sapiens
tatctagagcctggaagtcttg

SEQ ID NO: 8473003 - DNA, 22 bp, Homo sapiens
tatctagagtcctgctgagaac

SEQ ID NO: 8473004 - DNA, 22 bp, Homo sapiens
tatctacattcttgtatcttct

SEQ ID NO: 8473005 - DNA, 21 bp, Homo sapiens
tatctactggtgtctttcaga

SEQ ID NO: 8473006 - DNA, 22 bp, Homo sapiens
tatctagaaacagagttttact

SEQ ID NO: 8473007 - DNA, 22 bp, Homo sapiens
tatctacagttaatatgtcatc

SEQ ID NO: 8473008 - DNA, 22 bp, Homo sapiens
tatcccaggaggccacctgtca

SEQ ID NO: 8473009 - DNA, 22 bp, Homo sapiens
tatctaaaggatttaatttagt

SEQ ID NO: 8473010 - DNA, 22 bp, Homo sapiens
tatctaagagagtcaatattta

SEQ ID NO: 8473011 - DNA, 22 bp, Homo sapiens
tatctaaaggatttaatttagt

SEQ ID NO: 8473012 - DNA, 20 bp, Homo sapiens
tatctaaatgcttacattac

SEQ ID NO: 8473013 - DNA, 20 bp, Homo sapiens
tatctaaatgcttacattac

SEQ ID NO: 8473014 - DNA, 22 bp, Homo sapiens
tatgactttggaaaaattactt

SEQ ID NO: 8473015 - DNA, 22 bp, Homo sapiens
tatgagaacaagaacaatctcc

SEQ ID NO: 8473016 - DNA, 22 bp, Homo sapiens
tatgagaaaggagaatgacttt

SEQ ID NO: 8473017 - DNA, 22 bp, Homo sapiens
tatgagaaaataaatatctgtt

SEQ ID NO: 8473018 - DNA, 22 bp, Homo sapiens
tatagcaattcagaatacatgt

SEQ ID NO: 8473019 - DNA, 22 bp, Homo sapiens
tataggaaatttatctcctggg

SEQ ID NO: 8473020 - DNA, 22 bp, Homo sapiens
tataggaaataggtcttctgtg

SEQ ID NO: 8473021 - DNA, 22 bp, Homo sapiens
tataggtgaataaatgagttta

SEQ ID NO: 8473022 - DNA, 22 bp, Homo sapiens
tatagttagtttcataatcatg

SEQ ID NO: 8473023 - DNA, 22 bp, Homo sapiens
tatatatgggggaagctggatg

SEQ ID NO: 8473024 - DNA, 22 bp, Homo sapiens
tatagtttcatgagctttttaa

SEQ ID NO: 8473025 - DNA, 22 bp, Homo sapiens
tatccaaagtttctcagaaact

SEQ ID NO: 8473026 - DNA, 22 bp, Homo sapiens
tatccaaagtggcatattatag
